United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 115

SEQ ID NO: 4070499 - RNA, 21 nt, Staphylococcus aureus subsp. aureus N315
uuuagcaacaguauuugccuu

SEQ ID NO: 4070500 - RNA, 22 nt, Staphylococcus aureus subsp. aureus N315
uuuagcauacauuaagcuaugc

SEQ ID NO: 4070501 - RNA, 19 nt, Staphylococcus aureus subsp. aureus N315
uuuagcuauguaaaauuau

SEQ ID NO: 4070502 - RNA, 22 nt, Staphylococcus aureus subsp. aureus N315
uuuaggaaugaauaaagcuaac

SEQ ID NO: 4070503 - RNA, 23 nt, Staphylococcus aureus subsp. aureus N315
uuuaggacgugccuuaacuucau

SEQ ID NO: 4070504 - RNA, 18 nt, Staphylococcus aureus subsp. aureus N315
uuuagucgguguuuucuu

SEQ ID NO: 4070505 - RNA, 17 nt, Staphylococcus aureus subsp. aureus N315
uuuagugaaaaaguuuc

SEQ ID NO: 4070506 - RNA, 15 nt, Staphylococcus aureus subsp. aureus N315
uuuaguuaaauacaa

SEQ ID NO: 4070507 - RNA, 13 nt, Staphylococcus aureus subsp. aureus N315
uuuaguuaaauag

SEQ ID NO: 4070508 - RNA, 15 nt, Staphylococcus aureus subsp. aureus N315
uuuaguuaaauagua

SEQ ID NO: 4070509 - RNA, 16 nt, Staphylococcus aureus subsp. aureus N315
uuuaguuaaauaguaa

SEQ ID NO: 4070510 - RNA, 18 nt, Staphylococcus aureus subsp. aureus N315
uuuaguuauacuacuauu

SEQ ID NO: 4070511 - RNA, 21 nt, Staphylococcus aureus subsp. aureus N315
uuuaguucaccauuucguguu

SEQ ID NO: 4070512 - RNA, 13 nt, Staphylococcus aureus subsp. aureus N315
uuuauaaaaagag

SEQ ID NO: 4070513 - RNA, 18 nt, Staphylococcus aureus subsp. aureus N315
uuuauaaacaauaaaaaa

SEQ ID NO: 4070514 - RNA, 19 nt, Staphylococcus aureus subsp. aureus N315
uuuauaaacaauuacaaaa

SEQ ID NO: 4070515 - RNA, 15 nt, Staphylococcus aureus subsp. aureus N315
uuuauaaauuaaaug

SEQ ID NO: 4070516 - RNA, 21 nt, Staphylococcus aureus subsp. aureus N315
uuuauaaauuaaaugcaauac

SEQ ID NO: 4070517 - RNA, 14 nt, Staphylococcus aureus subsp. aureus N315
uuuauaaauuauag

SEQ ID NO: 4070518 - RNA, 22 nt, Staphylococcus aureus subsp. aureus N315
uuuauaacauacguuauuuuuu

SEQ ID NO: 4070519 - RNA, 18 nt, Staphylococcus aureus subsp. aureus N315
uuuauaacauuuaagaaa

SEQ ID NO: 4070520 - RNA, 22 nt, Staphylococcus aureus subsp. aureus N315
uuuauaagaacaugauacugaa

SEQ ID NO: 4070521 - RNA, 15 nt, Staphylococcus aureus subsp. aureus N315
uuuauaauaaauguc

SEQ ID NO: 4070522 - RNA, 15 nt, Staphylococcus aureus subsp. aureus N315
uuuauaauaaauuuc

SEQ ID NO: 4070523 - RNA, 13 nt, Staphylococcus aureus subsp. aureus N315
uuuauaauucuaa

SEQ ID NO: 4070524 - RNA, 16 nt, Staphylococcus aureus subsp. aureus N315
uuuauaauucuaaguc

SEQ ID NO: 4070525 - RNA, 13 nt, Staphylococcus aureus subsp. aureus N315
uuuauacaauacu

SEQ ID NO: 4070526 - RNA, 10 nt, Staphylococcus aureus subsp. aureus N315
uuuauacauu

SEQ ID NO: 4070527 - RNA, 17 nt, Staphylococcus aureus subsp. aureus N315
uuuauacuauaaauaca

SEQ ID NO: 4070528 - RNA, 15 nt, Staphylococcus aureus subsp. aureus N315
uuuauaguaauagcu

SEQ ID NO: 4070529 - RNA, 19 nt, Staphylococcus aureus subsp. aureus N315
uuuauauauaaagaaauaa

SEQ ID NO: 4070530 - RNA, 14 nt, Staphylococcus aureus subsp. aureus N315
uuuauaucaaaaaa

SEQ ID NO: 4070531 - RNA, 20 nt, Staphylococcus aureus subsp. aureus N315
uuuauaugauuaauuagccu

SEQ ID NO: 4070532 - RNA, 21 nt, Staphylococcus aureus subsp. aureus N315
uuuauauuaaauacuauauau

SEQ ID NO: 4070533 - RNA, 13 nt, Staphylococcus aureus subsp. aureus N315
uuuauauucuaau

SEQ ID NO: 4070534 - RNA, 13 nt, Staphylococcus aureus subsp. aureus N315
uuuauauuuauuu

SEQ ID NO: 4070535 - RNA, 23 nt, Staphylococcus aureus subsp. aureus N315
uuuauauuuuaguucacaugaau

SEQ ID NO: 4070536 - RNA, 13 nt, Staphylococcus aureus subsp. aureus N315
uuuauauuuuuau

SEQ ID NO: 4070537 - RNA, 17 nt, Staphylococcus aureus subsp. aureus N315
uuuauauuuuuaucauc

SEQ ID NO: 4070538 - RNA, 16 nt, Staphylococcus aureus subsp. aureus N315
uuuaucaacaaauuua

SEQ ID NO: 4070539 - RNA, 15 nt, Staphylococcus aureus subsp. aureus N315
uuuaucaacauaaaa

SEQ ID NO: 4070540 - RNA, 19 nt, Staphylococcus aureus subsp. aureus N315
uuuaucaacauaaaauuua

SEQ ID NO: 4070541 - RNA, 12 nt, Staphylococcus aureus subsp. aureus N315
uuuaucaauaaa

SEQ ID NO: 4070542 - RNA, 21 nt, Staphylococcus aureus subsp. aureus N315
uuuccauaaauauuuaaaaua

SEQ ID NO: 4070543 - RNA, 14 nt, Staphylococcus aureus subsp. aureus N315
uuucccauuuaucu

SEQ ID NO: 4070544 - RNA, 17 nt, Staphylococcus aureus subsp. aureus N315
uuucccuacugcuugug

SEQ ID NO: 4070545 - RNA, 19 nt, Staphylococcus aureus subsp. aureus N315
uuuccuaauucuugagcaa

SEQ ID NO: 4070546 - RNA, 18 nt, Staphylococcus aureus subsp. aureus N315
uuuccuacacuguuuuau

SEQ ID NO: 4070547 - RNA, 11 nt, Staphylococcus aureus subsp. aureus N315
uuuccucuuua

SEQ ID NO: 4070548 - RNA, 22 nt, Staphylococcus aureus subsp. aureus N315
uuuccucuuuaaagcuaaaugu

SEQ ID NO: 4070549 - RNA, 22 nt, Staphylococcus aureus subsp. aureus N315
uuucgaaaagaaauucuacagg

SEQ ID NO: 4070550 - RNA, 18 nt, Staphylococcus aureus subsp. aureus N315
uuucgaacgcuugaaaaa

SEQ ID NO: 4070551 - RNA, 21 nt, Staphylococcus aureus subsp. aureus N315
uuucgaacuuuuguucuaagu

SEQ ID NO: 4070552 - RNA, 21 nt, Staphylococcus aureus subsp. aureus N315
uuucgacaucuagaugaaauu

SEQ ID NO: 4070553 - RNA, 18 nt, Staphylococcus aureus subsp. aureus N315
uuucgauaccuaaaauac

SEQ ID NO: 4070554 - RNA, 19 nt, Staphylococcus aureus subsp. aureus N315
uuucgcuuuuuuuauuuuu

SEQ ID NO: 4070555 - RNA, 19 nt, Staphylococcus aureus subsp. aureus N315
uuucggcuagauuuuaaac

SEQ ID NO: 4070556 - RNA, 20 nt, Staphylococcus aureus subsp. aureus N315
uuucguaauguguuaauacu

SEQ ID NO: 4070557 - RNA, 14 nt, Staphylococcus aureus subsp. aureus N315
uuucguauuuuucu

SEQ ID NO: 4070558 - RNA, 14 nt, Staphylococcus aureus subsp. aureus N315
uuucgucagauuca

SEQ ID NO: 4070559 - RNA, 17 nt, Staphylococcus aureus subsp. aureus N315
uuucguguuccaauuuu

SEQ ID NO: 4070560 - RNA, 23 nt, Staphylococcus aureus subsp. aureus N315
uuucguuagacucacuucuuaaa

SEQ ID NO: 4070561 - RNA, 15 nt, Staphylococcus aureus subsp. aureus N315
uuucuaaaauaacua

SEQ ID NO: 4070562 - RNA, 23 nt, Staphylococcus aureus subsp. aureus N315
uuucuaaaugauuuauucuaaau

SEQ ID NO: 4070563 - RNA, 19 nt, Staphylococcus aureus subsp. aureus N315
uuucuaaauucuuuuuguu

SEQ ID NO: 4070564 - RNA, 15 nt, Staphylococcus aureus subsp. aureus N315
uuucuaaugcucauu

SEQ ID NO: 4070565 - RNA, 21 nt, Staphylococcus aureus subsp. aureus N315
uuucuacaccuacaacuguug

SEQ ID NO: 4070566 - RNA, 21 nt, Staphylococcus aureus subsp. aureus N315
uuucuacucugauuacauaua

SEQ ID NO: 4070567 - RNA, 19 nt, Staphylococcus aureus subsp. aureus N315
uuucuacuguauaagugcu

SEQ ID NO: 4070568 - RNA, 14 nt, Staphylococcus aureus subsp. aureus N315
uuucuagcaacuga

SEQ ID NO: 4070569 - RNA, 21 nt, Staphylococcus aureus subsp. aureus N315
uuucuagcuauauccaguaaa

SEQ ID NO: 4070570 - RNA, 14 nt, Staphylococcus aureus subsp. aureus N315
uuucuaucaaauaa

SEQ ID NO: 4070571 - RNA, 14 nt, Staphylococcus aureus subsp. aureus N315
uuucuauuaauaua

SEQ ID NO: 4070572 - RNA, 18 nt, Staphylococcus aureus subsp. aureus N315
uuucuauuaauauagaag

SEQ ID NO: 4070573 - RNA, 14 nt, Staphylococcus aureus subsp. aureus N315
uuucuauucaaaaa

SEQ ID NO: 4070574 - RNA, 19 nt, Staphylococcus aureus subsp. aureus N315
uuucucaaacguucaucua

SEQ ID NO: 4070575 - RNA, 23 nt, Staphylococcus aureus subsp. aureus N315
uuucucaaacguucaucuaauuu

SEQ ID NO: 4070576 - RNA, 20 nt, Staphylococcus aureus subsp. aureus N315
uuucucaaguaacucaagug

SEQ ID NO: 4070577 - RNA, 19 nt, Staphylococcus aureus subsp. aureus N315
uuucucgauuaauuuucuu

SEQ ID NO: 4070578 - RNA, 15 nt, Staphylococcus aureus subsp. aureus N315
uuucugaaaugauac

SEQ ID NO: 4070579 - RNA, 18 nt, Staphylococcus aureus subsp. aureus N315
uuucugacuuuuaaaaaa

SEQ ID NO: 4070580 - RNA, 16 nt, Staphylococcus aureus subsp. aureus N315
uuucugagaagaaaua

SEQ ID NO: 4070581 - RNA, 21 nt, Staphylococcus aureus subsp. aureus N315
uuucugagaagaaauauauug

SEQ ID NO: 4070582 - RNA, 18 nt, Staphylococcus aureus subsp. aureus N315
uuucuggccacuaaugca

SEQ ID NO: 4070583 - RNA, 14 nt, Staphylococcus aureus subsp. aureus N315
uuucugugaccaau

SEQ ID NO: 4070584 - RNA, 19 nt, Staphylococcus aureus subsp. aureus N315
uuucugugaccaauagaau

SEQ ID NO: 4070585 - RNA, 19 nt, Staphylococcus aureus subsp. aureus N315
uuucuguuuaauuaaaaua

SEQ ID NO: 4070586 - RNA, 15 nt, Staphylococcus aureus subsp. aureus N315
uuucuguuucaucac

SEQ ID NO: 4070587 - RNA, 18 nt, Staphylococcus aureus subsp. aureus N315
uuucuuaguuugacaucu

SEQ ID NO: 4070588 - RNA, 13 nt, Staphylococcus aureus subsp. aureus N315
uuucuuauguaua

SEQ ID NO: 4070589 - RNA, 13 nt, Staphylococcus aureus subsp. aureus N315
uuucuuauuuauu

SEQ ID NO: 4070590 - RNA, 16 nt, Staphylococcus aureus subsp. aureus N315
uuucuuauuuguaauu

SEQ ID NO: 4070591 - RNA, 20 nt, Staphylococcus aureus subsp. aureus N315
uuucuucagaaccuugaaug

SEQ ID NO: 4070592 - RNA, 22 nt, Staphylococcus aureus subsp. aureus N315
uuucuucagaaccuugaaugau

SEQ ID NO: 4070593 - RNA, 12 nt, Staphylococcus aureus subsp. aureus N315
uuucuucauuuu

SEQ ID NO: 4070594 - RNA, 11 nt, Staphylococcus aureus subsp. aureus N315
uuucuucuucu

SEQ ID NO: 4070595 - RNA, 15 nt, Staphylococcus aureus subsp. aureus N315
uuucuugaucuaaug

SEQ ID NO: 4070596 - RNA, 23 nt, Staphylococcus aureus subsp. aureus N315
uuucuugccaucaauuucuguaa

SEQ ID NO: 4070597 - RNA, 14 nt, Staphylococcus aureus subsp. aureus N315
uuucuuguucuaaa

SEQ ID NO: 4070598 - RNA, 15 nt, Staphylococcus aureus subsp. aureus N315
uuucuuuauuuuaaa

SEQ ID NO: 4070599 - RNA, 14 nt, Staphylococcus aureus subsp. aureus N315
uuucuuucauaauu

SEQ ID NO: 4070600 - RNA, 22 nt, Staphylococcus aureus subsp. aureus N315
uuucuuugauaacaauuuuaaa

SEQ ID NO: 4070601 - RNA, 17 nt, Staphylococcus aureus subsp. aureus N315
uuucuuuguguuugcuu

SEQ ID NO: 4070602 - RNA, 20 nt, Staphylococcus aureus subsp. aureus N315
uuucuuuugaacguuguaug

SEQ ID NO: 4070603 - RNA, 18 nt, Staphylococcus aureus subsp. aureus N315
uuucuuuuuuaauucuau

SEQ ID NO: 4070604 - RNA, 22 nt, Staphylococcus aureus subsp. aureus N315
uuucuuuuuuuauggauuucuu

SEQ ID NO: 4070605 - RNA, 18 nt, Staphylococcus aureus subsp. aureus N315
uuugaaaauuucaccgcu

SEQ ID NO: 4070606 - RNA, 13 nt, Staphylococcus aureus subsp. aureus N315
uuugaaauauacc

SEQ ID NO: 4070607 - RNA, 23 nt, Staphylococcus aureus subsp. aureus N315
uuugaacaacaucuuuuguuguu

SEQ ID NO: 4070608 - RNA, 16 nt, Staphylococcus aureus subsp. aureus N315
uuugaaccuaaauucc

SEQ ID NO: 4070609 - RNA, 17 nt, Staphylococcus aureus subsp. aureus N315
uuugaagaauaaaaaag

SEQ ID NO: 4070610 - RNA, 20 nt, Staphylococcus aureus subsp. aureus N315
uuugaaggagauauuuucuu

SEQ ID NO: 4070611 - RNA, 21 nt, Staphylococcus aureus subsp. aureus N315
uuugaaguuacuauauuuauu

SEQ ID NO: 4070612 - RNA, 12 nt, Staphylococcus aureus subsp. aureus N315
uuugaauauacu

SEQ ID NO: 4070613 - RNA, 16 nt, Staphylococcus aureus subsp. aureus N315
uuugaauauacuuaau

SEQ ID NO: 4070614 - RNA, 16 nt, Staphylococcus aureus subsp. aureus N315
uuugaauauuugcuuu

SEQ ID NO: 4070615 - RNA, 18 nt, Staphylococcus aureus subsp. aureus N315
uuugaaucauuugaugcu

SEQ ID NO: 4070616 - RNA, 16 nt, Staphylococcus aureus subsp. aureus N315
uuugaaucuuguugaa

SEQ ID NO: 4070617 - RNA, 12 nt, Staphylococcus aureus subsp. aureus N315
uuugaaugcaaa

SEQ ID NO: 4070618 - RNA, 22 nt, Staphylococcus aureus subsp. aureus N315
uuugaaugcaaaucaaauacau

SEQ ID NO: 4070619 - RNA, 12 nt, Staphylococcus aureus subsp. aureus N315
uuugaauuuuau

SEQ ID NO: 4070620 - RNA, 16 nt, Staphylococcus aureus subsp. aureus N315
uuugacaguuuuaaau

SEQ ID NO: 4070621 - RNA, 20 nt, Staphylococcus aureus subsp. aureus N315
uuugacaguuuuaaaugaaa

SEQ ID NO: 4070622 - RNA, 16 nt, Staphylococcus aureus subsp. aureus N315
uuugacuauucucagu

SEQ ID NO: 4070623 - RNA, 14 nt, Staphylococcus aureus subsp. aureus N315
uuugagagauuauu

SEQ ID NO: 4070624 - RNA, 17 nt, Staphylococcus aureus subsp. aureus N315
uuugagcauuuuuauau

SEQ ID NO: 4070625 - RNA, 14 nt, Staphylococcus aureus subsp. aureus N315
uuugaguaaauuaa

SEQ ID NO: 4070626 - RNA, 17 nt, Staphylococcus aureus subsp. aureus N315
uuugaguauccaauacu

SEQ ID NO: 4070627 - RNA, 18 nt, Staphylococcus aureus subsp. aureus N315
uuugaguauccaauacua

SEQ ID NO: 4070628 - RNA, 20 nt, Staphylococcus aureus subsp. aureus N315
uuugaguuauauuuuuagga

SEQ ID NO: 4070629 - RNA, 22 nt, Staphylococcus aureus subsp. aureus N315
uuuuaaauuacuauauuuaaau

SEQ ID NO: 4070630 - RNA, 13 nt, Staphylococcus aureus subsp. aureus N315
uuuuaaauuuaag

SEQ ID NO: 4070631 - RNA, 12 nt, Staphylococcus aureus subsp. aureus N315
uuuuaaauuuag

SEQ ID NO: 4070632 - RNA, 21 nt, Staphylococcus aureus subsp. aureus N315
uuuuaaauuuaguaucucauu

SEQ ID NO: 4070633 - RNA, 15 nt, Staphylococcus aureus subsp. aureus N315
uuuuaacaaaauaua

SEQ ID NO: 4070634 - RNA, 17 nt, Staphylococcus aureus subsp. aureus N315
uuuuaacaaaauauacu

SEQ ID NO: 4070635 - RNA, 20 nt, Staphylococcus aureus subsp. aureus N315
uuuuaacagcgugaauauaa

SEQ ID NO: 4070636 - RNA, 15 nt, Staphylococcus aureus subsp. aureus N315
uuuuaacagcugcag

SEQ ID NO: 4070637 - RNA, 20 nt, Staphylococcus aureus subsp. aureus N315
uuuuaacugguugauaaaua

SEQ ID NO: 4070638 - RNA, 21 nt, Staphylococcus aureus subsp. aureus N315
uuuuaacuuccuaaaauuuac

SEQ ID NO: 4070639 - RNA, 23 nt, Staphylococcus aureus subsp. aureus N315
uuuuaacuuuaacaucugaaucu

SEQ ID NO: 4070640 - RNA, 24 nt, Staphylococcus aureus subsp. aureus N315
uuuuaaggcagcuaaaaaguauac

SEQ ID NO: 4070641 - RNA, 12 nt, Staphylococcus aureus subsp. aureus N315
uuuuaagugaug

SEQ ID NO: 4070642 - RNA, 23 nt, Staphylococcus aureus subsp. aureus N315
uuuuaagugaugaccaauauucu

SEQ ID NO: 4070643 - RNA, 17 nt, Staphylococcus aureus subsp. aureus N315
uuuuaauauauuuauuu

SEQ ID NO: 4070644 - RNA, 21 nt, Staphylococcus aureus subsp. aureus N315
uuuuaauauauuuauuuuuga

SEQ ID NO: 4070645 - RNA, 20 nt, Staphylococcus aureus subsp. aureus N315
uuuuaauauugaaaugagcu

SEQ ID NO: 4070646 - RNA, 20 nt, Staphylococcus aureus subsp. aureus N315
uuuuaaucuauccuucaaaa

SEQ ID NO: 4070647 - RNA, 22 nt, Staphylococcus aureus subsp. aureus N315
uuuuaaugggcgauaaaaguug

SEQ ID NO: 4070648 - RNA, 16 nt, Staphylococcus aureus subsp. aureus N315
uuuuaauuaauuauca

SEQ ID NO: 4070649 - RNA, 18 nt, Staphylococcus aureus subsp. aureus N315
uuuuaauuauuuuaaaaa

SEQ ID NO: 4070650 - RNA, 13 nt, Staphylococcus aureus subsp. aureus N315
uuuuaauucuauu

SEQ ID NO: 4070651 - RNA, 20 nt, Staphylococcus aureus subsp. aureus N315
uuuuaauuguacuuaaaccu

SEQ ID NO: 4070652 - RNA, 19 nt, Staphylococcus aureus subsp. aureus N315
uuuuaauuguuuaauaaca

SEQ ID NO: 4070653 - RNA, 18 nt, Staphylococcus aureus subsp. aureus N315
uuuuaauuuguauuuaaa

SEQ ID NO: 4070654 - RNA, 13 nt, Staphylococcus aureus subsp. aureus N315
uuuuaauuuucag

SEQ ID NO: 4070655 - RNA, 23 nt, Staphylococcus aureus subsp. aureus N315
uuuuacaaaauauggaauuucau

SEQ ID NO: 4070656 - RNA, 15 nt, Staphylococcus aureus subsp. aureus N315
uuuuacaaagugauu

SEQ ID NO: 4070657 - RNA, 20 nt, Staphylococcus aureus subsp. aureus N315
uuuuacaaucaucacacaua

SEQ ID NO: 4070658 - RNA, 21 nt, Staphylococcus aureus subsp. aureus N315
uuuuaccuaguaacucaacau

SEQ ID NO: 4070659 - RNA, 18 nt, Staphylococcus aureus subsp. aureus N315
uuuuaccucugauaaaug

SEQ ID NO: 4070660 - RNA, 23 nt, Staphylococcus aureus subsp. aureus N315
uuuuaccuucgcauacuuuuuca

SEQ ID NO: 4070661 - RNA, 14 nt, Staphylococcus aureus subsp. aureus N315
uuuuaccuuuaauu

SEQ ID NO: 4070662 - RNA, 16 nt, Staphylococcus aureus subsp. aureus N315
uuuuacuaaaucauuu

SEQ ID NO: 4070663 - RNA, 19 nt, Staphylococcus aureus subsp. aureus N315
uuuuacuaggaauauaaaa

SEQ ID NO: 4070664 - RNA, 20 nt, Staphylococcus aureus subsp. aureus N315
uuuuacuuucaccauuuacu

SEQ ID NO: 4070665 - RNA, 15 nt, Staphylococcus aureus subsp. aureus N315
uuuuacuuuuauaau

SEQ ID NO: 4070666 - RNA, 13 nt, Staphylococcus aureus subsp. aureus N315
uuuuagaaaagga

SEQ ID NO: 4070667 - RNA, 17 nt, Staphylococcus aureus subsp. aureus N315
uuuuagauuaucuuuca

SEQ ID NO: 4070668 - RNA, 15 nt, Staphylococcus aureus subsp. aureus N315
uuuuagauuugaaau

SEQ ID NO: 4070669 - RNA, 19 nt, Staphylococcus aureus subsp. aureus N315
uuuuagccccagcaaauac

SEQ ID NO: 4070670 - RNA, 21 nt, Staphylococcus aureus subsp. aureus N315
uuuuagccccagcaaauacuu

SEQ ID NO: 4070671 - RNA, 22 nt, Staphylococcus aureus subsp. aureus N315
uuuuagcuaaacgacauuguuu

SEQ ID NO: 4070672 - RNA, 15 nt, Staphylococcus aureus subsp. aureus N315
uuuuagcuauagaaa

SEQ ID NO: 4070673 - RNA, 14 nt, Staphylococcus aureus subsp. aureus N315
uuuuagcuuuugua

SEQ ID NO: 4070674 - RNA, 16 nt, Staphylococcus aureus subsp. aureus N315
uuuuagugacaaacau

SEQ ID NO: 4070675 - RNA, 23 nt, Staphylococcus aureus subsp. aureus N315
uuuuaguuagaaaguauuuauuu

SEQ ID NO: 4070676 - RNA, 16 nt, Staphylococcus aureus subsp. aureus N315
uuuuauaaaauauauu

SEQ ID NO: 4070677 - RNA, 12 nt, Staphylococcus aureus subsp. aureus N315
uuuuauaaauua

SEQ ID NO: 4070678 - RNA, 13 nt, Staphylococcus aureus subsp. aureus N315
uuuuauaaauuuu

SEQ ID NO: 4070679 - RNA, 14 nt, Staphylococcus aureus subsp. aureus N315
uuuuauaaauuuug

SEQ ID NO: 4070680 - RNA, 18 nt, Staphylococcus aureus subsp. aureus N315
uuuuauaauaaaugucac

SEQ ID NO: 4070681 - RNA, 16 nt, Staphylococcus aureus subsp. aureus N315
uuuuauaccaauaauu

SEQ ID NO: 4070682 - RNA, 16 nt, Staphylococcus aureus subsp. aureus N315
uuuuauaguaauagcu

SEQ ID NO: 4070683 - RNA, 19 nt, Staphylococcus aureus subsp. aureus N315
uuuuauagugguaaaaagu

SEQ ID NO: 4070684 - RNA, 22 nt, Staphylococcus aureus subsp. aureus N315
uuuuauauaauucgugauuaca

SEQ ID NO: 4070685 - RNA, 18 nt, Staphylococcus aureus subsp. aureus N315
uuuuauaugcaacuuaua

SEQ ID NO: 4070686 - RNA, 21 nt, Staphylococcus aureus subsp. aureus N315
uuuuauauucaacuuauuauu

SEQ ID NO: 4070687 - RNA, 14 nt, Staphylococcus aureus subsp. aureus N315
uuuuauauuuauuu

SEQ ID NO: 4070688 - RNA, 13 nt, Staphylococcus aureus subsp. aureus N315
uuuuauauuuuua

SEQ ID NO: 4070689 - RNA, 18 nt, Staphylococcus aureus subsp. aureus N315
uuuuaucaauauuaguuu

SEQ ID NO: 4070690 - RNA, 19 nt, Staphylococcus aureus subsp. aureus N315
uuuuaucaucuauucaacu

SEQ ID NO: 4070691 - RNA, 21 nt, Staphylococcus aureus subsp. aureus N315
uuuuaucuaucgguaauuuuu

SEQ ID NO: 4070692 - RNA, 18 nt, Staphylococcus aureus subsp. aureus N315
uuuuaucugaaaauauca

SEQ ID NO: 4070693 - RNA, 13 nt, Staphylococcus aureus subsp. aureus N315
uuuuaucugaauc

SEQ ID NO: 4070694 - RNA, 21 nt, Staphylococcus aureus subsp. aureus N315
uuuuaugaauugaguauuaaa

SEQ ID NO: 4070695 - RNA, 22 nt, Staphylococcus aureus subsp. aureus N315
uuuuaugaauugaguauuaaau

SEQ ID NO: 4070696 - RNA, 18 nt, Staphylococcus aureus subsp. aureus N315
uuuuaugacguaauuaau

SEQ ID NO: 4070697 - RNA, 20 nt, Staphylococcus aureus subsp. aureus N315
uuuuaugagcuucuuuaaau

SEQ ID NO: 4070698 - RNA, 15 nt, Staphylococcus aureus subsp. aureus N315
uuuuaugauuuucuu

SEQ ID NO: 4070699 - RNA, 19 nt, Staphylococcus aureus subsp. aureus N315
uuuuaugauuuucuuuaau

SEQ ID NO: 4070700 - RNA, 24 nt, Staphylococcus aureus subsp. aureus N315
uuuuaugcauuauagaugacugua

SEQ ID NO: 4070701 - RNA, 15 nt, Staphylococcus aureus subsp. aureus N315
uuuuaugcuuuaaau

SEQ ID NO: 4070702 - RNA, 18 nt, Staphylococcus aureus subsp. aureus N315
uuuuauggcgguuugaaa

SEQ ID NO: 4070703 - RNA, 20 nt, Staphylococcus aureus subsp. aureus N315
uuuuaugucuaguucuugag

SEQ ID NO: 4070704 - RNA, 19 nt, Staphylococcus aureus subsp. aureus N315
uuuuauguuuaauuugauu

SEQ ID NO: 4070705 - RNA, 14 nt, Staphylococcus aureus subsp. aureus N315
uuuuauguuuuaau

SEQ ID NO: 4070706 - RNA, 15 nt, Staphylococcus aureus subsp. aureus N315
uuuuauguuuuaauu

SEQ ID NO: 4070707 - RNA, 19 nt, Staphylococcus aureus subsp. aureus N315
uuuuauuacuuauuucuuu

SEQ ID NO: 4070708 - RNA, 17 nt, Staphylococcus aureus subsp. aureus N315
uuuuauuagaauauuca

SEQ ID NO: 4070709 - RNA, 19 nt, Staphylococcus aureus subsp. aureus N315
uuuuauuaucuuuguaaau

SEQ ID NO: 4070710 - RNA, 15 nt, Staphylococcus aureus subsp. aureus N315
uuuuauuauguguuu

SEQ ID NO: 4070711 - RNA, 20 nt, Staphylococcus aureus subsp. aureus N315
uuuuauuauugucaucaugu

SEQ ID NO: 4070712 - RNA, 14 nt, Staphylococcus aureus subsp. aureus N315
uuuuauuuaaaaau

SEQ ID NO: 4070713 - RNA, 16 nt, Staphylococcus aureus subsp. aureus N315
uuuuauuuaaaaauag

SEQ ID NO: 4070714 - RNA, 17 nt, Staphylococcus aureus subsp. aureus N315
uuuuauuuauacuaaau

SEQ ID NO: 4070715 - RNA, 11 nt, Staphylococcus aureus subsp. aureus N315
uuuuauuuauc

SEQ ID NO: 4070716 - RNA, 18 nt, Staphylococcus aureus subsp. aureus N315
uuuuuauaaguauucaua

SEQ ID NO: 4070717 - RNA, 23 nt, Staphylococcus aureus subsp. aureus N315
uuuuuauauuauuucaauacccu

SEQ ID NO: 4070718 - RNA, 15 nt, Staphylococcus aureus subsp. aureus N315
uuuuuaucaucuucu

SEQ ID NO: 4070719 - RNA, 13 nt, Staphylococcus aureus subsp. aureus N315
uuuuuaucaugau

SEQ ID NO: 4070720 - RNA, 20 nt, Staphylococcus aureus subsp. aureus N315
uuuuuaucuguagaaacacu

SEQ ID NO: 4070721 - RNA, 20 nt, Staphylococcus aureus subsp. aureus N315
uuuuuaugcuuuaaaucgau

SEQ ID NO: 4070722 - RNA, 15 nt, Staphylococcus aureus subsp. aureus N315
uuuuuauuauacacu

SEQ ID NO: 4070723 - RNA, 13 nt, Staphylococcus aureus subsp. aureus N315
uuuuuauuuacuc

SEQ ID NO: 4070724 - RNA, 15 nt, Staphylococcus aureus subsp. aureus N315
uuuuuauuuuacuua

SEQ ID NO: 4070725 - RNA, 17 nt, Staphylococcus aureus subsp. aureus N315
uuuuucaaauaauauaa

SEQ ID NO: 4070726 - RNA, 19 nt, Staphylococcus aureus subsp. aureus N315
uuuuucaauuaaauguuua

SEQ ID NO: 4070727 - RNA, 19 nt, Staphylococcus aureus subsp. aureus N315
uuuuucauaauuaauaaca

SEQ ID NO: 4070728 - RNA, 15 nt, Staphylococcus aureus subsp. aureus N315
uuuuucauauucaca

SEQ ID NO: 4070729 - RNA, 14 nt, Staphylococcus aureus subsp. aureus N315
uuuuuccauuuuuu

SEQ ID NO: 4070730 - RNA, 13 nt, Staphylococcus aureus subsp. aureus N315
uuuuucgcauuaa

SEQ ID NO: 4070731 - RNA, 15 nt, Staphylococcus aureus subsp. aureus N315
uuuuucguaacauuu

SEQ ID NO: 4070732 - RNA, 14 nt, Staphylococcus aureus subsp. aureus N315
uuuuucuaaauaaa

SEQ ID NO: 4070733 - RNA, 22 nt, Staphylococcus aureus subsp. aureus N315
uuuuucuaaaugauuuauucua

SEQ ID NO: 4070734 - RNA, 22 nt, Staphylococcus aureus subsp. aureus N315
uuuuucucaaugugagauauaa

SEQ ID NO: 4070735 - RNA, 21 nt, Staphylococcus aureus subsp. aureus N315
uuuuucuguaauaauuauuaa

SEQ ID NO: 4070736 - RNA, 12 nt, Staphylococcus aureus subsp. aureus N315
uuuuucuuucau

SEQ ID NO: 4070737 - RNA, 14 nt, Staphylococcus aureus subsp. aureus N315
uuuuucuuuuguuu

SEQ ID NO: 4070738 - RNA, 16 nt, Staphylococcus aureus subsp. aureus N315
uuuuugaauaucuaau

SEQ ID NO: 4070739 - RNA, 17 nt, Staphylococcus aureus subsp. aureus N315
uuuuugacauauuuuuu

SEQ ID NO: 4070740 - RNA, 21 nt, Staphylococcus aureus subsp. aureus N315
uuuuugauaguaauaguuaac

SEQ ID NO: 4070741 - RNA, 19 nt, Staphylococcus aureus subsp. aureus N315
uuuuuggagcguaaaguuu

SEQ ID NO: 4070742 - RNA, 13 nt, Staphylococcus aureus subsp. aureus N315
uuuuugucaguaa

SEQ ID NO: 4070743 - RNA, 14 nt, Staphylococcus aureus subsp. aureus N315
uuuuuguugcaauu

SEQ ID NO: 4070744 - RNA, 13 nt, Staphylococcus aureus subsp. aureus N315
uuuuuuaaaauga

SEQ ID NO: 4070745 - RNA, 13 nt, Staphylococcus aureus subsp. aureus N315
uuuuuuaaaguuu

SEQ ID NO: 4070746 - RNA, 11 nt, Staphylococcus aureus subsp. aureus N315
uuuuuuaauuu

SEQ ID NO: 4070747 - RNA, 16 nt, Staphylococcus aureus subsp. aureus N315
uuuuuuacauucguuu

SEQ ID NO: 4070748 - RNA, 21 nt, Staphylococcus aureus subsp. aureus N315
uuuuuuauauguuauauuaaa

SEQ ID NO: 4070749 - RNA, 21 nt, Staphylococcus aureus subsp. aureus N315
uuuuuuaugcacaaaaaaauc

SEQ ID NO: 4070750 - RNA, 14 nt, Staphylococcus aureus subsp. aureus N315
uuuuuuauuugucu

SEQ ID NO: 4070751 - RNA, 19 nt, Staphylococcus aureus subsp. aureus N315
uuuuuucaauucuagucag

SEQ ID NO: 4070752 - RNA, 13 nt, Staphylococcus aureus subsp. aureus N315
uuuuuuccuuucu

SEQ ID NO: 4070753 - RNA, 11 nt, Staphylococcus aureus subsp. aureus N315
uuuuuuuaaag

SEQ ID NO: 4070754 - RNA, 23 nt, Staphylococcus aureus subsp. aureus N315
uuuuuuuauaaguuaaaaaugua

SEQ ID NO: 4070755 - RNA, 13 nt, Streptococcus pneumoniae R6
aaaaaaagaagca

SEQ ID NO: 4070756 - RNA, 20 nt, Streptococcus pneumoniae R6
aaaaaaagaagcagaaaaau

SEQ ID NO: 4070757 - RNA, 11 nt, Streptococcus pneumoniae R6
aaaaaaagcua

SEQ ID NO: 4070758 - RNA, 20 nt, Streptococcus pneumoniae R6
aaaaaaagggggaacguuuu

SEQ ID NO: 4070759 - RNA, 12 nt, Streptococcus pneumoniae R6
aaaaaaaugaua

SEQ ID NO: 4070760 - RNA, 16 nt, Streptococcus pneumoniae R6
aaaaaacaaaggauuu

SEQ ID NO: 4070761 - RNA, 23 nt, Streptococcus pneumoniae R6
aaaaaaccaauucccaaacaucu

SEQ ID NO: 4070762 - RNA, 23 nt, Streptococcus pneumoniae R6
aaaaaagggggaacguuuuuaaa

SEQ ID NO: 4070763 - RNA, 12 nt, Streptococcus pneumoniae R6
aaaaaauaaaaa

SEQ ID NO: 4070764 - RNA, 17 nt, Streptococcus pneumoniae R6
aaaaaauaaaaaaauuu

SEQ ID NO: 4070765 - RNA, 15 nt, Streptococcus pneumoniae R6
aaaaaauaaucaaaa

SEQ ID NO: 4070766 - RNA, 20 nt, Streptococcus pneumoniae R6
aaaaaauaaucaaaacuaua

SEQ ID NO: 4070767 - RNA, 12 nt, Streptococcus pneumoniae R6
aaaaaaugaaau

SEQ ID NO: 4070768 - RNA, 23 nt, Streptococcus pneumoniae R6
aaaaaaugauaauagauauaauu

SEQ ID NO: 4070769 - RNA, 14 nt, Streptococcus pneumoniae R6
aaaaacaaagagau

SEQ ID NO: 4070770 - RNA, 11 nt, Streptococcus pneumoniae R6
aaaaacaaagg

SEQ ID NO: 4070771 - RNA, 17 nt, Streptococcus pneumoniae R6
aaaaacaaaguauuaaa

SEQ ID NO: 4070772 - RNA, 13 nt, Streptococcus pneumoniae R6
aaaaacacaauuu

SEQ ID NO: 4070773 - RNA, 16 nt, Streptococcus pneumoniae R6
aaaaacacaauuuuag

SEQ ID NO: 4070774 - RNA, 20 nt, Streptococcus pneumoniae R6
aaaaacacauuuugaaaugu

SEQ ID NO: 4070775 - RNA, 22 nt, Streptococcus pneumoniae R6
aaaaacagaggcuggacaaaaa

SEQ ID NO: 4070776 - RNA, 16 nt, Streptococcus pneumoniae R6
aaaaacauaauuuuag

SEQ ID NO: 4070777 - RNA, 17 nt, Streptococcus pneumoniae R6
aaaaacguuuuucaaac

SEQ ID NO: 4070778 - RNA, 18 nt, Streptococcus pneumoniae R6
aaaaacuauggcagagaa

SEQ ID NO: 4070779 - RNA, 19 nt, Streptococcus pneumoniae R6
aaaaacucgacuucaggaa

SEQ ID NO: 4070780 - RNA, 23 nt, Streptococcus pneumoniae R6
aaaaacucuccugggaaauucca

SEQ ID NO: 4070781 - RNA, 20 nt, Streptococcus pneumoniae R6
aaaaacucuuguccuaaaua

SEQ ID NO: 4070782 - RNA, 21 nt, Streptococcus pneumoniae R6
aaaaacugcuuagaaccgaaa

SEQ ID NO: 4070783 - RNA, 22 nt, Streptococcus pneumoniae R6
aaaaacugcuuagaaccgaaaa

SEQ ID NO: 4070784 - RNA, 16 nt, Streptococcus pneumoniae R6
aaaaacuucuggcuua

SEQ ID NO: 4070785 - RNA, 16 nt, Streptococcus pneumoniae R6
aaaaacuugauacuau

SEQ ID NO: 4070786 - RNA, 12 nt, Streptococcus pneumoniae R6
aaaaagaaauau

SEQ ID NO: 4070787 - RNA, 14 nt, Streptococcus pneumoniae R6
aaaaagaagcagaa

SEQ ID NO: 4070788 - RNA, 20 nt, Streptococcus pneumoniae R6
aaaaagaaggauugagaagc

SEQ ID NO: 4070789 - RNA, 19 nt, Streptococcus pneumoniae R6
aaaaagaccggauugcucc

SEQ ID NO: 4070790 - RNA, 20 nt, Streptococcus pneumoniae R6
aaaaagagggauucuuauau

SEQ ID NO: 4070791 - RNA, 23 nt, Streptococcus pneumoniae R6
aaaaagaucaguucauuuuuccu

SEQ ID NO: 4070792 - RNA, 13 nt, Streptococcus pneumoniae R6
aaaaagauuugaa

SEQ ID NO: 4070793 - RNA, 16 nt, Streptococcus pneumoniae R6
aaaaagauuuuuuaaa

SEQ ID NO: 4070794 - RNA, 17 nt, Streptococcus pneumoniae R6
aaaaagcccuugaauua

SEQ ID NO: 4070795 - RNA, 22 nt, Streptococcus pneumoniae R6
aaaaagcuugaguggaaaaacc

SEQ ID NO: 4070796 - RNA, 14 nt, Streptococcus pneumoniae R6
aaaaaggaguaacu

SEQ ID NO: 4070797 - RNA, 21 nt, Streptococcus pneumoniae R6
aaaaaggcgauugaaacauga

SEQ ID NO: 4070798 - RNA, 22 nt, Streptococcus pneumoniae R6
aaaaaggcgauugaaacaugag

SEQ ID NO: 4070799 - RNA, 23 nt, Streptococcus pneumoniae R6
aaaaaggucaucagcagagaaag

SEQ ID NO: 4070800 - RNA, 14 nt, Streptococcus pneumoniae R6
aaaaaguauacucu

SEQ ID NO: 4070801 - RNA, 14 nt, Streptococcus pneumoniae R6
aaaaagucaauaau

SEQ ID NO: 4070802 - RNA, 14 nt, Streptococcus pneumoniae R6
aaaaaguccucuuu

SEQ ID NO: 4070803 - RNA, 19 nt, Streptococcus pneumoniae R6
aaaaagucuugacaaagaa

SEQ ID NO: 4070804 - RNA, 17 nt, Streptococcus pneumoniae R6
aaaaagugaaaggaaga

SEQ ID NO: 4070805 - RNA, 15 nt, Streptococcus pneumoniae R6
aaaaaguggaaagag

SEQ ID NO: 4070806 - RNA, 17 nt, Streptococcus pneumoniae R6
aaaaagugguaucauau

SEQ ID NO: 4070807 - RNA, 17 nt, Streptococcus pneumoniae R6
aaaaaguuaaaucuuau

SEQ ID NO: 4070808 - RNA, 14 nt, Streptococcus pneumoniae R6
aaaaaguucaauuu

SEQ ID NO: 4070809 - RNA, 15 nt, Streptococcus pneumoniae R6
aaaaaguucaauuuc

SEQ ID NO: 4070810 - RNA, 16 nt, Streptococcus pneumoniae R6
aaaaaguuuaaaaaaa

SEQ ID NO: 4070811 - RNA, 16 nt, Streptococcus pneumoniae R6
aaaaaguuuauauuau

SEQ ID NO: 4070812 - RNA, 14 nt, Streptococcus pneumoniae R6
aaaacucaauuuga

SEQ ID NO: 4070813 - RNA, 23 nt, Streptococcus pneumoniae R6
aaaacucuucuuuuggcaauaaa

SEQ ID NO: 4070814 - RNA, 18 nt, Streptococcus pneumoniae R6
aaaacugaacaaauuaau

SEQ ID NO: 4070815 - RNA, 14 nt, Streptococcus pneumoniae R6
aaaacugguccaga

SEQ ID NO: 4070816 - RNA, 19 nt, Streptococcus pneumoniae R6
aaaacugguccagagauag

SEQ ID NO: 4070817 - RNA, 15 nt, Streptococcus pneumoniae R6
aaaacuguaugagaa

SEQ ID NO: 4070818 - RNA, 14 nt, Streptococcus pneumoniae R6
aaaacuuaaaaauc

SEQ ID NO: 4070819 - RNA, 20 nt, Streptococcus pneumoniae R6
aaaacuuacaaugucuaaau

SEQ ID NO: 4070820 - RNA, 16 nt, Streptococcus pneumoniae R6
aaaacuugugauuuag

SEQ ID NO: 4070821 - RNA, 17 nt, Streptococcus pneumoniae R6
aaaacuuucauaaugga

SEQ ID NO: 4070822 - RNA, 15 nt, Streptococcus pneumoniae R6
aaaacuuuuaaaauc

SEQ ID NO: 4070823 - RNA, 17 nt, Streptococcus pneumoniae R6
aaaacuuuuuaaaaaau

SEQ ID NO: 4070824 - RNA, 19 nt, Streptococcus pneumoniae R6
aaaagaaaccaaucagacu

SEQ ID NO: 4070825 - RNA, 14 nt, Streptococcus pneumoniae R6
aaaagaaauauaua

SEQ ID NO: 4070826 - RNA, 15 nt, Streptococcus pneumoniae R6
aaaagaacaaguaaa

SEQ ID NO: 4070827 - RNA, 22 nt, Streptococcus pneumoniae R6
aaaagaagccugauggaaacau

SEQ ID NO: 4070828 - RNA, 19 nt, Streptococcus pneumoniae R6
aaaagaaguaaaucuuccc

SEQ ID NO: 4070829 - RNA, 14 nt, Streptococcus pneumoniae R6
aaaagacaucagau

SEQ ID NO: 4070830 - RNA, 17 nt, Streptococcus pneumoniae R6
aaaagaccguuugaaaa

SEQ ID NO: 4070831 - RNA, 18 nt, Streptococcus pneumoniae R6
aaaagacuugaaauacua

SEQ ID NO: 4070832 - RNA, 20 nt, Streptococcus pneumoniae R6
aaaagacuugaaauacuaaa

SEQ ID NO: 4070833 - RNA, 11 nt, Streptococcus pneumoniae R6
aaaagagaaag

SEQ ID NO: 4070834 - RNA, 19 nt, Streptococcus pneumoniae R6
aaaagagaaagacuugacc

SEQ ID NO: 4070835 - RNA, 21 nt, Streptococcus pneumoniae R6
aaaagagaauuuuccggcucu

SEQ ID NO: 4070836 - RNA, 20 nt, Streptococcus pneumoniae R6
aaaagagaguuacaaacucu

SEQ ID NO: 4070837 - RNA, 16 nt, Streptococcus pneumoniae R6
aaaagagcaagaacuu

SEQ ID NO: 4070838 - RNA, 21 nt, Streptococcus pneumoniae R6
aaaagaggagguaaaucccaa

SEQ ID NO: 4070839 - RNA, 23 nt, Streptococcus pneumoniae R6
aaaagaggaugaaccugcuuuag

SEQ ID NO: 4070840 - RNA, 14 nt, Streptococcus pneumoniae R6
aaaagaguuucgaa

SEQ ID NO: 4070841 - RNA, 14 nt, Streptococcus pneumoniae R6
aaaagauaagauag

SEQ ID NO: 4070842 - RNA, 21 nt, Streptococcus pneumoniae R6
aaaagauaagguucaaaaaau

SEQ ID NO: 4070843 - RNA, 15 nt, Streptococcus pneumoniae R6
aaaagauaaucaucu

SEQ ID NO: 4070844 - RNA, 14 nt, Streptococcus pneumoniae R6
aaaagauagcuaug

SEQ ID NO: 4070845 - RNA, 22 nt, Streptococcus pneumoniae R6
aaaagaucaguucauuuuuccu

SEQ ID NO: 4070846 - RNA, 21 nt, Streptococcus pneumoniae R6
aaaagauggaguguucuaaaa

SEQ ID NO: 4070847 - RNA, 19 nt, Streptococcus pneumoniae R6
aaaagauguucaaagauuu

SEQ ID NO: 4070848 - RNA, 19 nt, Streptococcus pneumoniae R6
aaaagauuugaaacuaaau

SEQ ID NO: 4070849 - RNA, 17 nt, Streptococcus pneumoniae R6
aaaagauuuuuuaaaaa

SEQ ID NO: 4070850 - RNA, 14 nt, Streptococcus pneumoniae R6
aaaagcaaauagca

SEQ ID NO: 4070851 - RNA, 19 nt, Streptococcus pneumoniae R6
aaaagcaagagcugauaga

SEQ ID NO: 4070852 - RNA, 24 nt, Streptococcus pneumoniae R6
aaaagcaagagcugauagagauua

SEQ ID NO: 4070853 - RNA, 14 nt, Streptococcus pneumoniae R6
aaaagcacucaaua

SEQ ID NO: 4070854 - RNA, 20 nt, Streptococcus pneumoniae R6
aaaagcagaggcaaugacaa

SEQ ID NO: 4070855 - RNA, 18 nt, Streptococcus pneumoniae R6
aaaagcaggaguuuuccc

SEQ ID NO: 4070856 - RNA, 18 nt, Streptococcus pneumoniae R6
aaaagcauaguaucaggu

SEQ ID NO: 4070857 - RNA, 21 nt, Streptococcus pneumoniae R6
aaaagcauucuaguccaucuc

SEQ ID NO: 4070858 - RNA, 20 nt, Streptococcus pneumoniae R6
aaaagccuccaaucuggagg

SEQ ID NO: 4070859 - RNA, 18 nt, Streptococcus pneumoniae R6
aaaagcucgauacucuaa

SEQ ID NO: 4070860 - RNA, 16 nt, Streptococcus pneumoniae R6
aaaagcuguauuggug

SEQ ID NO: 4070861 - RNA, 15 nt, Streptococcus pneumoniae R6
aaaagcuguuaaaaa

SEQ ID NO: 4070862 - RNA, 17 nt, Streptococcus pneumoniae R6
aaaagcuguuaaaaacu

SEQ ID NO: 4070863 - RNA, 15 nt, Streptococcus pneumoniae R6
aaaagcuuguuuaaa

SEQ ID NO: 4070864 - RNA, 16 nt, Streptococcus pneumoniae R6
aaaagcuuguuuaaaa

SEQ ID NO: 4070865 - RNA, 13 nt, Streptococcus pneumoniae R6
aaaaggaaaauac

SEQ ID NO: 4070866 - RNA, 16 nt, Streptococcus pneumoniae R6
aaaaggaguagaaaau

SEQ ID NO: 4070867 - RNA, 18 nt, Streptococcus pneumoniae R6
aaaaggaguagaaaauga

SEQ ID NO: 4070868 - RNA, 22 nt, Streptococcus pneumoniae R6
aaaaggcaucuugucaaagagu

SEQ ID NO: 4070869 - RNA, 17 nt, Streptococcus pneumoniae R6
aaaagggggcaaaacuu

SEQ ID NO: 4070870 - RNA, 13 nt, Streptococcus pneumoniae R6
aaaaggucaguug

SEQ ID NO: 4070871 - RNA, 13 nt, Streptococcus pneumoniae R6
aaaaguaaaaagg

SEQ ID NO: 4070872 - RNA, 15 nt, Streptococcus pneumoniae R6
aaaaguaaaaagggu

SEQ ID NO: 4070873 - RNA, 16 nt, Streptococcus pneumoniae R6
aaaaguacuuucagaa

SEQ ID NO: 4070874 - RNA, 22 nt, Streptococcus pneumoniae R6
aaaaguagcuucacugcgugga

SEQ ID NO: 4070875 - RNA, 20 nt, Streptococcus pneumoniae R6
aaaaguaggacgauaaaaac

SEQ ID NO: 4070876 - RNA, 21 nt, Streptococcus pneumoniae R6
aaaaguaggacgauaaaaacg

SEQ ID NO: 4070877 - RNA, 17 nt, Streptococcus pneumoniae R6
aaaaguagggcgauaaa

SEQ ID NO: 4070878 - RNA, 15 nt, Streptococcus pneumoniae R6
aaaaguauacucuaa

SEQ ID NO: 4070879 - RNA, 23 nt, Streptococcus pneumoniae R6
aaaagucaucuauaaucaauaua

SEQ ID NO: 4070880 - RNA, 16 nt, Streptococcus pneumoniae R6
aaaaguccaaaagacc

SEQ ID NO: 4070881 - RNA, 13 nt, Streptococcus pneumoniae R6
aaaaguccaaaga

SEQ ID NO: 4070882 - RNA, 14 nt, Streptococcus pneumoniae R6
aaaaguccucguag

SEQ ID NO: 4070883 - RNA, 18 nt, Streptococcus pneumoniae R6
aaaagucugaaucaaaaa

SEQ ID NO: 4070884 - RNA, 21 nt, Streptococcus pneumoniae R6
aaaagucugaaucaaaaauga

SEQ ID NO: 4070885 - RNA, 17 nt, Streptococcus pneumoniae R6
aaaagucugggaaaaau

SEQ ID NO: 4070886 - RNA, 13 nt, Streptococcus pneumoniae R6
aaaagucuuauaa

SEQ ID NO: 4070887 - RNA, 22 nt, Streptococcus pneumoniae R6
aaaagucuucacaaucaaaaaa

SEQ ID NO: 4070888 - RNA, 19 nt, Streptococcus pneumoniae R6
aaaagucuugacaaagaaa

SEQ ID NO: 4070889 - RNA, 16 nt, Streptococcus pneumoniae R6
aaaagucuuuaaaauc

SEQ ID NO: 4070890 - RNA, 17 nt, Streptococcus pneumoniae R6
aaaagucuuuaaaauua

SEQ ID NO: 4070891 - RNA, 18 nt, Streptococcus pneumoniae R6
aaaagucuuuaaaauuau

SEQ ID NO: 4070892 - RNA, 17 nt, Streptococcus pneumoniae R6
aaaaguggaaagagcag

SEQ ID NO: 4070893 - RNA, 22 nt, Streptococcus pneumoniae R6
aaaagugguaucauauaaauau

SEQ ID NO: 4070894 - RNA, 17 nt, Streptococcus pneumoniae R6
aaaagugucagauagga

SEQ ID NO: 4070895 - RNA, 19 nt, Streptococcus pneumoniae R6
aaaaguguugacaagugaa

SEQ ID NO: 4070896 - RNA, 15 nt, Streptococcus pneumoniae R6
aaaaguuagaaauaa

SEQ ID NO: 4070897 - RNA, 17 nt, Streptococcus pneumoniae R6
aaaaguuagaaauaaaa

SEQ ID NO: 4070898 - RNA, 17 nt, Streptococcus pneumoniae R6
aaaaguuagacaaauaa

SEQ ID NO: 4070899 - RNA, 22 nt, Streptococcus pneumoniae R6
aaaaguuagacaaauaauuuau

SEQ ID NO: 4070900 - RNA, 22 nt, Streptococcus pneumoniae R6
aaaaguuagacaauuaauuuau

SEQ ID NO: 4070901 - RNA, 19 nt, Streptococcus pneumoniae R6
aaaaguuagacagaaaaaa

SEQ ID NO: 4070902 - RNA, 15 nt, Streptococcus pneumoniae R6
aaaaguucaauuuca

SEQ ID NO: 4070903 - RNA, 14 nt, Streptococcus pneumoniae R6
aaaaguucucuuuc

SEQ ID NO: 4070904 - RNA, 17 nt, Streptococcus pneumoniae R6
aaaaguucucuuucuaa

SEQ ID NO: 4070905 - RNA, 13 nt, Streptococcus pneumoniae R6
aaaaguuuaaaaa

SEQ ID NO: 4070906 - RNA, 13 nt, Streptococcus pneumoniae R6
aaaaguuuaucua

SEQ ID NO: 4070907 - RNA, 16 nt, Streptococcus pneumoniae R6
aaaaguuuaucuagaa

SEQ ID NO: 4070908 - RNA, 19 nt, Streptococcus pneumoniae R6
aaaaguuuaucuagaauuu

SEQ ID NO: 4070909 - RNA, 11 nt, Streptococcus pneumoniae R6
aaaauaaaaaa

SEQ ID NO: 4070910 - RNA, 13 nt, Streptococcus pneumoniae R6
aaaauaaaaaaau

SEQ ID NO: 4070911 - RNA, 13 nt, Streptococcus pneumoniae R6
aaaauaaaaaaga

SEQ ID NO: 4070912 - RNA, 15 nt, Streptococcus pneumoniae R6
aaaauaaaaaagaga

SEQ ID NO: 4070913 - RNA, 14 nt, Streptococcus pneumoniae R6
aaaauaaaauuccu

SEQ ID NO: 4070914 - RNA, 23 nt, Streptococcus pneumoniae R6
aaaauaaaauuccuuuaaaaaca

SEQ ID NO: 4070915 - RNA, 14 nt, Streptococcus pneumoniae R6
aaaauuauuaaaau

SEQ ID NO: 4070916 - RNA, 22 nt, Streptococcus pneumoniae R6
aaaauuauuuugcgcauguaaa

SEQ ID NO: 4070917 - RNA, 19 nt, Streptococcus pneumoniae R6
aaaauucaaauuaauuucu

SEQ ID NO: 4070918 - RNA, 15 nt, Streptococcus pneumoniae R6
aaaauuccuuuaaaa

SEQ ID NO: 4070919 - RNA, 17 nt, Streptococcus pneumoniae R6
aaaauuccuuuaaaaac

SEQ ID NO: 4070920 - RNA, 20 nt, Streptococcus pneumoniae R6
aaaauuccuuuaaaaacaau

SEQ ID NO: 4070921 - RNA, 19 nt, Streptococcus pneumoniae R6
aaaauucggugcgcacacc

SEQ ID NO: 4070922 - RNA, 13 nt, Streptococcus pneumoniae R6
aaaauucuaaagg

SEQ ID NO: 4070923 - RNA, 19 nt, Streptococcus pneumoniae R6
aaaauucuaaaggcuuaau

SEQ ID NO: 4070924 - RNA, 12 nt, Streptococcus pneumoniae R6
aaaauucuuuga

SEQ ID NO: 4070925 - RNA, 14 nt, Streptococcus pneumoniae R6
aaaauucuuugaaa

SEQ ID NO: 4070926 - RNA, 15 nt, Streptococcus pneumoniae R6
aaaauucuuugaaau

SEQ ID NO: 4070927 - RNA, 19 nt, Streptococcus pneumoniae R6
aaaauucuuugaaaucaga

SEQ ID NO: 4070928 - RNA, 17 nt, Streptococcus pneumoniae R6
aaaauugauuuauagaa

SEQ ID NO: 4070929 - RNA, 18 nt, Streptococcus pneumoniae R6
aaaauugauuuauagaaa

SEQ ID NO: 4070930 - RNA, 22 nt, Streptococcus pneumoniae R6
aaaauugguguaaauagaaacc

SEQ ID NO: 4070931 - RNA, 14 nt, Streptococcus pneumoniae R6
aaaauuuaaaaaua

SEQ ID NO: 4070932 - RNA, 18 nt, Streptococcus pneumoniae R6
aaaauuuaaaagauacua

SEQ ID NO: 4070933 - RNA, 19 nt, Streptococcus pneumoniae R6
aaaauuucauuucgacuga

SEQ ID NO: 4070934 - RNA, 16 nt, Streptococcus pneumoniae R6
aaaauuucauuuucua

SEQ ID NO: 4070935 - RNA, 12 nt, Streptococcus pneumoniae R6
aaaauuucucug

SEQ ID NO: 4070936 - RNA, 16 nt, Streptococcus pneumoniae R6
aaaauuugacuccaga

SEQ ID NO: 4070937 - RNA, 20 nt, Streptococcus pneumoniae R6
aaaauuuuauuuaagcaaaa

SEQ ID NO: 4070938 - RNA, 13 nt, Streptococcus pneumoniae R6
aaaauuuucaaaa

SEQ ID NO: 4070939 - RNA, 20 nt, Streptococcus pneumoniae R6
aaaauuuugacauucuaaaa

SEQ ID NO: 4070940 - RNA, 13 nt, Streptococcus pneumoniae R6
aaaauuuuuaaag

SEQ ID NO: 4070941 - RNA, 11 nt, Streptococcus pneumoniae R6
aaaauuuuucc

SEQ ID NO: 4070942 - RNA, 19 nt, Streptococcus pneumoniae R6
aaaauuuuucuaaccaauc

SEQ ID NO: 4070943 - RNA, 24 nt, Streptococcus pneumoniae R6
aaaauuuuuuucuaauuaaaucau

SEQ ID NO: 4070944 - RNA, 13 nt, Streptococcus pneumoniae R6
aaacaaaauauau

SEQ ID NO: 4070945 - RNA, 16 nt, Streptococcus pneumoniae R6
aaacaaaauucuuccu

SEQ ID NO: 4070946 - RNA, 14 nt, Streptococcus pneumoniae R6
aaacaaagaaaaag

SEQ ID NO: 4070947 - RNA, 16 nt, Streptococcus pneumoniae R6
aaacaaaguauuaaaa

SEQ ID NO: 4070948 - RNA, 17 nt, Streptococcus pneumoniae R6
aaacaaaguauuaaaau

SEQ ID NO: 4070949 - RNA, 14 nt, Streptococcus pneumoniae R6
aaacaaagucugaa

SEQ ID NO: 4070950 - RNA, 19 nt, Streptococcus pneumoniae R6
aaacaaauccaaucuucua

SEQ ID NO: 4070951 - RNA, 13 nt, Streptococcus pneumoniae R6
aaacaaccgauaa

SEQ ID NO: 4070952 - RNA, 15 nt, Streptococcus pneumoniae R6
aaacaacuuauaaaa

SEQ ID NO: 4070953 - RNA, 16 nt, Streptococcus pneumoniae R6
aaacaacuuauaaaaa

SEQ ID NO: 4070954 - RNA, 18 nt, Streptococcus pneumoniae R6
aaacaagaacaagacaaa

SEQ ID NO: 4070955 - RNA, 18 nt, Streptococcus pneumoniae R6
aaacaagggcaaaaaaga

SEQ ID NO: 4070956 - RNA, 22 nt, Streptococcus pneumoniae R6
aaacaaguugcuugaaaacuca

SEQ ID NO: 4070957 - RNA, 18 nt, Streptococcus pneumoniae R6
aaacaauaaaucugucag

SEQ ID NO: 4070958 - RNA, 15 nt, Streptococcus pneumoniae R6
aaacaauauuuuuga

SEQ ID NO: 4070959 - RNA, 21 nt, Streptococcus pneumoniae R6
aaacaaucacggacaggguug

SEQ ID NO: 4070960 - RNA, 23 nt, Streptococcus pneumoniae R6
aaacaaugugcucagaaacaaga

SEQ ID NO: 4070961 - RNA, 16 nt, Streptococcus pneumoniae R6
aaacaauguucucaua

SEQ ID NO: 4070962 - RNA, 14 nt, Streptococcus pneumoniae R6
aaacaauugcccaa

SEQ ID NO: 4070963 - RNA, 16 nt, Streptococcus pneumoniae R6
aaacacaaaaaguccu

SEQ ID NO: 4070964 - RNA, 13 nt, Streptococcus pneumoniae R6
aaacacaaaagga

SEQ ID NO: 4070965 - RNA, 20 nt, Streptococcus pneumoniae R6
aaacacaguuuugagguugu

SEQ ID NO: 4070966 - RNA, 19 nt, Streptococcus pneumoniae R6
aaacacuguuuugagguug

SEQ ID NO: 4070967 - RNA, 12 nt, Streptococcus pneumoniae R6
aaacagaaaaau

SEQ ID NO: 4070968 - RNA, 19 nt, Streptococcus pneumoniae R6
aaacagagguggaaaagca

SEQ ID NO: 4070969 - RNA, 18 nt, Streptococcus pneumoniae R6
aaacagcgagauugaagc

SEQ ID NO: 4070970 - RNA, 19 nt, Streptococcus pneumoniae R6
aaacagcgagauugaagcu

SEQ ID NO: 4070971 - RNA, 15 nt, Streptococcus pneumoniae R6
aaacagcuaaagaca

SEQ ID NO: 4070972 - RNA, 11 nt, Streptococcus pneumoniae R6
aaacagcugcg

SEQ ID NO: 4070973 - RNA, 18 nt, Streptococcus pneumoniae R6
aaacagcugcgauaagga

SEQ ID NO: 4070974 - RNA, 16 nt, Streptococcus pneumoniae R6
aaacaggaguucuuuu

SEQ ID NO: 4070975 - RNA, 17 nt, Streptococcus pneumoniae R6
aaacaggaguucuuuua

SEQ ID NO: 4070976 - RNA, 21 nt, Streptococcus pneumoniae R6
aaacaggcucggcaauaccgu

SEQ ID NO: 4070977 - RNA, 20 nt, Streptococcus pneumoniae R6
aaacagggcaucuaagcauu

SEQ ID NO: 4070978 - RNA, 18 nt, Streptococcus pneumoniae R6
aaacaguaauaaagacac

SEQ ID NO: 4070979 - RNA, 15 nt, Streptococcus pneumoniae R6
aaacagugcuagaaa

SEQ ID NO: 4070980 - RNA, 22 nt, Streptococcus pneumoniae R6
aaacagugcuagaaauugacug

SEQ ID NO: 4070981 - RNA, 23 nt, Streptococcus pneumoniae R6
aaacaguuagacaauuaauuuau

SEQ ID NO: 4070982 - RNA, 15 nt, Streptococcus pneumoniae R6
aaacaucgaaagcaa

SEQ ID NO: 4070983 - RNA, 19 nt, Streptococcus pneumoniae R6
aaacaucucagaauaauau

SEQ ID NO: 4070984 - RNA, 17 nt, Streptococcus pneumoniae R6
aaacauugauaauagga

SEQ ID NO: 4070985 - RNA, 16 nt, Streptococcus pneumoniae R6
aaacauuggucgcauc

SEQ ID NO: 4070986 - RNA, 21 nt, Streptococcus pneumoniae R6
aaacauugugagaaauugguu

SEQ ID NO: 4070987 - RNA, 14 nt, Streptococcus pneumoniae R6
aaacauuuccgauu

SEQ ID NO: 4070988 - RNA, 18 nt, Streptococcus pneumoniae R6
aaacauuucggauuuuaa

SEQ ID NO: 4070989 - RNA, 17 nt, Streptococcus pneumoniae R6
aaacauuucuauaaauc

SEQ ID NO: 4070990 - RNA, 12 nt, Streptococcus pneumoniae R6
aaacauuugauu

SEQ ID NO: 4070991 - RNA, 13 nt, Streptococcus pneumoniae R6
aaacauuugauuu

SEQ ID NO: 4070992 - RNA, 23 nt, Streptococcus pneumoniae R6
aaaccaaaaaguggaaagagcag

SEQ ID NO: 4070993 - RNA, 20 nt, Streptococcus pneumoniae R6
aaaccaaacgacauagguca

SEQ ID NO: 4070994 - RNA, 18 nt, Streptococcus pneumoniae R6
aaaccaaacggauuuugu

SEQ ID NO: 4070995 - RNA, 18 nt, Streptococcus pneumoniae R6
aaaccaaacggauuuuuu

SEQ ID NO: 4070996 - RNA, 13 nt, Streptococcus pneumoniae R6
aaaccaaaggcau

SEQ ID NO: 4070997 - RNA, 20 nt, Streptococcus pneumoniae R6
aaaccaaaggcauugugcuu

SEQ ID NO: 4070998 - RNA, 11 nt, Streptococcus pneumoniae R6
aaaccaagaac

SEQ ID NO: 4070999 - RNA, 21 nt, Streptococcus pneumoniae R6
aaaccaagaaguccauagcgu

SEQ ID NO: 4071000 - RNA, 21 nt, Streptococcus pneumoniae R6
aaaccaagcaaggucaaaaug

SEQ ID NO: 4071001 - RNA, 13 nt, Streptococcus pneumoniae R6
aaaccaauaauaa

SEQ ID NO: 4071002 - RNA, 22 nt, Streptococcus pneumoniae R6
aaaccaauagccgcaaacuugg

SEQ ID NO: 4071003 - RNA, 18 nt, Streptococcus pneumoniae R6
aaaccaaucucaaauccu

SEQ ID NO: 4071004 - RNA, 17 nt, Streptococcus pneumoniae R6
aaaccaauucccaaaca

SEQ ID NO: 4071005 - RNA, 17 nt, Streptococcus pneumoniae R6
aaaccaccgacaaccca

SEQ ID NO: 4071006 - RNA, 21 nt, Streptococcus pneumoniae R6
aaaccaguccuggaaaaacgu

SEQ ID NO: 4071007 - RNA, 20 nt, Streptococcus pneumoniae R6
aaaccaguuccuuugucuuu

SEQ ID NO: 4071008 - RNA, 20 nt, Streptococcus pneumoniae R6
aaaccauguuuugagcugac

SEQ ID NO: 4071009 - RNA, 13 nt, Streptococcus pneumoniae R6
aaaccccaagaaa

SEQ ID NO: 4071010 - RNA, 13 nt, Streptococcus pneumoniae R6
aaaccguucaaga

SEQ ID NO: 4071011 - RNA, 13 nt, Streptococcus pneumoniae R6
aaaccucaaggca

SEQ ID NO: 4071012 - RNA, 19 nt, Streptococcus pneumoniae R6
aaaccuccaaaguagcuug

SEQ ID NO: 4071013 - RNA, 16 nt, Streptococcus pneumoniae R6
aaaccugagaaggaga

SEQ ID NO: 4071014 - RNA, 21 nt, Streptococcus pneumoniae R6
aaaccuguaaucccucagagu

SEQ ID NO: 4071015 - RNA, 14 nt, Streptococcus pneumoniae R6
aaaccuuauuuuuu

SEQ ID NO: 4071016 - RNA, 17 nt, Streptococcus pneumoniae R6
aaaccuucccacaauaa

SEQ ID NO: 4071017 - RNA, 18 nt, Streptococcus pneumoniae R6
aaaccuugauaggaugcc

SEQ ID NO: 4071018 - RNA, 23 nt, Streptococcus pneumoniae R6
aaagaauagagggauucuccaua

SEQ ID NO: 4071019 - RNA, 15 nt, Streptococcus pneumoniae R6
aaagaauccaauuca

SEQ ID NO: 4071020 - RNA, 19 nt, Streptococcus pneumoniae R6
aaagaauccaauucaaagu

SEQ ID NO: 4071021 - RNA, 12 nt, Streptococcus pneumoniae R6
aaagaauccauc

SEQ ID NO: 4071022 - RNA, 15 nt, Streptococcus pneumoniae R6
aaagaauccaucuga

SEQ ID NO: 4071023 - RNA, 19 nt, Streptococcus pneumoniae R6
aaagaauccaucugauaaa

SEQ ID NO: 4071024 - RNA, 13 nt, Streptococcus pneumoniae R6
aaagaaugcucag

SEQ ID NO: 4071025 - RNA, 16 nt, Streptococcus pneumoniae R6
aaagaaugcucagaca

SEQ ID NO: 4071026 - RNA, 19 nt, Streptococcus pneumoniae R6
aaagaauguuaugcaacuu

SEQ ID NO: 4071027 - RNA, 19 nt, Streptococcus pneumoniae R6
aaagaauuaggaaaacaug

SEQ ID NO: 4071028 - RNA, 13 nt, Streptococcus pneumoniae R6
aaagaauuugaaa

SEQ ID NO: 4071029 - RNA, 18 nt, Streptococcus pneumoniae R6
aaagaauuugaaaaaaau

SEQ ID NO: 4071030 - RNA, 14 nt, Streptococcus pneumoniae R6
aaagacaaagguca

SEQ ID NO: 4071031 - RNA, 20 nt, Streptococcus pneumoniae R6
aaagacaccaccgaaggcuu

SEQ ID NO: 4071032 - RNA, 16 nt, Streptococcus pneumoniae R6
aaagacagucugaaaa

SEQ ID NO: 4071033 - RNA, 21 nt, Streptococcus pneumoniae R6
aaagacagucugaaaaagagg

SEQ ID NO: 4071034 - RNA, 19 nt, Streptococcus pneumoniae R6
aaagacagucugaaaaaua

SEQ ID NO: 4071035 - RNA, 24 nt, Streptococcus pneumoniae R6
aaagaccaccucaucuugauagau

SEQ ID NO: 4071036 - RNA, 17 nt, Streptococcus pneumoniae R6
aaagaccaguucaucau

SEQ ID NO: 4071037 - RNA, 17 nt, Streptococcus pneumoniae R6
aaagaccauagcaaagg

SEQ ID NO: 4071038 - RNA, 15 nt, Streptococcus pneumoniae R6
aaagaccguuugaaa

SEQ ID NO: 4071039 - RNA, 19 nt, Streptococcus pneumoniae R6
aaagacuggugagauaaaa

SEQ ID NO: 4071040 - RNA, 13 nt, Streptococcus pneumoniae R6
aaagacuuagucu

SEQ ID NO: 4071041 - RNA, 13 nt, Streptococcus pneumoniae R6
aaagacuugaaau

SEQ ID NO: 4071042 - RNA, 21 nt, Streptococcus pneumoniae R6
aaagacuugaccggagaaaga

SEQ ID NO: 4071043 - RNA, 13 nt, Streptococcus pneumoniae R6
aaagagaagaaau

SEQ ID NO: 4071044 - RNA, 14 nt, Streptococcus pneumoniae R6
aaagagcaagaacu

SEQ ID NO: 4071045 - RNA, 23 nt, Streptococcus pneumoniae R6
aaagagcacugcuagcaucaucg

SEQ ID NO: 4071046 - RNA, 15 nt, Streptococcus pneumoniae R6
aaagagccaaaaaag

SEQ ID NO: 4071047 - RNA, 16 nt, Streptococcus pneumoniae R6
aaagagccaaaaaaga

SEQ ID NO: 4071048 - RNA, 17 nt, Streptococcus pneumoniae R6
aaagagccaaaaaagaa

SEQ ID NO: 4071049 - RNA, 15 nt, Streptococcus pneumoniae R6
aaagagccauaaaaa

SEQ ID NO: 4071050 - RNA, 19 nt, Streptococcus pneumoniae R6
aaagagccauaaaaauaac

SEQ ID NO: 4071051 - RNA, 16 nt, Streptococcus pneumoniae R6
aaagagccgaaaaaau

SEQ ID NO: 4071052 - RNA, 23 nt, Streptococcus pneumoniae R6
aaagagccgggauuuuuuagcuu

SEQ ID NO: 4071053 - RNA, 15 nt, Streptococcus pneumoniae R6
aaagaggaaaucuuu

SEQ ID NO: 4071054 - RNA, 13 nt, Streptococcus pneumoniae R6
aaagaggaagagg

SEQ ID NO: 4071055 - RNA, 18 nt, Streptococcus pneumoniae R6
aaagaggagguaaauccc

SEQ ID NO: 4071056 - RNA, 17 nt, Streptococcus pneumoniae R6
aaagaggagucuuauag

SEQ ID NO: 4071057 - RNA, 23 nt, Streptococcus pneumoniae R6
aaagagggauucuuauauuaaaa

SEQ ID NO: 4071058 - RNA, 18 nt, Streptococcus pneumoniae R6
aaagaguacagucuuugc

SEQ ID NO: 4071059 - RNA, 17 nt, Streptococcus pneumoniae R6
aaagagucccuuagaaa

SEQ ID NO: 4071060 - RNA, 20 nt, Streptococcus pneumoniae R6
aaagagucccuuagaaaaac

SEQ ID NO: 4071061 - RNA, 20 nt, Streptococcus pneumoniae R6
aaagagucuggaacaaaaua

SEQ ID NO: 4071062 - RNA, 17 nt, Streptococcus pneumoniae R6
aaagaguuucaugaguu

SEQ ID NO: 4071063 - RNA, 20 nt, Streptococcus pneumoniae R6
aaagaguuucgaaaagaauu

SEQ ID NO: 4071064 - RNA, 18 nt, Streptococcus pneumoniae R6
aaagauaaaauugauaau

SEQ ID NO: 4071065 - RNA, 19 nt, Streptococcus pneumoniae R6
aaagauaagguucaaaaaa

SEQ ID NO: 4071066 - RNA, 20 nt, Streptococcus pneumoniae R6
aaagauaagguucaaaaaau

SEQ ID NO: 4071067 - RNA, 22 nt, Streptococcus pneumoniae R6
aaagauaccgucgacugcaguc

SEQ ID NO: 4071068 - RNA, 13 nt, Streptococcus pneumoniae R6
aaagauaucgguu

SEQ ID NO: 4071069 - RNA, 22 nt, Streptococcus pneumoniae R6
aaagaucaguucauuuuuccuu

SEQ ID NO: 4071070 - RNA, 15 nt, Streptococcus pneumoniae R6
aaagaugaagcaauc

SEQ ID NO: 4071071 - RNA, 15 nt, Streptococcus pneumoniae R6
aaagauggaaaaacu

SEQ ID NO: 4071072 - RNA, 16 nt, Streptococcus pneumoniae R6
aaagauguuagaaaaa

SEQ ID NO: 4071073 - RNA, 17 nt, Streptococcus pneumoniae R6
aaagauguuagaaaaag

SEQ ID NO: 4071074 - RNA, 18 nt, Streptococcus pneumoniae R6
aaagauguucaaagauuu

SEQ ID NO: 4071075 - RNA, 21 nt, Streptococcus pneumoniae R6
aaagauuaaucuucaaauuuu

SEQ ID NO: 4071076 - RNA, 19 nt, Streptococcus pneumoniae R6
aaagauuauaggcgauaau

SEQ ID NO: 4071077 - RNA, 20 nt, Streptococcus pneumoniae R6
aaagauuucuauaaauucau

SEQ ID NO: 4071078 - RNA, 18 nt, Streptococcus pneumoniae R6
aaagauuugaaacuaaau

SEQ ID NO: 4071079 - RNA, 22 nt, Streptococcus pneumoniae R6
aaagauuuuauccaaucuauuu

SEQ ID NO: 4071080 - RNA, 15 nt, Streptococcus pneumoniae R6
aaagauuuuuuaaaa

SEQ ID NO: 4071081 - RNA, 18 nt, Streptococcus pneumoniae R6
aaagauuuuuuaaaaagu

SEQ ID NO: 4071082 - RNA, 17 nt, Streptococcus pneumoniae R6
aaagauuuuuuccuugc

SEQ ID NO: 4071083 - RNA, 18 nt, Streptococcus pneumoniae R6
aaagauuuuuuccuugcu

SEQ ID NO: 4071084 - RNA, 19 nt, Streptococcus pneumoniae R6
aaagcaaaagaacaaguaa

SEQ ID NO: 4071085 - RNA, 12 nt, Streptococcus pneumoniae R6
aaagcaaaaugg

SEQ ID NO: 4071086 - RNA, 19 nt, Streptococcus pneumoniae R6
aaagcaaauuuaauauuua

SEQ ID NO: 4071087 - RNA, 17 nt, Streptococcus pneumoniae R6
aaagcaacacaccuugu

SEQ ID NO: 4071088 - RNA, 23 nt, Streptococcus pneumoniae R6
aaagcaacuuacuccggcggagc

SEQ ID NO: 4071089 - RNA, 18 nt, Streptococcus pneumoniae R6
aaagcaaguuuugaacuu

SEQ ID NO: 4071090 - RNA, 20 nt, Streptococcus pneumoniae R6
aaagcacuugcuuuugaugg

SEQ ID NO: 4071091 - RNA, 19 nt, Streptococcus pneumoniae R6
aaagcagugcuuugagcaa

SEQ ID NO: 4071092 - RNA, 14 nt, Streptococcus pneumoniae R6
aaagccaaaucaau

SEQ ID NO: 4071093 - RNA, 15 nt, Streptococcus pneumoniae R6
aaagccagucgucac

SEQ ID NO: 4071094 - RNA, 17 nt, Streptococcus pneumoniae R6
aaagccgagcaagaauu

SEQ ID NO: 4071095 - RNA, 19 nt, Streptococcus pneumoniae R6
aaagccuuccuugauucgg

SEQ ID NO: 4071096 - RNA, 22 nt, Streptococcus pneumoniae R6
aaagccuuugccggcauauccu

SEQ ID NO: 4071097 - RNA, 19 nt, Streptococcus pneumoniae R6
aaagcgaaaggagaaaaau

SEQ ID NO: 4071098 - RNA, 17 nt, Streptococcus pneumoniae R6
aaagcgaagaucuagaa

SEQ ID NO: 4071099 - RNA, 15 nt, Streptococcus pneumoniae R6
aaagcgauaaaaauc

SEQ ID NO: 4071100 - RNA, 22 nt, Streptococcus pneumoniae R6
aaagcgggauuuaaaauaagag

SEQ ID NO: 4071101 - RNA, 20 nt, Streptococcus pneumoniae R6
aaagcguguaggaaaccaau

SEQ ID NO: 4071102 - RNA, 22 nt, Streptococcus pneumoniae R6
aaagcguguaggaaaccaaucu

SEQ ID NO: 4071103 - RNA, 23 nt, Streptococcus pneumoniae R6
aaagcguuuauauaguagccaaa

SEQ ID NO: 4071104 - RNA, 12 nt, Streptococcus pneumoniae R6
aaagcuaaaucc

SEQ ID NO: 4071105 - RNA, 13 nt, Streptococcus pneumoniae R6
aaagcuaaauccu

SEQ ID NO: 4071106 - RNA, 17 nt, Streptococcus pneumoniae R6
aaagcuaagaaaguaag

SEQ ID NO: 4071107 - RNA, 18 nt, Streptococcus pneumoniae R6
aaagcuaagcucgagaaa

SEQ ID NO: 4071108 - RNA, 23 nt, Streptococcus pneumoniae R6
aaagcuaagcucgagaaaggaca

SEQ ID NO: 4071109 - RNA, 18 nt, Streptococcus pneumoniae R6
aaagcuacaaucuggaga

SEQ ID NO: 4071110 - RNA, 20 nt, Streptococcus pneumoniae R6
aaagcuacuauaaaagagga

SEQ ID NO: 4071111 - RNA, 14 nt, Streptococcus pneumoniae R6
aaagcuacuuuuuu

SEQ ID NO: 4071112 - RNA, 16 nt, Streptococcus pneumoniae R6
aaagcuagauuuaaaa

SEQ ID NO: 4071113 - RNA, 20 nt, Streptococcus pneumoniae R6
aaagcuagucgcagguugcu

SEQ ID NO: 4071114 - RNA, 16 nt, Streptococcus pneumoniae R6
aaagcucgauacucua

SEQ ID NO: 4071115 - RNA, 21 nt, Streptococcus pneumoniae R6
aaagcugaauucuaauguaca

SEQ ID NO: 4071116 - RNA, 21 nt, Streptococcus pneumoniae R6
aaagcugacgcgguuugaaga

SEQ ID NO: 4071117 - RNA, 22 nt, Streptococcus pneumoniae R6
aaagcugacgcgguuugaagag

SEQ ID NO: 4071118 - RNA, 22 nt, Streptococcus pneumoniae R6
aaagcuggcuugaggucccaug

SEQ ID NO: 4071119 - RNA, 19 nt, Streptococcus pneumoniae R6
aaagcugugcuuugagcaa

SEQ ID NO: 4071120 - RNA, 17 nt, Streptococcus pneumoniae R6
aaaguuagacagaaaaa

SEQ ID NO: 4071121 - RNA, 18 nt, Streptococcus pneumoniae R6
aaaguuagacagaaaaaa

SEQ ID NO: 4071122 - RNA, 22 nt, Streptococcus pneumoniae R6
aaaguuagauuuuuucugucua

SEQ ID NO: 4071123 - RNA, 20 nt, Streptococcus pneumoniae R6
aaaguuaugaaaaagauuuu

SEQ ID NO: 4071124 - RNA, 16 nt, Streptococcus pneumoniae R6
aaaguucaauuucacu

SEQ ID NO: 4071125 - RNA, 23 nt, Streptococcus pneumoniae R6
aaaguucggccguugauuuaaca

SEQ ID NO: 4071126 - RNA, 22 nt, Streptococcus pneumoniae R6
aaaguucucuuucuaaaauagu

SEQ ID NO: 4071127 - RNA, 12 nt, Streptococcus pneumoniae R6
aaaguucuuccc

SEQ ID NO: 4071128 - RNA, 14 nt, Streptococcus pneumoniae R6
aaaguucuuccccu

SEQ ID NO: 4071129 - RNA, 15 nt, Streptococcus pneumoniae R6
aaaguucuuccccua

SEQ ID NO: 4071130 - RNA, 14 nt, Streptococcus pneumoniae R6
aaaguuuaaaaaaa

SEQ ID NO: 4071131 - RNA, 22 nt, Streptococcus pneumoniae R6
aaaguuuaucuagaauuucuuu

SEQ ID NO: 4071132 - RNA, 19 nt, Streptococcus pneumoniae R6
aaaguuuaucucuugccua

SEQ ID NO: 4071133 - RNA, 23 nt, Streptococcus pneumoniae R6
aaaguuuccagucaucugauugg

SEQ ID NO: 4071134 - RNA, 18 nt, Streptococcus pneumoniae R6
aaaguuucgaaaaccaaa

SEQ ID NO: 4071135 - RNA, 15 nt, Streptococcus pneumoniae R6
aaaguuuucuuuguu

SEQ ID NO: 4071136 - RNA, 14 nt, Streptococcus pneumoniae R6
aaaguuuuugguaa

SEQ ID NO: 4071137 - RNA, 21 nt, Streptococcus pneumoniae R6
aaaguuuuugguaauuuucuu

SEQ ID NO: 4071138 - RNA, 18 nt, Streptococcus pneumoniae R6
aaauaaaaaaauuuggaa

SEQ ID NO: 4071139 - RNA, 16 nt, Streptococcus pneumoniae R6
aaauaaaaacaucuac

SEQ ID NO: 4071140 - RNA, 15 nt, Streptococcus pneumoniae R6
aaauaaaaguaacac

SEQ ID NO: 4071141 - RNA, 13 nt, Streptococcus pneumoniae R6
aaauaaagcaaau

SEQ ID NO: 4071142 - RNA, 14 nt, Streptococcus pneumoniae R6
aaauaaagcaaauc

SEQ ID NO: 4071143 - RNA, 13 nt, Streptococcus pneumoniae R6
aaauaaauaaaac

SEQ ID NO: 4071144 - RNA, 15 nt, Streptococcus pneumoniae R6
aaauaaaucuaucag

SEQ ID NO: 4071145 - RNA, 14 nt, Streptococcus pneumoniae R6
aaauaacaaaccaa

SEQ ID NO: 4071146 - RNA, 20 nt, Streptococcus pneumoniae R6
aaauaacaaaccaagaauaa

SEQ ID NO: 4071147 - RNA, 14 nt, Streptococcus pneumoniae R6
aaauaacucauaau

SEQ ID NO: 4071148 - RNA, 14 nt, Streptococcus pneumoniae R6
aaauaacucuguaa

SEQ ID NO: 4071149 - RNA, 15 nt, Streptococcus pneumoniae R6
aaauaagaaauaguu

SEQ ID NO: 4071150 - RNA, 16 nt, Streptococcus pneumoniae R6
aaauaagaacaggaca

SEQ ID NO: 4071151 - RNA, 14 nt, Streptococcus pneumoniae R6
aaauaagauaugaa

SEQ ID NO: 4071152 - RNA, 16 nt, Streptococcus pneumoniae R6
aaauaagaugagaaca

SEQ ID NO: 4071153 - RNA, 20 nt, Streptococcus pneumoniae R6
aaauaagccgaagccaauca

SEQ ID NO: 4071154 - RNA, 11 nt, Streptococcus pneumoniae R6
aaauaagcucg

SEQ ID NO: 4071155 - RNA, 16 nt, Streptococcus pneumoniae R6
aaauaagcucuguuuu

SEQ ID NO: 4071156 - RNA, 22 nt, Streptococcus pneumoniae R6
aaauaagggcaaagaaaaggaa

SEQ ID NO: 4071157 - RNA, 23 nt, Streptococcus pneumoniae R6
aaauaaggggauagagauagaag

SEQ ID NO: 4071158 - RNA, 21 nt, Streptococcus pneumoniae R6
aaauaagucagcucacaaaaa

SEQ ID NO: 4071159 - RNA, 19 nt, Streptococcus pneumoniae R6
aaauaaguucaacaaauca

SEQ ID NO: 4071160 - RNA, 17 nt, Streptococcus pneumoniae R6
aaauaaguucuguuuag

SEQ ID NO: 4071161 - RNA, 22 nt, Streptococcus pneumoniae R6
aaauaauaagcuuugaaaauuc

SEQ ID NO: 4071162 - RNA, 16 nt, Streptococcus pneumoniae R6
aaauaaucaaaacuau

SEQ ID NO: 4071163 - RNA, 13 nt, Streptococcus pneumoniae R6
aaauaaucaaaau

SEQ ID NO: 4071164 - RNA, 18 nt, Streptococcus pneumoniae R6
aaauaaucaaaauauguu

SEQ ID NO: 4071165 - RNA, 16 nt, Streptococcus pneumoniae R6
aaauaaucucugaacu

SEQ ID NO: 4071166 - RNA, 19 nt, Streptococcus pneumoniae R6
aaauaaucucugaacuuuc

SEQ ID NO: 4071167 - RNA, 13 nt, Streptococcus pneumoniae R6
aaauaauuaaaau

SEQ ID NO: 4071168 - RNA, 22 nt, Streptococcus pneumoniae R6
aaauaauuaaaaugugauuucu

SEQ ID NO: 4071169 - RNA, 20 nt, Streptococcus pneumoniae R6
aaauaauuaguucagaauuu

SEQ ID NO: 4071170 - RNA, 22 nt, Streptococcus pneumoniae R6
aaauaauuaguucagaauuuuc

SEQ ID NO: 4071171 - RNA, 12 nt, Streptococcus pneumoniae R6
aaauaauuuuuu

SEQ ID NO: 4071172 - RNA, 16 nt, Streptococcus pneumoniae R6
aaauacaaaaacaaag

SEQ ID NO: 4071173 - RNA, 14 nt, Streptococcus pneumoniae R6
aaauacaaaaauag

SEQ ID NO: 4071174 - RNA, 15 nt, Streptococcus pneumoniae R6
aaauacaaaccaaac

SEQ ID NO: 4071175 - RNA, 17 nt, Streptococcus pneumoniae R6
aaauacaaaccaaacga

SEQ ID NO: 4071176 - RNA, 20 nt, Streptococcus pneumoniae R6
aaauaccaaguucauuuuuu

SEQ ID NO: 4071177 - RNA, 15 nt, Streptococcus pneumoniae R6
aaauacccucuauca

SEQ ID NO: 4071178 - RNA, 16 nt, Streptococcus pneumoniae R6
aaauacccucuaucaa

SEQ ID NO: 4071179 - RNA, 13 nt, Streptococcus pneumoniae R6
aaauacuaaaaaa

SEQ ID NO: 4071180 - RNA, 19 nt, Streptococcus pneumoniae R6
aaauacucaucaugaauau

SEQ ID NO: 4071181 - RNA, 14 nt, Streptococcus pneumoniae R6
aaauagaagauuuc

SEQ ID NO: 4071182 - RNA, 15 nt, Streptococcus pneumoniae R6
aaauagauaaauacu

SEQ ID NO: 4071183 - RNA, 21 nt, Streptococcus pneumoniae R6
aaauagauuggauaaaaucuu

SEQ ID NO: 4071184 - RNA, 21 nt, Streptococcus pneumoniae R6
aaauagcagagacauuagaaa

SEQ ID NO: 4071185 - RNA, 15 nt, Streptococcus pneumoniae R6
aaauagcauccacca

SEQ ID NO: 4071186 - RNA, 18 nt, Streptococcus pneumoniae R6
aaauagcauccaccacuu

SEQ ID NO: 4071187 - RNA, 16 nt, Streptococcus pneumoniae R6
aaauagccaagaccaa

SEQ ID NO: 4071188 - RNA, 21 nt, Streptococcus pneumoniae R6
aaauagccaagaccaauccua

SEQ ID NO: 4071189 - RNA, 14 nt, Streptococcus pneumoniae R6
aaauagcccauaaa

SEQ ID NO: 4071190 - RNA, 21 nt, Streptococcus pneumoniae R6
aaauagcccauaaagagaggu

SEQ ID NO: 4071191 - RNA, 22 nt, Streptococcus pneumoniae R6
aaauagccccuagauauuuuga

SEQ ID NO: 4071192 - RNA, 21 nt, Streptococcus pneumoniae R6
aaauagcuccuuuaacauuug

SEQ ID NO: 4071193 - RNA, 14 nt, Streptococcus pneumoniae R6
aaauagcuguuuca

SEQ ID NO: 4071194 - RNA, 16 nt, Streptococcus pneumoniae R6
aaauaggaagcuaguc

SEQ ID NO: 4071195 - RNA, 22 nt, Streptococcus pneumoniae R6
aaauaggaaucaaccaacuuuu

SEQ ID NO: 4071196 - RNA, 11 nt, Streptococcus pneumoniae R6
aaauaggcucc

SEQ ID NO: 4071197 - RNA, 17 nt, Streptococcus pneumoniae R6
aaauaguacgaaacaau

SEQ ID NO: 4071198 - RNA, 20 nt, Streptococcus pneumoniae R6
aaauaguauaccacacuaaa

SEQ ID NO: 4071199 - RNA, 16 nt, Streptococcus pneumoniae R6
aaauaguuuaaaacau

SEQ ID NO: 4071200 - RNA, 21 nt, Streptococcus pneumoniae R6
aaauaguuuagauaaaacuau

SEQ ID NO: 4071201 - RNA, 18 nt, Streptococcus pneumoniae R6
aaauauaguaaaaugaaa

SEQ ID NO: 4071202 - RNA, 18 nt, Streptococcus pneumoniae R6
aaauauaguagauugaaa

SEQ ID NO: 4071203 - RNA, 24 nt, Streptococcus pneumoniae R6
aaauaucauuaaguaaucucugau

SEQ ID NO: 4071204 - RNA, 14 nt, Streptococcus pneumoniae R6
aaauaucuauccua

SEQ ID NO: 4071205 - RNA, 21 nt, Streptococcus pneumoniae R6
aaauaucugcacucucauuca

SEQ ID NO: 4071206 - RNA, 14 nt, Streptococcus pneumoniae R6
aaauaugaucgauu

SEQ ID NO: 4071207 - RNA, 13 nt, Streptococcus pneumoniae R6
aaauaugaucuau

SEQ ID NO: 4071208 - RNA, 18 nt, Streptococcus pneumoniae R6
aaauaugcauaauuucca

SEQ ID NO: 4071209 - RNA, 15 nt, Streptococcus pneumoniae R6
aaauauggcacaaaa

SEQ ID NO: 4071210 - RNA, 16 nt, Streptococcus pneumoniae R6
aaauauguuuucuuug

SEQ ID NO: 4071211 - RNA, 20 nt, Streptococcus pneumoniae R6
aaauauuagcaaaaaagcaa

SEQ ID NO: 4071212 - RNA, 20 nt, Streptococcus pneumoniae R6
aaauauuguuuuaauauaau

SEQ ID NO: 4071213 - RNA, 23 nt, Streptococcus pneumoniae R6
aaauauuguuuuaauauaauauc

SEQ ID NO: 4071214 - RNA, 13 nt, Streptococcus pneumoniae R6
aaauauuuacuuc

SEQ ID NO: 4071215 - RNA, 22 nt, Streptococcus pneumoniae R6
aaauauuucuaugauaaaacgc

SEQ ID NO: 4071216 - RNA, 18 nt, Streptococcus pneumoniae R6
aaauauuuugcuguuuau

SEQ ID NO: 4071217 - RNA, 16 nt, Streptococcus pneumoniae R6
aaauauuuuuuacuuu

SEQ ID NO: 4071218 - RNA, 14 nt, Streptococcus pneumoniae R6
aaaucaaaaaaauu

SEQ ID NO: 4071219 - RNA, 12 nt, Streptococcus pneumoniae R6
aaaucaaaauau

SEQ ID NO: 4071220 - RNA, 14 nt, Streptococcus pneumoniae R6
aaaucaaaauauag

SEQ ID NO: 4071221 - RNA, 14 nt, Streptococcus pneumoniae R6
aaaucaaagagcaa

SEQ ID NO: 4071222 - RNA, 13 nt, Streptococcus pneumoniae R6
aaaucaaauuuau

SEQ ID NO: 4071223 - RNA, 21 nt, Streptococcus pneumoniae R6
aaaugaggguccgaaccacaa

SEQ ID NO: 4071224 - RNA, 13 nt, Streptococcus pneumoniae R6
aaaugaguaugaa

SEQ ID NO: 4071225 - RNA, 19 nt, Streptococcus pneumoniae R6
aaaugaguaugaaaagaga

SEQ ID NO: 4071226 - RNA, 11 nt, Streptococcus pneumoniae R6
aaaugagucua

SEQ ID NO: 4071227 - RNA, 15 nt, Streptococcus pneumoniae R6
aaaugauaauugauu

SEQ ID NO: 4071228 - RNA, 21 nt, Streptococcus pneumoniae R6
aaaugauaauugauuaagaag

SEQ ID NO: 4071229 - RNA, 14 nt, Streptococcus pneumoniae R6
aaaugcaagacaca

SEQ ID NO: 4071230 - RNA, 17 nt, Streptococcus pneumoniae R6
aaaugcugguuuuuacu

SEQ ID NO: 4071231 - RNA, 22 nt, Streptococcus pneumoniae R6
aaauggaaguuucaaaauuccc

SEQ ID NO: 4071232 - RNA, 12 nt, Streptococcus pneumoniae R6
aaauggcaugag

SEQ ID NO: 4071233 - RNA, 18 nt, Streptococcus pneumoniae R6
aaaugguuccaaaaggca

SEQ ID NO: 4071234 - RNA, 13 nt, Streptococcus pneumoniae R6
aaauguaguuaau

SEQ ID NO: 4071235 - RNA, 17 nt, Streptococcus pneumoniae R6
aaauguauuugaaaggg

SEQ ID NO: 4071236 - RNA, 19 nt, Streptococcus pneumoniae R6
aaauguucuguaaugaaau

SEQ ID NO: 4071237 - RNA, 20 nt, Streptococcus pneumoniae R6
aaauguugaaucauuuuguu

SEQ ID NO: 4071238 - RNA, 21 nt, Streptococcus pneumoniae R6
aaauguuuucucauagccaua

SEQ ID NO: 4071239 - RNA, 22 nt, Streptococcus pneumoniae R6
aaauguuuucucauagccauaa

SEQ ID NO: 4071240 - RNA, 14 nt, Streptococcus pneumoniae R6
aaauuaaaaagagu

SEQ ID NO: 4071241 - RNA, 16 nt, Streptococcus pneumoniae R6
aaauuaaaaugcaaga

SEQ ID NO: 4071242 - RNA, 19 nt, Streptococcus pneumoniae R6
aaauuaaucagaauggguu

SEQ ID NO: 4071243 - RNA, 19 nt, Streptococcus pneumoniae R6
aaauuaauuuauagaaaaa

SEQ ID NO: 4071244 - RNA, 20 nt, Streptococcus pneumoniae R6
aaauuaauuuauagaaauau

SEQ ID NO: 4071245 - RNA, 23 nt, Streptococcus pneumoniae R6
aaauuaauuuauagaaauauuuu

SEQ ID NO: 4071246 - RNA, 13 nt, Streptococcus pneumoniae R6
aaauuaauuugaa

SEQ ID NO: 4071247 - RNA, 16 nt, Streptococcus pneumoniae R6
aaauuaauuugaauuu

SEQ ID NO: 4071248 - RNA, 20 nt, Streptococcus pneumoniae R6
aaauuaauuugaauuuucua

SEQ ID NO: 4071249 - RNA, 13 nt, Streptococcus pneumoniae R6
aaauuaauuuuac

SEQ ID NO: 4071250 - RNA, 18 nt, Streptococcus pneumoniae R6
aaauuacaguuauuuuag

SEQ ID NO: 4071251 - RNA, 16 nt, Streptococcus pneumoniae R6
aaauuagaaaaagacu

SEQ ID NO: 4071252 - RNA, 18 nt, Streptococcus pneumoniae R6
aaauuagcucaaaacacu

SEQ ID NO: 4071253 - RNA, 21 nt, Streptococcus pneumoniae R6
aaauuagggauacuccauaaa

SEQ ID NO: 4071254 - RNA, 15 nt, Streptococcus pneumoniae R6
aaauuauaaauuauu

SEQ ID NO: 4071255 - RNA, 20 nt, Streptococcus pneumoniae R6
aaauuaugaugcauaguuga

SEQ ID NO: 4071256 - RNA, 15 nt, Streptococcus pneumoniae R6
aaauuauguuuuuga

SEQ ID NO: 4071257 - RNA, 18 nt, Streptococcus pneumoniae R6
aaauuauguuuuugaaua

SEQ ID NO: 4071258 - RNA, 22 nt, Streptococcus pneumoniae R6
aaauuauucuuaucuuuggcaa

SEQ ID NO: 4071259 - RNA, 13 nt, Streptococcus pneumoniae R6
aaauuauuucuuu

SEQ ID NO: 4071260 - RNA, 17 nt, Streptococcus pneumoniae R6
aaauuauuucuuuugua

SEQ ID NO: 4071261 - RNA, 21 nt, Streptococcus pneumoniae R6
aaauuauuuugcgcauguaaa

SEQ ID NO: 4071262 - RNA, 22 nt, Streptococcus pneumoniae R6
aaauucaaacucaaauuuacca

SEQ ID NO: 4071263 - RNA, 19 nt, Streptococcus pneumoniae R6
aaauucaaauuaauuucua

SEQ ID NO: 4071264 - RNA, 17 nt, Streptococcus pneumoniae R6
aaauucaauguuuacuc

SEQ ID NO: 4071265 - RNA, 15 nt, Streptococcus pneumoniae R6
aaauucaauucacua

SEQ ID NO: 4071266 - RNA, 18 nt, Streptococcus pneumoniae R6
aaauucacaaaauccuuu

SEQ ID NO: 4071267 - RNA, 14 nt, Streptococcus pneumoniae R6
aaauucaccaacua

SEQ ID NO: 4071268 - RNA, 16 nt, Streptococcus pneumoniae R6
aaauucaccaauuuua

SEQ ID NO: 4071269 - RNA, 21 nt, Streptococcus pneumoniae R6
aaauucaccaauuuuaccuuu

SEQ ID NO: 4071270 - RNA, 17 nt, Streptococcus pneumoniae R6
aaauucaggugauuuac

SEQ ID NO: 4071271 - RNA, 17 nt, Streptococcus pneumoniae R6
aaauuccaaauuagaaa

SEQ ID NO: 4071272 - RNA, 20 nt, Streptococcus pneumoniae R6
aaauuccaaauuagaaaaag

SEQ ID NO: 4071273 - RNA, 16 nt, Streptococcus pneumoniae R6
aaauuccauaccuaaa

SEQ ID NO: 4071274 - RNA, 21 nt, Streptococcus pneumoniae R6
aaauuccaucguuccugucuu

SEQ ID NO: 4071275 - RNA, 13 nt, Streptococcus pneumoniae R6
aaauuccauucga

SEQ ID NO: 4071276 - RNA, 23 nt, Streptococcus pneumoniae R6
aaauucccuuauccacaucauca

SEQ ID NO: 4071277 - RNA, 23 nt, Streptococcus pneumoniae R6
aaauucccuuuuugauuuuaaau

SEQ ID NO: 4071278 - RNA, 14 nt, Streptococcus pneumoniae R6
aaauuccuuaaacu

SEQ ID NO: 4071279 - RNA, 17 nt, Streptococcus pneumoniae R6
aaauuccuuaaacucuu

SEQ ID NO: 4071280 - RNA, 14 nt, Streptococcus pneumoniae R6
aaauuccuuuaaaa

SEQ ID NO: 4071281 - RNA, 15 nt, Streptococcus pneumoniae R6
aaauuccuuuaaaaa

SEQ ID NO: 4071282 - RNA, 19 nt, Streptococcus pneumoniae R6
aaauuccuuuaaaaacaau

SEQ ID NO: 4071283 - RNA, 21 nt, Streptococcus pneumoniae R6
aaauucgcuuuuuuaaaugcu

SEQ ID NO: 4071284 - RNA, 14 nt, Streptococcus pneumoniae R6
aaauucguuucauu

SEQ ID NO: 4071285 - RNA, 16 nt, Streptococcus pneumoniae R6
aaauucguuucauuau

SEQ ID NO: 4071286 - RNA, 18 nt, Streptococcus pneumoniae R6
aaauucuccacagaccug

SEQ ID NO: 4071287 - RNA, 20 nt, Streptococcus pneumoniae R6
aaauucuccacagaccuguc

SEQ ID NO: 4071288 - RNA, 18 nt, Streptococcus pneumoniae R6
aaauucuggcauuuguaa

SEQ ID NO: 4071289 - RNA, 18 nt, Streptococcus pneumoniae R6
aaauucuuaaagccacua

SEQ ID NO: 4071290 - RNA, 10 nt, Streptococcus pneumoniae R6
aaauucuucc

SEQ ID NO: 4071291 - RNA, 18 nt, Streptococcus pneumoniae R6
aaauucuuuagaaaacua

SEQ ID NO: 4071292 - RNA, 19 nt, Streptococcus pneumoniae R6
aaauucuuuagaaaacuag

SEQ ID NO: 4071293 - RNA, 13 nt, Streptococcus pneumoniae R6
aaauugaacuuuu

SEQ ID NO: 4071294 - RNA, 16 nt, Streptococcus pneumoniae R6
aaauugaauaaaguca

SEQ ID NO: 4071295 - RNA, 14 nt, Streptococcus pneumoniae R6
aaauugacuuucuu

SEQ ID NO: 4071296 - RNA, 20 nt, Streptococcus pneumoniae R6
aaauugauaauagcacuuaa

SEQ ID NO: 4071297 - RNA, 22 nt, Streptococcus pneumoniae R6
aaauugauaauagcacuuaaaa

SEQ ID NO: 4071298 - RNA, 23 nt, Streptococcus pneumoniae R6
aaauugauauaaugguuauaucu

SEQ ID NO: 4071299 - RNA, 16 nt, Streptococcus pneumoniae R6
aaauugaucuagcucu

SEQ ID NO: 4071300 - RNA, 19 nt, Streptococcus pneumoniae R6
aaauugauuaggaaauuca

SEQ ID NO: 4071301 - RNA, 13 nt, Streptococcus pneumoniae R6
aaauugauuuaua

SEQ ID NO: 4071302 - RNA, 13 nt, Streptococcus pneumoniae R6
aaauugauuugaa

SEQ ID NO: 4071303 - RNA, 22 nt, Streptococcus pneumoniae R6
aaauugauuugaauuccaaaau

SEQ ID NO: 4071304 - RNA, 17 nt, Streptococcus pneumoniae R6
aaauugcacuuuccucu

SEQ ID NO: 4071305 - RNA, 17 nt, Streptococcus pneumoniae R6
aaauugcgauuuugcca

SEQ ID NO: 4071306 - RNA, 15 nt, Streptococcus pneumoniae R6
aaauugcuggagaau

SEQ ID NO: 4071307 - RNA, 18 nt, Streptococcus pneumoniae R6
aaauuggauauugaguaa

SEQ ID NO: 4071308 - RNA, 16 nt, Streptococcus pneumoniae R6
aaauuggcugcaauaa

SEQ ID NO: 4071309 - RNA, 21 nt, Streptococcus pneumoniae R6
aaauugguuacgauuguugaa

SEQ ID NO: 4071310 - RNA, 15 nt, Streptococcus pneumoniae R6
aaauugguuuaaaua

SEQ ID NO: 4071311 - RNA, 19 nt, Streptococcus pneumoniae R6
aaauugugcaguuuucauu

SEQ ID NO: 4071312 - RNA, 22 nt, Streptococcus pneumoniae R6
aaauugugcaguuuucauucua

SEQ ID NO: 4071313 - RNA, 15 nt, Streptococcus pneumoniae R6
aaauuguuaaaguuc

SEQ ID NO: 4071314 - RNA, 20 nt, Streptococcus pneumoniae R6
aaauuuaaaagauacuaaca

SEQ ID NO: 4071315 - RNA, 11 nt, Streptococcus pneumoniae R6
aaauuuacuua

SEQ ID NO: 4071316 - RNA, 18 nt, Streptococcus pneumoniae R6
aaauuuacuuaaaauugu

SEQ ID NO: 4071317 - RNA, 19 nt, Streptococcus pneumoniae R6
aaauuuauugguauuaaua

SEQ ID NO: 4071318 - RNA, 14 nt, Streptococcus pneumoniae R6
aaauuucauccuca

SEQ ID NO: 4071319 - RNA, 17 nt, Streptococcus pneumoniae R6
aaauuucauuucgacug

SEQ ID NO: 4071320 - RNA, 21 nt, Streptococcus pneumoniae R6
aaauuuccugcaaguuuaugc

SEQ ID NO: 4071321 - RNA, 15 nt, Streptococcus pneumoniae R6
aaauuucgaaaaaug

SEQ ID NO: 4071322 - RNA, 20 nt, Streptococcus pneumoniae R6
aaauuucgauugucaucauc

SEQ ID NO: 4071323 - RNA, 21 nt, Streptococcus pneumoniae R6
aaauuucgauugucaucaucu

SEQ ID NO: 4071324 - RNA, 16 nt, Streptococcus pneumoniae R6
aaauuucuaugauaaa

SEQ ID NO: 4071325 - RNA, 15 nt, Streptococcus pneumoniae R6
aacagcuccauaaca

SEQ ID NO: 4071326 - RNA, 16 nt, Streptococcus pneumoniae R6
aacagcuccauaacaa

SEQ ID NO: 4071327 - RNA, 19 nt, Streptococcus pneumoniae R6
aacagcuccauaacaauag

SEQ ID NO: 4071328 - RNA, 17 nt, Streptococcus pneumoniae R6
aacagcugcgauuuuag

SEQ ID NO: 4071329 - RNA, 14 nt, Streptococcus pneumoniae R6
aacaggauuuuguu

SEQ ID NO: 4071330 - RNA, 17 nt, Streptococcus pneumoniae R6
aacaggauuuuguucuu

SEQ ID NO: 4071331 - RNA, 16 nt, Streptococcus pneumoniae R6
aacaggccaauacaga

SEQ ID NO: 4071332 - RNA, 17 nt, Streptococcus pneumoniae R6
aacagucucaccugcuu

SEQ ID NO: 4071333 - RNA, 20 nt, Streptococcus pneumoniae R6
aacagugcuagaaauugacu

SEQ ID NO: 4071334 - RNA, 22 nt, Streptococcus pneumoniae R6
aacaguguuuugagcaaccugc

SEQ ID NO: 4071335 - RNA, 22 nt, Streptococcus pneumoniae R6
aacaguguuuugaggcugcaga

SEQ ID NO: 4071336 - RNA, 15 nt, Streptococcus pneumoniae R6
aacaguuaguugacc

SEQ ID NO: 4071337 - RNA, 13 nt, Streptococcus pneumoniae R6
aacaguuaugaua

SEQ ID NO: 4071338 - RNA, 18 nt, Streptococcus pneumoniae R6
aacauaaaaaacgaauag

SEQ ID NO: 4071339 - RNA, 13 nt, Streptococcus pneumoniae R6
aacauaaaugaug

SEQ ID NO: 4071340 - RNA, 23 nt, Streptococcus pneumoniae R6
aacauaaguuguaguacugaaca

SEQ ID NO: 4071341 - RNA, 13 nt, Streptococcus pneumoniae R6
aacauaauuuuag

SEQ ID NO: 4071342 - RNA, 14 nt, Streptococcus pneumoniae R6
aacauacugugcca

SEQ ID NO: 4071343 - RNA, 20 nt, Streptococcus pneumoniae R6
aacauacugugccagccaua

SEQ ID NO: 4071344 - RNA, 15 nt, Streptococcus pneumoniae R6
aacauagauccaagc

SEQ ID NO: 4071345 - RNA, 16 nt, Streptococcus pneumoniae R6
aacauagcagauaggu

SEQ ID NO: 4071346 - RNA, 20 nt, Streptococcus pneumoniae R6
aacauagcagauaggugggg

SEQ ID NO: 4071347 - RNA, 20 nt, Streptococcus pneumoniae R6
aacauauuucuagaaauuaa

SEQ ID NO: 4071348 - RNA, 18 nt, Streptococcus pneumoniae R6
aacauauuuucaaaacug

SEQ ID NO: 4071349 - RNA, 17 nt, Streptococcus pneumoniae R6
aacaucagaaaacgcau

SEQ ID NO: 4071350 - RNA, 12 nt, Streptococcus pneumoniae R6
aacaucaucugc

SEQ ID NO: 4071351 - RNA, 14 nt, Streptococcus pneumoniae R6
aacaucaucugcau

SEQ ID NO: 4071352 - RNA, 20 nt, Streptococcus pneumoniae R6
aacauccauaccgccaauca

SEQ ID NO: 4071353 - RNA, 11 nt, Streptococcus pneumoniae R6
aacauccauuc

SEQ ID NO: 4071354 - RNA, 16 nt, Streptococcus pneumoniae R6
aacaucgaaguugugu

SEQ ID NO: 4071355 - RNA, 16 nt, Streptococcus pneumoniae R6
aacaucuccaacugca

SEQ ID NO: 4071356 - RNA, 17 nt, Streptococcus pneumoniae R6
aacaucucuaucaggaa

SEQ ID NO: 4071357 - RNA, 21 nt, Streptococcus pneumoniae R6
aacaucucuuguuuaagagca

SEQ ID NO: 4071358 - RNA, 19 nt, Streptococcus pneumoniae R6
aacaucuuuugauagauga

SEQ ID NO: 4071359 - RNA, 18 nt, Streptococcus pneumoniae R6
aacaugaaccucuucauu

SEQ ID NO: 4071360 - RNA, 16 nt, Streptococcus pneumoniae R6
aacauggcuuccagga

SEQ ID NO: 4071361 - RNA, 23 nt, Streptococcus pneumoniae R6
aacaugguuuugagguuguagau

SEQ ID NO: 4071362 - RNA, 18 nt, Streptococcus pneumoniae R6
aacauuauccaugaaaaa

SEQ ID NO: 4071363 - RNA, 22 nt, Streptococcus pneumoniae R6
aacauucccacaauaaaacgca

SEQ ID NO: 4071364 - RNA, 9 nt, Streptococcus pneumoniae R6
aacauucuc

SEQ ID NO: 4071365 - RNA, 14 nt, Streptococcus pneumoniae R6
aacauucuuacaaa

SEQ ID NO: 4071366 - RNA, 20 nt, Streptococcus pneumoniae R6
aacauugacuugcuguuuuc

SEQ ID NO: 4071367 - RNA, 13 nt, Streptococcus pneumoniae R6
aacauugugagaa

SEQ ID NO: 4071368 - RNA, 20 nt, Streptococcus pneumoniae R6
aacauuuaucuauaaacaaa

SEQ ID NO: 4071369 - RNA, 22 nt, Streptococcus pneumoniae R6
aacauuucggauuuuaaaaugc

SEQ ID NO: 4071370 - RNA, 23 nt, Streptococcus pneumoniae R6
aacauuucuauaaaucaauuuuc

SEQ ID NO: 4071371 - RNA, 16 nt, Streptococcus pneumoniae R6
aacauuugauuuugua

SEQ ID NO: 4071372 - RNA, 19 nt, Streptococcus pneumoniae R6
aacauuugauuuuguaaaa

SEQ ID NO: 4071373 - RNA, 22 nt, Streptococcus pneumoniae R6
aacauuugauuuuguaaaaaua

SEQ ID NO: 4071374 - RNA, 16 nt, Streptococcus pneumoniae R6
aacauuuuccagauug

SEQ ID NO: 4071375 - RNA, 18 nt, Streptococcus pneumoniae R6
aaccaaaaaguggaaaga

SEQ ID NO: 4071376 - RNA, 23 nt, Streptococcus pneumoniae R6
aaccaaaaucauacuuggagaac

SEQ ID NO: 4071377 - RNA, 14 nt, Streptococcus pneumoniae R6
aaccaaaggaagcu

SEQ ID NO: 4071378 - RNA, 15 nt, Streptococcus pneumoniae R6
aaccaacauagcuaa

SEQ ID NO: 4071379 - RNA, 18 nt, Streptococcus pneumoniae R6
aaccaacguuuugugaaa

SEQ ID NO: 4071380 - RNA, 14 nt, Streptococcus pneumoniae R6
aaccaacuucuuuu

SEQ ID NO: 4071381 - RNA, 16 nt, Streptococcus pneumoniae R6
aaccaacuucuuuuuu

SEQ ID NO: 4071382 - RNA, 14 nt, Streptococcus pneumoniae R6
aaccaacuuuugaa

SEQ ID NO: 4071383 - RNA, 15 nt, Streptococcus pneumoniae R6
aaccaacuuuugaau

SEQ ID NO: 4071384 - RNA, 16 nt, Streptococcus pneumoniae R6
aaccaacuuuugaaug

SEQ ID NO: 4071385 - RNA, 21 nt, Streptococcus pneumoniae R6
aaccaagaucuugucugcaug

SEQ ID NO: 4071386 - RNA, 20 nt, Streptococcus pneumoniae R6
aaccaagcaaggucaaaaug

SEQ ID NO: 4071387 - RNA, 12 nt, Streptococcus pneumoniae R6
aaccaagcuagg

SEQ ID NO: 4071388 - RNA, 15 nt, Streptococcus pneumoniae R6
aaccaagucugcaug

SEQ ID NO: 4071389 - RNA, 20 nt, Streptococcus pneumoniae R6
aaccaaguuuguaucuuccu

SEQ ID NO: 4071390 - RNA, 14 nt, Streptococcus pneumoniae R6
aaccaauaauaaaa

SEQ ID NO: 4071391 - RNA, 21 nt, Streptococcus pneumoniae R6
aaccaauagccgcaaacuugg

SEQ ID NO: 4071392 - RNA, 20 nt, Streptococcus pneumoniae R6
aaccaaucagacuauaauau

SEQ ID NO: 4071393 - RNA, 21 nt, Streptococcus pneumoniae R6
aaccaaucagacuauaauaua

SEQ ID NO: 4071394 - RNA, 13 nt, Streptococcus pneumoniae R6
aaccaauuucuaa

SEQ ID NO: 4071395 - RNA, 21 nt, Streptococcus pneumoniae R6
aaccaauuucuuaauagcuga

SEQ ID NO: 4071396 - RNA, 12 nt, Streptococcus pneumoniae R6
aaccacaaaaaa

SEQ ID NO: 4071397 - RNA, 14 nt, Streptococcus pneumoniae R6
aaccacaaaaaagc

SEQ ID NO: 4071398 - RNA, 16 nt, Streptococcus pneumoniae R6
aaccacaacaaaaaag

SEQ ID NO: 4071399 - RNA, 16 nt, Streptococcus pneumoniae R6
aaccaccugagcuacg

SEQ ID NO: 4071400 - RNA, 17 nt, Streptococcus pneumoniae R6
aaccacgguaaaauacu

SEQ ID NO: 4071401 - RNA, 18 nt, Streptococcus pneumoniae R6
aaccacuuaacaacugau

SEQ ID NO: 4071402 - RNA, 15 nt, Streptococcus pneumoniae R6
aaccagacauagaga

SEQ ID NO: 4071403 - RNA, 15 nt, Streptococcus pneumoniae R6
aaccagaucuuagaa

SEQ ID NO: 4071404 - RNA, 18 nt, Streptococcus pneumoniae R6
aaccagaucuuagaagca

SEQ ID NO: 4071405 - RNA, 18 nt, Streptococcus pneumoniae R6
aaccagccuguuuucaua

SEQ ID NO: 4071406 - RNA, 20 nt, Streptococcus pneumoniae R6
aaccagcuaccagaccaagu

SEQ ID NO: 4071407 - RNA, 22 nt, Streptococcus pneumoniae R6
aaccagcugcguaguagauugg

SEQ ID NO: 4071408 - RNA, 12 nt, Streptococcus pneumoniae R6
aaccaggaaacc

SEQ ID NO: 4071409 - RNA, 17 nt, Streptococcus pneumoniae R6
aaccaggaaaccagcug

SEQ ID NO: 4071410 - RNA, 15 nt, Streptococcus pneumoniae R6
aaccaggucaucugc

SEQ ID NO: 4071411 - RNA, 14 nt, Streptococcus pneumoniae R6
aaccaguccuggaa

SEQ ID NO: 4071412 - RNA, 17 nt, Streptococcus pneumoniae R6
aaccaguccuggaaaaa

SEQ ID NO: 4071413 - RNA, 21 nt, Streptococcus pneumoniae R6
aaccaguccuugaaaaacgug

SEQ ID NO: 4071414 - RNA, 22 nt, Streptococcus pneumoniae R6
aaccaucuguaccgaccuuguc

SEQ ID NO: 4071415 - RNA, 20 nt, Streptococcus pneumoniae R6
aaccaucuucauuuugguaa

SEQ ID NO: 4071416 - RNA, 13 nt, Streptococcus pneumoniae R6
aaccauguuuuga

SEQ ID NO: 4071417 - RNA, 22 nt, Streptococcus pneumoniae R6
aaccauguuuugagcugacuuc

SEQ ID NO: 4071418 - RNA, 15 nt, Streptococcus pneumoniae R6
aaccauucaaaauac

SEQ ID NO: 4071419 - RNA, 19 nt, Streptococcus pneumoniae R6
aacccaccaagucaucaaa

SEQ ID NO: 4071420 - RNA, 18 nt, Streptococcus pneumoniae R6
aacccgcgcaauuaagca

SEQ ID NO: 4071421 - RNA, 18 nt, Streptococcus pneumoniae R6
aacccuaagugucuggaa

SEQ ID NO: 4071422 - RNA, 13 nt, Streptococcus pneumoniae R6
aacccuguuuuau

SEQ ID NO: 4071423 - RNA, 22 nt, Streptococcus pneumoniae R6
aacccuucuuuuuauaggcucu

SEQ ID NO: 4071424 - RNA, 17 nt, Streptococcus pneumoniae R6
aacccuugauacuaugc

SEQ ID NO: 4071425 - RNA, 18 nt, Streptococcus pneumoniae R6
aaccgaaaaucuccucua

SEQ ID NO: 4071426 - RNA, 18 nt, Streptococcus pneumoniae R6
aaccgauuuaagauaagu

SEQ ID NO: 4071427 - RNA, 23 nt, Streptococcus pneumoniae R6
aaccguaugauucguuugaagcu

SEQ ID NO: 4071428 - RNA, 18 nt, Streptococcus pneumoniae R6
aacucaaauuucccauca

SEQ ID NO: 4071429 - RNA, 17 nt, Streptococcus pneumoniae R6
aacucaauuaagaaauu

SEQ ID NO: 4071430 - RNA, 13 nt, Streptococcus pneumoniae R6
aacucagaccgau

SEQ ID NO: 4071431 - RNA, 15 nt, Streptococcus pneumoniae R6
aacucaguuaaaauc

SEQ ID NO: 4071432 - RNA, 17 nt, Streptococcus pneumoniae R6
aacucauaauagucucu

SEQ ID NO: 4071433 - RNA, 14 nt, Streptococcus pneumoniae R6
aacucauagcagau

SEQ ID NO: 4071434 - RNA, 16 nt, Streptococcus pneumoniae R6
aacucauagcagauaa

SEQ ID NO: 4071435 - RNA, 18 nt, Streptococcus pneumoniae R6
aacucaucaaaggucucu

SEQ ID NO: 4071436 - RNA, 16 nt, Streptococcus pneumoniae R6
aacucaucuuggucag

SEQ ID NO: 4071437 - RNA, 21 nt, Streptococcus pneumoniae R6
aacuccaaacgcgauacaaua

SEQ ID NO: 4071438 - RNA, 19 nt, Streptococcus pneumoniae R6
aacuccagauuaucuuccu

SEQ ID NO: 4071439 - RNA, 21 nt, Streptococcus pneumoniae R6
aacuccagugaaaacaggagu

SEQ ID NO: 4071440 - RNA, 19 nt, Streptococcus pneumoniae R6
aacucccugaugauucaag

SEQ ID NO: 4071441 - RNA, 19 nt, Streptococcus pneumoniae R6
aacucccuguuccaaagaa

SEQ ID NO: 4071442 - RNA, 17 nt, Streptococcus pneumoniae R6
aacuccucucuccuccc

SEQ ID NO: 4071443 - RNA, 22 nt, Streptococcus pneumoniae R6
aacucgggcugaauauauucuc

SEQ ID NO: 4071444 - RNA, 14 nt, Streptococcus pneumoniae R6
aacucuagcuagcu

SEQ ID NO: 4071445 - RNA, 14 nt, Streptococcus pneumoniae R6
aacucuagcuuuuu

SEQ ID NO: 4071446 - RNA, 23 nt, Streptococcus pneumoniae R6
aacucuagcuuuuuaauuuugag

SEQ ID NO: 4071447 - RNA, 14 nt, Streptococcus pneumoniae R6
aacucucauuaaaa

SEQ ID NO: 4071448 - RNA, 15 nt, Streptococcus pneumoniae R6
aacucucauuaaaac

SEQ ID NO: 4071449 - RNA, 15 nt, Streptococcus pneumoniae R6
aacucuccaauauca

SEQ ID NO: 4071450 - RNA, 22 nt, Streptococcus pneumoniae R6
aacucuccaauaucaucgauuu

SEQ ID NO: 4071451 - RNA, 17 nt, Streptococcus pneumoniae R6
aacucugcacguguaau

SEQ ID NO: 4071452 - RNA, 19 nt, Streptococcus pneumoniae R6
aacucugcacguguaauga

SEQ ID NO: 4071453 - RNA, 21 nt, Streptococcus pneumoniae R6
aacucugcacguguaaugaca

SEQ ID NO: 4071454 - RNA, 16 nt, Streptococcus pneumoniae R6
aacucuggguguuucu

SEQ ID NO: 4071455 - RNA, 19 nt, Streptococcus pneumoniae R6
aacucuguaaucucuagcc

SEQ ID NO: 4071456 - RNA, 13 nt, Streptococcus pneumoniae R6
aacucuuacaaaa

SEQ ID NO: 4071457 - RNA, 23 nt, Streptococcus pneumoniae R6
aacucuucuuuuggcaauaaaaa

SEQ ID NO: 4071458 - RNA, 14 nt, Streptococcus pneumoniae R6
aacucuugaaauau

SEQ ID NO: 4071459 - RNA, 17 nt, Streptococcus pneumoniae R6
aacucuuguccuaaaua

SEQ ID NO: 4071460 - RNA, 21 nt, Streptococcus pneumoniae R6
aacugacgaagucagcucaaa

SEQ ID NO: 4071461 - RNA, 23 nt, Streptococcus pneumoniae R6
aacugacgaagucaguaaccaua

SEQ ID NO: 4071462 - RNA, 18 nt, Streptococcus pneumoniae R6
aacugccccccaaaaguu

SEQ ID NO: 4071463 - RNA, 15 nt, Streptococcus pneumoniae R6
aacugcguuuugauu

SEQ ID NO: 4071464 - RNA, 21 nt, Streptococcus pneumoniae R6
aacugcuaaaagauuucuaua

SEQ ID NO: 4071465 - RNA, 20 nt, Streptococcus pneumoniae R6
aacugcugcuuggaaggaag

SEQ ID NO: 4071466 - RNA, 21 nt, Streptococcus pneumoniae R6
aacugcugcuuggaaggaagc

SEQ ID NO: 4071467 - RNA, 18 nt, Streptococcus pneumoniae R6
aacuggaccaaguuuaag

SEQ ID NO: 4071468 - RNA, 12 nt, Streptococcus pneumoniae R6
aacuggagacuu

SEQ ID NO: 4071469 - RNA, 15 nt, Streptococcus pneumoniae R6
aacuggguugaagau

SEQ ID NO: 4071470 - RNA, 13 nt, Streptococcus pneumoniae R6
aacugguccagag

SEQ ID NO: 4071471 - RNA, 16 nt, Streptococcus pneumoniae R6
aacugguccagagaua

SEQ ID NO: 4071472 - RNA, 15 nt, Streptococcus pneumoniae R6
aacuguaaaguagca

SEQ ID NO: 4071473 - RNA, 19 nt, Streptococcus pneumoniae R6
aacuguaaaguagcaaaac

SEQ ID NO: 4071474 - RNA, 21 nt, Streptococcus pneumoniae R6
aacuguaaaguagcaaaacac

SEQ ID NO: 4071475 - RNA, 11 nt, Streptococcus pneumoniae R6
aacuguagugg

SEQ ID NO: 4071476 - RNA, 20 nt, Streptococcus pneumoniae R6
aacuguaguggguugaagaa

SEQ ID NO: 4071477 - RNA, 21 nt, Streptococcus pneumoniae R6
aacuguaguggguugaagaaa

SEQ ID NO: 4071478 - RNA, 22 nt, Streptococcus pneumoniae R6
aacuguaguggguugaagucag

SEQ ID NO: 4071479 - RNA, 14 nt, Streptococcus pneumoniae R6
aacuguaugagaaa

SEQ ID NO: 4071480 - RNA, 16 nt, Streptococcus pneumoniae R6
aacuguccacaaagau

SEQ ID NO: 4071481 - RNA, 14 nt, Streptococcus pneumoniae R6
aacuguggaaaaua

SEQ ID NO: 4071482 - RNA, 16 nt, Streptococcus pneumoniae R6
aacuuacgagcacgag

SEQ ID NO: 4071483 - RNA, 13 nt, Streptococcus pneumoniae R6
aacuuaggaagca

SEQ ID NO: 4071484 - RNA, 21 nt, Streptococcus pneumoniae R6
aacuuaggaagcaguccaagg

SEQ ID NO: 4071485 - RNA, 18 nt, Streptococcus pneumoniae R6
aacuuagguuaucguaac

SEQ ID NO: 4071486 - RNA, 23 nt, Streptococcus pneumoniae R6
aacuuaguaaacagucccauaaa

SEQ ID NO: 4071487 - RNA, 21 nt, Streptococcus pneumoniae R6
aacuuauccgaacccuguuuu

SEQ ID NO: 4071488 - RNA, 22 nt, Streptococcus pneumoniae R6
aacuuaucuagggcauuaauca

SEQ ID NO: 4071489 - RNA, 16 nt, Streptococcus pneumoniae R6
aacuuaugagcuaggu

SEQ ID NO: 4071490 - RNA, 12 nt, Streptococcus pneumoniae R6
aacuucaacauu

SEQ ID NO: 4071491 - RNA, 19 nt, Streptococcus pneumoniae R6
aacuucacuaguauucauc

SEQ ID NO: 4071492 - RNA, 13 nt, Streptococcus pneumoniae R6
aacuucauuauag

SEQ ID NO: 4071493 - RNA, 23 nt, Streptococcus pneumoniae R6
aacuuccaagcgaugauauccug

SEQ ID NO: 4071494 - RNA, 15 nt, Streptococcus pneumoniae R6
aacuuccauguugua

SEQ ID NO: 4071495 - RNA, 12 nt, Streptococcus pneumoniae R6
aacuucuaucac

SEQ ID NO: 4071496 - RNA, 22 nt, Streptococcus pneumoniae R6
aacuucuugaccaacuuuaaga

SEQ ID NO: 4071497 - RNA, 16 nt, Streptococcus pneumoniae R6
aacuucuuuuugauuu

SEQ ID NO: 4071498 - RNA, 22 nt, Streptococcus pneumoniae R6
aacuucuuuuuuugauauuuau

SEQ ID NO: 4071499 - RNA, 22 nt, Streptococcus pneumoniae R6
aacuugaaaauaccaaguucau

SEQ ID NO: 4071500 - RNA, 20 nt, Streptococcus pneumoniae R6
aacuugaagcaaaucaacug

SEQ ID NO: 4071501 - RNA, 24 nt, Streptococcus pneumoniae R6
aacuugaagcaaaucaacuggcau

SEQ ID NO: 4071502 - RNA, 18 nt, Streptococcus pneumoniae R6
aacuugaauccuucguaa

SEQ ID NO: 4071503 - RNA, 21 nt, Streptococcus pneumoniae R6
aacuugaauccuucguaaaua

SEQ ID NO: 4071504 - RNA, 12 nt, Streptococcus pneumoniae R6
aacuugauacua

SEQ ID NO: 4071505 - RNA, 14 nt, Streptococcus pneumoniae R6
aacuugcucagagg

SEQ ID NO: 4071506 - RNA, 20 nt, Streptococcus pneumoniae R6
aacuugguaauuugaacaaa

SEQ ID NO: 4071507 - RNA, 17 nt, Streptococcus pneumoniae R6
aacuuguaagucaaguc

SEQ ID NO: 4071508 - RNA, 16 nt, Streptococcus pneumoniae R6
aacuugugauuuagua

SEQ ID NO: 4071509 - RNA, 20 nt, Streptococcus pneumoniae R6
aacuuguuuacguuuuaaaa

SEQ ID NO: 4071510 - RNA, 13 nt, Streptococcus pneumoniae R6
aacuuuaccaaaa

SEQ ID NO: 4071511 - RNA, 16 nt, Streptococcus pneumoniae R6
aacuuuaccaaaaccu

SEQ ID NO: 4071512 - RNA, 17 nt, Streptococcus pneumoniae R6
aacuuucuuuuuuucca

SEQ ID NO: 4071513 - RNA, 15 nt, Streptococcus pneumoniae R6
aacuuugguuauaaa

SEQ ID NO: 4071514 - RNA, 22 nt, Streptococcus pneumoniae R6
aacuuugguuauaaaaaacaaa

SEQ ID NO: 4071515 - RNA, 15 nt, Streptococcus pneumoniae R6
aacuuuuccaguaau

SEQ ID NO: 4071516 - RNA, 17 nt, Streptococcus pneumoniae R6
aacuuuuuaaguuuuuu

SEQ ID NO: 4071517 - RNA, 16 nt, Streptococcus pneumoniae R6
aacuuuuuaguuuuug

SEQ ID NO: 4071518 - RNA, 13 nt, Streptococcus pneumoniae R6
aagaaaaacucuu

SEQ ID NO: 4071519 - RNA, 13 nt, Streptococcus pneumoniae R6
aagaaaaagaagg

SEQ ID NO: 4071520 - RNA, 23 nt, Streptococcus pneumoniae R6
aagaaaaaguguuugauaucuau

SEQ ID NO: 4071521 - RNA, 18 nt, Streptococcus pneumoniae R6
aagaaaacuugauacuau

SEQ ID NO: 4071522 - RNA, 18 nt, Streptococcus pneumoniae R6
aagaaaagugcaaauaag

SEQ ID NO: 4071523 - RNA, 16 nt, Streptococcus pneumoniae R6
aagaaacaacaaugga

SEQ ID NO: 4071524 - RNA, 19 nt, Streptococcus pneumoniae R6
aagaaacaacaauggaaau

SEQ ID NO: 4071525 - RNA, 17 nt, Streptococcus pneumoniae R6
aagaaaccaaucagacu

SEQ ID NO: 4071526 - RNA, 19 nt, Streptococcus pneumoniae R6
aagaaacucuaaacaaacu

SEQ ID NO: 4071527 - RNA, 17 nt, Streptococcus pneumoniae R6
aagaaagaccauagcaa

SEQ ID NO: 4071528 - RNA, 24 nt, Streptococcus pneumoniae R6
aagaaagaccauagcaaaggugca

SEQ ID NO: 4071529 - RNA, 14 nt, Streptococcus pneumoniae R6
aagaaagagaauaa

SEQ ID NO: 4071530 - RNA, 16 nt, Streptococcus pneumoniae R6
aagagaauaacagcca

SEQ ID NO: 4071531 - RNA, 18 nt, Streptococcus pneumoniae R6
aagagaauuaagauaaaa

SEQ ID NO: 4071532 - RNA, 16 nt, Streptococcus pneumoniae R6
aagagacucuuuaaga

SEQ ID NO: 4071533 - RNA, 16 nt, Streptococcus pneumoniae R6
aagagaggaucagacu

SEQ ID NO: 4071534 - RNA, 22 nt, Streptococcus pneumoniae R6
aagagauguugacuuaaugaau

SEQ ID NO: 4071535 - RNA, 21 nt, Streptococcus pneumoniae R6
aagagauugcccaucauuccu

SEQ ID NO: 4071536 - RNA, 16 nt, Streptococcus pneumoniae R6
aagagauuugacauaa

SEQ ID NO: 4071537 - RNA, 17 nt, Streptococcus pneumoniae R6
aagagauuuucaaagag

SEQ ID NO: 4071538 - RNA, 23 nt, Streptococcus pneumoniae R6
aagagauuuucgaagaguauaaa

SEQ ID NO: 4071539 - RNA, 23 nt, Streptococcus pneumoniae R6
aagagauuuucuaagaguauaaa

SEQ ID NO: 4071540 - RNA, 16 nt, Streptococcus pneumoniae R6
aagagcaaaaacaauu

SEQ ID NO: 4071541 - RNA, 15 nt, Streptococcus pneumoniae R6
aagagcaaacuagga

SEQ ID NO: 4071542 - RNA, 14 nt, Streptococcus pneumoniae R6
aagagcaucugccg

SEQ ID NO: 4071543 - RNA, 15 nt, Streptococcus pneumoniae R6
aagagccaaaaaaga

SEQ ID NO: 4071544 - RNA, 17 nt, Streptococcus pneumoniae R6
aagagccacucuuuauu

SEQ ID NO: 4071545 - RNA, 19 nt, Streptococcus pneumoniae R6
aagagccagaaaaaucccu

SEQ ID NO: 4071546 - RNA, 18 nt, Streptococcus pneumoniae R6
aagagccuuuuuaaagau

SEQ ID NO: 4071547 - RNA, 20 nt, Streptococcus pneumoniae R6
aagagccuuuuuaaagauau

SEQ ID NO: 4071548 - RNA, 14 nt, Streptococcus pneumoniae R6
aagagcuucuuuug

SEQ ID NO: 4071549 - RNA, 23 nt, Streptococcus pneumoniae R6
aagagcuugguaagagucacugu

SEQ ID NO: 4071550 - RNA, 13 nt, Streptococcus pneumoniae R6
aagaggagguaaa

SEQ ID NO: 4071551 - RNA, 13 nt, Streptococcus pneumoniae R6
aagaggaguagga

SEQ ID NO: 4071552 - RNA, 15 nt, Streptococcus pneumoniae R6
aagaggagugauaau

SEQ ID NO: 4071553 - RNA, 21 nt, Streptococcus pneumoniae R6
aagagggauucuuauauuaaa

SEQ ID NO: 4071554 - RNA, 15 nt, Streptococcus pneumoniae R6
aagagggauuuugua

SEQ ID NO: 4071555 - RNA, 21 nt, Streptococcus pneumoniae R6
aagagggcuucuucaacagcu

SEQ ID NO: 4071556 - RNA, 14 nt, Streptococcus pneumoniae R6
aagagguaaggauu

SEQ ID NO: 4071557 - RNA, 18 nt, Streptococcus pneumoniae R6
aagaggugcgagccucuu

SEQ ID NO: 4071558 - RNA, 16 nt, Streptococcus pneumoniae R6
aagagguugggcaauc

SEQ ID NO: 4071559 - RNA, 14 nt, Streptococcus pneumoniae R6
aagaguaaacuaga

SEQ ID NO: 4071560 - RNA, 15 nt, Streptococcus pneumoniae R6
aagaguaaacuagaa

SEQ ID NO: 4071561 - RNA, 16 nt, Streptococcus pneumoniae R6
aagaguacagucuuug

SEQ ID NO: 4071562 - RNA, 17 nt, Streptococcus pneumoniae R6
aagaguacagucuuugc

SEQ ID NO: 4071563 - RNA, 16 nt, Streptococcus pneumoniae R6
aagaguagagagaaag

SEQ ID NO: 4071564 - RNA, 13 nt, Streptococcus pneumoniae R6
aagaguaggcugu

SEQ ID NO: 4071565 - RNA, 16 nt, Streptococcus pneumoniae R6
aagaguauaaaaucaa

SEQ ID NO: 4071566 - RNA, 20 nt, Streptococcus pneumoniae R6
aagaguauaaaaucaaauuu

SEQ ID NO: 4071567 - RNA, 17 nt, Streptococcus pneumoniae R6
aagaguauaagucuuug

SEQ ID NO: 4071568 - RNA, 21 nt, Streptococcus pneumoniae R6
aagaguauuagccuuccauau

SEQ ID NO: 4071569 - RNA, 14 nt, Streptococcus pneumoniae R6
aagagucaagacaa

SEQ ID NO: 4071570 - RNA, 19 nt, Streptococcus pneumoniae R6
aagagucagacuuggaaca

SEQ ID NO: 4071571 - RNA, 18 nt, Streptococcus pneumoniae R6
aagagucccuuagaaaaa

SEQ ID NO: 4071572 - RNA, 21 nt, Streptococcus pneumoniae R6
aagagucccuuagaaaaacga

SEQ ID NO: 4071573 - RNA, 18 nt, Streptococcus pneumoniae R6
aagagucgaggaaauccc

SEQ ID NO: 4071574 - RNA, 17 nt, Streptococcus pneumoniae R6
aagagucuccucaaaaa

SEQ ID NO: 4071575 - RNA, 21 nt, Streptococcus pneumoniae R6
aagagucuccucaaaaacagg

SEQ ID NO: 4071576 - RNA, 22 nt, Streptococcus pneumoniae R6
aagaguuaauggccaccuucaa

SEQ ID NO: 4071577 - RNA, 23 nt, Streptococcus pneumoniae R6
aagaguugcuugucaucuuccaa

SEQ ID NO: 4071578 - RNA, 17 nt, Streptococcus pneumoniae R6
aagaguugggcagaagu

SEQ ID NO: 4071579 - RNA, 17 nt, Streptococcus pneumoniae R6
aagaguugguagguaua

SEQ ID NO: 4071580 - RNA, 13 nt, Streptococcus pneumoniae R6
aagaguuucauga

SEQ ID NO: 4071581 - RNA, 16 nt, Streptococcus pneumoniae R6
aagaguuuucugauuu

SEQ ID NO: 4071582 - RNA, 20 nt, Streptococcus pneumoniae R6
aagauaacugcuagaaaugc

SEQ ID NO: 4071583 - RNA, 20 nt, Streptococcus pneumoniae R6
aagauaaggccugauaagau

SEQ ID NO: 4071584 - RNA, 23 nt, Streptococcus pneumoniae R6
aagauaaggccugauaagaugac

SEQ ID NO: 4071585 - RNA, 23 nt, Streptococcus pneumoniae R6
aagauaagguucaaaaaaugccu

SEQ ID NO: 4071586 - RNA, 16 nt, Streptococcus pneumoniae R6
aagauaauaaauaguu

SEQ ID NO: 4071587 - RNA, 23 nt, Streptococcus pneumoniae R6
aagauaauagcgaugaagagaga

SEQ ID NO: 4071588 - RNA, 13 nt, Streptococcus pneumoniae R6
aagauaaucaucu

SEQ ID NO: 4071589 - RNA, 19 nt, Streptococcus pneumoniae R6
aagauaaucgcaagguaga

SEQ ID NO: 4071590 - RNA, 18 nt, Streptococcus pneumoniae R6
aagauacaaauuuauacu

SEQ ID NO: 4071591 - RNA, 14 nt, Streptococcus pneumoniae R6
aagauacccacaaa

SEQ ID NO: 4071592 - RNA, 15 nt, Streptococcus pneumoniae R6
aagauacugaaucaa

SEQ ID NO: 4071593 - RNA, 13 nt, Streptococcus pneumoniae R6
aagauagaaucca

SEQ ID NO: 4071594 - RNA, 23 nt, Streptococcus pneumoniae R6
aagauagagaaagaaaaacugcu

SEQ ID NO: 4071595 - RNA, 23 nt, Streptococcus pneumoniae R6
aagauagagagcuccaaagaaga

SEQ ID NO: 4071596 - RNA, 22 nt, Streptococcus pneumoniae R6
aagauagcugugaagcguucca

SEQ ID NO: 4071597 - RNA, 19 nt, Streptococcus pneumoniae R6
aagauaggaaucccuggag

SEQ ID NO: 4071598 - RNA, 22 nt, Streptococcus pneumoniae R6
aagauaggcgcaaauccgaaaa

SEQ ID NO: 4071599 - RNA, 12 nt, Streptococcus pneumoniae R6
aagauaguaaag

SEQ ID NO: 4071600 - RNA, 20 nt, Streptococcus pneumoniae R6
aagauaguaaaggacaccag

SEQ ID NO: 4071601 - RNA, 19 nt, Streptococcus pneumoniae R6
aagauagucgauaaaaagg

SEQ ID NO: 4071602 - RNA, 18 nt, Streptococcus pneumoniae R6
aagauauacuaaaagcga

SEQ ID NO: 4071603 - RNA, 20 nt, Streptococcus pneumoniae R6
aagauauagcauacugaauu

SEQ ID NO: 4071604 - RNA, 13 nt, Streptococcus pneumoniae R6
aagauaucacuca

SEQ ID NO: 4071605 - RNA, 17 nt, Streptococcus pneumoniae R6
aagauaugaacaaaucg

SEQ ID NO: 4071606 - RNA, 13 nt, Streptococcus pneumoniae R6
aagauauuaagaa

SEQ ID NO: 4071607 - RNA, 21 nt, Streptococcus pneumoniae R6
aagauauugccgauaucacca

SEQ ID NO: 4071608 - RNA, 11 nt, Streptococcus pneumoniae R6
aagaucaaguu

SEQ ID NO: 4071609 - RNA, 13 nt, Streptococcus pneumoniae R6
aagaucaguucau

SEQ ID NO: 4071610 - RNA, 16 nt, Streptococcus pneumoniae R6
aagauccaauccuuuu

SEQ ID NO: 4071611 - RNA, 21 nt, Streptococcus pneumoniae R6
aagauccaguacuuuuucuau

SEQ ID NO: 4071612 - RNA, 17 nt, Streptococcus pneumoniae R6
aagaucuagaaaggaca

SEQ ID NO: 4071613 - RNA, 15 nt, Streptococcus pneumoniae R6
aagaugacaucuaaa

SEQ ID NO: 4071614 - RNA, 15 nt, Streptococcus pneumoniae R6
aagaugaccuuaucu

SEQ ID NO: 4071615 - RNA, 18 nt, Streptococcus pneumoniae R6
aagaugaugauaacgaau

SEQ ID NO: 4071616 - RNA, 19 nt, Streptococcus pneumoniae R6
aagauggaguguucuaaaa

SEQ ID NO: 4071617 - RNA, 13 nt, Streptococcus pneumoniae R6
aagauguaaaagu

SEQ ID NO: 4071618 - RNA, 17 nt, Streptococcus pneumoniae R6
aagauguaaaaguuuau

SEQ ID NO: 4071619 - RNA, 22 nt, Streptococcus pneumoniae R6
aagauguauaauggauugaaau

SEQ ID NO: 4071620 - RNA, 16 nt, Streptococcus pneumoniae R6
aagauguuagaaaaag

SEQ ID NO: 4071621 - RNA, 20 nt, Streptococcus pneumoniae R6
aagauuaaucuucaaauuuu

SEQ ID NO: 4071622 - RNA, 14 nt, Streptococcus pneumoniae R6
aagauuaggagaau

SEQ ID NO: 4071623 - RNA, 17 nt, Streptococcus pneumoniae R6
aagauucaacaucacuu

SEQ ID NO: 4071624 - RNA, 23 nt, Streptococcus pneumoniae R6
aagauuccacguuucuaauaauu

SEQ ID NO: 4071625 - RNA, 19 nt, Streptococcus pneumoniae R6
aagauuccuccgagaagua

SEQ ID NO: 4071626 - RNA, 14 nt, Streptococcus pneumoniae R6
aagauucuucuggu

SEQ ID NO: 4071627 - RNA, 21 nt, Streptococcus pneumoniae R6
aagauuuacuucuuuuucucc

SEQ ID NO: 4071628 - RNA, 14 nt, Streptococcus pneumoniae R6
aagauuuccugauu

SEQ ID NO: 4071629 - RNA, 13 nt, Streptococcus pneumoniae R6
aagauuucuauaa

SEQ ID NO: 4071630 - RNA, 14 nt, Streptococcus pneumoniae R6
aagauuucuuucau

SEQ ID NO: 4071631 - RNA, 16 nt, Streptococcus pneumoniae R6
aagauuugaaacuaaa

SEQ ID NO: 4071632 - RNA, 16 nt, Streptococcus pneumoniae R6
aaguauuaaaauaagu

SEQ ID NO: 4071633 - RNA, 19 nt, Streptococcus pneumoniae R6
aaguauuaaaauaaguuca

SEQ ID NO: 4071634 - RNA, 14 nt, Streptococcus pneumoniae R6
aaguauuauaauau

SEQ ID NO: 4071635 - RNA, 14 nt, Streptococcus pneumoniae R6
aaguauucaagagu

SEQ ID NO: 4071636 - RNA, 16 nt, Streptococcus pneumoniae R6
aaguauuguaagaauu

SEQ ID NO: 4071637 - RNA, 20 nt, Streptococcus pneumoniae R6
aaguauuguaagaauuugau

SEQ ID NO: 4071638 - RNA, 16 nt, Streptococcus pneumoniae R6
aagucaaagccaauca

SEQ ID NO: 4071639 - RNA, 14 nt, Streptococcus pneumoniae R6
aagucaaauaagaa

SEQ ID NO: 4071640 - RNA, 19 nt, Streptococcus pneumoniae R6
aagucaaauaagaaagacc

SEQ ID NO: 4071641 - RNA, 23 nt, Streptococcus pneumoniae R6
aagucaaauuaauuuauagaaaa

SEQ ID NO: 4071642 - RNA, 11 nt, Streptococcus pneumoniae R6
aagucaacacc

SEQ ID NO: 4071643 - RNA, 15 nt, Streptococcus pneumoniae R6
aagucaacaucucuu

SEQ ID NO: 4071644 - RNA, 19 nt, Streptococcus pneumoniae R6
aagucaacaucucuuguuu

SEQ ID NO: 4071645 - RNA, 13 nt, Streptococcus pneumoniae R6
aagucaacuugaa

SEQ ID NO: 4071646 - RNA, 22 nt, Streptococcus pneumoniae R6
aagucaagccuccaauagcaac

SEQ ID NO: 4071647 - RNA, 16 nt, Streptococcus pneumoniae R6
aagucagcuaggcucg

SEQ ID NO: 4071648 - RNA, 21 nt, Streptococcus pneumoniae R6
aagucagcuaggcucgagaaa

SEQ ID NO: 4071649 - RNA, 22 nt, Streptococcus pneumoniae R6
aagucagcuaggcucgagaaag

SEQ ID NO: 4071650 - RNA, 19 nt, Streptococcus pneumoniae R6
aagucagcucaaaacacug

SEQ ID NO: 4071651 - RNA, 17 nt, Streptococcus pneumoniae R6
aagucagcucaaaacau

SEQ ID NO: 4071652 - RNA, 18 nt, Streptococcus pneumoniae R6
aagucagcucaaaacaug

SEQ ID NO: 4071653 - RNA, 15 nt, Streptococcus pneumoniae R6
aagucauaacauucu

SEQ ID NO: 4071654 - RNA, 15 nt, Streptococcus pneumoniae R6
aagucauacuuucuc

SEQ ID NO: 4071655 - RNA, 13 nt, Streptococcus pneumoniae R6
aagucauaggcuu

SEQ ID NO: 4071656 - RNA, 19 nt, Streptococcus pneumoniae R6
aagucauaggcuugcucac

SEQ ID NO: 4071657 - RNA, 16 nt, Streptococcus pneumoniae R6
aagucaucaaaaauag

SEQ ID NO: 4071658 - RNA, 23 nt, Streptococcus pneumoniae R6
aagucaucaaaaauagaaauaaa

SEQ ID NO: 4071659 - RNA, 14 nt, Streptococcus pneumoniae R6
aagucaucaaaauc

SEQ ID NO: 4071660 - RNA, 21 nt, Streptococcus pneumoniae R6
aagucaucuaucaaaagaugu

SEQ ID NO: 4071661 - RNA, 15 nt, Streptococcus pneumoniae R6
aagucaugagaguuu

SEQ ID NO: 4071662 - RNA, 23 nt, Streptococcus pneumoniae R6
aagucaugggcgaugaagagaua

SEQ ID NO: 4071663 - RNA, 13 nt, Streptococcus pneumoniae R6
aagucauuuucuu

SEQ ID NO: 4071664 - RNA, 18 nt, Streptococcus pneumoniae R6
aaguccagaaccguucaa

SEQ ID NO: 4071665 - RNA, 17 nt, Streptococcus pneumoniae R6
aaguccagaggacugcu

SEQ ID NO: 4071666 - RNA, 23 nt, Streptococcus pneumoniae R6
aaguccauagcgucaaagaaggc

SEQ ID NO: 4071667 - RNA, 14 nt, Streptococcus pneumoniae R6
aaguccgaaaaauu

SEQ ID NO: 4071668 - RNA, 17 nt, Streptococcus pneumoniae R6
aaguccgaauaggauuu

SEQ ID NO: 4071669 - RNA, 15 nt, Streptococcus pneumoniae R6
aaguccguuuucacc

SEQ ID NO: 4071670 - RNA, 20 nt, Streptococcus pneumoniae R6
aaguccuacccacugugcuu

SEQ ID NO: 4071671 - RNA, 16 nt, Streptococcus pneumoniae R6
aaguccucauuucaau

SEQ ID NO: 4071672 - RNA, 21 nt, Streptococcus pneumoniae R6
aaguccucauuucaauagaaa

SEQ ID NO: 4071673 - RNA, 20 nt, Streptococcus pneumoniae R6
aaguccuuacucaaauaaaa

SEQ ID NO: 4071674 - RNA, 22 nt, Streptococcus pneumoniae R6
aaguccuuguuugagcucuuug

SEQ ID NO: 4071675 - RNA, 14 nt, Streptococcus pneumoniae R6
aagucgaaaauaaa

SEQ ID NO: 4071676 - RNA, 21 nt, Streptococcus pneumoniae R6
aagucgaguucauguuucgga

SEQ ID NO: 4071677 - RNA, 18 nt, Streptococcus pneumoniae R6
aagucgcucgucaucguc

SEQ ID NO: 4071678 - RNA, 13 nt, Streptococcus pneumoniae R6
aagucggaaggca

SEQ ID NO: 4071679 - RNA, 15 nt, Streptococcus pneumoniae R6
aagucuccugugcuc

SEQ ID NO: 4071680 - RNA, 21 nt, Streptococcus pneumoniae R6
aagucucugucccaucauuuc

SEQ ID NO: 4071681 - RNA, 14 nt, Streptococcus pneumoniae R6
aagucugaaucaaa

SEQ ID NO: 4071682 - RNA, 22 nt, Streptococcus pneumoniae R6
aagucugaugccaucuucguaa

SEQ ID NO: 4071683 - RNA, 18 nt, Streptococcus pneumoniae R6
aagucugggaaaaauuuu

SEQ ID NO: 4071684 - RNA, 20 nt, Streptococcus pneumoniae R6
aagucugggaaaaauuuuca

SEQ ID NO: 4071685 - RNA, 13 nt, Streptococcus pneumoniae R6
aagucuguauaga

SEQ ID NO: 4071686 - RNA, 23 nt, Streptococcus pneumoniae R6
aagucuguauagaccugaucaaa

SEQ ID NO: 4071687 - RNA, 18 nt, Streptococcus pneumoniae R6
aagucugucaccuuauca

SEQ ID NO: 4071688 - RNA, 22 nt, Streptococcus pneumoniae R6
aagucugucaccuuaucacgaa

SEQ ID NO: 4071689 - RNA, 20 nt, Streptococcus pneumoniae R6
aagucuucggagaagaaaac

SEQ ID NO: 4071690 - RNA, 21 nt, Streptococcus pneumoniae R6
aagucuucggagaagaaaaca

SEQ ID NO: 4071691 - RNA, 21 nt, Streptococcus pneumoniae R6
aagucuucuaacagcauguag

SEQ ID NO: 4071692 - RNA, 17 nt, Streptococcus pneumoniae R6
aagucuugacaaagaaa

SEQ ID NO: 4071693 - RNA, 19 nt, Streptococcus pneumoniae R6
aagucuugacaaagaaaaa

SEQ ID NO: 4071694 - RNA, 21 nt, Streptococcus pneumoniae R6
aagucuugacaaagaaaaaac

SEQ ID NO: 4071695 - RNA, 13 nt, Streptococcus pneumoniae R6
aagucuuggaaaa

SEQ ID NO: 4071696 - RNA, 16 nt, Streptococcus pneumoniae R6
aagucuuguuugagaa

SEQ ID NO: 4071697 - RNA, 12 nt, Streptococcus pneumoniae R6
aagucuuuaaaa

SEQ ID NO: 4071698 - RNA, 17 nt, Streptococcus pneumoniae R6
aagucuuuaaaauuaua

SEQ ID NO: 4071699 - RNA, 20 nt, Streptococcus pneumoniae R6
aagugaaaguggcugugaua

SEQ ID NO: 4071700 - RNA, 18 nt, Streptococcus pneumoniae R6
aagugacagucgcaaaga

SEQ ID NO: 4071701 - RNA, 20 nt, Streptococcus pneumoniae R6
aagugacagucgcaaagagg

SEQ ID NO: 4071702 - RNA, 14 nt, Streptococcus pneumoniae R6
aagugacauaugau

SEQ ID NO: 4071703 - RNA, 19 nt, Streptococcus pneumoniae R6
aagugaguaccagauauac

SEQ ID NO: 4071704 - RNA, 15 nt, Streptococcus pneumoniae R6
aagugauaaugauuu

SEQ ID NO: 4071705 - RNA, 15 nt, Streptococcus pneumoniae R6
aagugauauacuaug

SEQ ID NO: 4071706 - RNA, 18 nt, Streptococcus pneumoniae R6
aagugauuuaaauguuug

SEQ ID NO: 4071707 - RNA, 18 nt, Streptococcus pneumoniae R6
aagugauuuaaauguuuu

SEQ ID NO: 4071708 - RNA, 20 nt, Streptococcus pneumoniae R6
aagugauuuaaauguuuucu

SEQ ID NO: 4071709 - RNA, 23 nt, Streptococcus pneumoniae R6
aagugauuuaaauguuuucucau

SEQ ID NO: 4071710 - RNA, 16 nt, Streptococcus pneumoniae R6
aagugcguugauaauc

SEQ ID NO: 4071711 - RNA, 22 nt, Streptococcus pneumoniae R6
aagugcguugauaaucuuaucu

SEQ ID NO: 4071712 - RNA, 13 nt, Streptococcus pneumoniae R6
aagugcuaagaua

SEQ ID NO: 4071713 - RNA, 16 nt, Streptococcus pneumoniae R6
aagugcuaagauaaua

SEQ ID NO: 4071714 - RNA, 17 nt, Streptococcus pneumoniae R6
aagugcuuuugugauuu

SEQ ID NO: 4071715 - RNA, 16 nt, Streptococcus pneumoniae R6
aaguggaaagagcaga

SEQ ID NO: 4071716 - RNA, 17 nt, Streptococcus pneumoniae R6
aaguggaaagagcagaa

SEQ ID NO: 4071717 - RNA, 19 nt, Streptococcus pneumoniae R6
aaguggaauucauuuucuu

SEQ ID NO: 4071718 - RNA, 22 nt, Streptococcus pneumoniae R6
aaguggauuuuucuucuuuucu

SEQ ID NO: 4071719 - RNA, 22 nt, Streptococcus pneumoniae R6
aagugggcugauuuugaaaaug

SEQ ID NO: 4071720 - RNA, 15 nt, Streptococcus pneumoniae R6
aagugguaucauaua

SEQ ID NO: 4071721 - RNA, 21 nt, Streptococcus pneumoniae R6
aagugguguuacgauuucaag

SEQ ID NO: 4071722 - RNA, 21 nt, Streptococcus pneumoniae R6
aagugguugauaaauuucaaa

SEQ ID NO: 4071723 - RNA, 19 nt, Streptococcus pneumoniae R6
aaguguaacaacuucacga

SEQ ID NO: 4071724 - RNA, 19 nt, Streptococcus pneumoniae R6
aaguguaacuggaccaagu

SEQ ID NO: 4071725 - RNA, 14 nt, Streptococcus pneumoniae R6
aagugucucccuuu

SEQ ID NO: 4071726 - RNA, 18 nt, Streptococcus pneumoniae R6
aagugucuggaaugauaa

SEQ ID NO: 4071727 - RNA, 16 nt, Streptococcus pneumoniae R6
aaguguugaaaacccu

SEQ ID NO: 4071728 - RNA, 17 nt, Streptococcus pneumoniae R6
aaguguugaaaacccuu

SEQ ID NO: 4071729 - RNA, 20 nt, Streptococcus pneumoniae R6
aaguguugacaagugaaagu

SEQ ID NO: 4071730 - RNA, 19 nt, Streptococcus pneumoniae R6
aaguguugaccgacuauuu

SEQ ID NO: 4071731 - RNA, 19 nt, Streptococcus pneumoniae R6
aaguguuguaaagucuaug

SEQ ID NO: 4071732 - RNA, 20 nt, Streptococcus pneumoniae R6
aaguguuugauaucuaucaa

SEQ ID NO: 4071733 - RNA, 13 nt, Streptococcus pneumoniae R6
aaguguuuucacu

SEQ ID NO: 4071734 - RNA, 18 nt, Streptococcus pneumoniae R6
aauaagggcaaagaaaag

SEQ ID NO: 4071735 - RNA, 17 nt, Streptococcus pneumoniae R6
aauaagguaauugaaga

SEQ ID NO: 4071736 - RNA, 16 nt, Streptococcus pneumoniae R6
aauaaguucaacaaau

SEQ ID NO: 4071737 - RNA, 20 nt, Streptococcus pneumoniae R6
aauaaguucaacaaaucaga

SEQ ID NO: 4071738 - RNA, 13 nt, Streptococcus pneumoniae R6
aauaauaaaacuu

SEQ ID NO: 4071739 - RNA, 14 nt, Streptococcus pneumoniae R6
aauaauacaaaaaa

SEQ ID NO: 4071740 - RNA, 12 nt, Streptococcus pneumoniae R6
aauaauacacuu

SEQ ID NO: 4071741 - RNA, 20 nt, Streptococcus pneumoniae R6
aauaauagaaaacagacaaa

SEQ ID NO: 4071742 - RNA, 21 nt, Streptococcus pneumoniae R6
aauaauagacuuccugcaaaa

SEQ ID NO: 4071743 - RNA, 20 nt, Streptococcus pneumoniae R6
aauaauagcuugcaauucuu

SEQ ID NO: 4071744 - RNA, 22 nt, Streptococcus pneumoniae R6
aauaauagcuugcaauucuuua

SEQ ID NO: 4071745 - RNA, 15 nt, Streptococcus pneumoniae R6
aauaauauaggucag

SEQ ID NO: 4071746 - RNA, 17 nt, Streptococcus pneumoniae R6
aauaauauccgauagca

SEQ ID NO: 4071747 - RNA, 20 nt, Streptococcus pneumoniae R6
aauaauauccgauagcauca

SEQ ID NO: 4071748 - RNA, 14 nt, Streptococcus pneumoniae R6
aauaaucaaaacua

SEQ ID NO: 4071749 - RNA, 21 nt, Streptococcus pneumoniae R6
aauaaucccaccuagaacaag

SEQ ID NO: 4071750 - RNA, 12 nt, Streptococcus pneumoniae R6
aauaauccuaac

SEQ ID NO: 4071751 - RNA, 20 nt, Streptococcus pneumoniae R6
aauaauguuaaccacaaaaa

SEQ ID NO: 4071752 - RNA, 13 nt, Streptococcus pneumoniae R6
aauaauuaaauca

SEQ ID NO: 4071753 - RNA, 19 nt, Streptococcus pneumoniae R6
aauaauuaguucagaauuu

SEQ ID NO: 4071754 - RNA, 23 nt, Streptococcus pneumoniae R6
aauaauuaguucagaauuuucuu

SEQ ID NO: 4071755 - RNA, 19 nt, Streptococcus pneumoniae R6
aauaauuauagaaaugagg

SEQ ID NO: 4071756 - RNA, 20 nt, Streptococcus pneumoniae R6
aauaauuauagaaaugaggu

SEQ ID NO: 4071757 - RNA, 19 nt, Streptococcus pneumoniae R6
aauaauugacgaagaaacc

SEQ ID NO: 4071758 - RNA, 21 nt, Streptococcus pneumoniae R6
aauaauuuugauucagauuca

SEQ ID NO: 4071759 - RNA, 13 nt, Streptococcus pneumoniae R6
aauacaaaaaaua

SEQ ID NO: 4071760 - RNA, 12 nt, Streptococcus pneumoniae R6
aauacaaaaaua

SEQ ID NO: 4071761 - RNA, 22 nt, Streptococcus pneumoniae R6
aauacaaaaaucuaagauaaag

SEQ ID NO: 4071762 - RNA, 23 nt, Streptococcus pneumoniae R6
aauacaaaaucccucuuuuuaca

SEQ ID NO: 4071763 - RNA, 19 nt, Streptococcus pneumoniae R6
aauacaacaggaaaagucu

SEQ ID NO: 4071764 - RNA, 22 nt, Streptococcus pneumoniae R6
aauacaagcucaucuuugauuu

SEQ ID NO: 4071765 - RNA, 21 nt, Streptococcus pneumoniae R6
aauacaauugcucuucugaaa

SEQ ID NO: 4071766 - RNA, 14 nt, Streptococcus pneumoniae R6
aauacagaagaaaa

SEQ ID NO: 4071767 - RNA, 15 nt, Streptococcus pneumoniae R6
aauacagauaaaaau

SEQ ID NO: 4071768 - RNA, 20 nt, Streptococcus pneumoniae R6
aauacagcuuuuuucuuugc

SEQ ID NO: 4071769 - RNA, 23 nt, Streptococcus pneumoniae R6
aauacagcuuuuuucuuugccuc

SEQ ID NO: 4071770 - RNA, 15 nt, Streptococcus pneumoniae R6
aauacaggaaaacca

SEQ ID NO: 4071771 - RNA, 19 nt, Streptococcus pneumoniae R6
aauacauuuuguaaaaaag

SEQ ID NO: 4071772 - RNA, 14 nt, Streptococcus pneumoniae R6
aauaccaaagaagu

SEQ ID NO: 4071773 - RNA, 15 nt, Streptococcus pneumoniae R6
aauaccaaagaaguc

SEQ ID NO: 4071774 - RNA, 16 nt, Streptococcus pneumoniae R6
aauaccaaagaaguca

SEQ ID NO: 4071775 - RNA, 17 nt, Streptococcus pneumoniae R6
aauaccaaguucauuuu

SEQ ID NO: 4071776 - RNA, 23 nt, Streptococcus pneumoniae R6
aauaccaaguucauuuuuuaugg

SEQ ID NO: 4071777 - RNA, 14 nt, Streptococcus pneumoniae R6
aauaccagcaauca

SEQ ID NO: 4071778 - RNA, 13 nt, Streptococcus pneumoniae R6
aauaccagguaau

SEQ ID NO: 4071779 - RNA, 18 nt, Streptococcus pneumoniae R6
aauacccccuuaaaacca

SEQ ID NO: 4071780 - RNA, 14 nt, Streptococcus pneumoniae R6
aauaccuaccagag

SEQ ID NO: 4071781 - RNA, 22 nt, Streptococcus pneumoniae R6
aauaccuuauccaauucuucag

SEQ ID NO: 4071782 - RNA, 20 nt, Streptococcus pneumoniae R6
aauacgaagggcaggaaaaa

SEQ ID NO: 4071783 - RNA, 14 nt, Streptococcus pneumoniae R6
aauacgaccaaucu

SEQ ID NO: 4071784 - RNA, 14 nt, Streptococcus pneumoniae R6
aauacgcaaaauca

SEQ ID NO: 4071785 - RNA, 18 nt, Streptococcus pneumoniae R6
aauacggacauagcagau

SEQ ID NO: 4071786 - RNA, 19 nt, Streptococcus pneumoniae R6
aauacggacauagcagaua

SEQ ID NO: 4071787 - RNA, 18 nt, Streptococcus pneumoniae R6
aauacggucaaucaacuu

SEQ ID NO: 4071788 - RNA, 18 nt, Streptococcus pneumoniae R6
aauacguuuucaaagcua

SEQ ID NO: 4071789 - RNA, 20 nt, Streptococcus pneumoniae R6
aauacuagucuuucuucguu

SEQ ID NO: 4071790 - RNA, 13 nt, Streptococcus pneumoniae R6
aauacucaaugaa

SEQ ID NO: 4071791 - RNA, 15 nt, Streptococcus pneumoniae R6
aauacucaaugaaaa

SEQ ID NO: 4071792 - RNA, 19 nt, Streptococcus pneumoniae R6
aauacucuuucaguuucau

SEQ ID NO: 4071793 - RNA, 15 nt, Streptococcus pneumoniae R6
aauacugaaacaaca

SEQ ID NO: 4071794 - RNA, 16 nt, Streptococcus pneumoniae R6
aauacugaaacaacau

SEQ ID NO: 4071795 - RNA, 22 nt, Streptococcus pneumoniae R6
aauacugaaacaacaucuuucc

SEQ ID NO: 4071796 - RNA, 12 nt, Streptococcus pneumoniae R6
aauacugcucgg

SEQ ID NO: 4071797 - RNA, 14 nt, Streptococcus pneumoniae R6
aauacuucaacaaa

SEQ ID NO: 4071798 - RNA, 23 nt, Streptococcus pneumoniae R6
aauacuuggacuagggaaagaag

SEQ ID NO: 4071799 - RNA, 14 nt, Streptococcus pneumoniae R6
aauacuuuuuccug

SEQ ID NO: 4071800 - RNA, 12 nt, Streptococcus pneumoniae R6
aauagaaaaaau

SEQ ID NO: 4071801 - RNA, 15 nt, Streptococcus pneumoniae R6
aauagaaaacaaaaa

SEQ ID NO: 4071802 - RNA, 13 nt, Streptococcus pneumoniae R6
aauagaaaccagc

SEQ ID NO: 4071803 - RNA, 13 nt, Streptococcus pneumoniae R6
aauagaaauaaaa

SEQ ID NO: 4071804 - RNA, 13 nt, Streptococcus pneumoniae R6
aauagaaaucacg

SEQ ID NO: 4071805 - RNA, 12 nt, Streptococcus pneumoniae R6
aauagaagauaa

SEQ ID NO: 4071806 - RNA, 23 nt, Streptococcus pneumoniae R6
aauagacccuuguuucuaaaaca

SEQ ID NO: 4071807 - RNA, 19 nt, Streptococcus pneumoniae R6
aauagauacaaaaccaaac

SEQ ID NO: 4071808 - RNA, 17 nt, Streptococcus pneumoniae R6
aauagauuggauaaaau

SEQ ID NO: 4071809 - RNA, 18 nt, Streptococcus pneumoniae R6
aauagauuggauaaaauc

SEQ ID NO: 4071810 - RNA, 15 nt, Streptococcus pneumoniae R6
aauagcacuuaaaaa

SEQ ID NO: 4071811 - RNA, 14 nt, Streptococcus pneumoniae R6
aauagcaguaacuu

SEQ ID NO: 4071812 - RNA, 22 nt, Streptococcus pneumoniae R6
aauagcccacugugauuucuaa

SEQ ID NO: 4071813 - RNA, 17 nt, Streptococcus pneumoniae R6
aauagcccauaaagaga

SEQ ID NO: 4071814 - RNA, 18 nt, Streptococcus pneumoniae R6
aauagcccauaaagagag

SEQ ID NO: 4071815 - RNA, 21 nt, Streptococcus pneumoniae R6
aauagcccuucggauaaaauc

SEQ ID NO: 4071816 - RNA, 18 nt, Streptococcus pneumoniae R6
aauagcgaguaggcugga

SEQ ID NO: 4071817 - RNA, 22 nt, Streptococcus pneumoniae R6
aauagcgauagauguuuucaaa

SEQ ID NO: 4071818 - RNA, 16 nt, Streptococcus pneumoniae R6
aauagcuaaaccuuau

SEQ ID NO: 4071819 - RNA, 22 nt, Streptococcus pneumoniae R6
aauagcuaguagggaaaccacu

SEQ ID NO: 4071820 - RNA, 15 nt, Streptococcus pneumoniae R6
aauagcucaaaaguu

SEQ ID NO: 4071821 - RNA, 16 nt, Streptococcus pneumoniae R6
aauagcuuaaaaucuu

SEQ ID NO: 4071822 - RNA, 16 nt, Streptococcus pneumoniae R6
aauagcuuccuugaug

SEQ ID NO: 4071823 - RNA, 19 nt, Streptococcus pneumoniae R6
aauagcuuguuccaauuga

SEQ ID NO: 4071824 - RNA, 15 nt, Streptococcus pneumoniae R6
aauaggacaucauaa

SEQ ID NO: 4071825 - RNA, 23 nt, Streptococcus pneumoniae R6
aauaggauuuggcguuaguuacu

SEQ ID NO: 4071826 - RNA, 17 nt, Streptococcus pneumoniae R6
aauagguggauaaaagu

SEQ ID NO: 4071827 - RNA, 14 nt, Streptococcus pneumoniae R6
aauaguaagaguug

SEQ ID NO: 4071828 - RNA, 12 nt, Streptococcus pneumoniae R6
aauaguacacuu

SEQ ID NO: 4071829 - RNA, 20 nt, Streptococcus pneumoniae R6
aauaguacgaaacaauugcu

SEQ ID NO: 4071830 - RNA, 23 nt, Streptococcus pneumoniae R6
aauaguauaccacacuaaauuua

SEQ ID NO: 4071831 - RNA, 11 nt, Streptococcus pneumoniae R6
aauaguccucc

SEQ ID NO: 4071832 - RNA, 12 nt, Streptococcus pneumoniae R6
aauagucucuug

SEQ ID NO: 4071833 - RNA, 21 nt, Streptococcus pneumoniae R6
aauaguuauagaguguuaucu

SEQ ID NO: 4071834 - RNA, 23 nt, Streptococcus pneumoniae R6
aauaguucagugaacuauuuuau

SEQ ID NO: 4071835 - RNA, 21 nt, Streptococcus pneumoniae R6
aauaguugaaaucaaggcagu

SEQ ID NO: 4071836 - RNA, 14 nt, Streptococcus pneumoniae R6
aauauaauaaacua

SEQ ID NO: 4071837 - RNA, 17 nt, Streptococcus pneumoniae R6
aaucagguguucaaaaa

SEQ ID NO: 4071838 - RNA, 20 nt, Streptococcus pneumoniae R6
aaucaguaauuuaguucuca

SEQ ID NO: 4071839 - RNA, 13 nt, Streptococcus pneumoniae R6
aaucauaaacacc

SEQ ID NO: 4071840 - RNA, 15 nt, Streptococcus pneumoniae R6
aaucauaaagccagu

SEQ ID NO: 4071841 - RNA, 20 nt, Streptococcus pneumoniae R6
aaucauacaccucuucugau

SEQ ID NO: 4071842 - RNA, 18 nt, Streptococcus pneumoniae R6
aaucauagaaaaaagcau

SEQ ID NO: 4071843 - RNA, 17 nt, Streptococcus pneumoniae R6
aaucauagagcaaacua

SEQ ID NO: 4071844 - RNA, 13 nt, Streptococcus pneumoniae R6
aaucauagauuca

SEQ ID NO: 4071845 - RNA, 19 nt, Streptococcus pneumoniae R6
aaucauagcauagaugaca

SEQ ID NO: 4071846 - RNA, 23 nt, Streptococcus pneumoniae R6
aaucaucacuaguaauaauuuca

SEQ ID NO: 4071847 - RNA, 15 nt, Streptococcus pneumoniae R6
aaucaucauaaaaau

SEQ ID NO: 4071848 - RNA, 17 nt, Streptococcus pneumoniae R6
aaucaucgcuaucaaug

SEQ ID NO: 4071849 - RNA, 21 nt, Streptococcus pneumoniae R6
aaucaucucaucgacuuguuu

SEQ ID NO: 4071850 - RNA, 14 nt, Streptococcus pneumoniae R6
aaucaugagaauau

SEQ ID NO: 4071851 - RNA, 12 nt, Streptococcus pneumoniae R6
aaucauuaaaau

SEQ ID NO: 4071852 - RNA, 14 nt, Streptococcus pneumoniae R6
aaucauuaaaauaa

SEQ ID NO: 4071853 - RNA, 15 nt, Streptococcus pneumoniae R6
aaucauuaaaauaac

SEQ ID NO: 4071854 - RNA, 20 nt, Streptococcus pneumoniae R6
aaucauuauagaaggcaauu

SEQ ID NO: 4071855 - RNA, 20 nt, Streptococcus pneumoniae R6
aaucauucugaacuaaaaaa

SEQ ID NO: 4071856 - RNA, 16 nt, Streptococcus pneumoniae R6
aaucauuuggaaaaca

SEQ ID NO: 4071857 - RNA, 16 nt, Streptococcus pneumoniae R6
aaucauuuucuugauu

SEQ ID NO: 4071858 - RNA, 13 nt, Streptococcus pneumoniae R6
aaucauuuuguaa

SEQ ID NO: 4071859 - RNA, 20 nt, Streptococcus pneumoniae R6
aauccaaaggcguuucguuu

SEQ ID NO: 4071860 - RNA, 18 nt, Streptococcus pneumoniae R6
aauccaacaccaauuuua

SEQ ID NO: 4071861 - RNA, 12 nt, Streptococcus pneumoniae R6
aauccaacucuu

SEQ ID NO: 4071862 - RNA, 15 nt, Streptococcus pneumoniae R6
aauccaauugaggaa

SEQ ID NO: 4071863 - RNA, 16 nt, Streptococcus pneumoniae R6
aauccaauugaggaag

SEQ ID NO: 4071864 - RNA, 17 nt, Streptococcus pneumoniae R6
aauccaauugaggaagu

SEQ ID NO: 4071865 - RNA, 15 nt, Streptococcus pneumoniae R6
aauccacauuuacga

SEQ ID NO: 4071866 - RNA, 22 nt, Streptococcus pneumoniae R6
aauccacguuuacgaaucucuu

SEQ ID NO: 4071867 - RNA, 23 nt, Streptococcus pneumoniae R6
aauccacucagcugucugagugg

SEQ ID NO: 4071868 - RNA, 16 nt, Streptococcus pneumoniae R6
aauccacucccucuag

SEQ ID NO: 4071869 - RNA, 15 nt, Streptococcus pneumoniae R6
aauccacuugggaaa

SEQ ID NO: 4071870 - RNA, 19 nt, Streptococcus pneumoniae R6
aauccacuugggaaaccaa

SEQ ID NO: 4071871 - RNA, 20 nt, Streptococcus pneumoniae R6
aauccacuugggaaaccaaa

SEQ ID NO: 4071872 - RNA, 23 nt, Streptococcus pneumoniae R6
aauccagucccuuuuaagaguua

SEQ ID NO: 4071873 - RNA, 23 nt, Streptococcus pneumoniae R6
aauccauaguaaacuucuucuuc

SEQ ID NO: 4071874 - RNA, 16 nt, Streptococcus pneumoniae R6
aauccauggaauacca

SEQ ID NO: 4071875 - RNA, 20 nt, Streptococcus pneumoniae R6
aauccauggaauaccaauau

SEQ ID NO: 4071876 - RNA, 22 nt, Streptococcus pneumoniae R6
aauccauggaauaccaauauca

SEQ ID NO: 4071877 - RNA, 23 nt, Streptococcus pneumoniae R6
aaucccaaagaaggacuccacca

SEQ ID NO: 4071878 - RNA, 13 nt, Streptococcus pneumoniae R6
aaucccaaucaug

SEQ ID NO: 4071879 - RNA, 15 nt, Streptococcus pneumoniae R6
aaucccauauuuuuc

SEQ ID NO: 4071880 - RNA, 13 nt, Streptococcus pneumoniae R6
aauccccaaggga

SEQ ID NO: 4071881 - RNA, 17 nt, Streptococcus pneumoniae R6
aaucccuagcuuuuucc

SEQ ID NO: 4071882 - RNA, 23 nt, Streptococcus pneumoniae R6
aaucccucuuuuuacaauuguaa

SEQ ID NO: 4071883 - RNA, 21 nt, Streptococcus pneumoniae R6
aaucccuucaauggaguaaaa

SEQ ID NO: 4071884 - RNA, 22 nt, Streptococcus pneumoniae R6
aaucccuucaauggaguaaaaa

SEQ ID NO: 4071885 - RNA, 21 nt, Streptococcus pneumoniae R6
aaucccuuuuuaagauuuuac

SEQ ID NO: 4071886 - RNA, 22 nt, Streptococcus pneumoniae R6
aaucccuuuuuaagauuuuacc

SEQ ID NO: 4071887 - RNA, 16 nt, Streptococcus pneumoniae R6
aauccgaaaaauuucu

SEQ ID NO: 4071888 - RNA, 15 nt, Streptococcus pneumoniae R6
aauccgaaaaucacu

SEQ ID NO: 4071889 - RNA, 23 nt, Streptococcus pneumoniae R6
aauccgacuucaauaaaauauaa

SEQ ID NO: 4071890 - RNA, 14 nt, Streptococcus pneumoniae R6
aauccgauaauaua

SEQ ID NO: 4071891 - RNA, 17 nt, Streptococcus pneumoniae R6
aauccgcuugggaaacc

SEQ ID NO: 4071892 - RNA, 13 nt, Streptococcus pneumoniae R6
aauccuaaauccu

SEQ ID NO: 4071893 - RNA, 13 nt, Streptococcus pneumoniae R6
aauccuaacuuaa

SEQ ID NO: 4071894 - RNA, 17 nt, Streptococcus pneumoniae R6
aauccuagauacaguga

SEQ ID NO: 4071895 - RNA, 14 nt, Streptococcus pneumoniae R6
aauccuaguucaug

SEQ ID NO: 4071896 - RNA, 16 nt, Streptococcus pneumoniae R6
aauccuaguucaugau

SEQ ID NO: 4071897 - RNA, 20 nt, Streptococcus pneumoniae R6
aauccuaguucaugauugau

SEQ ID NO: 4071898 - RNA, 18 nt, Streptococcus pneumoniae R6
aauccuguacggauuggu

SEQ ID NO: 4071899 - RNA, 18 nt, Streptococcus pneumoniae R6
aauccuuguaugacaucu

SEQ ID NO: 4071900 - RNA, 19 nt, Streptococcus pneumoniae R6
aauccuugucgucauacca

SEQ ID NO: 4071901 - RNA, 14 nt, Streptococcus pneumoniae R6
aauccuuuauuuuc

SEQ ID NO: 4071902 - RNA, 13 nt, Streptococcus pneumoniae R6
aauccuuuucuga

SEQ ID NO: 4071903 - RNA, 12 nt, Streptococcus pneumoniae R6
aauccuuuuuuc

SEQ ID NO: 4071904 - RNA, 16 nt, Streptococcus pneumoniae R6
aaucgaaacuccauaa

SEQ ID NO: 4071905 - RNA, 17 nt, Streptococcus pneumoniae R6
aaucgaggucuaaaucu

SEQ ID NO: 4071906 - RNA, 15 nt, Streptococcus pneumoniae R6
aaucgauaaagaaga

SEQ ID NO: 4071907 - RNA, 20 nt, Streptococcus pneumoniae R6
aaucgaucaggacagucaaa

SEQ ID NO: 4071908 - RNA, 21 nt, Streptococcus pneumoniae R6
aaucgauuuguucauaucuua

SEQ ID NO: 4071909 - RNA, 22 nt, Streptococcus pneumoniae R6
aaucgauuuguucucaucuuau

SEQ ID NO: 4071910 - RNA, 19 nt, Streptococcus pneumoniae R6
aaucgcaagguagagacag

SEQ ID NO: 4071911 - RNA, 15 nt, Streptococcus pneumoniae R6
aaucgcaaguuuuuc

SEQ ID NO: 4071912 - RNA, 16 nt, Streptococcus pneumoniae R6
aaucgcccuucuugua

SEQ ID NO: 4071913 - RNA, 19 nt, Streptococcus pneumoniae R6
aaucgcuggcauuucccau

SEQ ID NO: 4071914 - RNA, 14 nt, Streptococcus pneumoniae R6
aaucgcuuuuguaa

SEQ ID NO: 4071915 - RNA, 12 nt, Streptococcus pneumoniae R6
aaucggagaugg

SEQ ID NO: 4071916 - RNA, 15 nt, Streptococcus pneumoniae R6
aaucgggaucugaua

SEQ ID NO: 4071917 - RNA, 22 nt, Streptococcus pneumoniae R6
aaucguacuguggccagucauu

SEQ ID NO: 4071918 - RNA, 21 nt, Streptococcus pneumoniae R6
aaucguagucuuucaccacuu

SEQ ID NO: 4071919 - RNA, 15 nt, Streptococcus pneumoniae R6
aaucguccuugauuu

SEQ ID NO: 4071920 - RNA, 21 nt, Streptococcus pneumoniae R6
aaucgucucacgguaaaugua

SEQ ID NO: 4071921 - RNA, 20 nt, Streptococcus pneumoniae R6
aaucgucuguacaaauccca

SEQ ID NO: 4071922 - RNA, 14 nt, Streptococcus pneumoniae R6
aaucguugucaagu

SEQ ID NO: 4071923 - RNA, 13 nt, Streptococcus pneumoniae R6
aaucguuuaaaac

SEQ ID NO: 4071924 - RNA, 18 nt, Streptococcus pneumoniae R6
aaucguuuaaaacaccuu

SEQ ID NO: 4071925 - RNA, 14 nt, Streptococcus pneumoniae R6
aaucguuucaaaaa

SEQ ID NO: 4071926 - RNA, 18 nt, Streptococcus pneumoniae R6
aaucuaacccuaaguguc

SEQ ID NO: 4071927 - RNA, 20 nt, Streptococcus pneumoniae R6
aaucuaacccuaagugucug

SEQ ID NO: 4071928 - RNA, 14 nt, Streptococcus pneumoniae R6
aaucuaaguaacua

SEQ ID NO: 4071929 - RNA, 18 nt, Streptococcus pneumoniae R6
aaucuacgcuuuaaaaau

SEQ ID NO: 4071930 - RNA, 19 nt, Streptococcus pneumoniae R6
aaucuacuauauuuuugga

SEQ ID NO: 4071931 - RNA, 20 nt, Streptococcus pneumoniae R6
aaucuaguaaagcuagauuu

SEQ ID NO: 4071932 - RNA, 14 nt, Streptococcus pneumoniae R6
aaucuagucaucag

SEQ ID NO: 4071933 - RNA, 23 nt, Streptococcus pneumoniae R6
aaucuauuuaugaaaaaguuuau

SEQ ID NO: 4071934 - RNA, 13 nt, Streptococcus pneumoniae R6
aaucucaaaacag

SEQ ID NO: 4071935 - RNA, 14 nt, Streptococcus pneumoniae R6
aaucucaaaacagu

SEQ ID NO: 4071936 - RNA, 19 nt, Streptococcus pneumoniae R6
aaucucaaaagaaagcaua

SEQ ID NO: 4071937 - RNA, 13 nt, Streptococcus pneumoniae R6
aaucucaaauccu

SEQ ID NO: 4071938 - RNA, 22 nt, Streptococcus pneumoniae R6
aaucucacguaacauauuuuca

SEQ ID NO: 4071939 - RNA, 14 nt, Streptococcus pneumoniae R6
aaucuccucaggaa

SEQ ID NO: 4071940 - RNA, 22 nt, Streptococcus pneumoniae R6
aaucucuaacaaugcuuuagaa

SEQ ID NO: 4071941 - RNA, 23 nt, Streptococcus pneumoniae R6
aaucucuagccccucucacacca

SEQ ID NO: 4071942 - RNA, 16 nt, Streptococcus pneumoniae R6
aaucucuucaaaccau

SEQ ID NO: 4071943 - RNA, 12 nt, Streptococcus pneumoniae R6
aaucucuugaac

SEQ ID NO: 4071944 - RNA, 21 nt, Streptococcus pneumoniae R6
aaucucuugucuuacuugcgu

SEQ ID NO: 4071945 - RNA, 16 nt, Streptococcus pneumoniae R6
aaucucuuuccacacu

SEQ ID NO: 4071946 - RNA, 20 nt, Streptococcus pneumoniae R6
aaucucuuuccacacuuguu

SEQ ID NO: 4071947 - RNA, 12 nt, Streptococcus pneumoniae R6
aaucugaaaaau

SEQ ID NO: 4071948 - RNA, 18 nt, Streptococcus pneumoniae R6
aaucugaaauaguacgaa

SEQ ID NO: 4071949 - RNA, 19 nt, Streptococcus pneumoniae R6
aaucugccagauuccugaa

SEQ ID NO: 4071950 - RNA, 21 nt, Streptococcus pneumoniae R6
aaucugccgccauacuuucuc

SEQ ID NO: 4071951 - RNA, 18 nt, Streptococcus pneumoniae R6
aaucugccucaagaagug

SEQ ID NO: 4071952 - RNA, 23 nt, Streptococcus pneumoniae R6
aaucugccuuuuuauccaaaaua

SEQ ID NO: 4071953 - RNA, 18 nt, Streptococcus pneumoniae R6
aaucugcucaaucuuauc

SEQ ID NO: 4071954 - RNA, 18 nt, Streptococcus pneumoniae R6
aaucuggucuuaagacac

SEQ ID NO: 4071955 - RNA, 23 nt, Streptococcus pneumoniae R6
aaucuggugccccaguucuucag

SEQ ID NO: 4071956 - RNA, 15 nt, Streptococcus pneumoniae R6
aaucuguaauauaca

SEQ ID NO: 4071957 - RNA, 22 nt, Streptococcus pneumoniae R6
aaucuguuaaaaaauaaucaaa

SEQ ID NO: 4071958 - RNA, 15 nt, Streptococcus pneumoniae R6
aaucuuagcaaagau

SEQ ID NO: 4071959 - RNA, 20 nt, Streptococcus pneumoniae R6
aaucuuagucaaaacaauuc

SEQ ID NO: 4071960 - RNA, 20 nt, Streptococcus pneumoniae R6
aaucuuauauuuaguacucu

SEQ ID NO: 4071961 - RNA, 20 nt, Streptococcus pneumoniae R6
aaucuuaucuaagacugcuu

SEQ ID NO: 4071962 - RNA, 13 nt, Streptococcus pneumoniae R6
aaucuuaucucua

SEQ ID NO: 4071963 - RNA, 23 nt, Streptococcus pneumoniae R6
aaucuuaucucuaucucuuaaaa

SEQ ID NO: 4071964 - RNA, 12 nt, Streptococcus pneumoniae R6
aaucuucaaaau

SEQ ID NO: 4071965 - RNA, 13 nt, Streptococcus pneumoniae R6
aaucuucaaaauc

SEQ ID NO: 4071966 - RNA, 13 nt, Streptococcus pneumoniae R6
aaucuucaaauuu

SEQ ID NO: 4071967 - RNA, 16 nt, Streptococcus pneumoniae R6
aaucuucaaauuuuuc

SEQ ID NO: 4071968 - RNA, 21 nt, Streptococcus pneumoniae R6
aaucuucaaauuuuucauaau

SEQ ID NO: 4071969 - RNA, 23 nt, Streptococcus pneumoniae R6
aaucuucauauacacuaaacaaa

SEQ ID NO: 4071970 - RNA, 18 nt, Streptococcus pneumoniae R6
aaucuucccauaguaaaa

SEQ ID NO: 4071971 - RNA, 23 nt, Streptococcus pneumoniae R6
aaucuucccauaguaaaacgcau

SEQ ID NO: 4071972 - RNA, 10 nt, Streptococcus pneumoniae R6
aaucuucccg

SEQ ID NO: 4071973 - RNA, 14 nt, Streptococcus pneumoniae R6
aaucuuccuuacua

SEQ ID NO: 4071974 - RNA, 21 nt, Streptococcus pneumoniae R6
aaucuucuagcuaucuccuca

SEQ ID NO: 4071975 - RNA, 17 nt, Streptococcus pneumoniae R6
aaucuucuggcacagaa

SEQ ID NO: 4071976 - RNA, 14 nt, Streptococcus pneumoniae R6
aaucuucuguguuu

SEQ ID NO: 4071977 - RNA, 21 nt, Streptococcus pneumoniae R6
aaucuugacuauauuucuuaa

SEQ ID NO: 4071978 - RNA, 16 nt, Streptococcus pneumoniae R6
aaucuuggcaaaacgu

SEQ ID NO: 4071979 - RNA, 16 nt, Streptococcus pneumoniae R6
aaucuuggucaacaua

SEQ ID NO: 4071980 - RNA, 13 nt, Streptococcus pneumoniae R6
aaucuuguuaaga

SEQ ID NO: 4071981 - RNA, 23 nt, Streptococcus pneumoniae R6
aaucuuuaagauacuugauuuuu

SEQ ID NO: 4071982 - RNA, 20 nt, Streptococcus pneumoniae R6
aaucuuuaagguacuugauu

SEQ ID NO: 4071983 - RNA, 15 nt, Streptococcus pneumoniae R6
aaucuuuagcaccac

SEQ ID NO: 4071984 - RNA, 14 nt, Streptococcus pneumoniae R6
aaucuuuuacuucu

SEQ ID NO: 4071985 - RNA, 16 nt, Streptococcus pneumoniae R6
aaucuuuuccaacuca

SEQ ID NO: 4071986 - RNA, 20 nt, Streptococcus pneumoniae R6
aaugaaaaucaaagaguaaa

SEQ ID NO: 4071987 - RNA, 13 nt, Streptococcus pneumoniae R6
aaugaaagagcag

SEQ ID NO: 4071988 - RNA, 13 nt, Streptococcus pneumoniae R6
aaugaaauaagaa

SEQ ID NO: 4071989 - RNA, 16 nt, Streptococcus pneumoniae R6
aaugaaauaagaauag

SEQ ID NO: 4071990 - RNA, 14 nt, Streptococcus pneumoniae R6
aaugaaauuaaaua

SEQ ID NO: 4071991 - RNA, 17 nt, Streptococcus pneumoniae R6
aaugaaauuuuucugcu

SEQ ID NO: 4071992 - RNA, 15 nt, Streptococcus pneumoniae R6
aaugaacaucccaag

SEQ ID NO: 4071993 - RNA, 19 nt, Streptococcus pneumoniae R6
aaugaaguuagguuuuguu

SEQ ID NO: 4071994 - RNA, 14 nt, Streptococcus pneumoniae R6
aaugaauccgaaaa

SEQ ID NO: 4071995 - RNA, 17 nt, Streptococcus pneumoniae R6
aaugaauuugaaacaau

SEQ ID NO: 4071996 - RNA, 22 nt, Streptococcus pneumoniae R6
aaugaauuugaaacaaugaaaa

SEQ ID NO: 4071997 - RNA, 16 nt, Streptococcus pneumoniae R6
aaugacaaauccauuc

SEQ ID NO: 4071998 - RNA, 16 nt, Streptococcus pneumoniae R6
aaugacaauuauauaa

SEQ ID NO: 4071999 - RNA, 13 nt, Streptococcus pneumoniae R6
aaugacaauuuuu

SEQ ID NO: 4072000 - RNA, 19 nt, Streptococcus pneumoniae R6
aaugacacguaucggaaau

SEQ ID NO: 4072001 - RNA, 23 nt, Streptococcus pneumoniae R6
aaugacaugcuccucuguaucaa

SEQ ID NO: 4072002 - RNA, 23 nt, Streptococcus pneumoniae R6
aaugacgaaacgaagaaggaaga

SEQ ID NO: 4072003 - RNA, 14 nt, Streptococcus pneumoniae R6
aaugacuaauucua

SEQ ID NO: 4072004 - RNA, 19 nt, Streptococcus pneumoniae R6
aaugacucaaaaacuucuu

SEQ ID NO: 4072005 - RNA, 22 nt, Streptococcus pneumoniae R6
aaugacucccauaaaaauaaua

SEQ ID NO: 4072006 - RNA, 19 nt, Streptococcus pneumoniae R6
aaugacuuguguuuuuccu

SEQ ID NO: 4072007 - RNA, 22 nt, Streptococcus pneumoniae R6
aaugacuuucuaauuauuucaa

SEQ ID NO: 4072008 - RNA, 16 nt, Streptococcus pneumoniae R6
aaugagaaauuuuugg

SEQ ID NO: 4072009 - RNA, 18 nt, Streptococcus pneumoniae R6
aaugagccaaggaagucu

SEQ ID NO: 4072010 - RNA, 15 nt, Streptococcus pneumoniae R6
aaugagcuuccagua

SEQ ID NO: 4072011 - RNA, 20 nt, Streptococcus pneumoniae R6
aaugaggaaggggacaaggu

SEQ ID NO: 4072012 - RNA, 14 nt, Streptococcus pneumoniae R6
aaugaguaagaacu

SEQ ID NO: 4072013 - RNA, 14 nt, Streptococcus pneumoniae R6
aaugaguccgaaaa

SEQ ID NO: 4072014 - RNA, 17 nt, Streptococcus pneumoniae R6
aaugaguccgaaaaauu

SEQ ID NO: 4072015 - RNA, 17 nt, Streptococcus pneumoniae R6
aaugagucuaucaaaca

SEQ ID NO: 4072016 - RNA, 23 nt, Streptococcus pneumoniae R6
aaugagugcuguaauacgaaggg

SEQ ID NO: 4072017 - RNA, 16 nt, Streptococcus pneumoniae R6
aaugaguuguuuuguc

SEQ ID NO: 4072018 - RNA, 17 nt, Streptococcus pneumoniae R6
aaugauaccuugaucaa

SEQ ID NO: 4072019 - RNA, 23 nt, Streptococcus pneumoniae R6
aaugauaugguauuuaaaaccuc

SEQ ID NO: 4072020 - RNA, 19 nt, Streptococcus pneumoniae R6
aaugauauuuucaaaaaaa

SEQ ID NO: 4072021 - RNA, 12 nt, Streptococcus pneumoniae R6
aaugaucagacc

SEQ ID NO: 4072022 - RNA, 13 nt, Streptococcus pneumoniae R6
aaugaucagacca

SEQ ID NO: 4072023 - RNA, 21 nt, Streptococcus pneumoniae R6
aaugaugagggcgauuuuccc

SEQ ID NO: 4072024 - RNA, 15 nt, Streptococcus pneumoniae R6
aaugauuagauuuag

SEQ ID NO: 4072025 - RNA, 20 nt, Streptococcus pneumoniae R6
aaugauucuuuucaucucuu

SEQ ID NO: 4072026 - RNA, 20 nt, Streptococcus pneumoniae R6
aaugauuuggcaaauuccuu

SEQ ID NO: 4072027 - RNA, 24 nt, Streptococcus pneumoniae R6
aaugauuuggcaaauuccuugaug

SEQ ID NO: 4072028 - RNA, 15 nt, Streptococcus pneumoniae R6
aaugauuuuuuacug

SEQ ID NO: 4072029 - RNA, 13 nt, Streptococcus pneumoniae R6
aaugcaaagccaa

SEQ ID NO: 4072030 - RNA, 16 nt, Streptococcus pneumoniae R6
aaugcaccaaaacagg

SEQ ID NO: 4072031 - RNA, 13 nt, Streptococcus pneumoniae R6
aaugcaguaaauc

SEQ ID NO: 4072032 - RNA, 15 nt, Streptococcus pneumoniae R6
aaugccaaaauucca

SEQ ID NO: 4072033 - RNA, 17 nt, Streptococcus pneumoniae R6
aaugcccaauucuugag

SEQ ID NO: 4072034 - RNA, 15 nt, Streptococcus pneumoniae R6
aaugcccuuuuuugu

SEQ ID NO: 4072035 - RNA, 19 nt, Streptococcus pneumoniae R6
aaugccgauucccaaacuu

SEQ ID NO: 4072036 - RNA, 19 nt, Streptococcus pneumoniae R6
aaugccuccaagaaagaga

SEQ ID NO: 4072037 - RNA, 20 nt, Streptococcus pneumoniae R6
aaugcgccaccaacugcacc

SEQ ID NO: 4072038 - RNA, 17 nt, Streptococcus pneumoniae R6
aaugcuaauuuagaaau

SEQ ID NO: 4072039 - RNA, 16 nt, Streptococcus pneumoniae R6
aaugcucccuucuuua

SEQ ID NO: 4072040 - RNA, 15 nt, Streptococcus pneumoniae R6
aaugcuguuucuaua

SEQ ID NO: 4072041 - RNA, 21 nt, Streptococcus pneumoniae R6
aaugcuucuuggauaccuuua

SEQ ID NO: 4072042 - RNA, 15 nt, Streptococcus pneumoniae R6
aauucuaaaaacaga

SEQ ID NO: 4072043 - RNA, 21 nt, Streptococcus pneumoniae R6
aauucucaagcugugaguuca

SEQ ID NO: 4072044 - RNA, 23 nt, Streptococcus pneumoniae R6
aauucuccauuuuggauauaaga

SEQ ID NO: 4072045 - RNA, 22 nt, Streptococcus pneumoniae R6
aauucucguauauagugacuau

SEQ ID NO: 4072046 - RNA, 15 nt, Streptococcus pneumoniae R6
aauucucuaaauaag

SEQ ID NO: 4072047 - RNA, 11 nt, Streptococcus pneumoniae R6
aauucugccaa

SEQ ID NO: 4072048 - RNA, 17 nt, Streptococcus pneumoniae R6
aauucugcuuuuaaaua

SEQ ID NO: 4072049 - RNA, 18 nt, Streptococcus pneumoniae R6
aauucugucacaacugaa

SEQ ID NO: 4072050 - RNA, 14 nt, Streptococcus pneumoniae R6
aauucugucuuaga

SEQ ID NO: 4072051 - RNA, 12 nt, Streptococcus pneumoniae R6
aauucuguuuga

SEQ ID NO: 4072052 - RNA, 16 nt, Streptococcus pneumoniae R6
aauucuucauagaguu

SEQ ID NO: 4072053 - RNA, 19 nt, Streptococcus pneumoniae R6
aauucuuccuacugauauc

SEQ ID NO: 4072054 - RNA, 21 nt, Streptococcus pneumoniae R6
aauucuucguaagauucuucu

SEQ ID NO: 4072055 - RNA, 14 nt, Streptococcus pneumoniae R6
aauucuucuccuac

SEQ ID NO: 4072056 - RNA, 19 nt, Streptococcus pneumoniae R6
aauucuucuguuucugcaa

SEQ ID NO: 4072057 - RNA, 23 nt, Streptococcus pneumoniae R6
aauucuucuucugaaaagacgua

SEQ ID NO: 4072058 - RNA, 14 nt, Streptococcus pneumoniae R6
aauucuugaaaauc

SEQ ID NO: 4072059 - RNA, 23 nt, Streptococcus pneumoniae R6
aauucuuggaucuuagguugguu

SEQ ID NO: 4072060 - RNA, 22 nt, Streptococcus pneumoniae R6
aauucuugguugccuuuuugaa

SEQ ID NO: 4072061 - RNA, 18 nt, Streptococcus pneumoniae R6
aauucuuugaaaucagaa

SEQ ID NO: 4072062 - RNA, 20 nt, Streptococcus pneumoniae R6
aauucuuugaaaucagaaaa

SEQ ID NO: 4072063 - RNA, 22 nt, Streptococcus pneumoniae R6
aauucuuugaaaucagaaaaaa

SEQ ID NO: 4072064 - RNA, 11 nt, Streptococcus pneumoniae R6
aauucuuuucc

SEQ ID NO: 4072065 - RNA, 19 nt, Streptococcus pneumoniae R6
aauucuuuucgaaacucuu

SEQ ID NO: 4072066 - RNA, 18 nt, Streptococcus pneumoniae R6
aauugaaaacgguaacaa

SEQ ID NO: 4072067 - RNA, 18 nt, Streptococcus pneumoniae R6
aauugaaaauucacaaaa

SEQ ID NO: 4072068 - RNA, 12 nt, Streptococcus pneumoniae R6
aauugaaacaag

SEQ ID NO: 4072069 - RNA, 20 nt, Streptococcus pneumoniae R6
aauugaauaaagucaacaga

SEQ ID NO: 4072070 - RNA, 16 nt, Streptococcus pneumoniae R6
aauugaggaaguacca

SEQ ID NO: 4072071 - RNA, 20 nt, Streptococcus pneumoniae R6
aauugauaagaggauuuuaa

SEQ ID NO: 4072072 - RNA, 24 nt, Streptococcus pneumoniae R6
aauugauaagaggauuuuaaagua

SEQ ID NO: 4072073 - RNA, 17 nt, Streptococcus pneumoniae R6
aauugauaauaguaugu

SEQ ID NO: 4072074 - RNA, 20 nt, Streptococcus pneumoniae R6
aauugauaauaguaugucug

SEQ ID NO: 4072075 - RNA, 22 nt, Streptococcus pneumoniae R6
aauugauaauaguaugucugaa

SEQ ID NO: 4072076 - RNA, 12 nt, Streptococcus pneumoniae R6
aauugauuaagu

SEQ ID NO: 4072077 - RNA, 16 nt, Streptococcus pneumoniae R6
aauugauuaagugauu

SEQ ID NO: 4072078 - RNA, 19 nt, Streptococcus pneumoniae R6
aauugauuaagugauuuaa

SEQ ID NO: 4072079 - RNA, 15 nt, Streptococcus pneumoniae R6
aauugauuuauagaa

SEQ ID NO: 4072080 - RNA, 21 nt, Streptococcus pneumoniae R6
aauugauuuguucgcaucuua

SEQ ID NO: 4072081 - RNA, 14 nt, Streptococcus pneumoniae R6
aauugcaaauuuag

SEQ ID NO: 4072082 - RNA, 15 nt, Streptococcus pneumoniae R6
aauugcaagagggcu

SEQ ID NO: 4072083 - RNA, 15 nt, Streptococcus pneumoniae R6
aauugcacuuuccuc

SEQ ID NO: 4072084 - RNA, 21 nt, Streptococcus pneumoniae R6
aauugcaggagaaaaugaaau

SEQ ID NO: 4072085 - RNA, 23 nt, Streptococcus pneumoniae R6
aauugcccaaagcucaagaguuc

SEQ ID NO: 4072086 - RNA, 20 nt, Streptococcus pneumoniae R6
aauugccugauaacgaagag

SEQ ID NO: 4072087 - RNA, 18 nt, Streptococcus pneumoniae R6
aauugcgauuuugccaag

SEQ ID NO: 4072088 - RNA, 15 nt, Streptococcus pneumoniae R6
aauugcggaauucaa

SEQ ID NO: 4072089 - RNA, 12 nt, Streptococcus pneumoniae R6
aauugcuaaaac

SEQ ID NO: 4072090 - RNA, 14 nt, Streptococcus pneumoniae R6
aauugcuaaaacau

SEQ ID NO: 4072091 - RNA, 18 nt, Streptococcus pneumoniae R6
aauugcuaaaacauuuau

SEQ ID NO: 4072092 - RNA, 14 nt, Streptococcus pneumoniae R6
aauuggaaaauaaa

SEQ ID NO: 4072093 - RNA, 15 nt, Streptococcus pneumoniae R6
aauugggccuuagua

SEQ ID NO: 4072094 - RNA, 17 nt, Streptococcus pneumoniae R6
aauugguuaaaagcuca

SEQ ID NO: 4072095 - RNA, 14 nt, Streptococcus pneumoniae R6
aauugguuacgauu

SEQ ID NO: 4072096 - RNA, 14 nt, Streptococcus pneumoniae R6
aauuguaaaaagag

SEQ ID NO: 4072097 - RNA, 20 nt, Streptococcus pneumoniae R6
aauuguaaagacuuuuugcc

SEQ ID NO: 4072098 - RNA, 18 nt, Streptococcus pneumoniae R6
aauuguagauguucuuug

SEQ ID NO: 4072099 - RNA, 21 nt, Streptococcus pneumoniae R6
aauuguagauguucuuugaaa

SEQ ID NO: 4072100 - RNA, 22 nt, Streptococcus pneumoniae R6
aauuguagcuuuauuaagcccu

SEQ ID NO: 4072101 - RNA, 15 nt, Streptococcus pneumoniae R6
aauuguaggaaagaa

SEQ ID NO: 4072102 - RNA, 16 nt, Streptococcus pneumoniae R6
aauuguaggaaagaag

SEQ ID NO: 4072103 - RNA, 18 nt, Streptococcus pneumoniae R6
aauugucuaaaaauuuaa

SEQ ID NO: 4072104 - RNA, 19 nt, Streptococcus pneumoniae R6
aauugucuaacuuuuuugg

SEQ ID NO: 4072105 - RNA, 19 nt, Streptococcus pneumoniae R6
aauugucuaagcgaaacaa

SEQ ID NO: 4072106 - RNA, 21 nt, Streptococcus pneumoniae R6
aauugucuaagcgaaacaacc

SEQ ID NO: 4072107 - RNA, 15 nt, Streptococcus pneumoniae R6
aauugucugaaguug

SEQ ID NO: 4072108 - RNA, 15 nt, Streptococcus pneumoniae R6
aauugugacucuuuu

SEQ ID NO: 4072109 - RNA, 15 nt, Streptococcus pneumoniae R6
aauuguguuuuugcc

SEQ ID NO: 4072110 - RNA, 14 nt, Streptococcus pneumoniae R6
aauuguuaaaguuc

SEQ ID NO: 4072111 - RNA, 16 nt, Streptococcus pneumoniae R6
aauuguuuauaaaaua

SEQ ID NO: 4072112 - RNA, 23 nt, Streptococcus pneumoniae R6
aauuguuucguacuauuucagau

SEQ ID NO: 4072113 - RNA, 11 nt, Streptococcus pneumoniae R6
aauuuaaaaag

SEQ ID NO: 4072114 - RNA, 17 nt, Streptococcus pneumoniae R6
aauuuaaaaagaaauau

SEQ ID NO: 4072115 - RNA, 20 nt, Streptococcus pneumoniae R6
aauuuaaaaagaaauauaua

SEQ ID NO: 4072116 - RNA, 17 nt, Streptococcus pneumoniae R6
aauuuaaccaaaccaac

SEQ ID NO: 4072117 - RNA, 19 nt, Streptococcus pneumoniae R6
aauuuaauccacuauaaua

SEQ ID NO: 4072118 - RNA, 22 nt, Streptococcus pneumoniae R6
aauuuaccaaggaagcugaggg

SEQ ID NO: 4072119 - RNA, 16 nt, Streptococcus pneumoniae R6
aauuuagagaaugaaa

SEQ ID NO: 4072120 - RNA, 14 nt, Streptococcus pneumoniae R6
aauuuauaauauaa

SEQ ID NO: 4072121 - RNA, 17 nt, Streptococcus pneumoniae R6
aauuuauacuaauacau

SEQ ID NO: 4072122 - RNA, 14 nt, Streptococcus pneumoniae R6
aauuuauccgaaga

SEQ ID NO: 4072123 - RNA, 22 nt, Streptococcus pneumoniae R6
aauuuauugguauuaauaauuu

SEQ ID NO: 4072124 - RNA, 17 nt, Streptococcus pneumoniae R6
aauuucaaaaucuucug

SEQ ID NO: 4072125 - RNA, 13 nt, Streptococcus pneumoniae R6
aauuucaaaguag

SEQ ID NO: 4072126 - RNA, 15 nt, Streptococcus pneumoniae R6
aauuucaauguacua

SEQ ID NO: 4072127 - RNA, 19 nt, Streptococcus pneumoniae R6
aauuucacuauauugcaag

SEQ ID NO: 4072128 - RNA, 18 nt, Streptococcus pneumoniae R6
aauuucagaaaucuucuc

SEQ ID NO: 4072129 - RNA, 16 nt, Streptococcus pneumoniae R6
aauuucagaagaaaaa

SEQ ID NO: 4072130 - RNA, 19 nt, Streptococcus pneumoniae R6
aauuucagaagaaaaaaag

SEQ ID NO: 4072131 - RNA, 21 nt, Streptococcus pneumoniae R6
aauuucagaagaaaaaaagua

SEQ ID NO: 4072132 - RNA, 18 nt, Streptococcus pneumoniae R6
aauuucaugacagauuca

SEQ ID NO: 4072133 - RNA, 21 nt, Streptococcus pneumoniae R6
aauuucaugacagauucauca

SEQ ID NO: 4072134 - RNA, 20 nt, Streptococcus pneumoniae R6
aauuucaugguucgggauaa

SEQ ID NO: 4072135 - RNA, 22 nt, Streptococcus pneumoniae R6
aauuucauuaaauggaauagua

SEQ ID NO: 4072136 - RNA, 13 nt, Streptococcus pneumoniae R6
aauuucauuacua

SEQ ID NO: 4072137 - RNA, 11 nt, Streptococcus pneumoniae R6
aauuucauuuc

SEQ ID NO: 4072138 - RNA, 12 nt, Streptococcus pneumoniae R6
aauuucauuucu

SEQ ID NO: 4072139 - RNA, 11 nt, Streptococcus pneumoniae R6
aauuucauuuu

SEQ ID NO: 4072140 - RNA, 13 nt, Streptococcus pneumoniae R6
aauuucgaaaaau

SEQ ID NO: 4072141 - RNA, 15 nt, Streptococcus pneumoniae R6
aauuucgauugucau

SEQ ID NO: 4072142 - RNA, 18 nt, Streptococcus pneumoniae R6
aauuucuacaaauguuuu

SEQ ID NO: 4072143 - RNA, 13 nt, Streptococcus pneumoniae R6
aauuucuagaaau

SEQ ID NO: 4072144 - RNA, 20 nt, Streptococcus pneumoniae R6
aauuucuagcaaaguuuuag

SEQ ID NO: 4072145 - RNA, 17 nt, Streptococcus pneumoniae R6
acaaagagccccuuucu

SEQ ID NO: 4072146 - RNA, 17 nt, Streptococcus pneumoniae R6
acaaagagccgaaaaaa

SEQ ID NO: 4072147 - RNA, 12 nt, Streptococcus pneumoniae R6
acaaagauaaaa

SEQ ID NO: 4072148 - RNA, 21 nt, Streptococcus pneumoniae R6
acaaagcccauacgcccucca

SEQ ID NO: 4072149 - RNA, 18 nt, Streptococcus pneumoniae R6
acaaagccggguuuucca

SEQ ID NO: 4072150 - RNA, 23 nt, Streptococcus pneumoniae R6
acaaagggaugauguuaucaaau

SEQ ID NO: 4072151 - RNA, 13 nt, Streptococcus pneumoniae R6
acaaagggcaagc

SEQ ID NO: 4072152 - RNA, 18 nt, Streptococcus pneumoniae R6
acaaaggucaaaauuccu

SEQ ID NO: 4072153 - RNA, 22 nt, Streptococcus pneumoniae R6
acaaaggucaaaauuccuaaaa

SEQ ID NO: 4072154 - RNA, 23 nt, Streptococcus pneumoniae R6
acaaagguuugauuaguccauuc

SEQ ID NO: 4072155 - RNA, 14 nt, Streptococcus pneumoniae R6
acaaaguauuaaaa

SEQ ID NO: 4072156 - RNA, 17 nt, Streptococcus pneumoniae R6
acaaaguauuaaaauaa

SEQ ID NO: 4072157 - RNA, 14 nt, Streptococcus pneumoniae R6
acaaaguauuuuuu

SEQ ID NO: 4072158 - RNA, 14 nt, Streptococcus pneumoniae R6
acaaaguuugaaaa

SEQ ID NO: 4072159 - RNA, 15 nt, Streptococcus pneumoniae R6
acaaaguuugaaaag

SEQ ID NO: 4072160 - RNA, 22 nt, Streptococcus pneumoniae R6
acaaauaaacggacaaaacugu

SEQ ID NO: 4072161 - RNA, 14 nt, Streptococcus pneumoniae R6
acaaauaaaucauu

SEQ ID NO: 4072162 - RNA, 16 nt, Streptococcus pneumoniae R6
acaaauaauuuaucca

SEQ ID NO: 4072163 - RNA, 18 nt, Streptococcus pneumoniae R6
acaaauaauuuauccaaa

SEQ ID NO: 4072164 - RNA, 15 nt, Streptococcus pneumoniae R6
acaaaucagaaaagu

SEQ ID NO: 4072165 - RNA, 19 nt, Streptococcus pneumoniae R6
acaaaucagaaaaguaacu

SEQ ID NO: 4072166 - RNA, 15 nt, Streptococcus pneumoniae R6
acaaauccaaucuuc

SEQ ID NO: 4072167 - RNA, 13 nt, Streptococcus pneumoniae R6
acaaaucccauga

SEQ ID NO: 4072168 - RNA, 19 nt, Streptococcus pneumoniae R6
acaaaucgauugggaaagu

SEQ ID NO: 4072169 - RNA, 23 nt, Streptococcus pneumoniae R6
acaaaucgauugggaaaguaaaa

SEQ ID NO: 4072170 - RNA, 18 nt, Streptococcus pneumoniae R6
acaaaucuaagucaaaua

SEQ ID NO: 4072171 - RNA, 21 nt, Streptococcus pneumoniae R6
acaaaucuucuguagacaggc

SEQ ID NO: 4072172 - RNA, 17 nt, Streptococcus pneumoniae R6
acaaauguugaaucauu

SEQ ID NO: 4072173 - RNA, 13 nt, Streptococcus pneumoniae R6
acaaauguuuuag

SEQ ID NO: 4072174 - RNA, 23 nt, Streptococcus pneumoniae R6
acaaauuaauucggaaagccaaa

SEQ ID NO: 4072175 - RNA, 23 nt, Streptococcus pneumoniae R6
acaaauuaauugcggaauucaaa

SEQ ID NO: 4072176 - RNA, 23 nt, Streptococcus pneumoniae R6
acaaauucgacugccucucuucu

SEQ ID NO: 4072177 - RNA, 13 nt, Streptococcus pneumoniae R6
acaaauucuccac

SEQ ID NO: 4072178 - RNA, 13 nt, Streptococcus pneumoniae R6
acaaauugauuug

SEQ ID NO: 4072179 - RNA, 20 nt, Streptococcus pneumoniae R6
acaaauugauuugaauucca

SEQ ID NO: 4072180 - RNA, 19 nt, Streptococcus pneumoniae R6
acaaauuuauacuaauaca

SEQ ID NO: 4072181 - RNA, 17 nt, Streptococcus pneumoniae R6
acaaauuugaaaaucuu

SEQ ID NO: 4072182 - RNA, 14 nt, Streptococcus pneumoniae R6
acaacaaaaaaggu

SEQ ID NO: 4072183 - RNA, 17 nt, Streptococcus pneumoniae R6
acaacaauggaaaugau

SEQ ID NO: 4072184 - RNA, 20 nt, Streptococcus pneumoniae R6
acaacaccaucauagucuuu

SEQ ID NO: 4072185 - RNA, 14 nt, Streptococcus pneumoniae R6
acaacagcuacacc

SEQ ID NO: 4072186 - RNA, 16 nt, Streptococcus pneumoniae R6
acaacaggaaaagucu

SEQ ID NO: 4072187 - RNA, 13 nt, Streptococcus pneumoniae R6
acaacaucuuucc

SEQ ID NO: 4072188 - RNA, 21 nt, Streptococcus pneumoniae R6
acaacauggcuuccaggaaug

SEQ ID NO: 4072189 - RNA, 14 nt, Streptococcus pneumoniae R6
acaaccaaacuguc

SEQ ID NO: 4072190 - RNA, 23 nt, Streptococcus pneumoniae R6
acaaccaauuucuuaauagcuga

SEQ ID NO: 4072191 - RNA, 22 nt, Streptococcus pneumoniae R6
acaaccaggucaucugcuuuag

SEQ ID NO: 4072192 - RNA, 14 nt, Streptococcus pneumoniae R6
acaaccgauaagaa

SEQ ID NO: 4072193 - RNA, 15 nt, Streptococcus pneumoniae R6
acaaccgauaagaau

SEQ ID NO: 4072194 - RNA, 16 nt, Streptococcus pneumoniae R6
acaaccucaaaacaau

SEQ ID NO: 4072195 - RNA, 22 nt, Streptococcus pneumoniae R6
acaaccucaaaacaauguuuug

SEQ ID NO: 4072196 - RNA, 22 nt, Streptococcus pneumoniae R6
acaaccucaaaacaguguuuug

SEQ ID NO: 4072197 - RNA, 16 nt, Streptococcus pneumoniae R6
acaaccuuaaaacagu

SEQ ID NO: 4072198 - RNA, 18 nt, Streptococcus pneumoniae R6
acaaccuuaaaacagugu

SEQ ID NO: 4072199 - RNA, 24 nt, Streptococcus pneumoniae R6
acaacgaguguauuguacuuucca

SEQ ID NO: 4072200 - RNA, 17 nt, Streptococcus pneumoniae R6
acaacuaacaauuaugc

SEQ ID NO: 4072201 - RNA, 23 nt, Streptococcus pneumoniae R6
acaacugauucuacuuuuucaaa

SEQ ID NO: 4072202 - RNA, 13 nt, Streptococcus pneumoniae R6
acaacuuaaaaag

SEQ ID NO: 4072203 - RNA, 15 nt, Streptococcus pneumoniae R6
acaacuuaaaaagag

SEQ ID NO: 4072204 - RNA, 17 nt, Streptococcus pneumoniae R6
acaacuuaaaaagaggu

SEQ ID NO: 4072205 - RNA, 20 nt, Streptococcus pneumoniae R6
acaacuuauaaaaaacacaa

SEQ ID NO: 4072206 - RNA, 14 nt, Streptococcus pneumoniae R6
acaagaacagucuc

SEQ ID NO: 4072207 - RNA, 22 nt, Streptococcus pneumoniae R6
acaagacaaaagagccucauaa

SEQ ID NO: 4072208 - RNA, 17 nt, Streptococcus pneumoniae R6
acaagacgaaccaaugu

SEQ ID NO: 4072209 - RNA, 20 nt, Streptococcus pneumoniae R6
acaagacgaaccaaugugca

SEQ ID NO: 4072210 - RNA, 23 nt, Streptococcus pneumoniae R6
acaagacuaccgcuccuaaucuc

SEQ ID NO: 4072211 - RNA, 14 nt, Streptococcus pneumoniae R6
acaagagcaaggaa

SEQ ID NO: 4072212 - RNA, 14 nt, Streptococcus pneumoniae R6
acaagccuagucuu

SEQ ID NO: 4072213 - RNA, 17 nt, Streptococcus pneumoniae R6
acaagccuuuaucugcc

SEQ ID NO: 4072214 - RNA, 19 nt, Streptococcus pneumoniae R6
acaagcgcuauuaaaauuc

SEQ ID NO: 4072215 - RNA, 16 nt, Streptococcus pneumoniae R6
acaagcucaucuuuga

SEQ ID NO: 4072216 - RNA, 20 nt, Streptococcus pneumoniae R6
acaagggcaaaaaagaaacc

SEQ ID NO: 4072217 - RNA, 23 nt, Streptococcus pneumoniae R6
acaaguaaguagcaucuugcucg

SEQ ID NO: 4072218 - RNA, 17 nt, Streptococcus pneumoniae R6
acaaguauuguaagaau

SEQ ID NO: 4072219 - RNA, 16 nt, Streptococcus pneumoniae R6
acaagucagcucaaag

SEQ ID NO: 4072220 - RNA, 18 nt, Streptococcus pneumoniae R6
acaagucauccaugauaa

SEQ ID NO: 4072221 - RNA, 20 nt, Streptococcus pneumoniae R6
acaagucuugccuucaaccu

SEQ ID NO: 4072222 - RNA, 13 nt, Streptococcus pneumoniae R6
acaagugaaagug

SEQ ID NO: 4072223 - RNA, 23 nt, Streptococcus pneumoniae R6
acaagugaaguaacgauagcacc

SEQ ID NO: 4072224 - RNA, 14 nt, Streptococcus pneumoniae R6
acaaguguuuucac

SEQ ID NO: 4072225 - RNA, 13 nt, Streptococcus pneumoniae R6
acaaguuaaauaa

SEQ ID NO: 4072226 - RNA, 14 nt, Streptococcus pneumoniae R6
acaaguuagccaca

SEQ ID NO: 4072227 - RNA, 16 nt, Streptococcus pneumoniae R6
acaaguugcuugaaaa

SEQ ID NO: 4072228 - RNA, 13 nt, Streptococcus pneumoniae R6
acaauaaaaagca

SEQ ID NO: 4072229 - RNA, 20 nt, Streptococcus pneumoniae R6
acaauaaaacgcauaguaca

SEQ ID NO: 4072230 - RNA, 22 nt, Streptococcus pneumoniae R6
acaauaaaacgcaucauaucaa

SEQ ID NO: 4072231 - RNA, 17 nt, Streptococcus pneumoniae R6
acaauaaaaucaaacaa

SEQ ID NO: 4072232 - RNA, 15 nt, Streptococcus pneumoniae R6
acaauaaaauccaug

SEQ ID NO: 4072233 - RNA, 21 nt, Streptococcus pneumoniae R6
acaauaaagauaagcgcuagc

SEQ ID NO: 4072234 - RNA, 14 nt, Streptococcus pneumoniae R6
acaauaaagguguu

SEQ ID NO: 4072235 - RNA, 23 nt, Streptococcus pneumoniae R6
acaauaaagguguucaauccacu

SEQ ID NO: 4072236 - RNA, 15 nt, Streptococcus pneumoniae R6
acaauaaaucuguca

SEQ ID NO: 4072237 - RNA, 18 nt, Streptococcus pneumoniae R6
acaauaagagaauuaaga

SEQ ID NO: 4072238 - RNA, 19 nt, Streptococcus pneumoniae R6
acaauaagauaucacucau

SEQ ID NO: 4072239 - RNA, 22 nt, Streptococcus pneumoniae R6
acaauaauugguacauuuugau

SEQ ID NO: 4072240 - RNA, 19 nt, Streptococcus pneumoniae R6
acaauacaguagaugauuu

SEQ ID NO: 4072241 - RNA, 16 nt, Streptococcus pneumoniae R6
acaauacccacugcga

SEQ ID NO: 4072242 - RNA, 14 nt, Streptococcus pneumoniae R6
acaauaccuuuccu

SEQ ID NO: 4072243 - RNA, 19 nt, Streptococcus pneumoniae R6
acaauagcuaguagggaaa

SEQ ID NO: 4072244 - RNA, 18 nt, Streptococcus pneumoniae R6
acaauagcuuguuccaau

SEQ ID NO: 4072245 - RNA, 14 nt, Streptococcus pneumoniae R6
acaauauagccuaa

SEQ ID NO: 4072246 - RNA, 15 nt, Streptococcus pneumoniae R6
acaauauuuuagaag

SEQ ID NO: 4072247 - RNA, 19 nt, Streptococcus pneumoniae R6
acagcauuggaggcaaacu

SEQ ID NO: 4072248 - RNA, 23 nt, Streptococcus pneumoniae R6
acagcauuggaggcaaacuucua

SEQ ID NO: 4072249 - RNA, 20 nt, Streptococcus pneumoniae R6
acagccaaaaguccaaagau

SEQ ID NO: 4072250 - RNA, 20 nt, Streptococcus pneumoniae R6
acagccaucagagaggucca

SEQ ID NO: 4072251 - RNA, 20 nt, Streptococcus pneumoniae R6
acagccaugguguguaguug

SEQ ID NO: 4072252 - RNA, 15 nt, Streptococcus pneumoniae R6
acagcgccuguugcu

SEQ ID NO: 4072253 - RNA, 14 nt, Streptococcus pneumoniae R6
acagcuaaagcacc

SEQ ID NO: 4072254 - RNA, 17 nt, Streptococcus pneumoniae R6
acagcuaaagcaccuga

SEQ ID NO: 4072255 - RNA, 14 nt, Streptococcus pneumoniae R6
acagcuagucuagu

SEQ ID NO: 4072256 - RNA, 18 nt, Streptococcus pneumoniae R6
acagcuagucuagucugg

SEQ ID NO: 4072257 - RNA, 19 nt, Streptococcus pneumoniae R6
acagcugcgauaaggaagu

SEQ ID NO: 4072258 - RNA, 15 nt, Streptococcus pneumoniae R6
acagcugcgauuuua

SEQ ID NO: 4072259 - RNA, 16 nt, Streptococcus pneumoniae R6
acagcuguaucaauug

SEQ ID NO: 4072260 - RNA, 18 nt, Streptococcus pneumoniae R6
acagcuugagauuucacg

SEQ ID NO: 4072261 - RNA, 19 nt, Streptococcus pneumoniae R6
acagcuugguaaugcucca

SEQ ID NO: 4072262 - RNA, 15 nt, Streptococcus pneumoniae R6
acagcuuguugcuuu

SEQ ID NO: 4072263 - RNA, 19 nt, Streptococcus pneumoniae R6
acagcuuguugcuuuucuu

SEQ ID NO: 4072264 - RNA, 20 nt, Streptococcus pneumoniae R6
acagcuuguugcuuuucuuc

SEQ ID NO: 4072265 - RNA, 15 nt, Streptococcus pneumoniae R6
acagcuuuuuucuuu

SEQ ID NO: 4072266 - RNA, 20 nt, Streptococcus pneumoniae R6
acaggaaaagucuuauaaua

SEQ ID NO: 4072267 - RNA, 22 nt, Streptococcus pneumoniae R6
acaggacguccgugaggacagu

SEQ ID NO: 4072268 - RNA, 22 nt, Streptococcus pneumoniae R6
acaggauuaccuuugaaaaaau

SEQ ID NO: 4072269 - RNA, 13 nt, Streptococcus pneumoniae R6
acaggauuuuguu

SEQ ID NO: 4072270 - RNA, 19 nt, Streptococcus pneumoniae R6
acaggcaaccaaaaucaua

SEQ ID NO: 4072271 - RNA, 18 nt, Streptococcus pneumoniae R6
acaggggauugauuaucc

SEQ ID NO: 4072272 - RNA, 15 nt, Streptococcus pneumoniae R6
acaggugcuuaaaua

SEQ ID NO: 4072273 - RNA, 23 nt, Streptococcus pneumoniae R6
acagguguuauuagcugauuaug

SEQ ID NO: 4072274 - RNA, 12 nt, Streptococcus pneumoniae R6
acaguaaaaaau

SEQ ID NO: 4072275 - RNA, 18 nt, Streptococcus pneumoniae R6
acaguaaaaaaucauuuu

SEQ ID NO: 4072276 - RNA, 22 nt, Streptococcus pneumoniae R6
acaguacacaggaauacuaaaa

SEQ ID NO: 4072277 - RNA, 20 nt, Streptococcus pneumoniae R6
acaguauuuauaaacuuuau

SEQ ID NO: 4072278 - RNA, 17 nt, Streptococcus pneumoniae R6
acagucaaaucgauuuc

SEQ ID NO: 4072279 - RNA, 20 nt, Streptococcus pneumoniae R6
acagucaaaucgauuucuaa

SEQ ID NO: 4072280 - RNA, 13 nt, Streptococcus pneumoniae R6
acagucaguucau

SEQ ID NO: 4072281 - RNA, 21 nt, Streptococcus pneumoniae R6
acaguccucccuuguuuuuau

SEQ ID NO: 4072282 - RNA, 17 nt, Streptococcus pneumoniae R6
acaguccuuguuuccau

SEQ ID NO: 4072283 - RNA, 16 nt, Streptococcus pneumoniae R6
acagucgcaaagagga

SEQ ID NO: 4072284 - RNA, 17 nt, Streptococcus pneumoniae R6
acagucgcaaagaggaa

SEQ ID NO: 4072285 - RNA, 21 nt, Streptococcus pneumoniae R6
acagucgcaaagaggaagagg

SEQ ID NO: 4072286 - RNA, 14 nt, Streptococcus pneumoniae R6
acagucugaaaaag

SEQ ID NO: 4072287 - RNA, 15 nt, Streptococcus pneumoniae R6
acagucugaaaaaga

SEQ ID NO: 4072288 - RNA, 15 nt, Streptococcus pneumoniae R6
acagucugaaaaaua

SEQ ID NO: 4072289 - RNA, 16 nt, Streptococcus pneumoniae R6
acagucugaaaaauag

SEQ ID NO: 4072290 - RNA, 19 nt, Streptococcus pneumoniae R6
acagugaaggcuuuaaaug

SEQ ID NO: 4072291 - RNA, 15 nt, Streptococcus pneumoniae R6
acaguguacauacuu

SEQ ID NO: 4072292 - RNA, 12 nt, Streptococcus pneumoniae R6
acaguguuuuaa

SEQ ID NO: 4072293 - RNA, 17 nt, Streptococcus pneumoniae R6
acaguguuuugagcagc

SEQ ID NO: 4072294 - RNA, 23 nt, Streptococcus pneumoniae R6
acaguugacaaagagccauaaaa

SEQ ID NO: 4072295 - RNA, 21 nt, Streptococcus pneumoniae R6
acaguuucggcuguucuuuuu

SEQ ID NO: 4072296 - RNA, 19 nt, Streptococcus pneumoniae R6
acaguuuuuaauuuuucuu

SEQ ID NO: 4072297 - RNA, 21 nt, Streptococcus pneumoniae R6
acauaaaucgaucauauuuau

SEQ ID NO: 4072298 - RNA, 13 nt, Streptococcus pneumoniae R6
acauaaucaagau

SEQ ID NO: 4072299 - RNA, 14 nt, Streptococcus pneumoniae R6
acauaauuuaaaau

SEQ ID NO: 4072300 - RNA, 21 nt, Streptococcus pneumoniae R6
acauaauuuuaguagaaaaug

SEQ ID NO: 4072301 - RNA, 15 nt, Streptococcus pneumoniae R6
acauaccaccaagua

SEQ ID NO: 4072302 - RNA, 18 nt, Streptococcus pneumoniae R6
acauaccaccaaguacag

SEQ ID NO: 4072303 - RNA, 19 nt, Streptococcus pneumoniae R6
acauaccuacgauaucuga

SEQ ID NO: 4072304 - RNA, 22 nt, Streptococcus pneumoniae R6
acauacuuuaucuucuauugca

SEQ ID NO: 4072305 - RNA, 21 nt, Streptococcus pneumoniae R6
acauagaaaaugguuccaaaa

SEQ ID NO: 4072306 - RNA, 20 nt, Streptococcus pneumoniae R6
acauagcuggucaagaagcg

SEQ ID NO: 4072307 - RNA, 19 nt, Streptococcus pneumoniae R6
acauaggauucgugguuuu

SEQ ID NO: 4072308 - RNA, 14 nt, Streptococcus pneumoniae R6
acauaguuucauaa

SEQ ID NO: 4072309 - RNA, 17 nt, Streptococcus pneumoniae R6
acauauauucaacgaaa

SEQ ID NO: 4072310 - RNA, 19 nt, Streptococcus pneumoniae R6
acauaucaaccuuucucag

SEQ ID NO: 4072311 - RNA, 12 nt, Streptococcus pneumoniae R6
acauauccauuc

SEQ ID NO: 4072312 - RNA, 20 nt, Streptococcus pneumoniae R6
acauaugaaaucuuuuugau

SEQ ID NO: 4072313 - RNA, 18 nt, Streptococcus pneumoniae R6
acauaugauugucuccuu

SEQ ID NO: 4072314 - RNA, 19 nt, Streptococcus pneumoniae R6
acauaugauugucuccuuu

SEQ ID NO: 4072315 - RNA, 20 nt, Streptococcus pneumoniae R6
acauauuucuagaaauuaau

SEQ ID NO: 4072316 - RNA, 21 nt, Streptococcus pneumoniae R6
acauauuucuagaaauuaauu

SEQ ID NO: 4072317 - RNA, 18 nt, Streptococcus pneumoniae R6
acaucaaaaacagccgaa

SEQ ID NO: 4072318 - RNA, 19 nt, Streptococcus pneumoniae R6
acaucaaaaacagccgaaa

SEQ ID NO: 4072319 - RNA, 20 nt, Streptococcus pneumoniae R6
acaucaauaaccaucauuuu

SEQ ID NO: 4072320 - RNA, 17 nt, Streptococcus pneumoniae R6
acaucacuguuuuuuau

SEQ ID NO: 4072321 - RNA, 13 nt, Streptococcus pneumoniae R6
acaucagaugaca

SEQ ID NO: 4072322 - RNA, 19 nt, Streptococcus pneumoniae R6
acaucaguauuucauuaca

SEQ ID NO: 4072323 - RNA, 14 nt, Streptococcus pneumoniae R6
acaucauauaaaua

SEQ ID NO: 4072324 - RNA, 14 nt, Streptococcus pneumoniae R6
acauccaccagcua

SEQ ID NO: 4072325 - RNA, 16 nt, Streptococcus pneumoniae R6
acauccacgagaaaga

SEQ ID NO: 4072326 - RNA, 19 nt, Streptococcus pneumoniae R6
acauccguuuuucuccucu

SEQ ID NO: 4072327 - RNA, 16 nt, Streptococcus pneumoniae R6
acaucgaaguuguguu

SEQ ID NO: 4072328 - RNA, 13 nt, Streptococcus pneumoniae R6
acaucgucaccau

SEQ ID NO: 4072329 - RNA, 14 nt, Streptococcus pneumoniae R6
acaucuaaauaaua

SEQ ID NO: 4072330 - RNA, 11 nt, Streptococcus pneumoniae R6
acaucuaucuc

SEQ ID NO: 4072331 - RNA, 23 nt, Streptococcus pneumoniae R6
acaucucuaucaggaaagucaaa

SEQ ID NO: 4072332 - RNA, 19 nt, Streptococcus pneumoniae R6
acaucugccauaucaucgu

SEQ ID NO: 4072333 - RNA, 16 nt, Streptococcus pneumoniae R6
acaucuggcucauauc

SEQ ID NO: 4072334 - RNA, 21 nt, Streptococcus pneumoniae R6
acaucuggcucauaucuggca

SEQ ID NO: 4072335 - RNA, 19 nt, Streptococcus pneumoniae R6
acaucugucgcaaggaugc

SEQ ID NO: 4072336 - RNA, 23 nt, Streptococcus pneumoniae R6
acaucugucgcaaggaugccagc

SEQ ID NO: 4072337 - RNA, 21 nt, Streptococcus pneumoniae R6
acaucuguguagcacuuuucc

SEQ ID NO: 4072338 - RNA, 22 nt, Streptococcus pneumoniae R6
acaucuguguagcacuuuucca

SEQ ID NO: 4072339 - RNA, 15 nt, Streptococcus pneumoniae R6
acaucuguuuuaaac

SEQ ID NO: 4072340 - RNA, 15 nt, Streptococcus pneumoniae R6
acaucuuauuaucaa

SEQ ID NO: 4072341 - RNA, 17 nt, Streptococcus pneumoniae R6
acaucuuauuaucaagu

SEQ ID NO: 4072342 - RNA, 14 nt, Streptococcus pneumoniae R6
acaucuuauuucaa

SEQ ID NO: 4072343 - RNA, 22 nt, Streptococcus pneumoniae R6
acaucuucgcguucguauuuca

SEQ ID NO: 4072344 - RNA, 20 nt, Streptococcus pneumoniae R6
acaucuuggaguugauucau

SEQ ID NO: 4072345 - RNA, 21 nt, Streptococcus pneumoniae R6
acaugaaguaaauauuucuau

SEQ ID NO: 4072346 - RNA, 18 nt, Streptococcus pneumoniae R6
acaugacaaauucuccac

SEQ ID NO: 4072347 - RNA, 18 nt, Streptococcus pneumoniae R6
acaugagaauacaaaaau

SEQ ID NO: 4072348 - RNA, 20 nt, Streptococcus pneumoniae R6
acaugcaaguagaacgcuga

SEQ ID NO: 4072349 - RNA, 14 nt, Streptococcus pneumoniae R6
accacgaagcugac

SEQ ID NO: 4072350 - RNA, 17 nt, Streptococcus pneumoniae R6
accacggcagacagaga

SEQ ID NO: 4072351 - RNA, 23 nt, Streptococcus pneumoniae R6
accacgucagcuuuaucugcaac

SEQ ID NO: 4072352 - RNA, 14 nt, Streptococcus pneumoniae R6
accacguuccuugg

SEQ ID NO: 4072353 - RNA, 22 nt, Streptococcus pneumoniae R6
accacuagcauaaugauuucaa

SEQ ID NO: 4072354 - RNA, 19 nt, Streptococcus pneumoniae R6
accacuagugaauuugguu

SEQ ID NO: 4072355 - RNA, 21 nt, Streptococcus pneumoniae R6
accacuuaacaacugauacug

SEQ ID NO: 4072356 - RNA, 14 nt, Streptococcus pneumoniae R6
accagaaaaucauu

SEQ ID NO: 4072357 - RNA, 16 nt, Streptococcus pneumoniae R6
accagaaagaacuggg

SEQ ID NO: 4072358 - RNA, 14 nt, Streptococcus pneumoniae R6
accagaaauaaaag

SEQ ID NO: 4072359 - RNA, 14 nt, Streptococcus pneumoniae R6
accagacauagaga

SEQ ID NO: 4072360 - RNA, 20 nt, Streptococcus pneumoniae R6
accagagcgaauaccaccaa

SEQ ID NO: 4072361 - RNA, 13 nt, Streptococcus pneumoniae R6
accagauauacca

SEQ ID NO: 4072362 - RNA, 17 nt, Streptococcus pneumoniae R6
accagcauggcaccgcc

SEQ ID NO: 4072363 - RNA, 14 nt, Streptococcus pneumoniae R6
accagccaagacac

SEQ ID NO: 4072364 - RNA, 22 nt, Streptococcus pneumoniae R6
accagcgauagcuccaucucca

SEQ ID NO: 4072365 - RNA, 19 nt, Streptococcus pneumoniae R6
accagcuaccagaccaagu

SEQ ID NO: 4072366 - RNA, 14 nt, Streptococcus pneumoniae R6
accaggaaaccagc

SEQ ID NO: 4072367 - RNA, 15 nt, Streptococcus pneumoniae R6
accaggaaaccagcu

SEQ ID NO: 4072368 - RNA, 16 nt, Streptococcus pneumoniae R6
accaggaaaccagcug

SEQ ID NO: 4072369 - RNA, 15 nt, Streptococcus pneumoniae R6
accaggaucuuaucu

SEQ ID NO: 4072370 - RNA, 18 nt, Streptococcus pneumoniae R6
accaggcauuauuucacu

SEQ ID NO: 4072371 - RNA, 17 nt, Streptococcus pneumoniae R6
accagguucuucaauca

SEQ ID NO: 4072372 - RNA, 23 nt, Streptococcus pneumoniae R6
accaguacuuucaacuccuuacu

SEQ ID NO: 4072373 - RNA, 17 nt, Streptococcus pneumoniae R6
accaguccuugaaaaac

SEQ ID NO: 4072374 - RNA, 21 nt, Streptococcus pneumoniae R6
accagucgagacauaccauuu

SEQ ID NO: 4072375 - RNA, 18 nt, Streptococcus pneumoniae R6
accagucuccuagucuac

SEQ ID NO: 4072376 - RNA, 19 nt, Streptococcus pneumoniae R6
accaguuccuuugucuuua

SEQ ID NO: 4072377 - RNA, 21 nt, Streptococcus pneumoniae R6
accaguugccauagcuccuga

SEQ ID NO: 4072378 - RNA, 23 nt, Streptococcus pneumoniae R6
accaguuguggcgacuuccuugc

SEQ ID NO: 4072379 - RNA, 21 nt, Streptococcus pneumoniae R6
accauaaacuaagcuuauaua

SEQ ID NO: 4072380 - RNA, 15 nt, Streptococcus pneumoniae R6
accauagagcggacu

SEQ ID NO: 4072381 - RNA, 12 nt, Streptococcus pneumoniae R6
accauaguucca

SEQ ID NO: 4072382 - RNA, 18 nt, Streptococcus pneumoniae R6
accaucaaaauaguguga

SEQ ID NO: 4072383 - RNA, 20 nt, Streptococcus pneumoniae R6
accaucaaaauagugugacc

SEQ ID NO: 4072384 - RNA, 16 nt, Streptococcus pneumoniae R6
accaucauuuuuagau

SEQ ID NO: 4072385 - RNA, 21 nt, Streptococcus pneumoniae R6
accaucuaacucauagcagau

SEQ ID NO: 4072386 - RNA, 18 nt, Streptococcus pneumoniae R6
accaucuaagguauauuc

SEQ ID NO: 4072387 - RNA, 19 nt, Streptococcus pneumoniae R6
accaucuuccgcaauccac

SEQ ID NO: 4072388 - RNA, 19 nt, Streptococcus pneumoniae R6
accaucuuuaggaucauga

SEQ ID NO: 4072389 - RNA, 17 nt, Streptococcus pneumoniae R6
accaugaaauucaaaag

SEQ ID NO: 4072390 - RNA, 19 nt, Streptococcus pneumoniae R6
accaugaggaaacgcucgg

SEQ ID NO: 4072391 - RNA, 20 nt, Streptococcus pneumoniae R6
accaugcguuggaacgauuu

SEQ ID NO: 4072392 - RNA, 21 nt, Streptococcus pneumoniae R6
accaugcugaccgcaaaagcu

SEQ ID NO: 4072393 - RNA, 19 nt, Streptococcus pneumoniae R6
accaugucguuuccuucca

SEQ ID NO: 4072394 - RNA, 19 nt, Streptococcus pneumoniae R6
accauguuuugagcugacu

SEQ ID NO: 4072395 - RNA, 18 nt, Streptococcus pneumoniae R6
accauguuuuucaauagc

SEQ ID NO: 4072396 - RNA, 14 nt, Streptococcus pneumoniae R6
accauuauagcauu

SEQ ID NO: 4072397 - RNA, 21 nt, Streptococcus pneumoniae R6
accauuauagcauucuucuca

SEQ ID NO: 4072398 - RNA, 17 nt, Streptococcus pneumoniae R6
accauuauaguuuaagu

SEQ ID NO: 4072399 - RNA, 15 nt, Streptococcus pneumoniae R6
accauugucacaauu

SEQ ID NO: 4072400 - RNA, 14 nt, Streptococcus pneumoniae R6
accauuuccaucuc

SEQ ID NO: 4072401 - RNA, 16 nt, Streptococcus pneumoniae R6
accauuuuccaagacu

SEQ ID NO: 4072402 - RNA, 18 nt, Streptococcus pneumoniae R6
accauuuuccaagacuuu

SEQ ID NO: 4072403 - RNA, 21 nt, Streptococcus pneumoniae R6
accauuuuccaagacuuucaa

SEQ ID NO: 4072404 - RNA, 19 nt, Streptococcus pneumoniae R6
accauuuucguccaaguca

SEQ ID NO: 4072405 - RNA, 14 nt, Streptococcus pneumoniae R6
acccaccaagucau

SEQ ID NO: 4072406 - RNA, 15 nt, Streptococcus pneumoniae R6
acccacggauuaaga

SEQ ID NO: 4072407 - RNA, 16 nt, Streptococcus pneumoniae R6
acccacuacaguugac

SEQ ID NO: 4072408 - RNA, 22 nt, Streptococcus pneumoniae R6
acccauguauggacgaagugcu

SEQ ID NO: 4072409 - RNA, 23 nt, Streptococcus pneumoniae R6
acccaugucgcaucgucaucacg

SEQ ID NO: 4072410 - RNA, 14 nt, Streptococcus pneumoniae R6
acccauucaccauu

SEQ ID NO: 4072411 - RNA, 12 nt, Streptococcus pneumoniae R6
accccaaauucc

SEQ ID NO: 4072412 - RNA, 13 nt, Streptococcus pneumoniae R6
accccaaauuccu

SEQ ID NO: 4072413 - RNA, 15 nt, Streptococcus pneumoniae R6
accccaacuuacauu

SEQ ID NO: 4072414 - RNA, 15 nt, Streptococcus pneumoniae R6
accccauccgcccca

SEQ ID NO: 4072415 - RNA, 13 nt, Streptococcus pneumoniae R6
acccuaggcaagc

SEQ ID NO: 4072416 - RNA, 15 nt, Streptococcus pneumoniae R6
acccucguuaucauu

SEQ ID NO: 4072417 - RNA, 12 nt, Streptococcus pneumoniae R6
acccuucuuuuu

SEQ ID NO: 4072418 - RNA, 18 nt, Streptococcus pneumoniae R6
acccuugcgccaguuacc

SEQ ID NO: 4072419 - RNA, 17 nt, Streptococcus pneumoniae R6
acccuugcuuuuucuuu

SEQ ID NO: 4072420 - RNA, 16 nt, Streptococcus pneumoniae R6
acccuuguaggaaguu

SEQ ID NO: 4072421 - RNA, 18 nt, Streptococcus pneumoniae R6
acccuuguuucuaaaaca

SEQ ID NO: 4072422 - RNA, 22 nt, Streptococcus pneumoniae R6
acccuuguuucuaaaacauugu

SEQ ID NO: 4072423 - RNA, 22 nt, Streptococcus pneumoniae R6
acccuuuuuauacucaaugaaa

SEQ ID NO: 4072424 - RNA, 17 nt, Streptococcus pneumoniae R6
accgaagucgaaaauaa

SEQ ID NO: 4072425 - RNA, 16 nt, Streptococcus pneumoniae R6
accgaauguggauacu

SEQ ID NO: 4072426 - RNA, 16 nt, Streptococcus pneumoniae R6
accgaauuuuucaagu

SEQ ID NO: 4072427 - RNA, 21 nt, Streptococcus pneumoniae R6
accgaauuuuucaaguagguc

SEQ ID NO: 4072428 - RNA, 20 nt, Streptococcus pneumoniae R6
accgacuucugagcuacuau

SEQ ID NO: 4072429 - RNA, 23 nt, Streptococcus pneumoniae R6
accgauaagaauuggcacaaaag

SEQ ID NO: 4072430 - RNA, 20 nt, Streptococcus pneumoniae R6
accgauagcuuuugcagcac

SEQ ID NO: 4072431 - RNA, 16 nt, Streptococcus pneumoniae R6
accgauauggccugcu

SEQ ID NO: 4072432 - RNA, 14 nt, Streptococcus pneumoniae R6
accgaucucaucuu

SEQ ID NO: 4072433 - RNA, 15 nt, Streptococcus pneumoniae R6
accgaugauguucau

SEQ ID NO: 4072434 - RNA, 17 nt, Streptococcus pneumoniae R6
accgauggacuuuauca

SEQ ID NO: 4072435 - RNA, 15 nt, Streptococcus pneumoniae R6
accgcaaaagcuucu

SEQ ID NO: 4072436 - RNA, 15 nt, Streptococcus pneumoniae R6
accgcagucuucaau

SEQ ID NO: 4072437 - RNA, 18 nt, Streptococcus pneumoniae R6
accgccuucuacuuccug

SEQ ID NO: 4072438 - RNA, 16 nt, Streptococcus pneumoniae R6
accguacguaccauuc

SEQ ID NO: 4072439 - RNA, 15 nt, Streptococcus pneumoniae R6
accguauauauguua

SEQ ID NO: 4072440 - RNA, 15 nt, Streptococcus pneumoniae R6
accguccucauauuc

SEQ ID NO: 4072441 - RNA, 18 nt, Streptococcus pneumoniae R6
accguguuguaugaaaag

SEQ ID NO: 4072442 - RNA, 15 nt, Streptococcus pneumoniae R6
accguugaaaucaau

SEQ ID NO: 4072443 - RNA, 14 nt, Streptococcus pneumoniae R6
accguuugaaaaag

SEQ ID NO: 4072444 - RNA, 16 nt, Streptococcus pneumoniae R6
accuaaaauucccuua

SEQ ID NO: 4072445 - RNA, 16 nt, Streptococcus pneumoniae R6
accuaaccaaauaaua

SEQ ID NO: 4072446 - RNA, 15 nt, Streptococcus pneumoniae R6
accuaauuuuuuggc

SEQ ID NO: 4072447 - RNA, 22 nt, Streptococcus pneumoniae R6
accuaauuuuuuggcaaccucg

SEQ ID NO: 4072448 - RNA, 17 nt, Streptococcus pneumoniae R6
accuacccaaauggaua

SEQ ID NO: 4072449 - RNA, 21 nt, Streptococcus pneumoniae R6
accuacuguuagaacagucag

SEQ ID NO: 4072450 - RNA, 19 nt, Streptococcus pneumoniae R6
accuagaacaagcuaggug

SEQ ID NO: 4072451 - RNA, 16 nt, Streptococcus pneumoniae R6
accuaguacaaagaau

SEQ ID NO: 4072452 - RNA, 17 nt, Streptococcus pneumoniae R6
acgauaccaucauaggc

SEQ ID NO: 4072453 - RNA, 15 nt, Streptococcus pneumoniae R6
acgauacuguaguuu

SEQ ID NO: 4072454 - RNA, 18 nt, Streptococcus pneumoniae R6
acgauagcaccaaaagca

SEQ ID NO: 4072455 - RNA, 14 nt, Streptococcus pneumoniae R6
acgaucaaucaauu

SEQ ID NO: 4072456 - RNA, 13 nt, Streptococcus pneumoniae R6
acgaucugaaaua

SEQ ID NO: 4072457 - RNA, 13 nt, Streptococcus pneumoniae R6
acgaugaccaaga

SEQ ID NO: 4072458 - RNA, 19 nt, Streptococcus pneumoniae R6
acgaugaugauuggaauga

SEQ ID NO: 4072459 - RNA, 15 nt, Streptococcus pneumoniae R6
acgaugcuuuucuug

SEQ ID NO: 4072460 - RNA, 14 nt, Streptococcus pneumoniae R6
acgauguccauuga

SEQ ID NO: 4072461 - RNA, 14 nt, Streptococcus pneumoniae R6
acgauguugaugau

SEQ ID NO: 4072462 - RNA, 19 nt, Streptococcus pneumoniae R6
acgauguuugcagcaccag

SEQ ID NO: 4072463 - RNA, 20 nt, Streptococcus pneumoniae R6
acgauuaaauaguucuucca

SEQ ID NO: 4072464 - RNA, 21 nt, Streptococcus pneumoniae R6
acgauuaucuaacaauaagau

SEQ ID NO: 4072465 - RNA, 18 nt, Streptococcus pneumoniae R6
acgauucaucaagagaca

SEQ ID NO: 4072466 - RNA, 24 nt, Streptococcus pneumoniae R6
acgauucccacaagggauagcaca

SEQ ID NO: 4072467 - RNA, 15 nt, Streptococcus pneumoniae R6
acgauuggacucagu

SEQ ID NO: 4072468 - RNA, 19 nt, Streptococcus pneumoniae R6
acgauuggggauuuuuagu

SEQ ID NO: 4072469 - RNA, 16 nt, Streptococcus pneumoniae R6
acgauugguucugcuc

SEQ ID NO: 4072470 - RNA, 13 nt, Streptococcus pneumoniae R6
acgauuuucucuu

SEQ ID NO: 4072471 - RNA, 17 nt, Streptococcus pneumoniae R6
acgauuuucucuuuguc

SEQ ID NO: 4072472 - RNA, 21 nt, Streptococcus pneumoniae R6
acgauuuucucuuuguccuuu

SEQ ID NO: 4072473 - RNA, 17 nt, Streptococcus pneumoniae R6
acgauuuucucuuuguu

SEQ ID NO: 4072474 - RNA, 17 nt, Streptococcus pneumoniae R6
acgauuuuuucuuuguu

SEQ ID NO: 4072475 - RNA, 17 nt, Streptococcus pneumoniae R6
acgcaguucuucauaca

SEQ ID NO: 4072476 - RNA, 20 nt, Streptococcus pneumoniae R6
acgcauaagcaauuuuuuau

SEQ ID NO: 4072477 - RNA, 21 nt, Streptococcus pneumoniae R6
acgcauaauaucaaguuuuca

SEQ ID NO: 4072478 - RNA, 19 nt, Streptococcus pneumoniae R6
acgcaugauaucaaacuuu

SEQ ID NO: 4072479 - RNA, 16 nt, Streptococcus pneumoniae R6
acgccaaaaccucuaa

SEQ ID NO: 4072480 - RNA, 12 nt, Streptococcus pneumoniae R6
acgccagauacu

SEQ ID NO: 4072481 - RNA, 17 nt, Streptococcus pneumoniae R6
acgccucccaauuaaaa

SEQ ID NO: 4072482 - RNA, 19 nt, Streptococcus pneumoniae R6
acgccucccaauuaaaaua

SEQ ID NO: 4072483 - RNA, 13 nt, Streptococcus pneumoniae R6
acgccuuaaaaaa

SEQ ID NO: 4072484 - RNA, 14 nt, Streptococcus pneumoniae R6
acgcgauacaauaa

SEQ ID NO: 4072485 - RNA, 14 nt, Streptococcus pneumoniae R6
acgcuaaguagaaa

SEQ ID NO: 4072486 - RNA, 12 nt, Streptococcus pneumoniae R6
acgcuacuccua

SEQ ID NO: 4072487 - RNA, 17 nt, Streptococcus pneumoniae R6
acgcuacuccuaagaau

SEQ ID NO: 4072488 - RNA, 23 nt, Streptococcus pneumoniae R6
acgcucuucuggcagauagaugg

SEQ ID NO: 4072489 - RNA, 20 nt, Streptococcus pneumoniae R6
acgcuggcuggaucagcuuu

SEQ ID NO: 4072490 - RNA, 18 nt, Streptococcus pneumoniae R6
acgcuucccucucagauu

SEQ ID NO: 4072491 - RNA, 20 nt, Streptococcus pneumoniae R6
acggacgguagcgacuuucu

SEQ ID NO: 4072492 - RNA, 15 nt, Streptococcus pneumoniae R6
acggacguugauuug

SEQ ID NO: 4072493 - RNA, 22 nt, Streptococcus pneumoniae R6
acggacguugauuuguccaucu

SEQ ID NO: 4072494 - RNA, 16 nt, Streptococcus pneumoniae R6
acggagauaguaccau

SEQ ID NO: 4072495 - RNA, 19 nt, Streptococcus pneumoniae R6
acggaucugaagcuuuauu

SEQ ID NO: 4072496 - RNA, 22 nt, Streptococcus pneumoniae R6
acggcaaaaagcccuugaauua

SEQ ID NO: 4072497 - RNA, 20 nt, Streptococcus pneumoniae R6
acggcaagacgaagcugaca

SEQ ID NO: 4072498 - RNA, 16 nt, Streptococcus pneumoniae R6
acggcacguuccauac

SEQ ID NO: 4072499 - RNA, 17 nt, Streptococcus pneumoniae R6
acggcauugaggacaau

SEQ ID NO: 4072500 - RNA, 14 nt, Streptococcus pneumoniae R6
acggcugucgcguu

SEQ ID NO: 4072501 - RNA, 21 nt, Streptococcus pneumoniae R6
acgggcuuggcguuuugaguu

SEQ ID NO: 4072502 - RNA, 18 nt, Streptococcus pneumoniae R6
acgggguccuuaccuguu

SEQ ID NO: 4072503 - RNA, 18 nt, Streptococcus pneumoniae R6
acgguaucuguuucuguu

SEQ ID NO: 4072504 - RNA, 13 nt, Streptococcus pneumoniae R6
acggucaaaguca

SEQ ID NO: 4072505 - RNA, 23 nt, Streptococcus pneumoniae R6
acggucauuuucuucgucaccga

SEQ ID NO: 4072506 - RNA, 15 nt, Streptococcus pneumoniae R6
acggugaacuucuuc

SEQ ID NO: 4072507 - RNA, 21 nt, Streptococcus pneumoniae R6
acgguguuuugagcagucugc

SEQ ID NO: 4072508 - RNA, 21 nt, Streptococcus pneumoniae R6
acguaaaagucauacuuucuc

SEQ ID NO: 4072509 - RNA, 18 nt, Streptococcus pneumoniae R6
acguaacauauuuucaaa

SEQ ID NO: 4072510 - RNA, 19 nt, Streptococcus pneumoniae R6
acguaacuuguaacuagcu

SEQ ID NO: 4072511 - RNA, 16 nt, Streptococcus pneumoniae R6
acguacaacagcuaca

SEQ ID NO: 4072512 - RNA, 18 nt, Streptococcus pneumoniae R6
acguaguuuuuuuuguaa

SEQ ID NO: 4072513 - RNA, 16 nt, Streptococcus pneumoniae R6
acguauucagucaucu

SEQ ID NO: 4072514 - RNA, 19 nt, Streptococcus pneumoniae R6
acgucagcuuccaucugca

SEQ ID NO: 4072515 - RNA, 16 nt, Streptococcus pneumoniae R6
acguccaauuuugucu

SEQ ID NO: 4072516 - RNA, 23 nt, Streptococcus pneumoniae R6
acguccaccacaaaagagaaaga

SEQ ID NO: 4072517 - RNA, 20 nt, Streptococcus pneumoniae R6
acguccgucaagaagagcuu

SEQ ID NO: 4072518 - RNA, 17 nt, Streptococcus pneumoniae R6
acguccgugaggacagu

SEQ ID NO: 4072519 - RNA, 12 nt, Streptococcus pneumoniae R6
acguccuagcuc

SEQ ID NO: 4072520 - RNA, 16 nt, Streptococcus pneumoniae R6
acguccuagcucucgg

SEQ ID NO: 4072521 - RNA, 12 nt, Streptococcus pneumoniae R6
acguccuuggaa

SEQ ID NO: 4072522 - RNA, 14 nt, Streptococcus pneumoniae R6
acguccuuggaaga

SEQ ID NO: 4072523 - RNA, 18 nt, Streptococcus pneumoniae R6
acgucguaaccagagaca

SEQ ID NO: 4072524 - RNA, 19 nt, Streptococcus pneumoniae R6
acgucuucaauaccaaaga

SEQ ID NO: 4072525 - RNA, 16 nt, Streptococcus pneumoniae R6
acgugacucagcuucu

SEQ ID NO: 4072526 - RNA, 18 nt, Streptococcus pneumoniae R6
acgugauaaaguuucugu

SEQ ID NO: 4072527 - RNA, 17 nt, Streptococcus pneumoniae R6
acgugauaauaaggccu

SEQ ID NO: 4072528 - RNA, 15 nt, Streptococcus pneumoniae R6
acguggguugaggcc

SEQ ID NO: 4072529 - RNA, 15 nt, Streptococcus pneumoniae R6
acgugguuugaagag

SEQ ID NO: 4072530 - RNA, 15 nt, Streptococcus pneumoniae R6
acgugucaaagcauu

SEQ ID NO: 4072531 - RNA, 16 nt, Streptococcus pneumoniae R6
acguuagcaaagacuu

SEQ ID NO: 4072532 - RNA, 19 nt, Streptococcus pneumoniae R6
acguuagcaaagacuucaa

SEQ ID NO: 4072533 - RNA, 16 nt, Streptococcus pneumoniae R6
acguuccuauggguuc

SEQ ID NO: 4072534 - RNA, 14 nt, Streptococcus pneumoniae R6
acguucuucaagag

SEQ ID NO: 4072535 - RNA, 16 nt, Streptococcus pneumoniae R6
acguucuuuucaagaa

SEQ ID NO: 4072536 - RNA, 14 nt, Streptococcus pneumoniae R6
acguugcuuauacu

SEQ ID NO: 4072537 - RNA, 18 nt, Streptococcus pneumoniae R6
acguugcuuauacucaau

SEQ ID NO: 4072538 - RNA, 20 nt, Streptococcus pneumoniae R6
acguuuaaagacaguugcau

SEQ ID NO: 4072539 - RNA, 17 nt, Streptococcus pneumoniae R6
acguuuccuucuacugu

SEQ ID NO: 4072540 - RNA, 14 nt, Streptococcus pneumoniae R6
acguuucuaauaau

SEQ ID NO: 4072541 - RNA, 21 nt, Streptococcus pneumoniae R6
acguuuuaggacauaaaucga

SEQ ID NO: 4072542 - RNA, 11 nt, Streptococcus pneumoniae R6
acguuuuuaaa

SEQ ID NO: 4072543 - RNA, 16 nt, Streptococcus pneumoniae R6
acguuuuuacuacuuu

SEQ ID NO: 4072544 - RNA, 17 nt, Streptococcus pneumoniae R6
acguuuuuacuacuuuu

SEQ ID NO: 4072545 - RNA, 18 nt, Streptococcus pneumoniae R6
acguuuuuacuacuuuug

SEQ ID NO: 4072546 - RNA, 14 nt, Streptococcus pneumoniae R6
acguuuuuacuuug

SEQ ID NO: 4072547 - RNA, 17 nt, Streptococcus pneumoniae R6
acguuuuucuucuuuuu

SEQ ID NO: 4072548 - RNA, 22 nt, Streptococcus pneumoniae R6
acuaaaacguuguuuucacgau

SEQ ID NO: 4072549 - RNA, 23 nt, Streptococcus pneumoniae R6
acuaaaacguuguuuucacgauu

SEQ ID NO: 4072550 - RNA, 13 nt, Streptococcus pneumoniae R6
acuaaaauaacug

SEQ ID NO: 4072551 - RNA, 23 nt, Streptococcus pneumoniae R6
acuaaaauucuauaucuaaugac

SEQ ID NO: 4072552 - RNA, 11 nt, Streptococcus pneumoniae R6
acuaaacaagg

SEQ ID NO: 4072553 - RNA, 15 nt, Streptococcus pneumoniae R6
acuaaacgugauaaa

SEQ ID NO: 4072554 - RNA, 18 nt, Streptococcus pneumoniae R6
acuaaagcuuuuuucuuu

SEQ ID NO: 4072555 - RNA, 17 nt, Streptococcus pneumoniae R6
acuauucuaguuucaau

SEQ ID NO: 4072556 - RNA, 12 nt, Streptococcus pneumoniae R6
acuauucuuuuu

SEQ ID NO: 4072557 - RNA, 22 nt, Streptococcus pneumoniae R6
acuauugaguucacaaaugaga

SEQ ID NO: 4072558 - RNA, 20 nt, Streptococcus pneumoniae R6
acuauugaugaacugcuuga

SEQ ID NO: 4072559 - RNA, 15 nt, Streptococcus pneumoniae R6
acuauugaugaagua

SEQ ID NO: 4072560 - RNA, 21 nt, Streptococcus pneumoniae R6
acuauuguagauuauaugcua

SEQ ID NO: 4072561 - RNA, 19 nt, Streptococcus pneumoniae R6
acuauuguuauuuuucuuu

SEQ ID NO: 4072562 - RNA, 21 nt, Streptococcus pneumoniae R6
acuauuguuauuuuucuuuuu

SEQ ID NO: 4072563 - RNA, 14 nt, Streptococcus pneumoniae R6
acuauuuauuuaau

SEQ ID NO: 4072564 - RNA, 14 nt, Streptococcus pneumoniae R6
acuauuucagauuc

SEQ ID NO: 4072565 - RNA, 13 nt, Streptococcus pneumoniae R6
acuauuucuuauu

SEQ ID NO: 4072566 - RNA, 16 nt, Streptococcus pneumoniae R6
acuauuucuuauuuca

SEQ ID NO: 4072567 - RNA, 14 nt, Streptococcus pneumoniae R6
acuauuugaguaac

SEQ ID NO: 4072568 - RNA, 16 nt, Streptococcus pneumoniae R6
acuauuuuccaaaaau

SEQ ID NO: 4072569 - RNA, 14 nt, Streptococcus pneumoniae R6
acucaaaagaagau

SEQ ID NO: 4072570 - RNA, 15 nt, Streptococcus pneumoniae R6
acucaaaucaaaaua

SEQ ID NO: 4072571 - RNA, 17 nt, Streptococcus pneumoniae R6
acucaacaagcuguagu

SEQ ID NO: 4072572 - RNA, 14 nt, Streptococcus pneumoniae R6
acucaacagaagaa

SEQ ID NO: 4072573 - RNA, 24 nt, Streptococcus pneumoniae R6
acucaacagaagaauccugccaau

SEQ ID NO: 4072574 - RNA, 13 nt, Streptococcus pneumoniae R6
acucaaugaaaau

SEQ ID NO: 4072575 - RNA, 15 nt, Streptococcus pneumoniae R6
acucaaugaaaauca

SEQ ID NO: 4072576 - RNA, 16 nt, Streptococcus pneumoniae R6
acucaaugaaaaucaa

SEQ ID NO: 4072577 - RNA, 17 nt, Streptococcus pneumoniae R6
acucaauuguauaguga

SEQ ID NO: 4072578 - RNA, 16 nt, Streptococcus pneumoniae R6
acucacuaaaauucua

SEQ ID NO: 4072579 - RNA, 13 nt, Streptococcus pneumoniae R6
acucacuuacaua

SEQ ID NO: 4072580 - RNA, 20 nt, Streptococcus pneumoniae R6
acucacuucccugagacuua

SEQ ID NO: 4072581 - RNA, 23 nt, Streptococcus pneumoniae R6
acucagaccgauucgucugaguu

SEQ ID NO: 4072582 - RNA, 19 nt, Streptococcus pneumoniae R6
acucagcuucguaaucaua

SEQ ID NO: 4072583 - RNA, 20 nt, Streptococcus pneumoniae R6
acucaguauuacauccacca

SEQ ID NO: 4072584 - RNA, 19 nt, Streptococcus pneumoniae R6
acucaguuucugacuaucu

SEQ ID NO: 4072585 - RNA, 18 nt, Streptococcus pneumoniae R6
acucauaaagucuuuaac

SEQ ID NO: 4072586 - RNA, 18 nt, Streptococcus pneumoniae R6
acucaugacagccucaau

SEQ ID NO: 4072587 - RNA, 17 nt, Streptococcus pneumoniae R6
acucaugugucuugcau

SEQ ID NO: 4072588 - RNA, 23 nt, Streptococcus pneumoniae R6
acucaugugucuugcauuuuaau

SEQ ID NO: 4072589 - RNA, 20 nt, Streptococcus pneumoniae R6
acucauuuaaaaucaaaaag

SEQ ID NO: 4072590 - RNA, 15 nt, Streptococcus pneumoniae R6
acuccaaaaauaaau

SEQ ID NO: 4072591 - RNA, 19 nt, Streptococcus pneumoniae R6
acuccaaacgcgauacaau

SEQ ID NO: 4072592 - RNA, 23 nt, Streptococcus pneumoniae R6
acuccaaacgcgauacaauaaag

SEQ ID NO: 4072593 - RNA, 23 nt, Streptococcus pneumoniae R6
acuccaacuggucuugccagccu

SEQ ID NO: 4072594 - RNA, 13 nt, Streptococcus pneumoniae R6
acuccaagcaagc

SEQ ID NO: 4072595 - RNA, 16 nt, Streptococcus pneumoniae R6
acuccagugaaaacag

SEQ ID NO: 4072596 - RNA, 21 nt, Streptococcus pneumoniae R6
acuccauagccaucuuuugac

SEQ ID NO: 4072597 - RNA, 21 nt, Streptococcus pneumoniae R6
acuccauagggcauaaguucg

SEQ ID NO: 4072598 - RNA, 16 nt, Streptococcus pneumoniae R6
acuccaugccaagaaa

SEQ ID NO: 4072599 - RNA, 17 nt, Streptococcus pneumoniae R6
acuccucucaguucuga

SEQ ID NO: 4072600 - RNA, 19 nt, Streptococcus pneumoniae R6
acuccucucuccuccccuu

SEQ ID NO: 4072601 - RNA, 15 nt, Streptococcus pneumoniae R6
acuccuugaaucauc

SEQ ID NO: 4072602 - RNA, 16 nt, Streptococcus pneumoniae R6
acucgaacuagagaag

SEQ ID NO: 4072603 - RNA, 20 nt, Streptococcus pneumoniae R6
acucgaacuagagaagccaa

SEQ ID NO: 4072604 - RNA, 15 nt, Streptococcus pneumoniae R6
acucgaucugaaugu

SEQ ID NO: 4072605 - RNA, 19 nt, Streptococcus pneumoniae R6
acucgcgacaacagcuugg

SEQ ID NO: 4072606 - RNA, 15 nt, Streptococcus pneumoniae R6
acucggccuucuuuu

SEQ ID NO: 4072607 - RNA, 16 nt, Streptococcus pneumoniae R6
acucuaaauugaauaa

SEQ ID NO: 4072608 - RNA, 18 nt, Streptococcus pneumoniae R6
acucuaacuucugcuaau

SEQ ID NO: 4072609 - RNA, 12 nt, Streptococcus pneumoniae R6
acucuacagauu

SEQ ID NO: 4072610 - RNA, 14 nt, Streptococcus pneumoniae R6
acucuaguuuuuau

SEQ ID NO: 4072611 - RNA, 23 nt, Streptococcus pneumoniae R6
acucuaucaggaaagucaaauua

SEQ ID NO: 4072612 - RNA, 14 nt, Streptococcus pneumoniae R6
acucuccaauauca

SEQ ID NO: 4072613 - RNA, 21 nt, Streptococcus pneumoniae R6
acucuccuuagucucaaaauc

SEQ ID NO: 4072614 - RNA, 16 nt, Streptococcus pneumoniae R6
acucucggucuuguuu

SEQ ID NO: 4072615 - RNA, 15 nt, Streptococcus pneumoniae R6
acucucguaaacaaa

SEQ ID NO: 4072616 - RNA, 20 nt, Streptococcus pneumoniae R6
acucuggcaauuuaucuccu

SEQ ID NO: 4072617 - RNA, 21 nt, Streptococcus pneumoniae R6
acucuggcaauuuaucuccua

SEQ ID NO: 4072618 - RNA, 13 nt, Streptococcus pneumoniae R6
acucuguuuucac

SEQ ID NO: 4072619 - RNA, 14 nt, Streptococcus pneumoniae R6
acucuguuuucacc

SEQ ID NO: 4072620 - RNA, 19 nt, Streptococcus pneumoniae R6
acucuuagaaaaucucuuc

SEQ ID NO: 4072621 - RNA, 12 nt, Streptococcus pneumoniae R6
acucuucaaaaa

SEQ ID NO: 4072622 - RNA, 17 nt, Streptococcus pneumoniae R6
acucuugcccuuggcua

SEQ ID NO: 4072623 - RNA, 17 nt, Streptococcus pneumoniae R6
acucuuggaagaaaucc

SEQ ID NO: 4072624 - RNA, 15 nt, Streptococcus pneumoniae R6
acucuuguucaaagu

SEQ ID NO: 4072625 - RNA, 14 nt, Streptococcus pneumoniae R6
acucuuuacuuugc

SEQ ID NO: 4072626 - RNA, 21 nt, Streptococcus pneumoniae R6
acucuuuuuucauguauucca

SEQ ID NO: 4072627 - RNA, 18 nt, Streptococcus pneumoniae R6
acucuuuuuuggucuuau

SEQ ID NO: 4072628 - RNA, 17 nt, Streptococcus pneumoniae R6
acugaaacaacaucuuu

SEQ ID NO: 4072629 - RNA, 16 nt, Streptococcus pneumoniae R6
acugaacaaugaaaaa

SEQ ID NO: 4072630 - RNA, 16 nt, Streptococcus pneumoniae R6
acugaacuauuuuauu

SEQ ID NO: 4072631 - RNA, 17 nt, Streptococcus pneumoniae R6
acugaagcguucaauca

SEQ ID NO: 4072632 - RNA, 16 nt, Streptococcus pneumoniae R6
acugaauccgcacugu

SEQ ID NO: 4072633 - RNA, 23 nt, Streptococcus pneumoniae R6
acugaauccgcacugucguuccu

SEQ ID NO: 4072634 - RNA, 22 nt, Streptococcus pneumoniae R6
acugaaucguuggcaaagcucu

SEQ ID NO: 4072635 - RNA, 19 nt, Streptococcus pneumoniae R6
acugacgaaaucaguaaca

SEQ ID NO: 4072636 - RNA, 23 nt, Streptococcus pneumoniae R6
acugacgaagucagcucaaaaca

SEQ ID NO: 4072637 - RNA, 14 nt, Streptococcus pneumoniae R6
acugacuaaaacuu

SEQ ID NO: 4072638 - RNA, 17 nt, Streptococcus pneumoniae R6
acugacuaaaacuugug

SEQ ID NO: 4072639 - RNA, 19 nt, Streptococcus pneumoniae R6
acugacuucgucaguucua

SEQ ID NO: 4072640 - RNA, 20 nt, Streptococcus pneumoniae R6
acugacuucgucaguucuau

SEQ ID NO: 4072641 - RNA, 23 nt, Streptococcus pneumoniae R6
acugacuucgucaguucuaucua

SEQ ID NO: 4072642 - RNA, 19 nt, Streptococcus pneumoniae R6
acugagauggauuuuccuu

SEQ ID NO: 4072643 - RNA, 20 nt, Streptococcus pneumoniae R6
acugaguauuuuauaguaau

SEQ ID NO: 4072644 - RNA, 21 nt, Streptococcus pneumoniae R6
acugaguuuuucccagccuuc

SEQ ID NO: 4072645 - RNA, 16 nt, Streptococcus pneumoniae R6
acugauucuacuuuuu

SEQ ID NO: 4072646 - RNA, 21 nt, Streptococcus pneumoniae R6
acugauucuacuuuuucaaag

SEQ ID NO: 4072647 - RNA, 23 nt, Streptococcus pneumoniae R6
acugauucuacuuuuucaaaguu

SEQ ID NO: 4072648 - RNA, 22 nt, Streptococcus pneumoniae R6
acugauuggugucaaaaaggaa

SEQ ID NO: 4072649 - RNA, 20 nt, Streptococcus pneumoniae R6
acugauuuacaaauauucac

SEQ ID NO: 4072650 - RNA, 22 nt, Streptococcus pneumoniae R6
acugauuugagguuguagauag

SEQ ID NO: 4072651 - RNA, 18 nt, Streptococcus pneumoniae R6
acugcaaguccagaaccg

SEQ ID NO: 4072652 - RNA, 19 nt, Streptococcus pneumoniae R6
acugcagcaacgucuucaa

SEQ ID NO: 4072653 - RNA, 12 nt, Streptococcus pneumoniae R6
acugcaucuuug

SEQ ID NO: 4072654 - RNA, 22 nt, Streptococcus pneumoniae R6
acugccauuaauuccugagaac

SEQ ID NO: 4072655 - RNA, 16 nt, Streptococcus pneumoniae R6
acugccccccaaaaaa

SEQ ID NO: 4072656 - RNA, 20 nt, Streptococcus pneumoniae R6
acugccccccaaaaguuaga

SEQ ID NO: 4072657 - RNA, 21 nt, Streptococcus pneumoniae R6
acuucgucguaaccuucuucu

SEQ ID NO: 4072658 - RNA, 14 nt, Streptococcus pneumoniae R6
acuucuaaaacauu

SEQ ID NO: 4072659 - RNA, 17 nt, Streptococcus pneumoniae R6
acuucuaaaacauucuu

SEQ ID NO: 4072660 - RNA, 19 nt, Streptococcus pneumoniae R6
acuucuaaaacauucuuag

SEQ ID NO: 4072661 - RNA, 19 nt, Streptococcus pneumoniae R6
acuucuaaaacauuguuag

SEQ ID NO: 4072662 - RNA, 15 nt, Streptococcus pneumoniae R6
acuucuaaggaaaaa

SEQ ID NO: 4072663 - RNA, 20 nt, Streptococcus pneumoniae R6
acuucugaaguuaaguuuuu

SEQ ID NO: 4072664 - RNA, 20 nt, Streptococcus pneumoniae R6
acuucugagguuaaaaucuu

SEQ ID NO: 4072665 - RNA, 14 nt, Streptococcus pneumoniae R6
acuucuguaaguca

SEQ ID NO: 4072666 - RNA, 16 nt, Streptococcus pneumoniae R6
acuucuguaagucauu

SEQ ID NO: 4072667 - RNA, 18 nt, Streptococcus pneumoniae R6
acuucuguaagucauuuu

SEQ ID NO: 4072668 - RNA, 18 nt, Streptococcus pneumoniae R6
acuucugucuauuugcuu

SEQ ID NO: 4072669 - RNA, 21 nt, Streptococcus pneumoniae R6
acuucuuaaucaauuaucauu

SEQ ID NO: 4072670 - RNA, 13 nt, Streptococcus pneumoniae R6
acuucuucuucca

SEQ ID NO: 4072671 - RNA, 18 nt, Streptococcus pneumoniae R6
acuucuucuuccauaucg

SEQ ID NO: 4072672 - RNA, 21 nt, Streptococcus pneumoniae R6
acuucuugucgauauaagaau

SEQ ID NO: 4072673 - RNA, 23 nt, Streptococcus pneumoniae R6
acuucuuuaacuacuugauaaaa

SEQ ID NO: 4072674 - RNA, 21 nt, Streptococcus pneumoniae R6
acuucuuugguugcuacaucu

SEQ ID NO: 4072675 - RNA, 21 nt, Streptococcus pneumoniae R6
acuucuuuuucuccuaaaauu

SEQ ID NO: 4072676 - RNA, 16 nt, Streptococcus pneumoniae R6
acuucuuuuugauuua

SEQ ID NO: 4072677 - RNA, 21 nt, Streptococcus pneumoniae R6
acuucuuuuugauuuauccaa

SEQ ID NO: 4072678 - RNA, 15 nt, Streptococcus pneumoniae R6
acuucuuuuuguauu

SEQ ID NO: 4072679 - RNA, 23 nt, Streptococcus pneumoniae R6
acuucuuuuuguauuucuucuuc

SEQ ID NO: 4072680 - RNA, 20 nt, Streptococcus pneumoniae R6
acuucuuuuuugagaugaga

SEQ ID NO: 4072681 - RNA, 15 nt, Streptococcus pneumoniae R6
acuucuuuuuuugau

SEQ ID NO: 4072682 - RNA, 17 nt, Streptococcus pneumoniae R6
acuugaaucugaugaac

SEQ ID NO: 4072683 - RNA, 19 nt, Streptococcus pneumoniae R6
acuugaaucuggcuuucaa

SEQ ID NO: 4072684 - RNA, 17 nt, Streptococcus pneumoniae R6
acuugaccggagaaaga

SEQ ID NO: 4072685 - RNA, 22 nt, Streptococcus pneumoniae R6
acuugaccggagaaagaaucca

SEQ ID NO: 4072686 - RNA, 13 nt, Streptococcus pneumoniae R6
acuugaccuguuu

SEQ ID NO: 4072687 - RNA, 18 nt, Streptococcus pneumoniae R6
acuugaccuguuuucaca

SEQ ID NO: 4072688 - RNA, 20 nt, Streptococcus pneumoniae R6
acuugacgcuucccucucag

SEQ ID NO: 4072689 - RNA, 14 nt, Streptococcus pneumoniae R6
acuugacuagcaau

SEQ ID NO: 4072690 - RNA, 18 nt, Streptococcus pneumoniae R6
acuugagacuguuugaga

SEQ ID NO: 4072691 - RNA, 21 nt, Streptococcus pneumoniae R6
acuugaguaaugaacucaggu

SEQ ID NO: 4072692 - RNA, 15 nt, Streptococcus pneumoniae R6
acuugauaaaaguua

SEQ ID NO: 4072693 - RNA, 14 nt, Streptococcus pneumoniae R6
acuugaugaaaaaa

SEQ ID NO: 4072694 - RNA, 16 nt, Streptococcus pneumoniae R6
acuugauugcaaagca

SEQ ID NO: 4072695 - RNA, 22 nt, Streptococcus pneumoniae R6
acuugauuuuugccauauagca

SEQ ID NO: 4072696 - RNA, 15 nt, Streptococcus pneumoniae R6
acuugcaaaaagacu

SEQ ID NO: 4072697 - RNA, 15 nt, Streptococcus pneumoniae R6
acuugcaagaaagua

SEQ ID NO: 4072698 - RNA, 21 nt, Streptococcus pneumoniae R6
acuugcauuuagauaguacca

SEQ ID NO: 4072699 - RNA, 13 nt, Streptococcus pneumoniae R6
acuugccaguagc

SEQ ID NO: 4072700 - RNA, 21 nt, Streptococcus pneumoniae R6
acuugccugcuuuuucaagca

SEQ ID NO: 4072701 - RNA, 15 nt, Streptococcus pneumoniae R6
acuugcguuucuucu

SEQ ID NO: 4072702 - RNA, 20 nt, Streptococcus pneumoniae R6
acuugcucagaggagaugaa

SEQ ID NO: 4072703 - RNA, 22 nt, Streptococcus pneumoniae R6
acuugcuguuuucuuggucauu

SEQ ID NO: 4072704 - RNA, 13 nt, Streptococcus pneumoniae R6
acuuggaaaaaug

SEQ ID NO: 4072705 - RNA, 15 nt, Streptococcus pneumoniae R6
acuuggauaagagaa

SEQ ID NO: 4072706 - RNA, 13 nt, Streptococcus pneumoniae R6
acuuggauucuuu

SEQ ID NO: 4072707 - RNA, 12 nt, Streptococcus pneumoniae R6
acuuggcaaaau

SEQ ID NO: 4072708 - RNA, 19 nt, Streptococcus pneumoniae R6
acuugguaggauaaagugu

SEQ ID NO: 4072709 - RNA, 18 nt, Streptococcus pneumoniae R6
acuuggugcccaaauacu

SEQ ID NO: 4072710 - RNA, 16 nt, Streptococcus pneumoniae R6
acuugguguugagaaa

SEQ ID NO: 4072711 - RNA, 18 nt, Streptococcus pneumoniae R6
acuugguguugagaaagc

SEQ ID NO: 4072712 - RNA, 19 nt, Streptococcus pneumoniae R6
acuugguguugagaaagca

SEQ ID NO: 4072713 - RNA, 21 nt, Streptococcus pneumoniae R6
acuugguugauuuaccauuuu

SEQ ID NO: 4072714 - RNA, 21 nt, Streptococcus pneumoniae R6
acuuguaaagaguacagucuu

SEQ ID NO: 4072715 - RNA, 23 nt, Streptococcus pneumoniae R6
acuuguaaagcgaaaggagaaaa

SEQ ID NO: 4072716 - RNA, 20 nt, Streptococcus pneumoniae R6
acuuguaacuagcugccuag

SEQ ID NO: 4072717 - RNA, 14 nt, Streptococcus pneumoniae R6
acuuguacucaaug

SEQ ID NO: 4072718 - RNA, 16 nt, Streptococcus pneumoniae R6
acuuguacuugagauu

SEQ ID NO: 4072719 - RNA, 20 nt, Streptococcus pneumoniae R6
acuuguaggcuucuugacca

SEQ ID NO: 4072720 - RNA, 21 nt, Streptococcus pneumoniae R6
acuuguaggcuucuugaccag

SEQ ID NO: 4072721 - RNA, 16 nt, Streptococcus pneumoniae R6
acuuguauccuccucu

SEQ ID NO: 4072722 - RNA, 12 nt, Streptococcus pneumoniae R6
acuugugucaua

SEQ ID NO: 4072723 - RNA, 15 nt, Streptococcus pneumoniae R6
acuuguguuuuuccu

SEQ ID NO: 4072724 - RNA, 22 nt, Streptococcus pneumoniae R6
acuuguguuuuuccuuugagua

SEQ ID NO: 4072725 - RNA, 19 nt, Streptococcus pneumoniae R6
acuuguuagcugauuuuuu

SEQ ID NO: 4072726 - RNA, 16 nt, Streptococcus pneumoniae R6
acuuuaaaaauuuuuu

SEQ ID NO: 4072727 - RNA, 19 nt, Streptococcus pneumoniae R6
acuuuaaaaauuuuuuucu

SEQ ID NO: 4072728 - RNA, 19 nt, Streptococcus pneumoniae R6
acuuuaacuggaucaauga

SEQ ID NO: 4072729 - RNA, 16 nt, Streptococcus pneumoniae R6
acuuuaacuugaacuu

SEQ ID NO: 4072730 - RNA, 21 nt, Streptococcus pneumoniae R6
acuuuaagagcuucuuuugga

SEQ ID NO: 4072731 - RNA, 22 nt, Streptococcus pneumoniae R6
acuuuaagggaauuagagaguu

SEQ ID NO: 4072732 - RNA, 17 nt, Streptococcus pneumoniae R6
acuuuagcagcuuucaa

SEQ ID NO: 4072733 - RNA, 19 nt, Streptococcus pneumoniae R6
acuuuagcagcuuucaaag

SEQ ID NO: 4072734 - RNA, 22 nt, Streptococcus pneumoniae R6
acuuuaucaccuccuucuccag

SEQ ID NO: 4072735 - RNA, 12 nt, Streptococcus pneumoniae R6
acuuuauuuucu

SEQ ID NO: 4072736 - RNA, 18 nt, Streptococcus pneumoniae R6
acuuuauuuucucaucaa

SEQ ID NO: 4072737 - RNA, 20 nt, Streptococcus pneumoniae R6
acuuuauuuucucaucaaau

SEQ ID NO: 4072738 - RNA, 15 nt, Streptococcus pneumoniae R6
acuuucaauucuuca

SEQ ID NO: 4072739 - RNA, 21 nt, Streptococcus pneumoniae R6
acuuucccuuuccaagaaucc

SEQ ID NO: 4072740 - RNA, 18 nt, Streptococcus pneumoniae R6
acuuucuaucuucauuuu

SEQ ID NO: 4072741 - RNA, 21 nt, Streptococcus pneumoniae R6
acuuucugauagauuuauuuu

SEQ ID NO: 4072742 - RNA, 19 nt, Streptococcus pneumoniae R6
acuuucuggucuuuuugcu

SEQ ID NO: 4072743 - RNA, 18 nt, Streptococcus pneumoniae R6
acuuucuucgaaauucca

SEQ ID NO: 4072744 - RNA, 12 nt, Streptococcus pneumoniae R6
acuuucuuguuu

SEQ ID NO: 4072745 - RNA, 23 nt, Streptococcus pneumoniae R6
acuuucuuuuuauacucaucugc

SEQ ID NO: 4072746 - RNA, 18 nt, Streptococcus pneumoniae R6
acuuugaaauuuaucaac

SEQ ID NO: 4072747 - RNA, 14 nt, Streptococcus pneumoniae R6
acuuugagcaaccu

SEQ ID NO: 4072748 - RNA, 15 nt, Streptococcus pneumoniae R6
acuuugagcaaccug

SEQ ID NO: 4072749 - RNA, 14 nt, Streptococcus pneumoniae R6
acuuugauuuuuau

SEQ ID NO: 4072750 - RNA, 17 nt, Streptococcus pneumoniae R6
acuuuuaagaaaucaua

SEQ ID NO: 4072751 - RNA, 16 nt, Streptococcus pneumoniae R6
acuuuuccaguaauuu

SEQ ID NO: 4072752 - RNA, 14 nt, Streptococcus pneumoniae R6
acuuuuccuuaaca

SEQ ID NO: 4072753 - RNA, 20 nt, Streptococcus pneumoniae R6
acuuuuggggggcaguucag

SEQ ID NO: 4072754 - RNA, 20 nt, Streptococcus pneumoniae R6
acuuuuggggggcaguucau

SEQ ID NO: 4072755 - RNA, 23 nt, Streptococcus pneumoniae R6
acuuuuguccuauucuuguuuca

SEQ ID NO: 4072756 - RNA, 20 nt, Streptococcus pneumoniae R6
acuuuuguuucccuaauaau

SEQ ID NO: 4072757 - RNA, 13 nt, Streptococcus pneumoniae R6
acuuuuucaguuu

SEQ ID NO: 4072758 - RNA, 19 nt, Streptococcus pneumoniae R6
acuuuuucaguuuuagauu

SEQ ID NO: 4072759 - RNA, 20 nt, Streptococcus pneumoniae R6
agaaccaaaccaaacagucu

SEQ ID NO: 4072760 - RNA, 18 nt, Streptococcus pneumoniae R6
agaaccacgguaaaauac

SEQ ID NO: 4072761 - RNA, 15 nt, Streptococcus pneumoniae R6
agaaccaggaaacca

SEQ ID NO: 4072762 - RNA, 21 nt, Streptococcus pneumoniae R6
agaaccaggaaaccagcugcg

SEQ ID NO: 4072763 - RNA, 19 nt, Streptococcus pneumoniae R6
agaaccccgauaacagccg

SEQ ID NO: 4072764 - RNA, 14 nt, Streptococcus pneumoniae R6
agaacccuuauuuc

SEQ ID NO: 4072765 - RNA, 22 nt, Streptococcus pneumoniae R6
agaacccuuuuuggauaaguuu

SEQ ID NO: 4072766 - RNA, 23 nt, Streptococcus pneumoniae R6
agaaccucuguauaaauagcuac

SEQ ID NO: 4072767 - RNA, 23 nt, Streptococcus pneumoniae R6
agaacgauaaacaagggcaaaaa

SEQ ID NO: 4072768 - RNA, 14 nt, Streptococcus pneumoniae R6
agaacuaaaucuuc

SEQ ID NO: 4072769 - RNA, 14 nt, Streptococcus pneumoniae R6
agaacuaaauuacu

SEQ ID NO: 4072770 - RNA, 16 nt, Streptococcus pneumoniae R6
agaacuccagugaaaa

SEQ ID NO: 4072771 - RNA, 23 nt, Streptococcus pneumoniae R6
agaacucccuguuccaaagaagu

SEQ ID NO: 4072772 - RNA, 16 nt, Streptococcus pneumoniae R6
agaacugacgaaguca

SEQ ID NO: 4072773 - RNA, 20 nt, Streptococcus pneumoniae R6
agaacugacgaagucagcuc

SEQ ID NO: 4072774 - RNA, 19 nt, Streptococcus pneumoniae R6
agaacuugcuccaaaggag

SEQ ID NO: 4072775 - RNA, 20 nt, Streptococcus pneumoniae R6
agaacuugguuugucaucgu

SEQ ID NO: 4072776 - RNA, 16 nt, Streptococcus pneumoniae R6
agaacuuuaacuugaa

SEQ ID NO: 4072777 - RNA, 14 nt, Streptococcus pneumoniae R6
agaacuuuuaacuu

SEQ ID NO: 4072778 - RNA, 14 nt, Streptococcus pneumoniae R6
agaacuuuuuaaag

SEQ ID NO: 4072779 - RNA, 12 nt, Streptococcus pneumoniae R6
agaagagagcau

SEQ ID NO: 4072780 - RNA, 14 nt, Streptococcus pneumoniae R6
agaagagggcuucu

SEQ ID NO: 4072781 - RNA, 16 nt, Streptococcus pneumoniae R6
agaagaucaauaguga

SEQ ID NO: 4072782 - RNA, 18 nt, Streptococcus pneumoniae R6
agaagauuucagaaauau

SEQ ID NO: 4072783 - RNA, 18 nt, Streptococcus pneumoniae R6
agaagcaagugacaaaga

SEQ ID NO: 4072784 - RNA, 19 nt, Streptococcus pneumoniae R6
agaagcaccaguugcaguc

SEQ ID NO: 4072785 - RNA, 13 nt, Streptococcus pneumoniae R6
agaagcagaaaaa

SEQ ID NO: 4072786 - RNA, 18 nt, Streptococcus pneumoniae R6
agaagcagaaaaauuuca

SEQ ID NO: 4072787 - RNA, 18 nt, Streptococcus pneumoniae R6
agaagcauagagggauuu

SEQ ID NO: 4072788 - RNA, 13 nt, Streptococcus pneumoniae R6
agaagcguagagg

SEQ ID NO: 4072789 - RNA, 14 nt, Streptococcus pneumoniae R6
agaagcuccuuuag

SEQ ID NO: 4072790 - RNA, 18 nt, Streptococcus pneumoniae R6
agaagcuguaaaucuagg

SEQ ID NO: 4072791 - RNA, 22 nt, Streptococcus pneumoniae R6
agaaggaauucaagcaaaacaa

SEQ ID NO: 4072792 - RNA, 17 nt, Streptococcus pneumoniae R6
agaaggagccagcugaa

SEQ ID NO: 4072793 - RNA, 18 nt, Streptococcus pneumoniae R6
agaaggaggauuggguaa

SEQ ID NO: 4072794 - RNA, 14 nt, Streptococcus pneumoniae R6
agaaggaguugagc

SEQ ID NO: 4072795 - RNA, 13 nt, Streptococcus pneumoniae R6
agaaggauuuccu

SEQ ID NO: 4072796 - RNA, 14 nt, Streptococcus pneumoniae R6
agaaggauuuccua

SEQ ID NO: 4072797 - RNA, 21 nt, Streptococcus pneumoniae R6
agaaggccgagucaaaauucu

SEQ ID NO: 4072798 - RNA, 11 nt, Streptococcus pneumoniae R6
agaaggcuggu

SEQ ID NO: 4072799 - RNA, 14 nt, Streptococcus pneumoniae R6
agaaggcuucuugu

SEQ ID NO: 4072800 - RNA, 16 nt, Streptococcus pneumoniae R6
agaaggcuucuugugg

SEQ ID NO: 4072801 - RNA, 16 nt, Streptococcus pneumoniae R6
agaaggcuuuaccaaa

SEQ ID NO: 4072802 - RNA, 19 nt, Streptococcus pneumoniae R6
agaaggcuuucuaauuuuu

SEQ ID NO: 4072803 - RNA, 19 nt, Streptococcus pneumoniae R6
agaagguauucauaaaaua

SEQ ID NO: 4072804 - RNA, 21 nt, Streptococcus pneumoniae R6
agaagguauucauaaaauacc

SEQ ID NO: 4072805 - RNA, 16 nt, Streptococcus pneumoniae R6
agaaggucaagagaaa

SEQ ID NO: 4072806 - RNA, 20 nt, Streptococcus pneumoniae R6
agaaggucaagagaaaacca

SEQ ID NO: 4072807 - RNA, 18 nt, Streptococcus pneumoniae R6
agaagguguugauuuccu

SEQ ID NO: 4072808 - RNA, 12 nt, Streptococcus pneumoniae R6
agaagguuuuug

SEQ ID NO: 4072809 - RNA, 18 nt, Streptococcus pneumoniae R6
agaagguuuuugaaaguc

SEQ ID NO: 4072810 - RNA, 19 nt, Streptococcus pneumoniae R6
agaagguuuuugaaaguca

SEQ ID NO: 4072811 - RNA, 14 nt, Streptococcus pneumoniae R6
agaagucaccauaa

SEQ ID NO: 4072812 - RNA, 15 nt, Streptococcus pneumoniae R6
agaaguccauaaugu

SEQ ID NO: 4072813 - RNA, 18 nt, Streptococcus pneumoniae R6
agaaguccauagcgucaa

SEQ ID NO: 4072814 - RNA, 16 nt, Streptococcus pneumoniae R6
agaaguggauuuucuu

SEQ ID NO: 4072815 - RNA, 21 nt, Streptococcus pneumoniae R6
agaaguuggccaacuaaccaa

SEQ ID NO: 4072816 - RNA, 13 nt, Streptococcus pneumoniae R6
agaaguuuuccuu

SEQ ID NO: 4072817 - RNA, 17 nt, Streptococcus pneumoniae R6
agaauaagggauucgaa

SEQ ID NO: 4072818 - RNA, 14 nt, Streptococcus pneumoniae R6
agaauaauuaaauc

SEQ ID NO: 4072819 - RNA, 15 nt, Streptococcus pneumoniae R6
agaauacaguaucag

SEQ ID NO: 4072820 - RNA, 13 nt, Streptococcus pneumoniae R6
agaauacucuuua

SEQ ID NO: 4072821 - RNA, 21 nt, Streptococcus pneumoniae R6
agaauacucuuuacuuugcuu

SEQ ID NO: 4072822 - RNA, 16 nt, Streptococcus pneumoniae R6
agaauagcgauuuaau

SEQ ID NO: 4072823 - RNA, 13 nt, Streptococcus pneumoniae R6
agaauaguacacu

SEQ ID NO: 4072824 - RNA, 17 nt, Streptococcus pneumoniae R6
agaauaguguaguugaa

SEQ ID NO: 4072825 - RNA, 16 nt, Streptococcus pneumoniae R6
agaauaucaagauaag

SEQ ID NO: 4072826 - RNA, 20 nt, Streptococcus pneumoniae R6
agaauaucaagauaagaaaa

SEQ ID NO: 4072827 - RNA, 15 nt, Streptococcus pneumoniae R6
agaauauuuacuuca

SEQ ID NO: 4072828 - RNA, 15 nt, Streptococcus pneumoniae R6
agaaucaacaugaga

SEQ ID NO: 4072829 - RNA, 23 nt, Streptococcus pneumoniae R6
agaaucaacaugagaauacaaaa

SEQ ID NO: 4072830 - RNA, 14 nt, Streptococcus pneumoniae R6
agaauccaaaaaau

SEQ ID NO: 4072831 - RNA, 15 nt, Streptococcus pneumoniae R6
agaauccaauucaaa

SEQ ID NO: 4072832 - RNA, 12 nt, Streptococcus pneumoniae R6
agaauccaucug

SEQ ID NO: 4072833 - RNA, 14 nt, Streptococcus pneumoniae R6
agaaucccaaagaa

SEQ ID NO: 4072834 - RNA, 15 nt, Streptococcus pneumoniae R6
agaaucccaaagaag

SEQ ID NO: 4072835 - RNA, 13 nt, Streptococcus pneumoniae R6
agaaucccagaua

SEQ ID NO: 4072836 - RNA, 15 nt, Streptococcus pneumoniae R6
agaaucccagauaaa

SEQ ID NO: 4072837 - RNA, 17 nt, Streptococcus pneumoniae R6
agaaucccagauaaagc

SEQ ID NO: 4072838 - RNA, 22 nt, Streptococcus pneumoniae R6
agaaucgucuguacaaauccca

SEQ ID NO: 4072839 - RNA, 19 nt, Streptococcus pneumoniae R6
agaaucgugaguuccuguu

SEQ ID NO: 4072840 - RNA, 14 nt, Streptococcus pneumoniae R6
agaaucugcaugac

SEQ ID NO: 4072841 - RNA, 21 nt, Streptococcus pneumoniae R6
agaaugcuugcgacaaaaaga

SEQ ID NO: 4072842 - RNA, 18 nt, Streptococcus pneumoniae R6
agaaugcuuuuugaaagc

SEQ ID NO: 4072843 - RNA, 18 nt, Streptococcus pneumoniae R6
agaauguccauaacugcu

SEQ ID NO: 4072844 - RNA, 16 nt, Streptococcus pneumoniae R6
agaauguuaugcaacu

SEQ ID NO: 4072845 - RNA, 20 nt, Streptococcus pneumoniae R6
agaauugaaagucuuggaaa

SEQ ID NO: 4072846 - RNA, 19 nt, Streptococcus pneumoniae R6
agaauuggcacaaaagcga

SEQ ID NO: 4072847 - RNA, 17 nt, Streptococcus pneumoniae R6
agaauuggcuaaagagu

SEQ ID NO: 4072848 - RNA, 18 nt, Streptococcus pneumoniae R6
agaauuggcuaaagaguu

SEQ ID NO: 4072849 - RNA, 20 nt, Streptococcus pneumoniae R6
agaauuuaacucuuuuuugg

SEQ ID NO: 4072850 - RNA, 16 nt, Streptococcus pneumoniae R6
agaauuugaaaaaaau

SEQ ID NO: 4072851 - RNA, 10 nt, Streptococcus pneumoniae R6
agacaaaaaa

SEQ ID NO: 4072852 - RNA, 12 nt, Streptococcus pneumoniae R6
agacaaaaaaaa

SEQ ID NO: 4072853 - RNA, 20 nt, Streptococcus pneumoniae R6
agacaacuccuugaaucauc

SEQ ID NO: 4072854 - RNA, 16 nt, Streptococcus pneumoniae R6
agacaaggauaaaaag

SEQ ID NO: 4072855 - RNA, 17 nt, Streptococcus pneumoniae R6
agacaaggauaaaaagu

SEQ ID NO: 4072856 - RNA, 18 nt, Streptococcus pneumoniae R6
agacaauguucuuuucuc

SEQ ID NO: 4072857 - RNA, 22 nt, Streptococcus pneumoniae R6
agacaauuuccggcucuuuguc

SEQ ID NO: 4072858 - RNA, 13 nt, Streptococcus pneumoniae R6
agacaauuuucau

SEQ ID NO: 4072859 - RNA, 16 nt, Streptococcus pneumoniae R6
agacacaugaguagca

SEQ ID NO: 4072860 - RNA, 14 nt, Streptococcus pneumoniae R6
agacacuaagaaga

SEQ ID NO: 4072861 - RNA, 19 nt, Streptococcus pneumoniae R6
agacacuuacggaucuagc

SEQ ID NO: 4072862 - RNA, 18 nt, Streptococcus pneumoniae R6
agagagcuccaaagaaga

SEQ ID NO: 4072863 - RNA, 19 nt, Streptococcus pneumoniae R6
agagagcuccaaagaagau

SEQ ID NO: 4072864 - RNA, 21 nt, Streptococcus pneumoniae R6
agagagcuuucuaaacaaugu

SEQ ID NO: 4072865 - RNA, 21 nt, Streptococcus pneumoniae R6
agagagguagaggcgccugcu

SEQ ID NO: 4072866 - RNA, 20 nt, Streptococcus pneumoniae R6
agagauaggucaagccgagc

SEQ ID NO: 4072867 - RNA, 18 nt, Streptococcus pneumoniae R6
agagaugagagauaaaua

SEQ ID NO: 4072868 - RNA, 16 nt, Streptococcus pneumoniae R6
agagauuauaguggug

SEQ ID NO: 4072869 - RNA, 19 nt, Streptococcus pneumoniae R6
agagauugauaucuggauu

SEQ ID NO: 4072870 - RNA, 17 nt, Streptococcus pneumoniae R6
agagauugcgauacugu

SEQ ID NO: 4072871 - RNA, 12 nt, Streptococcus pneumoniae R6
agagcaaaaaca

SEQ ID NO: 4072872 - RNA, 20 nt, Streptococcus pneumoniae R6
agagcaaacuaggaaaccag

SEQ ID NO: 4072873 - RNA, 17 nt, Streptococcus pneumoniae R6
agagcaaacuaggaagc

SEQ ID NO: 4072874 - RNA, 20 nt, Streptococcus pneumoniae R6
agagcaaacuaggaagcuag

SEQ ID NO: 4072875 - RNA, 15 nt, Streptococcus pneumoniae R6
agagcaacaaauaug

SEQ ID NO: 4072876 - RNA, 22 nt, Streptococcus pneumoniae R6
agagcaccaaccaagcgcucga

SEQ ID NO: 4072877 - RNA, 16 nt, Streptococcus pneumoniae R6
agagcaguuuuccuau

SEQ ID NO: 4072878 - RNA, 13 nt, Streptococcus pneumoniae R6
agagcauauuuac

SEQ ID NO: 4072879 - RNA, 22 nt, Streptococcus pneumoniae R6
agagcauucuuuuguucaucau

SEQ ID NO: 4072880 - RNA, 15 nt, Streptococcus pneumoniae R6
agagccaaaaaagaa

SEQ ID NO: 4072881 - RNA, 16 nt, Streptococcus pneumoniae R6
agagccaaaaaagaaa

SEQ ID NO: 4072882 - RNA, 19 nt, Streptococcus pneumoniae R6
agagccaaaaaagaaagga

SEQ ID NO: 4072883 - RNA, 16 nt, Streptococcus pneumoniae R6
agagcccaauauucuc

SEQ ID NO: 4072884 - RNA, 20 nt, Streptococcus pneumoniae R6
agagcccaauauucucuaga

SEQ ID NO: 4072885 - RNA, 21 nt, Streptococcus pneumoniae R6
agagccgaaaaaauaggcaga

SEQ ID NO: 4072886 - RNA, 14 nt, Streptococcus pneumoniae R6
agagccuaguugcu

SEQ ID NO: 4072887 - RNA, 23 nt, Streptococcus pneumoniae R6
agagccuaguugcuaguguaugg

SEQ ID NO: 4072888 - RNA, 12 nt, Streptococcus pneumoniae R6
agagcgauaaaa

SEQ ID NO: 4072889 - RNA, 22 nt, Streptococcus pneumoniae R6
agagcgauaaaaauccuuuuuu

SEQ ID NO: 4072890 - RNA, 22 nt, Streptococcus pneumoniae R6
agagcguugacgauuuuuucuu

SEQ ID NO: 4072891 - RNA, 15 nt, Streptococcus pneumoniae R6
agagcuaacuuuucc

SEQ ID NO: 4072892 - RNA, 18 nt, Streptococcus pneumoniae R6
agagcuaacuuuuccuua

SEQ ID NO: 4072893 - RNA, 23 nt, Streptococcus pneumoniae R6
agagcuccaaauggcaugaggag

SEQ ID NO: 4072894 - RNA, 17 nt, Streptococcus pneumoniae R6
agagcugauagagauua

SEQ ID NO: 4072895 - RNA, 12 nt, Streptococcus pneumoniae R6
agagcugccauu

SEQ ID NO: 4072896 - RNA, 22 nt, Streptococcus pneumoniae R6
agagcuucuuuuggauuuucaa

SEQ ID NO: 4072897 - RNA, 23 nt, Streptococcus pneumoniae R6
agagcuuugcuuuccucagcagg

SEQ ID NO: 4072898 - RNA, 13 nt, Streptococcus pneumoniae R6
agaggaagaggac

SEQ ID NO: 4072899 - RNA, 16 nt, Streptococcus pneumoniae R6
agaggacauagaaaau

SEQ ID NO: 4072900 - RNA, 21 nt, Streptococcus pneumoniae R6
agaggaggugaaacuaaugag

SEQ ID NO: 4072901 - RNA, 21 nt, Streptococcus pneumoniae R6
agaggagucuuauaguaacga

SEQ ID NO: 4072902 - RNA, 13 nt, Streptococcus pneumoniae R6
agaggagugauaa

SEQ ID NO: 4072903 - RNA, 23 nt, Streptococcus pneumoniae R6
agaggaugaaccugcuuuagauu

SEQ ID NO: 4072904 - RNA, 17 nt, Streptococcus pneumoniae R6
agaggcaacagaaauaa

SEQ ID NO: 4072905 - RNA, 14 nt, Streptococcus pneumoniae R6
agaggcaaugacaa

SEQ ID NO: 4072906 - RNA, 13 nt, Streptococcus pneumoniae R6
agagggcaaggau

SEQ ID NO: 4072907 - RNA, 22 nt, Streptococcus pneumoniae R6
agagggcgguacccacaaagau

SEQ ID NO: 4072908 - RNA, 21 nt, Streptococcus pneumoniae R6
agaggguggaaagacugguga

SEQ ID NO: 4072909 - RNA, 21 nt, Streptococcus pneumoniae R6
agagguauuuaccgucuuuag

SEQ ID NO: 4072910 - RNA, 12 nt, Streptococcus pneumoniae R6
agaggugccagu

SEQ ID NO: 4072911 - RNA, 22 nt, Streptococcus pneumoniae R6
agaggugccaguacaauagcua

SEQ ID NO: 4072912 - RNA, 17 nt, Streptococcus pneumoniae R6
agagguggaaaagcaag

SEQ ID NO: 4072913 - RNA, 21 nt, Streptococcus pneumoniae R6
agaguaaaagaaauacaguac

SEQ ID NO: 4072914 - RNA, 20 nt, Streptococcus pneumoniae R6
agaguaaacuagaaagcuag

SEQ ID NO: 4072915 - RNA, 15 nt, Streptococcus pneumoniae R6
agaguaagaaagcag

SEQ ID NO: 4072916 - RNA, 19 nt, Streptococcus pneumoniae R6
agaguacgaaauucguacu

SEQ ID NO: 4072917 - RNA, 17 nt, Streptococcus pneumoniae R6
agaguacuaaauauaag

SEQ ID NO: 4072918 - RNA, 15 nt, Streptococcus pneumoniae R6
agaguagagagaaag

SEQ ID NO: 4072919 - RNA, 19 nt, Streptococcus pneumoniae R6
agaguagucugggugcuga

SEQ ID NO: 4072920 - RNA, 22 nt, Streptococcus pneumoniae R6
agaguauaaaaccuugaagagu

SEQ ID NO: 4072921 - RNA, 16 nt, Streptococcus pneumoniae R6
agaguauaaaaucaaa

SEQ ID NO: 4072922 - RNA, 18 nt, Streptococcus pneumoniae R6
agaguauaaaauuuugac

SEQ ID NO: 4072923 - RNA, 17 nt, Streptococcus pneumoniae R6
agaguauaagucuuuga

SEQ ID NO: 4072924 - RNA, 16 nt, Streptococcus pneumoniae R6
agaguauuacaaucau

SEQ ID NO: 4072925 - RNA, 16 nt, Streptococcus pneumoniae R6
agagucacaaagguca

SEQ ID NO: 4072926 - RNA, 21 nt, Streptococcus pneumoniae R6
agagucagcucuuuuuugaua

SEQ ID NO: 4072927 - RNA, 18 nt, Streptococcus pneumoniae R6
agagucccuuagaaaaac

SEQ ID NO: 4072928 - RNA, 23 nt, Streptococcus pneumoniae R6
agaguccugcccacuaaaaauau

SEQ ID NO: 4072929 - RNA, 16 nt, Streptococcus pneumoniae R6
agagucuggaacaaaa

SEQ ID NO: 4072930 - RNA, 18 nt, Streptococcus pneumoniae R6
agagucuggaacaaaaua

SEQ ID NO: 4072931 - RNA, 24 nt, Streptococcus pneumoniae R6
agagugacagggccuuuugcauaa

SEQ ID NO: 4072932 - RNA, 17 nt, Streptococcus pneumoniae R6
agaguggcuuuugauuu

SEQ ID NO: 4072933 - RNA, 14 nt, Streptococcus pneumoniae R6
agaguuaaaaaaag

SEQ ID NO: 4072934 - RNA, 21 nt, Streptococcus pneumoniae R6
agaguucacggauucucucag

SEQ ID NO: 4072935 - RNA, 22 nt, Streptococcus pneumoniae R6
agaguugaaaaguccucguagc

SEQ ID NO: 4072936 - RNA, 22 nt, Streptococcus pneumoniae R6
agaguugaaugccuccaagaaa

SEQ ID NO: 4072937 - RNA, 19 nt, Streptococcus pneumoniae R6
agaguugcuugucaucuuc

SEQ ID NO: 4072938 - RNA, 16 nt, Streptococcus pneumoniae R6
agaguuggaugucauu

SEQ ID NO: 4072939 - RNA, 21 nt, Streptococcus pneumoniae R6
agaguuguucacaucuuauuu

SEQ ID NO: 4072940 - RNA, 12 nt, Streptococcus pneumoniae R6
agaguuucaauu

SEQ ID NO: 4072941 - RNA, 21 nt, Streptococcus pneumoniae R6
agaguuuugguugaugaagaa

SEQ ID NO: 4072942 - RNA, 18 nt, Streptococcus pneumoniae R6
agauaaaaccugccugug

SEQ ID NO: 4072943 - RNA, 23 nt, Streptococcus pneumoniae R6
agauaaaagcgccugacauucuu

SEQ ID NO: 4072944 - RNA, 23 nt, Streptococcus pneumoniae R6
agauaaaagggaacacagcugug

SEQ ID NO: 4072945 - RNA, 23 nt, Streptococcus pneumoniae R6
agauaaagagucuggaacaaaau

SEQ ID NO: 4072946 - RNA, 15 nt, Streptococcus pneumoniae R6
agauaacaguuuuua

SEQ ID NO: 4072947 - RNA, 16 nt, Streptococcus pneumoniae R6
agauaaccaucucaca

SEQ ID NO: 4072948 - RNA, 13 nt, Streptococcus pneumoniae R6
agauaaccccacg

SEQ ID NO: 4072949 - RNA, 16 nt, Streptococcus pneumoniae R6
agauaacugcuagaaa

SEQ ID NO: 4072950 - RNA, 14 nt, Streptococcus pneumoniae R6
agauaacuuuucug

SEQ ID NO: 4072951 - RNA, 19 nt, Streptococcus pneumoniae R6
agauaagauagucgauaaa

SEQ ID NO: 4072952 - RNA, 13 nt, Streptococcus pneumoniae R6
agauaaggacugc

SEQ ID NO: 4072953 - RNA, 17 nt, Streptococcus pneumoniae R6
agauaaggcaucuuaac

SEQ ID NO: 4072954 - RNA, 20 nt, Streptococcus pneumoniae R6
agauaaggcaucuuaacauu

SEQ ID NO: 4072955 - RNA, 16 nt, Streptococcus pneumoniae R6
agauaaggccugauaa

SEQ ID NO: 4072956 - RNA, 22 nt, Streptococcus pneumoniae R6
agauaaggucaucuuauagcga

SEQ ID NO: 4072957 - RNA, 19 nt, Streptococcus pneumoniae R6
agauaagguucaaaaaaug

SEQ ID NO: 4072958 - RNA, 15 nt, Streptococcus pneumoniae R6
agauaaguuugguuu

SEQ ID NO: 4072959 - RNA, 22 nt, Streptococcus pneumoniae R6
agauaauagcgaugaagagaga

SEQ ID NO: 4072960 - RNA, 20 nt, Streptococcus pneumoniae R6
agauaaucugcaaaguauuc

SEQ ID NO: 4072961 - RNA, 18 nt, Streptococcus pneumoniae R6
agauaaugcccaagagac

SEQ ID NO: 4072962 - RNA, 12 nt, Streptococcus pneumoniae R6
agauaauucucu

SEQ ID NO: 4072963 - RNA, 14 nt, Streptococcus pneumoniae R6
agauacaaaaccaa

SEQ ID NO: 4072964 - RNA, 16 nt, Streptococcus pneumoniae R6
agauucugacaaucca

SEQ ID NO: 4072965 - RNA, 20 nt, Streptococcus pneumoniae R6
agauucugugguaaugcuuu

SEQ ID NO: 4072966 - RNA, 16 nt, Streptococcus pneumoniae R6
agauugaaauagaaua

SEQ ID NO: 4072967 - RNA, 17 nt, Streptococcus pneumoniae R6
agauugagaucucuuag

SEQ ID NO: 4072968 - RNA, 19 nt, Streptococcus pneumoniae R6
agauugauaaaggcagauu

SEQ ID NO: 4072969 - RNA, 16 nt, Streptococcus pneumoniae R6
agauugcacgcuagca

SEQ ID NO: 4072970 - RNA, 21 nt, Streptococcus pneumoniae R6
agauugccuugcucuguucug

SEQ ID NO: 4072971 - RNA, 13 nt, Streptococcus pneumoniae R6
agauuggauaaaa

SEQ ID NO: 4072972 - RNA, 21 nt, Streptococcus pneumoniae R6
agauuguaaaggaugacaaua

SEQ ID NO: 4072973 - RNA, 23 nt, Streptococcus pneumoniae R6
agauuuaaaaauguugcauuuuu

SEQ ID NO: 4072974 - RNA, 21 nt, Streptococcus pneumoniae R6
agauuuaaaaucguagucuuu

SEQ ID NO: 4072975 - RNA, 12 nt, Streptococcus pneumoniae R6
agauuuaaucug

SEQ ID NO: 4072976 - RNA, 17 nt, Streptococcus pneumoniae R6
agauuuacuuccuuuuc

SEQ ID NO: 4072977 - RNA, 21 nt, Streptococcus pneumoniae R6
agauuuacuucuuuuucuccu

SEQ ID NO: 4072978 - RNA, 21 nt, Streptococcus pneumoniae R6
agauuucacgguaauuguuuu

SEQ ID NO: 4072979 - RNA, 13 nt, Streptococcus pneumoniae R6
agauuucagaaau

SEQ ID NO: 4072980 - RNA, 22 nt, Streptococcus pneumoniae R6
agauuuccuccauaaacgcaag

SEQ ID NO: 4072981 - RNA, 22 nt, Streptococcus pneumoniae R6
agauuugacguuuccuucuacu

SEQ ID NO: 4072982 - RNA, 18 nt, Streptococcus pneumoniae R6
agauuugcaucaaucucu

SEQ ID NO: 4072983 - RNA, 20 nt, Streptococcus pneumoniae R6
agauuuguuuuucaaagacu

SEQ ID NO: 4072984 - RNA, 16 nt, Streptococcus pneumoniae R6
agauuuucaaaaaaag

SEQ ID NO: 4072985 - RNA, 19 nt, Streptococcus pneumoniae R6
agauuuucauaaacaagag

SEQ ID NO: 4072986 - RNA, 21 nt, Streptococcus pneumoniae R6
agauuuuccucauuuucuagu

SEQ ID NO: 4072987 - RNA, 16 nt, Streptococcus pneumoniae R6
agauuuucgaagagua

SEQ ID NO: 4072988 - RNA, 21 nt, Streptococcus pneumoniae R6
agauuuucgaagaguauaaaa

SEQ ID NO: 4072989 - RNA, 18 nt, Streptococcus pneumoniae R6
agauuuucuggcagauuu

SEQ ID NO: 4072990 - RNA, 22 nt, Streptococcus pneumoniae R6
agauuuucuggcagauuuugaa

SEQ ID NO: 4072991 - RNA, 13 nt, Streptococcus pneumoniae R6
agauuuugaagau

SEQ ID NO: 4072992 - RNA, 14 nt, Streptococcus pneumoniae R6
agauuuuuggaaaa

SEQ ID NO: 4072993 - RNA, 20 nt, Streptococcus pneumoniae R6
agauuuuuggaaaaaauaaa

SEQ ID NO: 4072994 - RNA, 21 nt, Streptococcus pneumoniae R6
agauuuuuucugucuaacuuu

SEQ ID NO: 4072995 - RNA, 21 nt, Streptococcus pneumoniae R6
agauuuuuuggauucucaaaa

SEQ ID NO: 4072996 - RNA, 18 nt, Streptococcus pneumoniae R6
agcaaaaaggaguuaccu

SEQ ID NO: 4072997 - RNA, 15 nt, Streptococcus pneumoniae R6
agcaaaacacuacca

SEQ ID NO: 4072998 - RNA, 17 nt, Streptococcus pneumoniae R6
agcaaaagaacaaguaa

SEQ ID NO: 4072999 - RNA, 17 nt, Streptococcus pneumoniae R6
agcaaaagcagcgacau

SEQ ID NO: 4073000 - RNA, 21 nt, Streptococcus pneumoniae R6
agcaaacgaacgccuuaaaaa

SEQ ID NO: 4073001 - RNA, 23 nt, Streptococcus pneumoniae R6
agcaaacuaaauaccuuauccaa

SEQ ID NO: 4073002 - RNA, 15 nt, Streptococcus pneumoniae R6
agcaaaucagcuaag

SEQ ID NO: 4073003 - RNA, 17 nt, Streptococcus pneumoniae R6
agcaacacgaccuucaa

SEQ ID NO: 4073004 - RNA, 13 nt, Streptococcus pneumoniae R6
agcaacagaugag

SEQ ID NO: 4073005 - RNA, 13 nt, Streptococcus pneumoniae R6
agcaacagcugga

SEQ ID NO: 4073006 - RNA, 19 nt, Streptococcus pneumoniae R6
agcaaccacguuccuuggc

SEQ ID NO: 4073007 - RNA, 17 nt, Streptococcus pneumoniae R6
agcaaccauuuucucaa

SEQ ID NO: 4073008 - RNA, 15 nt, Streptococcus pneumoniae R6
agcaacgucuucaau

SEQ ID NO: 4073009 - RNA, 13 nt, Streptococcus pneumoniae R6
agcaacuaaaauc

SEQ ID NO: 4073010 - RNA, 17 nt, Streptococcus pneumoniae R6
agcaacuauaagauacu

SEQ ID NO: 4073011 - RNA, 14 nt, Streptococcus pneumoniae R6
agcaacuucagauu

SEQ ID NO: 4073012 - RNA, 18 nt, Streptococcus pneumoniae R6
agcaacuucagauucacu

SEQ ID NO: 4073013 - RNA, 14 nt, Streptococcus pneumoniae R6
agcaagacaaaaac

SEQ ID NO: 4073014 - RNA, 14 nt, Streptococcus pneumoniae R6
agcaagaguuuuuc

SEQ ID NO: 4073015 - RNA, 17 nt, Streptococcus pneumoniae R6
agcaaggcuagugggag

SEQ ID NO: 4073016 - RNA, 23 nt, Streptococcus pneumoniae R6
agcaaggcuuuguggucuugcuu

SEQ ID NO: 4073017 - RNA, 14 nt, Streptococcus pneumoniae R6
agcaaguucaagac

SEQ ID NO: 4073018 - RNA, 16 nt, Streptococcus pneumoniae R6
agcaaguuuugaacuu

SEQ ID NO: 4073019 - RNA, 16 nt, Streptococcus pneumoniae R6
agcaauaauaaugguu

SEQ ID NO: 4073020 - RNA, 15 nt, Streptococcus pneumoniae R6
agcaaucaaaauugu

SEQ ID NO: 4073021 - RNA, 14 nt, Streptococcus pneumoniae R6
agcaaucacucuaa

SEQ ID NO: 4073022 - RNA, 17 nt, Streptococcus pneumoniae R6
agcaaucacucuaacuu

SEQ ID NO: 4073023 - RNA, 22 nt, Streptococcus pneumoniae R6
agcaaucauaccugcauugucu

SEQ ID NO: 4073024 - RNA, 18 nt, Streptococcus pneumoniae R6
agcaaucgcaaucuacuu

SEQ ID NO: 4073025 - RNA, 19 nt, Streptococcus pneumoniae R6
agcaaucgcaaucuacuug

SEQ ID NO: 4073026 - RNA, 21 nt, Streptococcus pneumoniae R6
agcaaugauagacauuucacg

SEQ ID NO: 4073027 - RNA, 12 nt, Streptococcus pneumoniae R6
agcaaugccaaa

SEQ ID NO: 4073028 - RNA, 16 nt, Streptococcus pneumoniae R6
agcaaugccaaaggua

SEQ ID NO: 4073029 - RNA, 22 nt, Streptococcus pneumoniae R6
agcaaugccaaagguaauccaa

SEQ ID NO: 4073030 - RNA, 18 nt, Streptococcus pneumoniae R6
agcaauugaucccauacc

SEQ ID NO: 4073031 - RNA, 17 nt, Streptococcus pneumoniae R6
agcaauuuugaaagauu

SEQ ID NO: 4073032 - RNA, 23 nt, Streptococcus pneumoniae R6
agcacaaaaucaggaaaucuucu

SEQ ID NO: 4073033 - RNA, 19 nt, Streptococcus pneumoniae R6
agcacaaugcuguuucuau

SEQ ID NO: 4073034 - RNA, 12 nt, Streptococcus pneumoniae R6
agcacacaaauc

SEQ ID NO: 4073035 - RNA, 14 nt, Streptococcus pneumoniae R6
agcacaccaaacau

SEQ ID NO: 4073036 - RNA, 16 nt, Streptococcus pneumoniae R6
agcacaugacaaauuc

SEQ ID NO: 4073037 - RNA, 15 nt, Streptococcus pneumoniae R6
agcaccaaaagcaga

SEQ ID NO: 4073038 - RNA, 16 nt, Streptococcus pneumoniae R6
agcaccagacauuuca

SEQ ID NO: 4073039 - RNA, 18 nt, Streptococcus pneumoniae R6
agcaccuaguacaaagaa

SEQ ID NO: 4073040 - RNA, 23 nt, Streptococcus pneumoniae R6
agcaccuguggcuguuuuggcaa

SEQ ID NO: 4073041 - RNA, 16 nt, Streptococcus pneumoniae R6
agcacggaucuugaac

SEQ ID NO: 4073042 - RNA, 23 nt, Streptococcus pneumoniae R6
agcacgugcggcuagccuccuag

SEQ ID NO: 4073043 - RNA, 15 nt, Streptococcus pneumoniae R6
agcacguuuuucuuc

SEQ ID NO: 4073044 - RNA, 18 nt, Streptococcus pneumoniae R6
agcacguuuuucuucuuu

SEQ ID NO: 4073045 - RNA, 20 nt, Streptococcus pneumoniae R6
agcacuauuguuauuuuucu

SEQ ID NO: 4073046 - RNA, 14 nt, Streptococcus pneumoniae R6
agcacucaauauua

SEQ ID NO: 4073047 - RNA, 19 nt, Streptococcus pneumoniae R6
agcacuugaugaaaaaaag

SEQ ID NO: 4073048 - RNA, 23 nt, Streptococcus pneumoniae R6
agcagaaaaaugacaauaaaaua

SEQ ID NO: 4073049 - RNA, 19 nt, Streptococcus pneumoniae R6
agcagaacaaugacuccca

SEQ ID NO: 4073050 - RNA, 19 nt, Streptococcus pneumoniae R6
agcagaaccccgauaacag

SEQ ID NO: 4073051 - RNA, 15 nt, Streptococcus pneumoniae R6
agcagacuucuuuuu

SEQ ID NO: 4073052 - RNA, 12 nt, Streptococcus pneumoniae R6
agcagagaaaga

SEQ ID NO: 4073053 - RNA, 17 nt, Streptococcus pneumoniae R6
agcagaggcaaugacaa

SEQ ID NO: 4073054 - RNA, 13 nt, Streptococcus pneumoniae R6
agcagaguuuuua

SEQ ID NO: 4073055 - RNA, 21 nt, Streptococcus pneumoniae R6
agcagauaaguuugguuuuuu

SEQ ID NO: 4073056 - RNA, 15 nt, Streptococcus pneumoniae R6
agcagauagccagcc

SEQ ID NO: 4073057 - RNA, 16 nt, Streptococcus pneumoniae R6
agcagauugaaauaag

SEQ ID NO: 4073058 - RNA, 18 nt, Streptococcus pneumoniae R6
agcagauugaaauaagau

SEQ ID NO: 4073059 - RNA, 20 nt, Streptococcus pneumoniae R6
agcagccuccguaccaacac

SEQ ID NO: 4073060 - RNA, 18 nt, Streptococcus pneumoniae R6
agcagcggacucuuaauc

SEQ ID NO: 4073061 - RNA, 14 nt, Streptococcus pneumoniae R6
agcagcgguuccau

SEQ ID NO: 4073062 - RNA, 22 nt, Streptococcus pneumoniae R6
agcagcuaaaagcaaagcagau

SEQ ID NO: 4073063 - RNA, 19 nt, Streptococcus pneumoniae R6
agcagcuaagaccuugaua

SEQ ID NO: 4073064 - RNA, 20 nt, Streptococcus pneumoniae R6
agcagcuaagaccuugauag

SEQ ID NO: 4073065 - RNA, 21 nt, Streptococcus pneumoniae R6
agcaggacuuggauaagagaa

SEQ ID NO: 4073066 - RNA, 22 nt, Streptococcus pneumoniae R6
agcggauuuggcuuuuuuguau

SEQ ID NO: 4073067 - RNA, 13 nt, Streptococcus pneumoniae R6
agcggauuuucaa

SEQ ID NO: 4073068 - RNA, 22 nt, Streptococcus pneumoniae R6
agcggcuagcgucuaacaauua

SEQ ID NO: 4073069 - RNA, 13 nt, Streptococcus pneumoniae R6
agcgguaucaauc

SEQ ID NO: 4073070 - RNA, 15 nt, Streptococcus pneumoniae R6
agcggucaaucgcuu

SEQ ID NO: 4073071 - RNA, 15 nt, Streptococcus pneumoniae R6
agcgguucagcucaa

SEQ ID NO: 4073072 - RNA, 19 nt, Streptococcus pneumoniae R6
agcguagucuuuuaaacua

SEQ ID NO: 4073073 - RNA, 22 nt, Streptococcus pneumoniae R6
agcguccaucucgacuggcaaa

SEQ ID NO: 4073074 - RNA, 17 nt, Streptococcus pneumoniae R6
agcguugacgauuuuuu

SEQ ID NO: 4073075 - RNA, 19 nt, Streptococcus pneumoniae R6
agcguuuugaaacuagaac

SEQ ID NO: 4073076 - RNA, 19 nt, Streptococcus pneumoniae R6
agcguuuugaaacuagaau

SEQ ID NO: 4073077 - RNA, 21 nt, Streptococcus pneumoniae R6
agcguuuuuguguucuacucu

SEQ ID NO: 4073078 - RNA, 12 nt, Streptococcus pneumoniae R6
agcuaaaagcaa

SEQ ID NO: 4073079 - RNA, 15 nt, Streptococcus pneumoniae R6
agcuaaaagcaaagc

SEQ ID NO: 4073080 - RNA, 20 nt, Streptococcus pneumoniae R6
agcuaaagaugaugguuagg

SEQ ID NO: 4073081 - RNA, 15 nt, Streptococcus pneumoniae R6
agcuaaauccuuuuu

SEQ ID NO: 4073082 - RNA, 15 nt, Streptococcus pneumoniae R6
agcuaacuuuuccuu

SEQ ID NO: 4073083 - RNA, 13 nt, Streptococcus pneumoniae R6
agcuaauuuugcc

SEQ ID NO: 4073084 - RNA, 15 nt, Streptococcus pneumoniae R6
agcuaauuuugccag

SEQ ID NO: 4073085 - RNA, 13 nt, Streptococcus pneumoniae R6
agcuacagagcua

SEQ ID NO: 4073086 - RNA, 21 nt, Streptococcus pneumoniae R6
agcuacgcgcccaaguuaaaa

SEQ ID NO: 4073087 - RNA, 18 nt, Streptococcus pneumoniae R6
agcuacguucugucaaac

SEQ ID NO: 4073088 - RNA, 16 nt, Streptococcus pneumoniae R6
agcuacuauaaaagag

SEQ ID NO: 4073089 - RNA, 22 nt, Streptococcus pneumoniae R6
agcuagccgcagguugcucaaa

SEQ ID NO: 4073090 - RNA, 19 nt, Streptococcus pneumoniae R6
agcuaggagacucuugagg

SEQ ID NO: 4073091 - RNA, 18 nt, Streptococcus pneumoniae R6
agcuaggauagcuugaac

SEQ ID NO: 4073092 - RNA, 16 nt, Streptococcus pneumoniae R6
agcuagggauuugaua

SEQ ID NO: 4073093 - RNA, 20 nt, Streptococcus pneumoniae R6
agcuagucgugaaagagcag

SEQ ID NO: 4073094 - RNA, 14 nt, Streptococcus pneumoniae R6
agcuagucuacuug

SEQ ID NO: 4073095 - RNA, 13 nt, Streptococcus pneumoniae R6
agcuauagauaag

SEQ ID NO: 4073096 - RNA, 20 nt, Streptococcus pneumoniae R6
agcuauagauaaggucaucu

SEQ ID NO: 4073097 - RNA, 18 nt, Streptococcus pneumoniae R6
agcuaugaauaugaguuc

SEQ ID NO: 4073098 - RNA, 22 nt, Streptococcus pneumoniae R6
agcuauguagccacucuggcaa

SEQ ID NO: 4073099 - RNA, 18 nt, Streptococcus pneumoniae R6
agcuauuaaagauuuuuu

SEQ ID NO: 4073100 - RNA, 15 nt, Streptococcus pneumoniae R6
agcuauuacaucguu

SEQ ID NO: 4073101 - RNA, 16 nt, Streptococcus pneumoniae R6
agcuauuagaccugcc

SEQ ID NO: 4073102 - RNA, 13 nt, Streptococcus pneumoniae R6
agcucaaaacacu

SEQ ID NO: 4073103 - RNA, 14 nt, Streptococcus pneumoniae R6
agcucaaaacacug

SEQ ID NO: 4073104 - RNA, 20 nt, Streptococcus pneumoniae R6
agcucaaaacacuguuuuaa

SEQ ID NO: 4073105 - RNA, 12 nt, Streptococcus pneumoniae R6
agcucaaaagcu

SEQ ID NO: 4073106 - RNA, 16 nt, Streptococcus pneumoniae R6
agcucaagaccuugau

SEQ ID NO: 4073107 - RNA, 23 nt, Streptococcus pneumoniae R6
agcucauccuuugcauccacauc

SEQ ID NO: 4073108 - RNA, 18 nt, Streptococcus pneumoniae R6
agcucaucuaauguuuuu

SEQ ID NO: 4073109 - RNA, 18 nt, Streptococcus pneumoniae R6
agcuccaaagaagauaau

SEQ ID NO: 4073110 - RNA, 15 nt, Streptococcus pneumoniae R6
agcuccaucuccaac

SEQ ID NO: 4073111 - RNA, 18 nt, Streptococcus pneumoniae R6
agcuccaucuccaacugc

SEQ ID NO: 4073112 - RNA, 18 nt, Streptococcus pneumoniae R6
agcuccgaagacggggcu

SEQ ID NO: 4073113 - RNA, 14 nt, Streptococcus pneumoniae R6
agcuccuucaaguu

SEQ ID NO: 4073114 - RNA, 14 nt, Streptococcus pneumoniae R6
agcuccuugugcac

SEQ ID NO: 4073115 - RNA, 19 nt, Streptococcus pneumoniae R6
agcuccuugugcacacuca

SEQ ID NO: 4073116 - RNA, 17 nt, Streptococcus pneumoniae R6
agcucgagaaaggacaa

SEQ ID NO: 4073117 - RNA, 22 nt, Streptococcus pneumoniae R6
agcucgagaaaggacaaauuuc

SEQ ID NO: 4073118 - RNA, 13 nt, Streptococcus pneumoniae R6
agcucgauaaagg

SEQ ID NO: 4073119 - RNA, 19 nt, Streptococcus pneumoniae R6
agcucgauaaaggacaaaa

SEQ ID NO: 4073120 - RNA, 18 nt, Streptococcus pneumoniae R6
agcucgcucuuacuauua

SEQ ID NO: 4073121 - RNA, 23 nt, Streptococcus pneumoniae R6
agcucguucuauggcuuguucaa

SEQ ID NO: 4073122 - RNA, 12 nt, Streptococcus pneumoniae R6
agcucugugcaa

SEQ ID NO: 4073123 - RNA, 23 nt, Streptococcus pneumoniae R6
agcucuuaaaagcaaaagaacaa

SEQ ID NO: 4073124 - RNA, 16 nt, Streptococcus pneumoniae R6
agcucuucagcaaaac

SEQ ID NO: 4073125 - RNA, 23 nt, Streptococcus pneumoniae R6
agcucuuggucauccauauaaau

SEQ ID NO: 4073126 - RNA, 18 nt, Streptococcus pneumoniae R6
agcucuuuagucccagcu

SEQ ID NO: 4073127 - RNA, 22 nt, Streptococcus pneumoniae R6
agcucuuuagucccagcuucuu

SEQ ID NO: 4073128 - RNA, 23 nt, Streptococcus pneumoniae R6
agcucuuuagucccagcuucuuu

SEQ ID NO: 4073129 - RNA, 18 nt, Streptococcus pneumoniae R6
agcucuuugacagaaagg

SEQ ID NO: 4073130 - RNA, 17 nt, Streptococcus pneumoniae R6
agcucuuuuuugauauc

SEQ ID NO: 4073131 - RNA, 18 nt, Streptococcus pneumoniae R6
agcucuuuuuugauaucu

SEQ ID NO: 4073132 - RNA, 22 nt, Streptococcus pneumoniae R6
agcucuuuuuugauaucuuccu

SEQ ID NO: 4073133 - RNA, 18 nt, Streptococcus pneumoniae R6
agcugacuucgucaguuc

SEQ ID NO: 4073134 - RNA, 18 nt, Streptococcus pneumoniae R6
agcugacuucgucaguuu

SEQ ID NO: 4073135 - RNA, 14 nt, Streptococcus pneumoniae R6
agcugaggaaaucc

SEQ ID NO: 4073136 - RNA, 18 nt, Streptococcus pneumoniae R6
agcugaguggauuuuucg

SEQ ID NO: 4073137 - RNA, 17 nt, Streptococcus pneumoniae R6
agcugauagagauuaua

SEQ ID NO: 4073138 - RNA, 15 nt, Streptococcus pneumoniae R6
agcugccccaccugc

SEQ ID NO: 4073139 - RNA, 22 nt, Streptococcus pneumoniae R6
agcugccccaccugcuacagag

SEQ ID NO: 4073140 - RNA, 19 nt, Streptococcus pneumoniae R6
agcugccuaguuugaucuu

SEQ ID NO: 4073141 - RNA, 18 nt, Streptococcus pneumoniae R6
agcugcgauaaggaaguu

SEQ ID NO: 4073142 - RNA, 14 nt, Streptococcus pneumoniae R6
agcugcgauuuuag

SEQ ID NO: 4073143 - RNA, 18 nt, Streptococcus pneumoniae R6
agcugcggcuuucuucac

SEQ ID NO: 4073144 - RNA, 23 nt, Streptococcus pneumoniae R6
agcugcggcuuucuucacaucac

SEQ ID NO: 4073145 - RNA, 22 nt, Streptococcus pneumoniae R6
agcugcgggcugcucaaaacac

SEQ ID NO: 4073146 - RNA, 23 nt, Streptococcus pneumoniae R6
agcugcgggcugcucaaaacacu

SEQ ID NO: 4073147 - RNA, 22 nt, Streptococcus pneumoniae R6
agcuggccgacaucagaaccaa

SEQ ID NO: 4073148 - RNA, 18 nt, Streptococcus pneumoniae R6
agcuggucaagaagcgaa

SEQ ID NO: 4073149 - RNA, 23 nt, Streptococcus pneumoniae R6
agcuguaaaucuaggacaaagcg

SEQ ID NO: 4073150 - RNA, 15 nt, Streptococcus pneumoniae R6
agcugucaagaaauu

SEQ ID NO: 4073151 - RNA, 23 nt, Streptococcus pneumoniae R6
agcugucgcaccugacuccauag

SEQ ID NO: 4073152 - RNA, 19 nt, Streptococcus pneumoniae R6
agcuguuccaccaccugca

SEQ ID NO: 4073153 - RNA, 14 nt, Streptococcus pneumoniae R6
agcuguuucaacac

SEQ ID NO: 4073154 - RNA, 18 nt, Streptococcus pneumoniae R6
agcuucaaaccguguucu

SEQ ID NO: 4073155 - RNA, 15 nt, Streptococcus pneumoniae R6
agcuucaaaucccau

SEQ ID NO: 4073156 - RNA, 20 nt, Streptococcus pneumoniae R6
agcuucaauggacuauagua

SEQ ID NO: 4073157 - RNA, 17 nt, Streptococcus pneumoniae R6
agcuucauuuaucuucu

SEQ ID NO: 4073158 - RNA, 18 nt, Streptococcus pneumoniae R6
agcuuccccauucuaugg

SEQ ID NO: 4073159 - RNA, 23 nt, Streptococcus pneumoniae R6
agcuuccgguaaaguugaaauga

SEQ ID NO: 4073160 - RNA, 19 nt, Streptococcus pneumoniae R6
agcuucuucguccucuguc

SEQ ID NO: 4073161 - RNA, 22 nt, Streptococcus pneumoniae R6
agcuucuugcauucguucuugg

SEQ ID NO: 4073162 - RNA, 15 nt, Streptococcus pneumoniae R6
agcuucuuuuggauu

SEQ ID NO: 4073163 - RNA, 18 nt, Streptococcus pneumoniae R6
agcuucuuuuuauauaua

SEQ ID NO: 4073164 - RNA, 17 nt, Streptococcus pneumoniae R6
agcuugaagcuauccug

SEQ ID NO: 4073165 - RNA, 16 nt, Streptococcus pneumoniae R6
agcuugaauucuuccu

SEQ ID NO: 4073166 - RNA, 20 nt, Streptococcus pneumoniae R6
agcuugaguaaauaaaacaa

SEQ ID NO: 4073167 - RNA, 16 nt, Streptococcus pneumoniae R6
agcuugaguggaaaaa

SEQ ID NO: 4073168 - RNA, 11 nt, Streptococcus pneumoniae R6
aggauguaggg

SEQ ID NO: 4073169 - RNA, 19 nt, Streptococcus pneumoniae R6
aggauugacaaaauuuggu

SEQ ID NO: 4073170 - RNA, 15 nt, Streptococcus pneumoniae R6
aggauugcccuagcu

SEQ ID NO: 4073171 - RNA, 22 nt, Streptococcus pneumoniae R6
aggauuguacucaggugaguag

SEQ ID NO: 4073172 - RNA, 21 nt, Streptococcus pneumoniae R6
aggauugucugaacugccccc

SEQ ID NO: 4073173 - RNA, 22 nt, Streptococcus pneumoniae R6
aggauuuaggacuaaauacaaa

SEQ ID NO: 4073174 - RNA, 23 nt, Streptococcus pneumoniae R6
aggauuuaggacuaaauacaaaa

SEQ ID NO: 4073175 - RNA, 15 nt, Streptococcus pneumoniae R6
aggauuuauuuuucu

SEQ ID NO: 4073176 - RNA, 14 nt, Streptococcus pneumoniae R6
aggauuuccuagua

SEQ ID NO: 4073177 - RNA, 14 nt, Streptococcus pneumoniae R6
aggauuucucuauu

SEQ ID NO: 4073178 - RNA, 14 nt, Streptococcus pneumoniae R6
aggauuucugcuuu

SEQ ID NO: 4073179 - RNA, 23 nt, Streptococcus pneumoniae R6
aggauuucuuugaaaucuuguug

SEQ ID NO: 4073180 - RNA, 22 nt, Streptococcus pneumoniae R6
aggauuugcaucccuugaauag

SEQ ID NO: 4073181 - RNA, 13 nt, Streptococcus pneumoniae R6
aggauuuugugaa

SEQ ID NO: 4073182 - RNA, 20 nt, Streptococcus pneumoniae R6
aggauuuuugaauauuagua

SEQ ID NO: 4073183 - RNA, 18 nt, Streptococcus pneumoniae R6
aggcaauggccuguucua

SEQ ID NO: 4073184 - RNA, 16 nt, Streptococcus pneumoniae R6
aggcaauuaaaaggcu

SEQ ID NO: 4073185 - RNA, 15 nt, Streptococcus pneumoniae R6
aggcagcuuguucuu

SEQ ID NO: 4073186 - RNA, 21 nt, Streptococcus pneumoniae R6
aggcagcuuguucuucugcug

SEQ ID NO: 4073187 - RNA, 16 nt, Streptococcus pneumoniae R6
aggcaggacaaaagau

SEQ ID NO: 4073188 - RNA, 19 nt, Streptococcus pneumoniae R6
aggcauaauacuguggaau

SEQ ID NO: 4073189 - RNA, 23 nt, Streptococcus pneumoniae R6
aggcaucacgaaaauauuuggaa

SEQ ID NO: 4073190 - RNA, 17 nt, Streptococcus pneumoniae R6
aggcaucaucugaaauc

SEQ ID NO: 4073191 - RNA, 17 nt, Streptococcus pneumoniae R6
aggcaucuuaacauucu

SEQ ID NO: 4073192 - RNA, 15 nt, Streptococcus pneumoniae R6
aggccaaacuugaaa

SEQ ID NO: 4073193 - RNA, 11 nt, Streptococcus pneumoniae R6
aggccaagaua

SEQ ID NO: 4073194 - RNA, 13 nt, Streptococcus pneumoniae R6
aggccaauacaga

SEQ ID NO: 4073195 - RNA, 14 nt, Streptococcus pneumoniae R6
aggccacaaaugcu

SEQ ID NO: 4073196 - RNA, 23 nt, Streptococcus pneumoniae R6
aggccacaaaugcuucuuugaua

SEQ ID NO: 4073197 - RNA, 19 nt, Streptococcus pneumoniae R6
aggcccaauuaaaaucaaa

SEQ ID NO: 4073198 - RNA, 14 nt, Streptococcus pneumoniae R6
aggccuaaggcugu

SEQ ID NO: 4073199 - RNA, 17 nt, Streptococcus pneumoniae R6
aggccucuucaaagaag

SEQ ID NO: 4073200 - RNA, 13 nt, Streptococcus pneumoniae R6
aggcgaaaagcua

SEQ ID NO: 4073201 - RNA, 18 nt, Streptococcus pneumoniae R6
aggcgaaaucauuugaau

SEQ ID NO: 4073202 - RNA, 14 nt, Streptococcus pneumoniae R6
aggcguuucguuug

SEQ ID NO: 4073203 - RNA, 22 nt, Streptococcus pneumoniae R6
aggcuaauugcaaauuuagcaa

SEQ ID NO: 4073204 - RNA, 18 nt, Streptococcus pneumoniae R6
aggcuauuauuaauguuu

SEQ ID NO: 4073205 - RNA, 18 nt, Streptococcus pneumoniae R6
aggcucgagaaaggacaa

SEQ ID NO: 4073206 - RNA, 22 nt, Streptococcus pneumoniae R6
aggcucgagaaaggacaaauuu

SEQ ID NO: 4073207 - RNA, 14 nt, Streptococcus pneumoniae R6
aggcugacaauaaa

SEQ ID NO: 4073208 - RNA, 17 nt, Streptococcus pneumoniae R6
aggcugacaauaaagau

SEQ ID NO: 4073209 - RNA, 20 nt, Streptococcus pneumoniae R6
aggcugacaauaaagauaag

SEQ ID NO: 4073210 - RNA, 16 nt, Streptococcus pneumoniae R6
aggcugcucaaaacac

SEQ ID NO: 4073211 - RNA, 14 nt, Streptococcus pneumoniae R6
aggcuggucgagaa

SEQ ID NO: 4073212 - RNA, 21 nt, Streptococcus pneumoniae R6
aggcuucuugaccagcgauag

SEQ ID NO: 4073213 - RNA, 14 nt, Streptococcus pneumoniae R6
aggcuuuaaaugcu

SEQ ID NO: 4073214 - RNA, 21 nt, Streptococcus pneumoniae R6
aggcuuuaaaugcugguuuuu

SEQ ID NO: 4073215 - RNA, 18 nt, Streptococcus pneumoniae R6
aggcuuuaccaaaaaugu

SEQ ID NO: 4073216 - RNA, 20 nt, Streptococcus pneumoniae R6
aggcuuuaguaucaagugua

SEQ ID NO: 4073217 - RNA, 15 nt, Streptococcus pneumoniae R6
aggcuuucaacugcu

SEQ ID NO: 4073218 - RNA, 13 nt, Streptococcus pneumoniae R6
aggcuuucucccu

SEQ ID NO: 4073219 - RNA, 21 nt, Streptococcus pneumoniae R6
aggcuuucucccuuuugcucg

SEQ ID NO: 4073220 - RNA, 21 nt, Streptococcus pneumoniae R6
aggcuuuuucucaucuauuuu

SEQ ID NO: 4073221 - RNA, 11 nt, Streptococcus pneumoniae R6
agggaaagaag

SEQ ID NO: 4073222 - RNA, 20 nt, Streptococcus pneumoniae R6
agggaaagaagguauucaua

SEQ ID NO: 4073223 - RNA, 18 nt, Streptococcus pneumoniae R6
agggaaauccuagauaca

SEQ ID NO: 4073224 - RNA, 22 nt, Streptococcus pneumoniae R6
agggagguaaagauagccauga

SEQ ID NO: 4073225 - RNA, 12 nt, Streptococcus pneumoniae R6
agggauuaauaa

SEQ ID NO: 4073226 - RNA, 20 nt, Streptococcus pneumoniae R6
agggauucuuauauuaaaaa

SEQ ID NO: 4073227 - RNA, 17 nt, Streptococcus pneumoniae R6
agggauuuggccuguag

SEQ ID NO: 4073228 - RNA, 23 nt, Streptococcus pneumoniae R6
agggauuuuucuggcucuuuguc

SEQ ID NO: 4073229 - RNA, 14 nt, Streptococcus pneumoniae R6
agggcaaaaaagaa

SEQ ID NO: 4073230 - RNA, 15 nt, Streptococcus pneumoniae R6
agggcaaaaaagaaa

SEQ ID NO: 4073231 - RNA, 18 nt, Streptococcus pneumoniae R6
agggcaaagaaaaggaaa

SEQ ID NO: 4073232 - RNA, 13 nt, Streptococcus pneumoniae R6
agggcaaauaaaa

SEQ ID NO: 4073233 - RNA, 15 nt, Streptococcus pneumoniae R6
agggcaaauaaaaag

SEQ ID NO: 4073234 - RNA, 21 nt, Streptococcus pneumoniae R6
agggcaccaaacuuaggaagc

SEQ ID NO: 4073235 - RNA, 20 nt, Streptococcus pneumoniae R6
agggcauuaaucauucccug

SEQ ID NO: 4073236 - RNA, 22 nt, Streptococcus pneumoniae R6
agggcguugacgauuuucucuu

SEQ ID NO: 4073237 - RNA, 13 nt, Streptococcus pneumoniae R6
agggcugaacgac

SEQ ID NO: 4073238 - RNA, 21 nt, Streptococcus pneumoniae R6
agggcugcguugaggacaggu

SEQ ID NO: 4073239 - RNA, 13 nt, Streptococcus pneumoniae R6
agggcuucaucaa

SEQ ID NO: 4073240 - RNA, 13 nt, Streptococcus pneumoniae R6
agggcuucuuuga

SEQ ID NO: 4073241 - RNA, 20 nt, Streptococcus pneumoniae R6
agggcuuuucuaucacucca

SEQ ID NO: 4073242 - RNA, 14 nt, Streptococcus pneumoniae R6
aggggacagauguu

SEQ ID NO: 4073243 - RNA, 16 nt, Streptococcus pneumoniae R6
aggggagcaacuucag

SEQ ID NO: 4073244 - RNA, 18 nt, Streptococcus pneumoniae R6
aggggaggauagaccugu

SEQ ID NO: 4073245 - RNA, 22 nt, Streptococcus pneumoniae R6
aggggcaacucuucaagguuuu

SEQ ID NO: 4073246 - RNA, 18 nt, Streptococcus pneumoniae R6
aggggcaucuugaauagc

SEQ ID NO: 4073247 - RNA, 16 nt, Streptococcus pneumoniae R6
aggggcucuuugucaa

SEQ ID NO: 4073248 - RNA, 15 nt, Streptococcus pneumoniae R6
agggggcaaaaaggg

SEQ ID NO: 4073249 - RNA, 20 nt, Streptococcus pneumoniae R6
agggggcauauaaauacaac

SEQ ID NO: 4073250 - RNA, 20 nt, Streptococcus pneumoniae R6
aggggucaugacuagugaag

SEQ ID NO: 4073251 - RNA, 23 nt, Streptococcus pneumoniae R6
aggggugauuuuauauaaaauaa

SEQ ID NO: 4073252 - RNA, 19 nt, Streptococcus pneumoniae R6
agggucaaaguagugaaug

SEQ ID NO: 4073253 - RNA, 20 nt, Streptococcus pneumoniae R6
agggucuuuaaugucuagua

SEQ ID NO: 4073254 - RNA, 12 nt, Streptococcus pneumoniae R6
agggucuuuguu

SEQ ID NO: 4073255 - RNA, 17 nt, Streptococcus pneumoniae R6
agggucuuuguucugaa

SEQ ID NO: 4073256 - RNA, 23 nt, Streptococcus pneumoniae R6
agggucuuuguucugaaagugaa

SEQ ID NO: 4073257 - RNA, 13 nt, Streptococcus pneumoniae R6
agggugaagaguu

SEQ ID NO: 4073258 - RNA, 15 nt, Streptococcus pneumoniae R6
agggugacaguaaaa

SEQ ID NO: 4073259 - RNA, 18 nt, Streptococcus pneumoniae R6
agggugacuucauuauua

SEQ ID NO: 4073260 - RNA, 18 nt, Streptococcus pneumoniae R6
aggguugguuaaaaguug

SEQ ID NO: 4073261 - RNA, 15 nt, Streptococcus pneumoniae R6
agguaaaaccaauau

SEQ ID NO: 4073262 - RNA, 18 nt, Streptococcus pneumoniae R6
agguaaaauauagaauug

SEQ ID NO: 4073263 - RNA, 20 nt, Streptococcus pneumoniae R6
agguaaaaucuuaaaaaggg

SEQ ID NO: 4073264 - RNA, 18 nt, Streptococcus pneumoniae R6
agguaaagauagccauga

SEQ ID NO: 4073265 - RNA, 20 nt, Streptococcus pneumoniae R6
agguaaauucugucacaacu

SEQ ID NO: 4073266 - RNA, 16 nt, Streptococcus pneumoniae R6
agguaauuaugaaauu

SEQ ID NO: 4073267 - RNA, 20 nt, Streptococcus pneumoniae R6
agguaauuaugaaauuuaaa

SEQ ID NO: 4073268 - RNA, 22 nt, Streptococcus pneumoniae R6
agguaauuuucuggcagauaga

SEQ ID NO: 4073269 - RNA, 15 nt, Streptococcus pneumoniae R6
agguagcuuagaaau

SEQ ID NO: 4073270 - RNA, 23 nt, Streptococcus pneumoniae R6
aguaaugggcgcauuuuccuugg

SEQ ID NO: 4073271 - RNA, 19 nt, Streptococcus pneumoniae R6
aguaaugguugauuugguu

SEQ ID NO: 4073272 - RNA, 16 nt, Streptococcus pneumoniae R6
aguaauuucccauuug

SEQ ID NO: 4073273 - RNA, 13 nt, Streptococcus pneumoniae R6
aguaauuuuguga

SEQ ID NO: 4073274 - RNA, 19 nt, Streptococcus pneumoniae R6
aguaauuuugugauaaaau

SEQ ID NO: 4073275 - RNA, 20 nt, Streptococcus pneumoniae R6
aguaauuuugugauaaaaug

SEQ ID NO: 4073276 - RNA, 14 nt, Streptococcus pneumoniae R6
aguacaaaagcacu

SEQ ID NO: 4073277 - RNA, 16 nt, Streptococcus pneumoniae R6
aguacaaaagcacuca

SEQ ID NO: 4073278 - RNA, 20 nt, Streptococcus pneumoniae R6
aguacaaagaauaaaauagu

SEQ ID NO: 4073279 - RNA, 13 nt, Streptococcus pneumoniae R6
aguacaauaccuu

SEQ ID NO: 4073280 - RNA, 17 nt, Streptococcus pneumoniae R6
aguacaauaccuuuccu

SEQ ID NO: 4073281 - RNA, 20 nt, Streptococcus pneumoniae R6
aguacaccuuuacuucuaaa

SEQ ID NO: 4073282 - RNA, 15 nt, Streptococcus pneumoniae R6
aguacacuucugcuu

SEQ ID NO: 4073283 - RNA, 14 nt, Streptococcus pneumoniae R6
aguacagaacuggc

SEQ ID NO: 4073284 - RNA, 12 nt, Streptococcus pneumoniae R6
aguacaugucag

SEQ ID NO: 4073285 - RNA, 20 nt, Streptococcus pneumoniae R6
aguacauucaacaccugaua

SEQ ID NO: 4073286 - RNA, 18 nt, Streptococcus pneumoniae R6
aguacauugaaauuaaaa

SEQ ID NO: 4073287 - RNA, 18 nt, Streptococcus pneumoniae R6
aguacauugauugcuuca

SEQ ID NO: 4073288 - RNA, 15 nt, Streptococcus pneumoniae R6
aguaccaaggaagaa

SEQ ID NO: 4073289 - RNA, 16 nt, Streptococcus pneumoniae R6
aguaccaaggaagaag

SEQ ID NO: 4073290 - RNA, 16 nt, Streptococcus pneumoniae R6
aguaccagauauacca

SEQ ID NO: 4073291 - RNA, 20 nt, Streptococcus pneumoniae R6
aguaccagcucguucuaugg

SEQ ID NO: 4073292 - RNA, 16 nt, Streptococcus pneumoniae R6
aguaccgacuucugag

SEQ ID NO: 4073293 - RNA, 18 nt, Streptococcus pneumoniae R6
aguaccgccaaaccuucu

SEQ ID NO: 4073294 - RNA, 21 nt, Streptococcus pneumoniae R6
aguacgaacaaguugugcagu

SEQ ID NO: 4073295 - RNA, 19 nt, Streptococcus pneumoniae R6
aguacgauugguucugcuc

SEQ ID NO: 4073296 - RNA, 20 nt, Streptococcus pneumoniae R6
aguacuauugaguucacaaa

SEQ ID NO: 4073297 - RNA, 24 nt, Streptococcus pneumoniae R6
aguacuauugaguucacaaaugag

SEQ ID NO: 4073298 - RNA, 15 nt, Streptococcus pneumoniae R6
aguacugaacaauga

SEQ ID NO: 4073299 - RNA, 23 nt, Streptococcus pneumoniae R6
aguacugaacaaugaaaaaaaca

SEQ ID NO: 4073300 - RNA, 23 nt, Streptococcus pneumoniae R6
aguacugcuuugagguuguagau

SEQ ID NO: 4073301 - RNA, 13 nt, Streptococcus pneumoniae R6
aguacuugagaau

SEQ ID NO: 4073302 - RNA, 15 nt, Streptococcus pneumoniae R6
aguacuugcuggaau

SEQ ID NO: 4073303 - RNA, 19 nt, Streptococcus pneumoniae R6
aguacuuugagcaaccugc

SEQ ID NO: 4073304 - RNA, 23 nt, Streptococcus pneumoniae R6
aguacuuugagcaaccugcgacu

SEQ ID NO: 4073305 - RNA, 16 nt, Streptococcus pneumoniae R6
aguacuuuuaauauac

SEQ ID NO: 4073306 - RNA, 16 nt, Streptococcus pneumoniae R6
aguacuuuuucuauga

SEQ ID NO: 4073307 - RNA, 14 nt, Streptococcus pneumoniae R6
aguagaaaguuaau

SEQ ID NO: 4073308 - RNA, 18 nt, Streptococcus pneumoniae R6
aguagacugaaucugaaa

SEQ ID NO: 4073309 - RNA, 19 nt, Streptococcus pneumoniae R6
aguagacugaaucugaaau

SEQ ID NO: 4073310 - RNA, 14 nt, Streptococcus pneumoniae R6
aguagagagucaca

SEQ ID NO: 4073311 - RNA, 21 nt, Streptococcus pneumoniae R6
aguagaucaugacugagagcu

SEQ ID NO: 4073312 - RNA, 17 nt, Streptococcus pneumoniae R6
aguagaugauuuucaaa

SEQ ID NO: 4073313 - RNA, 18 nt, Streptococcus pneumoniae R6
aguagauugaaauaagau

SEQ ID NO: 4073314 - RNA, 22 nt, Streptococcus pneumoniae R6
aguagccuugaccagaaauaaa

SEQ ID NO: 4073315 - RNA, 14 nt, Streptococcus pneumoniae R6
aguaggaaggaaga

SEQ ID NO: 4073316 - RNA, 21 nt, Streptococcus pneumoniae R6
aguaggccaaacuugaaauga

SEQ ID NO: 4073317 - RNA, 14 nt, Streptococcus pneumoniae R6
aguaguaaccaccu

SEQ ID NO: 4073318 - RNA, 14 nt, Streptococcus pneumoniae R6
aguaguaacuuuuu

SEQ ID NO: 4073319 - RNA, 13 nt, Streptococcus pneumoniae R6
aguaguagcugaa

SEQ ID NO: 4073320 - RNA, 15 nt, Streptococcus pneumoniae R6
aguaguauuuacuaa

SEQ ID NO: 4073321 - RNA, 15 nt, Streptococcus pneumoniae R6
aguagucuuuuuguu

SEQ ID NO: 4073322 - RNA, 21 nt, Streptococcus pneumoniae R6
aguagugguuuuuaggcaaua

SEQ ID NO: 4073323 - RNA, 23 nt, Streptococcus pneumoniae R6
aguagugguuuuuaggcaauaaa

SEQ ID NO: 4073324 - RNA, 14 nt, Streptococcus pneumoniae R6
aguaguuuguauaa

SEQ ID NO: 4073325 - RNA, 22 nt, Streptococcus pneumoniae R6
aguauaaaucuuccuaggauaa

SEQ ID NO: 4073326 - RNA, 16 nt, Streptococcus pneumoniae R6
aguauaagauacaaau

SEQ ID NO: 4073327 - RNA, 19 nt, Streptococcus pneumoniae R6
aguauaagauauacuaaaa

SEQ ID NO: 4073328 - RNA, 23 nt, Streptococcus pneumoniae R6
aguauaagauauacuaaaagcga

SEQ ID NO: 4073329 - RNA, 18 nt, Streptococcus pneumoniae R6
aguauaagguuacuuuau

SEQ ID NO: 4073330 - RNA, 23 nt, Streptococcus pneumoniae R6
aguauaccacacuaaauuuagau

SEQ ID NO: 4073331 - RNA, 18 nt, Streptococcus pneumoniae R6
aguauacucuaauugaaa

SEQ ID NO: 4073332 - RNA, 20 nt, Streptococcus pneumoniae R6
aguauacucuaauugaaaac

SEQ ID NO: 4073333 - RNA, 18 nt, Streptococcus pneumoniae R6
aguauauucugugugugg

SEQ ID NO: 4073334 - RNA, 18 nt, Streptococcus pneumoniae R6
aguaucaagcuauaguua

SEQ ID NO: 4073335 - RNA, 18 nt, Streptococcus pneumoniae R6
aguaucaagguuuuagaa

SEQ ID NO: 4073336 - RNA, 17 nt, Streptococcus pneumoniae R6
aguaucaaguguugaaa

SEQ ID NO: 4073337 - RNA, 19 nt, Streptococcus pneumoniae R6
aguaucaaguuuuugcaca

SEQ ID NO: 4073338 - RNA, 19 nt, Streptococcus pneumoniae R6
aguauccaucacaguuuac

SEQ ID NO: 4073339 - RNA, 20 nt, Streptococcus pneumoniae R6
aguauccaucacaguuuaca

SEQ ID NO: 4073340 - RNA, 12 nt, Streptococcus pneumoniae R6
aguaucccauuc

SEQ ID NO: 4073341 - RNA, 17 nt, Streptococcus pneumoniae R6
aguaucugaugcugaca

SEQ ID NO: 4073342 - RNA, 19 nt, Streptococcus pneumoniae R6
aguaucugaugcugacaag

SEQ ID NO: 4073343 - RNA, 13 nt, Streptococcus pneumoniae R6
aguaugaaaagag

SEQ ID NO: 4073344 - RNA, 22 nt, Streptococcus pneumoniae R6
aguaugucugaauauauaauua

SEQ ID NO: 4073345 - RNA, 22 nt, Streptococcus pneumoniae R6
aguauguuuaaagucucugucc

SEQ ID NO: 4073346 - RNA, 17 nt, Streptococcus pneumoniae R6
aguauuaaaauaaguuc

SEQ ID NO: 4073347 - RNA, 23 nt, Streptococcus pneumoniae R6
aguauuaaaauaaguucaacaaa

SEQ ID NO: 4073348 - RNA, 15 nt, Streptococcus pneumoniae R6
aguauuaaacaaaaa

SEQ ID NO: 4073349 - RNA, 23 nt, Streptococcus pneumoniae R6
aguauuaaucacuaauuaucuau

SEQ ID NO: 4073350 - RNA, 15 nt, Streptococcus pneumoniae R6
aguauuacaaucaua

SEQ ID NO: 4073351 - RNA, 19 nt, Streptococcus pneumoniae R6
aguauuagagguuugcuua

SEQ ID NO: 4073352 - RNA, 16 nt, Streptococcus pneumoniae R6
aguauuagccauagca

SEQ ID NO: 4073353 - RNA, 18 nt, Streptococcus pneumoniae R6
aguauuagccauagcaag

SEQ ID NO: 4073354 - RNA, 19 nt, Streptococcus pneumoniae R6
aguauuagccauagcaaga

SEQ ID NO: 4073355 - RNA, 18 nt, Streptococcus pneumoniae R6
aguauuauucuucaucug

SEQ ID NO: 4073356 - RNA, 12 nt, Streptococcus pneumoniae R6
aguauucaagag

SEQ ID NO: 4073357 - RNA, 23 nt, Streptococcus pneumoniae R6
aguauucguucugucugcugacu

SEQ ID NO: 4073358 - RNA, 23 nt, Streptococcus pneumoniae R6
aguauuuagcaaccauuuucuca

SEQ ID NO: 4073359 - RNA, 20 nt, Streptococcus pneumoniae R6
aguauuuuauaguaauuccc

SEQ ID NO: 4073360 - RNA, 12 nt, Streptococcus pneumoniae R6
aguauuuuuagu

SEQ ID NO: 4073361 - RNA, 19 nt, Streptococcus pneumoniae R6
aguauuuuuaguucuacuu

SEQ ID NO: 4073362 - RNA, 12 nt, Streptococcus pneumoniae R6
agucaaaaagaa

SEQ ID NO: 4073363 - RNA, 15 nt, Streptococcus pneumoniae R6
agucaaaaagaagga

SEQ ID NO: 4073364 - RNA, 17 nt, Streptococcus pneumoniae R6
agucaaaaccaucauaa

SEQ ID NO: 4073365 - RNA, 13 nt, Streptococcus pneumoniae R6
agucaaaauucuu

SEQ ID NO: 4073366 - RNA, 16 nt, Streptococcus pneumoniae R6
agucaaaauucuuuga

SEQ ID NO: 4073367 - RNA, 19 nt, Streptococcus pneumoniae R6
agucaaaauucuuugaaau

SEQ ID NO: 4073368 - RNA, 20 nt, Streptococcus pneumoniae R6
agucaaaauucuuugaaauc

SEQ ID NO: 4073369 - RNA, 17 nt, Streptococcus pneumoniae R6
agucaaacguuuaacug

SEQ ID NO: 4073370 - RNA, 13 nt, Streptococcus pneumoniae R6
agucaaagaguuu

SEQ ID NO: 4073371 - RNA, 14 nt, Streptococcus pneumoniae R6
agucaaagaguuuu

SEQ ID NO: 4073372 - RNA, 18 nt, Streptococcus pneumoniae R6
agugaaaaaguaagaguu

SEQ ID NO: 4073373 - RNA, 12 nt, Streptococcus pneumoniae R6
agugaaaggaag

SEQ ID NO: 4073374 - RNA, 13 nt, Streptococcus pneumoniae R6
agugaaaggaaga

SEQ ID NO: 4073375 - RNA, 16 nt, Streptococcus pneumoniae R6
agugaaaggaagagag

SEQ ID NO: 4073376 - RNA, 18 nt, Streptococcus pneumoniae R6
agugaaguguuuaggcaa

SEQ ID NO: 4073377 - RNA, 13 nt, Streptococcus pneumoniae R6
agugaauugaaau

SEQ ID NO: 4073378 - RNA, 20 nt, Streptococcus pneumoniae R6
agugacagaaaugaguaaga

SEQ ID NO: 4073379 - RNA, 21 nt, Streptococcus pneumoniae R6
agugacagucgcaaagaggaa

SEQ ID NO: 4073380 - RNA, 22 nt, Streptococcus pneumoniae R6
agugacagucgcaaagaggaag

SEQ ID NO: 4073381 - RNA, 15 nt, Streptococcus pneumoniae R6
agugacuucagaguc

SEQ ID NO: 4073382 - RNA, 21 nt, Streptococcus pneumoniae R6
agugacuuuuucgaagcuugc

SEQ ID NO: 4073383 - RNA, 17 nt, Streptococcus pneumoniae R6
agugagaagcccaguac

SEQ ID NO: 4073384 - RNA, 20 nt, Streptococcus pneumoniae R6
agugagcaccaucuauaagu

SEQ ID NO: 4073385 - RNA, 17 nt, Streptococcus pneumoniae R6
agugauaacgaauacca

SEQ ID NO: 4073386 - RNA, 18 nt, Streptococcus pneumoniae R6
agugauaucuugaaggau

SEQ ID NO: 4073387 - RNA, 18 nt, Streptococcus pneumoniae R6
agugauggguucagaaua

SEQ ID NO: 4073388 - RNA, 18 nt, Streptococcus pneumoniae R6
agugauguaauuucugaa

SEQ ID NO: 4073389 - RNA, 20 nt, Streptococcus pneumoniae R6
agugauuggagauacuuuuu

SEQ ID NO: 4073390 - RNA, 23 nt, Streptococcus pneumoniae R6
agugauuguguccucaauauagu

SEQ ID NO: 4073391 - RNA, 20 nt, Streptococcus pneumoniae R6
agugcaaacuaggaagcuag

SEQ ID NO: 4073392 - RNA, 19 nt, Streptococcus pneumoniae R6
agugcaaauaagaaaucuc

SEQ ID NO: 4073393 - RNA, 20 nt, Streptococcus pneumoniae R6
agugcauacgaaaaguagga

SEQ ID NO: 4073394 - RNA, 19 nt, Streptococcus pneumoniae R6
agugcggacggucuuugga

SEQ ID NO: 4073395 - RNA, 18 nt, Streptococcus pneumoniae R6
agugcucacagaguagaa

SEQ ID NO: 4073396 - RNA, 21 nt, Streptococcus pneumoniae R6
agugcucacagaguagaaguu

SEQ ID NO: 4073397 - RNA, 18 nt, Streptococcus pneumoniae R6
aguggaaagaggacuuuu

SEQ ID NO: 4073398 - RNA, 20 nt, Streptococcus pneumoniae R6
aguggaacguagaucaucug

SEQ ID NO: 4073399 - RNA, 17 nt, Streptococcus pneumoniae R6
aguggaauucauuuucu

SEQ ID NO: 4073400 - RNA, 18 nt, Streptococcus pneumoniae R6
aguggaauucauuuucuu

SEQ ID NO: 4073401 - RNA, 19 nt, Streptococcus pneumoniae R6
aguggauuuuuaagaaaga

SEQ ID NO: 4073402 - RNA, 14 nt, Streptococcus pneumoniae R6
aguggauuuuucuu

SEQ ID NO: 4073403 - RNA, 16 nt, Streptococcus pneumoniae R6
aguggcaggaauaucc

SEQ ID NO: 4073404 - RNA, 13 nt, Streptococcus pneumoniae R6
agugggaacuaga

SEQ ID NO: 4073405 - RNA, 16 nt, Streptococcus pneumoniae R6
agugggccagauuuau

SEQ ID NO: 4073406 - RNA, 21 nt, Streptococcus pneumoniae R6
agugggcuauuccauauucaa

SEQ ID NO: 4073407 - RNA, 17 nt, Streptococcus pneumoniae R6
aguggguggguaaagga

SEQ ID NO: 4073408 - RNA, 14 nt, Streptococcus pneumoniae R6
aguggguugaaguc

SEQ ID NO: 4073409 - RNA, 22 nt, Streptococcus pneumoniae R6
agugguaucauauaaauauaga

SEQ ID NO: 4073410 - RNA, 15 nt, Streptococcus pneumoniae R6
agugguguuucaagu

SEQ ID NO: 4073411 - RNA, 16 nt, Streptococcus pneumoniae R6
agugguucacuggcau

SEQ ID NO: 4073412 - RNA, 22 nt, Streptococcus pneumoniae R6
agugguuuuuaggcaauaaaau

SEQ ID NO: 4073413 - RNA, 15 nt, Streptococcus pneumoniae R6
aguguacuagucuaa

SEQ ID NO: 4073414 - RNA, 12 nt, Streptococcus pneumoniae R6
aguguagcagau

SEQ ID NO: 4073415 - RNA, 22 nt, Streptococcus pneumoniae R6
aguguauaagguucauuagaac

SEQ ID NO: 4073416 - RNA, 16 nt, Streptococcus pneumoniae R6
aguguauaugaagauu

SEQ ID NO: 4073417 - RNA, 13 nt, Streptococcus pneumoniae R6
aguguauggagcu

SEQ ID NO: 4073418 - RNA, 15 nt, Streptococcus pneumoniae R6
aguguauuguacuuu

SEQ ID NO: 4073419 - RNA, 15 nt, Streptococcus pneumoniae R6
agugucauaguccug

SEQ ID NO: 4073420 - RNA, 15 nt, Streptococcus pneumoniae R6
agugucuggaaugau

SEQ ID NO: 4073421 - RNA, 16 nt, Streptococcus pneumoniae R6
agugucuggaaugaua

SEQ ID NO: 4073422 - RNA, 14 nt, Streptococcus pneumoniae R6
agugugacacuagc

SEQ ID NO: 4073423 - RNA, 20 nt, Streptococcus pneumoniae R6
agugugacccaagauaggau

SEQ ID NO: 4073424 - RNA, 19 nt, Streptococcus pneumoniae R6
agugugagcaauuccuucg

SEQ ID NO: 4073425 - RNA, 19 nt, Streptococcus pneumoniae R6
aguguggacaugaguccug

SEQ ID NO: 4073426 - RNA, 17 nt, Streptococcus pneumoniae R6
aguguuagauuaggaau

SEQ ID NO: 4073427 - RNA, 15 nt, Streptococcus pneumoniae R6
aguguucuaaaauaa

SEQ ID NO: 4073428 - RNA, 16 nt, Streptococcus pneumoniae R6
aguguucuaaaauaag

SEQ ID NO: 4073429 - RNA, 19 nt, Streptococcus pneumoniae R6
aguguucuaaaauaaguuc

SEQ ID NO: 4073430 - RNA, 21 nt, Streptococcus pneumoniae R6
aguguucugucuuguaaaaaa

SEQ ID NO: 4073431 - RNA, 18 nt, Streptococcus pneumoniae R6
aguguugaauguugaaac

SEQ ID NO: 4073432 - RNA, 19 nt, Streptococcus pneumoniae R6
aguguuugauaucuaucaa

SEQ ID NO: 4073433 - RNA, 21 nt, Streptococcus pneumoniae R6
aguguuuuaagcugacuucgu

SEQ ID NO: 4073434 - RNA, 13 nt, Streptococcus pneumoniae R6
aguguuuucacuu

SEQ ID NO: 4073435 - RNA, 23 nt, Streptococcus pneumoniae R6
aguguuuucacuuccuuaccauc

SEQ ID NO: 4073436 - RNA, 15 nt, Streptococcus pneumoniae R6
aguguuuugagcagc

SEQ ID NO: 4073437 - RNA, 23 nt, Streptococcus pneumoniae R6
aguguuuugagcuaauuuugcca

SEQ ID NO: 4073438 - RNA, 15 nt, Streptococcus pneumoniae R6
aguguuuugagcuga

SEQ ID NO: 4073439 - RNA, 16 nt, Streptococcus pneumoniae R6
aguguuuugagcugac

SEQ ID NO: 4073440 - RNA, 19 nt, Streptococcus pneumoniae R6
aguguuuugagcugacuuc

SEQ ID NO: 4073441 - RNA, 21 nt, Streptococcus pneumoniae R6
aguguuuugaucugacuucgu

SEQ ID NO: 4073442 - RNA, 15 nt, Streptococcus pneumoniae R6
aguuaaaaaagauuu

SEQ ID NO: 4073443 - RNA, 15 nt, Streptococcus pneumoniae R6
aguuaaaacaaagaa

SEQ ID NO: 4073444 - RNA, 18 nt, Streptococcus pneumoniae R6
aguuaaauaauagaaauu

SEQ ID NO: 4073445 - RNA, 17 nt, Streptococcus pneumoniae R6
aguuaaauuaguuuuua

SEQ ID NO: 4073446 - RNA, 15 nt, Streptococcus pneumoniae R6
aguuaaauuauuaaa

SEQ ID NO: 4073447 - RNA, 19 nt, Streptococcus pneumoniae R6
aguuaaauucuucuccuac

SEQ ID NO: 4073448 - RNA, 22 nt, Streptococcus pneumoniae R6
aguuaaucuacgcuuuaaaaau

SEQ ID NO: 4073449 - RNA, 16 nt, Streptococcus pneumoniae R6
aguuaaucucuccuua

SEQ ID NO: 4073450 - RNA, 21 nt, Streptococcus pneumoniae R6
aguuacaaacucucauuaaaa

SEQ ID NO: 4073451 - RNA, 12 nt, Streptococcus pneumoniae R6
aguuaccauuga

SEQ ID NO: 4073452 - RNA, 19 nt, Streptococcus pneumoniae R6
aguuaccuaaauuaugaug

SEQ ID NO: 4073453 - RNA, 17 nt, Streptococcus pneumoniae R6
aguuacucaggauaaaa

SEQ ID NO: 4073454 - RNA, 17 nt, Streptococcus pneumoniae R6
aguuagauaacuuuucu

SEQ ID NO: 4073455 - RNA, 18 nt, Streptococcus pneumoniae R6
aguuagccacaacuagga

SEQ ID NO: 4073456 - RNA, 15 nt, Streptococcus pneumoniae R6
aguuaguguauaagg

SEQ ID NO: 4073457 - RNA, 18 nt, Streptococcus pneumoniae R6
aguuauauugacagaaga

SEQ ID NO: 4073458 - RNA, 17 nt, Streptococcus pneumoniae R6
aguuaucguaauuaaag

SEQ ID NO: 4073459 - RNA, 13 nt, Streptococcus pneumoniae R6
aguuaucugcaaa

SEQ ID NO: 4073460 - RNA, 18 nt, Streptococcus pneumoniae R6
aguuaugauauugaguuu

SEQ ID NO: 4073461 - RNA, 14 nt, Streptococcus pneumoniae R6
aguuauuaacaaaa

SEQ ID NO: 4073462 - RNA, 16 nt, Streptococcus pneumoniae R6
aguuauuaacagcaaa

SEQ ID NO: 4073463 - RNA, 20 nt, Streptococcus pneumoniae R6
aguuauuaacagcaaaaagg

SEQ ID NO: 4073464 - RNA, 22 nt, Streptococcus pneumoniae R6
aguuauuggaacuaaaguuccu

SEQ ID NO: 4073465 - RNA, 22 nt, Streptococcus pneumoniae R6
aguuauuucuccuaaagaaaaa

SEQ ID NO: 4073466 - RNA, 18 nt, Streptococcus pneumoniae R6
aguuauuuuaguaaaaaa

SEQ ID NO: 4073467 - RNA, 19 nt, Streptococcus pneumoniae R6
aguucaagugcuuuuguga

SEQ ID NO: 4073468 - RNA, 16 nt, Streptococcus pneumoniae R6
aguucaaucagcuaaa

SEQ ID NO: 4073469 - RNA, 20 nt, Streptococcus pneumoniae R6
aguucaaucagcuaaaaaua

SEQ ID NO: 4073470 - RNA, 14 nt, Streptococcus pneumoniae R6
aguucacaaaugag

SEQ ID NO: 4073471 - RNA, 14 nt, Streptococcus pneumoniae R6
aguucacucaaacc

SEQ ID NO: 4073472 - RNA, 19 nt, Streptococcus pneumoniae R6
aguucagaauuuucuuacu

SEQ ID NO: 4073473 - RNA, 21 nt, Streptococcus pneumoniae R6
aguucagcaguaaucacugca

SEQ ID NO: 4073474 - RNA, 14 nt, Streptococcus pneumoniae R6
aguuucuuuauucg

SEQ ID NO: 4073475 - RNA, 12 nt, Streptococcus pneumoniae R6
aguuugcucuuu

SEQ ID NO: 4073476 - RNA, 17 nt, Streptococcus pneumoniae R6
aguuugcucuuugauuu

SEQ ID NO: 4073477 - RNA, 22 nt, Streptococcus pneumoniae R6
aguuugcucuuugauuuucauu

SEQ ID NO: 4073478 - RNA, 19 nt, Streptococcus pneumoniae R6
aguuugcuuuuugauuuuu

SEQ ID NO: 4073479 - RNA, 17 nt, Streptococcus pneumoniae R6
aguuuggcuucaguaau

SEQ ID NO: 4073480 - RNA, 15 nt, Streptococcus pneumoniae R6
aguuuguaucuuccu

SEQ ID NO: 4073481 - RNA, 15 nt, Streptococcus pneumoniae R6
aguuugucuuucauu

SEQ ID NO: 4073482 - RNA, 19 nt, Streptococcus pneumoniae R6
aguuuuaaucucaaaagaa

SEQ ID NO: 4073483 - RNA, 23 nt, Streptococcus pneumoniae R6
aguuuuaaucucaaaagaaagca

SEQ ID NO: 4073484 - RNA, 16 nt, Streptococcus pneumoniae R6
aguuuuagauugcuuu

SEQ ID NO: 4073485 - RNA, 17 nt, Streptococcus pneumoniae R6
aguuuuaggaauauuau

SEQ ID NO: 4073486 - RNA, 16 nt, Streptococcus pneumoniae R6
aguuuuaucaguaauc

SEQ ID NO: 4073487 - RNA, 20 nt, Streptococcus pneumoniae R6
aguuuuaucaguaaucucaa

SEQ ID NO: 4073488 - RNA, 22 nt, Streptococcus pneumoniae R6
aguuuuaucaguaaucucaaaa

SEQ ID NO: 4073489 - RNA, 15 nt, Streptococcus pneumoniae R6
aguuuuauuuuugau

SEQ ID NO: 4073490 - RNA, 13 nt, Streptococcus pneumoniae R6
aguuuucaaaguu

SEQ ID NO: 4073491 - RNA, 17 nt, Streptococcus pneumoniae R6
aguuuucaaaguuccua

SEQ ID NO: 4073492 - RNA, 14 nt, Streptococcus pneumoniae R6
aguuuucaaaguuu

SEQ ID NO: 4073493 - RNA, 13 nt, Streptococcus pneumoniae R6
aguuuucacaccu

SEQ ID NO: 4073494 - RNA, 17 nt, Streptococcus pneumoniae R6
aguuuugauuauuuuuu

SEQ ID NO: 4073495 - RNA, 22 nt, Streptococcus pneumoniae R6
aguuuugcccauucuuuagcag

SEQ ID NO: 4073496 - RNA, 20 nt, Streptococcus pneumoniae R6
aguuuugguugaugaagaac

SEQ ID NO: 4073497 - RNA, 15 nt, Streptococcus pneumoniae R6
aguuuugguuuuucu

SEQ ID NO: 4073498 - RNA, 20 nt, Streptococcus pneumoniae R6
aguuuuguuuuuuauaacag

SEQ ID NO: 4073499 - RNA, 21 nt, Streptococcus pneumoniae R6
aguuuuucagccaagugagua

SEQ ID NO: 4073500 - RNA, 12 nt, Streptococcus pneumoniae R6
aguuuuuccucg

SEQ ID NO: 4073501 - RNA, 12 nt, Streptococcus pneumoniae R6
aguuuuugcaau

SEQ ID NO: 4073502 - RNA, 18 nt, Streptococcus pneumoniae R6
aguuuuugcacaccugau

SEQ ID NO: 4073503 - RNA, 16 nt, Streptococcus pneumoniae R6
aguuuuuuauuuuccc

SEQ ID NO: 4073504 - RNA, 20 nt, Streptococcus pneumoniae R6
aguuuuuuauuuucccagua

SEQ ID NO: 4073505 - RNA, 21 nt, Streptococcus pneumoniae R6
aguuuuuuauuuucccaguag

SEQ ID NO: 4073506 - RNA, 18 nt, Streptococcus pneumoniae R6
aguuuuuucacaaauucu

SEQ ID NO: 4073507 - RNA, 13 nt, Streptococcus pneumoniae R6
aguuuuuucucug

SEQ ID NO: 4073508 - RNA, 20 nt, Streptococcus pneumoniae R6
aguuuuuucucuguuaccac

SEQ ID NO: 4073509 - RNA, 17 nt, Streptococcus pneumoniae R6
aguuuuuugacuucugu

SEQ ID NO: 4073510 - RNA, 13 nt, Streptococcus pneumoniae R6
auaaaaaagagag

SEQ ID NO: 4073511 - RNA, 17 nt, Streptococcus pneumoniae R6
auaaaaaagucugggaa

SEQ ID NO: 4073512 - RNA, 15 nt, Streptococcus pneumoniae R6
auaaaaaagugaaca

SEQ ID NO: 4073513 - RNA, 16 nt, Streptococcus pneumoniae R6
auaaaaaagugaacaa

SEQ ID NO: 4073514 - RNA, 21 nt, Streptococcus pneumoniae R6
auaaaaacugaacaaauuaau

SEQ ID NO: 4073515 - RNA, 14 nt, Streptococcus pneumoniae R6
auaaaaagaaaugu

SEQ ID NO: 4073516 - RNA, 11 nt, Streptococcus pneumoniae R6
auaaaaagacc

SEQ ID NO: 4073517 - RNA, 12 nt, Streptococcus pneumoniae R6
auaaaaagaccg

SEQ ID NO: 4073518 - RNA, 21 nt, Streptococcus pneumoniae R6
auaaaaagaccggauugcucc

SEQ ID NO: 4073519 - RNA, 16 nt, Streptococcus pneumoniae R6
auaaaaauccuuuuuu

SEQ ID NO: 4073520 - RNA, 21 nt, Streptococcus pneumoniae R6
auaaaaauccuuuuuuugaag

SEQ ID NO: 4073521 - RNA, 19 nt, Streptococcus pneumoniae R6
auaaaacauuuccgauuuc

SEQ ID NO: 4073522 - RNA, 20 nt, Streptococcus pneumoniae R6
auaaaacauuucggauuuua

SEQ ID NO: 4073523 - RNA, 23 nt, Streptococcus pneumoniae R6
auaaaaccaaaaaguggaaagag

SEQ ID NO: 4073524 - RNA, 22 nt, Streptococcus pneumoniae R6
auaaaaccuguuugaaucaauu

SEQ ID NO: 4073525 - RNA, 19 nt, Streptococcus pneumoniae R6
auaaaacgcauaguaucag

SEQ ID NO: 4073526 - RNA, 15 nt, Streptococcus pneumoniae R6
auaaaacgcaucaua

SEQ ID NO: 4073527 - RNA, 17 nt, Streptococcus pneumoniae R6
auaaaacguaauuucau

SEQ ID NO: 4073528 - RNA, 22 nt, Streptococcus pneumoniae R6
auaaaacguacaguaucaaggu

SEQ ID NO: 4073529 - RNA, 17 nt, Streptococcus pneumoniae R6
auaaaacuauugacuuu

SEQ ID NO: 4073530 - RNA, 13 nt, Streptococcus pneumoniae R6
auaaaacuuauga

SEQ ID NO: 4073531 - RNA, 14 nt, Streptococcus pneumoniae R6
auaaaacuuuuaaa

SEQ ID NO: 4073532 - RNA, 16 nt, Streptococcus pneumoniae R6
auaaaacuuuuaaaau

SEQ ID NO: 4073533 - RNA, 22 nt, Streptococcus pneumoniae R6
auaaaacuuuuaaaauccauaa

SEQ ID NO: 4073534 - RNA, 23 nt, Streptococcus pneumoniae R6
auaaaagaggagguaaaucccaa

SEQ ID NO: 4073535 - RNA, 18 nt, Streptococcus pneumoniae R6
auaaaagaguuuuuggaa

SEQ ID NO: 4073536 - RNA, 11 nt, Streptococcus pneumoniae R6
auaaaagauag

SEQ ID NO: 4073537 - RNA, 23 nt, Streptococcus pneumoniae R6
auaaaagauagagaaagaaaaac

SEQ ID NO: 4073538 - RNA, 22 nt, Streptococcus pneumoniae R6
auaaaagauagcuaugaauaug

SEQ ID NO: 4073539 - RNA, 13 nt, Streptococcus pneumoniae R6
auaaaagcuaaca

SEQ ID NO: 4073540 - RNA, 19 nt, Streptococcus pneumoniae R6
auaaaaguaacaccucuuc

SEQ ID NO: 4073541 - RNA, 18 nt, Streptococcus pneumoniae R6
auaaaauacccucuauca

SEQ ID NO: 4073542 - RNA, 12 nt, Streptococcus pneumoniae R6
auaaaauauagu

SEQ ID NO: 4073543 - RNA, 22 nt, Streptococcus pneumoniae R6
auaaaauauaguagauugaaau

SEQ ID NO: 4073544 - RNA, 21 nt, Streptococcus pneumoniae R6
auaaaaucagguguucaaaaa

SEQ ID NO: 4073545 - RNA, 18 nt, Streptococcus pneumoniae R6
auaaaaucugaagaaagc

SEQ ID NO: 4073546 - RNA, 22 nt, Streptococcus pneumoniae R6
auaaaaucugaagaaagcaauu

SEQ ID NO: 4073547 - RNA, 16 nt, Streptococcus pneumoniae R6
auaaaaucugaaucaa

SEQ ID NO: 4073548 - RNA, 23 nt, Streptococcus pneumoniae R6
auaaaaucugaaucaaaggagau

SEQ ID NO: 4073549 - RNA, 11 nt, Streptococcus pneumoniae R6
auaaaaugaaa

SEQ ID NO: 4073550 - RNA, 12 nt, Streptococcus pneumoniae R6
auaaaaugaaau

SEQ ID NO: 4073551 - RNA, 16 nt, Streptococcus pneumoniae R6
auaaaaugaaauaaga

SEQ ID NO: 4073552 - RNA, 18 nt, Streptococcus pneumoniae R6
auaaaauuccuuuaaaaa

SEQ ID NO: 4073553 - RNA, 20 nt, Streptococcus pneumoniae R6
auaaaauuccuuuaaaaaca

SEQ ID NO: 4073554 - RNA, 20 nt, Streptococcus pneumoniae R6
auaaaauucgcgaaguuuau

SEQ ID NO: 4073555 - RNA, 13 nt, Streptococcus pneumoniae R6
auaaaauuuaaaa

SEQ ID NO: 4073556 - RNA, 18 nt, Streptococcus pneumoniae R6
auaaaauuuaaaaauaga

SEQ ID NO: 4073557 - RNA, 17 nt, Streptococcus pneumoniae R6
auaaaauuucuugacau

SEQ ID NO: 4073558 - RNA, 21 nt, Streptococcus pneumoniae R6
auaaaauuugaacaaauuaau

SEQ ID NO: 4073559 - RNA, 17 nt, Streptococcus pneumoniae R6
auaaaauuuuuuucaaa

SEQ ID NO: 4073560 - RNA, 17 nt, Streptococcus pneumoniae R6
auaaacaagggcaaaaa

SEQ ID NO: 4073561 - RNA, 19 nt, Streptococcus pneumoniae R6
auaaacaagggcaaaaaag

SEQ ID NO: 4073562 - RNA, 21 nt, Streptococcus pneumoniae R6
auaaacaagggcaaaaaagaa

SEQ ID NO: 4073563 - RNA, 12 nt, Streptococcus pneumoniae R6
auaaacagcgag

SEQ ID NO: 4073564 - RNA, 19 nt, Streptococcus pneumoniae R6
auaaacaucucgugcauuu

SEQ ID NO: 4073565 - RNA, 15 nt, Streptococcus pneumoniae R6
auaaaccaaaggaag

SEQ ID NO: 4073566 - RNA, 22 nt, Streptococcus pneumoniae R6
auaaacgcaagcaacaaaaacg

SEQ ID NO: 4073567 - RNA, 17 nt, Streptococcus pneumoniae R6
auaaacuaagcuuauau

SEQ ID NO: 4073568 - RNA, 18 nt, Streptococcus pneumoniae R6
auaaacuaagcuuauaua

SEQ ID NO: 4073569 - RNA, 18 nt, Streptococcus pneumoniae R6
auaaacuauccagagcau

SEQ ID NO: 4073570 - RNA, 23 nt, Streptococcus pneumoniae R6
auaaacuggguugaagauuucau

SEQ ID NO: 4073571 - RNA, 21 nt, Streptococcus pneumoniae R6
auaaacuguaaacgaauacuu

SEQ ID NO: 4073572 - RNA, 15 nt, Streptococcus pneumoniae R6
auaaacuuguaggcu

SEQ ID NO: 4073573 - RNA, 15 nt, Streptococcus pneumoniae R6
auaaacuuugguuau

SEQ ID NO: 4073574 - RNA, 13 nt, Streptococcus pneumoniae R6
auaaagaaacuug

SEQ ID NO: 4073575 - RNA, 20 nt, Streptococcus pneumoniae R6
auaaagaaacuuggcaaaau

SEQ ID NO: 4073576 - RNA, 20 nt, Streptococcus pneumoniae R6
auaaguuuuaacuuucuggu

SEQ ID NO: 4073577 - RNA, 16 nt, Streptococcus pneumoniae R6
auaauaaaacuuuuaa

SEQ ID NO: 4073578 - RNA, 18 nt, Streptococcus pneumoniae R6
auaauaaaacuuuuaaaa

SEQ ID NO: 4073579 - RNA, 15 nt, Streptococcus pneumoniae R6
auaauaaauaguuau

SEQ ID NO: 4073580 - RNA, 23 nt, Streptococcus pneumoniae R6
auaauaauugacgaagaaaccaa

SEQ ID NO: 4073581 - RNA, 16 nt, Streptococcus pneumoniae R6
auaauacaaaaaauag

SEQ ID NO: 4073582 - RNA, 18 nt, Streptococcus pneumoniae R6
auaauacucaaugaaaau

SEQ ID NO: 4073583 - RNA, 15 nt, Streptococcus pneumoniae R6
auaauagcacuuaaa

SEQ ID NO: 4073584 - RNA, 22 nt, Streptococcus pneumoniae R6
auaauagcgauagauguuuuca

SEQ ID NO: 4073585 - RNA, 21 nt, Streptococcus pneumoniae R6
auaauagcgaugaagagagag

SEQ ID NO: 4073586 - RNA, 16 nt, Streptococcus pneumoniae R6
auaauagcuugcaauu

SEQ ID NO: 4073587 - RNA, 15 nt, Streptococcus pneumoniae R6
auaauaggagcuuuu

SEQ ID NO: 4073588 - RNA, 23 nt, Streptococcus pneumoniae R6
auaauaguaagaguugaaaauag

SEQ ID NO: 4073589 - RNA, 18 nt, Streptococcus pneumoniae R6
auaauaguaugucugaau

SEQ ID NO: 4073590 - RNA, 14 nt, Streptococcus pneumoniae R6
auaauagucucuug

SEQ ID NO: 4073591 - RNA, 15 nt, Streptococcus pneumoniae R6
auaauagucucuugc

SEQ ID NO: 4073592 - RNA, 17 nt, Streptococcus pneumoniae R6
auaauagucucuugcga

SEQ ID NO: 4073593 - RNA, 16 nt, Streptococcus pneumoniae R6
auaauauaauaaacua

SEQ ID NO: 4073594 - RNA, 15 nt, Streptococcus pneumoniae R6
auaauauaggucaga

SEQ ID NO: 4073595 - RNA, 17 nt, Streptococcus pneumoniae R6
auaauaucagauauucu

SEQ ID NO: 4073596 - RNA, 17 nt, Streptococcus pneumoniae R6
auaauauguauuuauag

SEQ ID NO: 4073597 - RNA, 22 nt, Streptococcus pneumoniae R6
auaauauugucaaauuacgaug

SEQ ID NO: 4073598 - RNA, 22 nt, Streptococcus pneumoniae R6
auaaucaaaauauguuuucuuu

SEQ ID NO: 4073599 - RNA, 14 nt, Streptococcus pneumoniae R6
auaaucaaacuagc

SEQ ID NO: 4073600 - RNA, 23 nt, Streptococcus pneumoniae R6
auaaucaaacuagcaagugcuaa

SEQ ID NO: 4073601 - RNA, 15 nt, Streptococcus pneumoniae R6
auaaucauaaagccu

SEQ ID NO: 4073602 - RNA, 15 nt, Streptococcus pneumoniae R6
auaaucauuaaaaua

SEQ ID NO: 4073603 - RNA, 18 nt, Streptococcus pneumoniae R6
auaaucccaccuagaaca

SEQ ID NO: 4073604 - RNA, 18 nt, Streptococcus pneumoniae R6
auaauccgcauacuuggu

SEQ ID NO: 4073605 - RNA, 16 nt, Streptococcus pneumoniae R6
auaaucgacaagauac

SEQ ID NO: 4073606 - RNA, 15 nt, Streptococcus pneumoniae R6
auaaucgcaagguag

SEQ ID NO: 4073607 - RNA, 21 nt, Streptococcus pneumoniae R6
auaaucgcaagguagagacag

SEQ ID NO: 4073608 - RNA, 12 nt, Streptococcus pneumoniae R6
auaaucgccaua

SEQ ID NO: 4073609 - RNA, 16 nt, Streptococcus pneumoniae R6
auaaucgcuggcauuu

SEQ ID NO: 4073610 - RNA, 18 nt, Streptococcus pneumoniae R6
auaaucgcuggcauuucc

SEQ ID NO: 4073611 - RNA, 18 nt, Streptococcus pneumoniae R6
auaaucguuuaaaacacc

SEQ ID NO: 4073612 - RNA, 20 nt, Streptococcus pneumoniae R6
auaaucguuuaaaacaccuu

SEQ ID NO: 4073613 - RNA, 23 nt, Streptococcus pneumoniae R6
auaaucugggcuaauucucuggc

SEQ ID NO: 4073614 - RNA, 19 nt, Streptococcus pneumoniae R6
auaaucuguuaucuucgca

SEQ ID NO: 4073615 - RNA, 12 nt, Streptococcus pneumoniae R6
auaaucuuaucu

SEQ ID NO: 4073616 - RNA, 13 nt, Streptococcus pneumoniae R6
auaaucuugacaa

SEQ ID NO: 4073617 - RNA, 17 nt, Streptococcus pneumoniae R6
auaaucuuggucaacau

SEQ ID NO: 4073618 - RNA, 22 nt, Streptococcus pneumoniae R6
auaaugaagacaucauauaaau

SEQ ID NO: 4073619 - RNA, 12 nt, Streptococcus pneumoniae R6
auaaugagcugu

SEQ ID NO: 4073620 - RNA, 14 nt, Streptococcus pneumoniae R6
auaaugagguugcu

SEQ ID NO: 4073621 - RNA, 21 nt, Streptococcus pneumoniae R6
auaaugauuuggcaaauuccu

SEQ ID NO: 4073622 - RNA, 17 nt, Streptococcus pneumoniae R6
auaauggauugaaauaa

SEQ ID NO: 4073623 - RNA, 15 nt, Streptococcus pneumoniae R6
auaauggcuuauucc

SEQ ID NO: 4073624 - RNA, 22 nt, Streptococcus pneumoniae R6
auaaugguaucacauucaaugu

SEQ ID NO: 4073625 - RNA, 21 nt, Streptococcus pneumoniae R6
auaaugguugucguccccuuc

SEQ ID NO: 4073626 - RNA, 23 nt, Streptococcus pneumoniae R6
auaaugguugucguccccuucaa

SEQ ID NO: 4073627 - RNA, 20 nt, Streptococcus pneumoniae R6
auaauguuaaccacaaaaag

SEQ ID NO: 4073628 - RNA, 19 nt, Streptococcus pneumoniae R6
auaauuaccaccaacaugu

SEQ ID NO: 4073629 - RNA, 16 nt, Streptococcus pneumoniae R6
auaauuauagaaauga

SEQ ID NO: 4073630 - RNA, 17 nt, Streptococcus pneumoniae R6
auaauuauauauaaaaa

SEQ ID NO: 4073631 - RNA, 14 nt, Streptococcus pneumoniae R6
auaauuauucugca

SEQ ID NO: 4073632 - RNA, 14 nt, Streptococcus pneumoniae R6
auaauucaccuauu

SEQ ID NO: 4073633 - RNA, 15 nt, Streptococcus pneumoniae R6
auaauucaccuauua

SEQ ID NO: 4073634 - RNA, 19 nt, Streptococcus pneumoniae R6
auaauucaccuauuaacaa

SEQ ID NO: 4073635 - RNA, 22 nt, Streptococcus pneumoniae R6
auaauucaccuauuaacaauaa

SEQ ID NO: 4073636 - RNA, 19 nt, Streptococcus pneumoniae R6
auaauucggagauacuggu

SEQ ID NO: 4073637 - RNA, 21 nt, Streptococcus pneumoniae R6
auaauugacgaagaaaccaag

SEQ ID NO: 4073638 - RNA, 18 nt, Streptococcus pneumoniae R6
auaauugcuugagcaauc

SEQ ID NO: 4073639 - RNA, 20 nt, Streptococcus pneumoniae R6
auaauugguacauuuugauu

SEQ ID NO: 4073640 - RNA, 15 nt, Streptococcus pneumoniae R6
auaauuguaaacaaa

SEQ ID NO: 4073641 - RNA, 18 nt, Streptococcus pneumoniae R6
auaauuguaaacaaaaau

SEQ ID NO: 4073642 - RNA, 23 nt, Streptococcus pneumoniae R6
auaauuuauccaaaggauuuagu

SEQ ID NO: 4073643 - RNA, 15 nt, Streptococcus pneumoniae R6
auaauuucaaaaucu

SEQ ID NO: 4073644 - RNA, 11 nt, Streptococcus pneumoniae R6
auaauuucaac

SEQ ID NO: 4073645 - RNA, 12 nt, Streptococcus pneumoniae R6
auaauuuuaaag

SEQ ID NO: 4073646 - RNA, 17 nt, Streptococcus pneumoniae R6
auaauuuuccuuaaucc

SEQ ID NO: 4073647 - RNA, 21 nt, Streptococcus pneumoniae R6
auaauuuuguuaagacacuuu

SEQ ID NO: 4073648 - RNA, 14 nt, Streptococcus pneumoniae R6
auaauuuuucauuu

SEQ ID NO: 4073649 - RNA, 12 nt, Streptococcus pneumoniae R6
auacaaaaauag

SEQ ID NO: 4073650 - RNA, 23 nt, Streptococcus pneumoniae R6
auacaaaaucccucuuuuuacaa

SEQ ID NO: 4073651 - RNA, 16 nt, Streptococcus pneumoniae R6
auacaaagcucuuggu

SEQ ID NO: 4073652 - RNA, 16 nt, Streptococcus pneumoniae R6
auacaaaguauuuuuu

SEQ ID NO: 4073653 - RNA, 23 nt, Streptococcus pneumoniae R6
auacaaaguauuuuuucuuccca

SEQ ID NO: 4073654 - RNA, 23 nt, Streptococcus pneumoniae R6
auacaacuuuaaccaauuguuua

SEQ ID NO: 4073655 - RNA, 18 nt, Streptococcus pneumoniae R6
auacaagcugccaaagca

SEQ ID NO: 4073656 - RNA, 15 nt, Streptococcus pneumoniae R6
auacaauauauccaa

SEQ ID NO: 4073657 - RNA, 14 nt, Streptococcus pneumoniae R6
auacacacuuaaau

SEQ ID NO: 4073658 - RNA, 21 nt, Streptococcus pneumoniae R6
auacacacuuaaauugguguu

SEQ ID NO: 4073659 - RNA, 13 nt, Streptococcus pneumoniae R6
auacaccucuucu

SEQ ID NO: 4073660 - RNA, 18 nt, Streptococcus pneumoniae R6
auacagacacuugacuag

SEQ ID NO: 4073661 - RNA, 12 nt, Streptococcus pneumoniae R6
auacagagaaag

SEQ ID NO: 4073662 - RNA, 15 nt, Streptococcus pneumoniae R6
auacagagaaaguca

SEQ ID NO: 4073663 - RNA, 15 nt, Streptococcus pneumoniae R6
auacagauaaaaccu

SEQ ID NO: 4073664 - RNA, 16 nt, Streptococcus pneumoniae R6
auacagcuuuuuucuu

SEQ ID NO: 4073665 - RNA, 23 nt, Streptococcus pneumoniae R6
auacaguaccgaauguggauacu

SEQ ID NO: 4073666 - RNA, 20 nt, Streptococcus pneumoniae R6
auacaguagaugauuuucaa

SEQ ID NO: 4073667 - RNA, 20 nt, Streptococcus pneumoniae R6
auacagugaaggcuuuaaau

SEQ ID NO: 4073668 - RNA, 23 nt, Streptococcus pneumoniae R6
auacagugaaggcuuuaaaugcu

SEQ ID NO: 4073669 - RNA, 20 nt, Streptococcus pneumoniae R6
auacauagcuaaaaucaggu

SEQ ID NO: 4073670 - RNA, 22 nt, Streptococcus pneumoniae R6
auacauccguuuuucuccucua

SEQ ID NO: 4073671 - RNA, 19 nt, Streptococcus pneumoniae R6
auacaucuggguuaaaaau

SEQ ID NO: 4073672 - RNA, 16 nt, Streptococcus pneumoniae R6
auacaugcaaguagaa

SEQ ID NO: 4073673 - RNA, 23 nt, Streptococcus pneumoniae R6
auacauuuagaaagguaaaauau

SEQ ID NO: 4073674 - RNA, 15 nt, Streptococcus pneumoniae R6
auacauuuuguaaaa

SEQ ID NO: 4073675 - RNA, 17 nt, Streptococcus pneumoniae R6
auacauuuuguaaaaaa

SEQ ID NO: 4073676 - RNA, 14 nt, Streptococcus pneumoniae R6
auacauuuuuucug

SEQ ID NO: 4073677 - RNA, 15 nt, Streptococcus pneumoniae R6
auacauuuuuucuga

SEQ ID NO: 4073678 - RNA, 15 nt, Streptococcus pneumoniae R6
auagacauuuucugu

SEQ ID NO: 4073679 - RNA, 22 nt, Streptococcus pneumoniae R6
auagacccuuguuucuaaaaca

SEQ ID NO: 4073680 - RNA, 17 nt, Streptococcus pneumoniae R6
auagaccugaucaaagg

SEQ ID NO: 4073681 - RNA, 16 nt, Streptococcus pneumoniae R6
auagacgaaaagucau

SEQ ID NO: 4073682 - RNA, 18 nt, Streptococcus pneumoniae R6
auagacuauauugauuau

SEQ ID NO: 4073683 - RNA, 21 nt, Streptococcus pneumoniae R6
auagacuaucuaaaauagaag

SEQ ID NO: 4073684 - RNA, 20 nt, Streptococcus pneumoniae R6
auagacucaggauguuauag

SEQ ID NO: 4073685 - RNA, 18 nt, Streptococcus pneumoniae R6
auagacuguuaccacuuc

SEQ ID NO: 4073686 - RNA, 22 nt, Streptococcus pneumoniae R6
auagagaccaacuccucucucc

SEQ ID NO: 4073687 - RNA, 18 nt, Streptococcus pneumoniae R6
auagagagcuccaaagaa

SEQ ID NO: 4073688 - RNA, 16 nt, Streptococcus pneumoniae R6
auagagauagaagguc

SEQ ID NO: 4073689 - RNA, 24 nt, Streptococcus pneumoniae R6
auagagauuauagugguguuucaa

SEQ ID NO: 4073690 - RNA, 17 nt, Streptococcus pneumoniae R6
auagagccuucuuccau

SEQ ID NO: 4073691 - RNA, 16 nt, Streptococcus pneumoniae R6
auagagggauuuuuug

SEQ ID NO: 4073692 - RNA, 21 nt, Streptococcus pneumoniae R6
auagagguuauucaaaaacau

SEQ ID NO: 4073693 - RNA, 13 nt, Streptococcus pneumoniae R6
auagaguguuauc

SEQ ID NO: 4073694 - RNA, 16 nt, Streptococcus pneumoniae R6
auagauaaauacucug

SEQ ID NO: 4073695 - RNA, 22 nt, Streptococcus pneumoniae R6
auagauccaagcauaacagcau

SEQ ID NO: 4073696 - RNA, 13 nt, Streptococcus pneumoniae R6
auagauccuucaa

SEQ ID NO: 4073697 - RNA, 14 nt, Streptococcus pneumoniae R6
auagaucugauagu

SEQ ID NO: 4073698 - RNA, 14 nt, Streptococcus pneumoniae R6
auagaugaugguuu

SEQ ID NO: 4073699 - RNA, 18 nt, Streptococcus pneumoniae R6
auagaugcuugaauuccc

SEQ ID NO: 4073700 - RNA, 17 nt, Streptococcus pneumoniae R6
auagaugguauccaaaa

SEQ ID NO: 4073701 - RNA, 21 nt, Streptococcus pneumoniae R6
auagauguuaagcuccaauuu

SEQ ID NO: 4073702 - RNA, 23 nt, Streptococcus pneumoniae R6
auagauucaacgaacuauaaaau

SEQ ID NO: 4073703 - RNA, 16 nt, Streptococcus pneumoniae R6
auagauuggauaaaau

SEQ ID NO: 4073704 - RNA, 15 nt, Streptococcus pneumoniae R6
auagcaaggaugagg

SEQ ID NO: 4073705 - RNA, 20 nt, Streptococcus pneumoniae R6
auagcacaugacaaauucuc

SEQ ID NO: 4073706 - RNA, 17 nt, Streptococcus pneumoniae R6
auagcacuuaaaaaguu

SEQ ID NO: 4073707 - RNA, 16 nt, Streptococcus pneumoniae R6
auagcagauagccagc

SEQ ID NO: 4073708 - RNA, 19 nt, Streptococcus pneumoniae R6
auagcagauagguggggca

SEQ ID NO: 4073709 - RNA, 17 nt, Streptococcus pneumoniae R6
auagcagcgguuccauu

SEQ ID NO: 4073710 - RNA, 18 nt, Streptococcus pneumoniae R6
auagcaguugguuguuca

SEQ ID NO: 4073711 - RNA, 22 nt, Streptococcus pneumoniae R6
auagcauccccuaggagaugag

SEQ ID NO: 4073712 - RNA, 12 nt, Streptococcus pneumoniae R6
auagcaucuuuu

SEQ ID NO: 4073713 - RNA, 17 nt, Streptococcus pneumoniae R6
auagcauuuggaagaau

SEQ ID NO: 4073714 - RNA, 22 nt, Streptococcus pneumoniae R6
auagccaacucauacuuucuau

SEQ ID NO: 4073715 - RNA, 15 nt, Streptococcus pneumoniae R6
auagccaagaccaau

SEQ ID NO: 4073716 - RNA, 14 nt, Streptococcus pneumoniae R6
auagccaccaugcu

SEQ ID NO: 4073717 - RNA, 13 nt, Streptococcus pneumoniae R6
auagccagacugg

SEQ ID NO: 4073718 - RNA, 16 nt, Streptococcus pneumoniae R6
auagccauaaaacauu

SEQ ID NO: 4073719 - RNA, 18 nt, Streptococcus pneumoniae R6
auagccauaaaacauuuc

SEQ ID NO: 4073720 - RNA, 19 nt, Streptococcus pneumoniae R6
auagccauaaaacauuucc

SEQ ID NO: 4073721 - RNA, 18 nt, Streptococcus pneumoniae R6
auagccccuaugcuuucc

SEQ ID NO: 4073722 - RNA, 22 nt, Streptococcus pneumoniae R6
auagccccuaugcuuuccuuuc

SEQ ID NO: 4073723 - RNA, 14 nt, Streptococcus pneumoniae R6
auagcgaaaucgug

SEQ ID NO: 4073724 - RNA, 13 nt, Streptococcus pneumoniae R6
auagcgaaauucu

SEQ ID NO: 4073725 - RNA, 15 nt, Streptococcus pneumoniae R6
auagcgacuauaaaa

SEQ ID NO: 4073726 - RNA, 20 nt, Streptococcus pneumoniae R6
auagcgauucccaagucuga

SEQ ID NO: 4073727 - RNA, 16 nt, Streptococcus pneumoniae R6
auagcgcuagagacua

SEQ ID NO: 4073728 - RNA, 17 nt, Streptococcus pneumoniae R6
auagcgugcccaaaaau

SEQ ID NO: 4073729 - RNA, 16 nt, Streptococcus pneumoniae R6
auagcuaaaccuuauu

SEQ ID NO: 4073730 - RNA, 23 nt, Streptococcus pneumoniae R6
auagcuaaacuaucgcuggcugc

SEQ ID NO: 4073731 - RNA, 15 nt, Streptococcus pneumoniae R6
auagcuccaucucca

SEQ ID NO: 4073732 - RNA, 21 nt, Streptococcus pneumoniae R6
auagcuccuccaaguccaaga

SEQ ID NO: 4073733 - RNA, 14 nt, Streptococcus pneumoniae R6
auagcugcagcuga

SEQ ID NO: 4073734 - RNA, 18 nt, Streptococcus pneumoniae R6
auagcugcggcuuucuuc

SEQ ID NO: 4073735 - RNA, 15 nt, Streptococcus pneumoniae R6
auagcuggucaagaa

SEQ ID NO: 4073736 - RNA, 18 nt, Streptococcus pneumoniae R6
auagcuggucaagaagcg

SEQ ID NO: 4073737 - RNA, 19 nt, Streptococcus pneumoniae R6
auagcugucaaaucauccg

SEQ ID NO: 4073738 - RNA, 17 nt, Streptococcus pneumoniae R6
auagcuguuucaacacg

SEQ ID NO: 4073739 - RNA, 20 nt, Streptococcus pneumoniae R6
auagcuuaaaaucuugucaa

SEQ ID NO: 4073740 - RNA, 17 nt, Streptococcus pneumoniae R6
auagcuuuuuauauaua

SEQ ID NO: 4073741 - RNA, 16 nt, Streptococcus pneumoniae R6
auaggaaguugagcgg

SEQ ID NO: 4073742 - RNA, 15 nt, Streptococcus pneumoniae R6
auaggacguuuucag

SEQ ID NO: 4073743 - RNA, 24 nt, Streptococcus pneumoniae R6
auaggacguuuucagauuuuuagu

SEQ ID NO: 4073744 - RNA, 22 nt, Streptococcus pneumoniae R6
auaggagcuauguagccacucu

SEQ ID NO: 4073745 - RNA, 22 nt, Streptococcus pneumoniae R6
auaggaugaaccugcuuaagau

SEQ ID NO: 4073746 - RNA, 22 nt, Streptococcus pneumoniae R6
auaggcaauuucgauaauaccu

SEQ ID NO: 4073747 - RNA, 19 nt, Streptococcus pneumoniae R6
auaggccucuucaaagaag

SEQ ID NO: 4073748 - RNA, 17 nt, Streptococcus pneumoniae R6
auaggccuuguggaaga

SEQ ID NO: 4073749 - RNA, 21 nt, Streptococcus pneumoniae R6
auaggccuuguggaagaaguu

SEQ ID NO: 4073750 - RNA, 15 nt, Streptococcus pneumoniae R6
auaggcgauaauuuc

SEQ ID NO: 4073751 - RNA, 21 nt, Streptococcus pneumoniae R6
auaggcggacaccucuuucuu

SEQ ID NO: 4073752 - RNA, 14 nt, Streptococcus pneumoniae R6
auagggaagguaug

SEQ ID NO: 4073753 - RNA, 19 nt, Streptococcus pneumoniae R6
auagggcuuuuuuugcuua

SEQ ID NO: 4073754 - RNA, 12 nt, Streptococcus pneumoniae R6
auaggggaauau

SEQ ID NO: 4073755 - RNA, 13 nt, Streptococcus pneumoniae R6
auagguaguucaa

SEQ ID NO: 4073756 - RNA, 21 nt, Streptococcus pneumoniae R6
auagguggauaaaagucuuca

SEQ ID NO: 4073757 - RNA, 20 nt, Streptococcus pneumoniae R6
auagguggggcaaaaacaca

SEQ ID NO: 4073758 - RNA, 18 nt, Streptococcus pneumoniae R6
auaggugguuggaaguag

SEQ ID NO: 4073759 - RNA, 13 nt, Streptococcus pneumoniae R6
auagguugcaaag

SEQ ID NO: 4073760 - RNA, 15 nt, Streptococcus pneumoniae R6
auagguugcaaagag

SEQ ID NO: 4073761 - RNA, 14 nt, Streptococcus pneumoniae R6
auaguaaaaugaaa

SEQ ID NO: 4073762 - RNA, 15 nt, Streptococcus pneumoniae R6
auaguaaaaugaaac

SEQ ID NO: 4073763 - RNA, 19 nt, Streptococcus pneumoniae R6
auaguaaaaugaaauaaga

SEQ ID NO: 4073764 - RNA, 20 nt, Streptococcus pneumoniae R6
auaguaacgagucaaaaaag

SEQ ID NO: 4073765 - RNA, 20 nt, Streptococcus pneumoniae R6
auaguaauuccacacagaaa

SEQ ID NO: 4073766 - RNA, 19 nt, Streptococcus pneumoniae R6
auaguacacaucuacuucu

SEQ ID NO: 4073767 - RNA, 21 nt, Streptococcus pneumoniae R6
auaguacacaucuacuucuaa

SEQ ID NO: 4073768 - RNA, 16 nt, Streptococcus pneumoniae R6
auaguacaccuuuacu

SEQ ID NO: 4073769 - RNA, 17 nt, Streptococcus pneumoniae R6
auaguacaccuuuacuu

SEQ ID NO: 4073770 - RNA, 19 nt, Streptococcus pneumoniae R6
auaguacacuucugcuucu

SEQ ID NO: 4073771 - RNA, 14 nt, Streptococcus pneumoniae R6
auaguaccaguuac

SEQ ID NO: 4073772 - RNA, 22 nt, Streptococcus pneumoniae R6
auaguaccaguuaccauugacu

SEQ ID NO: 4073773 - RNA, 15 nt, Streptococcus pneumoniae R6
auaguacgaaacaau

SEQ ID NO: 4073774 - RNA, 21 nt, Streptococcus pneumoniae R6
auaguacgaaacaauugcuaa

SEQ ID NO: 4073775 - RNA, 22 nt, Streptococcus pneumoniae R6
auaguacgaaacaauugcuaaa

SEQ ID NO: 4073776 - RNA, 18 nt, Streptococcus pneumoniae R6
auaguagccaaaauccuu

SEQ ID NO: 4073777 - RNA, 23 nt, Streptococcus pneumoniae R6
auaguagccaaaauccuugacca

SEQ ID NO: 4073778 - RNA, 15 nt, Streptococcus pneumoniae R6
auaguagccaauuga

SEQ ID NO: 4073779 - RNA, 13 nt, Streptococcus pneumoniae R6
auaguaucaaaug

SEQ ID NO: 4073780 - RNA, 18 nt, Streptococcus pneumoniae R6
auaucuaauaauuuuuca

SEQ ID NO: 4073781 - RNA, 17 nt, Streptococcus pneumoniae R6
auaucuaauacccauuu

SEQ ID NO: 4073782 - RNA, 19 nt, Streptococcus pneumoniae R6
auaucuaccugcaccagau

SEQ ID NO: 4073783 - RNA, 16 nt, Streptococcus pneumoniae R6
auaucuagguaaaaau

SEQ ID NO: 4073784 - RNA, 16 nt, Streptococcus pneumoniae R6
auaucuaucaaacacu

SEQ ID NO: 4073785 - RNA, 16 nt, Streptococcus pneumoniae R6
auaucuauccuaucuu

SEQ ID NO: 4073786 - RNA, 13 nt, Streptococcus pneumoniae R6
auaucucuuugaa

SEQ ID NO: 4073787 - RNA, 11 nt, Streptococcus pneumoniae R6
auaucugaaag

SEQ ID NO: 4073788 - RNA, 18 nt, Streptococcus pneumoniae R6
auaucugaaaguuuaucu

SEQ ID NO: 4073789 - RNA, 20 nt, Streptococcus pneumoniae R6
auaucugcacucucauucau

SEQ ID NO: 4073790 - RNA, 19 nt, Streptococcus pneumoniae R6
auaucuggacuuauaugcu

SEQ ID NO: 4073791 - RNA, 16 nt, Streptococcus pneumoniae R6
auaucuggcauuccug

SEQ ID NO: 4073792 - RNA, 15 nt, Streptococcus pneumoniae R6
auaucugucuuacca

SEQ ID NO: 4073793 - RNA, 17 nt, Streptococcus pneumoniae R6
auaucuuauuuuucuau

SEQ ID NO: 4073794 - RNA, 12 nt, Streptococcus pneumoniae R6
auaucuuccuca

SEQ ID NO: 4073795 - RNA, 13 nt, Streptococcus pneumoniae R6
auaucuuccucag

SEQ ID NO: 4073796 - RNA, 17 nt, Streptococcus pneumoniae R6
auaucuucggauuuuuc

SEQ ID NO: 4073797 - RNA, 18 nt, Streptococcus pneumoniae R6
auaucuucugcuugcauc

SEQ ID NO: 4073798 - RNA, 13 nt, Streptococcus pneumoniae R6
auaucuuugauuu

SEQ ID NO: 4073799 - RNA, 18 nt, Streptococcus pneumoniae R6
auaugaaaucuuuuugau

SEQ ID NO: 4073800 - RNA, 16 nt, Streptococcus pneumoniae R6
auaugaggagaaagaa

SEQ ID NO: 4073801 - RNA, 17 nt, Streptococcus pneumoniae R6
auaugaggagaaagaag

SEQ ID NO: 4073802 - RNA, 15 nt, Streptococcus pneumoniae R6
auaugaugcguuuua

SEQ ID NO: 4073803 - RNA, 15 nt, Streptococcus pneumoniae R6
auaugauugucuccu

SEQ ID NO: 4073804 - RNA, 13 nt, Streptococcus pneumoniae R6
auaugauuucaau

SEQ ID NO: 4073805 - RNA, 14 nt, Streptococcus pneumoniae R6
auaugauuucaauu

SEQ ID NO: 4073806 - RNA, 19 nt, Streptococcus pneumoniae R6
auaugcaacuuguuuuucc

SEQ ID NO: 4073807 - RNA, 23 nt, Streptococcus pneumoniae R6
auaugcaacuuguuuuuccugau

SEQ ID NO: 4073808 - RNA, 13 nt, Streptococcus pneumoniae R6
auaugcacagaca

SEQ ID NO: 4073809 - RNA, 15 nt, Streptococcus pneumoniae R6
auaugcgaacuagcu

SEQ ID NO: 4073810 - RNA, 21 nt, Streptococcus pneumoniae R6
auaugggauuuucauauaaua

SEQ ID NO: 4073811 - RNA, 15 nt, Streptococcus pneumoniae R6
auaugguaauguucu

SEQ ID NO: 4073812 - RNA, 21 nt, Streptococcus pneumoniae R6
auaugguaggcuuuaucaagc

SEQ ID NO: 4073813 - RNA, 19 nt, Streptococcus pneumoniae R6
auaugguauuuaaaaccuc

SEQ ID NO: 4073814 - RNA, 19 nt, Streptococcus pneumoniae R6
auauggugcguuuuuugau

SEQ ID NO: 4073815 - RNA, 20 nt, Streptococcus pneumoniae R6
auauguaaacaguaauaaag

SEQ ID NO: 4073816 - RNA, 21 nt, Streptococcus pneumoniae R6
auauguaaacaguaauaaaga

SEQ ID NO: 4073817 - RNA, 13 nt, Streptococcus pneumoniae R6
auauuaagaaucu

SEQ ID NO: 4073818 - RNA, 23 nt, Streptococcus pneumoniae R6
auauuaccaaguuaaacaaccuu

SEQ ID NO: 4073819 - RNA, 12 nt, Streptococcus pneumoniae R6
auauuagaugau

SEQ ID NO: 4073820 - RNA, 21 nt, Streptococcus pneumoniae R6
auauuagaugauuuuucuguu

SEQ ID NO: 4073821 - RNA, 13 nt, Streptococcus pneumoniae R6
auauuagcaaaaa

SEQ ID NO: 4073822 - RNA, 24 nt, Streptococcus pneumoniae R6
auauuagcugucucggcauuauua

SEQ ID NO: 4073823 - RNA, 15 nt, Streptococcus pneumoniae R6
auauuaguaaauaga

SEQ ID NO: 4073824 - RNA, 22 nt, Streptococcus pneumoniae R6
auauuagucggaaucuuuaagg

SEQ ID NO: 4073825 - RNA, 15 nt, Streptococcus pneumoniae R6
auauuaugcguuuua

SEQ ID NO: 4073826 - RNA, 15 nt, Streptococcus pneumoniae R6
auauuauuucaaaga

SEQ ID NO: 4073827 - RNA, 22 nt, Streptococcus pneumoniae R6
auauucaaaauacaaaaguuga

SEQ ID NO: 4073828 - RNA, 18 nt, Streptococcus pneumoniae R6
auauucaauuauccauau

SEQ ID NO: 4073829 - RNA, 18 nt, Streptococcus pneumoniae R6
auauucaauucuuuaaca

SEQ ID NO: 4073830 - RNA, 13 nt, Streptococcus pneumoniae R6
auauucaccacau

SEQ ID NO: 4073831 - RNA, 14 nt, Streptococcus pneumoniae R6
auauuccacauuca

SEQ ID NO: 4073832 - RNA, 15 nt, Streptococcus pneumoniae R6
auauuccauuccucu

SEQ ID NO: 4073833 - RNA, 16 nt, Streptococcus pneumoniae R6
auauuccuaugauuaa

SEQ ID NO: 4073834 - RNA, 20 nt, Streptococcus pneumoniae R6
auauucguuggauauaggag

SEQ ID NO: 4073835 - RNA, 23 nt, Streptococcus pneumoniae R6
auauucucaauuucuauuuuaaa

SEQ ID NO: 4073836 - RNA, 21 nt, Streptococcus pneumoniae R6
auauucuuggcaaaguuuuug

SEQ ID NO: 4073837 - RNA, 16 nt, Streptococcus pneumoniae R6
auauugaaaugaaaua

SEQ ID NO: 4073838 - RNA, 14 nt, Streptococcus pneumoniae R6
auauugauauuuau

SEQ ID NO: 4073839 - RNA, 19 nt, Streptococcus pneumoniae R6
auauugccgauaucaccaa

SEQ ID NO: 4073840 - RNA, 18 nt, Streptococcus pneumoniae R6
auauuggcugcuugcaau

SEQ ID NO: 4073841 - RNA, 19 nt, Streptococcus pneumoniae R6
auauuggucagauuguaaa

SEQ ID NO: 4073842 - RNA, 14 nt, Streptococcus pneumoniae R6
auauuguuaauggu

SEQ ID NO: 4073843 - RNA, 13 nt, Streptococcus pneumoniae R6
auauuguuuuaau

SEQ ID NO: 4073844 - RNA, 14 nt, Streptococcus pneumoniae R6
auauuguuuuaaua

SEQ ID NO: 4073845 - RNA, 16 nt, Streptococcus pneumoniae R6
auauuguuuuaauaua

SEQ ID NO: 4073846 - RNA, 15 nt, Streptococcus pneumoniae R6
auauuuacuaauuaa

SEQ ID NO: 4073847 - RNA, 16 nt, Streptococcus pneumoniae R6
auauuuacuucauguu

SEQ ID NO: 4073848 - RNA, 15 nt, Streptococcus pneumoniae R6
auauuuauagaaaau

SEQ ID NO: 4073849 - RNA, 13 nt, Streptococcus pneumoniae R6
auauuuauccauu

SEQ ID NO: 4073850 - RNA, 15 nt, Streptococcus pneumoniae R6
auauuuauccauuca

SEQ ID NO: 4073851 - RNA, 12 nt, Streptococcus pneumoniae R6
auauuuauuaua

SEQ ID NO: 4073852 - RNA, 19 nt, Streptococcus pneumoniae R6
auauuucaagaauuaagug

SEQ ID NO: 4073853 - RNA, 15 nt, Streptococcus pneumoniae R6
auauuuccaucaacu

SEQ ID NO: 4073854 - RNA, 16 nt, Streptococcus pneumoniae R6
auauuucgcuuauaaa

SEQ ID NO: 4073855 - RNA, 13 nt, Streptococcus pneumoniae R6
auauuucuagaaa

SEQ ID NO: 4073856 - RNA, 16 nt, Streptococcus pneumoniae R6
auauuucuagaaauua

SEQ ID NO: 4073857 - RNA, 13 nt, Streptococcus pneumoniae R6
auauuucuuaauu

SEQ ID NO: 4073858 - RNA, 23 nt, Streptococcus pneumoniae R6
auauuuggaauguugcugaaaug

SEQ ID NO: 4073859 - RNA, 16 nt, Streptococcus pneumoniae R6
auauuuggagcaagug

SEQ ID NO: 4073860 - RNA, 19 nt, Streptococcus pneumoniae R6
auauuuggcauauuuuuag

SEQ ID NO: 4073861 - RNA, 17 nt, Streptococcus pneumoniae R6
auauuuuagaagcagag

SEQ ID NO: 4073862 - RNA, 13 nt, Streptococcus pneumoniae R6
auauuuucagaua

SEQ ID NO: 4073863 - RNA, 22 nt, Streptococcus pneumoniae R6
auauuuucagauaaccaucuca

SEQ ID NO: 4073864 - RNA, 20 nt, Streptococcus pneumoniae R6
auauuuucuuuauuagcaua

SEQ ID NO: 4073865 - RNA, 15 nt, Streptococcus pneumoniae R6
auauuuuucaaauaa

SEQ ID NO: 4073866 - RNA, 17 nt, Streptococcus pneumoniae R6
auauuuuuccuucauca

SEQ ID NO: 4073867 - RNA, 18 nt, Streptococcus pneumoniae R6
auauuuuuuacuuuugca

SEQ ID NO: 4073868 - RNA, 19 nt, Streptococcus pneumoniae R6
aucaaaaaaagaaguuggu

SEQ ID NO: 4073869 - RNA, 19 nt, Streptococcus pneumoniae R6
aucaaaaaaauucuucaca

SEQ ID NO: 4073870 - RNA, 13 nt, Streptococcus pneumoniae R6
aucaaaaauagaa

SEQ ID NO: 4073871 - RNA, 14 nt, Streptococcus pneumoniae R6
aucaaaaauagaaa

SEQ ID NO: 4073872 - RNA, 17 nt, Streptococcus pneumoniae R6
aucaaaaauagaaauaa

SEQ ID NO: 4073873 - RNA, 13 nt, Streptococcus pneumoniae R6
aucaaaaauuggu

SEQ ID NO: 4073874 - RNA, 22 nt, Streptococcus pneumoniae R6
aucaaaaauugguguaaauaga

SEQ ID NO: 4073875 - RNA, 21 nt, Streptococcus pneumoniae R6
aucaaaagauguuagaaaaag

SEQ ID NO: 4073876 - RNA, 11 nt, Streptococcus pneumoniae R6
aucaaaauaaa

SEQ ID NO: 4073877 - RNA, 20 nt, Streptococcus pneumoniae R6
aucaaaauauagcaauaaga

SEQ ID NO: 4073878 - RNA, 18 nt, Streptococcus pneumoniae R6
aucaaaauauguuuucuu

SEQ ID NO: 4073879 - RNA, 19 nt, Streptococcus pneumoniae R6
aucaaaauauguuuucuuu

SEQ ID NO: 4073880 - RNA, 16 nt, Streptococcus pneumoniae R6
aucaaaaucacagacc

SEQ ID NO: 4073881 - RNA, 19 nt, Streptococcus pneumoniae R6
aucaaacgagaaucuguau

SEQ ID NO: 4073882 - RNA, 14 nt, Streptococcus pneumoniae R6
aucaaacuagcaag

SEQ ID NO: 4073883 - RNA, 18 nt, Streptococcus pneumoniae R6
aucaggaaagucaaauua

SEQ ID NO: 4073884 - RNA, 18 nt, Streptococcus pneumoniae R6
aucaggaaggucacuuuu

SEQ ID NO: 4073885 - RNA, 20 nt, Streptococcus pneumoniae R6
aucaggaaggucacuuuuuu

SEQ ID NO: 4073886 - RNA, 21 nt, Streptococcus pneumoniae R6
aucaggaauaaauccagcuga

SEQ ID NO: 4073887 - RNA, 14 nt, Streptococcus pneumoniae R6
aucaggauuuuuaa

SEQ ID NO: 4073888 - RNA, 21 nt, Streptococcus pneumoniae R6
aucaggauuuuuucauggaug

SEQ ID NO: 4073889 - RNA, 22 nt, Streptococcus pneumoniae R6
aucaggauuuuuucauggaugc

SEQ ID NO: 4073890 - RNA, 23 nt, Streptococcus pneumoniae R6
aucaggauuuuuucauggaugca

SEQ ID NO: 4073891 - RNA, 15 nt, Streptococcus pneumoniae R6
aucaggccuacaauu

SEQ ID NO: 4073892 - RNA, 13 nt, Streptococcus pneumoniae R6
aucaggucuuaua

SEQ ID NO: 4073893 - RNA, 16 nt, Streptococcus pneumoniae R6
aucaggucuuauagaa

SEQ ID NO: 4073894 - RNA, 16 nt, Streptococcus pneumoniae R6
aucaguaaucucaaaa

SEQ ID NO: 4073895 - RNA, 19 nt, Streptococcus pneumoniae R6
aucaguaaucucaaaacag

SEQ ID NO: 4073896 - RNA, 18 nt, Streptococcus pneumoniae R6
aucaguauauugaaauga

SEQ ID NO: 4073897 - RNA, 14 nt, Streptococcus pneumoniae R6
aucagucaagaguu

SEQ ID NO: 4073898 - RNA, 19 nt, Streptococcus pneumoniae R6
aucagucaagaguucuucu

SEQ ID NO: 4073899 - RNA, 17 nt, Streptococcus pneumoniae R6
aucaguucauuuuuccu

SEQ ID NO: 4073900 - RNA, 18 nt, Streptococcus pneumoniae R6
aucaguucauuuuuccuu

SEQ ID NO: 4073901 - RNA, 19 nt, Streptococcus pneumoniae R6
aucauaaaucaauuuuucg

SEQ ID NO: 4073902 - RNA, 20 nt, Streptococcus pneumoniae R6
aucauaacacuauuaaaguu

SEQ ID NO: 4073903 - RNA, 21 nt, Streptococcus pneumoniae R6
aucauaagaggucugaaacua

SEQ ID NO: 4073904 - RNA, 14 nt, Streptococcus pneumoniae R6
aucauaagauuaau

SEQ ID NO: 4073905 - RNA, 21 nt, Streptococcus pneumoniae R6
aucauacuuagcuaauuuucu

SEQ ID NO: 4073906 - RNA, 16 nt, Streptococcus pneumoniae R6
aucauacuuggagaac

SEQ ID NO: 4073907 - RNA, 16 nt, Streptococcus pneumoniae R6
aucauagaaauuuuua

SEQ ID NO: 4073908 - RNA, 17 nt, Streptococcus pneumoniae R6
aucauagaaauuuuuac

SEQ ID NO: 4073909 - RNA, 17 nt, Streptococcus pneumoniae R6
aucauagauucaccagu

SEQ ID NO: 4073910 - RNA, 18 nt, Streptococcus pneumoniae R6
aucauaggcauaguacca

SEQ ID NO: 4073911 - RNA, 14 nt, Streptococcus pneumoniae R6
aucauauaaauaau

SEQ ID NO: 4073912 - RNA, 14 nt, Streptococcus pneumoniae R6
aucauauccagcuu

SEQ ID NO: 4073913 - RNA, 13 nt, Streptococcus pneumoniae R6
aucauauuuucug

SEQ ID NO: 4073914 - RNA, 17 nt, Streptococcus pneumoniae R6
aucaucaaauugaaaua

SEQ ID NO: 4073915 - RNA, 14 nt, Streptococcus pneumoniae R6
aucaucacacuagc

SEQ ID NO: 4073916 - RNA, 14 nt, Streptococcus pneumoniae R6
aucaucacuaguaa

SEQ ID NO: 4073917 - RNA, 14 nt, Streptococcus pneumoniae R6
aucaucauaaaaau

SEQ ID NO: 4073918 - RNA, 15 nt, Streptococcus pneumoniae R6
aucaucauaaaaaua

SEQ ID NO: 4073919 - RNA, 16 nt, Streptococcus pneumoniae R6
aucauccaccuugcaa

SEQ ID NO: 4073920 - RNA, 20 nt, Streptococcus pneumoniae R6
aucauccaccuugcaaaaaa

SEQ ID NO: 4073921 - RNA, 22 nt, Streptococcus pneumoniae R6
aucauccaccuugcaaaaaaac

SEQ ID NO: 4073922 - RNA, 16 nt, Streptococcus pneumoniae R6
aucauccagauuuuuc

SEQ ID NO: 4073923 - RNA, 17 nt, Streptococcus pneumoniae R6
aucauccagauuuuucu

SEQ ID NO: 4073924 - RNA, 14 nt, Streptococcus pneumoniae R6
aucauccgaagcaa

SEQ ID NO: 4073925 - RNA, 16 nt, Streptococcus pneumoniae R6
aucaucgauuuuuuca

SEQ ID NO: 4073926 - RNA, 14 nt, Streptococcus pneumoniae R6
aucaucugaaugac

SEQ ID NO: 4073927 - RNA, 14 nt, Streptococcus pneumoniae R6
aucaucugcaucaa

SEQ ID NO: 4073928 - RNA, 17 nt, Streptococcus pneumoniae R6
aucaucugcaucaagaa

SEQ ID NO: 4073929 - RNA, 16 nt, Streptococcus pneumoniae R6
aucaucuugcuaaaaa

SEQ ID NO: 4073930 - RNA, 19 nt, Streptococcus pneumoniae R6
aucaucuugcuaaaaaaag

SEQ ID NO: 4073931 - RNA, 17 nt, Streptococcus pneumoniae R6
aucaugacugagagcua

SEQ ID NO: 4073932 - RNA, 16 nt, Streptococcus pneumoniae R6
aucaugacuggacggu

SEQ ID NO: 4073933 - RNA, 13 nt, Streptococcus pneumoniae R6
aucaugagaauau

SEQ ID NO: 4073934 - RNA, 23 nt, Streptococcus pneumoniae R6
aucaugcuuggauccauugcugg

SEQ ID NO: 4073935 - RNA, 14 nt, Streptococcus pneumoniae R6
aucaugcuuuacua

SEQ ID NO: 4073936 - RNA, 15 nt, Streptococcus pneumoniae R6
aucauggauuuuucu

SEQ ID NO: 4073937 - RNA, 20 nt, Streptococcus pneumoniae R6
aucauguaccuaagauuaga

SEQ ID NO: 4073938 - RNA, 15 nt, Streptococcus pneumoniae R6
aucauguuucaacau

SEQ ID NO: 4073939 - RNA, 14 nt, Streptococcus pneumoniae R6
aucauguuuuuaag

SEQ ID NO: 4073940 - RNA, 22 nt, Streptococcus pneumoniae R6
aucauguuuuuaagcuacuacu

SEQ ID NO: 4073941 - RNA, 20 nt, Streptococcus pneumoniae R6
aucauuaaagaccaaagaaa

SEQ ID NO: 4073942 - RNA, 18 nt, Streptococcus pneumoniae R6
aucauuauccaugauaaa

SEQ ID NO: 4073943 - RNA, 13 nt, Streptococcus pneumoniae R6
aucauucugcaug

SEQ ID NO: 4073944 - RNA, 22 nt, Streptococcus pneumoniae R6
aucauucuuauuuggcaauuca

SEQ ID NO: 4073945 - RNA, 23 nt, Streptococcus pneumoniae R6
aucauucuuauuuggcaauucaa

SEQ ID NO: 4073946 - RNA, 15 nt, Streptococcus pneumoniae R6
aucauugaguuggcu

SEQ ID NO: 4073947 - RNA, 23 nt, Streptococcus pneumoniae R6
aucauugcuaucuaggcugacaa

SEQ ID NO: 4073948 - RNA, 13 nt, Streptococcus pneumoniae R6
aucauugugccau

SEQ ID NO: 4073949 - RNA, 12 nt, Streptococcus pneumoniae R6
aucauuuaauaa

SEQ ID NO: 4073950 - RNA, 14 nt, Streptococcus pneumoniae R6
aucauuuaauaaug

SEQ ID NO: 4073951 - RNA, 13 nt, Streptococcus pneumoniae R6
aucauuuccauug

SEQ ID NO: 4073952 - RNA, 20 nt, Streptococcus pneumoniae R6
aucauuuccuucguuuucac

SEQ ID NO: 4073953 - RNA, 15 nt, Streptococcus pneumoniae R6
aucauuucuucaaca

SEQ ID NO: 4073954 - RNA, 20 nt, Streptococcus pneumoniae R6
aucauuucuucuggaaguuc

SEQ ID NO: 4073955 - RNA, 18 nt, Streptococcus pneumoniae R6
aucauuugaaucaaaaau

SEQ ID NO: 4073956 - RNA, 16 nt, Streptococcus pneumoniae R6
aucauuuggaaaacaa

SEQ ID NO: 4073957 - RNA, 15 nt, Streptococcus pneumoniae R6
aucauuuuauucaua

SEQ ID NO: 4073958 - RNA, 19 nt, Streptococcus pneumoniae R6
aucauuuuauucauauccc

SEQ ID NO: 4073959 - RNA, 21 nt, Streptococcus pneumoniae R6
aucauuuuauucauaucccca

SEQ ID NO: 4073960 - RNA, 20 nt, Streptococcus pneumoniae R6
auccaaaaaaucuuccuaca

SEQ ID NO: 4073961 - RNA, 13 nt, Streptococcus pneumoniae R6
auccaaaaccauu

SEQ ID NO: 4073962 - RNA, 19 nt, Streptococcus pneumoniae R6
auccaaaaccauucaaaau

SEQ ID NO: 4073963 - RNA, 16 nt, Streptococcus pneumoniae R6
auccaaaagcaggagu

SEQ ID NO: 4073964 - RNA, 13 nt, Streptococcus pneumoniae R6
auccaaaauaugc

SEQ ID NO: 4073965 - RNA, 20 nt, Streptococcus pneumoniae R6
auccaaacgauuaucuaaca

SEQ ID NO: 4073966 - RNA, 20 nt, Streptococcus pneumoniae R6
auccaaauaaguaguguuag

SEQ ID NO: 4073967 - RNA, 20 nt, Streptococcus pneumoniae R6
auccaacucaggaaagauga

SEQ ID NO: 4073968 - RNA, 23 nt, Streptococcus pneumoniae R6
auccaagcgucugaggcaacaaa

SEQ ID NO: 4073969 - RNA, 12 nt, Streptococcus pneumoniae R6
auccaagcuucu

SEQ ID NO: 4073970 - RNA, 22 nt, Streptococcus pneumoniae R6
auccaaguuuggcagacaccaa

SEQ ID NO: 4073971 - RNA, 18 nt, Streptococcus pneumoniae R6
auccaauccuuuucuuuu

SEQ ID NO: 4073972 - RNA, 13 nt, Streptococcus pneumoniae R6
auccaaucuauuu

SEQ ID NO: 4073973 - RNA, 13 nt, Streptococcus pneumoniae R6
auccaauucuuca

SEQ ID NO: 4073974 - RNA, 16 nt, Streptococcus pneumoniae R6
auccaauucuucagca

SEQ ID NO: 4073975 - RNA, 15 nt, Streptococcus pneumoniae R6
auccaauuucuaacg

SEQ ID NO: 4073976 - RNA, 12 nt, Streptococcus pneumoniae R6
auccacaaccuc

SEQ ID NO: 4073977 - RNA, 15 nt, Streptococcus pneumoniae R6
auccacaaccucaaa

SEQ ID NO: 4073978 - RNA, 18 nt, Streptococcus pneumoniae R6
auccacaucaucaaaugu

SEQ ID NO: 4073979 - RNA, 14 nt, Streptococcus pneumoniae R6
auccacccccaaga

SEQ ID NO: 4073980 - RNA, 16 nt, Streptococcus pneumoniae R6
auccaccuauuauaca

SEQ ID NO: 4073981 - RNA, 21 nt, Streptococcus pneumoniae R6
auccaccuauuauacaaaguu

SEQ ID NO: 4073982 - RNA, 22 nt, Streptococcus pneumoniae R6
auccacguuuacgaaucucuuu

SEQ ID NO: 4073983 - RNA, 18 nt, Streptococcus pneumoniae R6
auccacuauaauaaaaug

SEQ ID NO: 4073984 - RNA, 18 nt, Streptococcus pneumoniae R6
auccacuugggaaaccaa

SEQ ID NO: 4073985 - RNA, 19 nt, Streptococcus pneumoniae R6
auccacuuguaaagcgaaa

SEQ ID NO: 4073986 - RNA, 22 nt, Streptococcus pneumoniae R6
aucgucucacgguaaauguaga

SEQ ID NO: 4073987 - RNA, 16 nt, Streptococcus pneumoniae R6
aucgugaguuccuguu

SEQ ID NO: 4073988 - RNA, 20 nt, Streptococcus pneumoniae R6
aucguguugaaauuguucac

SEQ ID NO: 4073989 - RNA, 16 nt, Streptococcus pneumoniae R6
aucguucaggacaguc

SEQ ID NO: 4073990 - RNA, 21 nt, Streptococcus pneumoniae R6
aucguucaggacagucaaauc

SEQ ID NO: 4073991 - RNA, 16 nt, Streptococcus pneumoniae R6
aucuaaaaaaaugaua

SEQ ID NO: 4073992 - RNA, 13 nt, Streptococcus pneumoniae R6
aucuaaaacuggu

SEQ ID NO: 4073993 - RNA, 16 nt, Streptococcus pneumoniae R6
aucuaaaauagaagga

SEQ ID NO: 4073994 - RNA, 24 nt, Streptococcus pneumoniae R6
aucuaacaauaagauaucacucau

SEQ ID NO: 4073995 - RNA, 13 nt, Streptococcus pneumoniae R6
aucuaagacugcu

SEQ ID NO: 4073996 - RNA, 20 nt, Streptococcus pneumoniae R6
aucuaagcauuuaauccaaa

SEQ ID NO: 4073997 - RNA, 21 nt, Streptococcus pneumoniae R6
aucuaagguauauucaaaaua

SEQ ID NO: 4073998 - RNA, 19 nt, Streptococcus pneumoniae R6
aucuaauacccauuuaugg

SEQ ID NO: 4073999 - RNA, 13 nt, Streptococcus pneumoniae R6
aucuaauagacua

SEQ ID NO: 4074000 - RNA, 19 nt, Streptococcus pneumoniae R6
aucuacaaccucaaaaaca

SEQ ID NO: 4074001 - RNA, 18 nt, Streptococcus pneumoniae R6
aucuacaaccucaaaacc

SEQ ID NO: 4074002 - RNA, 19 nt, Streptococcus pneumoniae R6
aucuacaaccucaaaacca

SEQ ID NO: 4074003 - RNA, 12 nt, Streptococcus pneumoniae R6
aucuacaaccuu

SEQ ID NO: 4074004 - RNA, 15 nt, Streptococcus pneumoniae R6
aucuacaaccuuaaa

SEQ ID NO: 4074005 - RNA, 14 nt, Streptococcus pneumoniae R6
aucuacaauugaaa

SEQ ID NO: 4074006 - RNA, 18 nt, Streptococcus pneumoniae R6
aucuacgcuuuaaaaauc

SEQ ID NO: 4074007 - RNA, 18 nt, Streptococcus pneumoniae R6
aucuacuaucucuacauu

SEQ ID NO: 4074008 - RNA, 18 nt, Streptococcus pneumoniae R6
aucuacuggcaaauuuuc

SEQ ID NO: 4074009 - RNA, 19 nt, Streptococcus pneumoniae R6
aucuacuggcaaauuuucu

SEQ ID NO: 4074010 - RNA, 17 nt, Streptococcus pneumoniae R6
aucuacuucuuuaacua

SEQ ID NO: 4074011 - RNA, 16 nt, Streptococcus pneumoniae R6
aucuacuuuuuucuaa

SEQ ID NO: 4074012 - RNA, 22 nt, Streptococcus pneumoniae R6
aucuacuuuuuucuaaagcaau

SEQ ID NO: 4074013 - RNA, 13 nt, Streptococcus pneumoniae R6
aucuagauaguac

SEQ ID NO: 4074014 - RNA, 20 nt, Streptococcus pneumoniae R6
aucuagcgcaaagcuaaauc

SEQ ID NO: 4074015 - RNA, 17 nt, Streptococcus pneumoniae R6
aucuagcucccuuaguu

SEQ ID NO: 4074016 - RNA, 18 nt, Streptococcus pneumoniae R6
aucuagcugagacaggga

SEQ ID NO: 4074017 - RNA, 15 nt, Streptococcus pneumoniae R6
aucuaggucaacagg

SEQ ID NO: 4074018 - RNA, 20 nt, Streptococcus pneumoniae R6
aucuaguaaaucgauuuuua

SEQ ID NO: 4074019 - RNA, 22 nt, Streptococcus pneumoniae R6
aucuaguaaaucgauuuuuaug

SEQ ID NO: 4074020 - RNA, 14 nt, Streptococcus pneumoniae R6
aucuagucaucaga

SEQ ID NO: 4074021 - RNA, 16 nt, Streptococcus pneumoniae R6
aucuagucgaagcuuc

SEQ ID NO: 4074022 - RNA, 15 nt, Streptococcus pneumoniae R6
aucuagucguuuaag

SEQ ID NO: 4074023 - RNA, 15 nt, Streptococcus pneumoniae R6
aucuaucuauuuuua

SEQ ID NO: 4074024 - RNA, 20 nt, Streptococcus pneumoniae R6
aucuauuccuagucagaaua

SEQ ID NO: 4074025 - RNA, 19 nt, Streptococcus pneumoniae R6
aucuauuuaugaaaaaguu

SEQ ID NO: 4074026 - RNA, 15 nt, Streptococcus pneumoniae R6
aucuauuuuuaaauu

SEQ ID NO: 4074027 - RNA, 17 nt, Streptococcus pneumoniae R6
aucuauuuuuacucaag

SEQ ID NO: 4074028 - RNA, 18 nt, Streptococcus pneumoniae R6
aucucaaaacaguguuuu

SEQ ID NO: 4074029 - RNA, 20 nt, Streptococcus pneumoniae R6
aucucacguaacauauuuuc

SEQ ID NO: 4074030 - RNA, 21 nt, Streptococcus pneumoniae R6
aucucacguaacauauuuuca

SEQ ID NO: 4074031 - RNA, 19 nt, Streptococcus pneumoniae R6
aucuccaaccaucaaaaua

SEQ ID NO: 4074032 - RNA, 19 nt, Streptococcus pneumoniae R6
aucuccaacugcaaagaua

SEQ ID NO: 4074033 - RNA, 21 nt, Streptococcus pneumoniae R6
aucuccaacugcaaagauacc

SEQ ID NO: 4074034 - RNA, 13 nt, Streptococcus pneumoniae R6
aucuccaacugcu

SEQ ID NO: 4074035 - RNA, 21 nt, Streptococcus pneumoniae R6
aucuccaacugcuguuguuac

SEQ ID NO: 4074036 - RNA, 21 nt, Streptococcus pneumoniae R6
aucuccaccaccgauauauug

SEQ ID NO: 4074037 - RNA, 20 nt, Streptococcus pneumoniae R6
aucuccagaccaccuuccuu

SEQ ID NO: 4074038 - RNA, 17 nt, Streptococcus pneumoniae R6
aucuccagauagagcua

SEQ ID NO: 4074039 - RNA, 19 nt, Streptococcus pneumoniae R6
aucuccguuuuuaaucaua

SEQ ID NO: 4074040 - RNA, 23 nt, Streptococcus pneumoniae R6
aucuccguuuuuaaucauacaca

SEQ ID NO: 4074041 - RNA, 13 nt, Streptococcus pneumoniae R6
aucuccuacuucc

SEQ ID NO: 4074042 - RNA, 18 nt, Streptococcus pneumoniae R6
aucucggucaucaucacu

SEQ ID NO: 4074043 - RNA, 22 nt, Streptococcus pneumoniae R6
aucucgugcauuucauccccau

SEQ ID NO: 4074044 - RNA, 20 nt, Streptococcus pneumoniae R6
aucucuacauucccaaacaa

SEQ ID NO: 4074045 - RNA, 16 nt, Streptococcus pneumoniae R6
aucucuacuacuugaa

SEQ ID NO: 4074046 - RNA, 13 nt, Streptococcus pneumoniae R6
aucucuccuuauc

SEQ ID NO: 4074047 - RNA, 15 nt, Streptococcus pneumoniae R6
aucucuccuuaucaa

SEQ ID NO: 4074048 - RNA, 14 nt, Streptococcus pneumoniae R6
aucucucuauaaua

SEQ ID NO: 4074049 - RNA, 13 nt, Streptococcus pneumoniae R6
aucucucugcgga

SEQ ID NO: 4074050 - RNA, 21 nt, Streptococcus pneumoniae R6
aucucugauaauauuuucuuu

SEQ ID NO: 4074051 - RNA, 20 nt, Streptococcus pneumoniae R6
aucucuggaucuacuuuuuu

SEQ ID NO: 4074052 - RNA, 16 nt, Streptococcus pneumoniae R6
aucucuuacaguuugc

SEQ ID NO: 4074053 - RNA, 16 nt, Streptococcus pneumoniae R6
aucucuuagaccaagu

SEQ ID NO: 4074054 - RNA, 20 nt, Streptococcus pneumoniae R6
aucucuuagaucuagauuaa

SEQ ID NO: 4074055 - RNA, 15 nt, Streptococcus pneumoniae R6
aucucuuuccacacu

SEQ ID NO: 4074056 - RNA, 23 nt, Streptococcus pneumoniae R6
aucucuuugaaggugauaaucau

SEQ ID NO: 4074057 - RNA, 17 nt, Streptococcus pneumoniae R6
aucugaaaaauuaacaa

SEQ ID NO: 4074058 - RNA, 20 nt, Streptococcus pneumoniae R6
aucugaaaucccuuguucca

SEQ ID NO: 4074059 - RNA, 23 nt, Streptococcus pneumoniae R6
aucugaaccugauuggccgcaag

SEQ ID NO: 4074060 - RNA, 14 nt, Streptococcus pneumoniae R6
aucugaagaaagca

SEQ ID NO: 4074061 - RNA, 11 nt, Streptococcus pneumoniae R6
aucugaagcuu

SEQ ID NO: 4074062 - RNA, 13 nt, Streptococcus pneumoniae R6
aucugaaucaaaa

SEQ ID NO: 4074063 - RNA, 20 nt, Streptococcus pneumoniae R6
aucugagguguaaguccucg

SEQ ID NO: 4074064 - RNA, 17 nt, Streptococcus pneumoniae R6
aucugauaaacucccac

SEQ ID NO: 4074065 - RNA, 13 nt, Streptococcus pneumoniae R6
aucugauauauuu

SEQ ID NO: 4074066 - RNA, 12 nt, Streptococcus pneumoniae R6
aucugcaaccuc

SEQ ID NO: 4074067 - RNA, 18 nt, Streptococcus pneumoniae R6
aucugcaaccucaaaaca

SEQ ID NO: 4074068 - RNA, 17 nt, Streptococcus pneumoniae R6
aucugcaaccuuaaaac

SEQ ID NO: 4074069 - RNA, 19 nt, Streptococcus pneumoniae R6
aucugcaaccuuaaaacag

SEQ ID NO: 4074070 - RNA, 14 nt, Streptococcus pneumoniae R6
aucugcaauaacaa

SEQ ID NO: 4074071 - RNA, 16 nt, Streptococcus pneumoniae R6
aucugcagaauacucu

SEQ ID NO: 4074072 - RNA, 19 nt, Streptococcus pneumoniae R6
aucugcagccucaaaacac

SEQ ID NO: 4074073 - RNA, 11 nt, Streptococcus pneumoniae R6
aucugcaugac

SEQ ID NO: 4074074 - RNA, 13 nt, Streptococcus pneumoniae R6
aucugcccaaaga

SEQ ID NO: 4074075 - RNA, 14 nt, Streptococcus pneumoniae R6
aucugcccaaagac

SEQ ID NO: 4074076 - RNA, 19 nt, Streptococcus pneumoniae R6
aucugccuuuuuauccaaa

SEQ ID NO: 4074077 - RNA, 18 nt, Streptococcus pneumoniae R6
aucugcuaaaacaaaauu

SEQ ID NO: 4074078 - RNA, 18 nt, Streptococcus pneumoniae R6
aucugcucaaucuuauca

SEQ ID NO: 4074079 - RNA, 14 nt, Streptococcus pneumoniae R6
aucuggaguagcau

SEQ ID NO: 4074080 - RNA, 14 nt, Streptococcus pneumoniae R6
aucuggauuuucaa

SEQ ID NO: 4074081 - RNA, 20 nt, Streptococcus pneumoniae R6
aucuggauuuucagccucua

SEQ ID NO: 4074082 - RNA, 19 nt, Streptococcus pneumoniae R6
aucuggcuuucuguaaucu

SEQ ID NO: 4074083 - RNA, 19 nt, Streptococcus pneumoniae R6
aucugguacucacuuacau

SEQ ID NO: 4074084 - RNA, 22 nt, Streptococcus pneumoniae R6
aucuguaauaugaacaaaaccu

SEQ ID NO: 4074085 - RNA, 20 nt, Streptococcus pneumoniae R6
aucuguacgguaaucaagug

SEQ ID NO: 4074086 - RNA, 16 nt, Streptococcus pneumoniae R6
aucugucguuagcaca

SEQ ID NO: 4074087 - RNA, 21 nt, Streptococcus pneumoniae R6
aucugucuaccuucaggagau

SEQ ID NO: 4074088 - RNA, 12 nt, Streptococcus pneumoniae R6
augaauauauuc

SEQ ID NO: 4074089 - RNA, 16 nt, Streptococcus pneumoniae R6
augaaucugaaucaaa

SEQ ID NO: 4074090 - RNA, 18 nt, Streptococcus pneumoniae R6
augaaucugaaucaaaau

SEQ ID NO: 4074091 - RNA, 13 nt, Streptococcus pneumoniae R6
augaauuucuaca

SEQ ID NO: 4074092 - RNA, 14 nt, Streptococcus pneumoniae R6
augaauuucuacaa

SEQ ID NO: 4074093 - RNA, 15 nt, Streptococcus pneumoniae R6
augaauuugaaacaa

SEQ ID NO: 4074094 - RNA, 18 nt, Streptococcus pneumoniae R6
augacaaaacguucccaa

SEQ ID NO: 4074095 - RNA, 19 nt, Streptococcus pneumoniae R6
augacaaaacguucccaac

SEQ ID NO: 4074096 - RNA, 20 nt, Streptococcus pneumoniae R6
augacaaaguacuugagaau

SEQ ID NO: 4074097 - RNA, 17 nt, Streptococcus pneumoniae R6
augacaaauccauucuu

SEQ ID NO: 4074098 - RNA, 23 nt, Streptococcus pneumoniae R6
augacaaaucuaagucaaauaag

SEQ ID NO: 4074099 - RNA, 14 nt, Streptococcus pneumoniae R6
augacaauaaaaua

SEQ ID NO: 4074100 - RNA, 14 nt, Streptococcus pneumoniae R6
augacaaucaagac

SEQ ID NO: 4074101 - RNA, 13 nt, Streptococcus pneumoniae R6
augacaauuauau

SEQ ID NO: 4074102 - RNA, 16 nt, Streptococcus pneumoniae R6
augacaauuauauaaa

SEQ ID NO: 4074103 - RNA, 15 nt, Streptococcus pneumoniae R6
augacaauuuuucca

SEQ ID NO: 4074104 - RNA, 18 nt, Streptococcus pneumoniae R6
augacacguaucggaaau

SEQ ID NO: 4074105 - RNA, 21 nt, Streptococcus pneumoniae R6
augacacguaucggaaauauu

SEQ ID NO: 4074106 - RNA, 17 nt, Streptococcus pneumoniae R6
augacaucuaaauaaua

SEQ ID NO: 4074107 - RNA, 13 nt, Streptococcus pneumoniae R6
augacaucuucca

SEQ ID NO: 4074108 - RNA, 22 nt, Streptococcus pneumoniae R6
augacaucuuggaguugauuca

SEQ ID NO: 4074109 - RNA, 17 nt, Streptococcus pneumoniae R6
augaccagaauagcugu

SEQ ID NO: 4074110 - RNA, 18 nt, Streptococcus pneumoniae R6
augacccaagcuuuaugc

SEQ ID NO: 4074111 - RNA, 16 nt, Streptococcus pneumoniae R6
augaccccuaaauaua

SEQ ID NO: 4074112 - RNA, 15 nt, Streptococcus pneumoniae R6
augacgaaacgaaga

SEQ ID NO: 4074113 - RNA, 16 nt, Streptococcus pneumoniae R6
augacgaaacgaagaa

SEQ ID NO: 4074114 - RNA, 22 nt, Streptococcus pneumoniae R6
augacuaacaauuaauucuaaa

SEQ ID NO: 4074115 - RNA, 16 nt, Streptococcus pneumoniae R6
augacuauaccacucu

SEQ ID NO: 4074116 - RNA, 20 nt, Streptococcus pneumoniae R6
augacucccauaaaaauaau

SEQ ID NO: 4074117 - RNA, 12 nt, Streptococcus pneumoniae R6
augacugagagc

SEQ ID NO: 4074118 - RNA, 18 nt, Streptococcus pneumoniae R6
augacuguuaaucaugau

SEQ ID NO: 4074119 - RNA, 13 nt, Streptococcus pneumoniae R6
augacuucuuaau

SEQ ID NO: 4074120 - RNA, 13 nt, Streptococcus pneumoniae R6
augacuugcaauc

SEQ ID NO: 4074121 - RNA, 22 nt, Streptococcus pneumoniae R6
augacuuguguuuuuccuuuga

SEQ ID NO: 4074122 - RNA, 20 nt, Streptococcus pneumoniae R6
augacuuuccacaauuuuca

SEQ ID NO: 4074123 - RNA, 22 nt, Streptococcus pneumoniae R6
augacuuucuaauuauuucaau

SEQ ID NO: 4074124 - RNA, 15 nt, Streptococcus pneumoniae R6
augagaaagauuuuc

SEQ ID NO: 4074125 - RNA, 23 nt, Streptococcus pneumoniae R6
augagaaguuuuauuaggaagaa

SEQ ID NO: 4074126 - RNA, 16 nt, Streptococcus pneumoniae R6
augagaauacaaaaau

SEQ ID NO: 4074127 - RNA, 12 nt, Streptococcus pneumoniae R6
augagaauaucg

SEQ ID NO: 4074128 - RNA, 11 nt, Streptococcus pneumoniae R6
augagagauuc

SEQ ID NO: 4074129 - RNA, 16 nt, Streptococcus pneumoniae R6
augagaggcaacagaa

SEQ ID NO: 4074130 - RNA, 17 nt, Streptococcus pneumoniae R6
augagaggcaacagaaa

SEQ ID NO: 4074131 - RNA, 13 nt, Streptococcus pneumoniae R6
augagaguuugau

SEQ ID NO: 4074132 - RNA, 15 nt, Streptococcus pneumoniae R6
augagauaauacaau

SEQ ID NO: 4074133 - RNA, 15 nt, Streptococcus pneumoniae R6
augagauuauugguc

SEQ ID NO: 4074134 - RNA, 19 nt, Streptococcus pneumoniae R6
augagauuucgcuccagca

SEQ ID NO: 4074135 - RNA, 23 nt, Streptococcus pneumoniae R6
augagcacuauuguuauuuuucu

SEQ ID NO: 4074136 - RNA, 13 nt, Streptococcus pneumoniae R6
augagccaaggaa

SEQ ID NO: 4074137 - RNA, 15 nt, Streptococcus pneumoniae R6
augagcgucuuucuu

SEQ ID NO: 4074138 - RNA, 22 nt, Streptococcus pneumoniae R6
augagcuccguacgcuccugaa

SEQ ID NO: 4074139 - RNA, 16 nt, Streptococcus pneumoniae R6
augagcuggaagaauu

SEQ ID NO: 4074140 - RNA, 17 nt, Streptococcus pneumoniae R6
augagcuggaagaauuu

SEQ ID NO: 4074141 - RNA, 23 nt, Streptococcus pneumoniae R6
augaggaaaaucuucccacaaua

SEQ ID NO: 4074142 - RNA, 16 nt, Streptococcus pneumoniae R6
augaggagaaagaaga

SEQ ID NO: 4074143 - RNA, 20 nt, Streptococcus pneumoniae R6
augaggauggcuuucuuuca

SEQ ID NO: 4074144 - RNA, 14 nt, Streptococcus pneumoniae R6
augagggcagggau

SEQ ID NO: 4074145 - RNA, 22 nt, Streptococcus pneumoniae R6
augagguuucgcauuugagcga

SEQ ID NO: 4074146 - RNA, 19 nt, Streptococcus pneumoniae R6
augaguauaagguuacuuu

SEQ ID NO: 4074147 - RNA, 22 nt, Streptococcus pneumoniae R6
augaguauaagguuacuuuaua

SEQ ID NO: 4074148 - RNA, 21 nt, Streptococcus pneumoniae R6
augaguccgaaaaauuucuca

SEQ ID NO: 4074149 - RNA, 21 nt, Streptococcus pneumoniae R6
augagucuaucaaacaggaug

SEQ ID NO: 4074150 - RNA, 20 nt, Streptococcus pneumoniae R6
augaguggagccccuugaua

SEQ ID NO: 4074151 - RNA, 17 nt, Streptococcus pneumoniae R6
augaguggcaggaauau

SEQ ID NO: 4074152 - RNA, 19 nt, Streptococcus pneumoniae R6
augaguguuugcaaagaug

SEQ ID NO: 4074153 - RNA, 14 nt, Streptococcus pneumoniae R6
augaguuaccuaaa

SEQ ID NO: 4074154 - RNA, 17 nt, Streptococcus pneumoniae R6
augauaauagauauaau

SEQ ID NO: 4074155 - RNA, 14 nt, Streptococcus pneumoniae R6
augauacccaaaau

SEQ ID NO: 4074156 - RNA, 19 nt, Streptococcus pneumoniae R6
augauauacacacuuaaau

SEQ ID NO: 4074157 - RNA, 20 nt, Streptococcus pneumoniae R6
augauauacacacuuaaauu

SEQ ID NO: 4074158 - RNA, 19 nt, Streptococcus pneumoniae R6
augauaucugguauauuuu

SEQ ID NO: 4074159 - RNA, 22 nt, Streptococcus pneumoniae R6
augauaucugguauauuuuguu

SEQ ID NO: 4074160 - RNA, 15 nt, Streptococcus pneumoniae R6
augauauuuucaaaa

SEQ ID NO: 4074161 - RNA, 15 nt, Streptococcus pneumoniae R6
augauccuucauucg

SEQ ID NO: 4074162 - RNA, 16 nt, Streptococcus pneumoniae R6
augaucuaaauguauu

SEQ ID NO: 4074163 - RNA, 20 nt, Streptococcus pneumoniae R6
augaucuauuccuagucaga

SEQ ID NO: 4074164 - RNA, 23 nt, Streptococcus pneumoniae R6
augaucuauuguugcauuaaaaa

SEQ ID NO: 4074165 - RNA, 19 nt, Streptococcus pneumoniae R6
augaugacaccugaaacau

SEQ ID NO: 4074166 - RNA, 16 nt, Streptococcus pneumoniae R6
augaugcguuuuauaa

SEQ ID NO: 4074167 - RNA, 22 nt, Streptococcus pneumoniae R6
augaugcguuuuauaauuuuaa

SEQ ID NO: 4074168 - RNA, 18 nt, Streptococcus pneumoniae R6
augaugcuuacugcugcc

SEQ ID NO: 4074169 - RNA, 14 nt, Streptococcus pneumoniae R6
augauggaagacug

SEQ ID NO: 4074170 - RNA, 15 nt, Streptococcus pneumoniae R6
augauuaaucaaaug

SEQ ID NO: 4074171 - RNA, 22 nt, Streptococcus pneumoniae R6
augauuaaucaaaugagcauag

SEQ ID NO: 4074172 - RNA, 12 nt, Streptococcus pneumoniae R6
augauuagaaau

SEQ ID NO: 4074173 - RNA, 18 nt, Streptococcus pneumoniae R6
augauucugaaauaacuc

SEQ ID NO: 4074174 - RNA, 17 nt, Streptococcus pneumoniae R6
augauucuuuucaaaau

SEQ ID NO: 4074175 - RNA, 14 nt, Streptococcus pneumoniae R6
augauugaaaggau

SEQ ID NO: 4074176 - RNA, 17 nt, Streptococcus pneumoniae R6
augauugaccucuggau

SEQ ID NO: 4074177 - RNA, 22 nt, Streptococcus pneumoniae R6
augauugagaaaguuaaaaaaa

SEQ ID NO: 4074178 - RNA, 18 nt, Streptococcus pneumoniae R6
augauuuaauuagaaaaa

SEQ ID NO: 4074179 - RNA, 20 nt, Streptococcus pneumoniae R6
augauuuaauuagaaaaaaa

SEQ ID NO: 4074180 - RNA, 23 nt, Streptococcus pneumoniae R6
augauuuaauuagaaaaaaauuu

SEQ ID NO: 4074181 - RNA, 17 nt, Streptococcus pneumoniae R6
augauuucaauuuuaaa

SEQ ID NO: 4074182 - RNA, 17 nt, Streptococcus pneumoniae R6
augauuugagugaauag

SEQ ID NO: 4074183 - RNA, 21 nt, Streptococcus pneumoniae R6
augauuuggcgaugauuuuag

SEQ ID NO: 4074184 - RNA, 14 nt, Streptococcus pneumoniae R6
augauuuuuuacug

SEQ ID NO: 4074185 - RNA, 15 nt, Streptococcus pneumoniae R6
augcaaaaaaaauga

SEQ ID NO: 4074186 - RNA, 13 nt, Streptococcus pneumoniae R6
augcaagauauuc

SEQ ID NO: 4074187 - RNA, 23 nt, Streptococcus pneumoniae R6
augcaauuucuuuauauaaaaag

SEQ ID NO: 4074188 - RNA, 15 nt, Streptococcus pneumoniae R6
augcacauauacacu

SEQ ID NO: 4074189 - RNA, 20 nt, Streptococcus pneumoniae R6
augcacauauacacuuaaau

SEQ ID NO: 4074190 - RNA, 18 nt, Streptococcus pneumoniae R6
augcagacugcuucggga

SEQ ID NO: 4074191 - RNA, 17 nt, Streptococcus pneumoniae R6
auguaauuucugaaauc

SEQ ID NO: 4074192 - RNA, 22 nt, Streptococcus pneumoniae R6
auguaauuucugaaaucaacac

SEQ ID NO: 4074193 - RNA, 14 nt, Streptococcus pneumoniae R6
auguaccuaagauu

SEQ ID NO: 4074194 - RNA, 17 nt, Streptococcus pneumoniae R6
auguaccugcaaauuua

SEQ ID NO: 4074195 - RNA, 14 nt, Streptococcus pneumoniae R6
auguacuaggcguc

SEQ ID NO: 4074196 - RNA, 14 nt, Streptococcus pneumoniae R6
auguagccacucug

SEQ ID NO: 4074197 - RNA, 17 nt, Streptococcus pneumoniae R6
auguagccacucuggca

SEQ ID NO: 4074198 - RNA, 18 nt, Streptococcus pneumoniae R6
auguagcgcuugaaacuc

SEQ ID NO: 4074199 - RNA, 16 nt, Streptococcus pneumoniae R6
auguaggcuagcaaca

SEQ ID NO: 4074200 - RNA, 18 nt, Streptococcus pneumoniae R6
auguagucaaucaaaaug

SEQ ID NO: 4074201 - RNA, 17 nt, Streptococcus pneumoniae R6
auguagucauucgaaug

SEQ ID NO: 4074202 - RNA, 20 nt, Streptococcus pneumoniae R6
auguaguucaaaacugccuu

SEQ ID NO: 4074203 - RNA, 21 nt, Streptococcus pneumoniae R6
auguauggacgaagugcuucu

SEQ ID NO: 4074204 - RNA, 22 nt, Streptococcus pneumoniae R6
auguauugaaucuagaauaguc

SEQ ID NO: 4074205 - RNA, 22 nt, Streptococcus pneumoniae R6
augucagcugaaagcaaguuuu

SEQ ID NO: 4074206 - RNA, 21 nt, Streptococcus pneumoniae R6
augucauguuagaaaaaugca

SEQ ID NO: 4074207 - RNA, 18 nt, Streptococcus pneumoniae R6
auguccauaacugcugcu

SEQ ID NO: 4074208 - RNA, 14 nt, Streptococcus pneumoniae R6
auguccgccuuuga

SEQ ID NO: 4074209 - RNA, 21 nt, Streptococcus pneumoniae R6
auguccuggauagacaucgua

SEQ ID NO: 4074210 - RNA, 21 nt, Streptococcus pneumoniae R6
auguccuugauagcagaauuu

SEQ ID NO: 4074211 - RNA, 20 nt, Streptococcus pneumoniae R6
augucguucaagguaauaau

SEQ ID NO: 4074212 - RNA, 13 nt, Streptococcus pneumoniae R6
augucuaaaucuu

SEQ ID NO: 4074213 - RNA, 15 nt, Streptococcus pneumoniae R6
augucuuggauuuuu

SEQ ID NO: 4074214 - RNA, 17 nt, Streptococcus pneumoniae R6
augucuuggauuuuuga

SEQ ID NO: 4074215 - RNA, 22 nt, Streptococcus pneumoniae R6
augugacgggcguuugacaagu

SEQ ID NO: 4074216 - RNA, 20 nt, Streptococcus pneumoniae R6
auguguuaccgguuacauau

SEQ ID NO: 4074217 - RNA, 21 nt, Streptococcus pneumoniae R6
auguguuaccgguuacauaua

SEQ ID NO: 4074218 - RNA, 14 nt, Streptococcus pneumoniae R6
auguuaaccacaaa

SEQ ID NO: 4074219 - RNA, 20 nt, Streptococcus pneumoniae R6
auguuaagugcuucuuugua

SEQ ID NO: 4074220 - RNA, 14 nt, Streptococcus pneumoniae R6
auguuacugacuuc

SEQ ID NO: 4074221 - RNA, 22 nt, Streptococcus pneumoniae R6
auguuacugacuucgucaguuc

SEQ ID NO: 4074222 - RNA, 19 nt, Streptococcus pneumoniae R6
auguuacugauuucgucag

SEQ ID NO: 4074223 - RNA, 22 nt, Streptococcus pneumoniae R6
auguuacugauuucgucaguuc

SEQ ID NO: 4074224 - RNA, 18 nt, Streptococcus pneumoniae R6
auguuacuucugaaucug

SEQ ID NO: 4074225 - RNA, 13 nt, Streptococcus pneumoniae R6
auguuagaaaaau

SEQ ID NO: 4074226 - RNA, 13 nt, Streptococcus pneumoniae R6
auguuauccuauu

SEQ ID NO: 4074227 - RNA, 12 nt, Streptococcus pneumoniae R6
auguuaugauuc

SEQ ID NO: 4074228 - RNA, 17 nt, Streptococcus pneumoniae R6
auguucaaagauuuuau

SEQ ID NO: 4074229 - RNA, 13 nt, Streptococcus pneumoniae R6
auguucaagacau

SEQ ID NO: 4074230 - RNA, 16 nt, Streptococcus pneumoniae R6
auguucaguuucuauu

SEQ ID NO: 4074231 - RNA, 23 nt, Streptococcus pneumoniae R6
auguucaguuucuauuucauuuu

SEQ ID NO: 4074232 - RNA, 13 nt, Streptococcus pneumoniae R6
auguucaucuucu

SEQ ID NO: 4074233 - RNA, 19 nt, Streptococcus pneumoniae R6
auguucaucuucuuucucc

SEQ ID NO: 4074234 - RNA, 12 nt, Streptococcus pneumoniae R6
auguucuaagaa

SEQ ID NO: 4074235 - RNA, 20 nt, Streptococcus pneumoniae R6
auguucuguaaugaaauacu

SEQ ID NO: 4074236 - RNA, 22 nt, Streptococcus pneumoniae R6
auguugaauaguuuaguaaguc

SEQ ID NO: 4074237 - RNA, 16 nt, Streptococcus pneumoniae R6
auguugguaagagaaa

SEQ ID NO: 4074238 - RNA, 19 nt, Streptococcus pneumoniae R6
auguugucaauuuccauuu

SEQ ID NO: 4074239 - RNA, 21 nt, Streptococcus pneumoniae R6
auguuuacucaguauuuggau

SEQ ID NO: 4074240 - RNA, 19 nt, Streptococcus pneumoniae R6
auguuucaagucuuccgaa

SEQ ID NO: 4074241 - RNA, 20 nt, Streptococcus pneumoniae R6
auguuuccugcaaagaguug

SEQ ID NO: 4074242 - RNA, 21 nt, Streptococcus pneumoniae R6
auguuucggaucauauuuucu

SEQ ID NO: 4074243 - RNA, 17 nt, Streptococcus pneumoniae R6
auguuuuagaaaucaca

SEQ ID NO: 4074244 - RNA, 22 nt, Streptococcus pneumoniae R6
auguuuucucauagccauaaaa

SEQ ID NO: 4074245 - RNA, 18 nt, Streptococcus pneumoniae R6
auguuuugagcugacuuc

SEQ ID NO: 4074246 - RNA, 16 nt, Streptococcus pneumoniae R6
auguuuuucuccuauu

SEQ ID NO: 4074247 - RNA, 18 nt, Streptococcus pneumoniae R6
auuaaaaagaguagaaau

SEQ ID NO: 4074248 - RNA, 19 nt, Streptococcus pneumoniae R6
auuaaaaagaguagaaauu

SEQ ID NO: 4074249 - RNA, 14 nt, Streptococcus pneumoniae R6
auuaaaacugccuu

SEQ ID NO: 4074250 - RNA, 15 nt, Streptococcus pneumoniae R6
auuaaaacuucgaua

SEQ ID NO: 4074251 - RNA, 18 nt, Streptococcus pneumoniae R6
auuaaaaggcucauaaau

SEQ ID NO: 4074252 - RNA, 16 nt, Streptococcus pneumoniae R6
auuaaaaugcaagaca

SEQ ID NO: 4074253 - RNA, 15 nt, Streptococcus pneumoniae R6
auuaaacaaaaagaa

SEQ ID NO: 4074254 - RNA, 13 nt, Streptococcus pneumoniae R6
auuaaaccuucca

SEQ ID NO: 4074255 - RNA, 13 nt, Streptococcus pneumoniae R6
auuaaagaccaaa

SEQ ID NO: 4074256 - RNA, 18 nt, Streptococcus pneumoniae R6
auuaaagagaugagagau

SEQ ID NO: 4074257 - RNA, 20 nt, Streptococcus pneumoniae R6
auuaaaguuuaacccacuua

SEQ ID NO: 4074258 - RNA, 21 nt, Streptococcus pneumoniae R6
auuaaauaugaacaaaucaau

SEQ ID NO: 4074259 - RNA, 16 nt, Streptococcus pneumoniae R6
auuaaaucauccauau

SEQ ID NO: 4074260 - RNA, 12 nt, Streptococcus pneumoniae R6
auuaaauuuuuu

SEQ ID NO: 4074261 - RNA, 12 nt, Streptococcus pneumoniae R6
auuaacaaaaag

SEQ ID NO: 4074262 - RNA, 14 nt, Streptococcus pneumoniae R6
auuaacaaaagagc

SEQ ID NO: 4074263 - RNA, 12 nt, Streptococcus pneumoniae R6
auuaacaauaau

SEQ ID NO: 4074264 - RNA, 11 nt, Streptococcus pneumoniae R6
auuaagccucu

SEQ ID NO: 4074265 - RNA, 19 nt, Streptococcus pneumoniae R6
auuaagugauuuaaauguu

SEQ ID NO: 4074266 - RNA, 16 nt, Streptococcus pneumoniae R6
auuaauaauuuucaca

SEQ ID NO: 4074267 - RNA, 14 nt, Streptococcus pneumoniae R6
auuaauauauaaaa

SEQ ID NO: 4074268 - RNA, 23 nt, Streptococcus pneumoniae R6
auuaaucagaauggguuaaaauu

SEQ ID NO: 4074269 - RNA, 19 nt, Streptococcus pneumoniae R6
auuaaucauucccugggga

SEQ ID NO: 4074270 - RNA, 18 nt, Streptococcus pneumoniae R6
auuaauccccauuugcuu

SEQ ID NO: 4074271 - RNA, 17 nt, Streptococcus pneumoniae R6
auuaauggcagugcuuu

SEQ ID NO: 4074272 - RNA, 18 nt, Streptococcus pneumoniae R6
auuaauucgauuucugcu

SEQ ID NO: 4074273 - RNA, 20 nt, Streptococcus pneumoniae R6
auuaauucggaaagccaaau

SEQ ID NO: 4074274 - RNA, 18 nt, Streptococcus pneumoniae R6
auuaauuuauagaaaaau

SEQ ID NO: 4074275 - RNA, 15 nt, Streptococcus pneumoniae R6
auuaauuuauuuaau

SEQ ID NO: 4074276 - RNA, 14 nt, Streptococcus pneumoniae R6
auuaauuucuagaa

SEQ ID NO: 4074277 - RNA, 15 nt, Streptococcus pneumoniae R6
auuaauuucuagaaa

SEQ ID NO: 4074278 - RNA, 14 nt, Streptococcus pneumoniae R6
auuaauuugacuuu

SEQ ID NO: 4074279 - RNA, 19 nt, Streptococcus pneumoniae R6
auuaauuugacuuuucuaa

SEQ ID NO: 4074280 - RNA, 19 nt, Streptococcus pneumoniae R6
auuaauuuucguacaauau

SEQ ID NO: 4074281 - RNA, 14 nt, Streptococcus pneumoniae R6
auuacaaucauaga

SEQ ID NO: 4074282 - RNA, 22 nt, Streptococcus pneumoniae R6
auuacacaaucguuucaaaaaa

SEQ ID NO: 4074283 - RNA, 21 nt, Streptococcus pneumoniae R6
auuacaguuauuuuaguaaaa

SEQ ID NO: 4074284 - RNA, 15 nt, Streptococcus pneumoniae R6
auuacauaaguuuau

SEQ ID NO: 4074285 - RNA, 13 nt, Streptococcus pneumoniae R6
auuacauccacca

SEQ ID NO: 4074286 - RNA, 18 nt, Streptococcus pneumoniae R6
auuaccuuugaaaaaaug

SEQ ID NO: 4074287 - RNA, 16 nt, Streptococcus pneumoniae R6
auuacgaugcuuuucu

SEQ ID NO: 4074288 - RNA, 18 nt, Streptococcus pneumoniae R6
auuacucaaguccuuuug

SEQ ID NO: 4074289 - RNA, 13 nt, Streptococcus pneumoniae R6
auuacugauaaaa

SEQ ID NO: 4074290 - RNA, 17 nt, Streptococcus pneumoniae R6
auuacugucauaucaua

SEQ ID NO: 4074291 - RNA, 17 nt, Streptococcus pneumoniae R6
auuacuguuguugagac

SEQ ID NO: 4074292 - RNA, 18 nt, Streptococcus pneumoniae R6
auuacuuaacccauucac

SEQ ID NO: 4074293 - RNA, 15 nt, Streptococcus pneumoniae R6
auuagaaaaagacuu

SEQ ID NO: 4074294 - RNA, 18 nt, Streptococcus pneumoniae R6
auuccaaauuagaaaaag

SEQ ID NO: 4074295 - RNA, 19 nt, Streptococcus pneumoniae R6
auuccaagguagcaacagc

SEQ ID NO: 4074296 - RNA, 23 nt, Streptococcus pneumoniae R6
auuccaagguagcaacagcugga

SEQ ID NO: 4074297 - RNA, 13 nt, Streptococcus pneumoniae R6
auuccacacagaa

SEQ ID NO: 4074298 - RNA, 17 nt, Streptococcus pneumoniae R6
auuccaccauucuuucc

SEQ ID NO: 4074299 - RNA, 13 nt, Streptococcus pneumoniae R6
auuccacgagcca

SEQ ID NO: 4074300 - RNA, 20 nt, Streptococcus pneumoniae R6
auuccacguuucuaauaauu

SEQ ID NO: 4074301 - RNA, 13 nt, Streptococcus pneumoniae R6
auuccauuggaag

SEQ ID NO: 4074302 - RNA, 23 nt, Streptococcus pneumoniae R6
auucccaaacuuguacuugagau

SEQ ID NO: 4074303 - RNA, 22 nt, Streptococcus pneumoniae R6
auucccaaggucugacaggcua

SEQ ID NO: 4074304 - RNA, 18 nt, Streptococcus pneumoniae R6
auucccaucaauaucgua

SEQ ID NO: 4074305 - RNA, 15 nt, Streptococcus pneumoniae R6
auuccccaucuucaa

SEQ ID NO: 4074306 - RNA, 15 nt, Streptococcus pneumoniae R6
auucccuacaaauac

SEQ ID NO: 4074307 - RNA, 17 nt, Streptococcus pneumoniae R6
auucccuuaaaguggga

SEQ ID NO: 4074308 - RNA, 13 nt, Streptococcus pneumoniae R6
auucccuuaucca

SEQ ID NO: 4074309 - RNA, 16 nt, Streptococcus pneumoniae R6
auucccuuguagaaaa

SEQ ID NO: 4074310 - RNA, 20 nt, Streptococcus pneumoniae R6
auucccuuguagaaaagcaa

SEQ ID NO: 4074311 - RNA, 15 nt, Streptococcus pneumoniae R6
auuccuacuucaaau

SEQ ID NO: 4074312 - RNA, 19 nt, Streptococcus pneumoniae R6
auuccuggaaucagaacac

SEQ ID NO: 4074313 - RNA, 21 nt, Streptococcus pneumoniae R6
auuccuguguacuguucuaaa

SEQ ID NO: 4074314 - RNA, 16 nt, Streptococcus pneumoniae R6
auuccuucuugaccac

SEQ ID NO: 4074315 - RNA, 21 nt, Streptococcus pneumoniae R6
auuccuugaugagcaaaggau

SEQ ID NO: 4074316 - RNA, 22 nt, Streptococcus pneumoniae R6
auuccuugaugagcaaaggauu

SEQ ID NO: 4074317 - RNA, 17 nt, Streptococcus pneumoniae R6
auucgaaaaucaaagug

SEQ ID NO: 4074318 - RNA, 23 nt, Streptococcus pneumoniae R6
auucgaaugauuucucuugcaau

SEQ ID NO: 4074319 - RNA, 14 nt, Streptococcus pneumoniae R6
auucgcuuacauaa

SEQ ID NO: 4074320 - RNA, 16 nt, Streptococcus pneumoniae R6
auucgcuuuuuuaaau

SEQ ID NO: 4074321 - RNA, 15 nt, Streptococcus pneumoniae R6
auucggaaagccaaa

SEQ ID NO: 4074322 - RNA, 23 nt, Streptococcus pneumoniae R6
auucggaaagccaaaucaauuuc

SEQ ID NO: 4074323 - RNA, 13 nt, Streptococcus pneumoniae R6
auucguacucucu

SEQ ID NO: 4074324 - RNA, 15 nt, Streptococcus pneumoniae R6
auucguacucucuuu

SEQ ID NO: 4074325 - RNA, 16 nt, Streptococcus pneumoniae R6
auucguccauccaagc

SEQ ID NO: 4074326 - RNA, 19 nt, Streptococcus pneumoniae R6
auucguccauccaagcguc

SEQ ID NO: 4074327 - RNA, 19 nt, Streptococcus pneumoniae R6
auucguccuuucuuuuuug

SEQ ID NO: 4074328 - RNA, 15 nt, Streptococcus pneumoniae R6
auucgucuaaaagua

SEQ ID NO: 4074329 - RNA, 21 nt, Streptococcus pneumoniae R6
auucgugggcuuucccagaca

SEQ ID NO: 4074330 - RNA, 16 nt, Streptococcus pneumoniae R6
auucguuccuuuaaaa

SEQ ID NO: 4074331 - RNA, 15 nt, Streptococcus pneumoniae R6
auucguuucauuauu

SEQ ID NO: 4074332 - RNA, 15 nt, Streptococcus pneumoniae R6
auucguuugaagcug

SEQ ID NO: 4074333 - RNA, 14 nt, Streptococcus pneumoniae R6
auucuaaauucaau

SEQ ID NO: 4074334 - RNA, 20 nt, Streptococcus pneumoniae R6
auucuaauguacagaagacu

SEQ ID NO: 4074335 - RNA, 19 nt, Streptococcus pneumoniae R6
auucuaauuaaauaaaaua

SEQ ID NO: 4074336 - RNA, 17 nt, Streptococcus pneumoniae R6
auucuaguuucaauaua

SEQ ID NO: 4074337 - RNA, 12 nt, Streptococcus pneumoniae R6
auucuauuuuuu

SEQ ID NO: 4074338 - RNA, 13 nt, Streptococcus pneumoniae R6
auucuauuuuuua

SEQ ID NO: 4074339 - RNA, 14 nt, Streptococcus pneumoniae R6
auucuauuuuuuau

SEQ ID NO: 4074340 - RNA, 19 nt, Streptococcus pneumoniae R6
auucuauuuuuuauaauau

SEQ ID NO: 4074341 - RNA, 21 nt, Streptococcus pneumoniae R6
auucuauuuuuuauaauauca

SEQ ID NO: 4074342 - RNA, 15 nt, Streptococcus pneumoniae R6
auucucagguuuuuc

SEQ ID NO: 4074343 - RNA, 17 nt, Streptococcus pneumoniae R6
auucuccauaauugcuu

SEQ ID NO: 4074344 - RNA, 19 nt, Streptococcus pneumoniae R6
auucucucuuacuauacuu

SEQ ID NO: 4074345 - RNA, 19 nt, Streptococcus pneumoniae R6
auucucuggcagaaggauu

SEQ ID NO: 4074346 - RNA, 19 nt, Streptococcus pneumoniae R6
auucucuuuucauacucau

SEQ ID NO: 4074347 - RNA, 22 nt, Streptococcus pneumoniae R6
auucucuuuucauacucauuua

SEQ ID NO: 4074348 - RNA, 18 nt, Streptococcus pneumoniae R6
auucugaaagugaaacag

SEQ ID NO: 4074349 - RNA, 16 nt, Streptococcus pneumoniae R6
auucugaacuaaaaaa

SEQ ID NO: 4074350 - RNA, 16 nt, Streptococcus pneumoniae R6
auucugaaugcuuucc

SEQ ID NO: 4074351 - RNA, 16 nt, Streptococcus pneumoniae R6
auucugacuaggaaua

SEQ ID NO: 4074352 - RNA, 20 nt, Streptococcus pneumoniae R6
auucugcauguaucacagua

SEQ ID NO: 4074353 - RNA, 21 nt, Streptococcus pneumoniae R6
auucugcuagacuaacuucuu

SEQ ID NO: 4074354 - RNA, 15 nt, Streptococcus pneumoniae R6
auucugcuuuuaaau

SEQ ID NO: 4074355 - RNA, 15 nt, Streptococcus pneumoniae R6
auucuggaagugaaa

SEQ ID NO: 4074356 - RNA, 20 nt, Streptococcus pneumoniae R6
auucugggauuacaagaccg

SEQ ID NO: 4074357 - RNA, 19 nt, Streptococcus pneumoniae R6
auucugucacaacugaacg

SEQ ID NO: 4074358 - RNA, 12 nt, Streptococcus pneumoniae R6
auucuuaaaauu

SEQ ID NO: 4074359 - RNA, 20 nt, Streptococcus pneumoniae R6
auucuuaaaauugguuuaaa

SEQ ID NO: 4074360 - RNA, 17 nt, Streptococcus pneumoniae R6
auucuuacuaccuacuu

SEQ ID NO: 4074361 - RNA, 14 nt, Streptococcus pneumoniae R6
auucuuauauuaaa

SEQ ID NO: 4074362 - RNA, 16 nt, Streptococcus pneumoniae R6
auucuuauuucaaaaa

SEQ ID NO: 4074363 - RNA, 17 nt, Streptococcus pneumoniae R6
auucuuauuucaaaaaa

SEQ ID NO: 4074364 - RNA, 18 nt, Streptococcus pneumoniae R6
auucuuauuucaaaaaau

SEQ ID NO: 4074365 - RNA, 14 nt, Streptococcus pneumoniae R6
auucuuauuucauu

SEQ ID NO: 4074366 - RNA, 15 nt, Streptococcus pneumoniae R6
auucuuauuuggcaa

SEQ ID NO: 4074367 - RNA, 19 nt, Streptococcus pneumoniae R6
auucuucaggauugauaaa

SEQ ID NO: 4074368 - RNA, 19 nt, Streptococcus pneumoniae R6
auucuucauagucaaaacc

SEQ ID NO: 4074369 - RNA, 15 nt, Streptococcus pneumoniae R6
auucuuccuacugau

SEQ ID NO: 4074370 - RNA, 19 nt, Streptococcus pneumoniae R6
auucuucuucugaaaagac

SEQ ID NO: 4074371 - RNA, 20 nt, Streptococcus pneumoniae R6
auucuucuucugaaaagacg

SEQ ID NO: 4074372 - RNA, 17 nt, Streptococcus pneumoniae R6
auucuuuagaaaacuag

SEQ ID NO: 4074373 - RNA, 18 nt, Streptococcus pneumoniae R6
auucuuuagcagaugcuu

SEQ ID NO: 4074374 - RNA, 21 nt, Streptococcus pneumoniae R6
auucuuuguuaaaugaauaua

SEQ ID NO: 4074375 - RNA, 17 nt, Streptococcus pneumoniae R6
auucuuuuuaaauaaau

SEQ ID NO: 4074376 - RNA, 11 nt, Streptococcus pneumoniae R6
auucuuuuucu

SEQ ID NO: 4074377 - RNA, 17 nt, Streptococcus pneumoniae R6
auucuuuuuuaauucuu

SEQ ID NO: 4074378 - RNA, 19 nt, Streptococcus pneumoniae R6
auugaaaacgguaacaaaa

SEQ ID NO: 4074379 - RNA, 22 nt, Streptococcus pneumoniae R6
auugaaaauucacaaaauccuu

SEQ ID NO: 4074380 - RNA, 17 nt, Streptococcus pneumoniae R6
auugaaacaagaacaag

SEQ ID NO: 4074381 - RNA, 17 nt, Streptococcus pneumoniae R6
auugaaacagcuaaaga

SEQ ID NO: 4074382 - RNA, 20 nt, Streptococcus pneumoniae R6
auugaaacuagaauaguaca

SEQ ID NO: 4074383 - RNA, 20 nt, Streptococcus pneumoniae R6
auugaaacuggaauaguaca

SEQ ID NO: 4074384 - RNA, 17 nt, Streptococcus pneumoniae R6
auugaaaggaaucugcg

SEQ ID NO: 4074385 - RNA, 20 nt, Streptococcus pneumoniae R6
auugaaagucuuggaaaaug

SEQ ID NO: 4074386 - RNA, 12 nt, Streptococcus pneumoniae R6
auugaaaugaaa

SEQ ID NO: 4074387 - RNA, 23 nt, Streptococcus pneumoniae R6
auugaacccgcgcaauuaagcag

SEQ ID NO: 4074388 - RNA, 22 nt, Streptococcus pneumoniae R6
auugaaguuagaguaguacaca

SEQ ID NO: 4074389 - RNA, 22 nt, Streptococcus pneumoniae R6
auugaauaaagucaacagaguu

SEQ ID NO: 4074390 - RNA, 23 nt, Streptococcus pneumoniae R6
auugaauuucaagaaugaaaguu

SEQ ID NO: 4074391 - RNA, 17 nt, Streptococcus pneumoniae R6
auugacagaaccuugga

SEQ ID NO: 4074392 - RNA, 18 nt, Streptococcus pneumoniae R6
auugacagaaccuuggaa

SEQ ID NO: 4074393 - RNA, 12 nt, Streptococcus pneumoniae R6
auugacagaaga

SEQ ID NO: 4074394 - RNA, 13 nt, Streptococcus pneumoniae R6
auugacagaagau

SEQ ID NO: 4074395 - RNA, 21 nt, Streptococcus pneumoniae R6
auugacauaccaccaaguaca

SEQ ID NO: 4074396 - RNA, 14 nt, Streptococcus pneumoniae R6
auugugccccugau

SEQ ID NO: 4074397 - RNA, 17 nt, Streptococcus pneumoniae R6
auugugggaagauuuac

SEQ ID NO: 4074398 - RNA, 16 nt, Streptococcus pneumoniae R6
auugugggaauguuug

SEQ ID NO: 4074399 - RNA, 20 nt, Streptococcus pneumoniae R6
auugugggaauguuugcuuc

SEQ ID NO: 4074400 - RNA, 17 nt, Streptococcus pneumoniae R6
auuguguccucaauaua

SEQ ID NO: 4074401 - RNA, 13 nt, Streptococcus pneumoniae R6
auuguuaaacaau

SEQ ID NO: 4074402 - RNA, 12 nt, Streptococcus pneumoniae R6
auuguuaaaguu

SEQ ID NO: 4074403 - RNA, 18 nt, Streptococcus pneumoniae R6
auuguuagaaaucgauuu

SEQ ID NO: 4074404 - RNA, 14 nt, Streptococcus pneumoniae R6
auuguuauuuuucu

SEQ ID NO: 4074405 - RNA, 15 nt, Streptococcus pneumoniae R6
auuguuauuuuucuu

SEQ ID NO: 4074406 - RNA, 15 nt, Streptococcus pneumoniae R6
auuguucuaguuuuu

SEQ ID NO: 4074407 - RNA, 20 nt, Streptococcus pneumoniae R6
auuguugaaacggcauaaaa

SEQ ID NO: 4074408 - RNA, 15 nt, Streptococcus pneumoniae R6
auuguugcauuaaaa

SEQ ID NO: 4074409 - RNA, 20 nt, Streptococcus pneumoniae R6
auuguugcauuaaaaaguuu

SEQ ID NO: 4074410 - RNA, 21 nt, Streptococcus pneumoniae R6
auuguugucccuuuuucacua

SEQ ID NO: 4074411 - RNA, 20 nt, Streptococcus pneumoniae R6
auuguuuaauucuugaaaau

SEQ ID NO: 4074412 - RNA, 17 nt, Streptococcus pneumoniae R6
auuguuuauaaaauaac

SEQ ID NO: 4074413 - RNA, 18 nt, Streptococcus pneumoniae R6
auuguuucguacuauuuc

SEQ ID NO: 4074414 - RNA, 11 nt, Streptococcus pneumoniae R6
auuuaaaaaga

SEQ ID NO: 4074415 - RNA, 13 nt, Streptococcus pneumoniae R6
auuuaaaaagaaa

SEQ ID NO: 4074416 - RNA, 15 nt, Streptococcus pneumoniae R6
auuuaaaaagaaaua

SEQ ID NO: 4074417 - RNA, 16 nt, Streptococcus pneumoniae R6
auuuaaaaaucuauuu

SEQ ID NO: 4074418 - RNA, 23 nt, Streptococcus pneumoniae R6
auuuaaaaauguugcauuuuuua

SEQ ID NO: 4074419 - RNA, 21 nt, Streptococcus pneumoniae R6
auuuaaaacugugauauaaua

SEQ ID NO: 4074420 - RNA, 13 nt, Streptococcus pneumoniae R6
auuuaaaauacgc

SEQ ID NO: 4074421 - RNA, 21 nt, Streptococcus pneumoniae R6
auuuaaaauacgcaaaaucau

SEQ ID NO: 4074422 - RNA, 22 nt, Streptococcus pneumoniae R6
auuuaaagcaaauuaaccuuau

SEQ ID NO: 4074423 - RNA, 14 nt, Streptococcus pneumoniae R6
auuuaacaaaccac

SEQ ID NO: 4074424 - RNA, 15 nt, Streptococcus pneumoniae R6
auuuaaccaaaccaa

SEQ ID NO: 4074425 - RNA, 16 nt, Streptococcus pneumoniae R6
auuuaaccaaaccaac

SEQ ID NO: 4074426 - RNA, 16 nt, Streptococcus pneumoniae R6
auuuaagauaaguucc

SEQ ID NO: 4074427 - RNA, 22 nt, Streptococcus pneumoniae R6
auuuaagauaaguuccaucugg

SEQ ID NO: 4074428 - RNA, 16 nt, Streptococcus pneumoniae R6
auuuaagcaaaaaaag

SEQ ID NO: 4074429 - RNA, 14 nt, Streptococcus pneumoniae R6
auuuaauauauuua

SEQ ID NO: 4074430 - RNA, 21 nt, Streptococcus pneumoniae R6
auuuaaucauguaccuaagau

SEQ ID NO: 4074431 - RNA, 21 nt, Streptococcus pneumoniae R6
auuuaaucauuuaauaaugaa

SEQ ID NO: 4074432 - RNA, 18 nt, Streptococcus pneumoniae R6
auuuaaucugaauguuuc

SEQ ID NO: 4074433 - RNA, 16 nt, Streptococcus pneumoniae R6
auuuaauuagaaaaaa

SEQ ID NO: 4074434 - RNA, 18 nt, Streptococcus pneumoniae R6
auuuaauuagaaaaaaau

SEQ ID NO: 4074435 - RNA, 13 nt, Streptococcus pneumoniae R6
auuuacaaauauu

SEQ ID NO: 4074436 - RNA, 19 nt, Streptococcus pneumoniae R6
auuuacagaaagaacaaaa

SEQ ID NO: 4074437 - RNA, 16 nt, Streptococcus pneumoniae R6
auuuaccauaguucca

SEQ ID NO: 4074438 - RNA, 22 nt, Streptococcus pneumoniae R6
auuuaccauuuucguccaaguc

SEQ ID NO: 4074439 - RNA, 15 nt, Streptococcus pneumoniae R6
auuuacgaaucucuu

SEQ ID NO: 4074440 - RNA, 19 nt, Streptococcus pneumoniae R6
auuuacgaaucucuuucca

SEQ ID NO: 4074441 - RNA, 23 nt, Streptococcus pneumoniae R6
auuuacgaaucucuuuccacacu

SEQ ID NO: 4074442 - RNA, 22 nt, Streptococcus pneumoniae R6
auuuacuauuauagagaggguc

SEQ ID NO: 4074443 - RNA, 21 nt, Streptococcus pneumoniae R6
auuuacugaacggugaacuuc

SEQ ID NO: 4074444 - RNA, 16 nt, Streptococcus pneumoniae R6
auuuacuguuuuagcg

SEQ ID NO: 4074445 - RNA, 16 nt, Streptococcus pneumoniae R6
auuuacuucauguuuu

SEQ ID NO: 4074446 - RNA, 17 nt, Streptococcus pneumoniae R6
auuuacuucauuuuugc

SEQ ID NO: 4074447 - RNA, 14 nt, Streptococcus pneumoniae R6
auuuacuucuuuuu

SEQ ID NO: 4074448 - RNA, 17 nt, Streptococcus pneumoniae R6
auuuacuucuuuuucuc

SEQ ID NO: 4074449 - RNA, 23 nt, Streptococcus pneumoniae R6
auuuacuucuuuuucuccuaaaa

SEQ ID NO: 4074450 - RNA, 17 nt, Streptococcus pneumoniae R6
auuuacuuggauucuuu

SEQ ID NO: 4074451 - RNA, 20 nt, Streptococcus pneumoniae R6
auuuagaaagguaaaauaua

SEQ ID NO: 4074452 - RNA, 14 nt, Streptococcus pneumoniae R6
auuuagaacaccau

SEQ ID NO: 4074453 - RNA, 17 nt, Streptococcus pneumoniae R6
auuuagagaaugaaaua

SEQ ID NO: 4074454 - RNA, 19 nt, Streptococcus pneumoniae R6
auuuagaggccaugacguc

SEQ ID NO: 4074455 - RNA, 20 nt, Streptococcus pneumoniae R6
auuuagauucaguugcauaa

SEQ ID NO: 4074456 - RNA, 13 nt, Streptococcus pneumoniae R6
auuuagcuguauc

SEQ ID NO: 4074457 - RNA, 18 nt, Streptococcus pneumoniae R6
auuuaggacuaaauacaa

SEQ ID NO: 4074458 - RNA, 22 nt, Streptococcus pneumoniae R6
auuuaggcuaagagagaagccu

SEQ ID NO: 4074459 - RNA, 21 nt, Streptococcus pneumoniae R6
auuuagucuaacuuuugaggu

SEQ ID NO: 4074460 - RNA, 15 nt, Streptococcus pneumoniae R6
auuuaguucuguauu

SEQ ID NO: 4074461 - RNA, 20 nt, Streptococcus pneumoniae R6
auuuauaaaucuucuaaauu

SEQ ID NO: 4074462 - RNA, 22 nt, Streptococcus pneumoniae R6
auuuauaauauaaacuuuuuca

SEQ ID NO: 4074463 - RNA, 12 nt, Streptococcus pneumoniae R6
auuuauagaaaa

SEQ ID NO: 4074464 - RNA, 14 nt, Streptococcus pneumoniae R6
auuuauagaaaugu

SEQ ID NO: 4074465 - RNA, 18 nt, Streptococcus pneumoniae R6
auuuauauaaaaagaaau

SEQ ID NO: 4074466 - RNA, 15 nt, Streptococcus pneumoniae R6
auuuaucaguauauu

SEQ ID NO: 4074467 - RNA, 21 nt, Streptococcus pneumoniae R6
auuuaucaguauauugaaaug

SEQ ID NO: 4074468 - RNA, 23 nt, Streptococcus pneumoniae R6
auuuaucaguauauugaaaugaa

SEQ ID NO: 4074469 - RNA, 21 nt, Streptococcus pneumoniae R6
auuuaucccaauggauauaag

SEQ ID NO: 4074470 - RNA, 15 nt, Streptococcus pneumoniae R6
auuuaucuauaaaca

SEQ ID NO: 4074471 - RNA, 15 nt, Streptococcus pneumoniae R6
auuuauggaaaaaau

SEQ ID NO: 4074472 - RNA, 18 nt, Streptococcus pneumoniae R6
auuuauucagacuauaua

SEQ ID NO: 4074473 - RNA, 12 nt, Streptococcus pneumoniae R6
auuuauuuacuu

SEQ ID NO: 4074474 - RNA, 14 nt, Streptococcus pneumoniae R6
auuuauuuuucuuu

SEQ ID NO: 4074475 - RNA, 21 nt, Streptococcus pneumoniae R6
auuuauuuuucuuuuucagaa

SEQ ID NO: 4074476 - RNA, 15 nt, Streptococcus pneumoniae R6
auuucaaaaucuucu

SEQ ID NO: 4074477 - RNA, 19 nt, Streptococcus pneumoniae R6
auuucaaaggcuuuuucuu

SEQ ID NO: 4074478 - RNA, 13 nt, Streptococcus pneumoniae R6
auuucaaaucaua

SEQ ID NO: 4074479 - RNA, 15 nt, Streptococcus pneumoniae R6
auuucaaaucauaaa

SEQ ID NO: 4074480 - RNA, 18 nt, Streptococcus pneumoniae R6
auuucaaccuuguggaau

SEQ ID NO: 4074481 - RNA, 20 nt, Streptococcus pneumoniae R6
auuucaaccuuguggaauug

SEQ ID NO: 4074482 - RNA, 14 nt, Streptococcus pneumoniae R6
auuucaagaacucc

SEQ ID NO: 4074483 - RNA, 12 nt, Streptococcus pneumoniae R6
auuucaagaauu

SEQ ID NO: 4074484 - RNA, 18 nt, Streptococcus pneumoniae R6
auuucaagaccauuucca

SEQ ID NO: 4074485 - RNA, 15 nt, Streptococcus pneumoniae R6
auuucaauagaaauc

SEQ ID NO: 4074486 - RNA, 18 nt, Streptococcus pneumoniae R6
auuucaauagaaaucacg

SEQ ID NO: 4074487 - RNA, 15 nt, Streptococcus pneumoniae R6
auuucaaucugcuau

SEQ ID NO: 4074488 - RNA, 12 nt, Streptococcus pneumoniae R6
auuucaauuuac

SEQ ID NO: 4074489 - RNA, 14 nt, Streptococcus pneumoniae R6
auuucaauuuuaaa

SEQ ID NO: 4074490 - RNA, 15 nt, Streptococcus pneumoniae R6
auuucaauuuuaaau

SEQ ID NO: 4074491 - RNA, 23 nt, Streptococcus pneumoniae R6
auuucaauuuuaaauuuuucugc

SEQ ID NO: 4074492 - RNA, 19 nt, Streptococcus pneumoniae R6
auuucacaguuaaauuaua

SEQ ID NO: 4074493 - RNA, 16 nt, Streptococcus pneumoniae R6
auuucacgcaccuugg

SEQ ID NO: 4074494 - RNA, 15 nt, Streptococcus pneumoniae R6
auuucacgguaauug

SEQ ID NO: 4074495 - RNA, 16 nt, Streptococcus pneumoniae R6
auuucacuagaaaaug

SEQ ID NO: 4074496 - RNA, 20 nt, Streptococcus pneumoniae R6
auuucacuccacuauaaaac

SEQ ID NO: 4074497 - RNA, 22 nt, Streptococcus pneumoniae R6
auuucacuccacuauaaaacau

SEQ ID NO: 4074498 - RNA, 23 nt, Streptococcus pneumoniae R6
auuucacuccacuauaaaacauu

SEQ ID NO: 4074499 - RNA, 18 nt, Streptococcus pneumoniae R6
auuugcgcgcuugaauga

SEQ ID NO: 4074500 - RNA, 17 nt, Streptococcus pneumoniae R6
auuugcucaauaaccac

SEQ ID NO: 4074501 - RNA, 16 nt, Streptococcus pneumoniae R6
auuugcuucaucauuu

SEQ ID NO: 4074502 - RNA, 20 nt, Streptococcus pneumoniae R6
auuugcuuuucuuuuuuaua

SEQ ID NO: 4074503 - RNA, 21 nt, Streptococcus pneumoniae R6
auuugcuuuucuuuuuuauag

SEQ ID NO: 4074504 - RNA, 23 nt, Streptococcus pneumoniae R6
auuuggaaaauaguuuuugcaau

SEQ ID NO: 4074505 - RNA, 23 nt, Streptococcus pneumoniae R6
auuuggagcaagugguucuccaa

SEQ ID NO: 4074506 - RNA, 19 nt, Streptococcus pneumoniae R6
auuuggcaccgaauuuuuc

SEQ ID NO: 4074507 - RNA, 19 nt, Streptococcus pneumoniae R6
auuuggcuuuuuuguauuc

SEQ ID NO: 4074508 - RNA, 16 nt, Streptococcus pneumoniae R6
auuuggguaggucuuu

SEQ ID NO: 4074509 - RNA, 18 nt, Streptococcus pneumoniae R6
auuugggucaaucuuguc

SEQ ID NO: 4074510 - RNA, 21 nt, Streptococcus pneumoniae R6
auuuggugccucauuaguaau

SEQ ID NO: 4074511 - RNA, 20 nt, Streptococcus pneumoniae R6
auuugguuuuuggcaauuuu

SEQ ID NO: 4074512 - RNA, 17 nt, Streptococcus pneumoniae R6
auuuguagcaaauucac

SEQ ID NO: 4074513 - RNA, 22 nt, Streptococcus pneumoniae R6
auuuguaucaccaagcauuuuc

SEQ ID NO: 4074514 - RNA, 15 nt, Streptococcus pneumoniae R6
auuugucauucagau

SEQ ID NO: 4074515 - RNA, 17 nt, Streptococcus pneumoniae R6
auuuguuccgauuuuau

SEQ ID NO: 4074516 - RNA, 21 nt, Streptococcus pneumoniae R6
auuuguuccgauuuuauuuca

SEQ ID NO: 4074517 - RNA, 19 nt, Streptococcus pneumoniae R6
auuuguucguauccuauuu

SEQ ID NO: 4074518 - RNA, 21 nt, Streptococcus pneumoniae R6
auuuguucguauccuauuuca

SEQ ID NO: 4074519 - RNA, 23 nt, Streptococcus pneumoniae R6
auuuguuuaguguauaugaagau

SEQ ID NO: 4074520 - RNA, 21 nt, Streptococcus pneumoniae R6
auuuguuuucaagugacauau

SEQ ID NO: 4074521 - RNA, 13 nt, Streptococcus pneumoniae R6
auuuuaaaauauu

SEQ ID NO: 4074522 - RNA, 18 nt, Streptococcus pneumoniae R6
auuuuaaaauauuagcaa

SEQ ID NO: 4074523 - RNA, 19 nt, Streptococcus pneumoniae R6
auuuuaaaaugccaaagaa

SEQ ID NO: 4074524 - RNA, 14 nt, Streptococcus pneumoniae R6
auuuuaaagaaaua

SEQ ID NO: 4074525 - RNA, 15 nt, Streptococcus pneumoniae R6
auuuuaaagaaauag

SEQ ID NO: 4074526 - RNA, 14 nt, Streptococcus pneumoniae R6
auuuuaaagacuuu

SEQ ID NO: 4074527 - RNA, 19 nt, Streptococcus pneumoniae R6
auuuuaaagacuuuuuucu

SEQ ID NO: 4074528 - RNA, 19 nt, Streptococcus pneumoniae R6
auuuuaauaauuuuguuaa

SEQ ID NO: 4074529 - RNA, 18 nt, Streptococcus pneumoniae R6
auuuuaauauauaaaaaa

SEQ ID NO: 4074530 - RNA, 23 nt, Streptococcus pneumoniae R6
auuuuaaugcuaauuuagaaaua

SEQ ID NO: 4074531 - RNA, 17 nt, Streptococcus pneumoniae R6
auuuuaauuucaaugua

SEQ ID NO: 4074532 - RNA, 14 nt, Streptococcus pneumoniae R6
auuuuacaaauacc

SEQ ID NO: 4074533 - RNA, 14 nt, Streptococcus pneumoniae R6
auuuuacuauaaaa

SEQ ID NO: 4074534 - RNA, 16 nt, Streptococcus pneumoniae R6
auuuuacuucuucccc

SEQ ID NO: 4074535 - RNA, 15 nt, Streptococcus pneumoniae R6
auuuuagaagcagag

SEQ ID NO: 4074536 - RNA, 12 nt, Streptococcus pneumoniae R6
auuuuagauuuu

SEQ ID NO: 4074537 - RNA, 14 nt, Streptococcus pneumoniae R6
auuuuagauuuuuu

SEQ ID NO: 4074538 - RNA, 15 nt, Streptococcus pneumoniae R6
auuuuagauuuuuua

SEQ ID NO: 4074539 - RNA, 18 nt, Streptococcus pneumoniae R6
auuuuagcagucaagaug

SEQ ID NO: 4074540 - RNA, 12 nt, Streptococcus pneumoniae R6
auuuuaggaaac

SEQ ID NO: 4074541 - RNA, 19 nt, Streptococcus pneumoniae R6
auuuuaggagaaaaagaag

SEQ ID NO: 4074542 - RNA, 19 nt, Streptococcus pneumoniae R6
auuuuaguaaaaaaagaag

SEQ ID NO: 4074543 - RNA, 13 nt, Streptococcus pneumoniae R6
auuuuaguagaaa

SEQ ID NO: 4074544 - RNA, 14 nt, Streptococcus pneumoniae R6
auuuuauagucuaa

SEQ ID NO: 4074545 - RNA, 12 nt, Streptococcus pneumoniae R6
auuuuauauaaa

SEQ ID NO: 4074546 - RNA, 15 nt, Streptococcus pneumoniae R6
auuuuauauaaaaua

SEQ ID NO: 4074547 - RNA, 16 nt, Streptococcus pneumoniae R6
auuuuauccaacugau

SEQ ID NO: 4074548 - RNA, 23 nt, Streptococcus pneumoniae R6
auuuuauccgaagggcuauuuuu

SEQ ID NO: 4074549 - RNA, 16 nt, Streptococcus pneumoniae R6
auuuuaucuuugaaau

SEQ ID NO: 4074550 - RNA, 23 nt, Streptococcus pneumoniae R6
auuuuaucuuugaaauaaucaaa

SEQ ID NO: 4074551 - RNA, 20 nt, Streptococcus pneumoniae R6
auuuuaugcguuuuucugau

SEQ ID NO: 4074552 - RNA, 16 nt, Streptococcus pneumoniae R6
auuuucaaaaugacaa

SEQ ID NO: 4074553 - RNA, 18 nt, Streptococcus pneumoniae R6
auuuucaaaaugacaauu

SEQ ID NO: 4074554 - RNA, 14 nt, Streptococcus pneumoniae R6
auuuucaaagagua

SEQ ID NO: 4074555 - RNA, 22 nt, Streptococcus pneumoniae R6
auuuucaaagaguauuaaacaa

SEQ ID NO: 4074556 - RNA, 21 nt, Streptococcus pneumoniae R6
auuuucaaauuuucuuuacua

SEQ ID NO: 4074557 - RNA, 13 nt, Streptococcus pneumoniae R6
auuuucaacuuga

SEQ ID NO: 4074558 - RNA, 21 nt, Streptococcus pneumoniae R6
auuuucaauccguuuguguga

SEQ ID NO: 4074559 - RNA, 15 nt, Streptococcus pneumoniae R6
auuuucagaaagaag

SEQ ID NO: 4074560 - RNA, 13 nt, Streptococcus pneumoniae R6
auuuucagagggc

SEQ ID NO: 4074561 - RNA, 20 nt, Streptococcus pneumoniae R6
auuuucagauaaccaucuca

SEQ ID NO: 4074562 - RNA, 19 nt, Streptococcus pneumoniae R6
auuuucagccucuauacuu

SEQ ID NO: 4074563 - RNA, 19 nt, Streptococcus pneumoniae R6
auuuucauaaacaagagca

SEQ ID NO: 4074564 - RNA, 21 nt, Streptococcus pneumoniae R6
auuuucauagaggaaggggcg

SEQ ID NO: 4074565 - RNA, 14 nt, Streptococcus pneumoniae R6
auuuucauauaaua

SEQ ID NO: 4074566 - RNA, 21 nt, Streptococcus pneumoniae R6
auuuucauauaauaaauugua

SEQ ID NO: 4074567 - RNA, 18 nt, Streptococcus pneumoniae R6
auuuucauugaguauaag

SEQ ID NO: 4074568 - RNA, 21 nt, Streptococcus pneumoniae R6
auuuucauugaguauaagcaa

SEQ ID NO: 4074569 - RNA, 22 nt, Streptococcus pneumoniae R6
auuuucauugaguaugaaauaa

SEQ ID NO: 4074570 - RNA, 16 nt, Streptococcus pneumoniae R6
auuuuccaagacuuuc

SEQ ID NO: 4074571 - RNA, 19 nt, Streptococcus pneumoniae R6
auuuuccgagacagagaca

SEQ ID NO: 4074572 - RNA, 16 nt, Streptococcus pneumoniae R6
auuuucgaagaguauu

SEQ ID NO: 4074573 - RNA, 14 nt, Streptococcus pneumoniae R6
auuuucgauuuaau

SEQ ID NO: 4074574 - RNA, 19 nt, Streptococcus pneumoniae R6
auuuucgauuuaaugauau

SEQ ID NO: 4074575 - RNA, 20 nt, Streptococcus pneumoniae R6
auuuucuacacuugauuuau

SEQ ID NO: 4074576 - RNA, 16 nt, Streptococcus pneumoniae R6
auuuucuacuaaaauu

SEQ ID NO: 4074577 - RNA, 13 nt, Streptococcus pneumoniae R6
auuuucucaucaa

SEQ ID NO: 4074578 - RNA, 20 nt, Streptococcus pneumoniae R6
auuuucugggaagacuguca

SEQ ID NO: 4074579 - RNA, 12 nt, Streptococcus pneumoniae R6
auuuucuuaaaa

SEQ ID NO: 4074580 - RNA, 21 nt, Streptococcus pneumoniae R6
auuuucuuagcaauucuaaaa

SEQ ID NO: 4074581 - RNA, 14 nt, Streptococcus pneumoniae R6
auuuucuuaucacg

SEQ ID NO: 4074582 - RNA, 19 nt, Streptococcus pneumoniae R6
auuuucuugauuuguucuc

SEQ ID NO: 4074583 - RNA, 12 nt, Streptococcus pneumoniae R6
auuuucuuuacu

SEQ ID NO: 4074584 - RNA, 13 nt, Streptococcus pneumoniae R6
auuuucuuuacuu

SEQ ID NO: 4074585 - RNA, 18 nt, Streptococcus pneumoniae R6
auuuucuuuacuucugag

SEQ ID NO: 4074586 - RNA, 14 nt, Streptococcus pneumoniae R6
auuuucuuuuuccu

SEQ ID NO: 4074587 - RNA, 16 nt, Streptococcus pneumoniae R6
auuuucuuuuugaagu

SEQ ID NO: 4074588 - RNA, 18 nt, Streptococcus pneumoniae R6
auuuucuuuuugaaguug

SEQ ID NO: 4074589 - RNA, 15 nt, Streptococcus pneumoniae R6
auuuugaaaaugaau

SEQ ID NO: 4074590 - RNA, 11 nt, Streptococcus pneumoniae R6
auuuugaaaug

SEQ ID NO: 4074591 - RNA, 21 nt, Streptococcus pneumoniae R6
auuuugaaauguuccaagucc

SEQ ID NO: 4074592 - RNA, 17 nt, Streptococcus pneumoniae R6
auuuugacauucuaaaa

SEQ ID NO: 4074593 - RNA, 22 nt, Streptococcus pneumoniae R6
auuuugaccaccgagcaagaga

SEQ ID NO: 4074594 - RNA, 17 nt, Streptococcus pneumoniae R6
auuuugauucagauuca

SEQ ID NO: 4074595 - RNA, 14 nt, Streptococcus pneumoniae R6
auuuugcacaauau

SEQ ID NO: 4074596 - RNA, 14 nt, Streptococcus pneumoniae R6
auuuugcuguuuau

SEQ ID NO: 4074597 - RNA, 14 nt, Streptococcus pneumoniae R6
auuuuguaaaaaag

SEQ ID NO: 4074598 - RNA, 19 nt, Streptococcus pneumoniae R6
auuuugugaaaaacuuagu

SEQ ID NO: 4074599 - RNA, 22 nt, Streptococcus pneumoniae R6
auuuugugguugaaaacaauau

SEQ ID NO: 4074600 - RNA, 21 nt, Streptococcus pneumoniae R6
auuuuguucuccauaggccaa

SEQ ID NO: 4074601 - RNA, 15 nt, Streptococcus pneumoniae R6
caaaacuuucauaau

SEQ ID NO: 4074602 - RNA, 14 nt, Streptococcus pneumoniae R6
caaaacuuuuuaaa

SEQ ID NO: 4074603 - RNA, 22 nt, Streptococcus pneumoniae R6
caaaagaccguuugaaaaagcg

SEQ ID NO: 4074604 - RNA, 14 nt, Streptococcus pneumoniae R6
caaaagagaaagac

SEQ ID NO: 4074605 - RNA, 13 nt, Streptococcus pneumoniae R6
caaaagagcuacu

SEQ ID NO: 4074606 - RNA, 17 nt, Streptococcus pneumoniae R6
caaaagauagaugauuu

SEQ ID NO: 4074607 - RNA, 17 nt, Streptococcus pneumoniae R6
caaaagauguucaaaga

SEQ ID NO: 4074608 - RNA, 20 nt, Streptococcus pneumoniae R6
caaaagcaggaguuuucccu

SEQ ID NO: 4074609 - RNA, 17 nt, Streptococcus pneumoniae R6
caaaagccugagaagac

SEQ ID NO: 4074610 - RNA, 20 nt, Streptococcus pneumoniae R6
caaaagcuuguuuaaaaucu

SEQ ID NO: 4074611 - RNA, 19 nt, Streptococcus pneumoniae R6
caaaaggcaucuugucaaa

SEQ ID NO: 4074612 - RNA, 22 nt, Streptococcus pneumoniae R6
caaaaggcaucuugucaaagag

SEQ ID NO: 4074613 - RNA, 15 nt, Streptococcus pneumoniae R6
caaaagucgaguuca

SEQ ID NO: 4074614 - RNA, 23 nt, Streptococcus pneumoniae R6
caaaaguuagaaauaaaacucug

SEQ ID NO: 4074615 - RNA, 15 nt, Streptococcus pneumoniae R6
caaaaguuagauuuu

SEQ ID NO: 4074616 - RNA, 20 nt, Streptococcus pneumoniae R6
caaaaguuagauuuuuucug

SEQ ID NO: 4074617 - RNA, 14 nt, Streptococcus pneumoniae R6
caaaaguuuaucua

SEQ ID NO: 4074618 - RNA, 21 nt, Streptococcus pneumoniae R6
caaaaguuuaucuagaauuuc

SEQ ID NO: 4074619 - RNA, 14 nt, Streptococcus pneumoniae R6
caaaauaaaaacau

SEQ ID NO: 4074620 - RNA, 15 nt, Streptococcus pneumoniae R6
caaaauaaagcaaau

SEQ ID NO: 4074621 - RNA, 11 nt, Streptococcus pneumoniae R6
caaaauaauuu

SEQ ID NO: 4074622 - RNA, 16 nt, Streptococcus pneumoniae R6
caaaauaggaaucaac

SEQ ID NO: 4074623 - RNA, 20 nt, Streptococcus pneumoniae R6
caaaauaggcuccauaauau

SEQ ID NO: 4074624 - RNA, 23 nt, Streptococcus pneumoniae R6
caaaauaguucucaaccacaaaa

SEQ ID NO: 4074625 - RNA, 13 nt, Streptococcus pneumoniae R6
caaaauaugcucc

SEQ ID NO: 4074626 - RNA, 13 nt, Streptococcus pneumoniae R6
caaaaucaaagac

SEQ ID NO: 4074627 - RNA, 12 nt, Streptococcus pneumoniae R6
caaaaucaauga

SEQ ID NO: 4074628 - RNA, 20 nt, Streptococcus pneumoniae R6
caaaaucagaaccuuugaga

SEQ ID NO: 4074629 - RNA, 20 nt, Streptococcus pneumoniae R6
caaaaucauagcauagauga

SEQ ID NO: 4074630 - RNA, 15 nt, Streptococcus pneumoniae R6
caaaaucaugacaau

SEQ ID NO: 4074631 - RNA, 18 nt, Streptococcus pneumoniae R6
caaaaucccucuuuuuac

SEQ ID NO: 4074632 - RNA, 18 nt, Streptococcus pneumoniae R6
caaaauccgcuugggaaa

SEQ ID NO: 4074633 - RNA, 22 nt, Streptococcus pneumoniae R6
caaaauccgcuugggaaaccaa

SEQ ID NO: 4074634 - RNA, 19 nt, Streptococcus pneumoniae R6
caaaaucgagguauuucuu

SEQ ID NO: 4074635 - RNA, 12 nt, Streptococcus pneumoniae R6
caaaaugaaaag

SEQ ID NO: 4074636 - RNA, 20 nt, Streptococcus pneumoniae R6
caaaaugauugaaaggauug

SEQ ID NO: 4074637 - RNA, 15 nt, Streptococcus pneumoniae R6
caaaauguucaguuu

SEQ ID NO: 4074638 - RNA, 18 nt, Streptococcus pneumoniae R6
caaaauguucaguuucua

SEQ ID NO: 4074639 - RNA, 14 nt, Streptococcus pneumoniae R6
caaaauuaaaaugu

SEQ ID NO: 4074640 - RNA, 16 nt, Streptococcus pneumoniae R6
caaaauuaagauagcc

SEQ ID NO: 4074641 - RNA, 17 nt, Streptococcus pneumoniae R6
caaaauuccuaaaauaa

SEQ ID NO: 4074642 - RNA, 20 nt, Streptococcus pneumoniae R6
caaaauucugucuuagacuu

SEQ ID NO: 4074643 - RNA, 12 nt, Streptococcus pneumoniae R6
caaacaaaaaac

SEQ ID NO: 4074644 - RNA, 19 nt, Streptococcus pneumoniae R6
caaacaaaaaaccccagca

SEQ ID NO: 4074645 - RNA, 23 nt, Streptococcus pneumoniae R6
caaacaaaaaaccccagcauaaa

SEQ ID NO: 4074646 - RNA, 20 nt, Streptococcus pneumoniae R6
caaacaacaauacuuuccaa

SEQ ID NO: 4074647 - RNA, 20 nt, Streptococcus pneumoniae R6
caaacaaggugaacuugacc

SEQ ID NO: 4074648 - RNA, 20 nt, Streptococcus pneumoniae R6
caaacaggauguguaaaaaa

SEQ ID NO: 4074649 - RNA, 23 nt, Streptococcus pneumoniae R6
caaacaggauguguaaaaaagua

SEQ ID NO: 4074650 - RNA, 10 nt, Streptococcus pneumoniae R6
caaacauugu

SEQ ID NO: 4074651 - RNA, 18 nt, Streptococcus pneumoniae R6
caaaccaacauagauaaa

SEQ ID NO: 4074652 - RNA, 12 nt, Streptococcus pneumoniae R6
caaaccaagaau

SEQ ID NO: 4074653 - RNA, 22 nt, Streptococcus pneumoniae R6
caaaccaccgacaaucguugca

SEQ ID NO: 4074654 - RNA, 18 nt, Streptococcus pneumoniae R6
caaaccguccucuucagc

SEQ ID NO: 4074655 - RNA, 21 nt, Streptococcus pneumoniae R6
caaaccguguucugucaugcg

SEQ ID NO: 4074656 - RNA, 15 nt, Streptococcus pneumoniae R6
caaacgauuaucuaa

SEQ ID NO: 4074657 - RNA, 22 nt, Streptococcus pneumoniae R6
caaacgauuuuuuucaaacaau

SEQ ID NO: 4074658 - RNA, 14 nt, Streptococcus pneumoniae R6
caaacgcgauacaa

SEQ ID NO: 4074659 - RNA, 22 nt, Streptococcus pneumoniae R6
caaacuagcaagugcuaagaua

SEQ ID NO: 4074660 - RNA, 16 nt, Streptococcus pneumoniae R6
caaacuaggaagcuag

SEQ ID NO: 4074661 - RNA, 17 nt, Streptococcus pneumoniae R6
caaacucaguuaaaauc

SEQ ID NO: 4074662 - RNA, 16 nt, Streptococcus pneumoniae R6
caaacucgaucugaau

SEQ ID NO: 4074663 - RNA, 18 nt, Streptococcus pneumoniae R6
caaacucgaucugaaugu

SEQ ID NO: 4074664 - RNA, 15 nt, Streptococcus pneumoniae R6
caaacucucauuaaa

SEQ ID NO: 4074665 - RNA, 18 nt, Streptococcus pneumoniae R6
caaacugaauccgcacug

SEQ ID NO: 4074666 - RNA, 16 nt, Streptococcus pneumoniae R6
caaacuggagcauuuc

SEQ ID NO: 4074667 - RNA, 14 nt, Streptococcus pneumoniae R6
caaacuguccacaa

SEQ ID NO: 4074668 - RNA, 19 nt, Streptococcus pneumoniae R6
caaacuguccacaaagaua

SEQ ID NO: 4074669 - RNA, 16 nt, Streptococcus pneumoniae R6
caaacuucuaaggaaa

SEQ ID NO: 4074670 - RNA, 19 nt, Streptococcus pneumoniae R6
caaacuucuaaggaaaaag

SEQ ID NO: 4074671 - RNA, 15 nt, Streptococcus pneumoniae R6
caaacuuguacuuga

SEQ ID NO: 4074672 - RNA, 12 nt, Streptococcus pneumoniae R6
caaacuuuuuag

SEQ ID NO: 4074673 - RNA, 12 nt, Streptococcus pneumoniae R6
caaagaaaaaag

SEQ ID NO: 4074674 - RNA, 16 nt, Streptococcus pneumoniae R6
caaagaaaaaagcugu

SEQ ID NO: 4074675 - RNA, 14 nt, Streptococcus pneumoniae R6
caaagaaaaagaag

SEQ ID NO: 4074676 - RNA, 15 nt, Streptococcus pneumoniae R6
caaagaacaugaaag

SEQ ID NO: 4074677 - RNA, 17 nt, Streptococcus pneumoniae R6
caaagaacaugaaagau

SEQ ID NO: 4074678 - RNA, 21 nt, Streptococcus pneumoniae R6
caaagaaggcuuuaccaaaaa

SEQ ID NO: 4074679 - RNA, 13 nt, Streptococcus pneumoniae R6
caaagaauaaaau

SEQ ID NO: 4074680 - RNA, 14 nt, Streptococcus pneumoniae R6
caaagacaaagguc

SEQ ID NO: 4074681 - RNA, 18 nt, Streptococcus pneumoniae R6
caaagacagguuucacau

SEQ ID NO: 4074682 - RNA, 18 nt, Streptococcus pneumoniae R6
caaagaccuuugaaaacu

SEQ ID NO: 4074683 - RNA, 18 nt, Streptococcus pneumoniae R6
caaagacuggguguuugc

SEQ ID NO: 4074684 - RNA, 13 nt, Streptococcus pneumoniae R6
caaagacuucuug

SEQ ID NO: 4074685 - RNA, 15 nt, Streptococcus pneumoniae R6
caaagacuucuugag

SEQ ID NO: 4074686 - RNA, 14 nt, Streptococcus pneumoniae R6
caaagagagcagau

SEQ ID NO: 4074687 - RNA, 14 nt, Streptococcus pneumoniae R6
caaagagccaaaaa

SEQ ID NO: 4074688 - RNA, 20 nt, Streptococcus pneumoniae R6
caaagagccagaaaaauccc

SEQ ID NO: 4074689 - RNA, 16 nt, Streptococcus pneumoniae R6
caaagagccauaaaaa

SEQ ID NO: 4074690 - RNA, 17 nt, Streptococcus pneumoniae R6
caaagagccauaaaaau

SEQ ID NO: 4074691 - RNA, 21 nt, Streptococcus pneumoniae R6
caaagagccggaaaauucucu

SEQ ID NO: 4074692 - RNA, 23 nt, Streptococcus pneumoniae R6
caaagagccgggauuuuuuagcu

SEQ ID NO: 4074693 - RNA, 21 nt, Streptococcus pneumoniae R6
caaagagucccuuagaaaaac

SEQ ID NO: 4074694 - RNA, 13 nt, Streptococcus pneumoniae R6
caaagauaaaauu

SEQ ID NO: 4074695 - RNA, 16 nt, Streptococcus pneumoniae R6
caaagauagaauccau

SEQ ID NO: 4074696 - RNA, 12 nt, Streptococcus pneumoniae R6
caaagauaucau

SEQ ID NO: 4074697 - RNA, 15 nt, Streptococcus pneumoniae R6
caaagaugagaggag

SEQ ID NO: 4074698 - RNA, 17 nt, Streptococcus pneumoniae R6
caaagauuaaucuucaa

SEQ ID NO: 4074699 - RNA, 23 nt, Streptococcus pneumoniae R6
caaagauuuuauccaaucuauuu

SEQ ID NO: 4074700 - RNA, 17 nt, Streptococcus pneumoniae R6
caaagcagaugcaaaag

SEQ ID NO: 4074701 - RNA, 18 nt, Streptococcus pneumoniae R6
caaagccaaucaaaaaau

SEQ ID NO: 4074702 - RNA, 12 nt, Streptococcus pneumoniae R6
caaagcgauaaa

SEQ ID NO: 4074703 - RNA, 15 nt, Streptococcus pneumoniae R6
caaagcgauaaaaau

SEQ ID NO: 4074704 - RNA, 14 nt, Streptococcus pneumoniae R6
caacaucuuuccag

SEQ ID NO: 4074705 - RNA, 22 nt, Streptococcus pneumoniae R6
caacaucuuuccagaacuucaa

SEQ ID NO: 4074706 - RNA, 23 nt, Streptococcus pneumoniae R6
caacaucuuuccagaacuucaau

SEQ ID NO: 4074707 - RNA, 13 nt, Streptococcus pneumoniae R6
caacaugguauug

SEQ ID NO: 4074708 - RNA, 15 nt, Streptococcus pneumoniae R6
caacauucuccagua

SEQ ID NO: 4074709 - RNA, 14 nt, Streptococcus pneumoniae R6
caaccaacuuuucc

SEQ ID NO: 4074710 - RNA, 15 nt, Streptococcus pneumoniae R6
caaccaagucugcau

SEQ ID NO: 4074711 - RNA, 17 nt, Streptococcus pneumoniae R6
caaccacguuccuuggc

SEQ ID NO: 4074712 - RNA, 17 nt, Streptococcus pneumoniae R6
caaccacuucgucuugu

SEQ ID NO: 4074713 - RNA, 12 nt, Streptococcus pneumoniae R6
caaccaguugcc

SEQ ID NO: 4074714 - RNA, 14 nt, Streptococcus pneumoniae R6
caaccaucaaaaua

SEQ ID NO: 4074715 - RNA, 13 nt, Streptococcus pneumoniae R6
caacccacuacag

SEQ ID NO: 4074716 - RNA, 16 nt, Streptococcus pneumoniae R6
caacccaguaaagugu

SEQ ID NO: 4074717 - RNA, 21 nt, Streptococcus pneumoniae R6
caacccucucuucaaauuuga

SEQ ID NO: 4074718 - RNA, 23 nt, Streptococcus pneumoniae R6
caacccucucuucaaauuugacu

SEQ ID NO: 4074719 - RNA, 15 nt, Streptococcus pneumoniae R6
caaccgcaaaagcuu

SEQ ID NO: 4074720 - RNA, 19 nt, Streptococcus pneumoniae R6
caaccgugcagucuuuuug

SEQ ID NO: 4074721 - RNA, 14 nt, Streptococcus pneumoniae R6
caaccucaaaaaca

SEQ ID NO: 4074722 - RNA, 19 nt, Streptococcus pneumoniae R6
caaccucaaaaacauguuu

SEQ ID NO: 4074723 - RNA, 18 nt, Streptococcus pneumoniae R6
caaccucaaaacaauguu

SEQ ID NO: 4074724 - RNA, 14 nt, Streptococcus pneumoniae R6
caaccucaaagcag

SEQ ID NO: 4074725 - RNA, 12 nt, Streptococcus pneumoniae R6
caaccucaaggc

SEQ ID NO: 4074726 - RNA, 17 nt, Streptococcus pneumoniae R6
caaccugaaucuccuca

SEQ ID NO: 4074727 - RNA, 19 nt, Streptococcus pneumoniae R6
caaccuuaccacuagugaa

SEQ ID NO: 4074728 - RNA, 13 nt, Streptococcus pneumoniae R6
caaccuuucucag

SEQ ID NO: 4074729 - RNA, 17 nt, Streptococcus pneumoniae R6
caaccuuucucagauaa

SEQ ID NO: 4074730 - RNA, 19 nt, Streptococcus pneumoniae R6
caaccuuucucagauaaua

SEQ ID NO: 4074731 - RNA, 20 nt, Streptococcus pneumoniae R6
caaccuuucucagauaauaa

SEQ ID NO: 4074732 - RNA, 23 nt, Streptococcus pneumoniae R6
caaccuuucucagauaauaauug

SEQ ID NO: 4074733 - RNA, 13 nt, Streptococcus pneumoniae R6
caacgaaaauaau

SEQ ID NO: 4074734 - RNA, 14 nt, Streptococcus pneumoniae R6
caacgccgucuucu

SEQ ID NO: 4074735 - RNA, 13 nt, Streptococcus pneumoniae R6
caacgguaucuug

SEQ ID NO: 4074736 - RNA, 20 nt, Streptococcus pneumoniae R6
caacgucuuuugccuuagca

SEQ ID NO: 4074737 - RNA, 19 nt, Streptococcus pneumoniae R6
caacgugauuagauaagag

SEQ ID NO: 4074738 - RNA, 16 nt, Streptococcus pneumoniae R6
caacguuaaagaguug

SEQ ID NO: 4074739 - RNA, 21 nt, Streptococcus pneumoniae R6
caacuaacaauuaugcuuaaa

SEQ ID NO: 4074740 - RNA, 11 nt, Streptococcus pneumoniae R6
caacuaaccaa

SEQ ID NO: 4074741 - RNA, 20 nt, Streptococcus pneumoniae R6
caacuacuaaaccaauaaua

SEQ ID NO: 4074742 - RNA, 14 nt, Streptococcus pneumoniae R6
caacuaggguuuua

SEQ ID NO: 4074743 - RNA, 13 nt, Streptococcus pneumoniae R6
caacuauucuuuu

SEQ ID NO: 4074744 - RNA, 14 nt, Streptococcus pneumoniae R6
caacuccuccuuca

SEQ ID NO: 4074745 - RNA, 20 nt, Streptococcus pneumoniae R6
caacuccucucuccuccccu

SEQ ID NO: 4074746 - RNA, 20 nt, Streptococcus pneumoniae R6
caacucuuauacuuuucucu

SEQ ID NO: 4074747 - RNA, 23 nt, Streptococcus pneumoniae R6
caacugaucccuccauuucauag

SEQ ID NO: 4074748 - RNA, 15 nt, Streptococcus pneumoniae R6
caacugauucuacuu

SEQ ID NO: 4074749 - RNA, 14 nt, Streptococcus pneumoniae R6
caacugcaaagaua

SEQ ID NO: 4074750 - RNA, 20 nt, Streptococcus pneumoniae R6
caacugcaaguccagaaccg

SEQ ID NO: 4074751 - RNA, 19 nt, Streptococcus pneumoniae R6
caacugccugguaaagacu

SEQ ID NO: 4074752 - RNA, 21 nt, Streptococcus pneumoniae R6
caacugcuguuuucauguucc

SEQ ID NO: 4074753 - RNA, 22 nt, Streptococcus pneumoniae R6
caacugcuucuaagaucugguu

SEQ ID NO: 4074754 - RNA, 15 nt, Streptococcus pneumoniae R6
caacuggcaucccca

SEQ ID NO: 4074755 - RNA, 23 nt, Streptococcus pneumoniae R6
caacuguaguggguugaaaaaaa

SEQ ID NO: 4074756 - RNA, 18 nt, Streptococcus pneumoniae R6
caacugucuuauccaaac

SEQ ID NO: 4074757 - RNA, 21 nt, Streptococcus pneumoniae R6
caacugucuuauccaaacuag

SEQ ID NO: 4074758 - RNA, 13 nt, Streptococcus pneumoniae R6
caacuguuuuuuc

SEQ ID NO: 4074759 - RNA, 19 nt, Streptococcus pneumoniae R6
caacuguuuuuucaacagc

SEQ ID NO: 4074760 - RNA, 22 nt, Streptococcus pneumoniae R6
caacuugaagcaaaucaacugg

SEQ ID NO: 4074761 - RNA, 15 nt, Streptococcus pneumoniae R6
caacuuguaaacauc

SEQ ID NO: 4074762 - RNA, 22 nt, Streptococcus pneumoniae R6
caacuuuaguccacgguaaaua

SEQ ID NO: 4074763 - RNA, 20 nt, Streptococcus pneumoniae R6
caacuuuuccaauagauaau

SEQ ID NO: 4074764 - RNA, 22 nt, Streptococcus pneumoniae R6
caagaaaagugcaaauaagaaa

SEQ ID NO: 4074765 - RNA, 16 nt, Streptococcus pneumoniae R6
caagaaagagaauaac

SEQ ID NO: 4074766 - RNA, 17 nt, Streptococcus pneumoniae R6
caagaaagagaauaaca

SEQ ID NO: 4074767 - RNA, 14 nt, Streptococcus pneumoniae R6
caagaacaagacaa

SEQ ID NO: 4074768 - RNA, 18 nt, Streptococcus pneumoniae R6
caagaacaagacaaaaga

SEQ ID NO: 4074769 - RNA, 17 nt, Streptococcus pneumoniae R6
caagaacaauuucacaa

SEQ ID NO: 4074770 - RNA, 16 nt, Streptococcus pneumoniae R6
caagaacucuucuggu

SEQ ID NO: 4074771 - RNA, 18 nt, Streptococcus pneumoniae R6
caagaacuuuaacuugaa

SEQ ID NO: 4074772 - RNA, 13 nt, Streptococcus pneumoniae R6
caagaagagggcu

SEQ ID NO: 4074773 - RNA, 17 nt, Streptococcus pneumoniae R6
caagaagguuucaugug

SEQ ID NO: 4074774 - RNA, 13 nt, Streptococcus pneumoniae R6
caagaaguccaua

SEQ ID NO: 4074775 - RNA, 14 nt, Streptococcus pneumoniae R6
caagacaaaaacuc

SEQ ID NO: 4074776 - RNA, 17 nt, Streptococcus pneumoniae R6
caagacauagucaagcu

SEQ ID NO: 4074777 - RNA, 13 nt, Streptococcus pneumoniae R6
caagaccauggcg

SEQ ID NO: 4074778 - RNA, 15 nt, Streptococcus pneumoniae R6
caagaccauuuccau

SEQ ID NO: 4074779 - RNA, 17 nt, Streptococcus pneumoniae R6
caagaccauuuccaucu

SEQ ID NO: 4074780 - RNA, 23 nt, Streptococcus pneumoniae R6
caagaccgagaaacaagaacucu

SEQ ID NO: 4074781 - RNA, 16 nt, Streptococcus pneumoniae R6
caagacgaaccaaugu

SEQ ID NO: 4074782 - RNA, 16 nt, Streptococcus pneumoniae R6
caagacgaagcugaca

SEQ ID NO: 4074783 - RNA, 17 nt, Streptococcus pneumoniae R6
caagacguucaaagaua

SEQ ID NO: 4074784 - RNA, 18 nt, Streptococcus pneumoniae R6
caagacguucaaagauau

SEQ ID NO: 4074785 - RNA, 19 nt, Streptococcus pneumoniae R6
caagacuaccgcuccuaau

SEQ ID NO: 4074786 - RNA, 19 nt, Streptococcus pneumoniae R6
caagacuuucaauucuuca

SEQ ID NO: 4074787 - RNA, 16 nt, Streptococcus pneumoniae R6
caagacuuuuugagcc

SEQ ID NO: 4074788 - RNA, 13 nt, Streptococcus pneumoniae R6
caagagaaaacca

SEQ ID NO: 4074789 - RNA, 15 nt, Streptococcus pneumoniae R6
caagagaaaaccaaa

SEQ ID NO: 4074790 - RNA, 16 nt, Streptococcus pneumoniae R6
caagagaaaaccaaaa

SEQ ID NO: 4074791 - RNA, 13 nt, Streptococcus pneumoniae R6
caagagaaaucau

SEQ ID NO: 4074792 - RNA, 18 nt, Streptococcus pneumoniae R6
caagagaccuuucauaaa

SEQ ID NO: 4074793 - RNA, 22 nt, Streptococcus pneumoniae R6
caagagacgauuccaaacaaca

SEQ ID NO: 4074794 - RNA, 23 nt, Streptococcus pneumoniae R6
caagagacgauuccaaacaacaa

SEQ ID NO: 4074795 - RNA, 13 nt, Streptococcus pneumoniae R6
caagagacucuuu

SEQ ID NO: 4074796 - RNA, 23 nt, Streptococcus pneumoniae R6
caagagcaccgcggauguuauac

SEQ ID NO: 4074797 - RNA, 15 nt, Streptococcus pneumoniae R6
caagagccuuuuuaa

SEQ ID NO: 4074798 - RNA, 20 nt, Streptococcus pneumoniae R6
caagagccuuuuuaaagaua

SEQ ID NO: 4074799 - RNA, 19 nt, Streptococcus pneumoniae R6
caagagcgguuaauuuaaa

SEQ ID NO: 4074800 - RNA, 15 nt, Streptococcus pneumoniae R6
caagagcugauagag

SEQ ID NO: 4074801 - RNA, 17 nt, Streptococcus pneumoniae R6
caagagcugauagagau

SEQ ID NO: 4074802 - RNA, 21 nt, Streptococcus pneumoniae R6
caagagcugauagugguguuu

SEQ ID NO: 4074803 - RNA, 17 nt, Streptococcus pneumoniae R6
caagagcuuuaauagaa

SEQ ID NO: 4074804 - RNA, 19 nt, Streptococcus pneumoniae R6
caagaggguggaaagacug

SEQ ID NO: 4074805 - RNA, 19 nt, Streptococcus pneumoniae R6
caagauaaggaauuuuaga

SEQ ID NO: 4074806 - RNA, 16 nt, Streptococcus pneumoniae R6
caagauagaacuauga

SEQ ID NO: 4074807 - RNA, 21 nt, Streptococcus pneumoniae R6
caauaauaaaacuuuuaaaau

SEQ ID NO: 4074808 - RNA, 15 nt, Streptococcus pneumoniae R6
caauaauagaaaaca

SEQ ID NO: 4074809 - RNA, 16 nt, Streptococcus pneumoniae R6
caauaauagcuugcaa

SEQ ID NO: 4074810 - RNA, 22 nt, Streptococcus pneumoniae R6
caauaauagcuugcaauucuuu

SEQ ID NO: 4074811 - RNA, 19 nt, Streptococcus pneumoniae R6
caauaauccuaacuuaaaa

SEQ ID NO: 4074812 - RNA, 17 nt, Streptococcus pneumoniae R6
caauaauuucuuuuugu

SEQ ID NO: 4074813 - RNA, 16 nt, Streptococcus pneumoniae R6
caauacagauaaaaau

SEQ ID NO: 4074814 - RNA, 20 nt, Streptococcus pneumoniae R6
caauacagcuuuuuucuuug

SEQ ID NO: 4074815 - RNA, 13 nt, Streptococcus pneumoniae R6
caauacaggaaaa

SEQ ID NO: 4074816 - RNA, 17 nt, Streptococcus pneumoniae R6
caauacaggaaaaccag

SEQ ID NO: 4074817 - RNA, 17 nt, Streptococcus pneumoniae R6
caauacaguagaugauu

SEQ ID NO: 4074818 - RNA, 17 nt, Streptococcus pneumoniae R6
caauacccccuuaaaac

SEQ ID NO: 4074819 - RNA, 21 nt, Streptococcus pneumoniae R6
caauacuuggugcuauuuguu

SEQ ID NO: 4074820 - RNA, 14 nt, Streptococcus pneumoniae R6
caauacuuuccaau

SEQ ID NO: 4074821 - RNA, 12 nt, Streptococcus pneumoniae R6
caauacuuuuuc

SEQ ID NO: 4074822 - RNA, 15 nt, Streptococcus pneumoniae R6
caauagcaacuacug

SEQ ID NO: 4074823 - RNA, 14 nt, Streptococcus pneumoniae R6
caauagcaagguuc

SEQ ID NO: 4074824 - RNA, 22 nt, Streptococcus pneumoniae R6
caauagcauugucacaaaggau

SEQ ID NO: 4074825 - RNA, 23 nt, Streptococcus pneumoniae R6
caauagcgauucccaagucugac

SEQ ID NO: 4074826 - RNA, 17 nt, Streptococcus pneumoniae R6
caauaggauuguacuca

SEQ ID NO: 4074827 - RNA, 18 nt, Streptococcus pneumoniae R6
caauauagaaguaguuua

SEQ ID NO: 4074828 - RNA, 12 nt, Streptococcus pneumoniae R6
caauauagucua

SEQ ID NO: 4074829 - RNA, 20 nt, Streptococcus pneumoniae R6
caauauagucuacaauagcu

SEQ ID NO: 4074830 - RNA, 22 nt, Streptococcus pneumoniae R6
caauauagugaaauuaacaaaa

SEQ ID NO: 4074831 - RNA, 14 nt, Streptococcus pneumoniae R6
caauauauccaaaa

SEQ ID NO: 4074832 - RNA, 19 nt, Streptococcus pneumoniae R6
caauauauccaaaaccauu

SEQ ID NO: 4074833 - RNA, 15 nt, Streptococcus pneumoniae R6
caauaucaaaaccaa

SEQ ID NO: 4074834 - RNA, 13 nt, Streptococcus pneumoniae R6
caauaucuucugc

SEQ ID NO: 4074835 - RNA, 16 nt, Streptococcus pneumoniae R6
caauaucuuuaaagcu

SEQ ID NO: 4074836 - RNA, 13 nt, Streptococcus pneumoniae R6
caauauggguaua

SEQ ID NO: 4074837 - RNA, 22 nt, Streptococcus pneumoniae R6
caauauucuccgaagucaagcc

SEQ ID NO: 4074838 - RNA, 19 nt, Streptococcus pneumoniae R6
caauauucucuagaaaucu

SEQ ID NO: 4074839 - RNA, 15 nt, Streptococcus pneumoniae R6
caauauuuuugagcc

SEQ ID NO: 4074840 - RNA, 16 nt, Streptococcus pneumoniae R6
caauauuuuugagccu

SEQ ID NO: 4074841 - RNA, 12 nt, Streptococcus pneumoniae R6
caaucaaaaaau

SEQ ID NO: 4074842 - RNA, 11 nt, Streptococcus pneumoniae R6
caaucaaauca

SEQ ID NO: 4074843 - RNA, 16 nt, Streptococcus pneumoniae R6
caaucaaaucaauaac

SEQ ID NO: 4074844 - RNA, 14 nt, Streptococcus pneumoniae R6
caaucaaauucauu

SEQ ID NO: 4074845 - RNA, 21 nt, Streptococcus pneumoniae R6
caaucaaauugugcaguuuuc

SEQ ID NO: 4074846 - RNA, 15 nt, Streptococcus pneumoniae R6
caaucaacuuccaug

SEQ ID NO: 4074847 - RNA, 15 nt, Streptococcus pneumoniae R6
caaucaaucguccuu

SEQ ID NO: 4074848 - RNA, 17 nt, Streptococcus pneumoniae R6
caaucacucuaacuucu

SEQ ID NO: 4074849 - RNA, 17 nt, Streptococcus pneumoniae R6
caaucagacuauaauau

SEQ ID NO: 4074850 - RNA, 20 nt, Streptococcus pneumoniae R6
caaucagacuguuuuucuug

SEQ ID NO: 4074851 - RNA, 15 nt, Streptococcus pneumoniae R6
caaucagaugacugg

SEQ ID NO: 4074852 - RNA, 16 nt, Streptococcus pneumoniae R6
caaucauagauucacc

SEQ ID NO: 4074853 - RNA, 19 nt, Streptococcus pneumoniae R6
caaucauaucaucaaucaa

SEQ ID NO: 4074854 - RNA, 14 nt, Streptococcus pneumoniae R6
caaucauugcaaag

SEQ ID NO: 4074855 - RNA, 21 nt, Streptococcus pneumoniae R6
caaucauugcaaaggagagga

SEQ ID NO: 4074856 - RNA, 18 nt, Streptococcus pneumoniae R6
caaucauuucaaagccuu

SEQ ID NO: 4074857 - RNA, 19 nt, Streptococcus pneumoniae R6
caaucauuucaguugccuc

SEQ ID NO: 4074858 - RNA, 12 nt, Streptococcus pneumoniae R6
caauccaauugu

SEQ ID NO: 4074859 - RNA, 14 nt, Streptococcus pneumoniae R6
caauccacggcuca

SEQ ID NO: 4074860 - RNA, 22 nt, Streptococcus pneumoniae R6
caaucccuagcuuuuuccucau

SEQ ID NO: 4074861 - RNA, 24 nt, Streptococcus pneumoniae R6
caaucccuuuuuaagauuuuaccu

SEQ ID NO: 4074862 - RNA, 17 nt, Streptococcus pneumoniae R6
caauccguuugugugaa

SEQ ID NO: 4074863 - RNA, 13 nt, Streptococcus pneumoniae R6
caauccuuuucug

SEQ ID NO: 4074864 - RNA, 14 nt, Streptococcus pneumoniae R6
caauccuuuucuga

SEQ ID NO: 4074865 - RNA, 16 nt, Streptococcus pneumoniae R6
caauccuuuucugagg

SEQ ID NO: 4074866 - RNA, 15 nt, Streptococcus pneumoniae R6
caaucgauuuguucu

SEQ ID NO: 4074867 - RNA, 17 nt, Streptococcus pneumoniae R6
caaucgauuuguucuca

SEQ ID NO: 4074868 - RNA, 22 nt, Streptococcus pneumoniae R6
caaucgauuuguucucaucuua

SEQ ID NO: 4074869 - RNA, 16 nt, Streptococcus pneumoniae R6
caaucgccaauucuuu

SEQ ID NO: 4074870 - RNA, 18 nt, Streptococcus pneumoniae R6
caaucgcuuaauuucuau

SEQ ID NO: 4074871 - RNA, 16 nt, Streptococcus pneumoniae R6
caaucuacuauagaaa

SEQ ID NO: 4074872 - RNA, 15 nt, Streptococcus pneumoniae R6
caaucuacuuguuca

SEQ ID NO: 4074873 - RNA, 18 nt, Streptococcus pneumoniae R6
caaucucaaggcacgauu

SEQ ID NO: 4074874 - RNA, 17 nt, Streptococcus pneumoniae R6
caaucucgguagauacc

SEQ ID NO: 4074875 - RNA, 18 nt, Streptococcus pneumoniae R6
caaucucugcaauuucua

SEQ ID NO: 4074876 - RNA, 20 nt, Streptococcus pneumoniae R6
caaucucugcaauuucuaau

SEQ ID NO: 4074877 - RNA, 15 nt, Streptococcus pneumoniae R6
caaucucuuccaaag

SEQ ID NO: 4074878 - RNA, 19 nt, Streptococcus pneumoniae R6
caaucuggaggcuuuuucu

SEQ ID NO: 4074879 - RNA, 17 nt, Streptococcus pneumoniae R6
caaucuuaccaaccuca

SEQ ID NO: 4074880 - RNA, 20 nt, Streptococcus pneumoniae R6
caaucuuaccaaccucagaa

SEQ ID NO: 4074881 - RNA, 17 nt, Streptococcus pneumoniae R6
caaucuuaucaaucaaa

SEQ ID NO: 4074882 - RNA, 11 nt, Streptococcus pneumoniae R6
caaucuugucg

SEQ ID NO: 4074883 - RNA, 12 nt, Streptococcus pneumoniae R6
caaucuuuuuag

SEQ ID NO: 4074884 - RNA, 14 nt, Streptococcus pneumoniae R6
caaugaaaaucaaa

SEQ ID NO: 4074885 - RNA, 19 nt, Streptococcus pneumoniae R6
caaugacucccauaaaaau

SEQ ID NO: 4074886 - RNA, 20 nt, Streptococcus pneumoniae R6
caaugacucccauaaaaaua

SEQ ID NO: 4074887 - RNA, 22 nt, Streptococcus pneumoniae R6
caaugacucccauaaaaauaau

SEQ ID NO: 4074888 - RNA, 12 nt, Streptococcus pneumoniae R6
caaugagccaag

SEQ ID NO: 4074889 - RNA, 13 nt, Streptococcus pneumoniae R6
caaugauaaaagu

SEQ ID NO: 4074890 - RNA, 16 nt, Streptococcus pneumoniae R6
caaugauagacauuuc

SEQ ID NO: 4074891 - RNA, 22 nt, Streptococcus pneumoniae R6
caaugauaucugguauauuuug

SEQ ID NO: 4074892 - RNA, 17 nt, Streptococcus pneumoniae R6
caaugaucaagaugaga

SEQ ID NO: 4074893 - RNA, 21 nt, Streptococcus pneumoniae R6
caaugaugagggcgauuuucc

SEQ ID NO: 4074894 - RNA, 21 nt, Streptococcus pneumoniae R6
caaugcggaccaaauccccau

SEQ ID NO: 4074895 - RNA, 16 nt, Streptococcus pneumoniae R6
caauggaaaugauaau

SEQ ID NO: 4074896 - RNA, 22 nt, Streptococcus pneumoniae R6
caauggaguaaaaaaagaguug

SEQ ID NO: 4074897 - RNA, 14 nt, Streptococcus pneumoniae R6
caauggcaaaaaau

SEQ ID NO: 4074898 - RNA, 15 nt, Streptococcus pneumoniae R6
caauggccuguucua

SEQ ID NO: 4074899 - RNA, 20 nt, Streptococcus pneumoniae R6
caauggggcuuuauuugaua

SEQ ID NO: 4074900 - RNA, 18 nt, Streptococcus pneumoniae R6
caaugggguucaucucug

SEQ ID NO: 4074901 - RNA, 16 nt, Streptococcus pneumoniae R6
caaugguaacagucuu

SEQ ID NO: 4074902 - RNA, 18 nt, Streptococcus pneumoniae R6
caaugguuccaauaguca

SEQ ID NO: 4074903 - RNA, 20 nt, Streptococcus pneumoniae R6
caauguacuggauaaaguua

SEQ ID NO: 4074904 - RNA, 15 nt, Streptococcus pneumoniae R6
caauguucaagacau

SEQ ID NO: 4074905 - RNA, 18 nt, Streptococcus pneumoniae R6
caauguucucauauuuuc

SEQ ID NO: 4074906 - RNA, 19 nt, Streptococcus pneumoniae R6
caauguucucauauuuucu

SEQ ID NO: 4074907 - RNA, 17 nt, Streptococcus pneumoniae R6
caauguugucaauuucc

SEQ ID NO: 4074908 - RNA, 20 nt, Streptococcus pneumoniae R6
caauguugucaauuuccauu

SEQ ID NO: 4074909 - RNA, 17 nt, Streptococcus pneumoniae R6
caauguuuugaucugac

SEQ ID NO: 4074910 - RNA, 14 nt, Streptococcus pneumoniae R6
caccaguagacuug

SEQ ID NO: 4074911 - RNA, 16 nt, Streptococcus pneumoniae R6
caccauaguguuucuc

SEQ ID NO: 4074912 - RNA, 18 nt, Streptococcus pneumoniae R6
caccauaguguuucucug

SEQ ID NO: 4074913 - RNA, 20 nt, Streptococcus pneumoniae R6
caccaucuauaaguaagaga

SEQ ID NO: 4074914 - RNA, 19 nt, Streptococcus pneumoniae R6
cacccaaaacuucugcaau

SEQ ID NO: 4074915 - RNA, 15 nt, Streptococcus pneumoniae R6
cacccacgucacaaa

SEQ ID NO: 4074916 - RNA, 19 nt, Streptococcus pneumoniae R6
cacccauggcaacguuaaa

SEQ ID NO: 4074917 - RNA, 16 nt, Streptococcus pneumoniae R6
caccccacgaaggaca

SEQ ID NO: 4074918 - RNA, 21 nt, Streptococcus pneumoniae R6
cacccuuagucgcuacaggca

SEQ ID NO: 4074919 - RNA, 21 nt, Streptococcus pneumoniae R6
caccgaaggcuugcucuguca

SEQ ID NO: 4074920 - RNA, 13 nt, Streptococcus pneumoniae R6
caccgaagucagu

SEQ ID NO: 4074921 - RNA, 14 nt, Streptococcus pneumoniae R6
caccgaccaauucu

SEQ ID NO: 4074922 - RNA, 16 nt, Streptococcus pneumoniae R6
caccgacgauaaggac

SEQ ID NO: 4074923 - RNA, 22 nt, Streptococcus pneumoniae R6
caccgccgaggacggagcuugg

SEQ ID NO: 4074924 - RNA, 15 nt, Streptococcus pneumoniae R6
caccguaauuuccuc

SEQ ID NO: 4074925 - RNA, 17 nt, Streptococcus pneumoniae R6
caccguaauuuccucug

SEQ ID NO: 4074926 - RNA, 15 nt, Streptococcus pneumoniae R6
caccuagaacaagcu

SEQ ID NO: 4074927 - RNA, 14 nt, Streptococcus pneumoniae R6
caccuagcgccugu

SEQ ID NO: 4074928 - RNA, 16 nt, Streptococcus pneumoniae R6
caccuaguacaaagaa

SEQ ID NO: 4074929 - RNA, 17 nt, Streptococcus pneumoniae R6
caccuaguccaagacgu

SEQ ID NO: 4074930 - RNA, 14 nt, Streptococcus pneumoniae R6
caccuauuaacaau

SEQ ID NO: 4074931 - RNA, 23 nt, Streptococcus pneumoniae R6
caccuauucuaaguccaucacua

SEQ ID NO: 4074932 - RNA, 14 nt, Streptococcus pneumoniae R6
caccuccuucucca

SEQ ID NO: 4074933 - RNA, 18 nt, Streptococcus pneumoniae R6
caccugacaauguaccug

SEQ ID NO: 4074934 - RNA, 15 nt, Streptococcus pneumoniae R6
caccugauacuaugc

SEQ ID NO: 4074935 - RNA, 18 nt, Streptococcus pneumoniae R6
caccugauuucuccgcuu

SEQ ID NO: 4074936 - RNA, 14 nt, Streptococcus pneumoniae R6
caccugcagcgauu

SEQ ID NO: 4074937 - RNA, 17 nt, Streptococcus pneumoniae R6
caccugcagcgauugaa

SEQ ID NO: 4074938 - RNA, 15 nt, Streptococcus pneumoniae R6
caccugcuacagaga

SEQ ID NO: 4074939 - RNA, 15 nt, Streptococcus pneumoniae R6
caccuguugcuggca

SEQ ID NO: 4074940 - RNA, 21 nt, Streptococcus pneumoniae R6
caccuguugcuggcaagauuu

SEQ ID NO: 4074941 - RNA, 17 nt, Streptococcus pneumoniae R6
caccuuaucacgaauuu

SEQ ID NO: 4074942 - RNA, 15 nt, Streptococcus pneumoniae R6
caccuugaucuucca

SEQ ID NO: 4074943 - RNA, 23 nt, Streptococcus pneumoniae R6
caccuuuguauggaaacucaaaa

SEQ ID NO: 4074944 - RNA, 11 nt, Streptococcus pneumoniae R6
caccuuuucuc

SEQ ID NO: 4074945 - RNA, 18 nt, Streptococcus pneumoniae R6
caccuuuugcgucuucua

SEQ ID NO: 4074946 - RNA, 17 nt, Streptococcus pneumoniae R6
cacgaaaauauuuggaa

SEQ ID NO: 4074947 - RNA, 18 nt, Streptococcus pneumoniae R6
cacgaagcauaucagaca

SEQ ID NO: 4074948 - RNA, 19 nt, Streptococcus pneumoniae R6
cacgaagcauaucagacau

SEQ ID NO: 4074949 - RNA, 15 nt, Streptococcus pneumoniae R6
cacgaaggacaucuu

SEQ ID NO: 4074950 - RNA, 15 nt, Streptococcus pneumoniae R6
cacgaaguccuuguu

SEQ ID NO: 4074951 - RNA, 21 nt, Streptococcus pneumoniae R6
cacgaaguccuuguuugagcu

SEQ ID NO: 4074952 - RNA, 19 nt, Streptococcus pneumoniae R6
cacgaccagaaaaucauug

SEQ ID NO: 4074953 - RNA, 18 nt, Streptococcus pneumoniae R6
cacgacgggcuuggaaau

SEQ ID NO: 4074954 - RNA, 21 nt, Streptococcus pneumoniae R6
cacgacuaauuucaaaggcuu

SEQ ID NO: 4074955 - RNA, 18 nt, Streptococcus pneumoniae R6
cacgagccaagacuuuuu

SEQ ID NO: 4074956 - RNA, 20 nt, Streptococcus pneumoniae R6
cacgaggaggagaaaaagcg

SEQ ID NO: 4074957 - RNA, 17 nt, Streptococcus pneumoniae R6
cacgauaaucugggcua

SEQ ID NO: 4074958 - RNA, 18 nt, Streptococcus pneumoniae R6
cacgaucauccauucuuu

SEQ ID NO: 4074959 - RNA, 23 nt, Streptococcus pneumoniae R6
cacgauuaucuagucgaagcuuc

SEQ ID NO: 4074960 - RNA, 22 nt, Streptococcus pneumoniae R6
cacgauuggggucagaaagaag

SEQ ID NO: 4074961 - RNA, 19 nt, Streptococcus pneumoniae R6
cacgcauaagcaauuuuuu

SEQ ID NO: 4074962 - RNA, 14 nt, Streptococcus pneumoniae R6
cacgcuaaguagaa

SEQ ID NO: 4074963 - RNA, 15 nt, Streptococcus pneumoniae R6
cacgcuaccauuauc

SEQ ID NO: 4074964 - RNA, 22 nt, Streptococcus pneumoniae R6
cacggaauuuuucgacugugau

SEQ ID NO: 4074965 - RNA, 13 nt, Streptococcus pneumoniae R6
cacggacuucugc

SEQ ID NO: 4074966 - RNA, 20 nt, Streptococcus pneumoniae R6
cacggagcgagacaaaacaa

SEQ ID NO: 4074967 - RNA, 17 nt, Streptococcus pneumoniae R6
cacggaguuucuuggcc

SEQ ID NO: 4074968 - RNA, 22 nt, Streptococcus pneumoniae R6
cacggauaguuccuaaucugga

SEQ ID NO: 4074969 - RNA, 16 nt, Streptococcus pneumoniae R6
cacggaucuugaacug

SEQ ID NO: 4074970 - RNA, 15 nt, Streptococcus pneumoniae R6
cacggcuaauaccag

SEQ ID NO: 4074971 - RNA, 16 nt, Streptococcus pneumoniae R6
cacgggggaaaucaua

SEQ ID NO: 4074972 - RNA, 15 nt, Streptococcus pneumoniae R6
cacggguuuaacuaa

SEQ ID NO: 4074973 - RNA, 17 nt, Streptococcus pneumoniae R6
cacgguauuuaagauaa

SEQ ID NO: 4074974 - RNA, 24 nt, Streptococcus pneumoniae R6
cacguaaauugcccuugucauccu

SEQ ID NO: 4074975 - RNA, 14 nt, Streptococcus pneumoniae R6
cacguauaauucua

SEQ ID NO: 4074976 - RNA, 22 nt, Streptococcus pneumoniae R6
cacgucaacgucgccuugccgu

SEQ ID NO: 4074977 - RNA, 13 nt, Streptococcus pneumoniae R6
cacguccaauuuu

SEQ ID NO: 4074978 - RNA, 20 nt, Streptococcus pneumoniae R6
cacgugccugcauggcuccu

SEQ ID NO: 4074979 - RNA, 22 nt, Streptococcus pneumoniae R6
cacgugcggcuagccuccuagu

SEQ ID NO: 4074980 - RNA, 19 nt, Streptococcus pneumoniae R6
cacgugcucaaaacacugu

SEQ ID NO: 4074981 - RNA, 18 nt, Streptococcus pneumoniae R6
cacguuccauaccaucaa

SEQ ID NO: 4074982 - RNA, 17 nt, Streptococcus pneumoniae R6
cacguuucuaauaauua

SEQ ID NO: 4074983 - RNA, 17 nt, Streptococcus pneumoniae R6
cacuaaagguugaugag

SEQ ID NO: 4074984 - RNA, 20 nt, Streptococcus pneumoniae R6
cacuaaggacacgcuucuuu

SEQ ID NO: 4074985 - RNA, 21 nt, Streptococcus pneumoniae R6
cacuaauucaccuaaccaaau

SEQ ID NO: 4074986 - RNA, 14 nt, Streptococcus pneumoniae R6
cacuacaguugaca

SEQ ID NO: 4074987 - RNA, 17 nt, Streptococcus pneumoniae R6
cacuacaguugacaaag

SEQ ID NO: 4074988 - RNA, 22 nt, Streptococcus pneumoniae R6
cacuacaguugacaaagagcca

SEQ ID NO: 4074989 - RNA, 23 nt, Streptococcus pneumoniae R6
cacuagaaaaugaggaaaaucuu

SEQ ID NO: 4074990 - RNA, 20 nt, Streptococcus pneumoniae R6
cacuagcagccacuuuuuau

SEQ ID NO: 4074991 - RNA, 13 nt, Streptococcus pneumoniae R6
cacuagccccagc

SEQ ID NO: 4074992 - RNA, 22 nt, Streptococcus pneumoniae R6
cacuagcgagggaaacagccaa

SEQ ID NO: 4074993 - RNA, 22 nt, Streptococcus pneumoniae R6
cacuagucaugaccccuaaaua

SEQ ID NO: 4074994 - RNA, 22 nt, Streptococcus pneumoniae R6
cacuaguuuuaggacauaaaua

SEQ ID NO: 4074995 - RNA, 15 nt, Streptococcus pneumoniae R6
cacuauaaaacauuc

SEQ ID NO: 4074996 - RNA, 15 nt, Streptococcus pneumoniae R6
cacuauaacuuguuu

SEQ ID NO: 4074997 - RNA, 16 nt, Streptococcus pneumoniae R6
cacuauaauaauuuau

SEQ ID NO: 4074998 - RNA, 19 nt, Streptococcus pneumoniae R6
cacuauauugcaagagaaa

SEQ ID NO: 4074999 - RNA, 15 nt, Streptococcus pneumoniae R6
cacuaucgaaaaaua

SEQ ID NO: 4075000 - RNA, 21 nt, Streptococcus pneumoniae R6
cacuauggagaaucguauucu

SEQ ID NO: 4075001 - RNA, 14 nt, Streptococcus pneumoniae R6
cacuauucaucagg

SEQ ID NO: 4075002 - RNA, 23 nt, Streptococcus pneumoniae R6
cacuauugaugaaguaaauguga

SEQ ID NO: 4075003 - RNA, 17 nt, Streptococcus pneumoniae R6
cacuauuguauuuaugu

SEQ ID NO: 4075004 - RNA, 18 nt, Streptococcus pneumoniae R6
cacuauuguuauuuuucu

SEQ ID NO: 4075005 - RNA, 20 nt, Streptococcus pneumoniae R6
cacuauuuguagcaaauuca

SEQ ID NO: 4075006 - RNA, 12 nt, Streptococcus pneumoniae R6
cacucaaaccug

SEQ ID NO: 4075007 - RNA, 21 nt, Streptococcus pneumoniae R6
cacucaaaucaaaauauagca

SEQ ID NO: 4075008 - RNA, 17 nt, Streptococcus pneumoniae R6
cacucaacauuauccau

SEQ ID NO: 4075009 - RNA, 12 nt, Streptococcus pneumoniae R6
cacucaauauua

SEQ ID NO: 4075010 - RNA, 14 nt, Streptococcus pneumoniae R6
cacucaauuuaucu

SEQ ID NO: 4075011 - RNA, 18 nt, Streptococcus pneumoniae R6
cacucagggcaagauggg

SEQ ID NO: 4075012 - RNA, 23 nt, Streptococcus pneumoniae R6
cagauagguggggcaaaaacaca

SEQ ID NO: 4075013 - RNA, 17 nt, Streptococcus pneumoniae R6
cagauauucuaaaaccu

SEQ ID NO: 4075014 - RNA, 13 nt, Streptococcus pneumoniae R6
cagaugaaagcug

SEQ ID NO: 4075015 - RNA, 18 nt, Streptococcus pneumoniae R6
cagaugaaagcugaugcg

SEQ ID NO: 4075016 - RNA, 12 nt, Streptococcus pneumoniae R6
cagaugacugga

SEQ ID NO: 4075017 - RNA, 19 nt, Streptococcus pneumoniae R6
cagaugaugagcuggaaga

SEQ ID NO: 4075018 - RNA, 15 nt, Streptococcus pneumoniae R6
cagaugcaaaaguca

SEQ ID NO: 4075019 - RNA, 13 nt, Streptococcus pneumoniae R6
cagaugcuugcau

SEQ ID NO: 4075020 - RNA, 14 nt, Streptococcus pneumoniae R6
cagaugcuugcauu

SEQ ID NO: 4075021 - RNA, 20 nt, Streptococcus pneumoniae R6
cagaugcuugcauuuuuuga

SEQ ID NO: 4075022 - RNA, 14 nt, Streptococcus pneumoniae R6
cagauuaguaauuc

SEQ ID NO: 4075023 - RNA, 15 nt, Streptococcus pneumoniae R6
cagauuaguaauuca

SEQ ID NO: 4075024 - RNA, 13 nt, Streptococcus pneumoniae R6
cagauucaucacg

SEQ ID NO: 4075025 - RNA, 18 nt, Streptococcus pneumoniae R6
cagauugcucaaaacacu

SEQ ID NO: 4075026 - RNA, 13 nt, Streptococcus pneumoniae R6
cagauuguccuca

SEQ ID NO: 4075027 - RNA, 23 nt, Streptococcus pneumoniae R6
cagauugucgguagaacgauaaa

SEQ ID NO: 4075028 - RNA, 22 nt, Streptococcus pneumoniae R6
cagauuuauggucuuuuaacca

SEQ ID NO: 4075029 - RNA, 22 nt, Streptococcus pneumoniae R6
cagauuucaaaccugagaagga

SEQ ID NO: 4075030 - RNA, 15 nt, Streptococcus pneumoniae R6
cagauuuccauuaaa

SEQ ID NO: 4075031 - RNA, 20 nt, Streptococcus pneumoniae R6
cagauuugaaaacugaugaa

SEQ ID NO: 4075032 - RNA, 13 nt, Streptococcus pneumoniae R6
cagauuuuaaaga

SEQ ID NO: 4075033 - RNA, 13 nt, Streptococcus pneumoniae R6
cagauuuugaaga

SEQ ID NO: 4075034 - RNA, 12 nt, Streptococcus pneumoniae R6
cagauuuuucug

SEQ ID NO: 4075035 - RNA, 21 nt, Streptococcus pneumoniae R6
cagcaaaggacuaugaucagc

SEQ ID NO: 4075036 - RNA, 16 nt, Streptococcus pneumoniae R6
cagcaagaaugaacau

SEQ ID NO: 4075037 - RNA, 17 nt, Streptococcus pneumoniae R6
cagcaagaaugaacauc

SEQ ID NO: 4075038 - RNA, 24 nt, Streptococcus pneumoniae R6
cagcaagaguugauagagcugaua

SEQ ID NO: 4075039 - RNA, 19 nt, Streptococcus pneumoniae R6
cagcacguuuuucuucuuu

SEQ ID NO: 4075040 - RNA, 14 nt, Streptococcus pneumoniae R6
cagcacuaaaacgu

SEQ ID NO: 4075041 - RNA, 12 nt, Streptococcus pneumoniae R6
cagcagagaaag

SEQ ID NO: 4075042 - RNA, 13 nt, Streptococcus pneumoniae R6
cagcagagaagca

SEQ ID NO: 4075043 - RNA, 21 nt, Streptococcus pneumoniae R6
cagcaggagaaaguuugguuu

SEQ ID NO: 4075044 - RNA, 22 nt, Streptococcus pneumoniae R6
cagcagugguuuagaagucuca

SEQ ID NO: 4075045 - RNA, 19 nt, Streptococcus pneumoniae R6
cagcaguuaugauauauuu

SEQ ID NO: 4075046 - RNA, 14 nt, Streptococcus pneumoniae R6
cagcauacagagaa

SEQ ID NO: 4075047 - RNA, 16 nt, Streptococcus pneumoniae R6
cagcauggcccgcuuc

SEQ ID NO: 4075048 - RNA, 22 nt, Streptococcus pneumoniae R6
cagcauggcccgcuucgcuucc

SEQ ID NO: 4075049 - RNA, 14 nt, Streptococcus pneumoniae R6
cagcauuuuucaaa

SEQ ID NO: 4075050 - RNA, 12 nt, Streptococcus pneumoniae R6
cagccaaaccgu

SEQ ID NO: 4075051 - RNA, 12 nt, Streptococcus pneumoniae R6
cagccaagacac

SEQ ID NO: 4075052 - RNA, 16 nt, Streptococcus pneumoniae R6
cagccaaggcucccau

SEQ ID NO: 4075053 - RNA, 18 nt, Streptococcus pneumoniae R6
cagccacuguacguccaa

SEQ ID NO: 4075054 - RNA, 15 nt, Streptococcus pneumoniae R6
cagccagagcaccaa

SEQ ID NO: 4075055 - RNA, 12 nt, Streptococcus pneumoniae R6
cagccaguugcu

SEQ ID NO: 4075056 - RNA, 19 nt, Streptococcus pneumoniae R6
cagccauaagcuacauaga

SEQ ID NO: 4075057 - RNA, 20 nt, Streptococcus pneumoniae R6
cagccauaagcuacauagag

SEQ ID NO: 4075058 - RNA, 15 nt, Streptococcus pneumoniae R6
cagccaucagagagg

SEQ ID NO: 4075059 - RNA, 18 nt, Streptococcus pneumoniae R6
cagccaucagagaggucc

SEQ ID NO: 4075060 - RNA, 16 nt, Streptococcus pneumoniae R6
cagccgacuauacucc

SEQ ID NO: 4075061 - RNA, 19 nt, Streptococcus pneumoniae R6
cagccucuugaguaauucu

SEQ ID NO: 4075062 - RNA, 23 nt, Streptococcus pneumoniae R6
cagccuguuuucauaucuccauu

SEQ ID NO: 4075063 - RNA, 21 nt, Streptococcus pneumoniae R6
cagcgauagcuccaucuccaa

SEQ ID NO: 4075064 - RNA, 20 nt, Streptococcus pneumoniae R6
cagcgauugaaacagcugcg

SEQ ID NO: 4075065 - RNA, 21 nt, Streptococcus pneumoniae R6
cagcguuggcugucauuuuuu

SEQ ID NO: 4075066 - RNA, 19 nt, Streptococcus pneumoniae R6
cagcguuuucuacagcugu

SEQ ID NO: 4075067 - RNA, 16 nt, Streptococcus pneumoniae R6
cagcuaaaaauaacua

SEQ ID NO: 4075068 - RNA, 18 nt, Streptococcus pneumoniae R6
cagcuaacaagucuuaaa

SEQ ID NO: 4075069 - RNA, 19 nt, Streptococcus pneumoniae R6
cagcuaacaagucuuaaaa

SEQ ID NO: 4075070 - RNA, 15 nt, Streptococcus pneumoniae R6
cagcuaagccuuuuu

SEQ ID NO: 4075071 - RNA, 17 nt, Streptococcus pneumoniae R6
cagcuaagccuuuuucu

SEQ ID NO: 4075072 - RNA, 16 nt, Streptococcus pneumoniae R6
cagcuacgacaccuga

SEQ ID NO: 4075073 - RNA, 20 nt, Streptococcus pneumoniae R6
cagcuagucgugaaagagca

SEQ ID NO: 4075074 - RNA, 18 nt, Streptococcus pneumoniae R6
cagcuagucuagucugga

SEQ ID NO: 4075075 - RNA, 16 nt, Streptococcus pneumoniae R6
cagcucaaaacagugu

SEQ ID NO: 4075076 - RNA, 21 nt, Streptococcus pneumoniae R6
cagcuccgauguauuugaggu

SEQ ID NO: 4075077 - RNA, 15 nt, Streptococcus pneumoniae R6
cagcuccuucaaguu

SEQ ID NO: 4075078 - RNA, 14 nt, Streptococcus pneumoniae R6
cagcucucugauuu

SEQ ID NO: 4075079 - RNA, 13 nt, Streptococcus pneumoniae R6
cagcucuuuuuug

SEQ ID NO: 4075080 - RNA, 22 nt, Streptococcus pneumoniae R6
cagcugaguggauuuuucguau

SEQ ID NO: 4075081 - RNA, 16 nt, Streptococcus pneumoniae R6
cagcuggcuccuucuu

SEQ ID NO: 4075082 - RNA, 21 nt, Streptococcus pneumoniae R6
cagcuguaucgaccucuacca

SEQ ID NO: 4075083 - RNA, 15 nt, Streptococcus pneumoniae R6
cagcugucgcaccug

SEQ ID NO: 4075084 - RNA, 14 nt, Streptococcus pneumoniae R6
cagcuuaagugcgu

SEQ ID NO: 4075085 - RNA, 22 nt, Streptococcus pneumoniae R6
cagcuuaucucguacuucccga

SEQ ID NO: 4075086 - RNA, 15 nt, Streptococcus pneumoniae R6
cagcuuccaucugca

SEQ ID NO: 4075087 - RNA, 19 nt, Streptococcus pneumoniae R6
cagcuuccaucugcagccu

SEQ ID NO: 4075088 - RNA, 14 nt, Streptococcus pneumoniae R6
cagcuucuauuucu

SEQ ID NO: 4075089 - RNA, 16 nt, Streptococcus pneumoniae R6
cagcuucuauuucuug

SEQ ID NO: 4075090 - RNA, 17 nt, Streptococcus pneumoniae R6
cagcuucuauuucuugu

SEQ ID NO: 4075091 - RNA, 16 nt, Streptococcus pneumoniae R6
cagcuucuuuuuauau

SEQ ID NO: 4075092 - RNA, 21 nt, Streptococcus pneumoniae R6
cagcuugguaaugcuccaaua

SEQ ID NO: 4075093 - RNA, 21 nt, Streptococcus pneumoniae R6
cagcuuguugcuuuucuucaa

SEQ ID NO: 4075094 - RNA, 18 nt, Streptococcus pneumoniae R6
cagcuuguuguuaaacaa

SEQ ID NO: 4075095 - RNA, 21 nt, Streptococcus pneumoniae R6
cagcuuguuguuaaacaaggc

SEQ ID NO: 4075096 - RNA, 18 nt, Streptococcus pneumoniae R6
cagcuuuauagucaugaa

SEQ ID NO: 4075097 - RNA, 20 nt, Streptococcus pneumoniae R6
cagcuuuguucacuuuuugu

SEQ ID NO: 4075098 - RNA, 19 nt, Streptococcus pneumoniae R6
cagcuuuuuuggcagauuu

SEQ ID NO: 4075099 - RNA, 23 nt, Streptococcus pneumoniae R6
caggaaaaccaguucauaguucu

SEQ ID NO: 4075100 - RNA, 13 nt, Streptococcus pneumoniae R6
caggaaagaugau

SEQ ID NO: 4075101 - RNA, 16 nt, Streptococcus pneumoniae R6
caggaaagucaaauua

SEQ ID NO: 4075102 - RNA, 13 nt, Streptococcus pneumoniae R6
caggaagaaagag

SEQ ID NO: 4075103 - RNA, 18 nt, Streptococcus pneumoniae R6
caggaagcgaucaaccga

SEQ ID NO: 4075104 - RNA, 17 nt, Streptococcus pneumoniae R6
caggaaggaaauagcug

SEQ ID NO: 4075105 - RNA, 21 nt, Streptococcus pneumoniae R6
caggaaggucacuuuuuucuu

SEQ ID NO: 4075106 - RNA, 16 nt, Streptococcus pneumoniae R6
caggaaguuuuuucuc

SEQ ID NO: 4075107 - RNA, 22 nt, Streptococcus pneumoniae R6
caggaauaaauccagcugagau

SEQ ID NO: 4075108 - RNA, 14 nt, Streptococcus pneumoniae R6
caggaauauugagu

SEQ ID NO: 4075109 - RNA, 15 nt, Streptococcus pneumoniae R6
caggacaaaagauaa

SEQ ID NO: 4075110 - RNA, 17 nt, Streptococcus pneumoniae R6
caggacuaaauccaaaa

SEQ ID NO: 4075111 - RNA, 18 nt, Streptococcus pneumoniae R6
caggacuaaauccaaaag

SEQ ID NO: 4075112 - RNA, 14 nt, Streptococcus pneumoniae R6
caggagaaaaugaa

SEQ ID NO: 4075113 - RNA, 15 nt, Streptococcus pneumoniae R6
caggagauaaaagcg

SEQ ID NO: 4075114 - RNA, 23 nt, Streptococcus pneumoniae R6
caggagcaguugauggagcuggu

SEQ ID NO: 4075115 - RNA, 21 nt, Streptococcus pneumoniae R6
caguuuuagauugcuuuccaa

SEQ ID NO: 4075116 - RNA, 20 nt, Streptococcus pneumoniae R6
caguuuuccguucucaaagc

SEQ ID NO: 4075117 - RNA, 12 nt, Streptococcus pneumoniae R6
caguuuuuucuu

SEQ ID NO: 4075118 - RNA, 13 nt, Streptococcus pneumoniae R6
caguuuuuuucag

SEQ ID NO: 4075119 - RNA, 16 nt, Streptococcus pneumoniae R6
cauaaaaaaauccucc

SEQ ID NO: 4075120 - RNA, 19 nt, Streptococcus pneumoniae R6
cauaaaaaaguuuccaauc

SEQ ID NO: 4075121 - RNA, 15 nt, Streptococcus pneumoniae R6
cauaaaaagaccgga

SEQ ID NO: 4075122 - RNA, 12 nt, Streptococcus pneumoniae R6
cauaaaaauaac

SEQ ID NO: 4075123 - RNA, 18 nt, Streptococcus pneumoniae R6
cauaaaaauaacuucaga

SEQ ID NO: 4075124 - RNA, 13 nt, Streptococcus pneumoniae R6
cauaaaaauaaua

SEQ ID NO: 4075125 - RNA, 12 nt, Streptococcus pneumoniae R6
cauaaaacauuu

SEQ ID NO: 4075126 - RNA, 16 nt, Streptococcus pneumoniae R6
cauaaaagucuggcuc

SEQ ID NO: 4075127 - RNA, 13 nt, Streptococcus pneumoniae R6
cauaaaaucacau

SEQ ID NO: 4075128 - RNA, 19 nt, Streptococcus pneumoniae R6
cauaaacaagagcaaggaa

SEQ ID NO: 4075129 - RNA, 22 nt, Streptococcus pneumoniae R6
cauaaacgcaagcaacaaaaac

SEQ ID NO: 4075130 - RNA, 19 nt, Streptococcus pneumoniae R6
cauaaacuaagcuuauaua

SEQ ID NO: 4075131 - RNA, 17 nt, Streptococcus pneumoniae R6
cauaaacuugcaggaaa

SEQ ID NO: 4075132 - RNA, 12 nt, Streptococcus pneumoniae R6
cauaaagagaag

SEQ ID NO: 4075133 - RNA, 14 nt, Streptococcus pneumoniae R6
cauaaagagaagga

SEQ ID NO: 4075134 - RNA, 16 nt, Streptococcus pneumoniae R6
cauaaagagaaggagg

SEQ ID NO: 4075135 - RNA, 12 nt, Streptococcus pneumoniae R6
cauaaagccuuu

SEQ ID NO: 4075136 - RNA, 21 nt, Streptococcus pneumoniae R6
cauaaaguauuauaauauaau

SEQ ID NO: 4075137 - RNA, 16 nt, Streptococcus pneumoniae R6
cauaaaguuuucugag

SEQ ID NO: 4075138 - RNA, 20 nt, Streptococcus pneumoniae R6
cauaaauacuaucaauaaaa

SEQ ID NO: 4075139 - RNA, 22 nt, Streptococcus pneumoniae R6
cauaaauagauuggauaaaauc

SEQ ID NO: 4075140 - RNA, 21 nt, Streptococcus pneumoniae R6
cauaaaucaauuuuucguaug

SEQ ID NO: 4075141 - RNA, 18 nt, Streptococcus pneumoniae R6
cauaaaucgaucauauuu

SEQ ID NO: 4075142 - RNA, 17 nt, Streptococcus pneumoniae R6
cauaaaucuugaugucu

SEQ ID NO: 4075143 - RNA, 17 nt, Streptococcus pneumoniae R6
cauaacacccugcauga

SEQ ID NO: 4075144 - RNA, 17 nt, Streptococcus pneumoniae R6
cauaacagcauuuccac

SEQ ID NO: 4075145 - RNA, 19 nt, Streptococcus pneumoniae R6
cauaaccuaggucaaccaa

SEQ ID NO: 4075146 - RNA, 19 nt, Streptococcus pneumoniae R6
cauaacgacagaagaagug

SEQ ID NO: 4075147 - RNA, 20 nt, Streptococcus pneumoniae R6
cauaacgacagaagaaguga

SEQ ID NO: 4075148 - RNA, 16 nt, Streptococcus pneumoniae R6
cauaacgcaauuccug

SEQ ID NO: 4075149 - RNA, 23 nt, Streptococcus pneumoniae R6
cauaagaggucugaaacuacuuu

SEQ ID NO: 4075150 - RNA, 14 nt, Streptococcus pneumoniae R6
cauaagauuaauuu

SEQ ID NO: 4075151 - RNA, 23 nt, Streptococcus pneumoniae R6
cauaagauuaauuucagaaaucu

SEQ ID NO: 4075152 - RNA, 18 nt, Streptococcus pneumoniae R6
cauaagcuagucuacuug

SEQ ID NO: 4075153 - RNA, 17 nt, Streptococcus pneumoniae R6
cauaagucauaacauuc

SEQ ID NO: 4075154 - RNA, 21 nt, Streptococcus pneumoniae R6
cauaaguuguaguacugaaca

SEQ ID NO: 4075155 - RNA, 23 nt, Streptococcus pneumoniae R6
cauaaguuuauaucuaauaauuu

SEQ ID NO: 4075156 - RNA, 12 nt, Streptococcus pneumoniae R6
cauaauacugug

SEQ ID NO: 4075157 - RNA, 14 nt, Streptococcus pneumoniae R6
cauaauagcagaaa

SEQ ID NO: 4075158 - RNA, 20 nt, Streptococcus pneumoniae R6
cauaauagcagaaaaaugac

SEQ ID NO: 4075159 - RNA, 14 nt, Streptococcus pneumoniae R6
cauaauaucauaau

SEQ ID NO: 4075160 - RNA, 15 nt, Streptococcus pneumoniae R6
cauaaucaagaugaa

SEQ ID NO: 4075161 - RNA, 20 nt, Streptococcus pneumoniae R6
cauaaucuaaggucauuuga

SEQ ID NO: 4075162 - RNA, 14 nt, Streptococcus pneumoniae R6
cauaaucuguuuaa

SEQ ID NO: 4075163 - RNA, 18 nt, Streptococcus pneumoniae R6
cauaaucuuggucaacau

SEQ ID NO: 4075164 - RNA, 22 nt, Streptococcus pneumoniae R6
cauaaugagcuguacuauuguc

SEQ ID NO: 4075165 - RNA, 19 nt, Streptococcus pneumoniae R6
cauaaugauuucaagacca

SEQ ID NO: 4075166 - RNA, 14 nt, Streptococcus pneumoniae R6
cauaauuuaaaaua

SEQ ID NO: 4075167 - RNA, 17 nt, Streptococcus pneumoniae R6
cauacaacuuaaaaaga

SEQ ID NO: 4075168 - RNA, 13 nt, Streptococcus pneumoniae R6
cauacaagcugcc

SEQ ID NO: 4075169 - RNA, 16 nt, Streptococcus pneumoniae R6
cauacaagcugccaaa

SEQ ID NO: 4075170 - RNA, 14 nt, Streptococcus pneumoniae R6
cauacacuggaugu

SEQ ID NO: 4075171 - RNA, 19 nt, Streptococcus pneumoniae R6
cauacacuggauguguaua

SEQ ID NO: 4075172 - RNA, 16 nt, Streptococcus pneumoniae R6
cauacagagaaaguca

SEQ ID NO: 4075173 - RNA, 20 nt, Streptococcus pneumoniae R6
cauaccaaguucuuuggcga

SEQ ID NO: 4075174 - RNA, 14 nt, Streptococcus pneumoniae R6
cauaccacgguaag

SEQ ID NO: 4075175 - RNA, 23 nt, Streptococcus pneumoniae R6
cauaccagagcgaauaccaccaa

SEQ ID NO: 4075176 - RNA, 15 nt, Streptococcus pneumoniae R6
cauaccaucaaagac

SEQ ID NO: 4075177 - RNA, 15 nt, Streptococcus pneumoniae R6
cauacccaugcuuuu

SEQ ID NO: 4075178 - RNA, 14 nt, Streptococcus pneumoniae R6
cauacgagccgcaa

SEQ ID NO: 4075179 - RNA, 19 nt, Streptococcus pneumoniae R6
cauacggcgguucaacuaa

SEQ ID NO: 4075180 - RNA, 17 nt, Streptococcus pneumoniae R6
cauacuaauagcaccaa

SEQ ID NO: 4075181 - RNA, 17 nt, Streptococcus pneumoniae R6
cauacucauuuaaaauc

SEQ ID NO: 4075182 - RNA, 22 nt, Streptococcus pneumoniae R6
cauacucgugaagaaaucaucc

SEQ ID NO: 4075183 - RNA, 20 nt, Streptococcus pneumoniae R6
cauacugccaagauagagag

SEQ ID NO: 4075184 - RNA, 14 nt, Streptococcus pneumoniae R6
cauacugcccugaa

SEQ ID NO: 4075185 - RNA, 17 nt, Streptococcus pneumoniae R6
cauacugcccugaaauc

SEQ ID NO: 4075186 - RNA, 22 nt, Streptococcus pneumoniae R6
cauacugggcacggugauuuuu

SEQ ID NO: 4075187 - RNA, 20 nt, Streptococcus pneumoniae R6
cauacuuagcuaauuuucua

SEQ ID NO: 4075188 - RNA, 21 nt, Streptococcus pneumoniae R6
cauacuuggugcccaaauacu

SEQ ID NO: 4075189 - RNA, 17 nt, Streptococcus pneumoniae R6
cauacuuucuaucuuca

SEQ ID NO: 4075190 - RNA, 20 nt, Streptococcus pneumoniae R6
cauagaaaaugguuccaaaa

SEQ ID NO: 4075191 - RNA, 15 nt, Streptococcus pneumoniae R6
cauagaaguuuccuc

SEQ ID NO: 4075192 - RNA, 15 nt, Streptococcus pneumoniae R6
cauagagagggucug

SEQ ID NO: 4075193 - RNA, 15 nt, Streptococcus pneumoniae R6
cauagaugacaaagu

SEQ ID NO: 4075194 - RNA, 17 nt, Streptococcus pneumoniae R6
cauagaugaugguuuug

SEQ ID NO: 4075195 - RNA, 21 nt, Streptococcus pneumoniae R6
cauagauuuuuauuauuuccu

SEQ ID NO: 4075196 - RNA, 14 nt, Streptococcus pneumoniae R6
cauagccauaaaac

SEQ ID NO: 4075197 - RNA, 16 nt, Streptococcus pneumoniae R6
cauagccaucuuuuga

SEQ ID NO: 4075198 - RNA, 17 nt, Streptococcus pneumoniae R6
cauagccgacuccaugc

SEQ ID NO: 4075199 - RNA, 15 nt, Streptococcus pneumoniae R6
cauagcgucaaagaa

SEQ ID NO: 4075200 - RNA, 16 nt, Streptococcus pneumoniae R6
cauagcgucaaagaag

SEQ ID NO: 4075201 - RNA, 22 nt, Streptococcus pneumoniae R6
cauagcuaaaaucaggucuuau

SEQ ID NO: 4075202 - RNA, 15 nt, Streptococcus pneumoniae R6
cauaggaaguugagc

SEQ ID NO: 4075203 - RNA, 19 nt, Streptococcus pneumoniae R6
cauaggccaagucuuuucg

SEQ ID NO: 4075204 - RNA, 22 nt, Streptococcus pneumoniae R6
cauaggccuuguggaagaaguu

SEQ ID NO: 4075205 - RNA, 23 nt, Streptococcus pneumoniae R6
cauaggcuugcucacgggucaug

SEQ ID NO: 4075206 - RNA, 17 nt, Streptococcus pneumoniae R6
cauaguacaauaccuuu

SEQ ID NO: 4075207 - RNA, 18 nt, Streptococcus pneumoniae R6
cauaguaccaguuaccau

SEQ ID NO: 4075208 - RNA, 19 nt, Streptococcus pneumoniae R6
cauaguaccaguuaccauu

SEQ ID NO: 4075209 - RNA, 14 nt, Streptococcus pneumoniae R6
cauaguaguaaaca

SEQ ID NO: 4075210 - RNA, 18 nt, Streptococcus pneumoniae R6
cauaguagugguuuuuag

SEQ ID NO: 4075211 - RNA, 17 nt, Streptococcus pneumoniae R6
cauaguauaucacuuua

SEQ ID NO: 4075212 - RNA, 14 nt, Streptococcus pneumoniae R6
cauagucaaaacca

SEQ ID NO: 4075213 - RNA, 14 nt, Streptococcus pneumoniae R6
cauaguccugaaaa

SEQ ID NO: 4075214 - RNA, 18 nt, Streptococcus pneumoniae R6
cauaguuacucaggauaa

SEQ ID NO: 4075215 - RNA, 20 nt, Streptococcus pneumoniae R6
cauaguuacucaggauaaaa

SEQ ID NO: 4075216 - RNA, 20 nt, Streptococcus pneumoniae R6
cauaguuuaucucacacaaa

SEQ ID NO: 4075217 - RNA, 13 nt, Streptococcus pneumoniae R6
cauauaaauacaa

SEQ ID NO: 4075218 - RNA, 22 nt, Streptococcus pneumoniae R6
caucugcagccucaaaacacug

SEQ ID NO: 4075219 - RNA, 15 nt, Streptococcus pneumoniae R6
caucugcuuucaaaa

SEQ ID NO: 4075220 - RNA, 19 nt, Streptococcus pneumoniae R6
caucuggaguagcaucccc

SEQ ID NO: 4075221 - RNA, 20 nt, Streptococcus pneumoniae R6
caucuggaguagcaucccca

SEQ ID NO: 4075222 - RNA, 19 nt, Streptococcus pneumoniae R6
caucuguccccucacaucu

SEQ ID NO: 4075223 - RNA, 20 nt, Streptococcus pneumoniae R6
caucuguccccucacaucuu

SEQ ID NO: 4075224 - RNA, 15 nt, Streptococcus pneumoniae R6
caucuguuuucaaaa

SEQ ID NO: 4075225 - RNA, 16 nt, Streptococcus pneumoniae R6
caucuuaguuaaaaua

SEQ ID NO: 4075226 - RNA, 22 nt, Streptococcus pneumoniae R6
caucuuauagcgacuauaaaaa

SEQ ID NO: 4075227 - RNA, 14 nt, Streptococcus pneumoniae R6
caucuuauuucaau

SEQ ID NO: 4075228 - RNA, 16 nt, Streptococcus pneumoniae R6
caucuucaaaaucaaa

SEQ ID NO: 4075229 - RNA, 18 nt, Streptococcus pneumoniae R6
caucuucacucuucaaau

SEQ ID NO: 4075230 - RNA, 16 nt, Streptococcus pneumoniae R6
caucuucauuuuggua

SEQ ID NO: 4075231 - RNA, 12 nt, Streptococcus pneumoniae R6
caucuuccaaag

SEQ ID NO: 4075232 - RNA, 17 nt, Streptococcus pneumoniae R6
caucuuccgcaauccac

SEQ ID NO: 4075233 - RNA, 20 nt, Streptococcus pneumoniae R6
caucuucuguaccaauacua

SEQ ID NO: 4075234 - RNA, 14 nt, Streptococcus pneumoniae R6
caucuucuucuggu

SEQ ID NO: 4075235 - RNA, 13 nt, Streptococcus pneumoniae R6
caucuugacgaua

SEQ ID NO: 4075236 - RNA, 13 nt, Streptococcus pneumoniae R6
caucuuggucagg

SEQ ID NO: 4075237 - RNA, 16 nt, Streptococcus pneumoniae R6
caucuugucuucaaag

SEQ ID NO: 4075238 - RNA, 17 nt, Streptococcus pneumoniae R6
caucuugucuucaaagg

SEQ ID NO: 4075239 - RNA, 16 nt, Streptococcus pneumoniae R6
caucuuguguuuuuug

SEQ ID NO: 4075240 - RNA, 14 nt, Streptococcus pneumoniae R6
caucuuuugauaga

SEQ ID NO: 4075241 - RNA, 23 nt, Streptococcus pneumoniae R6
caugaaaccaccgacaacccagu

SEQ ID NO: 4075242 - RNA, 21 nt, Streptococcus pneumoniae R6
caugaaaggauuucucuauuc

SEQ ID NO: 4075243 - RNA, 16 nt, Streptococcus pneumoniae R6
caugaaccucuucauu

SEQ ID NO: 4075244 - RNA, 23 nt, Streptococcus pneumoniae R6
caugaaccucuucauucaaagaa

SEQ ID NO: 4075245 - RNA, 17 nt, Streptococcus pneumoniae R6
caugaaguaaauauuuc

SEQ ID NO: 4075246 - RNA, 20 nt, Streptococcus pneumoniae R6
caugaauacguacgauagca

SEQ ID NO: 4075247 - RNA, 22 nt, Streptococcus pneumoniae R6
caugaauauuccuaugauuaau

SEQ ID NO: 4075248 - RNA, 18 nt, Streptococcus pneumoniae R6
caugaaugaucaguaguc

SEQ ID NO: 4075249 - RNA, 17 nt, Streptococcus pneumoniae R6
caugacaaucaagaccc

SEQ ID NO: 4075250 - RNA, 16 nt, Streptococcus pneumoniae R6
caugacaaucauuuca

SEQ ID NO: 4075251 - RNA, 19 nt, Streptococcus pneumoniae R6
caugacagauucaucacga

SEQ ID NO: 4075252 - RNA, 14 nt, Streptococcus pneumoniae R6
caugacauuauuuu

SEQ ID NO: 4075253 - RNA, 15 nt, Streptococcus pneumoniae R6
caugaccaccaggaa

SEQ ID NO: 4075254 - RNA, 20 nt, Streptococcus pneumoniae R6
caugacgcauaguugcauua

SEQ ID NO: 4075255 - RNA, 23 nt, Streptococcus pneumoniae R6
caugacuucgucguaaccuucuu

SEQ ID NO: 4075256 - RNA, 16 nt, Streptococcus pneumoniae R6
caugagaauacaaaaa

SEQ ID NO: 4075257 - RNA, 17 nt, Streptococcus pneumoniae R6
caugagaauacaaaaau

SEQ ID NO: 4075258 - RNA, 17 nt, Streptococcus pneumoniae R6
caugagaguuuuuggca

SEQ ID NO: 4075259 - RNA, 21 nt, Streptococcus pneumoniae R6
caugagccacaacuuuuaaau

SEQ ID NO: 4075260 - RNA, 16 nt, Streptococcus pneumoniae R6
caugaguuuuucacca

SEQ ID NO: 4075261 - RNA, 17 nt, Streptococcus pneumoniae R6
caugaguuuuucaccag

SEQ ID NO: 4075262 - RNA, 17 nt, Streptococcus pneumoniae R6
caugauaucaaacuuuu

SEQ ID NO: 4075263 - RNA, 18 nt, Streptococcus pneumoniae R6
caugauaucaaacuuuuu

SEQ ID NO: 4075264 - RNA, 19 nt, Streptococcus pneumoniae R6
caugauugagaaaguuaaa

SEQ ID NO: 4075265 - RNA, 22 nt, Streptococcus pneumoniae R6
caugauugagaaaguuaaaaaa

SEQ ID NO: 4075266 - RNA, 23 nt, Streptococcus pneumoniae R6
caugauugagaaaguuaaaaaaa

SEQ ID NO: 4075267 - RNA, 13 nt, Streptococcus pneumoniae R6
caugauuggucaa

SEQ ID NO: 4075268 - RNA, 22 nt, Streptococcus pneumoniae R6
caugcgauagaugaucgagcag

SEQ ID NO: 4075269 - RNA, 20 nt, Streptococcus pneumoniae R6
caugcuuuacuaguucucaa

SEQ ID NO: 4075270 - RNA, 15 nt, Streptococcus pneumoniae R6
cauggaaagcaucuc

SEQ ID NO: 4075271 - RNA, 17 nt, Streptococcus pneumoniae R6
cauggaaagcaucucca

SEQ ID NO: 4075272 - RNA, 20 nt, Streptococcus pneumoniae R6
cauggaaccaaaguuccucc

SEQ ID NO: 4075273 - RNA, 14 nt, Streptococcus pneumoniae R6
cauggacuguuuca

SEQ ID NO: 4075274 - RNA, 15 nt, Streptococcus pneumoniae R6
cauggacuuuuuugc

SEQ ID NO: 4075275 - RNA, 18 nt, Streptococcus pneumoniae R6
cauggacuuuuuugcgaa

SEQ ID NO: 4075276 - RNA, 15 nt, Streptococcus pneumoniae R6
cauggcaagcaaguc

SEQ ID NO: 4075277 - RNA, 16 nt, Streptococcus pneumoniae R6
cauggcauggaaagca

SEQ ID NO: 4075278 - RNA, 16 nt, Streptococcus pneumoniae R6
caugggcgaugaagag

SEQ ID NO: 4075279 - RNA, 19 nt, Streptococcus pneumoniae R6
cauggucaaaguagucauu

SEQ ID NO: 4075280 - RNA, 17 nt, Streptococcus pneumoniae R6
cauguaaaucauuuucu

SEQ ID NO: 4075281 - RNA, 13 nt, Streptococcus pneumoniae R6
cauguaagaguuc

SEQ ID NO: 4075282 - RNA, 24 nt, Streptococcus pneumoniae R6
cauguaggccgucucacacggaaa

SEQ ID NO: 4075283 - RNA, 15 nt, Streptococcus pneumoniae R6
cauguagucaaucaa

SEQ ID NO: 4075284 - RNA, 12 nt, Streptococcus pneumoniae R6
cauguauauuac

SEQ ID NO: 4075285 - RNA, 16 nt, Streptococcus pneumoniae R6
caugucaauucucacu

SEQ ID NO: 4075286 - RNA, 19 nt, Streptococcus pneumoniae R6
caugucgcaucgucaucac

SEQ ID NO: 4075287 - RNA, 15 nt, Streptococcus pneumoniae R6
caugucguuuccuuc

SEQ ID NO: 4075288 - RNA, 13 nt, Streptococcus pneumoniae R6
cauguggcuaucu

SEQ ID NO: 4075289 - RNA, 13 nt, Streptococcus pneumoniae R6
cauguuagaaaaa

SEQ ID NO: 4075290 - RNA, 18 nt, Streptococcus pneumoniae R6
cauguucauguucgaucu

SEQ ID NO: 4075291 - RNA, 20 nt, Streptococcus pneumoniae R6
cauguucgaucuaaggaaga

SEQ ID NO: 4075292 - RNA, 13 nt, Streptococcus pneumoniae R6
cauguuucaacau

SEQ ID NO: 4075293 - RNA, 14 nt, Streptococcus pneumoniae R6
cauguuuucucaau

SEQ ID NO: 4075294 - RNA, 19 nt, Streptococcus pneumoniae R6
cauguuuugagcugacuuc

SEQ ID NO: 4075295 - RNA, 14 nt, Streptococcus pneumoniae R6
cauguuuuuaagcu

SEQ ID NO: 4075296 - RNA, 17 nt, Streptococcus pneumoniae R6
cauguuuuucaauagcc

SEQ ID NO: 4075297 - RNA, 21 nt, Streptococcus pneumoniae R6
cauuaaagacaauguucuuuu

SEQ ID NO: 4075298 - RNA, 23 nt, Streptococcus pneumoniae R6
cauuaacgacauagucaaagagu

SEQ ID NO: 4075299 - RNA, 14 nt, Streptococcus pneumoniae R6
cauuaacuggcuug

SEQ ID NO: 4075300 - RNA, 16 nt, Streptococcus pneumoniae R6
cauuacucaaguccuu

SEQ ID NO: 4075301 - RNA, 21 nt, Streptococcus pneumoniae R6
cauuacucaaguccuuuugau

SEQ ID NO: 4075302 - RNA, 14 nt, Streptococcus pneumoniae R6
cauuacuuaaccca

SEQ ID NO: 4075303 - RNA, 15 nt, Streptococcus pneumoniae R6
cauuaguaauuugca

SEQ ID NO: 4075304 - RNA, 21 nt, Streptococcus pneumoniae R6
cauuauacaucuucccacaau

SEQ ID NO: 4075305 - RNA, 12 nt, Streptococcus pneumoniae R6
cauuauagaagg

SEQ ID NO: 4075306 - RNA, 21 nt, Streptococcus pneumoniae R6
cauuauagaccuuucagaacu

SEQ ID NO: 4075307 - RNA, 23 nt, Streptococcus pneumoniae R6
cauuauaguuuaaguaguaacca

SEQ ID NO: 4075308 - RNA, 15 nt, Streptococcus pneumoniae R6
cauuauauuucucuc

SEQ ID NO: 4075309 - RNA, 19 nt, Streptococcus pneumoniae R6
cauuauccaacagagaaaa

SEQ ID NO: 4075310 - RNA, 16 nt, Streptococcus pneumoniae R6
cauuaucuaauaccaa

SEQ ID NO: 4075311 - RNA, 13 nt, Streptococcus pneumoniae R6
cauuaucuagacc

SEQ ID NO: 4075312 - RNA, 14 nt, Streptococcus pneumoniae R6
cauuauuaugaaaa

SEQ ID NO: 4075313 - RNA, 20 nt, Streptococcus pneumoniae R6
cauucaauacgaaucaauac

SEQ ID NO: 4075314 - RNA, 22 nt, Streptococcus pneumoniae R6
cauucaauccaucuccaaccau

SEQ ID NO: 4075315 - RNA, 17 nt, Streptococcus pneumoniae R6
cauucauagguucaucu

SEQ ID NO: 4075316 - RNA, 18 nt, Streptococcus pneumoniae R6
cauucauagguucaucua

SEQ ID NO: 4075317 - RNA, 22 nt, Streptococcus pneumoniae R6
cauuccaugaaaaucccuccca

SEQ ID NO: 4075318 - RNA, 15 nt, Streptococcus pneumoniae R6
cauucccaaacaaaa

SEQ ID NO: 4075319 - RNA, 16 nt, Streptococcus pneumoniae R6
cauucccaaacaaaaa

SEQ ID NO: 4075320 - RNA, 17 nt, Streptococcus pneumoniae R6
cauucccaaacaaaaaa

SEQ ID NO: 4075321 - RNA, 18 nt, Streptococcus pneumoniae R6
ccaccaccugcaacaaua

SEQ ID NO: 4075322 - RNA, 17 nt, Streptococcus pneumoniae R6
ccaccacguauaauucu

SEQ ID NO: 4075323 - RNA, 16 nt, Streptococcus pneumoniae R6
ccaccagcuauuaaga

SEQ ID NO: 4075324 - RNA, 15 nt, Streptococcus pneumoniae R6
ccaccuagcuucuca

SEQ ID NO: 4075325 - RNA, 13 nt, Streptococcus pneumoniae R6
ccaccucaucuug

SEQ ID NO: 4075326 - RNA, 17 nt, Streptococcus pneumoniae R6
ccaccucauuccccuuc

SEQ ID NO: 4075327 - RNA, 16 nt, Streptococcus pneumoniae R6
ccaccuugcaaaaaaa

SEQ ID NO: 4075328 - RNA, 13 nt, Streptococcus pneumoniae R6
ccacgaaguccuu

SEQ ID NO: 4075329 - RNA, 13 nt, Streptococcus pneumoniae R6
ccacgagucacau

SEQ ID NO: 4075330 - RNA, 16 nt, Streptococcus pneumoniae R6
ccacgcuccacuuccc

SEQ ID NO: 4075331 - RNA, 17 nt, Streptococcus pneumoniae R6
ccacgcuccacuucccc

SEQ ID NO: 4075332 - RNA, 21 nt, Streptococcus pneumoniae R6
ccacggagauagugaggagcg

SEQ ID NO: 4075333 - RNA, 18 nt, Streptococcus pneumoniae R6
ccacggaguuuggcagcg

SEQ ID NO: 4075334 - RNA, 22 nt, Streptococcus pneumoniae R6
ccacguccgucaagaagagcuu

SEQ ID NO: 4075335 - RNA, 15 nt, Streptococcus pneumoniae R6
ccacguguuuuucgu

SEQ ID NO: 4075336 - RNA, 16 nt, Streptococcus pneumoniae R6
ccacguucaaauacuc

SEQ ID NO: 4075337 - RNA, 13 nt, Streptococcus pneumoniae R6
ccacguuuuucca

SEQ ID NO: 4075338 - RNA, 13 nt, Streptococcus pneumoniae R6
ccacuaaaaauau

SEQ ID NO: 4075339 - RNA, 23 nt, Streptococcus pneumoniae R6
ccacuacacuugacaaagagcca

SEQ ID NO: 4075340 - RNA, 23 nt, Streptococcus pneumoniae R6
ccacuacaguugacaaagagcca

SEQ ID NO: 4075341 - RNA, 23 nt, Streptococcus pneumoniae R6
ccacuacaguugacaaagagccc

SEQ ID NO: 4075342 - RNA, 21 nt, Streptococcus pneumoniae R6
ccacuagcagccacuuuuuau

SEQ ID NO: 4075343 - RNA, 15 nt, Streptococcus pneumoniae R6
ccacuauaauaaaau

SEQ ID NO: 4075344 - RNA, 19 nt, Streptococcus pneumoniae R6
ccacuauaauaaaaugaaa

SEQ ID NO: 4075345 - RNA, 17 nt, Streptococcus pneumoniae R6
ccacuaucuaaaaaaau

SEQ ID NO: 4075346 - RNA, 18 nt, Streptococcus pneumoniae R6
ccacuauuuuaucuuacu

SEQ ID NO: 4075347 - RNA, 19 nt, Streptococcus pneumoniae R6
ccacucaaaucauuucuuu

SEQ ID NO: 4075348 - RNA, 16 nt, Streptococcus pneumoniae R6
ccacugaguuuuuccc

SEQ ID NO: 4075349 - RNA, 13 nt, Streptococcus pneumoniae R6
ccacuuaucauua

SEQ ID NO: 4075350 - RNA, 13 nt, Streptococcus pneumoniae R6
ccacuuccagaag

SEQ ID NO: 4075351 - RNA, 22 nt, Streptococcus pneumoniae R6
ccacuuccugcaaaucuacugg

SEQ ID NO: 4075352 - RNA, 16 nt, Streptococcus pneumoniae R6
ccacuugugucauaau

SEQ ID NO: 4075353 - RNA, 14 nt, Streptococcus pneumoniae R6
ccacuuuuuauccg

SEQ ID NO: 4075354 - RNA, 13 nt, Streptococcus pneumoniae R6
ccagaaaaaguca

SEQ ID NO: 4075355 - RNA, 20 nt, Streptococcus pneumoniae R6
ccagaaaaagucaauaauau

SEQ ID NO: 4075356 - RNA, 13 nt, Streptococcus pneumoniae R6
ccagaaaaucauu

SEQ ID NO: 4075357 - RNA, 18 nt, Streptococcus pneumoniae R6
ccagaaauugaucuagcu

SEQ ID NO: 4075358 - RNA, 15 nt, Streptococcus pneumoniae R6
ccagacauaacaccc

SEQ ID NO: 4075359 - RNA, 16 nt, Streptococcus pneumoniae R6
ccagacauaacacccu

SEQ ID NO: 4075360 - RNA, 21 nt, Streptococcus pneumoniae R6
ccagacauagagagggucugc

SEQ ID NO: 4075361 - RNA, 22 nt, Streptococcus pneumoniae R6
ccagacauuucaauaaauugag

SEQ ID NO: 4075362 - RNA, 15 nt, Streptococcus pneumoniae R6
ccagagauaguagac

SEQ ID NO: 4075363 - RNA, 14 nt, Streptococcus pneumoniae R6
ccagagcaaugaua

SEQ ID NO: 4075364 - RNA, 14 nt, Streptococcus pneumoniae R6
ccagagcauucuuu

SEQ ID NO: 4075365 - RNA, 14 nt, Streptococcus pneumoniae R6
ccagagcgacuggg

SEQ ID NO: 4075366 - RNA, 14 nt, Streptococcus pneumoniae R6
ccagagcuuuucaa

SEQ ID NO: 4075367 - RNA, 15 nt, Streptococcus pneumoniae R6
ccagagcuuuucaau

SEQ ID NO: 4075368 - RNA, 12 nt, Streptococcus pneumoniae R6
ccagaggacugc

SEQ ID NO: 4075369 - RNA, 20 nt, Streptococcus pneumoniae R6
ccagauaaagcugauuuuuu

SEQ ID NO: 4075370 - RNA, 15 nt, Streptococcus pneumoniae R6
ccagauagaauagca

SEQ ID NO: 4075371 - RNA, 17 nt, Streptococcus pneumoniae R6
ccagauagacauuuucu

SEQ ID NO: 4075372 - RNA, 12 nt, Streptococcus pneumoniae R6
ccagauuaggaa

SEQ ID NO: 4075373 - RNA, 19 nt, Streptococcus pneumoniae R6
ccagcauggcaccgccgag

SEQ ID NO: 4075374 - RNA, 14 nt, Streptococcus pneumoniae R6
ccagccaagacacu

SEQ ID NO: 4075375 - RNA, 21 nt, Streptococcus pneumoniae R6
ccagccaauguauuaagaacu

SEQ ID NO: 4075376 - RNA, 16 nt, Streptococcus pneumoniae R6
ccagccugccugaucu

SEQ ID NO: 4075377 - RNA, 18 nt, Streptococcus pneumoniae R6
ccagccuucauuuuacau

SEQ ID NO: 4075378 - RNA, 21 nt, Streptococcus pneumoniae R6
ccagcuaugccagugcccaua

SEQ ID NO: 4075379 - RNA, 18 nt, Streptococcus pneumoniae R6
ccagcuauuaagaaaaau

SEQ ID NO: 4075380 - RNA, 11 nt, Streptococcus pneumoniae R6
ccagcuucaaa

SEQ ID NO: 4075381 - RNA, 12 nt, Streptococcus pneumoniae R6
ccagcuucuugg

SEQ ID NO: 4075382 - RNA, 23 nt, Streptococcus pneumoniae R6
ccagcuucuuuuuauauauaaaa

SEQ ID NO: 4075383 - RNA, 14 nt, Streptococcus pneumoniae R6
ccagcuuuuucuug

SEQ ID NO: 4075384 - RNA, 24 nt, Streptococcus pneumoniae R6
ccaggagaguaugauuacuuauuu

SEQ ID NO: 4075385 - RNA, 21 nt, Streptococcus pneumoniae R6
ccagguaauccagaaauggaa

SEQ ID NO: 4075386 - RNA, 22 nt, Streptococcus pneumoniae R6
ccagguucuaaaaucugauucc

SEQ ID NO: 4075387 - RNA, 13 nt, Streptococcus pneumoniae R6
ccagguuuuucac

SEQ ID NO: 4075388 - RNA, 23 nt, Streptococcus pneumoniae R6
ccaguaaaggacuuuaaagcggu

SEQ ID NO: 4075389 - RNA, 20 nt, Streptococcus pneumoniae R6
ccaguagcuauuagaccugc

SEQ ID NO: 4075390 - RNA, 16 nt, Streptococcus pneumoniae R6
ccaguauagaccaaga

SEQ ID NO: 4075391 - RNA, 20 nt, Streptococcus pneumoniae R6
ccaguauucuuuuuaaauaa

SEQ ID NO: 4075392 - RNA, 22 nt, Streptococcus pneumoniae R6
ccaguauucuuuuuaaauaaau

SEQ ID NO: 4075393 - RNA, 20 nt, Streptococcus pneumoniae R6
ccaguauuuuuaguucuacu

SEQ ID NO: 4075394 - RNA, 19 nt, Streptococcus pneumoniae R6
ccagucccuuuuaagaguu

SEQ ID NO: 4075395 - RNA, 12 nt, Streptococcus pneumoniae R6
ccaguccuggaa

SEQ ID NO: 4075396 - RNA, 23 nt, Streptococcus pneumoniae R6
ccagugaaaacaggaguucuuuu

SEQ ID NO: 4075397 - RNA, 18 nt, Streptococcus pneumoniae R6
ccagugagaagaagggcu

SEQ ID NO: 4075398 - RNA, 18 nt, Streptococcus pneumoniae R6
ccagugcccauaagcuga

SEQ ID NO: 4075399 - RNA, 21 nt, Streptococcus pneumoniae R6
ccaguuacuacuggaacaucu

SEQ ID NO: 4075400 - RNA, 20 nt, Streptococcus pneumoniae R6
ccaguugccauagcuccuga

SEQ ID NO: 4075401 - RNA, 19 nt, Streptococcus pneumoniae R6
ccaguuguggcgacuuccu

SEQ ID NO: 4075402 - RNA, 12 nt, Streptococcus pneumoniae R6
ccaguuuucuuc

SEQ ID NO: 4075403 - RNA, 22 nt, Streptococcus pneumoniae R6
ccauaaaaauaauaagcuuuga

SEQ ID NO: 4075404 - RNA, 16 nt, Streptococcus pneumoniae R6
ccauaaacgcaagcaa

SEQ ID NO: 4075405 - RNA, 20 nt, Streptococcus pneumoniae R6
ccauaaacgcaagcaacaaa

SEQ ID NO: 4075406 - RNA, 13 nt, Streptococcus pneumoniae R6
ccauaaaucuuga

SEQ ID NO: 4075407 - RNA, 22 nt, Streptococcus pneumoniae R6
ccauaaucucugaggaaucaau

SEQ ID NO: 4075408 - RNA, 18 nt, Streptococcus pneumoniae R6
ccauaccacgaagcugac

SEQ ID NO: 4075409 - RNA, 14 nt, Streptococcus pneumoniae R6
ccauacgcccucca

SEQ ID NO: 4075410 - RNA, 14 nt, Streptococcus pneumoniae R6
ccauacuuucucug

SEQ ID NO: 4075411 - RNA, 14 nt, Streptococcus pneumoniae R6
ccauagauuucuug

SEQ ID NO: 4075412 - RNA, 22 nt, Streptococcus pneumoniae R6
ccauagauuuuuauuauuuccu

SEQ ID NO: 4075413 - RNA, 19 nt, Streptococcus pneumoniae R6
ccauaggcagcuuguucuu

SEQ ID NO: 4075414 - RNA, 22 nt, Streptococcus pneumoniae R6
ccauaggcagcuuguucuucug

SEQ ID NO: 4075415 - RNA, 18 nt, Streptococcus pneumoniae R6
ccauaguaaacuucuucu

SEQ ID NO: 4075416 - RNA, 23 nt, Streptococcus pneumoniae R6
ccauaguaaacuucuucuuccau

SEQ ID NO: 4075417 - RNA, 21 nt, Streptococcus pneumoniae R6
ccauauaaaaaagcaagacca

SEQ ID NO: 4075418 - RNA, 13 nt, Streptococcus pneumoniae R6
ccauauaaaucuc

SEQ ID NO: 4075419 - RNA, 19 nt, Streptococcus pneumoniae R6
ccauauaaggaccaaauau

SEQ ID NO: 4075420 - RNA, 17 nt, Streptococcus pneumoniae R6
ccauauuagccaagcua

SEQ ID NO: 4075421 - RNA, 24 nt, Streptococcus pneumoniae R6
ccaucaaggacggcuuuuaguaaa

SEQ ID NO: 4075422 - RNA, 17 nt, Streptococcus pneumoniae R6
ccaucauuucuucaaca

SEQ ID NO: 4075423 - RNA, 14 nt, Streptococcus pneumoniae R6
ccccuuuagaacuu

SEQ ID NO: 4075424 - RNA, 15 nt, Streptococcus pneumoniae R6
cccguugucuucugc

SEQ ID NO: 4075425 - RNA, 18 nt, Streptococcus pneumoniae R6
cccuaauaauacaaaaaa

SEQ ID NO: 4075426 - RNA, 17 nt, Streptococcus pneumoniae R6
cccuacuguacuuacau

SEQ ID NO: 4075427 - RNA, 18 nt, Streptococcus pneumoniae R6
cccuauauuauaagacuu

SEQ ID NO: 4075428 - RNA, 13 nt, Streptococcus pneumoniae R6
cccuauauucuuu

SEQ ID NO: 4075429 - RNA, 21 nt, Streptococcus pneumoniae R6
cccuauccgcaaccucaaaac

SEQ ID NO: 4075430 - RNA, 14 nt, Streptococcus pneumoniae R6
cccucacaucuuca

SEQ ID NO: 4075431 - RNA, 23 nt, Streptococcus pneumoniae R6
cccucagaguaagaaagcagcuu

SEQ ID NO: 4075432 - RNA, 15 nt, Streptococcus pneumoniae R6
cccucucagauuaca

SEQ ID NO: 4075433 - RNA, 23 nt, Streptococcus pneumoniae R6
cccugaguguaaacugacaacuu

SEQ ID NO: 4075434 - RNA, 14 nt, Streptococcus pneumoniae R6
cccugcauuucuuu

SEQ ID NO: 4075435 - RNA, 13 nt, Streptococcus pneumoniae R6
cccugccucauau

SEQ ID NO: 4075436 - RNA, 18 nt, Streptococcus pneumoniae R6
cccugcgacaaaauugau

SEQ ID NO: 4075437 - RNA, 13 nt, Streptococcus pneumoniae R6
cccugguaaaaga

SEQ ID NO: 4075438 - RNA, 16 nt, Streptococcus pneumoniae R6
cccuguaaucaugaug

SEQ ID NO: 4075439 - RNA, 11 nt, Streptococcus pneumoniae R6
cccugucuuua

SEQ ID NO: 4075440 - RNA, 12 nt, Streptococcus pneumoniae R6
cccuuaaagugg

SEQ ID NO: 4075441 - RNA, 13 nt, Streptococcus pneumoniae R6
cccuuagaaaaac

SEQ ID NO: 4075442 - RNA, 23 nt, Streptococcus pneumoniae R6
cccuuaucauuauggaccaugca

SEQ ID NO: 4075443 - RNA, 19 nt, Streptococcus pneumoniae R6
cccuuauuuccaucuucac

SEQ ID NO: 4075444 - RNA, 23 nt, Streptococcus pneumoniae R6
cccuucuuucucaaacauuguga

SEQ ID NO: 4075445 - RNA, 13 nt, Streptococcus pneumoniae R6
cccuucuuuuuau

SEQ ID NO: 4075446 - RNA, 18 nt, Streptococcus pneumoniae R6
cccuuggagggagcaacc

SEQ ID NO: 4075447 - RNA, 13 nt, Streptococcus pneumoniae R6
cccuuguucucca

SEQ ID NO: 4075448 - RNA, 20 nt, Streptococcus pneumoniae R6
cccuuuagaacuugcuccaa

SEQ ID NO: 4075449 - RNA, 21 nt, Streptococcus pneumoniae R6
cccuuuugcucggcauuguga

SEQ ID NO: 4075450 - RNA, 16 nt, Streptococcus pneumoniae R6
cccuuuuuuguuucaa

SEQ ID NO: 4075451 - RNA, 17 nt, Streptococcus pneumoniae R6
ccgaaccacaacaaaaa

SEQ ID NO: 4075452 - RNA, 15 nt, Streptococcus pneumoniae R6
ccgaacccuguuuua

SEQ ID NO: 4075453 - RNA, 16 nt, Streptococcus pneumoniae R6
ccgaaccguguuguau

SEQ ID NO: 4075454 - RNA, 15 nt, Streptococcus pneumoniae R6
ccgaagaaggccaaa

SEQ ID NO: 4075455 - RNA, 13 nt, Streptococcus pneumoniae R6
ccgaagacuuuaa

SEQ ID NO: 4075456 - RNA, 14 nt, Streptococcus pneumoniae R6
ccgaagacuuuaaa

SEQ ID NO: 4075457 - RNA, 18 nt, Streptococcus pneumoniae R6
ccgaagaguucaauagcu

SEQ ID NO: 4075458 - RNA, 22 nt, Streptococcus pneumoniae R6
ccgaagucaagccuccaauagc

SEQ ID NO: 4075459 - RNA, 18 nt, Streptococcus pneumoniae R6
ccgacaaucguugcaccu

SEQ ID NO: 4075460 - RNA, 19 nt, Streptococcus pneumoniae R6
ccgacaccaguauucuuuu

SEQ ID NO: 4075461 - RNA, 17 nt, Streptococcus pneumoniae R6
ccgaccaauucuucucu

SEQ ID NO: 4075462 - RNA, 13 nt, Streptococcus pneumoniae R6
ccgaccuugucuc

SEQ ID NO: 4075463 - RNA, 21 nt, Streptococcus pneumoniae R6
ccgacucaaguacagccugug

SEQ ID NO: 4075464 - RNA, 23 nt, Streptococcus pneumoniae R6
ccgacuuuaccagggauauagau

SEQ ID NO: 4075465 - RNA, 19 nt, Streptococcus pneumoniae R6
ccgagaguucuuguuucuc

SEQ ID NO: 4075466 - RNA, 16 nt, Streptococcus pneumoniae R6
ccgagcaagaauucaa

SEQ ID NO: 4075467 - RNA, 13 nt, Streptococcus pneumoniae R6
ccgauaacagcca

SEQ ID NO: 4075468 - RNA, 23 nt, Streptococcus pneumoniae R6
ccgauaauauauagguuuugcua

SEQ ID NO: 4075469 - RNA, 16 nt, Streptococcus pneumoniae R6
ccgauacugccgccac

SEQ ID NO: 4075470 - RNA, 14 nt, Streptococcus pneumoniae R6
ccgaucucaucuuc

SEQ ID NO: 4075471 - RNA, 18 nt, Streptococcus pneumoniae R6
ccgaugauguucauaacu

SEQ ID NO: 4075472 - RNA, 19 nt, Streptococcus pneumoniae R6
ccgauggacuuuaucaccu

SEQ ID NO: 4075473 - RNA, 21 nt, Streptococcus pneumoniae R6
ccgauggacuuuaucaccucc

SEQ ID NO: 4075474 - RNA, 19 nt, Streptococcus pneumoniae R6
ccgauuucagaaucccaaa

SEQ ID NO: 4075475 - RNA, 17 nt, Streptococcus pneumoniae R6
ccgcaaccucaaaacag

SEQ ID NO: 4075476 - RNA, 15 nt, Streptococcus pneumoniae R6
ccgcaugacaaaucg

SEQ ID NO: 4075477 - RNA, 13 nt, Streptococcus pneumoniae R6
ccgccagaacuuc

SEQ ID NO: 4075478 - RNA, 23 nt, Streptococcus pneumoniae R6
ccgccagaacuuccacuuccaga

SEQ ID NO: 4075479 - RNA, 17 nt, Streptococcus pneumoniae R6
ccgccgaggauuucacg

SEQ ID NO: 4075480 - RNA, 16 nt, Streptococcus pneumoniae R6
ccgccuucuacuuccu

SEQ ID NO: 4075481 - RNA, 18 nt, Streptococcus pneumoniae R6
ccgccuucuacuuccugc

SEQ ID NO: 4075482 - RNA, 14 nt, Streptococcus pneumoniae R6
ccggcuugucuuug

SEQ ID NO: 4075483 - RNA, 14 nt, Streptococcus pneumoniae R6
ccggcuuucacaaa

SEQ ID NO: 4075484 - RNA, 20 nt, Streptococcus pneumoniae R6
ccggugaacccaauagcgau

SEQ ID NO: 4075485 - RNA, 22 nt, Streptococcus pneumoniae R6
ccggugaacccaauagcgauuc

SEQ ID NO: 4075486 - RNA, 22 nt, Streptococcus pneumoniae R6
ccguagauagcugcagcugagg

SEQ ID NO: 4075487 - RNA, 15 nt, Streptococcus pneumoniae R6
ccguagguugcucaa

SEQ ID NO: 4075488 - RNA, 18 nt, Streptococcus pneumoniae R6
ccguagguuuucuccuug

SEQ ID NO: 4075489 - RNA, 17 nt, Streptococcus pneumoniae R6
ccguauauauguuacug

SEQ ID NO: 4075490 - RNA, 20 nt, Streptococcus pneumoniae R6
ccguauauauguuacugacu

SEQ ID NO: 4075491 - RNA, 23 nt, Streptococcus pneumoniae R6
ccguauucuuauuucaaaaaaug

SEQ ID NO: 4075492 - RNA, 11 nt, Streptococcus pneumoniae R6
ccgucaacagu

SEQ ID NO: 4075493 - RNA, 19 nt, Streptococcus pneumoniae R6
ccguccuuguaaagacuag

SEQ ID NO: 4075494 - RNA, 22 nt, Streptococcus pneumoniae R6
ccgucucacacggaaacagcuu

SEQ ID NO: 4075495 - RNA, 12 nt, Streptococcus pneumoniae R6
ccgucuucuucg

SEQ ID NO: 4075496 - RNA, 14 nt, Streptococcus pneumoniae R6
ccgucuuuagagag

SEQ ID NO: 4075497 - RNA, 16 nt, Streptococcus pneumoniae R6
ccguggaguacuucuu

SEQ ID NO: 4075498 - RNA, 21 nt, Streptococcus pneumoniae R6
ccguugaguuuuuuauuuucc

SEQ ID NO: 4075499 - RNA, 22 nt, Streptococcus pneumoniae R6
ccguuuuuguaguaaaagaauu

SEQ ID NO: 4075500 - RNA, 22 nt, Streptococcus pneumoniae R6
ccguuuuuugaaguuuucaaag

SEQ ID NO: 4075501 - RNA, 20 nt, Streptococcus pneumoniae R6
ccuaaaucaacuguuuuuga

SEQ ID NO: 4075502 - RNA, 16 nt, Streptococcus pneumoniae R6
ccuaaggcuguuucaa

SEQ ID NO: 4075503 - RNA, 21 nt, Streptococcus pneumoniae R6
ccuaauaguuaucguaauuaa

SEQ ID NO: 4075504 - RNA, 16 nt, Streptococcus pneumoniae R6
ccuaauccacucagac

SEQ ID NO: 4075505 - RNA, 22 nt, Streptococcus pneumoniae R6
ccuaauccuggucuuuuuuagc

SEQ ID NO: 4075506 - RNA, 13 nt, Streptococcus pneumoniae R6
ccuaaucucuggc

SEQ ID NO: 4075507 - RNA, 12 nt, Streptococcus pneumoniae R6
ccuaauuuuuca

SEQ ID NO: 4075508 - RNA, 17 nt, Streptococcus pneumoniae R6
ccuaauuuuucaauauc

SEQ ID NO: 4075509 - RNA, 21 nt, Streptococcus pneumoniae R6
ccuaauuuuucaauaucuuua

SEQ ID NO: 4075510 - RNA, 15 nt, Streptococcus pneumoniae R6
ccuacaauuggaaau

SEQ ID NO: 4075511 - RNA, 21 nt, Streptococcus pneumoniae R6
ccuacaugcuguuagaagacu

SEQ ID NO: 4075512 - RNA, 15 nt, Streptococcus pneumoniae R6
ccuacuguacuuaca

SEQ ID NO: 4075513 - RNA, 19 nt, Streptococcus pneumoniae R6
ccuacuugcuucccauuua

SEQ ID NO: 4075514 - RNA, 13 nt, Streptococcus pneumoniae R6
ccuagaaaaccaa

SEQ ID NO: 4075515 - RNA, 22 nt, Streptococcus pneumoniae R6
ccuagaaaaccaaguauuggca

SEQ ID NO: 4075516 - RNA, 22 nt, Streptococcus pneumoniae R6
ccuagccuucuggucugauuuu

SEQ ID NO: 4075517 - RNA, 22 nt, Streptococcus pneumoniae R6
ccuagcucauggcaagcaaguc

SEQ ID NO: 4075518 - RNA, 23 nt, Streptococcus pneumoniae R6
ccuaggcaagcuugaaacaaaua

SEQ ID NO: 4075519 - RNA, 18 nt, Streptococcus pneumoniae R6
ccuagucuacaaauucaa

SEQ ID NO: 4075520 - RNA, 13 nt, Streptococcus pneumoniae R6
ccuaguuugcucu

SEQ ID NO: 4075521 - RNA, 14 nt, Streptococcus pneumoniae R6
ccuaguuugcucuu

SEQ ID NO: 4075522 - RNA, 16 nt, Streptococcus pneumoniae R6
ccuaguuugcucuuug

SEQ ID NO: 4075523 - RNA, 13 nt, Streptococcus pneumoniae R6
ccuauagaaaaau

SEQ ID NO: 4075524 - RNA, 20 nt, Streptococcus pneumoniae R6
ccuauauuauaagacuuuuc

SEQ ID NO: 4075525 - RNA, 21 nt, Streptococcus pneumoniae R6
ccuauauuauaagacuuuucc

SEQ ID NO: 4075526 - RNA, 14 nt, Streptococcus pneumoniae R6
ccuuaacaucuuug

SEQ ID NO: 4075527 - RNA, 15 nt, Streptococcus pneumoniae R6
ccuuaacaucuuuga

SEQ ID NO: 4075528 - RNA, 17 nt, Streptococcus pneumoniae R6
ccuuaacccaaccacgu

SEQ ID NO: 4075529 - RNA, 14 nt, Streptococcus pneumoniae R6
ccuuaagaacaucu

SEQ ID NO: 4075530 - RNA, 23 nt, Streptococcus pneumoniae R6
ccuuaauccacuugguugcaccu

SEQ ID NO: 4075531 - RNA, 21 nt, Streptococcus pneumoniae R6
ccuuagcaacuguuuuuucaa

SEQ ID NO: 4075532 - RNA, 18 nt, Streptococcus pneumoniae R6
ccuuagcagacuucuuuu

SEQ ID NO: 4075533 - RNA, 23 nt, Streptococcus pneumoniae R6
ccuuaggaaugaauuuacguuga

SEQ ID NO: 4075534 - RNA, 17 nt, Streptococcus pneumoniae R6
ccuuagucgcuacaggc

SEQ ID NO: 4075535 - RNA, 13 nt, Streptococcus pneumoniae R6
ccuuagucucaaa

SEQ ID NO: 4075536 - RNA, 19 nt, Streptococcus pneumoniae R6
ccuuagucucaaaaucaaa

SEQ ID NO: 4075537 - RNA, 13 nt, Streptococcus pneumoniae R6
ccuuauauuuuuu

SEQ ID NO: 4075538 - RNA, 18 nt, Streptococcus pneumoniae R6
ccuuauccaauucuucag

SEQ ID NO: 4075539 - RNA, 20 nt, Streptococcus pneumoniae R6
ccuuauccacaucaucaaau

SEQ ID NO: 4075540 - RNA, 13 nt, Streptococcus pneumoniae R6
ccuuaugcauaau

SEQ ID NO: 4075541 - RNA, 15 nt, Streptococcus pneumoniae R6
ccuuauugaugaugu

SEQ ID NO: 4075542 - RNA, 12 nt, Streptococcus pneumoniae R6
ccuuauuuccau

SEQ ID NO: 4075543 - RNA, 19 nt, Streptococcus pneumoniae R6
ccuuauuuucuacucuuuc

SEQ ID NO: 4075544 - RNA, 13 nt, Streptococcus pneumoniae R6
ccuucaaauccug

SEQ ID NO: 4075545 - RNA, 14 nt, Streptococcus pneumoniae R6
ccuucaaauccugc

SEQ ID NO: 4075546 - RNA, 15 nt, Streptococcus pneumoniae R6
ccuucaaauccugca

SEQ ID NO: 4075547 - RNA, 18 nt, Streptococcus pneumoniae R6
ccuucaagggcagacaua

SEQ ID NO: 4075548 - RNA, 18 nt, Streptococcus pneumoniae R6
ccuucaaucuuuugcaag

SEQ ID NO: 4075549 - RNA, 16 nt, Streptococcus pneumoniae R6
ccuucaauggaguaaa

SEQ ID NO: 4075550 - RNA, 13 nt, Streptococcus pneumoniae R6
ccuucagcccaac

SEQ ID NO: 4075551 - RNA, 22 nt, Streptococcus pneumoniae R6
ccuucagcuuuggcaacugcuu

SEQ ID NO: 4075552 - RNA, 18 nt, Streptococcus pneumoniae R6
ccuucauacgagccgcaa

SEQ ID NO: 4075553 - RNA, 11 nt, Streptococcus pneumoniae R6
ccuucaucagu

SEQ ID NO: 4075554 - RNA, 17 nt, Streptococcus pneumoniae R6
ccuucaugaaauuauuu

SEQ ID NO: 4075555 - RNA, 17 nt, Streptococcus pneumoniae R6
ccuucauuuuacaucug

SEQ ID NO: 4075556 - RNA, 20 nt, Streptococcus pneumoniae R6
ccuuccuugauucggccacu

SEQ ID NO: 4075557 - RNA, 19 nt, Streptococcus pneumoniae R6
ccuucuaauagaacagaga

SEQ ID NO: 4075558 - RNA, 21 nt, Streptococcus pneumoniae R6
ccuucuggcaauuuaucccaa

SEQ ID NO: 4075559 - RNA, 17 nt, Streptococcus pneumoniae R6
ccuucuggucugauuuu

SEQ ID NO: 4075560 - RNA, 15 nt, Streptococcus pneumoniae R6
ccuucuguugguuga

SEQ ID NO: 4075561 - RNA, 12 nt, Streptococcus pneumoniae R6
ccuucuucuugg

SEQ ID NO: 4075562 - RNA, 19 nt, Streptococcus pneumoniae R6
ccuucuuucucaaacauug

SEQ ID NO: 4075563 - RNA, 12 nt, Streptococcus pneumoniae R6
ccuucuuuuacu

SEQ ID NO: 4075564 - RNA, 15 nt, Streptococcus pneumoniae R6
ccuucuuuuacuucu

SEQ ID NO: 4075565 - RNA, 19 nt, Streptococcus pneumoniae R6
ccuugaagaguugccccuu

SEQ ID NO: 4075566 - RNA, 18 nt, Streptococcus pneumoniae R6
ccuugaaggggcaacucu

SEQ ID NO: 4075567 - RNA, 20 nt, Streptococcus pneumoniae R6
ccuugaccaaguccucaauu

SEQ ID NO: 4075568 - RNA, 16 nt, Streptococcus pneumoniae R6
ccuugaccaaucaauc

SEQ ID NO: 4075569 - RNA, 16 nt, Streptococcus pneumoniae R6
ccuugauaaguucuuu

SEQ ID NO: 4075570 - RNA, 23 nt, Streptococcus pneumoniae R6
ccuugauaaugcguuuagcaucu

SEQ ID NO: 4075571 - RNA, 23 nt, Streptococcus pneumoniae R6
ccuugaucggaagcuacagagcu

SEQ ID NO: 4075572 - RNA, 14 nt, Streptococcus pneumoniae R6
ccuugauucggcca

SEQ ID NO: 4075573 - RNA, 16 nt, Streptococcus pneumoniae R6
ccuugauucggccacu

SEQ ID NO: 4075574 - RNA, 16 nt, Streptococcus pneumoniae R6
ccuugcaggauuuuug

SEQ ID NO: 4075575 - RNA, 19 nt, Streptococcus pneumoniae R6
ccuugccaucugcuucauc

SEQ ID NO: 4075576 - RNA, 20 nt, Streptococcus pneumoniae R6
ccuugccuaauuuuucaaua

SEQ ID NO: 4075577 - RNA, 19 nt, Streptococcus pneumoniae R6
ccuuggagggagcaaccac

SEQ ID NO: 4075578 - RNA, 21 nt, Streptococcus pneumoniae R6
ccuuggcaaauugauaaggac

SEQ ID NO: 4075579 - RNA, 21 nt, Streptococcus pneumoniae R6
ccuuguagaaaagcaaaaugg

SEQ ID NO: 4075580 - RNA, 13 nt, Streptococcus pneumoniae R6
ccuuguaggaagu

SEQ ID NO: 4075581 - RNA, 22 nt, Streptococcus pneumoniae R6
ccuuguaggaaguuuagauuaa

SEQ ID NO: 4075582 - RNA, 19 nt, Streptococcus pneumoniae R6
ccuuguuuccaaggaaagu

SEQ ID NO: 4075583 - RNA, 21 nt, Streptococcus pneumoniae R6
ccuuguuucuaaaacauugug

SEQ ID NO: 4075584 - RNA, 23 nt, Streptococcus pneumoniae R6
ccuuguuucuaaaacauugugag

SEQ ID NO: 4075585 - RNA, 17 nt, Streptococcus pneumoniae R6
ccuuguuugagcucuuu

SEQ ID NO: 4075586 - RNA, 13 nt, Streptococcus pneumoniae R6
ccuuuaaaaacaa

SEQ ID NO: 4075587 - RNA, 16 nt, Streptococcus pneumoniae R6
ccuuuaaaaugaauuc

SEQ ID NO: 4075588 - RNA, 13 nt, Streptococcus pneumoniae R6
ccuuuaacauuug

SEQ ID NO: 4075589 - RNA, 13 nt, Streptococcus pneumoniae R6
ccuuuagaaaggu

SEQ ID NO: 4075590 - RNA, 20 nt, Streptococcus pneumoniae R6
ccuuuagaaagguuuuaaag

SEQ ID NO: 4075591 - RNA, 13 nt, Streptococcus pneumoniae R6
ccuuuauaagcaa

SEQ ID NO: 4075592 - RNA, 16 nt, Streptococcus pneumoniae R6
ccuuuaucugcccaaa

SEQ ID NO: 4075593 - RNA, 13 nt, Streptococcus pneumoniae R6
ccuuuauuuucaa

SEQ ID NO: 4075594 - RNA, 16 nt, Streptococcus pneumoniae R6
ccuuuauuuucaagcg

SEQ ID NO: 4075595 - RNA, 15 nt, Streptococcus pneumoniae R6
ccuuucaaaccgcca

SEQ ID NO: 4075596 - RNA, 20 nt, Streptococcus pneumoniae R6
ccuuucaaaccgccaccaaa

SEQ ID NO: 4075597 - RNA, 21 nt, Streptococcus pneumoniae R6
ccuuucaaaccgccaccaaac

SEQ ID NO: 4075598 - RNA, 22 nt, Streptococcus pneumoniae R6
ccuuucaauagcauauuuuuag

SEQ ID NO: 4075599 - RNA, 17 nt, Streptococcus pneumoniae R6
ccuuucauaaaguuuuc

SEQ ID NO: 4075600 - RNA, 22 nt, Streptococcus pneumoniae R6
ccuuucucgagcuuagcuuuuc

SEQ ID NO: 4075601 - RNA, 11 nt, Streptococcus pneumoniae R6
ccuuugaguaa

SEQ ID NO: 4075602 - RNA, 14 nt, Streptococcus pneumoniae R6
ccuuugauagcauc

SEQ ID NO: 4075603 - RNA, 14 nt, Streptococcus pneumoniae R6
ccuuugcauccaca

SEQ ID NO: 4075604 - RNA, 20 nt, Streptococcus pneumoniae R6
ccuuuguccauuaugauaua

SEQ ID NO: 4075605 - RNA, 21 nt, Streptococcus pneumoniae R6
ccuuuuaguuuuaucuuaauu

SEQ ID NO: 4075606 - RNA, 22 nt, Streptococcus pneumoniae R6
ccuuuuaugaggugcuuuuuga

SEQ ID NO: 4075607 - RNA, 17 nt, Streptococcus pneumoniae R6
ccuuuuuaugauauuga

SEQ ID NO: 4075608 - RNA, 18 nt, Streptococcus pneumoniae R6
ccuuuuugauaagauaau

SEQ ID NO: 4075609 - RNA, 22 nt, Streptococcus pneumoniae R6
ccuuuuuucuaugcuuuuauuc

SEQ ID NO: 4075610 - RNA, 17 nt, Streptococcus pneumoniae R6
ccuuuuuucucaaucag

SEQ ID NO: 4075611 - RNA, 13 nt, Streptococcus pneumoniae R6
ccuuuuuuguuuc

SEQ ID NO: 4075612 - RNA, 17 nt, Streptococcus pneumoniae R6
cgaaaaaugcuggcgga

SEQ ID NO: 4075613 - RNA, 15 nt, Streptococcus pneumoniae R6
cgaaaaauuucucug

SEQ ID NO: 4075614 - RNA, 23 nt, Streptococcus pneumoniae R6
cgaaaaauuucucugguuccuua

SEQ ID NO: 4075615 - RNA, 17 nt, Streptococcus pneumoniae R6
cgaaaaguaggacgaua

SEQ ID NO: 4075616 - RNA, 15 nt, Streptococcus pneumoniae R6
cgaaaaucuccucua

SEQ ID NO: 4075617 - RNA, 13 nt, Streptococcus pneumoniae R6
cgaaacgaagaag

SEQ ID NO: 4075618 - RNA, 15 nt, Streptococcus pneumoniae R6
cgaaacgaagaagga

SEQ ID NO: 4075619 - RNA, 17 nt, Streptococcus pneumoniae R6
cgaaacuccauaaaauc

SEQ ID NO: 4075620 - RNA, 18 nt, Streptococcus pneumoniae R6
cgaaacuccauaaaauca

SEQ ID NO: 4075621 - RNA, 14 nt, Streptococcus pneumoniae R6
cgaaacucuuuuua

SEQ ID NO: 4075622 - RNA, 18 nt, Streptococcus pneumoniae R6
cgaaacucuuuuuaaacc

SEQ ID NO: 4075623 - RNA, 14 nt, Streptococcus pneumoniae R6
cgaaaggagaaaaa

SEQ ID NO: 4075624 - RNA, 17 nt, Streptococcus pneumoniae R6
cgaaaggagaaaaaaua

SEQ ID NO: 4075625 - RNA, 15 nt, Streptococcus pneumoniae R6
cgaaaggcuuuauuc

SEQ ID NO: 4075626 - RNA, 17 nt, Streptococcus pneumoniae R6
cgaaaucugucuaccuu

SEQ ID NO: 4075627 - RNA, 15 nt, Streptococcus pneumoniae R6
cgaacaucuccaacu

SEQ ID NO: 4075628 - RNA, 17 nt, Streptococcus pneumoniae R6
cgaacccccaugacuuc

SEQ ID NO: 4075629 - RNA, 15 nt, Streptococcus pneumoniae R6
cgaaccugugaccca

SEQ ID NO: 4075630 - RNA, 17 nt, Streptococcus pneumoniae R6
cgaacgccuuaaaaaac

SEQ ID NO: 4075631 - RNA, 19 nt, Streptococcus pneumoniae R6
cgaacgccuuaaaaaacca

SEQ ID NO: 4075632 - RNA, 14 nt, Streptococcus pneumoniae R6
cgaacggguucuuc

SEQ ID NO: 4075633 - RNA, 13 nt, Streptococcus pneumoniae R6
cgaacuagagaag

SEQ ID NO: 4075634 - RNA, 21 nt, Streptococcus pneumoniae R6
cgaacugcgacguuuucuccu

SEQ ID NO: 4075635 - RNA, 16 nt, Streptococcus pneumoniae R6
cgaagaaggaagaguc

SEQ ID NO: 4075636 - RNA, 21 nt, Streptococcus pneumoniae R6
cgaagaaggaagagucagacu

SEQ ID NO: 4075637 - RNA, 17 nt, Streptococcus pneumoniae R6
cgaagaguauaaaaacu

SEQ ID NO: 4075638 - RNA, 16 nt, Streptococcus pneumoniae R6
cgaagcauaucagaca

SEQ ID NO: 4075639 - RNA, 16 nt, Streptococcus pneumoniae R6
cgaaggauuuaguucu

SEQ ID NO: 4075640 - RNA, 17 nt, Streptococcus pneumoniae R6
cgaagguuauaccaaaa

SEQ ID NO: 4075641 - RNA, 20 nt, Streptococcus pneumoniae R6
cgaagguuauaccaaaaaaa

SEQ ID NO: 4075642 - RNA, 14 nt, Streptococcus pneumoniae R6
cgaagucagcucaa

SEQ ID NO: 4075643 - RNA, 13 nt, Streptococcus pneumoniae R6
cgaaguccuuguu

SEQ ID NO: 4075644 - RNA, 15 nt, Streptococcus pneumoniae R6
cgaagugcuucuggg

SEQ ID NO: 4075645 - RNA, 19 nt, Streptococcus pneumoniae R6
cgaaguuguucuugaaguc

SEQ ID NO: 4075646 - RNA, 14 nt, Streptococcus pneumoniae R6
cgaaguuucaaucg

SEQ ID NO: 4075647 - RNA, 23 nt, Streptococcus pneumoniae R6
cgaaguuucaaucguuucuggca

SEQ ID NO: 4075648 - RNA, 22 nt, Streptococcus pneumoniae R6
cgaauaaagaaacuuggcaaaa

SEQ ID NO: 4075649 - RNA, 23 nt, Streptococcus pneumoniae R6
cgaauaccaccaaucauuuggaa

SEQ ID NO: 4075650 - RNA, 17 nt, Streptococcus pneumoniae R6
cgaauagaguucuaaaa

SEQ ID NO: 4075651 - RNA, 16 nt, Streptococcus pneumoniae R6
cgaauagcucaaaagc

SEQ ID NO: 4075652 - RNA, 14 nt, Streptococcus pneumoniae R6
cgaauaggauuugg

SEQ ID NO: 4075653 - RNA, 15 nt, Streptococcus pneumoniae R6
cgaaugauuucucuu

SEQ ID NO: 4075654 - RNA, 17 nt, Streptococcus pneumoniae R6
cgaauuggauauagucu

SEQ ID NO: 4075655 - RNA, 16 nt, Streptococcus pneumoniae R6
cgacauccuauuuauu

SEQ ID NO: 4075656 - RNA, 15 nt, Streptococcus pneumoniae R6
cgacauuaccucuuu

SEQ ID NO: 4075657 - RNA, 23 nt, Streptococcus pneumoniae R6
cgacauuuugcccaccugucaag

SEQ ID NO: 4075658 - RNA, 17 nt, Streptococcus pneumoniae R6
cgaccagggaugacaac

SEQ ID NO: 4075659 - RNA, 22 nt, Streptococcus pneumoniae R6
cgaccuucaauuccuucuggaa

SEQ ID NO: 4075660 - RNA, 22 nt, Streptococcus pneumoniae R6
cgacuacuaguucugcagaauc

SEQ ID NO: 4075661 - RNA, 19 nt, Streptococcus pneumoniae R6
cgacugaggguuuugugcu

SEQ ID NO: 4075662 - RNA, 22 nt, Streptococcus pneumoniae R6
cgacugcgguugcguagcugag

SEQ ID NO: 4075663 - RNA, 18 nt, Streptococcus pneumoniae R6
cgacugguaaagaaugga

SEQ ID NO: 4075664 - RNA, 13 nt, Streptococcus pneumoniae R6
cgacuucacacuu

SEQ ID NO: 4075665 - RNA, 16 nt, Streptococcus pneumoniae R6
cgagaaacaagaacuc

SEQ ID NO: 4075666 - RNA, 14 nt, Streptococcus pneumoniae R6
cgagaaagaucauu

SEQ ID NO: 4075667 - RNA, 18 nt, Streptococcus pneumoniae R6
cgagaaaggacaaauuuc

SEQ ID NO: 4075668 - RNA, 22 nt, Streptococcus pneumoniae R6
cgagaaucuguauuuggcauug

SEQ ID NO: 4075669 - RNA, 14 nt, Streptococcus pneumoniae R6
cgagacaaaacaac

SEQ ID NO: 4075670 - RNA, 20 nt, Streptococcus pneumoniae R6
cgagacauaccauuuuccaa

SEQ ID NO: 4075671 - RNA, 21 nt, Streptococcus pneumoniae R6
cgagagcuuugacauccuuuu

SEQ ID NO: 4075672 - RNA, 22 nt, Streptococcus pneumoniae R6
cgagagugauaacauaaccuuc

SEQ ID NO: 4075673 - RNA, 17 nt, Streptococcus pneumoniae R6
cgagaguucuuguuucu

SEQ ID NO: 4075674 - RNA, 21 nt, Streptococcus pneumoniae R6
cgagauaaugcccaagagacu

SEQ ID NO: 4075675 - RNA, 18 nt, Streptococcus pneumoniae R6
cgagauagcgcugggcug

SEQ ID NO: 4075676 - RNA, 10 nt, Streptococcus pneumoniae R6
cgagccucuu

SEQ ID NO: 4075677 - RNA, 17 nt, Streptococcus pneumoniae R6
cgagcuuguuugcuuca

SEQ ID NO: 4075678 - RNA, 18 nt, Streptococcus pneumoniae R6
cgaggaggagaaaaagcg

SEQ ID NO: 4075679 - RNA, 20 nt, Streptococcus pneumoniae R6
cgaggauuucccaaguacga

SEQ ID NO: 4075680 - RNA, 23 nt, Streptococcus pneumoniae R6
cgaggguaaaggguuuggucaga

SEQ ID NO: 4075681 - RNA, 16 nt, Streptococcus pneumoniae R6
cgagguauuucuuguu

SEQ ID NO: 4075682 - RNA, 18 nt, Streptococcus pneumoniae R6
cgaguaaaagauaaucau

SEQ ID NO: 4075683 - RNA, 22 nt, Streptococcus pneumoniae R6
cgaguaaaagauaaucaucugg

SEQ ID NO: 4075684 - RNA, 16 nt, Streptococcus pneumoniae R6
cgagugcaagagcguc

SEQ ID NO: 4075685 - RNA, 16 nt, Streptococcus pneumoniae R6
cgaguguauuguacuu

SEQ ID NO: 4075686 - RNA, 20 nt, Streptococcus pneumoniae R6
cgaguguauuguacuuucca

SEQ ID NO: 4075687 - RNA, 21 nt, Streptococcus pneumoniae R6
cgaguguauuguacuuuccaa

SEQ ID NO: 4075688 - RNA, 17 nt, Streptococcus pneumoniae R6
cgaguuaaaacaaagaa

SEQ ID NO: 4075689 - RNA, 17 nt, Streptococcus pneumoniae R6
cgauaaaaauccuuuuu

SEQ ID NO: 4075690 - RNA, 23 nt, Streptococcus pneumoniae R6
cgauaaaaguaagaauguugcuu

SEQ ID NO: 4075691 - RNA, 18 nt, Streptococcus pneumoniae R6
cgauaaaaucguuuauca

SEQ ID NO: 4075692 - RNA, 23 nt, Streptococcus pneumoniae R6
cgauaaauugcuggagaaucauc

SEQ ID NO: 4075693 - RNA, 22 nt, Streptococcus pneumoniae R6
cgauaacgauagauccuucaaa

SEQ ID NO: 4075694 - RNA, 16 nt, Streptococcus pneumoniae R6
cgauaauuauuuuuua

SEQ ID NO: 4075695 - RNA, 14 nt, Streptococcus pneumoniae R6
cgauaauuucgcug

SEQ ID NO: 4075696 - RNA, 20 nt, Streptococcus pneumoniae R6
cgauacaauaaagguguuca

SEQ ID NO: 4075697 - RNA, 21 nt, Streptococcus pneumoniae R6
cgauacaguuagcauggucaa

SEQ ID NO: 4075698 - RNA, 19 nt, Streptococcus pneumoniae R6
cgauagauguuuucaaaaa

SEQ ID NO: 4075699 - RNA, 21 nt, Streptococcus pneumoniae R6
cgauagcuuuugcagcaccag

SEQ ID NO: 4075700 - RNA, 13 nt, Streptococcus pneumoniae R6
cgauauagugaaa

SEQ ID NO: 4075701 - RNA, 15 nt, Streptococcus pneumoniae R6
cgauaucagcuagga

SEQ ID NO: 4075702 - RNA, 22 nt, Streptococcus pneumoniae R6
cgaucaaaguuggucauauuaa

SEQ ID NO: 4075703 - RNA, 22 nt, Streptococcus pneumoniae R6
cgaucgaugcugugacacuaga

SEQ ID NO: 4075704 - RNA, 16 nt, Streptococcus pneumoniae R6
cgaucuggcaggcuga

SEQ ID NO: 4075705 - RNA, 20 nt, Streptococcus pneumoniae R6
cgaucuguucuucuaucuuc

SEQ ID NO: 4075706 - RNA, 15 nt, Streptococcus pneumoniae R6
cgaugaagagagagu

SEQ ID NO: 4075707 - RNA, 23 nt, Streptococcus pneumoniae R6
cgaugauuacaggcaggacaaaa

SEQ ID NO: 4075708 - RNA, 22 nt, Streptococcus pneumoniae R6
cgaugauuggugcuaauucuuu

SEQ ID NO: 4075709 - RNA, 11 nt, Streptococcus pneumoniae R6
cgaugauuuua

SEQ ID NO: 4075710 - RNA, 14 nt, Streptococcus pneumoniae R6
cgaugguugucccu

SEQ ID NO: 4075711 - RNA, 17 nt, Streptococcus pneumoniae R6
cgauguuacagacaaaa

SEQ ID NO: 4075712 - RNA, 19 nt, Streptococcus pneumoniae R6
cgauguuugcagcaccagc

SEQ ID NO: 4075713 - RNA, 16 nt, Streptococcus pneumoniae R6
cgauuaaauaguucuu

SEQ ID NO: 4075714 - RNA, 17 nt, Streptococcus pneumoniae R6
cgauuacaaucauagac

SEQ ID NO: 4075715 - RNA, 22 nt, Streptococcus pneumoniae R6
cgauuacaaucauagacuuaau

SEQ ID NO: 4075716 - RNA, 22 nt, Streptococcus pneumoniae R6
cgauuaccgccuucuacuuccu

SEQ ID NO: 4075717 - RNA, 19 nt, Streptococcus pneumoniae R6
cgauucauaguuacuccuu

SEQ ID NO: 4075718 - RNA, 16 nt, Streptococcus pneumoniae R6
cgauucaucaagagac

SEQ ID NO: 4075719 - RNA, 15 nt, Streptococcus pneumoniae R6
cgauucccaagucug

SEQ ID NO: 4075720 - RNA, 17 nt, Streptococcus pneumoniae R6
cgauugauuucggccaa

SEQ ID NO: 4075721 - RNA, 21 nt, Streptococcus pneumoniae R6
cgauuggggauugauuuucag

SEQ ID NO: 4075722 - RNA, 18 nt, Streptococcus pneumoniae R6
cgauuggggauuuuuagu

SEQ ID NO: 4075723 - RNA, 14 nt, Streptococcus pneumoniae R6
cgauuucaagaacu

SEQ ID NO: 4075724 - RNA, 15 nt, Streptococcus pneumoniae R6
cgauuucaagaacuc

SEQ ID NO: 4075725 - RNA, 16 nt, Streptococcus pneumoniae R6
cgauuucagaauccca

SEQ ID NO: 4075726 - RNA, 21 nt, Streptococcus pneumoniae R6
cgauuuguucuguucuuauuu

SEQ ID NO: 4075727 - RNA, 23 nt, Streptococcus pneumoniae R6
cgauuuucaaaaagaaguucugg

SEQ ID NO: 4075728 - RNA, 22 nt, Streptococcus pneumoniae R6
cgauuuucccuuuuguauucca

SEQ ID NO: 4075729 - RNA, 12 nt, Streptococcus pneumoniae R6
cgauuuucucuu

SEQ ID NO: 4075730 - RNA, 12 nt, Streptococcus pneumoniae R6
cgauuuuugugu

SEQ ID NO: 4075731 - RNA, 18 nt, Streptococcus pneumoniae R6
cguccuguugcuucaucu

SEQ ID NO: 4075732 - RNA, 15 nt, Streptococcus pneumoniae R6
cguccuuucuuuuuu

SEQ ID NO: 4075733 - RNA, 20 nt, Streptococcus pneumoniae R6
cgucgaagguuauaccaaaa

SEQ ID NO: 4075734 - RNA, 13 nt, Streptococcus pneumoniae R6
cgucuaaacugua

SEQ ID NO: 4075735 - RNA, 18 nt, Streptococcus pneumoniae R6
cgucuuggucugucaaag

SEQ ID NO: 4075736 - RNA, 13 nt, Streptococcus pneumoniae R6
cgucuuuuuuccg

SEQ ID NO: 4075737 - RNA, 22 nt, Streptococcus pneumoniae R6
cgugauaccagagcgacuggga

SEQ ID NO: 4075738 - RNA, 17 nt, Streptococcus pneumoniae R6
cgugauuguuuuuaaag

SEQ ID NO: 4075739 - RNA, 21 nt, Streptococcus pneumoniae R6
cgugauuuccaaucuucucca

SEQ ID NO: 4075740 - RNA, 14 nt, Streptococcus pneumoniae R6
cgugcauuucaucc

SEQ ID NO: 4075741 - RNA, 18 nt, Streptococcus pneumoniae R6
cgugcgcucuaaccaccu

SEQ ID NO: 4075742 - RNA, 22 nt, Streptococcus pneumoniae R6
cgugcuaauucggcuugguucg

SEQ ID NO: 4075743 - RNA, 17 nt, Streptococcus pneumoniae R6
cguggaguacuucuuug

SEQ ID NO: 4075744 - RNA, 18 nt, Streptococcus pneumoniae R6
cguguaggggauaaugag

SEQ ID NO: 4075745 - RNA, 17 nt, Streptococcus pneumoniae R6
cguguggguucauccag

SEQ ID NO: 4075746 - RNA, 16 nt, Streptococcus pneumoniae R6
cguguuagauaguuca

SEQ ID NO: 4075747 - RNA, 17 nt, Streptococcus pneumoniae R6
cguuaaaagcaaaaacg

SEQ ID NO: 4075748 - RNA, 19 nt, Streptococcus pneumoniae R6
cguuaaaaguuaguugaac

SEQ ID NO: 4075749 - RNA, 15 nt, Streptococcus pneumoniae R6
cguuacuauaagacu

SEQ ID NO: 4075750 - RNA, 18 nt, Streptococcus pneumoniae R6
cguuacuauaagacuccu

SEQ ID NO: 4075751 - RNA, 13 nt, Streptococcus pneumoniae R6
cguucaaagauau

SEQ ID NO: 4075752 - RNA, 16 nt, Streptococcus pneumoniae R6
cguucaaagauaucau

SEQ ID NO: 4075753 - RNA, 13 nt, Streptococcus pneumoniae R6
cguucauccacuc

SEQ ID NO: 4075754 - RNA, 19 nt, Streptococcus pneumoniae R6
cguuccaagauuggaucug

SEQ ID NO: 4075755 - RNA, 20 nt, Streptococcus pneumoniae R6
cguuccagcgguaucaauca

SEQ ID NO: 4075756 - RNA, 22 nt, Streptococcus pneumoniae R6
cguuccaguuuggcaaauagaa

SEQ ID NO: 4075757 - RNA, 17 nt, Streptococcus pneumoniae R6
cguuccauaguugagau

SEQ ID NO: 4075758 - RNA, 15 nt, Streptococcus pneumoniae R6
cguucggcuucaucu

SEQ ID NO: 4075759 - RNA, 18 nt, Streptococcus pneumoniae R6
cguucggcuucaucugga

SEQ ID NO: 4075760 - RNA, 21 nt, Streptococcus pneumoniae R6
cguucgguauuuucauagagg

SEQ ID NO: 4075761 - RNA, 14 nt, Streptococcus pneumoniae R6
cguucuucaacauc

SEQ ID NO: 4075762 - RNA, 12 nt, Streptococcus pneumoniae R6
cguucuucaaga

SEQ ID NO: 4075763 - RNA, 20 nt, Streptococcus pneumoniae R6
cguugaaugaaaugaggcug

SEQ ID NO: 4075764 - RNA, 19 nt, Streptococcus pneumoniae R6
cguugaguuuuuuauuuuc

SEQ ID NO: 4075765 - RNA, 19 nt, Streptococcus pneumoniae R6
cguugauaaucuuaucucu

SEQ ID NO: 4075766 - RNA, 20 nt, Streptococcus pneumoniae R6
cguuggaauaaggcagcuua

SEQ ID NO: 4075767 - RNA, 11 nt, Streptococcus pneumoniae R6
cguugucuucu

SEQ ID NO: 4075768 - RNA, 20 nt, Streptococcus pneumoniae R6
cguuuacgaaucucuuucca

SEQ ID NO: 4075769 - RNA, 13 nt, Streptococcus pneumoniae R6
cguuuagcaucuu

SEQ ID NO: 4075770 - RNA, 20 nt, Streptococcus pneumoniae R6
cguuuagcaucuucuucugg

SEQ ID NO: 4075771 - RNA, 17 nt, Streptococcus pneumoniae R6
cguuucagcauauuucc

SEQ ID NO: 4075772 - RNA, 18 nt, Streptococcus pneumoniae R6
cguuucagcauauuuccc

SEQ ID NO: 4075773 - RNA, 20 nt, Streptococcus pneumoniae R6
cguuucauggacuguuucau

SEQ ID NO: 4075774 - RNA, 15 nt, Streptococcus pneumoniae R6
cguuucgucauucca

SEQ ID NO: 4075775 - RNA, 16 nt, Streptococcus pneumoniae R6
cguuucgucauuccaa

SEQ ID NO: 4075776 - RNA, 14 nt, Streptococcus pneumoniae R6
cguuucuaauaauu

SEQ ID NO: 4075777 - RNA, 16 nt, Streptococcus pneumoniae R6
cguuuuaggacauaaa

SEQ ID NO: 4075778 - RNA, 16 nt, Streptococcus pneumoniae R6
cguuuuaucugcaauu

SEQ ID NO: 4075779 - RNA, 22 nt, Streptococcus pneumoniae R6
cguuuuccuagauuacaaaaaa

SEQ ID NO: 4075780 - RNA, 13 nt, Streptococcus pneumoniae R6
cguuuucuacaau

SEQ ID NO: 4075781 - RNA, 19 nt, Streptococcus pneumoniae R6
cguuuuucagauuuuaaag

SEQ ID NO: 4075782 - RNA, 15 nt, Streptococcus pneumoniae R6
cguuuuucuccucua

SEQ ID NO: 4075783 - RNA, 20 nt, Streptococcus pneumoniae R6
cguuuuucugauuuugaaaa

SEQ ID NO: 4075784 - RNA, 16 nt, Streptococcus pneumoniae R6
cguuuuuucugauuuc

SEQ ID NO: 4075785 - RNA, 22 nt, Streptococcus pneumoniae R6
cguuuuuugaaguuuucaaagu

SEQ ID NO: 4075786 - RNA, 15 nt, Streptococcus pneumoniae R6
cguuuuuuugauuuu

SEQ ID NO: 4075787 - RNA, 13 nt, Streptococcus pneumoniae R6
cuaaaaaaaugau

SEQ ID NO: 4075788 - RNA, 12 nt, Streptococcus pneumoniae R6
cuaaaaaauugc

SEQ ID NO: 4075789 - RNA, 16 nt, Streptococcus pneumoniae R6
cuaaaaacucuucuuu

SEQ ID NO: 4075790 - RNA, 18 nt, Streptococcus pneumoniae R6
cuaaaaagcuacuauaaa

SEQ ID NO: 4075791 - RNA, 15 nt, Streptococcus pneumoniae R6
cuaaaaauaaaaaag

SEQ ID NO: 4075792 - RNA, 21 nt, Streptococcus pneumoniae R6
cuaaaaauaacuaccuuacuc

SEQ ID NO: 4075793 - RNA, 15 nt, Streptococcus pneumoniae R6
cuaaaacaguuacau

SEQ ID NO: 4075794 - RNA, 17 nt, Streptococcus pneumoniae R6
cuaaaacauuguuaaaa

SEQ ID NO: 4075795 - RNA, 22 nt, Streptococcus pneumoniae R6
cuaaaacauuguuagaaaucaa

SEQ ID NO: 4075796 - RNA, 11 nt, Streptococcus pneumoniae R6
cuaaaacauuu

SEQ ID NO: 4075797 - RNA, 23 nt, Streptococcus pneumoniae R6
cuaaaacauuucuauaaaucaau

SEQ ID NO: 4075798 - RNA, 19 nt, Streptococcus pneumoniae R6
cuaaaaccaaaggcauugu

SEQ ID NO: 4075799 - RNA, 18 nt, Streptococcus pneumoniae R6
cuaaaacgcauccuauca

SEQ ID NO: 4075800 - RNA, 20 nt, Streptococcus pneumoniae R6
cuaaaacguuguuuucacga

SEQ ID NO: 4075801 - RNA, 13 nt, Streptococcus pneumoniae R6
cuaaaacuaguga

SEQ ID NO: 4075802 - RNA, 13 nt, Streptococcus pneumoniae R6
cuaaaacuccaac

SEQ ID NO: 4075803 - RNA, 13 nt, Streptococcus pneumoniae R6
cuaaaacuccuau

SEQ ID NO: 4075804 - RNA, 22 nt, Streptococcus pneumoniae R6
cuaaaagauuucuauaaauuca

SEQ ID NO: 4075805 - RNA, 10 nt, Streptococcus pneumoniae R6
cuaaaauaac

SEQ ID NO: 4075806 - RNA, 16 nt, Streptococcus pneumoniae R6
cuaaaauguuuuucgu

SEQ ID NO: 4075807 - RNA, 20 nt, Streptococcus pneumoniae R6
cuaaaauguuuuucgucucg

SEQ ID NO: 4075808 - RNA, 14 nt, Streptococcus pneumoniae R6
cuaaaauucccuua

SEQ ID NO: 4075809 - RNA, 17 nt, Streptococcus pneumoniae R6
cuaaaauucccuuaucc

SEQ ID NO: 4075810 - RNA, 21 nt, Streptococcus pneumoniae R6
cuaaaauucccuuauccacau

SEQ ID NO: 4075811 - RNA, 21 nt, Streptococcus pneumoniae R6
cuaaaauuguguuuuugcccc

SEQ ID NO: 4075812 - RNA, 17 nt, Streptococcus pneumoniae R6
cuaaacaaacuccucuc

SEQ ID NO: 4075813 - RNA, 23 nt, Streptococcus pneumoniae R6
cuaaacaauguucucauauuuuc

SEQ ID NO: 4075814 - RNA, 18 nt, Streptococcus pneumoniae R6
cuaaacuauuucuuauuu

SEQ ID NO: 4075815 - RNA, 19 nt, Streptococcus pneumoniae R6
cuaaacuguacaagaacaa

SEQ ID NO: 4075816 - RNA, 14 nt, Streptococcus pneumoniae R6
cuaaacuuugagcc

SEQ ID NO: 4075817 - RNA, 15 nt, Streptococcus pneumoniae R6
cuaaacuuugagccu

SEQ ID NO: 4075818 - RNA, 17 nt, Streptococcus pneumoniae R6
cuaaacuuugagccuag

SEQ ID NO: 4075819 - RNA, 19 nt, Streptococcus pneumoniae R6
cuaaagaauuugaaaaaaa

SEQ ID NO: 4075820 - RNA, 21 nt, Streptococcus pneumoniae R6
cuaaagaauuugaaaaaaauu

SEQ ID NO: 4075821 - RNA, 22 nt, Streptococcus pneumoniae R6
cuaaagcaauuuugaaagauuc

SEQ ID NO: 4075822 - RNA, 13 nt, Streptococcus pneumoniae R6
cuaaaguuccuaa

SEQ ID NO: 4075823 - RNA, 12 nt, Streptococcus pneumoniae R6
cuaaauaaaucu

SEQ ID NO: 4075824 - RNA, 14 nt, Streptococcus pneumoniae R6
cuaaauacaaaaac

SEQ ID NO: 4075825 - RNA, 15 nt, Streptococcus pneumoniae R6
cuaaauaccuuaucc

SEQ ID NO: 4075826 - RNA, 16 nt, Streptococcus pneumoniae R6
cuaaauccuuuuuucu

SEQ ID NO: 4075827 - RNA, 17 nt, Streptococcus pneumoniae R6
cuaaauccuuuuuucuu

SEQ ID NO: 4075828 - RNA, 23 nt, Streptococcus pneumoniae R6
cuaaauccuuuuuucuuuacucu

SEQ ID NO: 4075829 - RNA, 17 nt, Streptococcus pneumoniae R6
cuaaaucgauuauauuu

SEQ ID NO: 4075830 - RNA, 21 nt, Streptococcus pneumoniae R6
cuaaaucuagauacauuuuuu

SEQ ID NO: 4075831 - RNA, 16 nt, Streptococcus pneumoniae R6
cuaaaugcugaaaagu

SEQ ID NO: 4075832 - RNA, 16 nt, Streptococcus pneumoniae R6
cuaaauucaauucacu

SEQ ID NO: 4075833 - RNA, 21 nt, Streptococcus pneumoniae R6
cuaaauucaauucacuauaac

SEQ ID NO: 4075834 - RNA, 15 nt, Streptococcus pneumoniae R6
cuacgaacaggaacg

SEQ ID NO: 4075835 - RNA, 16 nt, Streptococcus pneumoniae R6
cuacgcuuuaaaaauc

SEQ ID NO: 4075836 - RNA, 14 nt, Streptococcus pneumoniae R6
cuacgucagcuucc

SEQ ID NO: 4075837 - RNA, 16 nt, Streptococcus pneumoniae R6
cuacgucagcuuccau

SEQ ID NO: 4075838 - RNA, 19 nt, Streptococcus pneumoniae R6
cuacguucugucaaaccau

SEQ ID NO: 4075839 - RNA, 18 nt, Streptococcus pneumoniae R6
cuacuaaaccaauaauaa

SEQ ID NO: 4075840 - RNA, 21 nt, Streptococcus pneumoniae R6
cuacuaaaccaauaauaaaac

SEQ ID NO: 4075841 - RNA, 20 nt, Streptococcus pneumoniae R6
cuacuaggcaggaaggaaau

SEQ ID NO: 4075842 - RNA, 17 nt, Streptococcus pneumoniae R6
cuacucaugugucuugc

SEQ ID NO: 4075843 - RNA, 15 nt, Streptococcus pneumoniae R6
cuacuccaagcaagc

SEQ ID NO: 4075844 - RNA, 20 nt, Streptococcus pneumoniae R6
cuacucgaacuagagaagcc

SEQ ID NO: 4075845 - RNA, 20 nt, Streptococcus pneumoniae R6
cuacucuuucgaagucugau

SEQ ID NO: 4075846 - RNA, 22 nt, Streptococcus pneumoniae R6
cuacugaaauugagucuuuuuc

SEQ ID NO: 4075847 - RNA, 18 nt, Streptococcus pneumoniae R6
cuacugcauccaacaauu

SEQ ID NO: 4075848 - RNA, 14 nt, Streptococcus pneumoniae R6
cuacuguaggcuug

SEQ ID NO: 4075849 - RNA, 22 nt, Streptococcus pneumoniae R6
cuacuucccacccauauuuuuc

SEQ ID NO: 4075850 - RNA, 12 nt, Streptococcus pneumoniae R6
cuacuuccuaag

SEQ ID NO: 4075851 - RNA, 23 nt, Streptococcus pneumoniae R6
cuacuuccuaagcuuucagcagc

SEQ ID NO: 4075852 - RNA, 14 nt, Streptococcus pneumoniae R6
cuacuugcuuccca

SEQ ID NO: 4075853 - RNA, 19 nt, Streptococcus pneumoniae R6
cuacuugguugucccaaga

SEQ ID NO: 4075854 - RNA, 22 nt, Streptococcus pneumoniae R6
cuacuuugauuuuaaagaaaua

SEQ ID NO: 4075855 - RNA, 12 nt, Streptococcus pneumoniae R6
cuacuuuuucaa

SEQ ID NO: 4075856 - RNA, 15 nt, Streptococcus pneumoniae R6
cuacuuuuucaaagu

SEQ ID NO: 4075857 - RNA, 13 nt, Streptococcus pneumoniae R6
cuagaaaaagcuu

SEQ ID NO: 4075858 - RNA, 16 nt, Streptococcus pneumoniae R6
cuagaaaaagcuucau

SEQ ID NO: 4075859 - RNA, 19 nt, Streptococcus pneumoniae R6
cuagaaaaagcuucauuua

SEQ ID NO: 4075860 - RNA, 17 nt, Streptococcus pneumoniae R6
cuagaaacguuguuaaa

SEQ ID NO: 4075861 - RNA, 18 nt, Streptococcus pneumoniae R6
cuagaaaggacaaauuuc

SEQ ID NO: 4075862 - RNA, 17 nt, Streptococcus pneumoniae R6
cuagaaaucucuuuuuu

SEQ ID NO: 4075863 - RNA, 16 nt, Streptococcus pneumoniae R6
cuagaaccacaccucc

SEQ ID NO: 4075864 - RNA, 20 nt, Streptococcus pneumoniae R6
cuagaaccacaccuccucga

SEQ ID NO: 4075865 - RNA, 20 nt, Streptococcus pneumoniae R6
cuagaagugguuccuagaau

SEQ ID NO: 4075866 - RNA, 15 nt, Streptococcus pneumoniae R6
cuagaauagaaacaa

SEQ ID NO: 4075867 - RNA, 23 nt, Streptococcus pneumoniae R6
cuagaauaguacaccuuuacuuc

SEQ ID NO: 4075868 - RNA, 15 nt, Streptococcus pneumoniae R6
cuagaauaguacacu

SEQ ID NO: 4075869 - RNA, 15 nt, Streptococcus pneumoniae R6
cuagaauaguccacu

SEQ ID NO: 4075870 - RNA, 21 nt, Streptococcus pneumoniae R6
cuagaauaguccacugcaauu

SEQ ID NO: 4075871 - RNA, 18 nt, Streptococcus pneumoniae R6
cuagaauccuaguucaug

SEQ ID NO: 4075872 - RNA, 15 nt, Streptococcus pneumoniae R6
cuagaaugucuucca

SEQ ID NO: 4075873 - RNA, 15 nt, Streptococcus pneumoniae R6
cuagacaauuuucau

SEQ ID NO: 4075874 - RNA, 19 nt, Streptococcus pneumoniae R6
cuagacgcuuguccugaau

SEQ ID NO: 4075875 - RNA, 13 nt, Streptococcus pneumoniae R6
cuagacuaacuuc

SEQ ID NO: 4075876 - RNA, 21 nt, Streptococcus pneumoniae R6
cuagagagcuuucuaaacaau

SEQ ID NO: 4075877 - RNA, 20 nt, Streptococcus pneumoniae R6
cuagagaguuuuuuucuuaa

SEQ ID NO: 4075878 - RNA, 15 nt, Streptococcus pneumoniae R6
cuagagauuaucccc

SEQ ID NO: 4075879 - RNA, 13 nt, Streptococcus pneumoniae R6
cuagauaaaagaa

SEQ ID NO: 4075880 - RNA, 17 nt, Streptococcus pneumoniae R6
cuagauaaaagaaugcu

SEQ ID NO: 4075881 - RNA, 19 nt, Streptococcus pneumoniae R6
cuagauaaaagaaugcuca

SEQ ID NO: 4075882 - RNA, 17 nt, Streptococcus pneumoniae R6
cuagauacauuuuuucu

SEQ ID NO: 4075883 - RNA, 18 nt, Streptococcus pneumoniae R6
cuagaugauuacucaaaa

SEQ ID NO: 4075884 - RNA, 17 nt, Streptococcus pneumoniae R6
cuagauucuauuuuuua

SEQ ID NO: 4075885 - RNA, 13 nt, Streptococcus pneumoniae R6
cuagauuuggaaa

SEQ ID NO: 4075886 - RNA, 15 nt, Streptococcus pneumoniae R6
cuagcaaauuuaaua

SEQ ID NO: 4075887 - RNA, 17 nt, Streptococcus pneumoniae R6
cuagcaaauuuaauaua

SEQ ID NO: 4075888 - RNA, 13 nt, Streptococcus pneumoniae R6
cuagcaagaguuu

SEQ ID NO: 4075889 - RNA, 18 nt, Streptococcus pneumoniae R6
cuagcaagaguuuuucuc

SEQ ID NO: 4075890 - RNA, 15 nt, Streptococcus pneumoniae R6
cuagcaaugguuuag

SEQ ID NO: 4075891 - RNA, 17 nt, Streptococcus pneumoniae R6
cuagcagccacuuuuua

SEQ ID NO: 4075892 - RNA, 21 nt, Streptococcus pneumoniae R6
cuagcauaaaagccuccaauc

SEQ ID NO: 4075893 - RNA, 18 nt, Streptococcus pneumoniae R6
cuagcauccaucccauuu

SEQ ID NO: 4075894 - RNA, 15 nt, Streptococcus pneumoniae R6
cuagccaguauuuuu

SEQ ID NO: 4075895 - RNA, 17 nt, Streptococcus pneumoniae R6
cuagccaguauuuuuag

SEQ ID NO: 4075896 - RNA, 13 nt, Streptococcus pneumoniae R6
cuagcgauuucca

SEQ ID NO: 4075897 - RNA, 17 nt, Streptococcus pneumoniae R6
cuagcuagaguuucaau

SEQ ID NO: 4075898 - RNA, 20 nt, Streptococcus pneumoniae R6
cuagcuaucuccucauauuu

SEQ ID NO: 4075899 - RNA, 22 nt, Streptococcus pneumoniae R6
cuagcuguuggauauaaggauu

SEQ ID NO: 4075900 - RNA, 15 nt, Streptococcus pneumoniae R6
cuagcuuaggaaaga

SEQ ID NO: 4075901 - RNA, 15 nt, Streptococcus pneumoniae R6
cuagcuucucauuga

SEQ ID NO: 4075902 - RNA, 23 nt, Streptococcus pneumoniae R6
cuagcuuggucaguaagauacag

SEQ ID NO: 4075903 - RNA, 21 nt, Streptococcus pneumoniae R6
cuagcuuuuauaaauuuucca

SEQ ID NO: 4075904 - RNA, 19 nt, Streptococcus pneumoniae R6
cuaggaaacuagcugcagg

SEQ ID NO: 4075905 - RNA, 21 nt, Streptococcus pneumoniae R6
cuaggcaagcuugaaacaaau

SEQ ID NO: 4075906 - RNA, 19 nt, Streptococcus pneumoniae R6
cuaggcaggaaggaaauag

SEQ ID NO: 4075907 - RNA, 13 nt, Streptococcus pneumoniae R6
cuaggcggcuggu

SEQ ID NO: 4075908 - RNA, 13 nt, Streptococcus pneumoniae R6
cuaggcuaacacu

SEQ ID NO: 4075909 - RNA, 19 nt, Streptococcus pneumoniae R6
cuaggcuaucgauaucaau

SEQ ID NO: 4075910 - RNA, 15 nt, Streptococcus pneumoniae R6
cuaggcugacaauaa

SEQ ID NO: 4075911 - RNA, 21 nt, Streptococcus pneumoniae R6
cuagggugacaguaaaaaauc

SEQ ID NO: 4075912 - RNA, 22 nt, Streptococcus pneumoniae R6
cuagguaaaaauuauuuaaagc

SEQ ID NO: 4075913 - RNA, 22 nt, Streptococcus pneumoniae R6
cuaggucaaccaacuuuuccuu

SEQ ID NO: 4075914 - RNA, 18 nt, Streptococcus pneumoniae R6
cuaggucuagacuauaac

SEQ ID NO: 4075915 - RNA, 13 nt, Streptococcus pneumoniae R6
cuaguaaaagaau

SEQ ID NO: 4075916 - RNA, 20 nt, Streptococcus pneumoniae R6
cuaguaaagcuagauuuaaa

SEQ ID NO: 4075917 - RNA, 16 nt, Streptococcus pneumoniae R6
cuaguaaaucgauuuu

SEQ ID NO: 4075918 - RNA, 22 nt, Streptococcus pneumoniae R6
cuaguaagaugaguuugcuuuu

SEQ ID NO: 4075919 - RNA, 23 nt, Streptococcus pneumoniae R6
cuaguaauuuugugauaaaaugu

SEQ ID NO: 4075920 - RNA, 17 nt, Streptococcus pneumoniae R6
cuaguacaaagaauaaa

SEQ ID NO: 4075921 - RNA, 21 nt, Streptococcus pneumoniae R6
cuaguagaucaugacugagag

SEQ ID NO: 4075922 - RNA, 19 nt, Streptococcus pneumoniae R6
cuagucuggauauccuuuu

SEQ ID NO: 4075923 - RNA, 12 nt, Streptococcus pneumoniae R6
cuagucuuucuu

SEQ ID NO: 4075924 - RNA, 20 nt, Streptococcus pneumoniae R6
cuagugaaauugaacuuuuu

SEQ ID NO: 4075925 - RNA, 21 nt, Streptococcus pneumoniae R6
cuaguuggucaacuuuuguau

SEQ ID NO: 4075926 - RNA, 13 nt, Streptococcus pneumoniae R6
cuaguuugcuuuu

SEQ ID NO: 4075927 - RNA, 22 nt, Streptococcus pneumoniae R6
cuaguuuucuaaagaauuugaa

SEQ ID NO: 4075928 - RNA, 19 nt, Streptococcus pneumoniae R6
cuaguuuugguuuuucuuc

SEQ ID NO: 4075929 - RNA, 22 nt, Streptococcus pneumoniae R6
cuaguuuugguuuuucuucagc

SEQ ID NO: 4075930 - RNA, 14 nt, Streptococcus pneumoniae R6
cuaguuuuuaggau

SEQ ID NO: 4075931 - RNA, 15 nt, Streptococcus pneumoniae R6
cuaguuuuuaggauu

SEQ ID NO: 4075932 - RNA, 13 nt, Streptococcus pneumoniae R6
cuaguuuuuauaa

SEQ ID NO: 4075933 - RNA, 14 nt, Streptococcus pneumoniae R6
cuauaaaaaacucu

SEQ ID NO: 4075934 - RNA, 19 nt, Streptococcus pneumoniae R6
cuauaaaacauucuuauca

SEQ ID NO: 4075935 - RNA, 20 nt, Streptococcus pneumoniae R6
cuauaaaagaggagguaaau

SEQ ID NO: 4075936 - RNA, 20 nt, Streptococcus pneumoniae R6
cucaaaaaaguuaaaucuua

SEQ ID NO: 4075937 - RNA, 23 nt, Streptococcus pneumoniae R6
cucaaaacaauguuuugaucuga

SEQ ID NO: 4075938 - RNA, 21 nt, Streptococcus pneumoniae R6
cucaaaacacaguuuugaggu

SEQ ID NO: 4075939 - RNA, 14 nt, Streptococcus pneumoniae R6
cucaaaacacuguu

SEQ ID NO: 4075940 - RNA, 15 nt, Streptococcus pneumoniae R6
cucaaaacacuguuu

SEQ ID NO: 4075941 - RNA, 16 nt, Streptococcus pneumoniae R6
cucaaaacacuguuuu

SEQ ID NO: 4075942 - RNA, 20 nt, Streptococcus pneumoniae R6
cucaaaacacuguuuugaga

SEQ ID NO: 4075943 - RNA, 20 nt, Streptococcus pneumoniae R6
cucaaaacacuguuuugagc

SEQ ID NO: 4075944 - RNA, 23 nt, Streptococcus pneumoniae R6
cucaaaacaguguuuuaagcuga

SEQ ID NO: 4075945 - RNA, 17 nt, Streptococcus pneumoniae R6
cucaaaacaguguuuug

SEQ ID NO: 4075946 - RNA, 20 nt, Streptococcus pneumoniae R6
cucaaaacaguguuuugagc

SEQ ID NO: 4075947 - RNA, 23 nt, Streptococcus pneumoniae R6
cucaaaacaguguuuugagcuga

SEQ ID NO: 4075948 - RNA, 23 nt, Streptococcus pneumoniae R6
cucaaaacaguguuuugaucuga

SEQ ID NO: 4075949 - RNA, 21 nt, Streptococcus pneumoniae R6
cucaaaacauguuuuugaggu

SEQ ID NO: 4075950 - RNA, 20 nt, Streptococcus pneumoniae R6
cucaaaaccauguuuugagc

SEQ ID NO: 4075951 - RNA, 17 nt, Streptococcus pneumoniae R6
cucaaaacgguguuuug

SEQ ID NO: 4075952 - RNA, 23 nt, Streptococcus pneumoniae R6
cucaaaacgguguuuugagcuga

SEQ ID NO: 4075953 - RNA, 11 nt, Streptococcus pneumoniae R6
cucaaaacuag

SEQ ID NO: 4075954 - RNA, 19 nt, Streptococcus pneumoniae R6
cucaaaagcuuguuuaaaa

SEQ ID NO: 4075955 - RNA, 15 nt, Streptococcus pneumoniae R6
cucaaaaguuagaaa

SEQ ID NO: 4075956 - RNA, 19 nt, Streptococcus pneumoniae R6
cucaaaaguuagaaauaaa

SEQ ID NO: 4075957 - RNA, 22 nt, Streptococcus pneumoniae R6
cucaaaauaaccaaguucuaaa

SEQ ID NO: 4075958 - RNA, 12 nt, Streptococcus pneumoniae R6
cucaaaaucauc

SEQ ID NO: 4075959 - RNA, 19 nt, Streptococcus pneumoniae R6
cucaaacagugcuagaaau

SEQ ID NO: 4075960 - RNA, 15 nt, Streptococcus pneumoniae R6
cucaaagcacugauu

SEQ ID NO: 4075961 - RNA, 18 nt, Streptococcus pneumoniae R6
cucaaagcacugauuuga

SEQ ID NO: 4075962 - RNA, 21 nt, Streptococcus pneumoniae R6
cucaaagcacugauuugaggu

SEQ ID NO: 4075963 - RNA, 21 nt, Streptococcus pneumoniae R6
cucaaagcaguacuuugagca

SEQ ID NO: 4075964 - RNA, 13 nt, Streptococcus pneumoniae R6
cucaaagcagugc

SEQ ID NO: 4075965 - RNA, 21 nt, Streptococcus pneumoniae R6
cucaaagcagugcuuugagca

SEQ ID NO: 4075966 - RNA, 22 nt, Streptococcus pneumoniae R6
cucaaagcagugcuuugagcaa

SEQ ID NO: 4075967 - RNA, 13 nt, Streptococcus pneumoniae R6
cucaaagcugugc

SEQ ID NO: 4075968 - RNA, 21 nt, Streptococcus pneumoniae R6
cucaaagcugugcuuugagca

SEQ ID NO: 4075969 - RNA, 20 nt, Streptococcus pneumoniae R6
cucaaaguacagauuugaaa

SEQ ID NO: 4075970 - RNA, 12 nt, Streptococcus pneumoniae R6
cucaaaguacug

SEQ ID NO: 4075971 - RNA, 13 nt, Streptococcus pneumoniae R6
cucaaauaaaaga

SEQ ID NO: 4075972 - RNA, 14 nt, Streptococcus pneumoniae R6
cucaaauguaaguu

SEQ ID NO: 4075973 - RNA, 17 nt, Streptococcus pneumoniae R6
cucaacaagcuguaguc

SEQ ID NO: 4075974 - RNA, 15 nt, Streptococcus pneumoniae R6
cucaacagaagaauc

SEQ ID NO: 4075975 - RNA, 14 nt, Streptococcus pneumoniae R6
cucaaccacaaaaa

SEQ ID NO: 4075976 - RNA, 16 nt, Streptococcus pneumoniae R6
cucaacgcuagaagca

SEQ ID NO: 4075977 - RNA, 13 nt, Streptococcus pneumoniae R6
cucaacuuccuua

SEQ ID NO: 4075978 - RNA, 20 nt, Streptococcus pneumoniae R6
cucaaggcaguacuuugagc

SEQ ID NO: 4075979 - RNA, 21 nt, Streptococcus pneumoniae R6
cucaaggcaguacuuugagca

SEQ ID NO: 4075980 - RNA, 17 nt, Streptococcus pneumoniae R6
cucaaggcggugcuuug

SEQ ID NO: 4075981 - RNA, 23 nt, Streptococcus pneumoniae R6
cucaauacugaaacaacaucuuu

SEQ ID NO: 4075982 - RNA, 19 nt, Streptococcus pneumoniae R6
cucaauaggauuguacuca

SEQ ID NO: 4075983 - RNA, 16 nt, Streptococcus pneumoniae R6
cucaaucaauccaaag

SEQ ID NO: 4075984 - RNA, 16 nt, Streptococcus pneumoniae R6
cucaaucaguuuuuuc

SEQ ID NO: 4075985 - RNA, 17 nt, Streptococcus pneumoniae R6
cucaaucccauauuuuu

SEQ ID NO: 4075986 - RNA, 18 nt, Streptococcus pneumoniae R6
cucaaucccauauuuuuc

SEQ ID NO: 4075987 - RNA, 15 nt, Streptococcus pneumoniae R6
cucaauccuuuucug

SEQ ID NO: 4075988 - RNA, 16 nt, Streptococcus pneumoniae R6
cucaaucuuaucaauc

SEQ ID NO: 4075989 - RNA, 16 nt, Streptococcus pneumoniae R6
cucaaugaaaaucaaa

SEQ ID NO: 4075990 - RNA, 23 nt, Streptococcus pneumoniae R6
cucaaugaaaaucaaagagcaaa

SEQ ID NO: 4075991 - RNA, 20 nt, Streptococcus pneumoniae R6
cucaaugaauccgaaaaauu

SEQ ID NO: 4075992 - RNA, 20 nt, Streptococcus pneumoniae R6
cucaaugaguccgaaaaauu

SEQ ID NO: 4075993 - RNA, 16 nt, Streptococcus pneumoniae R6
cucaaugauuugaaca

SEQ ID NO: 4075994 - RNA, 22 nt, Streptococcus pneumoniae R6
cucaauguuuuauuacauaagu

SEQ ID NO: 4075995 - RNA, 23 nt, Streptococcus pneumoniae R6
cucaauuaagaaauuuucuuuuu

SEQ ID NO: 4075996 - RNA, 21 nt, Streptococcus pneumoniae R6
cucaauuucagaagaaaaaaa

SEQ ID NO: 4075997 - RNA, 22 nt, Streptococcus pneumoniae R6
cucacacggaaacagcuucagu

SEQ ID NO: 4075998 - RNA, 18 nt, Streptococcus pneumoniae R6
cucacaucuucagacaca

SEQ ID NO: 4075999 - RNA, 13 nt, Streptococcus pneumoniae R6
cucaccaucuucc

SEQ ID NO: 4076000 - RNA, 23 nt, Streptococcus pneumoniae R6
cucaccuguugcuggcaagauuu

SEQ ID NO: 4076001 - RNA, 12 nt, Streptococcus pneumoniae R6
cucacgguaaau

SEQ ID NO: 4076002 - RNA, 15 nt, Streptococcus pneumoniae R6
cucacgguaaaugua

SEQ ID NO: 4076003 - RNA, 18 nt, Streptococcus pneumoniae R6
cucacuaucgaaaaauau

SEQ ID NO: 4076004 - RNA, 19 nt, Streptococcus pneumoniae R6
cucacuuacauauucuaac

SEQ ID NO: 4076005 - RNA, 17 nt, Streptococcus pneumoniae R6
cucagaacccuuauuuc

SEQ ID NO: 4076006 - RNA, 21 nt, Streptococcus pneumoniae R6
cucagaacccuuauuuccugc

SEQ ID NO: 4076007 - RNA, 15 nt, Streptococcus pneumoniae R6
cucagacagcugagu

SEQ ID NO: 4076008 - RNA, 19 nt, Streptococcus pneumoniae R6
cucagauucugacaaucca

SEQ ID NO: 4076009 - RNA, 18 nt, Streptococcus pneumoniae R6
cucagcagucguuccuuu

SEQ ID NO: 4076010 - RNA, 14 nt, Streptococcus pneumoniae R6
cucagcugagcggu

SEQ ID NO: 4076011 - RNA, 20 nt, Streptococcus pneumoniae R6
cucagcugagcgguuuuagu

SEQ ID NO: 4076012 - RNA, 16 nt, Streptococcus pneumoniae R6
cucagcugaugagugg

SEQ ID NO: 4076013 - RNA, 11 nt, Streptococcus pneumoniae R6
cucaggaaaga

SEQ ID NO: 4076014 - RNA, 15 nt, Streptococcus pneumoniae R6
cucaggauaaaacca

SEQ ID NO: 4076015 - RNA, 19 nt, Streptococcus pneumoniae R6
cucagguuuuucgucuuuu

SEQ ID NO: 4076016 - RNA, 17 nt, Streptococcus pneumoniae R6
cucaguauuacauccac

SEQ ID NO: 4076017 - RNA, 13 nt, Streptococcus pneumoniae R6
cucaguauuugga

SEQ ID NO: 4076018 - RNA, 22 nt, Streptococcus pneumoniae R6
cucagucugaccaccauuuuua

SEQ ID NO: 4076019 - RNA, 16 nt, Streptococcus pneumoniae R6
cucagugggcuauucc

SEQ ID NO: 4076020 - RNA, 14 nt, Streptococcus pneumoniae R6
cucauaaaagguau

SEQ ID NO: 4076021 - RNA, 16 nt, Streptococcus pneumoniae R6
cucauagccauaaaac

SEQ ID NO: 4076022 - RNA, 20 nt, Streptococcus pneumoniae R6
cucauagccauaaaacauuu

SEQ ID NO: 4076023 - RNA, 16 nt, Streptococcus pneumoniae R6
cucauaguuuaucuca

SEQ ID NO: 4076024 - RNA, 14 nt, Streptococcus pneumoniae R6
cucauaucugucuu

SEQ ID NO: 4076025 - RNA, 23 nt, Streptococcus pneumoniae R6
cucauaucugucuuaccacaaac

SEQ ID NO: 4076026 - RNA, 15 nt, Streptococcus pneumoniae R6
cucaucacaucguca

SEQ ID NO: 4076027 - RNA, 15 nt, Streptococcus pneumoniae R6
cucaucaucugaaug

SEQ ID NO: 4076028 - RNA, 18 nt, Streptococcus pneumoniae R6
cucaucuaauguuuuuau

SEQ ID NO: 4076029 - RNA, 12 nt, Streptococcus pneumoniae R6
cucaucugcaau

SEQ ID NO: 4076030 - RNA, 11 nt, Streptococcus pneumoniae R6
cucaucugcuu

SEQ ID NO: 4076031 - RNA, 15 nt, Streptococcus pneumoniae R6
cucaucugcuuagaa

SEQ ID NO: 4076032 - RNA, 16 nt, Streptococcus pneumoniae R6
cucaucugcuuucaaa

SEQ ID NO: 4076033 - RNA, 17 nt, Streptococcus pneumoniae R6
cucaucugcuuucaaaa

SEQ ID NO: 4076034 - RNA, 16 nt, Streptococcus pneumoniae R6
cucaucuguuuucaaa

SEQ ID NO: 4076035 - RNA, 17 nt, Streptococcus pneumoniae R6
cucaucuguuuucaaaa

SEQ ID NO: 4076036 - RNA, 23 nt, Streptococcus pneumoniae R6
cucaucuguuuucaaaaagcauu

SEQ ID NO: 4076037 - RNA, 15 nt, Streptococcus pneumoniae R6
cucaucuuugauuuc

SEQ ID NO: 4076038 - RNA, 22 nt, Streptococcus pneumoniae R6
cucucuuuuuugauguucaaag

SEQ ID NO: 4076039 - RNA, 18 nt, Streptococcus pneumoniae R6
cucugaaaacaaguucuu

SEQ ID NO: 4076040 - RNA, 19 nt, Streptococcus pneumoniae R6
cucugaaaacaaguucuuu

SEQ ID NO: 4076041 - RNA, 20 nt, Streptococcus pneumoniae R6
cucugaagucacuacuucca

SEQ ID NO: 4076042 - RNA, 23 nt, Streptococcus pneumoniae R6
cucugaagucacuacuuccaucu

SEQ ID NO: 4076043 - RNA, 18 nt, Streptococcus pneumoniae R6
cucugaauggccuccuuc

SEQ ID NO: 4076044 - RNA, 16 nt, Streptococcus pneumoniae R6
cucugacgagaaauag

SEQ ID NO: 4076045 - RNA, 23 nt, Streptococcus pneumoniae R6
cucugagauacuccaaaacaucu

SEQ ID NO: 4076046 - RNA, 20 nt, Streptococcus pneumoniae R6
cucugaggaaucaaucuuca

SEQ ID NO: 4076047 - RNA, 21 nt, Streptococcus pneumoniae R6
cucugaguauuuagcaaccau

SEQ ID NO: 4076048 - RNA, 16 nt, Streptococcus pneumoniae R6
cucugcacuagcuuca

SEQ ID NO: 4076049 - RNA, 15 nt, Streptococcus pneumoniae R6
cucugccuuccuugu

SEQ ID NO: 4076050 - RNA, 17 nt, Streptococcus pneumoniae R6
cucugcugcgucugucu

SEQ ID NO: 4076051 - RNA, 13 nt, Streptococcus pneumoniae R6
cucuggcaauuua

SEQ ID NO: 4076052 - RNA, 16 nt, Streptococcus pneumoniae R6
cucuguaaaacucuua

SEQ ID NO: 4076053 - RNA, 20 nt, Streptococcus pneumoniae R6
cucuguagagaguuaaaaaa

SEQ ID NO: 4076054 - RNA, 14 nt, Streptococcus pneumoniae R6
cucugugcaauaca

SEQ ID NO: 4076055 - RNA, 14 nt, Streptococcus pneumoniae R6
cucuguuaccacag

SEQ ID NO: 4076056 - RNA, 22 nt, Streptococcus pneumoniae R6
cucuguuuucacccuugauuuc

SEQ ID NO: 4076057 - RNA, 18 nt, Streptococcus pneumoniae R6
cucuuaaugucagucugg

SEQ ID NO: 4076058 - RNA, 14 nt, Streptococcus pneumoniae R6
cucuuacaagucgu

SEQ ID NO: 4076059 - RNA, 20 nt, Streptococcus pneumoniae R6
cucuuacaagucguucggcu

SEQ ID NO: 4076060 - RNA, 20 nt, Streptococcus pneumoniae R6
cucuuagaaaaucucuucaa

SEQ ID NO: 4076061 - RNA, 14 nt, Streptococcus pneumoniae R6
cucuuagaccaagu

SEQ ID NO: 4076062 - RNA, 19 nt, Streptococcus pneumoniae R6
cucuuaucuguccucgcaa

SEQ ID NO: 4076063 - RNA, 22 nt, Streptococcus pneumoniae R6
cucuuauuguauaguagauuga

SEQ ID NO: 4076064 - RNA, 20 nt, Streptococcus pneumoniae R6
cucuucaaaaaucucuucaa

SEQ ID NO: 4076065 - RNA, 22 nt, Streptococcus pneumoniae R6
cucuucgaaaaucucuucaauc

SEQ ID NO: 4076066 - RNA, 16 nt, Streptococcus pneumoniae R6
cucuucugaaaucuua

SEQ ID NO: 4076067 - RNA, 19 nt, Streptococcus pneumoniae R6
cucuucugaugcaacaagu

SEQ ID NO: 4076068 - RNA, 22 nt, Streptococcus pneumoniae R6
cucuucugaugcaacaaguugu

SEQ ID NO: 4076069 - RNA, 21 nt, Streptococcus pneumoniae R6
cucuucugguuugugcucaau

SEQ ID NO: 4076070 - RNA, 12 nt, Streptococcus pneumoniae R6
cucuucuucugg

SEQ ID NO: 4076071 - RNA, 12 nt, Streptococcus pneumoniae R6
cucuugaacaua

SEQ ID NO: 4076072 - RNA, 20 nt, Streptococcus pneumoniae R6
cucuugaagacuuuuuaaag

SEQ ID NO: 4076073 - RNA, 15 nt, Streptococcus pneumoniae R6
cucuugaaguucauu

SEQ ID NO: 4076074 - RNA, 20 nt, Streptococcus pneumoniae R6
cucuugaaguucauuuucuu

SEQ ID NO: 4076075 - RNA, 18 nt, Streptococcus pneumoniae R6
cucuugauuuuuuuuaaa

SEQ ID NO: 4076076 - RNA, 15 nt, Streptococcus pneumoniae R6
cucuugcccuuggcu

SEQ ID NO: 4076077 - RNA, 10 nt, Streptococcus pneumoniae R6
cucuuguccu

SEQ ID NO: 4076078 - RNA, 21 nt, Streptococcus pneumoniae R6
cucuuguucugccuauuuuuu

SEQ ID NO: 4076079 - RNA, 20 nt, Streptococcus pneumoniae R6
cucuuuacaugcgcaaaaua

SEQ ID NO: 4076080 - RNA, 23 nt, Streptococcus pneumoniae R6
cucuuuacaugcgcaaaauaauu

SEQ ID NO: 4076081 - RNA, 22 nt, Streptococcus pneumoniae R6
cucuuuagucccagcuucuuuu

SEQ ID NO: 4076082 - RNA, 14 nt, Streptococcus pneumoniae R6
cucuuuauuccaug

SEQ ID NO: 4076083 - RNA, 15 nt, Streptococcus pneumoniae R6
cucuuuauugguuaa

SEQ ID NO: 4076084 - RNA, 15 nt, Streptococcus pneumoniae R6
cucuuucaguuucau

SEQ ID NO: 4076085 - RNA, 14 nt, Streptococcus pneumoniae R6
cucuuucuuucuca

SEQ ID NO: 4076086 - RNA, 15 nt, Streptococcus pneumoniae R6
cucuuucuuucucac

SEQ ID NO: 4076087 - RNA, 12 nt, Streptococcus pneumoniae R6
cucuuugauuuu

SEQ ID NO: 4076088 - RNA, 15 nt, Streptococcus pneumoniae R6
cucuuugauuuuaau

SEQ ID NO: 4076089 - RNA, 13 nt, Streptococcus pneumoniae R6
cucuuugauuuuc

SEQ ID NO: 4076090 - RNA, 21 nt, Streptococcus pneumoniae R6
cucuuugauuuucauugagua

SEQ ID NO: 4076091 - RNA, 16 nt, Streptococcus pneumoniae R6
cucuuugcauuucauc

SEQ ID NO: 4076092 - RNA, 13 nt, Streptococcus pneumoniae R6
cucuuugucaacu

SEQ ID NO: 4076093 - RNA, 21 nt, Streptococcus pneumoniae R6
cucuuuguucuuuagaaaggu

SEQ ID NO: 4076094 - RNA, 12 nt, Streptococcus pneumoniae R6
cucuuuuuacuu

SEQ ID NO: 4076095 - RNA, 14 nt, Streptococcus pneumoniae R6
cucuuuuugauuuu

SEQ ID NO: 4076096 - RNA, 19 nt, Streptococcus pneumoniae R6
cucuuuuuggaauuuuuug

SEQ ID NO: 4076097 - RNA, 14 nt, Streptococcus pneumoniae R6
cucuuuuuucucca

SEQ ID NO: 4076098 - RNA, 13 nt, Streptococcus pneumoniae R6
cugaaaaauuaac

SEQ ID NO: 4076099 - RNA, 19 nt, Streptococcus pneumoniae R6
cugaaaacaaguucuuuuc

SEQ ID NO: 4076100 - RNA, 15 nt, Streptococcus pneumoniae R6
cugaaaaucaucugc

SEQ ID NO: 4076101 - RNA, 19 nt, Streptococcus pneumoniae R6
cugaaacaacaucuuucca

SEQ ID NO: 4076102 - RNA, 16 nt, Streptococcus pneumoniae R6
cugaaacuaagcuuca

SEQ ID NO: 4076103 - RNA, 14 nt, Streptococcus pneumoniae R6
cugaaagugaaaaa

SEQ ID NO: 4076104 - RNA, 15 nt, Streptococcus pneumoniae R6
cugaaagugaaaaag

SEQ ID NO: 4076105 - RNA, 16 nt, Streptococcus pneumoniae R6
cugaaaucuuagauac

SEQ ID NO: 4076106 - RNA, 19 nt, Streptococcus pneumoniae R6
cugaacaagacgaaccaau

SEQ ID NO: 4076107 - RNA, 14 nt, Streptococcus pneumoniae R6
cugaacaaugaaaa

SEQ ID NO: 4076108 - RNA, 18 nt, Streptococcus pneumoniae R6
cugaacaaugaaaaaaac

SEQ ID NO: 4076109 - RNA, 22 nt, Streptococcus pneumoniae R6
cugaaccaagguugcagcgaga

SEQ ID NO: 4076110 - RNA, 16 nt, Streptococcus pneumoniae R6
cugaacgcuagcuacu

SEQ ID NO: 4076111 - RNA, 20 nt, Streptococcus pneumoniae R6
cugaacggugaacuucuuca

SEQ ID NO: 4076112 - RNA, 15 nt, Streptococcus pneumoniae R6
cugaacuaaaaaauc

SEQ ID NO: 4076113 - RNA, 21 nt, Streptococcus pneumoniae R6
cugaacuaaaaaaucuucuua

SEQ ID NO: 4076114 - RNA, 18 nt, Streptococcus pneumoniae R6
cugaagcauauuccacau

SEQ ID NO: 4076115 - RNA, 20 nt, Streptococcus pneumoniae R6
cugaagcuuuauugucucua

SEQ ID NO: 4076116 - RNA, 18 nt, Streptococcus pneumoniae R6
cugaaggaacuaacucau

SEQ ID NO: 4076117 - RNA, 22 nt, Streptococcus pneumoniae R6
cugaaggaaugccaaagacaaa

SEQ ID NO: 4076118 - RNA, 18 nt, Streptococcus pneumoniae R6
cugaagucgaguuuuuuc

SEQ ID NO: 4076119 - RNA, 22 nt, Streptococcus pneumoniae R6
cugaaucauaggcauaguacca

SEQ ID NO: 4076120 - RNA, 23 nt, Streptococcus pneumoniae R6
cugaaucauaggcauaguaccag

SEQ ID NO: 4076121 - RNA, 21 nt, Streptococcus pneumoniae R6
cugaaucauguaguuggaaca

SEQ ID NO: 4076122 - RNA, 20 nt, Streptococcus pneumoniae R6
cugaaucugccucaagaagu

SEQ ID NO: 4076123 - RNA, 14 nt, Streptococcus pneumoniae R6
cugaaugauuucuu

SEQ ID NO: 4076124 - RNA, 16 nt, Streptococcus pneumoniae R6
cugaauugguggguuu

SEQ ID NO: 4076125 - RNA, 15 nt, Streptococcus pneumoniae R6
cugacagcauuggag

SEQ ID NO: 4076126 - RNA, 13 nt, Streptococcus pneumoniae R6
cugacauucuuua

SEQ ID NO: 4076127 - RNA, 12 nt, Streptococcus pneumoniae R6
cugacauugaag

SEQ ID NO: 4076128 - RNA, 13 nt, Streptococcus pneumoniae R6
cugaccguccuca

SEQ ID NO: 4076129 - RNA, 13 nt, Streptococcus pneumoniae R6
cugacgaaaucag

SEQ ID NO: 4076130 - RNA, 14 nt, Streptococcus pneumoniae R6
cugacgaagucagc

SEQ ID NO: 4076131 - RNA, 18 nt, Streptococcus pneumoniae R6
cugacgaagucagcucaa

SEQ ID NO: 4076132 - RNA, 14 nt, Streptococcus pneumoniae R6
cugacgaagucagu

SEQ ID NO: 4076133 - RNA, 23 nt, Streptococcus pneumoniae R6
cugacgaagucagucacauauau

SEQ ID NO: 4076134 - RNA, 18 nt, Streptococcus pneumoniae R6
cugacgcgaucuggcagg

SEQ ID NO: 4076135 - RNA, 18 nt, Streptococcus pneumoniae R6
cugacgggcaaauuucau

SEQ ID NO: 4076136 - RNA, 23 nt, Streptococcus pneumoniae R6
cugacguaguuugaagagauuuu

SEQ ID NO: 4076137 - RNA, 23 nt, Streptococcus pneumoniae R6
cugacgugguuugcagagauuuu

SEQ ID NO: 4076138 - RNA, 17 nt, Streptococcus pneumoniae R6
cugacuaucuuguugaa

SEQ ID NO: 4076139 - RNA, 17 nt, Streptococcus pneumoniae R6
cugacuucgucaguucc

SEQ ID NO: 4076140 - RNA, 17 nt, Streptococcus pneumoniae R6
cugcucaaaacacuguu

SEQ ID NO: 4076141 - RNA, 20 nt, Streptococcus pneumoniae R6
cugcucaaaacacuguuuua

SEQ ID NO: 4076142 - RNA, 18 nt, Streptococcus pneumoniae R6
cugcucaaucuuaucaau

SEQ ID NO: 4076143 - RNA, 21 nt, Streptococcus pneumoniae R6
cugcucaaucuuaucaaucaa

SEQ ID NO: 4076144 - RNA, 23 nt, Streptococcus pneumoniae R6
cugcuccauaggcagcuuguucu

SEQ ID NO: 4076145 - RNA, 12 nt, Streptococcus pneumoniae R6
cugcuccuccgc

SEQ ID NO: 4076146 - RNA, 18 nt, Streptococcus pneumoniae R6
cugcucgccccauuucuu

SEQ ID NO: 4076147 - RNA, 13 nt, Streptococcus pneumoniae R6
cugcucucaagaa

SEQ ID NO: 4076148 - RNA, 21 nt, Streptococcus pneumoniae R6
cugcucucaagaacaguuaug

SEQ ID NO: 4076149 - RNA, 16 nt, Streptococcus pneumoniae R6
cugcugccaauugcuc

SEQ ID NO: 4076150 - RNA, 22 nt, Streptococcus pneumoniae R6
cugcugccacugggauuacaua

SEQ ID NO: 4076151 - RNA, 21 nt, Streptococcus pneumoniae R6
cugcuucagauuguccucaau

SEQ ID NO: 4076152 - RNA, 15 nt, Streptococcus pneumoniae R6
cugcuuccauuucca

SEQ ID NO: 4076153 - RNA, 16 nt, Streptococcus pneumoniae R6
cugcuuccauuuccac

SEQ ID NO: 4076154 - RNA, 15 nt, Streptococcus pneumoniae R6
cugcuucgggaacau

SEQ ID NO: 4076155 - RNA, 14 nt, Streptococcus pneumoniae R6
cugcuucuaagauc

SEQ ID NO: 4076156 - RNA, 22 nt, Streptococcus pneumoniae R6
cugcuucuguugucaaaaucaa

SEQ ID NO: 4076157 - RNA, 21 nt, Streptococcus pneumoniae R6
cugcuuuagauuguccucaau

SEQ ID NO: 4076158 - RNA, 15 nt, Streptococcus pneumoniae R6
cugcuuucaaaaagc

SEQ ID NO: 4076159 - RNA, 19 nt, Streptococcus pneumoniae R6
cugcuuugagaucuuuuuc

SEQ ID NO: 4076160 - RNA, 12 nt, Streptococcus pneumoniae R6
cugcuuuuucaa

SEQ ID NO: 4076161 - RNA, 16 nt, Streptococcus pneumoniae R6
cugcuuuuucaagcau

SEQ ID NO: 4076162 - RNA, 23 nt, Streptococcus pneumoniae R6
cugcuuuuucaagcauuuuuuug

SEQ ID NO: 4076163 - RNA, 15 nt, Streptococcus pneumoniae R6
cugcuuuuucaauca

SEQ ID NO: 4076164 - RNA, 23 nt, Streptococcus pneumoniae R6
cuggaaauagauguuaagcucca

SEQ ID NO: 4076165 - RNA, 22 nt, Streptococcus pneumoniae R6
cuggaacaaaauaguucucaac

SEQ ID NO: 4076166 - RNA, 14 nt, Streptococcus pneumoniae R6
cuggaagugaaaca

SEQ ID NO: 4076167 - RNA, 23 nt, Streptococcus pneumoniae R6
cuggaauaguacacaucuacuuc

SEQ ID NO: 4076168 - RNA, 19 nt, Streptococcus pneumoniae R6
cuggaauaguacacuucug

SEQ ID NO: 4076169 - RNA, 17 nt, Streptococcus pneumoniae R6
cuggaauccacacuucc

SEQ ID NO: 4076170 - RNA, 17 nt, Streptococcus pneumoniae R6
cuggaauggcaaccguu

SEQ ID NO: 4076171 - RNA, 20 nt, Streptococcus pneumoniae R6
cuggacguucuucaagagcu

SEQ ID NO: 4076172 - RNA, 17 nt, Streptococcus pneumoniae R6
cuggagaaggagaugau

SEQ ID NO: 4076173 - RNA, 15 nt, Streptococcus pneumoniae R6
cuggagauuuuucaa

SEQ ID NO: 4076174 - RNA, 22 nt, Streptococcus pneumoniae R6
cuggagcaggacuuggauaaga

SEQ ID NO: 4076175 - RNA, 15 nt, Streptococcus pneumoniae R6
cuggaggauagcaca

SEQ ID NO: 4076176 - RNA, 14 nt, Streptococcus pneumoniae R6
cuggauaaaguuau

SEQ ID NO: 4076177 - RNA, 20 nt, Streptococcus pneumoniae R6
cuggauaacugaaauugaga

SEQ ID NO: 4076178 - RNA, 14 nt, Streptococcus pneumoniae R6
cuggauaauuucuu

SEQ ID NO: 4076179 - RNA, 20 nt, Streptococcus pneumoniae R6
cuggauaauuucuuuaaucu

SEQ ID NO: 4076180 - RNA, 17 nt, Streptococcus pneumoniae R6
cuggauacuaugaagga

SEQ ID NO: 4076181 - RNA, 23 nt, Streptococcus pneumoniae R6
cuggauagacaucguaguuuggu

SEQ ID NO: 4076182 - RNA, 16 nt, Streptococcus pneumoniae R6
cuggauagguugcaaa

SEQ ID NO: 4076183 - RNA, 15 nt, Streptococcus pneumoniae R6
cuggauauccuuuuc

SEQ ID NO: 4076184 - RNA, 15 nt, Streptococcus pneumoniae R6
cuggaucagcuuuuu

SEQ ID NO: 4076185 - RNA, 18 nt, Streptococcus pneumoniae R6
cuggaucagcuuuuucag

SEQ ID NO: 4076186 - RNA, 19 nt, Streptococcus pneumoniae R6
cuggaucuagauaguacca

SEQ ID NO: 4076187 - RNA, 20 nt, Streptococcus pneumoniae R6
cuggaucuagauaguaccau

SEQ ID NO: 4076188 - RNA, 16 nt, Streptococcus pneumoniae R6
cuggaugauucuuuuc

SEQ ID NO: 4076189 - RNA, 22 nt, Streptococcus pneumoniae R6
cuggauguucugucuguucucu

SEQ ID NO: 4076190 - RNA, 15 nt, Streptococcus pneumoniae R6
cuggauugccaacaa

SEQ ID NO: 4076191 - RNA, 17 nt, Streptococcus pneumoniae R6
cuggauuuucaacuuga

SEQ ID NO: 4076192 - RNA, 14 nt, Streptococcus pneumoniae R6
cuggcaagauuugu

SEQ ID NO: 4076193 - RNA, 13 nt, Streptococcus pneumoniae R6
cuggcaauuuauc

SEQ ID NO: 4076194 - RNA, 22 nt, Streptococcus pneumoniae R6
cuggcacaacacguuugauaau

SEQ ID NO: 4076195 - RNA, 15 nt, Streptococcus pneumoniae R6
cuggcagaaggauuu

SEQ ID NO: 4076196 - RNA, 23 nt, Streptococcus pneumoniae R6
cuggcagauagagacauaaucaa

SEQ ID NO: 4076197 - RNA, 22 nt, Streptococcus pneumoniae R6
cuggcauaagcaaucauaccug

SEQ ID NO: 4076198 - RNA, 14 nt, Streptococcus pneumoniae R6
cuggcauccccagc

SEQ ID NO: 4076199 - RNA, 20 nt, Streptococcus pneumoniae R6
cuggcuacagaugcugcauu

SEQ ID NO: 4076200 - RNA, 12 nt, Streptococcus pneumoniae R6
cuggcuauuuuu

SEQ ID NO: 4076201 - RNA, 18 nt, Streptococcus pneumoniae R6
cuggcuugaggucccaug

SEQ ID NO: 4076202 - RNA, 15 nt, Streptococcus pneumoniae R6
cugggagaaauuccu

SEQ ID NO: 4076203 - RNA, 16 nt, Streptococcus pneumoniae R6
cugggauuacauagac

SEQ ID NO: 4076204 - RNA, 22 nt, Streptococcus pneumoniae R6
cugggauuccuuuuugcagaag

SEQ ID NO: 4076205 - RNA, 22 nt, Streptococcus pneumoniae R6
cugggauugguaccgcugaaag

SEQ ID NO: 4076206 - RNA, 21 nt, Streptococcus pneumoniae R6
cugggcaccugucuugaccaa

SEQ ID NO: 4076207 - RNA, 21 nt, Streptococcus pneumoniae R6
cugggcuaauucucuggcaga

SEQ ID NO: 4076208 - RNA, 16 nt, Streptococcus pneumoniae R6
cuggguacucuuuuuu

SEQ ID NO: 4076209 - RNA, 14 nt, Streptococcus pneumoniae R6
cugggucucagucu

SEQ ID NO: 4076210 - RNA, 17 nt, Streptococcus pneumoniae R6
cugggucucagucugac

SEQ ID NO: 4076211 - RNA, 18 nt, Streptococcus pneumoniae R6
cugggugcugaauccuca

SEQ ID NO: 4076212 - RNA, 15 nt, Streptococcus pneumoniae R6
cugguaaaagagcaa

SEQ ID NO: 4076213 - RNA, 16 nt, Streptococcus pneumoniae R6
cugguaaaagagcaag

SEQ ID NO: 4076214 - RNA, 19 nt, Streptococcus pneumoniae R6
cugguaaaagagcaagaac

SEQ ID NO: 4076215 - RNA, 14 nt, Streptococcus pneumoniae R6
cugguaagaaguaa

SEQ ID NO: 4076216 - RNA, 20 nt, Streptococcus pneumoniae R6
cugguacaguugggauucca

SEQ ID NO: 4076217 - RNA, 16 nt, Streptococcus pneumoniae R6
cugguacuauuuaaug

SEQ ID NO: 4076218 - RNA, 17 nt, Streptococcus pneumoniae R6
cugguagcaacuaucug

SEQ ID NO: 4076219 - RNA, 18 nt, Streptococcus pneumoniae R6
cugguaggcauaaacagg

SEQ ID NO: 4076220 - RNA, 14 nt, Streptococcus pneumoniae R6
cugguauauuuugu

SEQ ID NO: 4076221 - RNA, 18 nt, Streptococcus pneumoniae R6
cugguaugaucuauuccu

SEQ ID NO: 4076222 - RNA, 13 nt, Streptococcus pneumoniae R6
cugguauuuuuuc

SEQ ID NO: 4076223 - RNA, 18 nt, Streptococcus pneumoniae R6
cugguauuuuuucaaucg

SEQ ID NO: 4076224 - RNA, 16 nt, Streptococcus pneumoniae R6
cuggucacgaccagaa

SEQ ID NO: 4076225 - RNA, 23 nt, Streptococcus pneumoniae R6
cuggucacgaccagaaaaucauu

SEQ ID NO: 4076226 - RNA, 11 nt, Streptococcus pneumoniae R6
cugguccagag

SEQ ID NO: 4076227 - RNA, 15 nt, Streptococcus pneumoniae R6
cuggucgagaaggac

SEQ ID NO: 4076228 - RNA, 14 nt, Streptococcus pneumoniae R6
cuggucuuauuuca

SEQ ID NO: 4076229 - RNA, 15 nt, Streptococcus pneumoniae R6
cuggucuuauuucau

SEQ ID NO: 4076230 - RNA, 22 nt, Streptococcus pneumoniae R6
cuggugccccaguucuucagaa

SEQ ID NO: 4076231 - RNA, 20 nt, Streptococcus pneumoniae R6
cugguuaauuaauuuauuua

SEQ ID NO: 4076232 - RNA, 17 nt, Streptococcus pneumoniae R6
cuguaaagacauuauaa

SEQ ID NO: 4076233 - RNA, 23 nt, Streptococcus pneumoniae R6
cuguaacccaaaagauagaugau

SEQ ID NO: 4076234 - RNA, 14 nt, Streptococcus pneumoniae R6
cuguaagaacuuuu

SEQ ID NO: 4076235 - RNA, 20 nt, Streptococcus pneumoniae R6
cuguaagaacuuuuuaaagu

SEQ ID NO: 4076236 - RNA, 17 nt, Streptococcus pneumoniae R6
cuguaagucauuuucuu

SEQ ID NO: 4076237 - RNA, 18 nt, Streptococcus pneumoniae R6
cuguaauaguuauaaagg

SEQ ID NO: 4076238 - RNA, 21 nt, Streptococcus pneumoniae R6
cuguaauaugaacaaaaccug

SEQ ID NO: 4076239 - RNA, 23 nt, Streptococcus pneumoniae R6
cuguaauaugaacaaaaccuggu

SEQ ID NO: 4076240 - RNA, 12 nt, Streptococcus pneumoniae R6
cuguaauuucuu

SEQ ID NO: 4076241 - RNA, 18 nt, Streptococcus pneumoniae R6
cuguacauuagaauucag

SEQ ID NO: 4076242 - RNA, 18 nt, Streptococcus pneumoniae R6
cuuacaguuugcucagca

SEQ ID NO: 4076243 - RNA, 21 nt, Streptococcus pneumoniae R6
cuuacauaaaguauuauaaua

SEQ ID NO: 4076244 - RNA, 13 nt, Streptococcus pneumoniae R6
cuuacauaauaac

SEQ ID NO: 4076245 - RNA, 15 nt, Streptococcus pneumoniae R6
cuuacaucaaaaaca

SEQ ID NO: 4076246 - RNA, 21 nt, Streptococcus pneumoniae R6
cuuacauuaugcguuuuugug

SEQ ID NO: 4076247 - RNA, 19 nt, Streptococcus pneumoniae R6
cuuaccaaggcuuugaggg

SEQ ID NO: 4076248 - RNA, 11 nt, Streptococcus pneumoniae R6
cuuaccacaaa

SEQ ID NO: 4076249 - RNA, 21 nt, Streptococcus pneumoniae R6
cuuacgaaugaguucaaagcu

SEQ ID NO: 4076250 - RNA, 14 nt, Streptococcus pneumoniae R6
cuuacggucaaagu

SEQ ID NO: 4076251 - RNA, 15 nt, Streptococcus pneumoniae R6
cuuacguuccaagau

SEQ ID NO: 4076252 - RNA, 22 nt, Streptococcus pneumoniae R6
cuuacguuccaagauuggaucu

SEQ ID NO: 4076253 - RNA, 17 nt, Streptococcus pneumoniae R6
cuuacucuacagauuuc

SEQ ID NO: 4076254 - RNA, 18 nt, Streptococcus pneumoniae R6
cuuacucuacagauuuca

SEQ ID NO: 4076255 - RNA, 21 nt, Streptococcus pneumoniae R6
cuuacucuuauuauucucuau

SEQ ID NO: 4076256 - RNA, 22 nt, Streptococcus pneumoniae R6
cuuagaaccgaaaaucuccucu

SEQ ID NO: 4076257 - RNA, 23 nt, Streptococcus pneumoniae R6
cuuagaaccgaaaaucuccucua

SEQ ID NO: 4076258 - RNA, 14 nt, Streptococcus pneumoniae R6
cuuagaagcaguug

SEQ ID NO: 4076259 - RNA, 17 nt, Streptococcus pneumoniae R6
cuuagacgguuuaccaa

SEQ ID NO: 4076260 - RNA, 23 nt, Streptococcus pneumoniae R6
cuuagacgguuuaccaauuuuuc

SEQ ID NO: 4076261 - RNA, 23 nt, Streptococcus pneumoniae R6
cuuagauugcuuugcaaucaagu

SEQ ID NO: 4076262 - RNA, 17 nt, Streptococcus pneumoniae R6
cuuagcagacuucuuuu

SEQ ID NO: 4076263 - RNA, 19 nt, Streptococcus pneumoniae R6
cuuagcagacuucuuuuuu

SEQ ID NO: 4076264 - RNA, 13 nt, Streptococcus pneumoniae R6
cuuagcauggaac

SEQ ID NO: 4076265 - RNA, 14 nt, Streptococcus pneumoniae R6
cuuagcuuuucuuc

SEQ ID NO: 4076266 - RNA, 22 nt, Streptococcus pneumoniae R6
cuuagcuuuucuucaacccacu

SEQ ID NO: 4076267 - RNA, 11 nt, Streptococcus pneumoniae R6
cuuagucgcua

SEQ ID NO: 4076268 - RNA, 15 nt, Streptococcus pneumoniae R6
cuuagucgcuacagg

SEQ ID NO: 4076269 - RNA, 18 nt, Streptococcus pneumoniae R6
cuuagucggauggaaaua

SEQ ID NO: 4076270 - RNA, 12 nt, Streptococcus pneumoniae R6
cuuagucucaaa

SEQ ID NO: 4076271 - RNA, 20 nt, Streptococcus pneumoniae R6
cuuagucucaaaaucaaaga

SEQ ID NO: 4076272 - RNA, 17 nt, Streptococcus pneumoniae R6
cuuagucuuuauuuucg

SEQ ID NO: 4076273 - RNA, 13 nt, Streptococcus pneumoniae R6
cuuaguuaaaaua

SEQ ID NO: 4076274 - RNA, 15 nt, Streptococcus pneumoniae R6
cuuaguuaaaauaag

SEQ ID NO: 4076275 - RNA, 15 nt, Streptococcus pneumoniae R6
cuuauaaacuguaaa

SEQ ID NO: 4076276 - RNA, 22 nt, Streptococcus pneumoniae R6
cuuauaaauauaguaaaaugaa

SEQ ID NO: 4076277 - RNA, 14 nt, Streptococcus pneumoniae R6
cuuauaagccucuu

SEQ ID NO: 4076278 - RNA, 13 nt, Streptococcus pneumoniae R6
cuuauaauauagg

SEQ ID NO: 4076279 - RNA, 18 nt, Streptococcus pneumoniae R6
cuuauacucaaugaaaau

SEQ ID NO: 4076280 - RNA, 19 nt, Streptococcus pneumoniae R6
cuuauacucaaugaaaauc

SEQ ID NO: 4076281 - RNA, 14 nt, Streptococcus pneumoniae R6
cuuauacucuucaa

SEQ ID NO: 4076282 - RNA, 12 nt, Streptococcus pneumoniae R6
cuuauacuuuuc

SEQ ID NO: 4076283 - RNA, 17 nt, Streptococcus pneumoniae R6
cuuauacuuuucucuua

SEQ ID NO: 4076284 - RNA, 19 nt, Streptococcus pneumoniae R6
cuuauagaaacaucuuauu

SEQ ID NO: 4076285 - RNA, 19 nt, Streptococcus pneumoniae R6
cuuauagcgacuauaaaaa

SEQ ID NO: 4076286 - RNA, 23 nt, Streptococcus pneumoniae R6
cuuauauauccauucuuaaaauu

SEQ ID NO: 4076287 - RNA, 21 nt, Streptococcus pneumoniae R6
cuuauaugcuagaauguaguu

SEQ ID NO: 4076288 - RNA, 23 nt, Streptococcus pneumoniae R6
cuuaucaaaaucgauagccaacu

SEQ ID NO: 4076289 - RNA, 20 nt, Streptococcus pneumoniae R6
cuuaucaaaucccuagcuca

SEQ ID NO: 4076290 - RNA, 16 nt, Streptococcus pneumoniae R6
cuuaucagaaaauaaa

SEQ ID NO: 4076291 - RNA, 21 nt, Streptococcus pneumoniae R6
cuuaucauuauccaugauaaa

SEQ ID NO: 4076292 - RNA, 19 nt, Streptococcus pneumoniae R6
cuuauccaauucuucagca

SEQ ID NO: 4076293 - RNA, 16 nt, Streptococcus pneumoniae R6
cuuauccacaucauca

SEQ ID NO: 4076294 - RNA, 13 nt, Streptococcus pneumoniae R6
cuuauccuuguca

SEQ ID NO: 4076295 - RNA, 18 nt, Streptococcus pneumoniae R6
cuuaucuagggcauuaau

SEQ ID NO: 4076296 - RNA, 14 nt, Streptococcus pneumoniae R6
cuuaucuauagcuu

SEQ ID NO: 4076297 - RNA, 19 nt, Streptococcus pneumoniae R6
cuuaucuguccucgcaaga

SEQ ID NO: 4076298 - RNA, 21 nt, Streptococcus pneumoniae R6
cuuaucuugauauucuuauca

SEQ ID NO: 4076299 - RNA, 14 nt, Streptococcus pneumoniae R6
cuuaucuuuggcaa

SEQ ID NO: 4076300 - RNA, 20 nt, Streptococcus pneumoniae R6
cuuaugacgaaugauaauca

SEQ ID NO: 4076301 - RNA, 21 nt, Streptococcus pneumoniae R6
cuuaugcauaaucuuggucaa

SEQ ID NO: 4076302 - RNA, 18 nt, Streptococcus pneumoniae R6
cuuauuagucaagaguug

SEQ ID NO: 4076303 - RNA, 22 nt, Streptococcus pneumoniae R6
cuuauucuggaagugaaaaagc

SEQ ID NO: 4076304 - RNA, 19 nt, Streptococcus pneumoniae R6
cuuauugaugauguuuaaa

SEQ ID NO: 4076305 - RNA, 23 nt, Streptococcus pneumoniae R6
cuuauugaugauguuuaaaaucu

SEQ ID NO: 4076306 - RNA, 22 nt, Streptococcus pneumoniae R6
cuuauuguuguaauaaucaaua

SEQ ID NO: 4076307 - RNA, 14 nt, Streptococcus pneumoniae R6
cuuauuucaaaaaa

SEQ ID NO: 4076308 - RNA, 18 nt, Streptococcus pneumoniae R6
cuuauuucacauuuucaa

SEQ ID NO: 4076309 - RNA, 16 nt, Streptococcus pneumoniae R6
cuuauuucaguuuacu

SEQ ID NO: 4076310 - RNA, 16 nt, Streptococcus pneumoniae R6
cuuauuucauuucacu

SEQ ID NO: 4076311 - RNA, 23 nt, Streptococcus pneumoniae R6
cuuauuucauuuggcuauaaaaa

SEQ ID NO: 4076312 - RNA, 13 nt, Streptococcus pneumoniae R6
cuuauuucauuuu

SEQ ID NO: 4076313 - RNA, 18 nt, Streptococcus pneumoniae R6
cuuauuugaacuugaauc

SEQ ID NO: 4076314 - RNA, 20 nt, Streptococcus pneumoniae R6
cuuauuuucuacucuuucga

SEQ ID NO: 4076315 - RNA, 14 nt, Streptococcus pneumoniae R6
cuuauuuuugcaag

SEQ ID NO: 4076316 - RNA, 13 nt, Streptococcus pneumoniae R6
cuucaaaaaagug

SEQ ID NO: 4076317 - RNA, 20 nt, Streptococcus pneumoniae R6
cuucaaaccacgucagcguc

SEQ ID NO: 4076318 - RNA, 13 nt, Streptococcus pneumoniae R6
cuucaaaccaugu

SEQ ID NO: 4076319 - RNA, 21 nt, Streptococcus pneumoniae R6
cuucaaaccgcgucagcuuua

SEQ ID NO: 4076320 - RNA, 22 nt, Streptococcus pneumoniae R6
cuucaaacuacgucagcuucca

SEQ ID NO: 4076321 - RNA, 14 nt, Streptococcus pneumoniae R6
cuucaaauuuuuca

SEQ ID NO: 4076322 - RNA, 19 nt, Streptococcus pneumoniae R6
cuucaaauuuuucauaauu

SEQ ID NO: 4076323 - RNA, 22 nt, Streptococcus pneumoniae R6
cuucaacccacuacaguugaca

SEQ ID NO: 4076324 - RNA, 23 nt, Streptococcus pneumoniae R6
cuucaacccacuacaguugacaa

SEQ ID NO: 4076325 - RNA, 17 nt, Streptococcus pneumoniae R6
cuucaacggcaccuucu

SEQ ID NO: 4076326 - RNA, 21 nt, Streptococcus pneumoniae R6
cuucaacggcaccuucuacag

SEQ ID NO: 4076327 - RNA, 16 nt, Streptococcus pneumoniae R6
cuucaacucuauuuuu

SEQ ID NO: 4076328 - RNA, 21 nt, Streptococcus pneumoniae R6
cuucaacucuauuuuugagca

SEQ ID NO: 4076329 - RNA, 15 nt, Streptococcus pneumoniae R6
cuucaagaacuuuaa

SEQ ID NO: 4076330 - RNA, 21 nt, Streptococcus pneumoniae R6
cuucaagggcagacauaucca

SEQ ID NO: 4076331 - RNA, 15 nt, Streptococcus pneumoniae R6
cuucaagguuuuaua

SEQ ID NO: 4076332 - RNA, 17 nt, Streptococcus pneumoniae R6
cuucaauaauuucuuuu

SEQ ID NO: 4076333 - RNA, 17 nt, Streptococcus pneumoniae R6
cuucaauggacuauagu

SEQ ID NO: 4076334 - RNA, 23 nt, Streptococcus pneumoniae R6
cuucaauggaguaaaaaaagagu

SEQ ID NO: 4076335 - RNA, 15 nt, Streptococcus pneumoniae R6
cuucaauuucuaaug

SEQ ID NO: 4076336 - RNA, 23 nt, Streptococcus pneumoniae R6
cuucaauuuguuuugggucuguu

SEQ ID NO: 4076337 - RNA, 23 nt, Streptococcus pneumoniae R6
cuucacuaguauucaucuuauca

SEQ ID NO: 4076338 - RNA, 14 nt, Streptococcus pneumoniae R6
cuucacuauugaug

SEQ ID NO: 4076339 - RNA, 14 nt, Streptococcus pneumoniae R6
cuucagaaauuuuc

SEQ ID NO: 4076340 - RNA, 23 nt, Streptococcus pneumoniae R6
cuucagcuuuuuuggcagauuua

SEQ ID NO: 4076341 - RNA, 15 nt, Streptococcus pneumoniae R6
cuucaggagauaaaa

SEQ ID NO: 4076342 - RNA, 18 nt, Streptococcus pneumoniae R6
cuucaggauugauaaaau

SEQ ID NO: 4076343 - RNA, 15 nt, Streptococcus pneumoniae R6
cuucaggauuuuuac

SEQ ID NO: 4076344 - RNA, 22 nt, Streptococcus pneumoniae R6
cuucuguugucaaaaucaagcu

SEQ ID NO: 4076345 - RNA, 15 nt, Streptococcus pneumoniae R6
cuucuuauuagcaac

SEQ ID NO: 4076346 - RNA, 21 nt, Streptococcus pneumoniae R6
cuucuucauggaucauuucuu

SEQ ID NO: 4076347 - RNA, 14 nt, Streptococcus pneumoniae R6
cuucuucgaugacc

SEQ ID NO: 4076348 - RNA, 12 nt, Streptococcus pneumoniae R6
cuucuucuucca

SEQ ID NO: 4076349 - RNA, 17 nt, Streptococcus pneumoniae R6
cuucuugaccaacuuua

SEQ ID NO: 4076350 - RNA, 21 nt, Streptococcus pneumoniae R6
cuucuuggaauucuggauuuu

SEQ ID NO: 4076351 - RNA, 23 nt, Streptococcus pneumoniae R6
cuucuugggcuggacguucuuca

SEQ ID NO: 4076352 - RNA, 19 nt, Streptococcus pneumoniae R6
cuucuugguuuuugccaug

SEQ ID NO: 4076353 - RNA, 16 nt, Streptococcus pneumoniae R6
cuucuuuauguucauc

SEQ ID NO: 4076354 - RNA, 20 nt, Streptococcus pneumoniae R6
cuucuuuauguucaucuucu

SEQ ID NO: 4076355 - RNA, 15 nt, Streptococcus pneumoniae R6
cuucuuugauggagu

SEQ ID NO: 4076356 - RNA, 21 nt, Streptococcus pneumoniae R6
cuucuuuguuaagaauaucca

SEQ ID NO: 4076357 - RNA, 13 nt, Streptococcus pneumoniae R6
cuucuuuuacuuc

SEQ ID NO: 4076358 - RNA, 21 nt, Streptococcus pneumoniae R6
cuucuuuuuaauuauuuucaa

SEQ ID NO: 4076359 - RNA, 13 nt, Streptococcus pneumoniae R6
cuucuuuuucucc

SEQ ID NO: 4076360 - RNA, 18 nt, Streptococcus pneumoniae R6
cuucuuuuuguauuucuu

SEQ ID NO: 4076361 - RNA, 22 nt, Streptococcus pneumoniae R6
cuucuuuuuguauuucuucuuc

SEQ ID NO: 4076362 - RNA, 23 nt, Streptococcus pneumoniae R6
cuucuuuuuguauuucuucuucu

SEQ ID NO: 4076363 - RNA, 14 nt, Streptococcus pneumoniae R6
cuugaaacaaauaa

SEQ ID NO: 4076364 - RNA, 22 nt, Streptococcus pneumoniae R6
cuugaaacucaucuuggucagg

SEQ ID NO: 4076365 - RNA, 17 nt, Streptococcus pneumoniae R6
cuugaaauacuaaaaaa

SEQ ID NO: 4076366 - RNA, 22 nt, Streptococcus pneumoniae R6
cuugaaauaucuggacuuauau

SEQ ID NO: 4076367 - RNA, 12 nt, Streptococcus pneumoniae R6
cuugaagaguug

SEQ ID NO: 4076368 - RNA, 19 nt, Streptococcus pneumoniae R6
cuugaaggacuuccaauuc

SEQ ID NO: 4076369 - RNA, 16 nt, Streptococcus pneumoniae R6
cuugaaguugauucau

SEQ ID NO: 4076370 - RNA, 22 nt, Streptococcus pneumoniae R6
cuugaauagauacaaaaccaaa

SEQ ID NO: 4076371 - RNA, 13 nt, Streptococcus pneumoniae R6
cuugaaucuggcu

SEQ ID NO: 4076372 - RNA, 23 nt, Streptococcus pneumoniae R6
cuugaauuuacguccuuggaaga

SEQ ID NO: 4076373 - RNA, 14 nt, Streptococcus pneumoniae R6
cuugaauuuuguga

SEQ ID NO: 4076374 - RNA, 22 nt, Streptococcus pneumoniae R6
cuugacaaagaaaaaacaaagu

SEQ ID NO: 4076375 - RNA, 14 nt, Streptococcus pneumoniae R6
cuugacaaagagcc

SEQ ID NO: 4076376 - RNA, 15 nt, Streptococcus pneumoniae R6
cuugaccaacuuuaa

SEQ ID NO: 4076377 - RNA, 16 nt, Streptococcus pneumoniae R6
cuugaccaaguccuca

SEQ ID NO: 4076378 - RNA, 15 nt, Streptococcus pneumoniae R6
cuugaccaaucaauc

SEQ ID NO: 4076379 - RNA, 17 nt, Streptococcus pneumoniae R6
cuugaccaaucaaucgu

SEQ ID NO: 4076380 - RNA, 16 nt, Streptococcus pneumoniae R6
cuugaccacguucugc

SEQ ID NO: 4076381 - RNA, 22 nt, Streptococcus pneumoniae R6
cuugaccagcuacuguacuucc

SEQ ID NO: 4076382 - RNA, 17 nt, Streptococcus pneumoniae R6
cuugaccuaaaucacuu

SEQ ID NO: 4076383 - RNA, 15 nt, Streptococcus pneumoniae R6
cuugacuagcaaugu

SEQ ID NO: 4076384 - RNA, 13 nt, Streptococcus pneumoniae R6
cuugagaagagcu

SEQ ID NO: 4076385 - RNA, 14 nt, Streptococcus pneumoniae R6
cuugagaagagcuu

SEQ ID NO: 4076386 - RNA, 22 nt, Streptococcus pneumoniae R6
cuugagagaagcaagugacaaa

SEQ ID NO: 4076387 - RNA, 21 nt, Streptococcus pneumoniae R6
cuugagcaaacugaauccgca

SEQ ID NO: 4076388 - RNA, 17 nt, Streptococcus pneumoniae R6
cuugagcgaauccuuga

SEQ ID NO: 4076389 - RNA, 22 nt, Streptococcus pneumoniae R6
cuugagcgaauccuugauaaca

SEQ ID NO: 4076390 - RNA, 20 nt, Streptococcus pneumoniae R6
cuugagcuaggguguuuuca

SEQ ID NO: 4076391 - RNA, 14 nt, Streptococcus pneumoniae R6
cuugaggaagagcu

SEQ ID NO: 4076392 - RNA, 21 nt, Streptococcus pneumoniae R6
cuugagguuuuagauaagacu

SEQ ID NO: 4076393 - RNA, 21 nt, Streptococcus pneumoniae R6
cuugaguaaauaaaacaaaaa

SEQ ID NO: 4076394 - RNA, 18 nt, Streptococcus pneumoniae R6
cuugaguggaaaaaccuu

SEQ ID NO: 4076395 - RNA, 20 nt, Streptococcus pneumoniae R6
cuugaguggauuuuuaagaa

SEQ ID NO: 4076396 - RNA, 22 nt, Streptococcus pneumoniae R6
cuugaguugauagaaagcaagg

SEQ ID NO: 4076397 - RNA, 16 nt, Streptococcus pneumoniae R6
cuugauaacagcugcg

SEQ ID NO: 4076398 - RNA, 18 nt, Streptococcus pneumoniae R6
cuugauaaguucuuuuug

SEQ ID NO: 4076399 - RNA, 22 nt, Streptococcus pneumoniae R6
cuugauagcagaauuuaacucu

SEQ ID NO: 4076400 - RNA, 19 nt, Streptococcus pneumoniae R6
cuugauagccuuguauuca

SEQ ID NO: 4076401 - RNA, 23 nt, Streptococcus pneumoniae R6
cuugauauuaugcguuuuacuau

SEQ ID NO: 4076402 - RNA, 16 nt, Streptococcus pneumoniae R6
cuugauauucuuauca

SEQ ID NO: 4076403 - RNA, 12 nt, Streptococcus pneumoniae R6
cuugaugagugu

SEQ ID NO: 4076404 - RNA, 16 nt, Streptococcus pneumoniae R6
cuugauggacaacaau

SEQ ID NO: 4076405 - RNA, 21 nt, Streptococcus pneumoniae R6
cuugaugucuuggauuuuuga

SEQ ID NO: 4076406 - RNA, 22 nt, Streptococcus pneumoniae R6
cuugaugugacuguuucagaga

SEQ ID NO: 4076407 - RNA, 15 nt, Streptococcus pneumoniae R6
cuugauugcaaagca

SEQ ID NO: 4076408 - RNA, 21 nt, Streptococcus pneumoniae R6
cuugauuuagaaccaagaucu

SEQ ID NO: 4076409 - RNA, 13 nt, Streptococcus pneumoniae R6
cuugauuuaucca

SEQ ID NO: 4076410 - RNA, 14 nt, Streptococcus pneumoniae R6
cuugauuucguuua

SEQ ID NO: 4076411 - RNA, 20 nt, Streptococcus pneumoniae R6
cuugauuuguucucuuugca

SEQ ID NO: 4076412 - RNA, 14 nt, Streptococcus pneumoniae R6
cuugauuuuuuccu

SEQ ID NO: 4076413 - RNA, 15 nt, Streptococcus pneumoniae R6
cuugauuuuuuccua

SEQ ID NO: 4076414 - RNA, 13 nt, Streptococcus pneumoniae R6
cuugcaaaaaaac

SEQ ID NO: 4076415 - RNA, 15 nt, Streptococcus pneumoniae R6
cuugcaaaaaaacuu

SEQ ID NO: 4076416 - RNA, 9 nt, Streptococcus pneumoniae R6
cuugcaauc

SEQ ID NO: 4076417 - RNA, 21 nt, Streptococcus pneumoniae R6
cuugcaaugagccaaggaagu

SEQ ID NO: 4076418 - RNA, 15 nt, Streptococcus pneumoniae R6
cuugcaggaaauuuu

SEQ ID NO: 4076419 - RNA, 16 nt, Streptococcus pneumoniae R6
cuugcauagacuucaa

SEQ ID NO: 4076420 - RNA, 21 nt, Streptococcus pneumoniae R6
cuugcauagacuucaacagca

SEQ ID NO: 4076421 - RNA, 21 nt, Streptococcus pneumoniae R6
cuugcaucaaaucacguacaa

SEQ ID NO: 4076422 - RNA, 21 nt, Streptococcus pneumoniae R6
cuugcauuugggcaaucgcca

SEQ ID NO: 4076423 - RNA, 19 nt, Streptococcus pneumoniae R6
cuugcauuuuaauuucaau

SEQ ID NO: 4076424 - RNA, 21 nt, Streptococcus pneumoniae R6
cuugcauuuuaauuucaaugu

SEQ ID NO: 4076425 - RNA, 12 nt, Streptococcus pneumoniae R6
cuugcauuuuuu

SEQ ID NO: 4076426 - RNA, 18 nt, Streptococcus pneumoniae R6
cuugccaacccucucuuc

SEQ ID NO: 4076427 - RNA, 13 nt, Streptococcus pneumoniae R6
cuugcccauacga

SEQ ID NO: 4076428 - RNA, 10 nt, Streptococcus pneumoniae R6
cuugcccuuc

SEQ ID NO: 4076429 - RNA, 16 nt, Streptococcus pneumoniae R6
cuugccgauugauuua

SEQ ID NO: 4076430 - RNA, 22 nt, Streptococcus pneumoniae R6
cuugccugcuuuuucaagcauu

SEQ ID NO: 4076431 - RNA, 14 nt, Streptococcus pneumoniae R6
cuugccuucaacac

SEQ ID NO: 4076432 - RNA, 19 nt, Streptococcus pneumoniae R6
cuugcuaaaaaaagggauu

SEQ ID NO: 4076433 - RNA, 19 nt, Streptococcus pneumoniae R6
cuugcuagucauaacugcu

SEQ ID NO: 4076434 - RNA, 16 nt, Streptococcus pneumoniae R6
cuugcuaucgucaggc

SEQ ID NO: 4076435 - RNA, 15 nt, Streptococcus pneumoniae R6
cuugcuccaaaggag

SEQ ID NO: 4076436 - RNA, 13 nt, Streptococcus pneumoniae R6
cuugcucuucauu

SEQ ID NO: 4076437 - RNA, 20 nt, Streptococcus pneumoniae R6
cuugcuguuuucuuggucau

SEQ ID NO: 4076438 - RNA, 21 nt, Streptococcus pneumoniae R6
cuugcuuagucggauggaaau

SEQ ID NO: 4076439 - RNA, 18 nt, Streptococcus pneumoniae R6
cuugcuuuuucuuuuuag

SEQ ID NO: 4076440 - RNA, 17 nt, Streptococcus pneumoniae R6
cuuggaaguuuuccuuu

SEQ ID NO: 4076441 - RNA, 20 nt, Streptococcus pneumoniae R6
cuuggaauucuggauuuuuc

SEQ ID NO: 4076442 - RNA, 19 nt, Streptococcus pneumoniae R6
cuuggaccaggaucuuauc

SEQ ID NO: 4076443 - RNA, 20 nt, Streptococcus pneumoniae R6
cuuggaccaggaucuuaucu

SEQ ID NO: 4076444 - RNA, 19 nt, Streptococcus pneumoniae R6
cuuggacuuggccaauucu

SEQ ID NO: 4076445 - RNA, 15 nt, Streptococcus pneumoniae R6
cuuggauuauauaug

SEQ ID NO: 4076446 - RNA, 22 nt, Streptococcus pneumoniae R6
cuuucucgagguuaacuccuuu

SEQ ID NO: 4076447 - RNA, 13 nt, Streptococcus pneumoniae R6
cuuucugauggau

SEQ ID NO: 4076448 - RNA, 17 nt, Streptococcus pneumoniae R6
cuuucugcauccaccuu

SEQ ID NO: 4076449 - RNA, 16 nt, Streptococcus pneumoniae R6
cuuucuucgaaauucc

SEQ ID NO: 4076450 - RNA, 22 nt, Streptococcus pneumoniae R6
cuuucuuuuuugauguucagag

SEQ ID NO: 4076451 - RNA, 14 nt, Streptococcus pneumoniae R6
cuuugaaauuuauc

SEQ ID NO: 4076452 - RNA, 21 nt, Streptococcus pneumoniae R6
cuuugacaagguuuccugcau

SEQ ID NO: 4076453 - RNA, 18 nt, Streptococcus pneumoniae R6
cuuugacaccgauaauau

SEQ ID NO: 4076454 - RNA, 21 nt, Streptococcus pneumoniae R6
cuuugacagcgccuguugcuu

SEQ ID NO: 4076455 - RNA, 16 nt, Streptococcus pneumoniae R6
cuuugacauccuuuuc

SEQ ID NO: 4076456 - RNA, 17 nt, Streptococcus pneumoniae R6
cuuugacauccuuuucu

SEQ ID NO: 4076457 - RNA, 23 nt, Streptococcus pneumoniae R6
cuuugagcaaccuacggcuagcu

SEQ ID NO: 4076458 - RNA, 17 nt, Streptococcus pneumoniae R6
cuuugagccuagugucu

SEQ ID NO: 4076459 - RNA, 18 nt, Streptococcus pneumoniae R6
cuuugaggaagguuuuaa

SEQ ID NO: 4076460 - RNA, 21 nt, Streptococcus pneumoniae R6
cuuugagggcugcaaaauuuu

SEQ ID NO: 4076461 - RNA, 17 nt, Streptococcus pneumoniae R6
cuuugagguuguagaua

SEQ ID NO: 4076462 - RNA, 19 nt, Streptococcus pneumoniae R6
cuuugagguuguagauaga

SEQ ID NO: 4076463 - RNA, 15 nt, Streptococcus pneumoniae R6
cuuugauacaaagcu

SEQ ID NO: 4076464 - RNA, 17 nt, Streptococcus pneumoniae R6
cuuugauggaguuuuca

SEQ ID NO: 4076465 - RNA, 13 nt, Streptococcus pneumoniae R6
cuuugauucagau

SEQ ID NO: 4076466 - RNA, 16 nt, Streptococcus pneumoniae R6
cuuugauuuucauuga

SEQ ID NO: 4076467 - RNA, 22 nt, Streptococcus pneumoniae R6
cuuugauuuucauugagcuuua

SEQ ID NO: 4076468 - RNA, 15 nt, Streptococcus pneumoniae R6
cuuugcauccacauc

SEQ ID NO: 4076469 - RNA, 20 nt, Streptococcus pneumoniae R6
cuuugccaccuagcuucuca

SEQ ID NO: 4076470 - RNA, 21 nt, Streptococcus pneumoniae R6
cuuugcccccaucuccuuggc

SEQ ID NO: 4076471 - RNA, 18 nt, Streptococcus pneumoniae R6
cuuugcugacuugccuuc

SEQ ID NO: 4076472 - RNA, 20 nt, Streptococcus pneumoniae R6
cuuugcugcuuuccuucaua

SEQ ID NO: 4076473 - RNA, 13 nt, Streptococcus pneumoniae R6
cuuugcuuuccuc

SEQ ID NO: 4076474 - RNA, 23 nt, Streptococcus pneumoniae R6
cuuuggaggcaauacguuuucaa

SEQ ID NO: 4076475 - RNA, 22 nt, Streptococcus pneumoniae R6
cuuuggaggcaauggccuguuc

SEQ ID NO: 4076476 - RNA, 19 nt, Streptococcus pneumoniae R6
cuuugggacgauuuucaaa

SEQ ID NO: 4076477 - RNA, 14 nt, Streptococcus pneumoniae R6
cuuugguuauaaaa

SEQ ID NO: 4076478 - RNA, 13 nt, Streptococcus pneumoniae R6
cuuugucaacugu

SEQ ID NO: 4076479 - RNA, 13 nt, Streptococcus pneumoniae R6
cuuuguggucuug

SEQ ID NO: 4076480 - RNA, 13 nt, Streptococcus pneumoniae R6
cuuuguucacuuu

SEQ ID NO: 4076481 - RNA, 13 nt, Streptococcus pneumoniae R6
cuuuguuccacuc

SEQ ID NO: 4076482 - RNA, 10 nt, Streptococcus pneumoniae R6
cuuuuaaaau

SEQ ID NO: 4076483 - RNA, 17 nt, Streptococcus pneumoniae R6
cuuuuaaauaguuuaaa

SEQ ID NO: 4076484 - RNA, 20 nt, Streptococcus pneumoniae R6
cuuuuaaccagacauagaga

SEQ ID NO: 4076485 - RNA, 18 nt, Streptococcus pneumoniae R6
cuuuuaagaaaucauaca

SEQ ID NO: 4076486 - RNA, 21 nt, Streptococcus pneumoniae R6
cuuuuaaucgauuauuuuuuc

SEQ ID NO: 4076487 - RNA, 21 nt, Streptococcus pneumoniae R6
cuuuuacaauguugucaauuu

SEQ ID NO: 4076488 - RNA, 16 nt, Streptococcus pneumoniae R6
cuuuuacacucaauuu

SEQ ID NO: 4076489 - RNA, 12 nt, Streptococcus pneumoniae R6
cuuuuacuucug

SEQ ID NO: 4076490 - RNA, 17 nt, Streptococcus pneumoniae R6
cuuuuauaaauuuucca

SEQ ID NO: 4076491 - RNA, 20 nt, Streptococcus pneumoniae R6
cuuuuauaauagaaagauuu

SEQ ID NO: 4076492 - RNA, 15 nt, Streptococcus pneumoniae R6
cuuuuauccuguucu

SEQ ID NO: 4076493 - RNA, 23 nt, Streptococcus pneumoniae R6
cuuuuaucuagucguuuaaggaa

SEQ ID NO: 4076494 - RNA, 15 nt, Streptococcus pneumoniae R6
cuuuuauuuuuauaa

SEQ ID NO: 4076495 - RNA, 16 nt, Streptococcus pneumoniae R6
cuuuucaaaauaaguc

SEQ ID NO: 4076496 - RNA, 14 nt, Streptococcus pneumoniae R6
cuuuucaagaacug

SEQ ID NO: 4076497 - RNA, 22 nt, Streptococcus pneumoniae R6
cuuuucaauacggucaaucaac

SEQ ID NO: 4076498 - RNA, 12 nt, Streptococcus pneumoniae R6
cuuuucacuuua

SEQ ID NO: 4076499 - RNA, 22 nt, Streptococcus pneumoniae R6
cuuuucaucuaguugaacuuua

SEQ ID NO: 4076500 - RNA, 19 nt, Streptococcus pneumoniae R6
cuuuucauuauaggucaua

SEQ ID NO: 4076501 - RNA, 12 nt, Streptococcus pneumoniae R6
cuuuucauucca

SEQ ID NO: 4076502 - RNA, 13 nt, Streptococcus pneumoniae R6
cuuuuccaaacau

SEQ ID NO: 4076503 - RNA, 17 nt, Streptococcus pneumoniae R6
cuuuuccaagucuagca

SEQ ID NO: 4076504 - RNA, 20 nt, Streptococcus pneumoniae R6
cuuuuccaauagauaauuua

SEQ ID NO: 4076505 - RNA, 19 nt, Streptococcus pneumoniae R6
cuuuuccaguaauuuccca

SEQ ID NO: 4076506 - RNA, 15 nt, Streptococcus pneumoniae R6
cuuuuccauuguuuu

SEQ ID NO: 4076507 - RNA, 19 nt, Streptococcus pneumoniae R6
cuuuuccuuaacaaucuua

SEQ ID NO: 4076508 - RNA, 21 nt, Streptococcus pneumoniae R6
cuuuucgaaacucuuuuuaaa

SEQ ID NO: 4076509 - RNA, 20 nt, Streptococcus pneumoniae R6
cuuuucuaagaugauuuuuc

SEQ ID NO: 4076510 - RNA, 14 nt, Streptococcus pneumoniae R6
cuuuucuacugaaa

SEQ ID NO: 4076511 - RNA, 18 nt, Streptococcus pneumoniae R6
cuuuucuauaggauuuau

SEQ ID NO: 4076512 - RNA, 16 nt, Streptococcus pneumoniae R6
cuuuucuaucacucca

SEQ ID NO: 4076513 - RNA, 17 nt, Streptococcus pneumoniae R6
cuuuucucuagcuuuua

SEQ ID NO: 4076514 - RNA, 20 nt, Streptococcus pneumoniae R6
cuuuucucuagcuuuuauaa

SEQ ID NO: 4076515 - RNA, 17 nt, Streptococcus pneumoniae R6
cuuuucugacgggagaa

SEQ ID NO: 4076516 - RNA, 14 nt, Streptococcus pneumoniae R6
cuuuucugaggauu

SEQ ID NO: 4076517 - RNA, 11 nt, Streptococcus pneumoniae R6
cuuuucugcua

SEQ ID NO: 4076518 - RNA, 19 nt, Streptococcus pneumoniae R6
cuuuucuguugauauuucc

SEQ ID NO: 4076519 - RNA, 15 nt, Streptococcus pneumoniae R6
cuuuucuuauaguuu

SEQ ID NO: 4076520 - RNA, 18 nt, Streptococcus pneumoniae R6
cuuuucuucaacauucuc

SEQ ID NO: 4076521 - RNA, 22 nt, Streptococcus pneumoniae R6
cuuuucuugaggcacuuuuguc

SEQ ID NO: 4076522 - RNA, 16 nt, Streptococcus pneumoniae R6
cuuuugaaaaaaaugu

SEQ ID NO: 4076523 - RNA, 19 nt, Streptococcus pneumoniae R6
cuuuugaaugcucccuucu

SEQ ID NO: 4076524 - RNA, 16 nt, Streptococcus pneumoniae R6
cuuuugacuugcaaaa

SEQ ID NO: 4076525 - RNA, 21 nt, Streptococcus pneumoniae R6
cuuuugauagaugacuucuua

SEQ ID NO: 4076526 - RNA, 22 nt, Streptococcus pneumoniae R6
cuuuugauagaugacuucuuaa

SEQ ID NO: 4076527 - RNA, 21 nt, Streptococcus pneumoniae R6
cuuuugauggguucuuugcca

SEQ ID NO: 4076528 - RNA, 11 nt, Streptococcus pneumoniae R6
cuuuugauuug

SEQ ID NO: 4076529 - RNA, 17 nt, Streptococcus pneumoniae R6
cuuuugcaaucauuuca

SEQ ID NO: 4076530 - RNA, 19 nt, Streptococcus pneumoniae R6
cuuuugcacgacccugcgc

SEQ ID NO: 4076531 - RNA, 12 nt, Streptococcus pneumoniae R6
cuuuugcagcac

SEQ ID NO: 4076532 - RNA, 13 nt, Streptococcus pneumoniae R6
cuuuugcagcacc

SEQ ID NO: 4076533 - RNA, 20 nt, Streptococcus pneumoniae R6
cuuuuggggggcaguucaga

SEQ ID NO: 4076534 - RNA, 22 nt, Streptococcus pneumoniae R6
cuuuuguaaaggguucuacaaa

SEQ ID NO: 4076535 - RNA, 23 nt, Streptococcus pneumoniae R6
cuuuuguacaaagggaugauguu

SEQ ID NO: 4076536 - RNA, 19 nt, Streptococcus pneumoniae R6
cuuuuguauuccacuugug

SEQ ID NO: 4076537 - RNA, 14 nt, Streptococcus pneumoniae R6
cuuuugucuugcuu

SEQ ID NO: 4076538 - RNA, 20 nt, Streptococcus pneumoniae R6
cuuuugucuuguucuuguuu

SEQ ID NO: 4076539 - RNA, 16 nt, Streptococcus pneumoniae R6
cuuuugugauuuuaaa

SEQ ID NO: 4076540 - RNA, 18 nt, Streptococcus pneumoniae R6
cuuuugugccaauucuua

SEQ ID NO: 4076541 - RNA, 20 nt, Streptococcus pneumoniae R6
cuuuugugccaauucuuauc

SEQ ID NO: 4076542 - RNA, 10 nt, Streptococcus pneumoniae R6
cuuuuuaaaa

SEQ ID NO: 4076543 - RNA, 19 nt, Streptococcus pneumoniae R6
cuuuuuaaaaaaucuuuuu

SEQ ID NO: 4076544 - RNA, 11 nt, Streptococcus pneumoniae R6
cuuuuuaaacc

SEQ ID NO: 4076545 - RNA, 20 nt, Streptococcus pneumoniae R6
cuuuuuaaauccgauaauau

SEQ ID NO: 4076546 - RNA, 12 nt, Streptococcus pneumoniae R6
cuuuuuaaguuu

SEQ ID NO: 4076547 - RNA, 18 nt, Streptococcus pneumoniae R6
cuuuuuacaauuguaaaa

SEQ ID NO: 4076548 - RNA, 19 nt, Streptococcus pneumoniae R6
cuuuuuacaauuguaaaaa

SEQ ID NO: 4076549 - RNA, 14 nt, Streptococcus pneumoniae R6
gaaacgaagaagga

SEQ ID NO: 4076550 - RNA, 17 nt, Streptococcus pneumoniae R6
gaaacgacggucaugcg

SEQ ID NO: 4076551 - RNA, 19 nt, Streptococcus pneumoniae R6
gaaacgacggucaugcgaa

SEQ ID NO: 4076552 - RNA, 12 nt, Streptococcus pneumoniae R6
gaaacggcagcu

SEQ ID NO: 4076553 - RNA, 12 nt, Streptococcus pneumoniae R6
gaaacguccaag

SEQ ID NO: 4076554 - RNA, 20 nt, Streptococcus pneumoniae R6
gaaacuagaauaauacacuu

SEQ ID NO: 4076555 - RNA, 14 nt, Streptococcus pneumoniae R6
gaaacuagcugcag

SEQ ID NO: 4076556 - RNA, 22 nt, Streptococcus pneumoniae R6
gaaacuaugaugugcuauucua

SEQ ID NO: 4076557 - RNA, 20 nt, Streptococcus pneumoniae R6
gaaacuccauaaaaucacau

SEQ ID NO: 4076558 - RNA, 22 nt, Streptococcus pneumoniae R6
gaaacuccuuggcuacuugcuu

SEQ ID NO: 4076559 - RNA, 14 nt, Streptococcus pneumoniae R6
gaaacucuaaacaa

SEQ ID NO: 4076560 - RNA, 19 nt, Streptococcus pneumoniae R6
gaaacucuagcuagcugua

SEQ ID NO: 4076561 - RNA, 11 nt, Streptococcus pneumoniae R6
gaaagaaaaac

SEQ ID NO: 4076562 - RNA, 13 nt, Streptococcus pneumoniae R6
gaaagaaaaacug

SEQ ID NO: 4076563 - RNA, 20 nt, Streptococcus pneumoniae R6
gaaagaaaaacugcuuagaa

SEQ ID NO: 4076564 - RNA, 15 nt, Streptococcus pneumoniae R6
gaaagaaguuuaaga

SEQ ID NO: 4076565 - RNA, 17 nt, Streptococcus pneumoniae R6
gaaagaccaguucauca

SEQ ID NO: 4076566 - RNA, 20 nt, Streptococcus pneumoniae R6
gaaagaccuguauucauuga

SEQ ID NO: 4076567 - RNA, 20 nt, Streptococcus pneumoniae R6
gaaagaggaguaggaguagu

SEQ ID NO: 4076568 - RNA, 13 nt, Streptococcus pneumoniae R6
gaaagauauuuug

SEQ ID NO: 4076569 - RNA, 13 nt, Streptococcus pneumoniae R6
gaaagauuauagg

SEQ ID NO: 4076570 - RNA, 19 nt, Streptococcus pneumoniae R6
gaaagauuugcuggauagu

SEQ ID NO: 4076571 - RNA, 16 nt, Streptococcus pneumoniae R6
gaaagcagcuuaucuc

SEQ ID NO: 4076572 - RNA, 19 nt, Streptococcus pneumoniae R6
gaaagcagcuuaucucgua

SEQ ID NO: 4076573 - RNA, 13 nt, Streptococcus pneumoniae R6
gaaagcauagaga

SEQ ID NO: 4076574 - RNA, 22 nt, Streptococcus pneumoniae R6
gaaagcauagagaaaaacagcu

SEQ ID NO: 4076575 - RNA, 15 nt, Streptococcus pneumoniae R6
gaaagcauaggggcu

SEQ ID NO: 4076576 - RNA, 18 nt, Streptococcus pneumoniae R6
gaaagcgaagaucuagaa

SEQ ID NO: 4076577 - RNA, 12 nt, Streptococcus pneumoniae R6
gaaaggaagaga

SEQ ID NO: 4076578 - RNA, 14 nt, Streptococcus pneumoniae R6
gaaaggagaaaaau

SEQ ID NO: 4076579 - RNA, 17 nt, Streptococcus pneumoniae R6
gaaaggauaugaggaga

SEQ ID NO: 4076580 - RNA, 23 nt, Streptococcus pneumoniae R6
gaaaggcuuuauucuuaaaucca

SEQ ID NO: 4076581 - RNA, 14 nt, Streptococcus pneumoniae R6
gaaagguaacuccu

SEQ ID NO: 4076582 - RNA, 17 nt, Streptococcus pneumoniae R6
gaaagguuuuaaagaca

SEQ ID NO: 4076583 - RNA, 18 nt, Streptococcus pneumoniae R6
gaaaguaagaaucugcau

SEQ ID NO: 4076584 - RNA, 15 nt, Streptococcus pneumoniae R6
gaaaguagaguccaa

SEQ ID NO: 4076585 - RNA, 19 nt, Streptococcus pneumoniae R6
gaaaguagaguccaaagac

SEQ ID NO: 4076586 - RNA, 18 nt, Streptococcus pneumoniae R6
gaaagucauauuucuuca

SEQ ID NO: 4076587 - RNA, 21 nt, Streptococcus pneumoniae R6
gaaaguccucauuucaauaga

SEQ ID NO: 4076588 - RNA, 16 nt, Streptococcus pneumoniae R6
gaaagucgugauuucu

SEQ ID NO: 4076589 - RNA, 19 nt, Streptococcus pneumoniae R6
gaaagucuaauguaauucu

SEQ ID NO: 4076590 - RNA, 22 nt, Streptococcus pneumoniae R6
gaaagugggcugauuuugaaaa

SEQ ID NO: 4076591 - RNA, 16 nt, Streptococcus pneumoniae R6
gaaauaaaauuugaac

SEQ ID NO: 4076592 - RNA, 16 nt, Streptococcus pneumoniae R6
gaaauaagauaugaac

SEQ ID NO: 4076593 - RNA, 22 nt, Streptococcus pneumoniae R6
gaaauaagaugcgaacaaauca

SEQ ID NO: 4076594 - RNA, 13 nt, Streptococcus pneumoniae R6
gaaauaagucagc

SEQ ID NO: 4076595 - RNA, 23 nt, Streptococcus pneumoniae R6
gaaauaaucaaaauauguuuucu

SEQ ID NO: 4076596 - RNA, 13 nt, Streptococcus pneumoniae R6
gaaauagaaaaca

SEQ ID NO: 4076597 - RNA, 14 nt, Streptococcus pneumoniae R6
gaaauagaauauga

SEQ ID NO: 4076598 - RNA, 22 nt, Streptococcus pneumoniae R6
gaaauagcagagacauuagaaa

SEQ ID NO: 4076599 - RNA, 19 nt, Streptococcus pneumoniae R6
gaaauagcauccaccacuu

SEQ ID NO: 4076600 - RNA, 17 nt, Streptococcus pneumoniae R6
gaaauaguacgaaacaa

SEQ ID NO: 4076601 - RNA, 18 nt, Streptococcus pneumoniae R6
gaaauauagaguauuucu

SEQ ID NO: 4076602 - RNA, 19 nt, Streptococcus pneumoniae R6
gaaauauaggccaagauau

SEQ ID NO: 4076603 - RNA, 21 nt, Streptococcus pneumoniae R6
gaaauauaggccaagauauug

SEQ ID NO: 4076604 - RNA, 20 nt, Streptococcus pneumoniae R6
gaaauaucgcguucgugcca

SEQ ID NO: 4076605 - RNA, 16 nt, Streptococcus pneumoniae R6
gaaauauuuuaguauu

SEQ ID NO: 4076606 - RNA, 22 nt, Streptococcus pneumoniae R6
gaaauauuuuuuacuuuugcac

SEQ ID NO: 4076607 - RNA, 24 nt, Streptococcus pneumoniae R6
gaaaucauacugccaagauagaga

SEQ ID NO: 4076608 - RNA, 14 nt, Streptococcus pneumoniae R6
gaaaucauuggaua

SEQ ID NO: 4076609 - RNA, 22 nt, Streptococcus pneumoniae R6
gaaaucauuugaaucaaaaauu

SEQ ID NO: 4076610 - RNA, 16 nt, Streptococcus pneumoniae R6
gaaaucccauaguagu

SEQ ID NO: 4076611 - RNA, 20 nt, Streptococcus pneumoniae R6
gaaauccucuacaugagcca

SEQ ID NO: 4076612 - RNA, 16 nt, Streptococcus pneumoniae R6
gaaaucguuucuaaua

SEQ ID NO: 4076613 - RNA, 17 nt, Streptococcus pneumoniae R6
gaaaucucuuuuuucuc

SEQ ID NO: 4076614 - RNA, 20 nt, Streptococcus pneumoniae R6
gaaaucucuuuuuucuccaa

SEQ ID NO: 4076615 - RNA, 18 nt, Streptococcus pneumoniae R6
gaaaugagguaauuauga

SEQ ID NO: 4076616 - RNA, 19 nt, Streptococcus pneumoniae R6
gaaaugauccaagcuucua

SEQ ID NO: 4076617 - RNA, 23 nt, Streptococcus pneumoniae R6
gaaauggucggcauucuucucuu

SEQ ID NO: 4076618 - RNA, 20 nt, Streptococcus pneumoniae R6
gaaauuaaauaugaacaaau

SEQ ID NO: 4076619 - RNA, 13 nt, Streptococcus pneumoniae R6
gaaauuauuucac

SEQ ID NO: 4076620 - RNA, 20 nt, Streptococcus pneumoniae R6
gaaauucaagaaugacacgu

SEQ ID NO: 4076621 - RNA, 17 nt, Streptococcus pneumoniae R6
gaaauuccuuaaacucu

SEQ ID NO: 4076622 - RNA, 23 nt, Streptococcus pneumoniae R6
gaaauucgcuuuuuuaaaugcug

SEQ ID NO: 4076623 - RNA, 16 nt, Streptococcus pneumoniae R6
gaaauucuaauuaaau

SEQ ID NO: 4076624 - RNA, 20 nt, Streptococcus pneumoniae R6
gaaauugaacuuuuucuaac

SEQ ID NO: 4076625 - RNA, 20 nt, Streptococcus pneumoniae R6
gaaauugguuugaauucucc

SEQ ID NO: 4076626 - RNA, 14 nt, Streptococcus pneumoniae R6
gaaauuuaaaaaga

SEQ ID NO: 4076627 - RNA, 22 nt, Streptococcus pneumoniae R6
gaaauuuaucaaccacuuaaca

SEQ ID NO: 4076628 - RNA, 12 nt, Streptococcus pneumoniae R6
gaaauuucaaca

SEQ ID NO: 4076629 - RNA, 17 nt, Streptococcus pneumoniae R6
gaaauuucugaaacuaa

SEQ ID NO: 4076630 - RNA, 22 nt, Streptococcus pneumoniae R6
gaaauuuuagaacuguaaauuu

SEQ ID NO: 4076631 - RNA, 22 nt, Streptococcus pneumoniae R6
gaaauuuugaaauaaucucuga

SEQ ID NO: 4076632 - RNA, 21 nt, Streptococcus pneumoniae R6
gaaauuuuuacuuuauuuucu

SEQ ID NO: 4076633 - RNA, 17 nt, Streptococcus pneumoniae R6
gaaauuuuucugcuucu

SEQ ID NO: 4076634 - RNA, 14 nt, Streptococcus pneumoniae R6
gaacaaauaauaug

SEQ ID NO: 4076635 - RNA, 16 nt, Streptococcus pneumoniae R6
gaacaaaucaauuaga

SEQ ID NO: 4076636 - RNA, 21 nt, Streptococcus pneumoniae R6
gaacaaaucaauuagaaaauu

SEQ ID NO: 4076637 - RNA, 12 nt, Streptococcus pneumoniae R6
gaacaaauguug

SEQ ID NO: 4076638 - RNA, 18 nt, Streptococcus pneumoniae R6
gaacaagccuagucuucu

SEQ ID NO: 4076639 - RNA, 24 nt, Streptococcus pneumoniae R6
gaacaaguugugcaguguaugaca

SEQ ID NO: 4076640 - RNA, 23 nt, Streptococcus pneumoniae R6
gaacaauaaaacgcauaauauca

SEQ ID NO: 4076641 - RNA, 23 nt, Streptococcus pneumoniae R6
gaacaaugacucccauaaaaaua

SEQ ID NO: 4076642 - RNA, 15 nt, Streptococcus pneumoniae R6
gaacaccugauuuua

SEQ ID NO: 4076643 - RNA, 16 nt, Streptococcus pneumoniae R6
gaacacuuccaauaau

SEQ ID NO: 4076644 - RNA, 19 nt, Streptococcus pneumoniae R6
gaacaguccuuguuuccau

SEQ ID NO: 4076645 - RNA, 16 nt, Streptococcus pneumoniae R6
gaacagugauagcacu

SEQ ID NO: 4076646 - RNA, 17 nt, Streptococcus pneumoniae R6
gaacaguuucggcuguu

SEQ ID NO: 4076647 - RNA, 12 nt, Streptococcus pneumoniae R6
gaacaucccaag

SEQ ID NO: 4076648 - RNA, 12 nt, Streptococcus pneumoniae R6
gaacaucuccaa

SEQ ID NO: 4076649 - RNA, 17 nt, Streptococcus pneumoniae R6
gaacauuacuacuaucc

SEQ ID NO: 4076650 - RNA, 15 nt, Streptococcus pneumoniae R6
gaacauuuggaaggc

SEQ ID NO: 4076651 - RNA, 20 nt, Streptococcus pneumoniae R6
gaagugaaaaagcaagagcu

SEQ ID NO: 4076652 - RNA, 20 nt, Streptococcus pneumoniae R6
gaagugacagucgcaaagag

SEQ ID NO: 4076653 - RNA, 16 nt, Streptococcus pneumoniae R6
gaagugauaaugauuu

SEQ ID NO: 4076654 - RNA, 21 nt, Streptococcus pneumoniae R6
gaagugccaguguacuagucu

SEQ ID NO: 4076655 - RNA, 14 nt, Streptococcus pneumoniae R6
gaagugggagaaaa

SEQ ID NO: 4076656 - RNA, 15 nt, Streptococcus pneumoniae R6
gaaguggggcaccau

SEQ ID NO: 4076657 - RNA, 19 nt, Streptococcus pneumoniae R6
gaaguguuguaaagucuau

SEQ ID NO: 4076658 - RNA, 19 nt, Streptococcus pneumoniae R6
gaaguuagguuuuguuucu

SEQ ID NO: 4076659 - RNA, 13 nt, Streptococcus pneumoniae R6
gaaguuggccaac

SEQ ID NO: 4076660 - RNA, 19 nt, Streptococcus pneumoniae R6
gaaguuggccaacuaacca

SEQ ID NO: 4076661 - RNA, 17 nt, Streptococcus pneumoniae R6
gaaguuuagauuaaaaa

SEQ ID NO: 4076662 - RNA, 16 nt, Streptococcus pneumoniae R6
gaaguuuaucuugauu

SEQ ID NO: 4076663 - RNA, 17 nt, Streptococcus pneumoniae R6
gaaguuuuuucucuguu

SEQ ID NO: 4076664 - RNA, 15 nt, Streptococcus pneumoniae R6
gaauaaagaaacuug

SEQ ID NO: 4076665 - RNA, 12 nt, Streptococcus pneumoniae R6
gaauaaauagau

SEQ ID NO: 4076666 - RNA, 23 nt, Streptococcus pneumoniae R6
gaauaaauccagcugagauaccu

SEQ ID NO: 4076667 - RNA, 16 nt, Streptococcus pneumoniae R6
gaauaagguaauugaa

SEQ ID NO: 4076668 - RNA, 21 nt, Streptococcus pneumoniae R6
gaauaauacacuucuacuaua

SEQ ID NO: 4076669 - RNA, 21 nt, Streptococcus pneumoniae R6
gaauaaugauuccugacugaa

SEQ ID NO: 4076670 - RNA, 14 nt, Streptococcus pneumoniae R6
gaauaauuaaauca

SEQ ID NO: 4076671 - RNA, 15 nt, Streptococcus pneumoniae R6
gaauaccauacagaa

SEQ ID NO: 4076672 - RNA, 21 nt, Streptococcus pneumoniae R6
gaauaccauacagaaucuuca

SEQ ID NO: 4076673 - RNA, 13 nt, Streptococcus pneumoniae R6
gaauacuaaaaua

SEQ ID NO: 4076674 - RNA, 14 nt, Streptococcus pneumoniae R6
gaauacuaaaauau

SEQ ID NO: 4076675 - RNA, 22 nt, Streptococcus pneumoniae R6
gaauacuaaaauauuucuagaa

SEQ ID NO: 4076676 - RNA, 15 nt, Streptococcus pneumoniae R6
gaauacuaaggaaag

SEQ ID NO: 4076677 - RNA, 23 nt, Streptococcus pneumoniae R6
gaauacucuuucaguuucauuca

SEQ ID NO: 4076678 - RNA, 17 nt, Streptococcus pneumoniae R6
gaauacuuuguuuagac

SEQ ID NO: 4076679 - RNA, 13 nt, Streptococcus pneumoniae R6
gaauagaaacaaa

SEQ ID NO: 4076680 - RNA, 19 nt, Streptococcus pneumoniae R6
gaauagaaacaaaauauau

SEQ ID NO: 4076681 - RNA, 21 nt, Streptococcus pneumoniae R6
gaauagcugcggcuuucuuca

SEQ ID NO: 4076682 - RNA, 18 nt, Streptococcus pneumoniae R6
gaauaggacaucauaacu

SEQ ID NO: 4076683 - RNA, 15 nt, Streptococcus pneumoniae R6
gaauaggauaauauu

SEQ ID NO: 4076684 - RNA, 19 nt, Streptococcus pneumoniae R6
gaauaggcccgauguuauu

SEQ ID NO: 4076685 - RNA, 14 nt, Streptococcus pneumoniae R6
gaauagguaguuca

SEQ ID NO: 4076686 - RNA, 22 nt, Streptococcus pneumoniae R6
gaauaguacacuucuacuucua

SEQ ID NO: 4076687 - RNA, 21 nt, Streptococcus pneumoniae R6
gaauaguacacuucugcuucu

SEQ ID NO: 4076688 - RNA, 13 nt, Streptococcus pneumoniae R6
gaauaguauaagg

SEQ ID NO: 4076689 - RNA, 20 nt, Streptococcus pneumoniae R6
gaauaguaucugaugcugac

SEQ ID NO: 4076690 - RNA, 21 nt, Streptococcus pneumoniae R6
gaauaguaucugaugcugaca

SEQ ID NO: 4076691 - RNA, 20 nt, Streptococcus pneumoniae R6
gaauaguccucccuucuuuc

SEQ ID NO: 4076692 - RNA, 21 nt, Streptococcus pneumoniae R6
gaauaguccucccuucuuucu

SEQ ID NO: 4076693 - RNA, 17 nt, Streptococcus pneumoniae R6
gaauagugaagauacuu

SEQ ID NO: 4076694 - RNA, 17 nt, Streptococcus pneumoniae R6
gaauaguugaaaucaag

SEQ ID NO: 4076695 - RNA, 13 nt, Streptococcus pneumoniae R6
gaauauagaggau

SEQ ID NO: 4076696 - RNA, 17 nt, Streptococcus pneumoniae R6
gaauauauucuccagcu

SEQ ID NO: 4076697 - RNA, 21 nt, Streptococcus pneumoniae R6
gaauauauucuccagcuauua

SEQ ID NO: 4076698 - RNA, 19 nt, Streptococcus pneumoniae R6
gaauauauuucucaauagc

SEQ ID NO: 4076699 - RNA, 15 nt, Streptococcus pneumoniae R6
gaauaucaagauaag

SEQ ID NO: 4076700 - RNA, 15 nt, Streptococcus pneumoniae R6
gaauauguauuucau

SEQ ID NO: 4076701 - RNA, 16 nt, Streptococcus pneumoniae R6
gaauaugucuagccag

SEQ ID NO: 4076702 - RNA, 18 nt, Streptococcus pneumoniae R6
gaauauuaguaaauagaa

SEQ ID NO: 4076703 - RNA, 13 nt, Streptococcus pneumoniae R6
gaaucaaaaauga

SEQ ID NO: 4076704 - RNA, 16 nt, Streptococcus pneumoniae R6
gaaucaauacagaaga

SEQ ID NO: 4076705 - RNA, 14 nt, Streptococcus pneumoniae R6
gaaucaaucuucaa

SEQ ID NO: 4076706 - RNA, 18 nt, Streptococcus pneumoniae R6
gaaucaaucuucaaaauc

SEQ ID NO: 4076707 - RNA, 19 nt, Streptococcus pneumoniae R6
gaaucagaacacuuccaau

SEQ ID NO: 4076708 - RNA, 17 nt, Streptococcus pneumoniae R6
gaaucagauuuuagaac

SEQ ID NO: 4076709 - RNA, 14 nt, Streptococcus pneumoniae R6
gaaucauguaguug

SEQ ID NO: 4076710 - RNA, 13 nt, Streptococcus pneumoniae R6
gaauccaauucaa

SEQ ID NO: 4076711 - RNA, 16 nt, Streptococcus pneumoniae R6
gaauccgaaaaauuuc

SEQ ID NO: 4076712 - RNA, 20 nt, Streptococcus pneumoniae R6
gaauccuaguucaugauuga

SEQ ID NO: 4076713 - RNA, 17 nt, Streptococcus pneumoniae R6
gaauccugccaaugguc

SEQ ID NO: 4076714 - RNA, 16 nt, Streptococcus pneumoniae R6
gaaucguaauuuagaa

SEQ ID NO: 4076715 - RNA, 16 nt, Streptococcus pneumoniae R6
gaaucgugaguuccug

SEQ ID NO: 4076716 - RNA, 20 nt, Streptococcus pneumoniae R6
gaaucguuucugacagagcu

SEQ ID NO: 4076717 - RNA, 17 nt, Streptococcus pneumoniae R6
gaaucuccucaggaacu

SEQ ID NO: 4076718 - RNA, 14 nt, Streptococcus pneumoniae R6
gaaucugaaucaaa

SEQ ID NO: 4076719 - RNA, 20 nt, Streptococcus pneumoniae R6
gaaucuugcugguuugugaa

SEQ ID NO: 4076720 - RNA, 13 nt, Streptococcus pneumoniae R6
gaaugaaauauag

SEQ ID NO: 4076721 - RNA, 12 nt, Streptococcus pneumoniae R6
gaaugaauugcc

SEQ ID NO: 4076722 - RNA, 17 nt, Streptococcus pneumoniae R6
gaaugacuaacccuucu

SEQ ID NO: 4076723 - RNA, 23 nt, Streptococcus pneumoniae R6
gaaugacuacauuuuuugaaaua

SEQ ID NO: 4076724 - RNA, 13 nt, Streptococcus pneumoniae R6
gaaugagcuucca

SEQ ID NO: 4076725 - RNA, 19 nt, Streptococcus pneumoniae R6
gaaugauaacauugacauc

SEQ ID NO: 4076726 - RNA, 16 nt, Streptococcus pneumoniae R6
gaaugauaaucaaacu

SEQ ID NO: 4076727 - RNA, 19 nt, Streptococcus pneumoniae R6
gaaugauauuuucaaaaaa

SEQ ID NO: 4076728 - RNA, 20 nt, Streptococcus pneumoniae R6
gaaugauauuuucaaaaaaa

SEQ ID NO: 4076729 - RNA, 14 nt, Streptococcus pneumoniae R6
gaaugaucaguagu

SEQ ID NO: 4076730 - RNA, 23 nt, Streptococcus pneumoniae R6
gaaugaugacaccugaaacauug

SEQ ID NO: 4076731 - RNA, 22 nt, Streptococcus pneumoniae R6
gaaugauuucuucuuggucugu

SEQ ID NO: 4076732 - RNA, 16 nt, Streptococcus pneumoniae R6
gaaugccaaaauucca

SEQ ID NO: 4076733 - RNA, 17 nt, Streptococcus pneumoniae R6
gaaugccuccaagaaag

SEQ ID NO: 4076734 - RNA, 14 nt, Streptococcus pneumoniae R6
gaaugcucccuucu

SEQ ID NO: 4076735 - RNA, 22 nt, Streptococcus pneumoniae R6
gaaugcuuacuucacuucugua

SEQ ID NO: 4076736 - RNA, 14 nt, Streptococcus pneumoniae R6
gaaugcuuuccaac

SEQ ID NO: 4076737 - RNA, 23 nt, Streptococcus pneumoniae R6
gaauggauuuaucaguauauuga

SEQ ID NO: 4076738 - RNA, 19 nt, Streptococcus pneumoniae R6
gaauguccauaacugcugc

SEQ ID NO: 4076739 - RNA, 13 nt, Streptococcus pneumoniae R6
gaaugucuuccaa

SEQ ID NO: 4076740 - RNA, 18 nt, Streptococcus pneumoniae R6
gaauguggauacuguauu

SEQ ID NO: 4076741 - RNA, 13 nt, Streptococcus pneumoniae R6
gaauuaagugacc

SEQ ID NO: 4076742 - RNA, 15 nt, Streptococcus pneumoniae R6
gaauuacaugaaacu

SEQ ID NO: 4076743 - RNA, 19 nt, Streptococcus pneumoniae R6
gaauuaggauagauaccuu

SEQ ID NO: 4076744 - RNA, 16 nt, Streptococcus pneumoniae R6
gaauucccuuacucuc

SEQ ID NO: 4076745 - RNA, 16 nt, Streptococcus pneumoniae R6
gaauucuccaaucaaa

SEQ ID NO: 4076746 - RNA, 13 nt, Streptococcus pneumoniae R6
gaauucuggauuu

SEQ ID NO: 4076747 - RNA, 22 nt, Streptococcus pneumoniae R6
gaauugccugauaacgaagagc

SEQ ID NO: 4076748 - RNA, 18 nt, Streptococcus pneumoniae R6
gaauugguggguuuucug

SEQ ID NO: 4076749 - RNA, 13 nt, Streptococcus pneumoniae R6
gaauuugaaacaa

SEQ ID NO: 4076750 - RNA, 16 nt, Streptococcus pneumoniae R6
gaauuugcuacaaaua

SEQ ID NO: 4076751 - RNA, 18 nt, Streptococcus pneumoniae R6
gaauuuuuugagcaaguu

SEQ ID NO: 4076752 - RNA, 23 nt, Streptococcus pneumoniae R6
gacaaaacuaacccuagaaaacc

SEQ ID NO: 4076753 - RNA, 18 nt, Streptococcus pneumoniae R6
gacaaaacuuuuuaaaaa

SEQ ID NO: 4076754 - RNA, 19 nt, Streptococcus pneumoniae R6
gacgacuacuuccuaagcu

SEQ ID NO: 4076755 - RNA, 14 nt, Streptococcus pneumoniae R6
gacgagaaauagcg

SEQ ID NO: 4076756 - RNA, 15 nt, Streptococcus pneumoniae R6
gacgagaaucgaacu

SEQ ID NO: 4076757 - RNA, 21 nt, Streptococcus pneumoniae R6
gacgaggccagaacucccugu

SEQ ID NO: 4076758 - RNA, 20 nt, Streptococcus pneumoniae R6
gacgaguuaaaacaaagaaa

SEQ ID NO: 4076759 - RNA, 20 nt, Streptococcus pneumoniae R6
gacgauaaauugcuggagaa

SEQ ID NO: 4076760 - RNA, 23 nt, Streptococcus pneumoniae R6
gacgauaaggacgguagcaggga

SEQ ID NO: 4076761 - RNA, 18 nt, Streptococcus pneumoniae R6
gacgauguugaugauaug

SEQ ID NO: 4076762 - RNA, 22 nt, Streptococcus pneumoniae R6
gacgauuaaauaguucuuccaa

SEQ ID NO: 4076763 - RNA, 22 nt, Streptococcus pneumoniae R6
gacgauuccaaacaacaauacu

SEQ ID NO: 4076764 - RNA, 14 nt, Streptococcus pneumoniae R6
gacgauuuucucuu

SEQ ID NO: 4076765 - RNA, 16 nt, Streptococcus pneumoniae R6
gacgauuuucucuuua

SEQ ID NO: 4076766 - RNA, 14 nt, Streptococcus pneumoniae R6
gacgauuuuuucuu

SEQ ID NO: 4076767 - RNA, 22 nt, Streptococcus pneumoniae R6
gacgcacaaacuucaucccagu

SEQ ID NO: 4076768 - RNA, 14 nt, Streptococcus pneumoniae R6
gacgcccuuaguaa

SEQ ID NO: 4076769 - RNA, 16 nt, Streptococcus pneumoniae R6
gacgcgguuugaagag

SEQ ID NO: 4076770 - RNA, 22 nt, Streptococcus pneumoniae R6
gacgcuuucuaaggagaauucu

SEQ ID NO: 4076771 - RNA, 15 nt, Streptococcus pneumoniae R6
gacgucguaaccaga

SEQ ID NO: 4076772 - RNA, 18 nt, Streptococcus pneumoniae R6
gacguucaaagauaucau

SEQ ID NO: 4076773 - RNA, 21 nt, Streptococcus pneumoniae R6
gacguuuaucaauaauagcga

SEQ ID NO: 4076774 - RNA, 23 nt, Streptococcus pneumoniae R6
gacuaaaaaacucugcuuuucag

SEQ ID NO: 4076775 - RNA, 22 nt, Streptococcus pneumoniae R6
gacuaaaguuguacaagaaaag

SEQ ID NO: 4076776 - RNA, 21 nt, Streptococcus pneumoniae R6
gacuaaauccaaaagcaggag

SEQ ID NO: 4076777 - RNA, 18 nt, Streptococcus pneumoniae R6
gacuaacccuucuuuuua

SEQ ID NO: 4076778 - RNA, 13 nt, Streptococcus pneumoniae R6
gacuaaggagagu

SEQ ID NO: 4076779 - RNA, 21 nt, Streptococcus pneumoniae R6
gacuaaguccuuuuaguuuua

SEQ ID NO: 4076780 - RNA, 15 nt, Streptococcus pneumoniae R6
gacuagauaaaagaa

SEQ ID NO: 4076781 - RNA, 20 nt, Streptococcus pneumoniae R6
gacuaggugagcaucaggaa

SEQ ID NO: 4076782 - RNA, 14 nt, Streptococcus pneumoniae R6
gacuauaguagguu

SEQ ID NO: 4076783 - RNA, 17 nt, Streptococcus pneumoniae R6
gacuauaucauauagau

SEQ ID NO: 4076784 - RNA, 13 nt, Streptococcus pneumoniae R6
gacuauauuucuu

SEQ ID NO: 4076785 - RNA, 14 nt, Streptococcus pneumoniae R6
gacuauauuucuua

SEQ ID NO: 4076786 - RNA, 22 nt, Streptococcus pneumoniae R6
gacuaucugcuaacugcuggau

SEQ ID NO: 4076787 - RNA, 23 nt, Streptococcus pneumoniae R6
gacuaucuuguugaaugagcuuc

SEQ ID NO: 4076788 - RNA, 18 nt, Streptococcus pneumoniae R6
gacuaugaucagcauuuc

SEQ ID NO: 4076789 - RNA, 21 nt, Streptococcus pneumoniae R6
gacuauuaaccuugucuucuc

SEQ ID NO: 4076790 - RNA, 20 nt, Streptococcus pneumoniae R6
gacuccaccauaguguuucu

SEQ ID NO: 4076791 - RNA, 15 nt, Streptococcus pneumoniae R6
gacuccuacaaagcc

SEQ ID NO: 4076792 - RNA, 15 nt, Streptococcus pneumoniae R6
gacucuguuccccaa

SEQ ID NO: 4076793 - RNA, 16 nt, Streptococcus pneumoniae R6
gacucuuagucuuuau

SEQ ID NO: 4076794 - RNA, 16 nt, Streptococcus pneumoniae R6
gacucuuauuucucaa

SEQ ID NO: 4076795 - RNA, 20 nt, Streptococcus pneumoniae R6
gacucuugcccuuggcuagu

SEQ ID NO: 4076796 - RNA, 12 nt, Streptococcus pneumoniae R6
gacucuuguucu

SEQ ID NO: 4076797 - RNA, 19 nt, Streptococcus pneumoniae R6
gacugaaucugaaauagua

SEQ ID NO: 4076798 - RNA, 15 nt, Streptococcus pneumoniae R6
gacugacuaccaagu

SEQ ID NO: 4076799 - RNA, 17 nt, Streptococcus pneumoniae R6
gacugagagcuacacgu

SEQ ID NO: 4076800 - RNA, 18 nt, Streptococcus pneumoniae R6
gacugauggaaguaauuu

SEQ ID NO: 4076801 - RNA, 15 nt, Streptococcus pneumoniae R6
gacugauuucaauuu

SEQ ID NO: 4076802 - RNA, 18 nt, Streptococcus pneumoniae R6
gacugccucucuucuguu

SEQ ID NO: 4076803 - RNA, 13 nt, Streptococcus pneumoniae R6
gacuggaaacuuu

SEQ ID NO: 4076804 - RNA, 16 nt, Streptococcus pneumoniae R6
gacuggcuaggugaga

SEQ ID NO: 4076805 - RNA, 16 nt, Streptococcus pneumoniae R6
gacugggauuccuuuu

SEQ ID NO: 4076806 - RNA, 17 nt, Streptococcus pneumoniae R6
gacugguaaagaaugga

SEQ ID NO: 4076807 - RNA, 24 nt, Streptococcus pneumoniae R6
gacuggugucguugaaugaaauga

SEQ ID NO: 4076808 - RNA, 19 nt, Streptococcus pneumoniae R6
gacuggugugauuuuccug

SEQ ID NO: 4076809 - RNA, 23 nt, Streptococcus pneumoniae R6
gacuggugugauuuuccugaaua

SEQ ID NO: 4076810 - RNA, 14 nt, Streptococcus pneumoniae R6
gacugguucucucu

SEQ ID NO: 4076811 - RNA, 22 nt, Streptococcus pneumoniae R6
gacugguucucucuuuuugauu

SEQ ID NO: 4076812 - RNA, 13 nt, Streptococcus pneumoniae R6
gacugucaaguuc

SEQ ID NO: 4076813 - RNA, 17 nt, Streptococcus pneumoniae R6
gacuguuauagauucaa

SEQ ID NO: 4076814 - RNA, 16 nt, Streptococcus pneumoniae R6
gacuuagcaaaucagc

SEQ ID NO: 4076815 - RNA, 24 nt, Streptococcus pneumoniae R6
gacuuagcucugugcaauacagaa

SEQ ID NO: 4076816 - RNA, 15 nt, Streptococcus pneumoniae R6
gacuucaauaaaaua

SEQ ID NO: 4076817 - RNA, 22 nt, Streptococcus pneumoniae R6
gacuucaauaaaauauaacuau

SEQ ID NO: 4076818 - RNA, 16 nt, Streptococcus pneumoniae R6
gacuucacacuuaagu

SEQ ID NO: 4076819 - RNA, 17 nt, Streptococcus pneumoniae R6
gacuucaggaaaaaaug

SEQ ID NO: 4076820 - RNA, 20 nt, Streptococcus pneumoniae R6
gacuuccaaaauuaaaaugu

SEQ ID NO: 4076821 - RNA, 19 nt, Streptococcus pneumoniae R6
gacuuccgccaucuuguuu

SEQ ID NO: 4076822 - RNA, 21 nt, Streptococcus pneumoniae R6
gacuuccuugccuucaaucuu

SEQ ID NO: 4076823 - RNA, 20 nt, Streptococcus pneumoniae R6
gacuucgucaguuucaucca

SEQ ID NO: 4076824 - RNA, 16 nt, Streptococcus pneumoniae R6
gacuucuugagcuagg

SEQ ID NO: 4076825 - RNA, 18 nt, Streptococcus pneumoniae R6
gacuugaaauacuaaaaa

SEQ ID NO: 4076826 - RNA, 18 nt, Streptococcus pneumoniae R6
gacuugaccgcagauuua

SEQ ID NO: 4076827 - RNA, 18 nt, Streptococcus pneumoniae R6
gacuugauauaaaugaca

SEQ ID NO: 4076828 - RNA, 15 nt, Streptococcus pneumoniae R6
gacuugccuucaaca

SEQ ID NO: 4076829 - RNA, 16 nt, Streptococcus pneumoniae R6
gacuugccuucaacac

SEQ ID NO: 4076830 - RNA, 19 nt, Streptococcus pneumoniae R6
gacuugcuugccaugagcu

SEQ ID NO: 4076831 - RNA, 17 nt, Streptococcus pneumoniae R6
gacuuuaaacauacuga

SEQ ID NO: 4076832 - RNA, 15 nt, Streptococcus pneumoniae R6
gacuuuaucaccucc

SEQ ID NO: 4076833 - RNA, 22 nt, Streptococcus pneumoniae R6
gacuuuaugugaauauucuugg

SEQ ID NO: 4076834 - RNA, 16 nt, Streptococcus pneumoniae R6
gacuuucaauucuuca

SEQ ID NO: 4076835 - RNA, 22 nt, Streptococcus pneumoniae R6
gacuuucuaauuauuucaauua

SEQ ID NO: 4076836 - RNA, 23 nt, Streptococcus pneumoniae R6
gacuuucuaauuauuucaauuag

SEQ ID NO: 4076837 - RNA, 14 nt, Streptococcus pneumoniae R6
gacuuucuuguuuu

SEQ ID NO: 4076838 - RNA, 17 nt, Streptococcus pneumoniae R6
gacuuucuuguuuucuu

SEQ ID NO: 4076839 - RNA, 22 nt, Streptococcus pneumoniae R6
gacuuucuuuuuauacucaucu

SEQ ID NO: 4076840 - RNA, 22 nt, Streptococcus pneumoniae R6
gacuuuggcuaggcgcuucacu

SEQ ID NO: 4076841 - RNA, 17 nt, Streptococcus pneumoniae R6
gacuuuuauccaccuau

SEQ ID NO: 4076842 - RNA, 13 nt, Streptococcus pneumoniae R6
gacuuuugaaaaa

SEQ ID NO: 4076843 - RNA, 20 nt, Streptococcus pneumoniae R6
gacuuuuuucuauaguagau

SEQ ID NO: 4076844 - RNA, 19 nt, Streptococcus pneumoniae R6
gagaaacagcuccugaaau

SEQ ID NO: 4076845 - RNA, 13 nt, Streptococcus pneumoniae R6
gagaaagaaaaac

SEQ ID NO: 4076846 - RNA, 18 nt, Streptococcus pneumoniae R6
gagaaagaaaaacugcuu

SEQ ID NO: 4076847 - RNA, 12 nt, Streptococcus pneumoniae R6
gagaaagaaaac

SEQ ID NO: 4076848 - RNA, 13 nt, Streptococcus pneumoniae R6
gagaaagacuuga

SEQ ID NO: 4076849 - RNA, 10 nt, Streptococcus pneumoniae R6
gagaaagcac

SEQ ID NO: 4076850 - RNA, 14 nt, Streptococcus pneumoniae R6
gagaaaguuaaaaa

SEQ ID NO: 4076851 - RNA, 19 nt, Streptococcus pneumoniae R6
gagaaauuucugaaacuaa

SEQ ID NO: 4076852 - RNA, 22 nt, Streptococcus pneumoniae R6
gagaacaguuucggcuguucuu

SEQ ID NO: 4076853 - RNA, 18 nt, Streptococcus pneumoniae R6
gagaaccaggaaaccagc

SEQ ID NO: 4076854 - RNA, 18 nt, Streptococcus pneumoniae R6
gagaacccuuuuuggaua

SEQ ID NO: 4076855 - RNA, 15 nt, Streptococcus pneumoniae R6
gagaagaaaacagaa

SEQ ID NO: 4076856 - RNA, 23 nt, Streptococcus pneumoniae R6
gagguuguugauucgcucuucaa

SEQ ID NO: 4076857 - RNA, 18 nt, Streptococcus pneumoniae R6
gaguaaaagaaauacagu

SEQ ID NO: 4076858 - RNA, 16 nt, Streptococcus pneumoniae R6
gaguaaaagacaucag

SEQ ID NO: 4076859 - RNA, 16 nt, Streptococcus pneumoniae R6
gaguaaauaaaacaaa

SEQ ID NO: 4076860 - RNA, 19 nt, Streptococcus pneumoniae R6
gaguaacaucaauaaccau

SEQ ID NO: 4076861 - RNA, 14 nt, Streptococcus pneumoniae R6
gaguaacggcuucc

SEQ ID NO: 4076862 - RNA, 14 nt, Streptococcus pneumoniae R6
gaguaacuaugaau

SEQ ID NO: 4076863 - RNA, 15 nt, Streptococcus pneumoniae R6
gaguaacuaugaauc

SEQ ID NO: 4076864 - RNA, 21 nt, Streptococcus pneumoniae R6
gaguacgaacaaguugugcag

SEQ ID NO: 4076865 - RNA, 17 nt, Streptococcus pneumoniae R6
gaguagagagaaaggag

SEQ ID NO: 4076866 - RNA, 17 nt, Streptococcus pneumoniae R6
gaguagcaccauauuug

SEQ ID NO: 4076867 - RNA, 21 nt, Streptococcus pneumoniae R6
gaguagguacuugcuguauuu

SEQ ID NO: 4076868 - RNA, 17 nt, Streptococcus pneumoniae R6
gaguaguaaaacuguau

SEQ ID NO: 4076869 - RNA, 16 nt, Streptococcus pneumoniae R6
gaguagucauaccaag

SEQ ID NO: 4076870 - RNA, 13 nt, Streptococcus pneumoniae R6
gaguauaaaaccu

SEQ ID NO: 4076871 - RNA, 12 nt, Streptococcus pneumoniae R6
gaguauaaaauu

SEQ ID NO: 4076872 - RNA, 16 nt, Streptococcus pneumoniae R6
gaguauaaauggacaa

SEQ ID NO: 4076873 - RNA, 20 nt, Streptococcus pneumoniae R6
gaguauaagauacaaauuua

SEQ ID NO: 4076874 - RNA, 19 nt, Streptococcus pneumoniae R6
gaguaugaaauaagauaug

SEQ ID NO: 4076875 - RNA, 14 nt, Streptococcus pneumoniae R6
gaguauuaaacaaa

SEQ ID NO: 4076876 - RNA, 20 nt, Streptococcus pneumoniae R6
gaguauuagagguuugcuua

SEQ ID NO: 4076877 - RNA, 16 nt, Streptococcus pneumoniae R6
gagucaagauaacagu

SEQ ID NO: 4076878 - RNA, 15 nt, Streptococcus pneumoniae R6
gagucagcucuuuuu

SEQ ID NO: 4076879 - RNA, 17 nt, Streptococcus pneumoniae R6
gagucauucaauccauc

SEQ ID NO: 4076880 - RNA, 14 nt, Streptococcus pneumoniae R6
gaguccaaagacca

SEQ ID NO: 4076881 - RNA, 22 nt, Streptococcus pneumoniae R6
gaguccaaagaccaugaggaaa

SEQ ID NO: 4076882 - RNA, 23 nt, Streptococcus pneumoniae R6
gagucuuuuuccaagaucuuuuu

SEQ ID NO: 4076883 - RNA, 18 nt, Streptococcus pneumoniae R6
gagugagcaccaucuaua

SEQ ID NO: 4076884 - RNA, 21 nt, Streptococcus pneumoniae R6
gaguggauuggcucaaucaau

SEQ ID NO: 4076885 - RNA, 13 nt, Streptococcus pneumoniae R6
gaguggucaaaca

SEQ ID NO: 4076886 - RNA, 21 nt, Streptococcus pneumoniae R6
gaguguaaaaagaaaguccuc

SEQ ID NO: 4076887 - RNA, 12 nt, Streptococcus pneumoniae R6
gaguguuugcaa

SEQ ID NO: 4076888 - RNA, 20 nt, Streptococcus pneumoniae R6
gaguguuugcaaagaugaug

SEQ ID NO: 4076889 - RNA, 17 nt, Streptococcus pneumoniae R6
gaguuaacuauaccaga

SEQ ID NO: 4076890 - RNA, 18 nt, Streptococcus pneumoniae R6
gaguuaccuaaauuauga

SEQ ID NO: 4076891 - RNA, 14 nt, Streptococcus pneumoniae R6
gaguucuucaacaa

SEQ ID NO: 4076892 - RNA, 14 nt, Streptococcus pneumoniae R6
gaguucuuguuucu

SEQ ID NO: 4076893 - RNA, 14 nt, Streptococcus pneumoniae R6
gaguucuuuaacaa

SEQ ID NO: 4076894 - RNA, 23 nt, Streptococcus pneumoniae R6
gaguugaaugccuccaagaaaga

SEQ ID NO: 4076895 - RNA, 16 nt, Streptococcus pneumoniae R6
gaguugggugaugagu

SEQ ID NO: 4076896 - RNA, 21 nt, Streptococcus pneumoniae R6
gaguugguccagcuucaaauc

SEQ ID NO: 4076897 - RNA, 11 nt, Streptococcus pneumoniae R6
gaguuucucuu

SEQ ID NO: 4076898 - RNA, 13 nt, Streptococcus pneumoniae R6
gaguuuugaaaac

SEQ ID NO: 4076899 - RNA, 11 nt, Streptococcus pneumoniae R6
gaguuuugcua

SEQ ID NO: 4076900 - RNA, 18 nt, Streptococcus pneumoniae R6
gauaaaacguugguaaaa

SEQ ID NO: 4076901 - RNA, 13 nt, Streptococcus pneumoniae R6
gauaaaacuauug

SEQ ID NO: 4076902 - RNA, 16 nt, Streptococcus pneumoniae R6
gauaaaagauagagaa

SEQ ID NO: 4076903 - RNA, 20 nt, Streptococcus pneumoniae R6
gauaaaagauagagaaagaa

SEQ ID NO: 4076904 - RNA, 21 nt, Streptococcus pneumoniae R6
gauaaaagauagagaaagaaa

SEQ ID NO: 4076905 - RNA, 19 nt, Streptococcus pneumoniae R6
gauaaaaggcuuagccagu

SEQ ID NO: 4076906 - RNA, 18 nt, Streptococcus pneumoniae R6
gauaaaaguuauagaagu

SEQ ID NO: 4076907 - RNA, 19 nt, Streptococcus pneumoniae R6
gauaaaaucguuuaucacu

SEQ ID NO: 4076908 - RNA, 15 nt, Streptococcus pneumoniae R6
gauaaacguaaaagu

SEQ ID NO: 4076909 - RNA, 19 nt, Streptococcus pneumoniae R6
gauaaacguaaaagucaua

SEQ ID NO: 4076910 - RNA, 15 nt, Streptococcus pneumoniae R6
gauaaagugucuccc

SEQ ID NO: 4076911 - RNA, 20 nt, Streptococcus pneumoniae R6
gauaaaguuaugaaaaagau

SEQ ID NO: 4076912 - RNA, 13 nt, Streptococcus pneumoniae R6
gauaacagucagu

SEQ ID NO: 4076913 - RNA, 15 nt, Streptococcus pneumoniae R6
gauaacagucaguuc

SEQ ID NO: 4076914 - RNA, 23 nt, Streptococcus pneumoniae R6
gauaacaguuuuuaauuuuucuu

SEQ ID NO: 4076915 - RNA, 13 nt, Streptococcus pneumoniae R6
gauaacauugaca

SEQ ID NO: 4076916 - RNA, 18 nt, Streptococcus pneumoniae R6
gauaacauugacaucugu

SEQ ID NO: 4076917 - RNA, 19 nt, Streptococcus pneumoniae R6
gauaaccaucucacacaau

SEQ ID NO: 4076918 - RNA, 14 nt, Streptococcus pneumoniae R6
gauaacugaaauug

SEQ ID NO: 4076919 - RNA, 11 nt, Streptococcus pneumoniae R6
gauaacugcua

SEQ ID NO: 4076920 - RNA, 14 nt, Streptococcus pneumoniae R6
gauaacugcuagaa

SEQ ID NO: 4076921 - RNA, 20 nt, Streptococcus pneumoniae R6
gauaagaccaaaagucgagu

SEQ ID NO: 4076922 - RNA, 13 nt, Streptococcus pneumoniae R6
gauaagacugacg

SEQ ID NO: 4076923 - RNA, 15 nt, Streptococcus pneumoniae R6
gauaagacugacgaa

SEQ ID NO: 4076924 - RNA, 14 nt, Streptococcus pneumoniae R6
gauaagagcaacaa

SEQ ID NO: 4076925 - RNA, 16 nt, Streptococcus pneumoniae R6
gauaagaguuuuacag

SEQ ID NO: 4076926 - RNA, 12 nt, Streptococcus pneumoniae R6
gauaagauaaag

SEQ ID NO: 4076927 - RNA, 18 nt, Streptococcus pneumoniae R6
gauaagauuuuuggaaaa

SEQ ID NO: 4076928 - RNA, 23 nt, Streptococcus pneumoniae R6
gauaagauuuuuggaaaaaauaa

SEQ ID NO: 4076929 - RNA, 18 nt, Streptococcus pneumoniae R6
gauaaggaauuuuagaag

SEQ ID NO: 4076930 - RNA, 18 nt, Streptococcus pneumoniae R6
gauaaggacgguagcagg

SEQ ID NO: 4076931 - RNA, 18 nt, Streptococcus pneumoniae R6
gauaaggagcgaauuuga

SEQ ID NO: 4076932 - RNA, 21 nt, Streptococcus pneumoniae R6
gauaaggcaucuuaacauucu

SEQ ID NO: 4076933 - RNA, 22 nt, Streptococcus pneumoniae R6
gauaaggccugauaagaugaca

SEQ ID NO: 4076934 - RNA, 23 nt, Streptococcus pneumoniae R6
gauaaguuccaucugggucggcu

SEQ ID NO: 4076935 - RNA, 18 nt, Streptococcus pneumoniae R6
gauaaguuugguuuuuug

SEQ ID NO: 4076936 - RNA, 12 nt, Streptococcus pneumoniae R6
gauaauaccagc

SEQ ID NO: 4076937 - RNA, 17 nt, Streptococcus pneumoniae R6
gauaauaccuaccagag

SEQ ID NO: 4076938 - RNA, 20 nt, Streptococcus pneumoniae R6
gauaauauauagguuuugcu

SEQ ID NO: 4076939 - RNA, 21 nt, Streptococcus pneumoniae R6
gauaauauauagguuuugcua

SEQ ID NO: 4076940 - RNA, 23 nt, Streptococcus pneumoniae R6
gauaauaucuaauugauuuaaau

SEQ ID NO: 4076941 - RNA, 19 nt, Streptococcus pneumoniae R6
gauaauauuacuucuaaaa

SEQ ID NO: 4076942 - RNA, 22 nt, Streptococcus pneumoniae R6
gauaauauuacuucuaaaacau

SEQ ID NO: 4076943 - RNA, 12 nt, Streptococcus pneumoniae R6
gauaauccagga

SEQ ID NO: 4076944 - RNA, 20 nt, Streptococcus pneumoniae R6
gauaaucgcaagguagagac

SEQ ID NO: 4076945 - RNA, 23 nt, Streptococcus pneumoniae R6
gauaaucgcaagguagagacaga

SEQ ID NO: 4076946 - RNA, 22 nt, Streptococcus pneumoniae R6
gauaaugguaucacauucaaug

SEQ ID NO: 4076947 - RNA, 14 nt, Streptococcus pneumoniae R6
gauaauuauuuuuu

SEQ ID NO: 4076948 - RNA, 23 nt, Streptococcus pneumoniae R6
gauaauuuaaaacucauuaauaa

SEQ ID NO: 4076949 - RNA, 14 nt, Streptococcus pneumoniae R6
gauaauuucgcugu

SEQ ID NO: 4076950 - RNA, 20 nt, Streptococcus pneumoniae R6
gauaauuuucuguggauacu

SEQ ID NO: 4076951 - RNA, 22 nt, Streptococcus pneumoniae R6
gauacaguuagcauggucaaag

SEQ ID NO: 4076952 - RNA, 14 nt, Streptococcus pneumoniae R6
gauaccaaccaguu

SEQ ID NO: 4076953 - RNA, 13 nt, Streptococcus pneumoniae R6
gauaccagagcga

SEQ ID NO: 4076954 - RNA, 19 nt, Streptococcus pneumoniae R6
gauaccuauccuacccacu

SEQ ID NO: 4076955 - RNA, 20 nt, Streptococcus pneumoniae R6
gauaccugggaagaugaaga

SEQ ID NO: 4076956 - RNA, 23 nt, Streptococcus pneumoniae R6
gauaccuuuuccuucauuuccaa

SEQ ID NO: 4076957 - RNA, 16 nt, Streptococcus pneumoniae R6
gauacgcucagcugau

SEQ ID NO: 4076958 - RNA, 20 nt, Streptococcus pneumoniae R6
gauacgguauuuaccaaaaa

SEQ ID NO: 4076959 - RNA, 19 nt, Streptococcus pneumoniae R6
gaugaguguuugcaaagau

SEQ ID NO: 4076960 - RNA, 16 nt, Streptococcus pneumoniae R6
gaugauaacgaaucca

SEQ ID NO: 4076961 - RNA, 19 nt, Streptococcus pneumoniae R6
gaugauaacgaauccaacu

SEQ ID NO: 4076962 - RNA, 12 nt, Streptococcus pneumoniae R6
gaugauaccauc

SEQ ID NO: 4076963 - RNA, 16 nt, Streptococcus pneumoniae R6
gaugaucgagcagauu

SEQ ID NO: 4076964 - RNA, 16 nt, Streptococcus pneumoniae R6
gaugaucuaaauguau

SEQ ID NO: 4076965 - RNA, 16 nt, Streptococcus pneumoniae R6
gaugauguuaucaaau

SEQ ID NO: 4076966 - RNA, 20 nt, Streptococcus pneumoniae R6
gaugauguuuaaaaucugga

SEQ ID NO: 4076967 - RNA, 22 nt, Streptococcus pneumoniae R6
gaugauuggaaauucaagaaug

SEQ ID NO: 4076968 - RNA, 23 nt, Streptococcus pneumoniae R6
gaugauuggaaugacgaaacgaa

SEQ ID NO: 4076969 - RNA, 19 nt, Streptococcus pneumoniae R6
gaugauuuaauuagaaaaa

SEQ ID NO: 4076970 - RNA, 14 nt, Streptococcus pneumoniae R6
gaugauuuucaaau

SEQ ID NO: 4076971 - RNA, 15 nt, Streptococcus pneumoniae R6
gaugcaauuuuuuug

SEQ ID NO: 4076972 - RNA, 19 nt, Streptococcus pneumoniae R6
gaugcaugccauuaaucag

SEQ ID NO: 4076973 - RNA, 19 nt, Streptococcus pneumoniae R6
gaugcccguacuuaccaag

SEQ ID NO: 4076974 - RNA, 21 nt, Streptococcus pneumoniae R6
gaugccuuuuauaauagaaag

SEQ ID NO: 4076975 - RNA, 23 nt, Streptococcus pneumoniae R6
gaugccuuuuauaauagaaagau

SEQ ID NO: 4076976 - RNA, 12 nt, Streptococcus pneumoniae R6
gauggaacugac

SEQ ID NO: 4076977 - RNA, 13 nt, Streptococcus pneumoniae R6
gauggaagacuga

SEQ ID NO: 4076978 - RNA, 14 nt, Streptococcus pneumoniae R6
gauggaagcugacg

SEQ ID NO: 4076979 - RNA, 21 nt, Streptococcus pneumoniae R6
gauggacacgauaaucugggc

SEQ ID NO: 4076980 - RNA, 22 nt, Streptococcus pneumoniae R6
gauggcuaggaggcggucaagg

SEQ ID NO: 4076981 - RNA, 17 nt, Streptococcus pneumoniae R6
gaugugacuguuucaga

SEQ ID NO: 4076982 - RNA, 12 nt, Streptococcus pneumoniae R6
gauguuaaaaug

SEQ ID NO: 4076983 - RNA, 19 nt, Streptococcus pneumoniae R6
gauguuaaaaugagucuau

SEQ ID NO: 4076984 - RNA, 17 nt, Streptococcus pneumoniae R6
gauguuaagugcuucuu

SEQ ID NO: 4076985 - RNA, 13 nt, Streptococcus pneumoniae R6
gauguuacagaca

SEQ ID NO: 4076986 - RNA, 19 nt, Streptococcus pneumoniae R6
gauguuacuucugaaucug

SEQ ID NO: 4076987 - RNA, 22 nt, Streptococcus pneumoniae R6
gauguuauacaaauaaggagua

SEQ ID NO: 4076988 - RNA, 16 nt, Streptococcus pneumoniae R6
gauguuauugaaacag

SEQ ID NO: 4076989 - RNA, 20 nt, Streptococcus pneumoniae R6
gauguuauuuacuguuuuag

SEQ ID NO: 4076990 - RNA, 13 nt, Streptococcus pneumoniae R6
gauguucaaagau

SEQ ID NO: 4076991 - RNA, 12 nt, Streptococcus pneumoniae R6
gauguucaaagc

SEQ ID NO: 4076992 - RNA, 12 nt, Streptococcus pneumoniae R6
gauguucaaagu

SEQ ID NO: 4076993 - RNA, 16 nt, Streptococcus pneumoniae R6
gauguucuuugaaaua

SEQ ID NO: 4076994 - RNA, 17 nt, Streptococcus pneumoniae R6
gauguugacuuaaugaa

SEQ ID NO: 4076995 - RNA, 16 nt, Streptococcus pneumoniae R6
gauguugcuagagaua

SEQ ID NO: 4076996 - RNA, 16 nt, Streptococcus pneumoniae R6
gauguuuaaaaucugg

SEQ ID NO: 4076997 - RNA, 21 nt, Streptococcus pneumoniae R6
gauguuuaagucuugcuucca

SEQ ID NO: 4076998 - RNA, 19 nt, Streptococcus pneumoniae R6
gauguuucuuuaaaucgcu

SEQ ID NO: 4076999 - RNA, 12 nt, Streptococcus pneumoniae R6
gauuaaaacugc

SEQ ID NO: 4077000 - RNA, 19 nt, Streptococcus pneumoniae R6
gauuaaaacugccuuucuc

SEQ ID NO: 4077001 - RNA, 18 nt, Streptococcus pneumoniae R6
gauuaaaaguaagagaaa

SEQ ID NO: 4077002 - RNA, 17 nt, Streptococcus pneumoniae R6
gauuaaauagagccuuc

SEQ ID NO: 4077003 - RNA, 15 nt, Streptococcus pneumoniae R6
gauuaaauaguucuu

SEQ ID NO: 4077004 - RNA, 18 nt, Streptococcus pneumoniae R6
gauuaaauaguucuucca

SEQ ID NO: 4077005 - RNA, 12 nt, Streptococcus pneumoniae R6
gauuaagugauu

SEQ ID NO: 4077006 - RNA, 22 nt, Streptococcus pneumoniae R6
gauuaauaauucggagauacug

SEQ ID NO: 4077007 - RNA, 13 nt, Streptococcus pneumoniae R6
gauuaaucaaaug

SEQ ID NO: 4077008 - RNA, 16 nt, Streptococcus pneumoniae R6
gauuaaucaaaugagc

SEQ ID NO: 4077009 - RNA, 13 nt, Streptococcus pneumoniae R6
gauuaauccccau

SEQ ID NO: 4077010 - RNA, 18 nt, Streptococcus pneumoniae R6
gauuacaaaaaaaacuac

SEQ ID NO: 4077011 - RNA, 18 nt, Streptococcus pneumoniae R6
gauuacaagacagguuuu

SEQ ID NO: 4077012 - RNA, 15 nt, Streptococcus pneumoniae R6
gauuacauagacuuc

SEQ ID NO: 4077013 - RNA, 17 nt, Streptococcus pneumoniae R6
gauuacaucucuuguaa

SEQ ID NO: 4077014 - RNA, 12 nt, Streptococcus pneumoniae R6
gauuaccgccuu

SEQ ID NO: 4077015 - RNA, 18 nt, Streptococcus pneumoniae R6
gauuacugauaaaacuga

SEQ ID NO: 4077016 - RNA, 21 nt, Streptococcus pneumoniae R6
gauuacuuauuugaacuugaa

SEQ ID NO: 4077017 - RNA, 16 nt, Streptococcus pneumoniae R6
gauuaggggggcuauu

SEQ ID NO: 4077018 - RNA, 16 nt, Streptococcus pneumoniae R6
gauuagguuuccuuua

SEQ ID NO: 4077019 - RNA, 11 nt, Streptococcus pneumoniae R6
gauuauaaaag

SEQ ID NO: 4077020 - RNA, 18 nt, Streptococcus pneumoniae R6
gauuauagguuccuucug

SEQ ID NO: 4077021 - RNA, 19 nt, Streptococcus pneumoniae R6
gauuauccuuuacuuguuu

SEQ ID NO: 4077022 - RNA, 22 nt, Streptococcus pneumoniae R6
gauuaucuaacaauaagauauc

SEQ ID NO: 4077023 - RNA, 19 nt, Streptococcus pneumoniae R6
gauuauuacaacaauaaga

SEQ ID NO: 4077024 - RNA, 23 nt, Streptococcus pneumoniae R6
gauuauuacaacaauaagagaau

SEQ ID NO: 4077025 - RNA, 22 nt, Streptococcus pneumoniae R6
gauuauugcagccaauuucuuu

SEQ ID NO: 4077026 - RNA, 14 nt, Streptococcus pneumoniae R6
gauuauuuuuucuc

SEQ ID NO: 4077027 - RNA, 16 nt, Streptococcus pneumoniae R6
gauuauuuuuucucaa

SEQ ID NO: 4077028 - RNA, 15 nt, Streptococcus pneumoniae R6
gauucagauucauca

SEQ ID NO: 4077029 - RNA, 15 nt, Streptococcus pneumoniae R6
gauucagcuaaaaug

SEQ ID NO: 4077030 - RNA, 14 nt, Streptococcus pneumoniae R6
gauuccagcuucuu

SEQ ID NO: 4077031 - RNA, 15 nt, Streptococcus pneumoniae R6
gauucccguaucuuu

SEQ ID NO: 4077032 - RNA, 14 nt, Streptococcus pneumoniae R6
gauuccuuuuugca

SEQ ID NO: 4077033 - RNA, 19 nt, Streptococcus pneumoniae R6
gauucggacgauuaaaagu

SEQ ID NO: 4077034 - RNA, 17 nt, Streptococcus pneumoniae R6
gauucgucauuuguuuu

SEQ ID NO: 4077035 - RNA, 19 nt, Streptococcus pneumoniae R6
gauucgucauuuguuuuag

SEQ ID NO: 4077036 - RNA, 19 nt, Streptococcus pneumoniae R6
gauucuacucuguuuucac

SEQ ID NO: 4077037 - RNA, 13 nt, Streptococcus pneumoniae R6
gauucucagguuu

SEQ ID NO: 4077038 - RNA, 13 nt, Streptococcus pneumoniae R6
gauucuuauaaau

SEQ ID NO: 4077039 - RNA, 12 nt, Streptococcus pneumoniae R6
gauucuuuucaa

SEQ ID NO: 4077040 - RNA, 14 nt, Streptococcus pneumoniae R6
gauugaaacuggaa

SEQ ID NO: 4077041 - RNA, 12 nt, Streptococcus pneumoniae R6
gauugaaauaac

SEQ ID NO: 4077042 - RNA, 14 nt, Streptococcus pneumoniae R6
gauugaaauaagau

SEQ ID NO: 4077043 - RNA, 22 nt, Streptococcus pneumoniae R6
gauugaaauaagauaugaacaa

SEQ ID NO: 4077044 - RNA, 12 nt, Streptococcus pneumoniae R6
gauugagaagcc

SEQ ID NO: 4077045 - RNA, 20 nt, Streptococcus pneumoniae R6
gauugagagcgacuuuuucu

SEQ ID NO: 4077046 - RNA, 17 nt, Streptococcus pneumoniae R6
gauugauaucuggauuu

SEQ ID NO: 4077047 - RNA, 18 nt, Streptococcus pneumoniae R6
gauugcaagcccuuauuu

SEQ ID NO: 4077048 - RNA, 20 nt, Streptococcus pneumoniae R6
gauugcuccgaucuuucaau

SEQ ID NO: 4077049 - RNA, 14 nt, Streptococcus pneumoniae R6
gauugcuuuccaau

SEQ ID NO: 4077050 - RNA, 17 nt, Streptococcus pneumoniae R6
gauugcuuuccaauaau

SEQ ID NO: 4077051 - RNA, 19 nt, Streptococcus pneumoniae R6
gauuggagauacuuuuuuc

SEQ ID NO: 4077052 - RNA, 19 nt, Streptococcus pneumoniae R6
gauuggauaguuuuucccg

SEQ ID NO: 4077053 - RNA, 22 nt, Streptococcus pneumoniae R6
gauuggccgcaagcagcuaaaa

SEQ ID NO: 4077054 - RNA, 19 nt, Streptococcus pneumoniae R6
gauuggcuuugacuuaaau

SEQ ID NO: 4077055 - RNA, 21 nt, Streptococcus pneumoniae R6
gauugggaaaguaaaauuaau

SEQ ID NO: 4077056 - RNA, 18 nt, Streptococcus pneumoniae R6
gauuggucaaucuuaucu

SEQ ID NO: 4077057 - RNA, 23 nt, Streptococcus pneumoniae R6
gauuggugcuaauucuuugacaa

SEQ ID NO: 4077058 - RNA, 13 nt, Streptococcus pneumoniae R6
gauugguucugcu

SEQ ID NO: 4077059 - RNA, 23 nt, Streptococcus pneumoniae R6
gauuguagguguaaacuuuauau

SEQ ID NO: 4077060 - RNA, 18 nt, Streptococcus pneumoniae R6
gauugucaucaucuugcu

SEQ ID NO: 4077061 - RNA, 17 nt, Streptococcus pneumoniae R6
gauugugauagcaguag

SEQ ID NO: 4077062 - RNA, 15 nt, Streptococcus pneumoniae R6
gcaaacuaggaaacc

SEQ ID NO: 4077063 - RNA, 21 nt, Streptococcus pneumoniae R6
gcaaacuaugucggcuucaca

SEQ ID NO: 4077064 - RNA, 13 nt, Streptococcus pneumoniae R6
gcaaagaggaaga

SEQ ID NO: 4077065 - RNA, 22 nt, Streptococcus pneumoniae R6
gcaaagagucccuuagaaaaac

SEQ ID NO: 4077066 - RNA, 14 nt, Streptococcus pneumoniae R6
gcaaagcaaucuaa

SEQ ID NO: 4077067 - RNA, 21 nt, Streptococcus pneumoniae R6
gcaaagcuaaauccuuuuuuc

SEQ ID NO: 4077068 - RNA, 20 nt, Streptococcus pneumoniae R6
gcaaaggcaugggccccagc

SEQ ID NO: 4077069 - RNA, 15 nt, Streptococcus pneumoniae R6
gcaaaguccuuacuc

SEQ ID NO: 4077070 - RNA, 20 nt, Streptococcus pneumoniae R6
gcaaaguccuuacucaaaua

SEQ ID NO: 4077071 - RNA, 23 nt, Streptococcus pneumoniae R6
gcaaaguccuuacucaaauaaaa

SEQ ID NO: 4077072 - RNA, 20 nt, Streptococcus pneumoniae R6
gcaaaguuuuugguaauuuu

SEQ ID NO: 4077073 - RNA, 15 nt, Streptococcus pneumoniae R6
gcaaauaagaaaucu

SEQ ID NO: 4077074 - RNA, 24 nt, Streptococcus pneumoniae R6
gcaaauagcaguaacuucugucua

SEQ ID NO: 4077075 - RNA, 15 nt, Streptococcus pneumoniae R6
gcaaaucaacuggca

SEQ ID NO: 4077076 - RNA, 14 nt, Streptococcus pneumoniae R6
gcaaauuauuuaca

SEQ ID NO: 4077077 - RNA, 21 nt, Streptococcus pneumoniae R6
gcaaauuauuuacagaaagaa

SEQ ID NO: 4077078 - RNA, 23 nt, Streptococcus pneumoniae R6
gcaaauuauuuacagaaagaaca

SEQ ID NO: 4077079 - RNA, 13 nt, Streptococcus pneumoniae R6
gcaaauucuguca

SEQ ID NO: 4077080 - RNA, 18 nt, Streptococcus pneumoniae R6
gcaaauuuaaucgcuugg

SEQ ID NO: 4077081 - RNA, 16 nt, Streptococcus pneumoniae R6
gcaaauuuauaaaucu

SEQ ID NO: 4077082 - RNA, 21 nt, Streptococcus pneumoniae R6
gcaaauuucaugacagauuca

SEQ ID NO: 4077083 - RNA, 22 nt, Streptococcus pneumoniae R6
gcaaauuugaccauuucaaccu

SEQ ID NO: 4077084 - RNA, 21 nt, Streptococcus pneumoniae R6
gcaacaaaguaaccaucugua

SEQ ID NO: 4077085 - RNA, 14 nt, Streptococcus pneumoniae R6
gcaacaaccugcac

SEQ ID NO: 4077086 - RNA, 20 nt, Streptococcus pneumoniae R6
gcaacagcuggaaucacauu

SEQ ID NO: 4077087 - RNA, 15 nt, Streptococcus pneumoniae R6
gcaaccucaaaacag

SEQ ID NO: 4077088 - RNA, 14 nt, Streptococcus pneumoniae R6
gcaaccuuaaaaca

SEQ ID NO: 4077089 - RNA, 17 nt, Streptococcus pneumoniae R6
gcaacguuaaagaguug

SEQ ID NO: 4077090 - RNA, 22 nt, Streptococcus pneumoniae R6
gcaacuaaaaucauagcaggaa

SEQ ID NO: 4077091 - RNA, 22 nt, Streptococcus pneumoniae R6
gcaacuauaagauacuauggca

SEQ ID NO: 4077092 - RNA, 19 nt, Streptococcus pneumoniae R6
gcaacuguuuuuucaacag

SEQ ID NO: 4077093 - RNA, 17 nt, Streptococcus pneumoniae R6
gcaacuugguaauaccu

SEQ ID NO: 4077094 - RNA, 21 nt, Streptococcus pneumoniae R6
gcaacuuguuuuuccugauua

SEQ ID NO: 4077095 - RNA, 17 nt, Streptococcus pneumoniae R6
gcaagacgaagcugaca

SEQ ID NO: 4077096 - RNA, 21 nt, Streptococcus pneumoniae R6
gcaagacgaagcugacaugau

SEQ ID NO: 4077097 - RNA, 14 nt, Streptococcus pneumoniae R6
gcaagagggcuuca

SEQ ID NO: 4077098 - RNA, 14 nt, Streptococcus pneumoniae R6
gcaagauauucauu

SEQ ID NO: 4077099 - RNA, 14 nt, Streptococcus pneumoniae R6
gcaagaucaaguuc

SEQ ID NO: 4077100 - RNA, 20 nt, Streptococcus pneumoniae R6
gcaagcuugaaacaaauaaa

SEQ ID NO: 4077101 - RNA, 17 nt, Streptococcus pneumoniae R6
gcaaggaugccagccuu

SEQ ID NO: 4077102 - RNA, 15 nt, Streptococcus pneumoniae R6
gcaaggcaagacuga

SEQ ID NO: 4077103 - RNA, 20 nt, Streptococcus pneumoniae R6
gcaaggcuagugggagugga

SEQ ID NO: 4077104 - RNA, 19 nt, Streptococcus pneumoniae R6
gcaagguagagacagaaga

SEQ ID NO: 4077105 - RNA, 15 nt, Streptococcus pneumoniae R6
gcaaggucaauaaca

SEQ ID NO: 4077106 - RNA, 17 nt, Streptococcus pneumoniae R6
gcaaguccuacccacug

SEQ ID NO: 4077107 - RNA, 16 nt, Streptococcus pneumoniae R6
gcaagucuagacugau

SEQ ID NO: 4077108 - RNA, 14 nt, Streptococcus pneumoniae R6
gcaagugcuaagau

SEQ ID NO: 4077109 - RNA, 14 nt, Streptococcus pneumoniae R6
gcaauacagaacua

SEQ ID NO: 4077110 - RNA, 18 nt, Streptococcus pneumoniae R6
gcaaucaagguuuccaaa

SEQ ID NO: 4077111 - RNA, 17 nt, Streptococcus pneumoniae R6
gcaaucacucuaacuuc

SEQ ID NO: 4077112 - RNA, 17 nt, Streptococcus pneumoniae R6
gcaaucauaccugcauu

SEQ ID NO: 4077113 - RNA, 17 nt, Streptococcus pneumoniae R6
gcaaucauugcaaagga

SEQ ID NO: 4077114 - RNA, 18 nt, Streptococcus pneumoniae R6
gcaaucguugucaaguuu

SEQ ID NO: 4077115 - RNA, 18 nt, Streptococcus pneumoniae R6
gcaaucucacguaacaua

SEQ ID NO: 4077116 - RNA, 22 nt, Streptococcus pneumoniae R6
gcaaucucuguuaagaaauaaa

SEQ ID NO: 4077117 - RNA, 17 nt, Streptococcus pneumoniae R6
gcaaucuuauccacaac

SEQ ID NO: 4077118 - RNA, 22 nt, Streptococcus pneumoniae R6
gcaaucuuugcgaaguauucaa

SEQ ID NO: 4077119 - RNA, 13 nt, Streptococcus pneumoniae R6
gcaauucaauuau

SEQ ID NO: 4077120 - RNA, 20 nt, Streptococcus pneumoniae R6
gcaauucuugguugccuuuu

SEQ ID NO: 4077121 - RNA, 19 nt, Streptococcus pneumoniae R6
gcaauuucgauaauaccua

SEQ ID NO: 4077122 - RNA, 22 nt, Streptococcus pneumoniae R6
gcaauuucuuuauauaaaaaga

SEQ ID NO: 4077123 - RNA, 18 nt, Streptococcus pneumoniae R6
gcaauuuuacuucuuccc

SEQ ID NO: 4077124 - RNA, 15 nt, Streptococcus pneumoniae R6
gcaauuuugaaagau

SEQ ID NO: 4077125 - RNA, 15 nt, Streptococcus pneumoniae R6
gcacaaaaggcucau

SEQ ID NO: 4077126 - RNA, 12 nt, Streptococcus pneumoniae R6
gcacaaacuuca

SEQ ID NO: 4077127 - RNA, 15 nt, Streptococcus pneumoniae R6
gcacagaaacaccuu

SEQ ID NO: 4077128 - RNA, 20 nt, Streptococcus pneumoniae R6
gcaccaacucgggcugaaua

SEQ ID NO: 4077129 - RNA, 19 nt, Streptococcus pneumoniae R6
gcaccauuuucagcccaga

SEQ ID NO: 4077130 - RNA, 16 nt, Streptococcus pneumoniae R6
gcaccgaauuuuucaa

SEQ ID NO: 4077131 - RNA, 21 nt, Streptococcus pneumoniae R6
gcaccggcaucggauacagac

SEQ ID NO: 4077132 - RNA, 17 nt, Streptococcus pneumoniae R6
gcaccuacaacauagac

SEQ ID NO: 4077133 - RNA, 22 nt, Streptococcus pneumoniae R6
gcaccucacggagcgagacaaa

SEQ ID NO: 4077134 - RNA, 16 nt, Streptococcus pneumoniae R6
gcaccugauuucuccg

SEQ ID NO: 4077135 - RNA, 21 nt, Streptococcus pneumoniae R6
gcaccuuuguauggaaacuca

SEQ ID NO: 4077136 - RNA, 23 nt, Streptococcus pneumoniae R6
gcaccuuuguauggaaacucaaa

SEQ ID NO: 4077137 - RNA, 22 nt, Streptococcus pneumoniae R6
gcaccuuuugcgucuucuacaa

SEQ ID NO: 4077138 - RNA, 23 nt, Streptococcus pneumoniae R6
gcacggacaccgcggucacggag

SEQ ID NO: 4077139 - RNA, 13 nt, Streptococcus pneumoniae R6
gcacggagaacaa

SEQ ID NO: 4077140 - RNA, 18 nt, Streptococcus pneumoniae R6
gcacggagaaucuucccg

SEQ ID NO: 4077141 - RNA, 23 nt, Streptococcus pneumoniae R6
gcacggaucuugaacugcauuuu

SEQ ID NO: 4077142 - RNA, 14 nt, Streptococcus pneumoniae R6
gcacggugauuuuu

SEQ ID NO: 4077143 - RNA, 20 nt, Streptococcus pneumoniae R6
gcacggugcuugggaaugau

SEQ ID NO: 4077144 - RNA, 16 nt, Streptococcus pneumoniae R6
gcacgugcucaaaaca

SEQ ID NO: 4077145 - RNA, 17 nt, Streptococcus pneumoniae R6
gcacuaguaaucgguag

SEQ ID NO: 4077146 - RNA, 18 nt, Streptococcus pneumoniae R6
gcacugcuagcaucaucg

SEQ ID NO: 4077147 - RNA, 15 nt, Streptococcus pneumoniae R6
gcacuucuuuuuguu

SEQ ID NO: 4077148 - RNA, 23 nt, Streptococcus pneumoniae R6
gcacuucuuuuuguucaaaauua

SEQ ID NO: 4077149 - RNA, 15 nt, Streptococcus pneumoniae R6
gcacuugaugaaaaa

SEQ ID NO: 4077150 - RNA, 18 nt, Streptococcus pneumoniae R6
gcagaaccccgauaacag

SEQ ID NO: 4077151 - RNA, 22 nt, Streptococcus pneumoniae R6
gcagaauacucuuucaguuuca

SEQ ID NO: 4077152 - RNA, 23 nt, Streptococcus pneumoniae R6
gcagaauacucuuucaguuucau

SEQ ID NO: 4077153 - RNA, 22 nt, Streptococcus pneumoniae R6
gcagaccauaaggauagauccc

SEQ ID NO: 4077154 - RNA, 14 nt, Streptococcus pneumoniae R6
gcagagaaagaaaa

SEQ ID NO: 4077155 - RNA, 16 nt, Streptococcus pneumoniae R6
gcagagacauuagaaa

SEQ ID NO: 4077156 - RNA, 14 nt, Streptococcus pneumoniae R6
gcagagcuaaaaac

SEQ ID NO: 4077157 - RNA, 19 nt, Streptococcus pneumoniae R6
gcagagcuaaaaacuucug

SEQ ID NO: 4077158 - RNA, 15 nt, Streptococcus pneumoniae R6
gcagaggcaaugaca

SEQ ID NO: 4077159 - RNA, 15 nt, Streptococcus pneumoniae R6
gcagaguggucaaac

SEQ ID NO: 4077160 - RNA, 23 nt, Streptococcus pneumoniae R6
gcagaguuuuuaucuagcucccu

SEQ ID NO: 4077161 - RNA, 17 nt, Streptococcus pneumoniae R6
gcagauaagacugacga

SEQ ID NO: 4077162 - RNA, 18 nt, Streptococcus pneumoniae R6
gcagaugcaaaagucagg

SEQ ID NO: 4077163 - RNA, 15 nt, Streptococcus pneumoniae R6
gcagauugcucaaaa

SEQ ID NO: 4077164 - RNA, 23 nt, Streptococcus pneumoniae R6
gccauauuagccaagcuaguaca

SEQ ID NO: 4077165 - RNA, 20 nt, Streptococcus pneumoniae R6
gccaugacaccguaagauag

SEQ ID NO: 4077166 - RNA, 15 nt, Streptococcus pneumoniae R6
gccauuaaucagaua

SEQ ID NO: 4077167 - RNA, 16 nt, Streptococcus pneumoniae R6
gccauugaaaauccug

SEQ ID NO: 4077168 - RNA, 21 nt, Streptococcus pneumoniae R6
gccauuggacaccgagaaagg

SEQ ID NO: 4077169 - RNA, 16 nt, Streptococcus pneumoniae R6
gccauuguauccugaa

SEQ ID NO: 4077170 - RNA, 22 nt, Streptococcus pneumoniae R6
gccauuguauccugaaaagcca

SEQ ID NO: 4077171 - RNA, 21 nt, Streptococcus pneumoniae R6
gcccaaccacuucgucuugua

SEQ ID NO: 4077172 - RNA, 13 nt, Streptococcus pneumoniae R6
gcccaauucuuga

SEQ ID NO: 4077173 - RNA, 15 nt, Streptococcus pneumoniae R6
gcccaauucuugagc

SEQ ID NO: 4077174 - RNA, 15 nt, Streptococcus pneumoniae R6
gcccaccugcuuaau

SEQ ID NO: 4077175 - RNA, 14 nt, Streptococcus pneumoniae R6
gcccacuaaaaaua

SEQ ID NO: 4077176 - RNA, 16 nt, Streptococcus pneumoniae R6
gcccauacgcccucca

SEQ ID NO: 4077177 - RNA, 19 nt, Streptococcus pneumoniae R6
gcccauacgcccuccauua

SEQ ID NO: 4077178 - RNA, 15 nt, Streptococcus pneumoniae R6
gcccaucauuccuga

SEQ ID NO: 4077179 - RNA, 13 nt, Streptococcus pneumoniae R6
gcccauguuuucu

SEQ ID NO: 4077180 - RNA, 15 nt, Streptococcus pneumoniae R6
gccccauuucuucag

SEQ ID NO: 4077181 - RNA, 15 nt, Streptococcus pneumoniae R6
gcccccaucuccuug

SEQ ID NO: 4077182 - RNA, 14 nt, Streptococcus pneumoniae R6
gccccuaugcuuuc

SEQ ID NO: 4077183 - RNA, 13 nt, Streptococcus pneumoniae R6
gccccuucaaggu

SEQ ID NO: 4077184 - RNA, 18 nt, Streptococcus pneumoniae R6
gcccgaaaaauuucucug

SEQ ID NO: 4077185 - RNA, 16 nt, Streptococcus pneumoniae R6
gcccuauccgcaaccu

SEQ ID NO: 4077186 - RNA, 16 nt, Streptococcus pneumoniae R6
gcccucuaaauacaaa

SEQ ID NO: 4077187 - RNA, 16 nt, Streptococcus pneumoniae R6
gcccuuauuuccaucu

SEQ ID NO: 4077188 - RNA, 15 nt, Streptococcus pneumoniae R6
gcccuucggauaaaa

SEQ ID NO: 4077189 - RNA, 15 nt, Streptococcus pneumoniae R6
gcccuuguucuccaa

SEQ ID NO: 4077190 - RNA, 13 nt, Streptococcus pneumoniae R6
gcccuuuuuucuc

SEQ ID NO: 4077191 - RNA, 20 nt, Streptococcus pneumoniae R6
gccgaacuuuugaauuucau

SEQ ID NO: 4077192 - RNA, 13 nt, Streptococcus pneumoniae R6
gccgauucccaaa

SEQ ID NO: 4077193 - RNA, 23 nt, Streptococcus pneumoniae R6
gccgcaaacuuggucgcugagua

SEQ ID NO: 4077194 - RNA, 18 nt, Streptococcus pneumoniae R6
gccggguuuuccaccagu

SEQ ID NO: 4077195 - RNA, 16 nt, Streptococcus pneumoniae R6
gccguugauuuaacaa

SEQ ID NO: 4077196 - RNA, 18 nt, Streptococcus pneumoniae R6
gccuaaacacuucacuaa

SEQ ID NO: 4077197 - RNA, 14 nt, Streptococcus pneumoniae R6
gccuaauuuuucaa

SEQ ID NO: 4077198 - RNA, 18 nt, Streptococcus pneumoniae R6
gccuaccugcggauaaaa

SEQ ID NO: 4077199 - RNA, 21 nt, Streptococcus pneumoniae R6
gccuaucguagcuuuucuuau

SEQ ID NO: 4077200 - RNA, 20 nt, Streptococcus pneumoniae R6
gccucacuaucgaaaaauau

SEQ ID NO: 4077201 - RNA, 14 nt, Streptococcus pneumoniae R6
gccucauaucuguc

SEQ ID NO: 4077202 - RNA, 17 nt, Streptococcus pneumoniae R6
gccucauaucugucuug

SEQ ID NO: 4077203 - RNA, 15 nt, Streptococcus pneumoniae R6
gccuccaagaaagag

SEQ ID NO: 4077204 - RNA, 22 nt, Streptococcus pneumoniae R6
gccucccacuaucuaaaaaaau

SEQ ID NO: 4077205 - RNA, 16 nt, Streptococcus pneumoniae R6
gccucugcacuagcuu

SEQ ID NO: 4077206 - RNA, 11 nt, Streptococcus pneumoniae R6
gccucuuucuu

SEQ ID NO: 4077207 - RNA, 12 nt, Streptococcus pneumoniae R6
gccucuuucuug

SEQ ID NO: 4077208 - RNA, 23 nt, Streptococcus pneumoniae R6
gccucuuucuugucguugaaaaa

SEQ ID NO: 4077209 - RNA, 22 nt, Streptococcus pneumoniae R6
gccugauaacgaagagcuggcu

SEQ ID NO: 4077210 - RNA, 21 nt, Streptococcus pneumoniae R6
gccugcucaccaucuuccgca

SEQ ID NO: 4077211 - RNA, 14 nt, Streptococcus pneumoniae R6
gccugcuuuuucaa

SEQ ID NO: 4077212 - RNA, 18 nt, Streptococcus pneumoniae R6
gccugcuuuuucaagcau

SEQ ID NO: 4077213 - RNA, 14 nt, Streptococcus pneumoniae R6
gccugcuuuuugca

SEQ ID NO: 4077214 - RNA, 16 nt, Streptococcus pneumoniae R6
gccuggauagguugca

SEQ ID NO: 4077215 - RNA, 21 nt, Streptococcus pneumoniae R6
gccuggguaacaacucaauuu

SEQ ID NO: 4077216 - RNA, 15 nt, Streptococcus pneumoniae R6
gccuguaaaaaguga

SEQ ID NO: 4077217 - RNA, 23 nt, Streptococcus pneumoniae R6
gccuguaaaaagugaaaggaaga

SEQ ID NO: 4077218 - RNA, 20 nt, Streptococcus pneumoniae R6
gccuguacuagggcauuuug

SEQ ID NO: 4077219 - RNA, 17 nt, Streptococcus pneumoniae R6
gccugugauuuucuuau

SEQ ID NO: 4077220 - RNA, 23 nt, Streptococcus pneumoniae R6
gccuuaaaaaaccaauucccaaa

SEQ ID NO: 4077221 - RNA, 21 nt, Streptococcus pneumoniae R6
gccuuaccaccuuuaaauccu

SEQ ID NO: 4077222 - RNA, 19 nt, Streptococcus pneumoniae R6
gccuuaucaacugccuggu

SEQ ID NO: 4077223 - RNA, 13 nt, Streptococcus pneumoniae R6
gccuucaacaccg

SEQ ID NO: 4077224 - RNA, 19 nt, Streptococcus pneumoniae R6
gccuucagcccaaccagcu

SEQ ID NO: 4077225 - RNA, 20 nt, Streptococcus pneumoniae R6
gccuucauaaaagucuggcu

SEQ ID NO: 4077226 - RNA, 14 nt, Streptococcus pneumoniae R6
gccuuccaagauaa

SEQ ID NO: 4077227 - RNA, 21 nt, Streptococcus pneumoniae R6
gccuuccauauagucuuucaa

SEQ ID NO: 4077228 - RNA, 19 nt, Streptococcus pneumoniae R6
gccuuccuugucuauccag

SEQ ID NO: 4077229 - RNA, 16 nt, Streptococcus pneumoniae R6
gccuucuacuuccugc

SEQ ID NO: 4077230 - RNA, 14 nt, Streptococcus pneumoniae R6
gccuucuuccaucu

SEQ ID NO: 4077231 - RNA, 18 nt, Streptococcus pneumoniae R6
gccuugaccagaaauaaa

SEQ ID NO: 4077232 - RNA, 16 nt, Streptococcus pneumoniae R6
gccuuguagaugaaaa

SEQ ID NO: 4077233 - RNA, 23 nt, Streptococcus pneumoniae R6
gccuugucccaucauuccuucaa

SEQ ID NO: 4077234 - RNA, 17 nt, Streptococcus pneumoniae R6
gccuuuuucuucuuauc

SEQ ID NO: 4077235 - RNA, 16 nt, Streptococcus pneumoniae R6
gcgaaaggagaaaaaa

SEQ ID NO: 4077236 - RNA, 20 nt, Streptococcus pneumoniae R6
gcgaaaucauuugaaucaaa

SEQ ID NO: 4077237 - RNA, 14 nt, Streptococcus pneumoniae R6
gcgaacaucuccaa

SEQ ID NO: 4077238 - RNA, 18 nt, Streptococcus pneumoniae R6
gcgaacaucuccaacugc

SEQ ID NO: 4077239 - RNA, 22 nt, Streptococcus pneumoniae R6
gcgacauugacugagucacguu

SEQ ID NO: 4077240 - RNA, 16 nt, Streptococcus pneumoniae R6
gcgaccaagagcaaaa

SEQ ID NO: 4077241 - RNA, 15 nt, Streptococcus pneumoniae R6
gcgacguuuucuccu

SEQ ID NO: 4077242 - RNA, 13 nt, Streptococcus pneumoniae R6
gcgacucccucuu

SEQ ID NO: 4077243 - RNA, 21 nt, Streptococcus pneumoniae R6
gcgacugggauuccuuuuugc

SEQ ID NO: 4077244 - RNA, 20 nt, Streptococcus pneumoniae R6
gcgagagcuuugacauccuu

SEQ ID NO: 4077245 - RNA, 23 nt, Streptococcus pneumoniae R6
gcgaguugcauagcgaagaacaa

SEQ ID NO: 4077246 - RNA, 15 nt, Streptococcus pneumoniae R6
gcgauaaaaauccuu

SEQ ID NO: 4077247 - RNA, 17 nt, Streptococcus pneumoniae R6
gcgauacgaucugaaau

SEQ ID NO: 4077248 - RNA, 13 nt, Streptococcus pneumoniae R6
gcgauaugguagg

SEQ ID NO: 4077249 - RNA, 23 nt, Streptococcus pneumoniae R6
gcgaucaaccgauuuaagauaag

SEQ ID NO: 4077250 - RNA, 17 nt, Streptococcus pneumoniae R6
gcgaucuggcaggcuga

SEQ ID NO: 4077251 - RNA, 20 nt, Streptococcus pneumoniae R6
gcgauuaggggggcuauucu

SEQ ID NO: 4077252 - RNA, 20 nt, Streptococcus pneumoniae R6
gcgauuuacaucuucucugg

SEQ ID NO: 4077253 - RNA, 21 nt, Streptococcus pneumoniae R6
gcgauuuacaucuucucuggc

SEQ ID NO: 4077254 - RNA, 13 nt, Streptococcus pneumoniae R6
gcgauuucuucac

SEQ ID NO: 4077255 - RNA, 22 nt, Streptococcus pneumoniae R6
gcgauuucuucacggcuaauac

SEQ ID NO: 4077256 - RNA, 16 nt, Streptococcus pneumoniae R6
gcgauuuuaggauacu

SEQ ID NO: 4077257 - RNA, 20 nt, Streptococcus pneumoniae R6
gcgcaaauccgaaaaucacu

SEQ ID NO: 4077258 - RNA, 19 nt, Streptococcus pneumoniae R6
gcgcaacacacuguuuuga

SEQ ID NO: 4077259 - RNA, 17 nt, Streptococcus pneumoniae R6
gcgcaucaacaugguau

SEQ ID NO: 4077260 - RNA, 23 nt, Streptococcus pneumoniae R6
gcgccagagcaaugauagacauu

SEQ ID NO: 4077261 - RNA, 20 nt, Streptococcus pneumoniae R6
gcgccaguuacccgaccuaa

SEQ ID NO: 4077262 - RNA, 19 nt, Streptococcus pneumoniae R6
gcgcccugcaaucauugca

SEQ ID NO: 4077263 - RNA, 17 nt, Streptococcus pneumoniae R6
gcgcccuuguucuccaa

SEQ ID NO: 4077264 - RNA, 15 nt, Streptococcus pneumoniae R6
gcgcgcuugaaugau

SEQ ID NO: 4077265 - RNA, 17 nt, Streptococcus pneumoniae R6
gcgcucgcuuuucaccu

SEQ ID NO: 4077266 - RNA, 22 nt, Streptococcus pneumoniae R6
gcucuucuggcagauagauggu

SEQ ID NO: 4077267 - RNA, 16 nt, Streptococcus pneumoniae R6
gcucuuggucauccau

SEQ ID NO: 4077268 - RNA, 18 nt, Streptococcus pneumoniae R6
gcucuuuagucccagcuu

SEQ ID NO: 4077269 - RNA, 18 nt, Streptococcus pneumoniae R6
gcucuuugauuuucauug

SEQ ID NO: 4077270 - RNA, 15 nt, Streptococcus pneumoniae R6
gcucuuugucaacug

SEQ ID NO: 4077271 - RNA, 16 nt, Streptococcus pneumoniae R6
gcucuuugucaacugu

SEQ ID NO: 4077272 - RNA, 15 nt, Streptococcus pneumoniae R6
gcugaacgacucacu

SEQ ID NO: 4077273 - RNA, 21 nt, Streptococcus pneumoniae R6
gcugaaggaaugccaaagaca

SEQ ID NO: 4077274 - RNA, 18 nt, Streptococcus pneumoniae R6
gcugaauauauucuccag

SEQ ID NO: 4077275 - RNA, 19 nt, Streptococcus pneumoniae R6
gcugacgcgaucuggcagg

SEQ ID NO: 4077276 - RNA, 23 nt, Streptococcus pneumoniae R6
gcugacugauuuacaaauauuca

SEQ ID NO: 4077277 - RNA, 22 nt, Streptococcus pneumoniae R6
gcugacuucgucagucuuaucu

SEQ ID NO: 4077278 - RNA, 21 nt, Streptococcus pneumoniae R6
gcugacuucgucaguucuauc

SEQ ID NO: 4077279 - RNA, 23 nt, Streptococcus pneumoniae R6
gcugacuucgucaguucuaucca

SEQ ID NO: 4077280 - RNA, 22 nt, Streptococcus pneumoniae R6
gcugacuucgucaguucuaucu

SEQ ID NO: 4077281 - RNA, 23 nt, Streptococcus pneumoniae R6
gcugacuucgucaguucuaucug

SEQ ID NO: 4077282 - RNA, 16 nt, Streptococcus pneumoniae R6
gcugagcuaaggaggc

SEQ ID NO: 4077283 - RNA, 22 nt, Streptococcus pneumoniae R6
gcugagcucuuuagucccagcu

SEQ ID NO: 4077284 - RNA, 13 nt, Streptococcus pneumoniae R6
gcugcaauaaucu

SEQ ID NO: 4077285 - RNA, 18 nt, Streptococcus pneumoniae R6
gcugcaccuucaacugca

SEQ ID NO: 4077286 - RNA, 15 nt, Streptococcus pneumoniae R6
gcugcacggacuucu

SEQ ID NO: 4077287 - RNA, 13 nt, Streptococcus pneumoniae R6
gcugcagcugagg

SEQ ID NO: 4077288 - RNA, 19 nt, Streptococcus pneumoniae R6
gcugcaggcugcucaaaac

SEQ ID NO: 4077289 - RNA, 22 nt, Streptococcus pneumoniae R6
gcugccauuugacgaacaaaaa

SEQ ID NO: 4077290 - RNA, 13 nt, Streptococcus pneumoniae R6
gcugcgauaagga

SEQ ID NO: 4077291 - RNA, 15 nt, Streptococcus pneumoniae R6
gcugcucaaaacacu

SEQ ID NO: 4077292 - RNA, 22 nt, Streptococcus pneumoniae R6
gcuggacaaaaacucaauuuca

SEQ ID NO: 4077293 - RNA, 20 nt, Streptococcus pneumoniae R6
gcuggagagacuugcucaag

SEQ ID NO: 4077294 - RNA, 19 nt, Streptococcus pneumoniae R6
gcuggauagaguagucugg

SEQ ID NO: 4077295 - RNA, 20 nt, Streptococcus pneumoniae R6
gcuggauagaguagucuggg

SEQ ID NO: 4077296 - RNA, 19 nt, Streptococcus pneumoniae R6
gcuggaucagcuuuuucag

SEQ ID NO: 4077297 - RNA, 11 nt, Streptococcus pneumoniae R6
gcuggcuacag

SEQ ID NO: 4077298 - RNA, 21 nt, Streptococcus pneumoniae R6
gcuggcuugaggucccaugcu

SEQ ID NO: 4077299 - RNA, 23 nt, Streptococcus pneumoniae R6
gcuggucacgaccagaaaaucau

SEQ ID NO: 4077300 - RNA, 16 nt, Streptococcus pneumoniae R6
gcuguccucaaaauga

SEQ ID NO: 4077301 - RNA, 16 nt, Streptococcus pneumoniae R6
gcugugauaaugguug

SEQ ID NO: 4077302 - RNA, 22 nt, Streptococcus pneumoniae R6
gcugugauaaugguugggaagg

SEQ ID NO: 4077303 - RNA, 16 nt, Streptococcus pneumoniae R6
gcugugcuuugagcaa

SEQ ID NO: 4077304 - RNA, 20 nt, Streptococcus pneumoniae R6
gcuguuagaagacuuuuguu

SEQ ID NO: 4077305 - RNA, 16 nt, Streptococcus pneumoniae R6
gcuguucuuuuuuguu

SEQ ID NO: 4077306 - RNA, 21 nt, Streptococcus pneumoniae R6
gcuguucuuuuuuguuucuug

SEQ ID NO: 4077307 - RNA, 14 nt, Streptococcus pneumoniae R6
gcuguuucaaauga

SEQ ID NO: 4077308 - RNA, 12 nt, Streptococcus pneumoniae R6
gcuguuucuaua

SEQ ID NO: 4077309 - RNA, 22 nt, Streptococcus pneumoniae R6
gcuuaagugcguugauaaucuu

SEQ ID NO: 4077310 - RNA, 16 nt, Streptococcus pneumoniae R6
gcuuaauuucuaucag

SEQ ID NO: 4077311 - RNA, 19 nt, Streptococcus pneumoniae R6
gcuuacaucaaaaacaucu

SEQ ID NO: 4077312 - RNA, 14 nt, Streptococcus pneumoniae R6
gcuuacaucauccc

SEQ ID NO: 4077313 - RNA, 22 nt, Streptococcus pneumoniae R6
gcuuagaaauaucugcacucuc

SEQ ID NO: 4077314 - RNA, 13 nt, Streptococcus pneumoniae R6
gcuuagcuuuucu

SEQ ID NO: 4077315 - RNA, 23 nt, Streptococcus pneumoniae R6
gcuuauaaucuggcgucuuaccu

SEQ ID NO: 4077316 - RNA, 22 nt, Streptococcus pneumoniae R6
gcuuauuuuugcaagugcucca

SEQ ID NO: 4077317 - RNA, 14 nt, Streptococcus pneumoniae R6
gcuucaaaaaaguc

SEQ ID NO: 4077318 - RNA, 14 nt, Streptococcus pneumoniae R6
gcuucaaaucccau

SEQ ID NO: 4077319 - RNA, 12 nt, Streptococcus pneumoniae R6
gcuucacauugc

SEQ ID NO: 4077320 - RNA, 15 nt, Streptococcus pneumoniae R6
gcuucagcgauuucu

SEQ ID NO: 4077321 - RNA, 18 nt, Streptococcus pneumoniae R6
gcuucaguuagagcgagu

SEQ ID NO: 4077322 - RNA, 16 nt, Streptococcus pneumoniae R6
gcuucaucuccuguca

SEQ ID NO: 4077323 - RNA, 13 nt, Streptococcus pneumoniae R6
gcuucaucuuuca

SEQ ID NO: 4077324 - RNA, 18 nt, Streptococcus pneumoniae R6
gcuucauuuaucuucuua

SEQ ID NO: 4077325 - RNA, 15 nt, Streptococcus pneumoniae R6
gcuuccaaaaauucu

SEQ ID NO: 4077326 - RNA, 14 nt, Streptococcus pneumoniae R6
gcuuccaauuuuug

SEQ ID NO: 4077327 - RNA, 21 nt, Streptococcus pneumoniae R6
gcuuccccauucuauggaauc

SEQ ID NO: 4077328 - RNA, 16 nt, Streptococcus pneumoniae R6
gcuucgggaacaugga

SEQ ID NO: 4077329 - RNA, 23 nt, Streptococcus pneumoniae R6
gcuucuaagaucugguuaaaauu

SEQ ID NO: 4077330 - RNA, 18 nt, Streptococcus pneumoniae R6
gcuucuuacgaaugaguu

SEQ ID NO: 4077331 - RNA, 19 nt, Streptococcus pneumoniae R6
gcuucuugcauucguucuu

SEQ ID NO: 4077332 - RNA, 22 nt, Streptococcus pneumoniae R6
gcuucuuuauguucaucuucuu

SEQ ID NO: 4077333 - RNA, 18 nt, Streptococcus pneumoniae R6
gcuucuuuuuuuacuaaa

SEQ ID NO: 4077334 - RNA, 13 nt, Streptococcus pneumoniae R6
gcuugaaacaaau

SEQ ID NO: 4077335 - RNA, 14 nt, Streptococcus pneumoniae R6
gcuugaaacaaaua

SEQ ID NO: 4077336 - RNA, 23 nt, Streptococcus pneumoniae R6
gcuugaaacucaucuuggucagg

SEQ ID NO: 4077337 - RNA, 19 nt, Streptococcus pneumoniae R6
gcuugaaugauaaaacaua

SEQ ID NO: 4077338 - RNA, 16 nt, Streptococcus pneumoniae R6
gcuugaccugauaguu

SEQ ID NO: 4077339 - RNA, 15 nt, Streptococcus pneumoniae R6
gcuugauaaccuuaa

SEQ ID NO: 4077340 - RNA, 16 nt, Streptococcus pneumoniae R6
gcuugauaaguuugau

SEQ ID NO: 4077341 - RNA, 17 nt, Streptococcus pneumoniae R6
gcuugauaaguuugaug

SEQ ID NO: 4077342 - RNA, 15 nt, Streptococcus pneumoniae R6
gcuugauagccuugu

SEQ ID NO: 4077343 - RNA, 18 nt, Streptococcus pneumoniae R6
gcuugauaguagccaauu

SEQ ID NO: 4077344 - RNA, 14 nt, Streptococcus pneumoniae R6
gcuugcaauucuuu

SEQ ID NO: 4077345 - RNA, 21 nt, Streptococcus pneumoniae R6
gcuugcaauucuuuagcagau

SEQ ID NO: 4077346 - RNA, 17 nt, Streptococcus pneumoniae R6
gcuugcaauucuuuucc

SEQ ID NO: 4077347 - RNA, 19 nt, Streptococcus pneumoniae R6
gcuugcuagauauuguucu

SEQ ID NO: 4077348 - RNA, 18 nt, Streptococcus pneumoniae R6
gcuuggauccauugcugg

SEQ ID NO: 4077349 - RNA, 14 nt, Streptococcus pneumoniae R6
gcuuggauuuaaaa

SEQ ID NO: 4077350 - RNA, 16 nt, Streptococcus pneumoniae R6
gcuuggauuuaaaaac

SEQ ID NO: 4077351 - RNA, 13 nt, Streptococcus pneumoniae R6
gcuugggaaacca

SEQ ID NO: 4077352 - RNA, 15 nt, Streptococcus pneumoniae R6
gcuuggugagaaagu

SEQ ID NO: 4077353 - RNA, 16 nt, Streptococcus pneumoniae R6
gcuugguucuucacua

SEQ ID NO: 4077354 - RNA, 19 nt, Streptococcus pneumoniae R6
gcuugucuuugauuuacua

SEQ ID NO: 4077355 - RNA, 13 nt, Streptococcus pneumoniae R6
gcuuguuccaauu

SEQ ID NO: 4077356 - RNA, 20 nt, Streptococcus pneumoniae R6
gcuuguuuaaaaucucuuua

SEQ ID NO: 4077357 - RNA, 22 nt, Streptococcus pneumoniae R6
gcuuguuuaaaaucucuuuauu

SEQ ID NO: 4077358 - RNA, 16 nt, Streptococcus pneumoniae R6
gcuuguuuaaaccuug

SEQ ID NO: 4077359 - RNA, 13 nt, Streptococcus pneumoniae R6
gcuuuaccauccu

SEQ ID NO: 4077360 - RNA, 15 nt, Streptococcus pneumoniae R6
gcuuuacuaguucuc

SEQ ID NO: 4077361 - RNA, 18 nt, Streptococcus pneumoniae R6
gcuuuagcaaucuuaucc

SEQ ID NO: 4077362 - RNA, 20 nt, Streptococcus pneumoniae R6
gcuuuagcaaucuuauccac

SEQ ID NO: 4077363 - RNA, 19 nt, Streptococcus pneumoniae R6
gcuuuaguaccagcucguu

SEQ ID NO: 4077364 - RNA, 21 nt, Streptococcus pneumoniae R6
gcuuuaucugcaaccucaaaa

SEQ ID NO: 4077365 - RNA, 15 nt, Streptococcus pneumoniae R6
gcuuuauuaagcccu

SEQ ID NO: 4077366 - RNA, 22 nt, Streptococcus pneumoniae R6
gcuuuauugucucuaaaaauaa

SEQ ID NO: 4077367 - RNA, 22 nt, Streptococcus pneumoniae R6
gcuuucaacugcuuuuucaauc

SEQ ID NO: 4077368 - RNA, 21 nt, Streptococcus pneumoniae R6
ggacagucaaaucgauuucua

SEQ ID NO: 4077369 - RNA, 22 nt, Streptococcus pneumoniae R6
ggacaucacuguuuuuuauccc

SEQ ID NO: 4077370 - RNA, 18 nt, Streptococcus pneumoniae R6
ggacaucauaacugcuaa

SEQ ID NO: 4077371 - RNA, 19 nt, Streptococcus pneumoniae R6
ggacauuagggucuuuaau

SEQ ID NO: 4077372 - RNA, 23 nt, Streptococcus pneumoniae R6
ggaccgacaccaguauucuuuuu

SEQ ID NO: 4077373 - RNA, 22 nt, Streptococcus pneumoniae R6
ggacuaaauccaaaagcaggag

SEQ ID NO: 4077374 - RNA, 22 nt, Streptococcus pneumoniae R6
ggacuauucguuugauguacua

SEQ ID NO: 4077375 - RNA, 21 nt, Streptococcus pneumoniae R6
ggacuccuacaaagcccauac

SEQ ID NO: 4077376 - RNA, 13 nt, Streptococcus pneumoniae R6
ggacugguuucgu

SEQ ID NO: 4077377 - RNA, 17 nt, Streptococcus pneumoniae R6
ggacuuagcucugugca

SEQ ID NO: 4077378 - RNA, 18 nt, Streptococcus pneumoniae R6
ggacuugauauaaaugac

SEQ ID NO: 4077379 - RNA, 12 nt, Streptococcus pneumoniae R6
ggagaaauuccu

SEQ ID NO: 4077380 - RNA, 18 nt, Streptococcus pneumoniae R6
ggagaaccaggaaaccag

SEQ ID NO: 4077381 - RNA, 12 nt, Streptococcus pneumoniae R6
ggagaagaaaac

SEQ ID NO: 4077382 - RNA, 16 nt, Streptococcus pneumoniae R6
ggagacggacuagaau

SEQ ID NO: 4077383 - RNA, 22 nt, Streptococcus pneumoniae R6
ggagagcacccucguuaucauu

SEQ ID NO: 4077384 - RNA, 20 nt, Streptococcus pneumoniae R6
ggagauaguaucccauucuu

SEQ ID NO: 4077385 - RNA, 15 nt, Streptococcus pneumoniae R6
ggagauggacuagaa

SEQ ID NO: 4077386 - RNA, 14 nt, Streptococcus pneumoniae R6
ggagcaagcuccua

SEQ ID NO: 4077387 - RNA, 20 nt, Streptococcus pneumoniae R6
ggagcaguugauggagcugg

SEQ ID NO: 4077388 - RNA, 16 nt, Streptococcus pneumoniae R6
ggagccaauggguuga

SEQ ID NO: 4077389 - RNA, 17 nt, Streptococcus pneumoniae R6
ggagcuggggcuacugg

SEQ ID NO: 4077390 - RNA, 16 nt, Streptococcus pneumoniae R6
ggagcugguuggcuug

SEQ ID NO: 4077391 - RNA, 20 nt, Streptococcus pneumoniae R6
ggagcuuggaaugauuuggg

SEQ ID NO: 4077392 - RNA, 15 nt, Streptococcus pneumoniae R6
ggaggcaaagaaaaa

SEQ ID NO: 4077393 - RNA, 18 nt, Streptococcus pneumoniae R6
ggaggcaaagaaaaaagc

SEQ ID NO: 4077394 - RNA, 17 nt, Streptococcus pneumoniae R6
ggagguaaaucccaagu

SEQ ID NO: 4077395 - RNA, 19 nt, Streptococcus pneumoniae R6
ggaguguucuaaaauaagu

SEQ ID NO: 4077396 - RNA, 13 nt, Streptococcus pneumoniae R6
ggauaaaagagaa

SEQ ID NO: 4077397 - RNA, 15 nt, Streptococcus pneumoniae R6
ggauaaauuuuauug

SEQ ID NO: 4077398 - RNA, 15 nt, Streptococcus pneumoniae R6
ggauaagguaucugg

SEQ ID NO: 4077399 - RNA, 19 nt, Streptococcus pneumoniae R6
ggauaauugaauauggaau

SEQ ID NO: 4077400 - RNA, 20 nt, Streptococcus pneumoniae R6
ggauaccaccagacauaucu

SEQ ID NO: 4077401 - RNA, 14 nt, Streptococcus pneumoniae R6
ggauagaacugacg

SEQ ID NO: 4077402 - RNA, 20 nt, Streptococcus pneumoniae R6
ggauagcuccuccaagucca

SEQ ID NO: 4077403 - RNA, 14 nt, Streptococcus pneumoniae R6
ggauauaagaagca

SEQ ID NO: 4077404 - RNA, 23 nt, Streptococcus pneumoniae R6
ggauauaagguaggagugaaaaa

SEQ ID NO: 4077405 - RNA, 20 nt, Streptococcus pneumoniae R6
ggauauucaauucuuuaaca

SEQ ID NO: 4077406 - RNA, 13 nt, Streptococcus pneumoniae R6
ggauauugacaac

SEQ ID NO: 4077407 - RNA, 21 nt, Streptococcus pneumoniae R6
ggaucauugauauaaagagca

SEQ ID NO: 4077408 - RNA, 13 nt, Streptococcus pneumoniae R6
ggaucccauggug

SEQ ID NO: 4077409 - RNA, 15 nt, Streptococcus pneumoniae R6
ggaucgguuagacca

SEQ ID NO: 4077410 - RNA, 15 nt, Streptococcus pneumoniae R6
ggaugaaacugacga

SEQ ID NO: 4077411 - RNA, 21 nt, Streptococcus pneumoniae R6
ggaugacaauagcuaauagaa

SEQ ID NO: 4077412 - RNA, 12 nt, Streptococcus pneumoniae R6
ggaugacacgau

SEQ ID NO: 4077413 - RNA, 15 nt, Streptococcus pneumoniae R6
ggaugagugacgaga

SEQ ID NO: 4077414 - RNA, 23 nt, Streptococcus pneumoniae R6
ggaugauucuuuucaaaauaagu

SEQ ID NO: 4077415 - RNA, 18 nt, Streptococcus pneumoniae R6
ggaugcccguacuuacca

SEQ ID NO: 4077416 - RNA, 18 nt, Streptococcus pneumoniae R6
ggaugcggucgccgaugg

SEQ ID NO: 4077417 - RNA, 14 nt, Streptococcus pneumoniae R6
ggauggaacugacg

SEQ ID NO: 4077418 - RNA, 12 nt, Streptococcus pneumoniae R6
ggauuaauaauu

SEQ ID NO: 4077419 - RNA, 18 nt, Streptococcus pneumoniae R6
ggauuaggguagcguguc

SEQ ID NO: 4077420 - RNA, 23 nt, Streptococcus pneumoniae R6
ggauuauuugccuaugaaaugag

SEQ ID NO: 4077421 - RNA, 20 nt, Streptococcus pneumoniae R6
ggauugccaacaaacauggc

SEQ ID NO: 4077422 - RNA, 16 nt, Streptococcus pneumoniae R6
ggauuguauagugaau

SEQ ID NO: 4077423 - RNA, 15 nt, Streptococcus pneumoniae R6
ggauuuaaaauaaga

SEQ ID NO: 4077424 - RNA, 19 nt, Streptococcus pneumoniae R6
ggauuuccacuaaagguug

SEQ ID NO: 4077425 - RNA, 21 nt, Streptococcus pneumoniae R6
ggauuucuccuguuucaaagu

SEQ ID NO: 4077426 - RNA, 18 nt, Streptococcus pneumoniae R6
ggauuucugcuuuuuaua

SEQ ID NO: 4077427 - RNA, 12 nt, Streptococcus pneumoniae R6
ggauuuucuccc

SEQ ID NO: 4077428 - RNA, 13 nt, Streptococcus pneumoniae R6
ggauuuuucuuuu

SEQ ID NO: 4077429 - RNA, 13 nt, Streptococcus pneumoniae R6
ggcaaagaaaaaa

SEQ ID NO: 4077430 - RNA, 14 nt, Streptococcus pneumoniae R6
ggcaaagauguucu

SEQ ID NO: 4077431 - RNA, 17 nt, Streptococcus pneumoniae R6
ggcaaagauguucucaa

SEQ ID NO: 4077432 - RNA, 19 nt, Streptococcus pneumoniae R6
ggcaaauuugaccauuuca

SEQ ID NO: 4077433 - RNA, 20 nt, Streptococcus pneumoniae R6
ggcaacaaaguaaccaucug

SEQ ID NO: 4077434 - RNA, 16 nt, Streptococcus pneumoniae R6
ggcaacgaagcuagaa

SEQ ID NO: 4077435 - RNA, 17 nt, Streptococcus pneumoniae R6
ggcaagagcuguuccac

SEQ ID NO: 4077436 - RNA, 16 nt, Streptococcus pneumoniae R6
ggcaagaucaaguuca

SEQ ID NO: 4077437 - RNA, 22 nt, Streptococcus pneumoniae R6
ggcaagggcaccaaacuuagga

SEQ ID NO: 4077438 - RNA, 19 nt, Streptococcus pneumoniae R6
ggcaauaccguuaaagcau

SEQ ID NO: 4077439 - RNA, 10 nt, Streptococcus pneumoniae R6
ggcaauuuua

SEQ ID NO: 4077440 - RNA, 19 nt, Streptococcus pneumoniae R6
ggcaauuuuacuucuuccc

SEQ ID NO: 4077441 - RNA, 13 nt, Streptococcus pneumoniae R6
ggcaccauuuuca

SEQ ID NO: 4077442 - RNA, 16 nt, Streptococcus pneumoniae R6
ggcaccgaauuuuuca

SEQ ID NO: 4077443 - RNA, 18 nt, Streptococcus pneumoniae R6
ggcagaaacuguccgagc

SEQ ID NO: 4077444 - RNA, 17 nt, Streptococcus pneumoniae R6
ggcagacagagaaaaug

SEQ ID NO: 4077445 - RNA, 14 nt, Streptococcus pneumoniae R6
ggcagauagagaca

SEQ ID NO: 4077446 - RNA, 16 nt, Streptococcus pneumoniae R6
ggcagcuuaagugcgu

SEQ ID NO: 4077447 - RNA, 19 nt, Streptococcus pneumoniae R6
ggcaggaaggaaauagcug

SEQ ID NO: 4077448 - RNA, 18 nt, Streptococcus pneumoniae R6
ggcaggcugguuccuccu

SEQ ID NO: 4077449 - RNA, 23 nt, Streptococcus pneumoniae R6
ggcaguaaaucuuccuugaaaga

SEQ ID NO: 4077450 - RNA, 14 nt, Streptococcus pneumoniae R6
ggcaguacauuuaa

SEQ ID NO: 4077451 - RNA, 23 nt, Streptococcus pneumoniae R6
ggcauaauacuguggaauauaga

SEQ ID NO: 4077452 - RNA, 14 nt, Streptococcus pneumoniae R6
ggcauauaaauaca

SEQ ID NO: 4077453 - RNA, 22 nt, Streptococcus pneumoniae R6
ggcaucacgaaaauauuuggaa

SEQ ID NO: 4077454 - RNA, 22 nt, Streptococcus pneumoniae R6
ggcauccuaucaagguuuuuga

SEQ ID NO: 4077455 - RNA, 12 nt, Streptococcus pneumoniae R6
ggcaucuaagca

SEQ ID NO: 4077456 - RNA, 19 nt, Streptococcus pneumoniae R6
ggcaugucguauaguagaa

SEQ ID NO: 4077457 - RNA, 19 nt, Streptococcus pneumoniae R6
ggccaaacuugaaaugaug

SEQ ID NO: 4077458 - RNA, 23 nt, Streptococcus pneumoniae R6
ggccaacuaaccaacuucuuuuu

SEQ ID NO: 4077459 - RNA, 17 nt, Streptococcus pneumoniae R6
ggccaagguucauuucu

SEQ ID NO: 4077460 - RNA, 17 nt, Streptococcus pneumoniae R6
ggccaaguccagaggac

SEQ ID NO: 4077461 - RNA, 18 nt, Streptococcus pneumoniae R6
ggccacgguuagaagcgu

SEQ ID NO: 4077462 - RNA, 15 nt, Streptococcus pneumoniae R6
ggccagaacucccug

SEQ ID NO: 4077463 - RNA, 23 nt, Streptococcus pneumoniae R6
ggccagaacucccuguuccaaag

SEQ ID NO: 4077464 - RNA, 23 nt, Streptococcus pneumoniae R6
ggccuaaggcuguuucaaaugaa

SEQ ID NO: 4077465 - RNA, 21 nt, Streptococcus pneumoniae R6
ggccuacaauuggaaauaaca

SEQ ID NO: 4077466 - RNA, 16 nt, Streptococcus pneumoniae R6
ggccuucuuuuuaauu

SEQ ID NO: 4077467 - RNA, 16 nt, Streptococcus pneumoniae R6
ggccuuguggaagaag

SEQ ID NO: 4077468 - RNA, 12 nt, Streptococcus pneumoniae R6
ggccuuuuugcc

SEQ ID NO: 4077469 - RNA, 18 nt, Streptococcus pneumoniae R6
ggcgaaggucuuucaagc

SEQ ID NO: 4077470 - RNA, 19 nt, Streptococcus pneumoniae R6
ggucucagucugaccacca

SEQ ID NO: 4077471 - RNA, 19 nt, Streptococcus pneumoniae R6
ggucucccaggauaggaag

SEQ ID NO: 4077472 - RNA, 21 nt, Streptococcus pneumoniae R6
ggucuuuaaugucuaguaauu

SEQ ID NO: 4077473 - RNA, 15 nt, Streptococcus pneumoniae R6
ggucuuuguucugaa

SEQ ID NO: 4077474 - RNA, 13 nt, Streptococcus pneumoniae R6
ggucuuuuguccu

SEQ ID NO: 4077475 - RNA, 18 nt, Streptococcus pneumoniae R6
ggugauuuuuucauagca

SEQ ID NO: 4077476 - RNA, 13 nt, Streptococcus pneumoniae R6
ggugcacacgaau

SEQ ID NO: 4077477 - RNA, 14 nt, Streptococcus pneumoniae R6
ggugcccaaauacu

SEQ ID NO: 4077478 - RNA, 19 nt, Streptococcus pneumoniae R6
ggugccucauuaguaauuu

SEQ ID NO: 4077479 - RNA, 20 nt, Streptococcus pneumoniae R6
gguggaucaugacuggacgg

SEQ ID NO: 4077480 - RNA, 13 nt, Streptococcus pneumoniae R6
gguguaaauagaa

SEQ ID NO: 4077481 - RNA, 19 nt, Streptococcus pneumoniae R6
gguguaaauagaaaccagc

SEQ ID NO: 4077482 - RNA, 14 nt, Streptococcus pneumoniae R6
gguguacuauucua

SEQ ID NO: 4077483 - RNA, 14 nt, Streptococcus pneumoniae R6
ggugucauauaauc

SEQ ID NO: 4077484 - RNA, 19 nt, Streptococcus pneumoniae R6
ggugugauuuuccugaaua

SEQ ID NO: 4077485 - RNA, 18 nt, Streptococcus pneumoniae R6
gguguuaauuggaaaaua

SEQ ID NO: 4077486 - RNA, 20 nt, Streptococcus pneumoniae R6
gguguuucaagucuucugaa

SEQ ID NO: 4077487 - RNA, 15 nt, Streptococcus pneumoniae R6
gguguuuugagcuga

SEQ ID NO: 4077488 - RNA, 23 nt, Streptococcus pneumoniae R6
gguuaaaaucuuuuacuucugaa

SEQ ID NO: 4077489 - RNA, 15 nt, Streptococcus pneumoniae R6
gguuaaaauugcuuu

SEQ ID NO: 4077490 - RNA, 12 nt, Streptococcus pneumoniae R6
gguuaaaauuuu

SEQ ID NO: 4077491 - RNA, 21 nt, Streptococcus pneumoniae R6
gguuaacgucaaaugacuacg

SEQ ID NO: 4077492 - RNA, 20 nt, Streptococcus pneumoniae R6
gguuaagacaccgccuuuuc

SEQ ID NO: 4077493 - RNA, 22 nt, Streptococcus pneumoniae R6
gguuaagugcauacgaaaagua

SEQ ID NO: 4077494 - RNA, 13 nt, Streptococcus pneumoniae R6
gguuacugacuuc

SEQ ID NO: 4077495 - RNA, 23 nt, Streptococcus pneumoniae R6
gguuacugacuucgucaguucua

SEQ ID NO: 4077496 - RNA, 16 nt, Streptococcus pneumoniae R6
gguuacuuuauaauuc

SEQ ID NO: 4077497 - RNA, 12 nt, Streptococcus pneumoniae R6
gguuagaaaauc

SEQ ID NO: 4077498 - RNA, 15 nt, Streptococcus pneumoniae R6
gguuauaaaaaacaa

SEQ ID NO: 4077499 - RNA, 17 nt, Streptococcus pneumoniae R6
gguuauaccaaaaaaac

SEQ ID NO: 4077500 - RNA, 17 nt, Streptococcus pneumoniae R6
gguucauccagcaggag

SEQ ID NO: 4077501 - RNA, 17 nt, Streptococcus pneumoniae R6
gguucauuucuucuaug

SEQ ID NO: 4077502 - RNA, 17 nt, Streptococcus pneumoniae R6
gguucgccauagaauuu

SEQ ID NO: 4077503 - RNA, 19 nt, Streptococcus pneumoniae R6
gguucgcccugucuuuagc

SEQ ID NO: 4077504 - RNA, 17 nt, Streptococcus pneumoniae R6
gguucuucgaaagucaa

SEQ ID NO: 4077505 - RNA, 22 nt, Streptococcus pneumoniae R6
gguucuuugccaguucuucaug

SEQ ID NO: 4077506 - RNA, 13 nt, Streptococcus pneumoniae R6
gguugaaaaaaag

SEQ ID NO: 4077507 - RNA, 12 nt, Streptococcus pneumoniae R6
gguugaagaggu

SEQ ID NO: 4077508 - RNA, 20 nt, Streptococcus pneumoniae R6
gguugcagauagaacugacg

SEQ ID NO: 4077509 - RNA, 14 nt, Streptococcus pneumoniae R6
gguugcucaaagca

SEQ ID NO: 4077510 - RNA, 20 nt, Streptococcus pneumoniae R6
gguuguagauagaacugacg

SEQ ID NO: 4077511 - RNA, 20 nt, Streptococcus pneumoniae R6
gguuguagauggaacugacg

SEQ ID NO: 4077512 - RNA, 20 nt, Streptococcus pneumoniae R6
gguuguccauuugaaagaac

SEQ ID NO: 4077513 - RNA, 21 nt, Streptococcus pneumoniae R6
gguuguggauagaacugacga

SEQ ID NO: 4077514 - RNA, 17 nt, Streptococcus pneumoniae R6
gguuguggaugaaacug

SEQ ID NO: 4077515 - RNA, 14 nt, Streptococcus pneumoniae R6
gguuuaucucccau

SEQ ID NO: 4077516 - RNA, 13 nt, Streptococcus pneumoniae R6
gguuugaaaaugu

SEQ ID NO: 4077517 - RNA, 14 nt, Streptococcus pneumoniae R6
gguuugaagagauu

SEQ ID NO: 4077518 - RNA, 14 nt, Streptococcus pneumoniae R6
gguuuugagguugu

SEQ ID NO: 4077519 - RNA, 10 nt, Streptococcus pneumoniae R6
gguuuuucuu

SEQ ID NO: 4077520 - RNA, 21 nt, Streptococcus pneumoniae R6
gguuuuucuuauacaaauaaa

SEQ ID NO: 4077521 - RNA, 13 nt, Streptococcus pneumoniae R6
gguuuuugccaug

SEQ ID NO: 4077522 - RNA, 18 nt, Streptococcus pneumoniae R6
guaaaaaaagaagcagaa

SEQ ID NO: 4077523 - RNA, 14 nt, Streptococcus pneumoniae R6
guaaaaaaguugaa

SEQ ID NO: 4077524 - RNA, 16 nt, Streptococcus pneumoniae R6
guaaaaagugaaagga

SEQ ID NO: 4077525 - RNA, 13 nt, Streptococcus pneumoniae R6
guaaaaauuucua

SEQ ID NO: 4077526 - RNA, 15 nt, Streptococcus pneumoniae R6
guaaaauacucauca

SEQ ID NO: 4077527 - RNA, 18 nt, Streptococcus pneumoniae R6
guaaaaucaggaagguca

SEQ ID NO: 4077528 - RNA, 14 nt, Streptococcus pneumoniae R6
guaaaaugaaacaa

SEQ ID NO: 4077529 - RNA, 21 nt, Streptococcus pneumoniae R6
guaaaaugaaauaagaacagg

SEQ ID NO: 4077530 - RNA, 17 nt, Streptococcus pneumoniae R6
guaaacaguaauaaaga

SEQ ID NO: 4077531 - RNA, 17 nt, Streptococcus pneumoniae R6
guaaacgaauacuuugu

SEQ ID NO: 4077532 - RNA, 16 nt, Streptococcus pneumoniae R6
guaaacuagaaagcua

SEQ ID NO: 4077533 - RNA, 22 nt, Streptococcus pneumoniae R6
guaaacuagaaagcuagucgca

SEQ ID NO: 4077534 - RNA, 20 nt, Streptococcus pneumoniae R6
guaaacugcgaagaaaucau

SEQ ID NO: 4077535 - RNA, 12 nt, Streptococcus pneumoniae R6
guaaagggcuuu

SEQ ID NO: 4077536 - RNA, 18 nt, Streptococcus pneumoniae R6
guaaaggguuuggucaga

SEQ ID NO: 4077537 - RNA, 16 nt, Streptococcus pneumoniae R6
guaaauaaauaucaaa

SEQ ID NO: 4077538 - RNA, 12 nt, Streptococcus pneumoniae R6
guaaauaucauu

SEQ ID NO: 4077539 - RNA, 22 nt, Streptococcus pneumoniae R6
guaaaucauacgauugaaagga

SEQ ID NO: 4077540 - RNA, 17 nt, Streptococcus pneumoniae R6
guaaauccgauauaucu

SEQ ID NO: 4077541 - RNA, 23 nt, Streptococcus pneumoniae R6
guaaaucuucccacaauaaaaag

SEQ ID NO: 4077542 - RNA, 17 nt, Streptococcus pneumoniae R6
guaaaugugagcuuugg

SEQ ID NO: 4077543 - RNA, 14 nt, Streptococcus pneumoniae R6
guaaauuauacucu

SEQ ID NO: 4077544 - RNA, 20 nt, Streptococcus pneumoniae R6
guaaauucugucacaacuga

SEQ ID NO: 4077545 - RNA, 19 nt, Streptococcus pneumoniae R6
guaaauucuuaaagccacu

SEQ ID NO: 4077546 - RNA, 21 nt, Streptococcus pneumoniae R6
guaaauugcccuugucauccu

SEQ ID NO: 4077547 - RNA, 17 nt, Streptococcus pneumoniae R6
guaaauugucuaaaaau

SEQ ID NO: 4077548 - RNA, 15 nt, Streptococcus pneumoniae R6
guaacagucuuagca

SEQ ID NO: 4077549 - RNA, 15 nt, Streptococcus pneumoniae R6
guaacauauuuucaa

SEQ ID NO: 4077550 - RNA, 19 nt, Streptococcus pneumoniae R6
guaacauauuuucaaaacu

SEQ ID NO: 4077551 - RNA, 17 nt, Streptococcus pneumoniae R6
guaacgagucaaaaaag

SEQ ID NO: 4077552 - RNA, 19 nt, Streptococcus pneumoniae R6
guaacgagucaaaaaagga

SEQ ID NO: 4077553 - RNA, 14 nt, Streptococcus pneumoniae R6
guaacgucuuuucg

SEQ ID NO: 4077554 - RNA, 14 nt, Streptococcus pneumoniae R6
guaacguucuucaa

SEQ ID NO: 4077555 - RNA, 18 nt, Streptococcus pneumoniae R6
guaacguucuucaacauc

SEQ ID NO: 4077556 - RNA, 18 nt, Streptococcus pneumoniae R6
guaacuaacgccaaaucc

SEQ ID NO: 4077557 - RNA, 14 nt, Streptococcus pneumoniae R6
guaacuauuuuuga

SEQ ID NO: 4077558 - RNA, 19 nt, Streptococcus pneumoniae R6
guaacuauuuuugaucuuc

SEQ ID NO: 4077559 - RNA, 12 nt, Streptococcus pneumoniae R6
guaacuguuuua

SEQ ID NO: 4077560 - RNA, 22 nt, Streptococcus pneumoniae R6
guaacuuuaccaaaaccuucuu

SEQ ID NO: 4077561 - RNA, 17 nt, Streptococcus pneumoniae R6
guaagaguggauuuuca

SEQ ID NO: 4077562 - RNA, 19 nt, Streptococcus pneumoniae R6
guaagauagggcugaagga

SEQ ID NO: 4077563 - RNA, 23 nt, Streptococcus pneumoniae R6
guaagccauauuggaugaguuua

SEQ ID NO: 4077564 - RNA, 16 nt, Streptococcus pneumoniae R6
guaaggagcagggcau

SEQ ID NO: 4077565 - RNA, 19 nt, Streptococcus pneumoniae R6
guaagucauuuucuuuuac

SEQ ID NO: 4077566 - RNA, 15 nt, Streptococcus pneumoniae R6
guaagucugcuuuau

SEQ ID NO: 4077567 - RNA, 21 nt, Streptococcus pneumoniae R6
guaagugaguaccagauauac

SEQ ID NO: 4077568 - RNA, 21 nt, Streptococcus pneumoniae R6
guaagugguaucgcuagacug

SEQ ID NO: 4077569 - RNA, 24 nt, Streptococcus pneumoniae R6
guaaguuaaaaauccugauuucaa

SEQ ID NO: 4077570 - RNA, 22 nt, Streptococcus pneumoniae R6
guaaguugggguuccuuuuuug

SEQ ID NO: 4077571 - RNA, 21 nt, Streptococcus pneumoniae R6
guaaguuuaauguccaugcuu

SEQ ID NO: 4077572 - RNA, 19 nt, Streptococcus pneumoniae R6
guaauaaacuggguugaag

SEQ ID NO: 4077573 - RNA, 13 nt, Streptococcus pneumoniae R6
guaugaaauagcc

SEQ ID NO: 4077574 - RNA, 13 nt, Streptococcus pneumoniae R6
guaugagaaacag

SEQ ID NO: 4077575 - RNA, 23 nt, Streptococcus pneumoniae R6
guaugcuauaucuuauuuuucua

SEQ ID NO: 4077576 - RNA, 15 nt, Streptococcus pneumoniae R6
guauggaaacucaaa

SEQ ID NO: 4077577 - RNA, 21 nt, Streptococcus pneumoniae R6
guauuaaacaaaaagaaaaaa

SEQ ID NO: 4077578 - RNA, 16 nt, Streptococcus pneumoniae R6
guauuaucaauaucaa

SEQ ID NO: 4077579 - RNA, 21 nt, Streptococcus pneumoniae R6
guauuaucaauaucaaaacca

SEQ ID NO: 4077580 - RNA, 20 nt, Streptococcus pneumoniae R6
guauuauuagggaaacaaaa

SEQ ID NO: 4077581 - RNA, 13 nt, Streptococcus pneumoniae R6
guauucauaaaau

SEQ ID NO: 4077582 - RNA, 17 nt, Streptococcus pneumoniae R6
guauucauugaaaaaau

SEQ ID NO: 4077583 - RNA, 17 nt, Streptococcus pneumoniae R6
guauucgcuuacauaaa

SEQ ID NO: 4077584 - RNA, 17 nt, Streptococcus pneumoniae R6
guauucucguagugcuu

SEQ ID NO: 4077585 - RNA, 22 nt, Streptococcus pneumoniae R6
guauucucguagugcuucucuu

SEQ ID NO: 4077586 - RNA, 16 nt, Streptococcus pneumoniae R6
guauugaaaaaacuug

SEQ ID NO: 4077587 - RNA, 13 nt, Streptococcus pneumoniae R6
guauugacugccc

SEQ ID NO: 4077588 - RNA, 15 nt, Streptococcus pneumoniae R6
guauuguacuuucca

SEQ ID NO: 4077589 - RNA, 21 nt, Streptococcus pneumoniae R6
gucaaagaaggcuuuaccaaa

SEQ ID NO: 4077590 - RNA, 16 nt, Streptococcus pneumoniae R6
gucaaagccaaucaaa

SEQ ID NO: 4077591 - RNA, 16 nt, Streptococcus pneumoniae R6
gucaaauaagaaagac

SEQ ID NO: 4077592 - RNA, 23 nt, Streptococcus pneumoniae R6
gucaaauuaauuuauagaaaaau

SEQ ID NO: 4077593 - RNA, 11 nt, Streptococcus pneumoniae R6
gucaaauuacg

SEQ ID NO: 4077594 - RNA, 20 nt, Streptococcus pneumoniae R6
gucaacaggauuuuguucuu

SEQ ID NO: 4077595 - RNA, 13 nt, Streptococcus pneumoniae R6
gucaacaguuagu

SEQ ID NO: 4077596 - RNA, 15 nt, Streptococcus pneumoniae R6
gucaaccaacuuuuc

SEQ ID NO: 4077597 - RNA, 14 nt, Streptococcus pneumoniae R6
gucaacgucaagaa

SEQ ID NO: 4077598 - RNA, 13 nt, Streptococcus pneumoniae R6
gucaacuguagug

SEQ ID NO: 4077599 - RNA, 21 nt, Streptococcus pneumoniae R6
gucaacuguaguggguugaag

SEQ ID NO: 4077600 - RNA, 13 nt, Streptococcus pneumoniae R6
gucaacuuguaaa

SEQ ID NO: 4077601 - RNA, 19 nt, Streptococcus pneumoniae R6
gucaacuuuuguauuuuga

SEQ ID NO: 4077602 - RNA, 20 nt, Streptococcus pneumoniae R6
gucaacuuuuguauuuugaa

SEQ ID NO: 4077603 - RNA, 22 nt, Streptococcus pneumoniae R6
gucaagaagagcuugguaagag

SEQ ID NO: 4077604 - RNA, 14 nt, Streptococcus pneumoniae R6
gucaagaagagggc

SEQ ID NO: 4077605 - RNA, 14 nt, Streptococcus pneumoniae R6
gucaagacuaggug

SEQ ID NO: 4077606 - RNA, 11 nt, Streptococcus pneumoniae R6
gucaagagaaa

SEQ ID NO: 4077607 - RNA, 14 nt, Streptococcus pneumoniae R6
gucaagaguugggc

SEQ ID NO: 4077608 - RNA, 12 nt, Streptococcus pneumoniae R6
gucaagcucuug

SEQ ID NO: 4077609 - RNA, 21 nt, Streptococcus pneumoniae R6
gucaagguguacuguuauaga

SEQ ID NO: 4077610 - RNA, 17 nt, Streptococcus pneumoniae R6
gucaaguguagugggua

SEQ ID NO: 4077611 - RNA, 18 nt, Streptococcus pneumoniae R6
gucaauccgaguuuuuca

SEQ ID NO: 4077612 - RNA, 19 nt, Streptococcus pneumoniae R6
gucaauccgaguuuuucag

SEQ ID NO: 4077613 - RNA, 21 nt, Streptococcus pneumoniae R6
gucaaucuugucuaaaaauag

SEQ ID NO: 4077614 - RNA, 15 nt, Streptococcus pneumoniae R6
gucaauugaaacaag

SEQ ID NO: 4077615 - RNA, 22 nt, Streptococcus pneumoniae R6
gucaauuuccauuuacagaagc

SEQ ID NO: 4077616 - RNA, 19 nt, Streptococcus pneumoniae R6
gucaauuucucuacaaaua

SEQ ID NO: 4077617 - RNA, 23 nt, Streptococcus pneumoniae R6
gucacauagacuccauagggcau

SEQ ID NO: 4077618 - RNA, 14 nt, Streptococcus pneumoniae R6
gucacauauauaau

SEQ ID NO: 4077619 - RNA, 17 nt, Streptococcus pneumoniae R6
gucacauauauaaucca

SEQ ID NO: 4077620 - RNA, 14 nt, Streptococcus pneumoniae R6
gucacauucccauu

SEQ ID NO: 4077621 - RNA, 16 nt, Streptococcus pneumoniae R6
gucaccaaauuucaua

SEQ ID NO: 4077622 - RNA, 20 nt, Streptococcus pneumoniae R6
gucaccaaauuucauauuuu

SEQ ID NO: 4077623 - RNA, 21 nt, Streptococcus pneumoniae R6
gucaccaaauuucauauuuuc

SEQ ID NO: 4077624 - RNA, 22 nt, Streptococcus pneumoniae R6
gucaccaaauuucauauuuuca

SEQ ID NO: 4077625 - RNA, 22 nt, Streptococcus pneumoniae R6
gucaccuuaucacgaauuucuu

SEQ ID NO: 4077626 - RNA, 16 nt, Streptococcus pneumoniae R6
gucacgaggaggagaa

SEQ ID NO: 4077627 - RNA, 20 nt, Streptococcus pneumoniae R6
gucacgaggaggagaaaaag

SEQ ID NO: 4077628 - RNA, 17 nt, Streptococcus pneumoniae R6
gucacugacagcauugg

SEQ ID NO: 4077629 - RNA, 21 nt, Streptococcus pneumoniae R6
gucagaaagaaguuuaagagc

SEQ ID NO: 4077630 - RNA, 22 nt, Streptococcus pneumoniae R6
gucagaaugaugauagucaugu

SEQ ID NO: 4077631 - RNA, 14 nt, Streptococcus pneumoniae R6
gucagcuaagcucg

SEQ ID NO: 4077632 - RNA, 18 nt, Streptococcus pneumoniae R6
gucagcucaaaacacugu

SEQ ID NO: 4077633 - RNA, 16 nt, Streptococcus pneumoniae R6
gucagcuuuaucugca

SEQ ID NO: 4077634 - RNA, 21 nt, Streptococcus pneumoniae R6
gucagcuuuaucugcaaccuc

SEQ ID NO: 4077635 - RNA, 14 nt, Streptococcus pneumoniae R6
gucaggccugcacu

SEQ ID NO: 4077636 - RNA, 24 nt, Streptococcus pneumoniae R6
gucaguaaaaaaaacauauauuca

SEQ ID NO: 4077637 - RNA, 14 nt, Streptococcus pneumoniae R6
gucaguaagauaca

SEQ ID NO: 4077638 - RNA, 17 nt, Streptococcus pneumoniae R6
gucagucuuaucuaaaa

SEQ ID NO: 4077639 - RNA, 22 nt, Streptococcus pneumoniae R6
gucagucuuaucugcaaccuca

SEQ ID NO: 4077640 - RNA, 22 nt, Streptococcus pneumoniae R6
gucaguuccauccacaaccuua

SEQ ID NO: 4077641 - RNA, 22 nt, Streptococcus pneumoniae R6
gucaguuccaucuacaaccuua

SEQ ID NO: 4077642 - RNA, 13 nt, Streptococcus pneumoniae R6
gucaguucuaucc

SEQ ID NO: 4077643 - RNA, 19 nt, Streptococcus pneumoniae R6
gucaguucuauccacaacc

SEQ ID NO: 4077644 - RNA, 13 nt, Streptococcus pneumoniae R6
gucaguucuaucu

SEQ ID NO: 4077645 - RNA, 14 nt, Streptococcus pneumoniae R6
gucaguucuaucug

SEQ ID NO: 4077646 - RNA, 15 nt, Streptococcus pneumoniae R6
gucaguucuaucugc

SEQ ID NO: 4077647 - RNA, 19 nt, Streptococcus pneumoniae R6
gucaguugaaaaggcaucu

SEQ ID NO: 4077648 - RNA, 22 nt, Streptococcus pneumoniae R6
gucauaauugaguugggauaaa

SEQ ID NO: 4077649 - RNA, 18 nt, Streptococcus pneumoniae R6
gucauacaaggacuggag

SEQ ID NO: 4077650 - RNA, 13 nt, Streptococcus pneumoniae R6
gucauaccaguuu

SEQ ID NO: 4077651 - RNA, 20 nt, Streptococcus pneumoniae R6
gucaucaaaaauagaaauaa

SEQ ID NO: 4077652 - RNA, 14 nt, Streptococcus pneumoniae R6
gucaucagaaaaaa

SEQ ID NO: 4077653 - RNA, 17 nt, Streptococcus pneumoniae R6
gucaucagaaaaaaggc

SEQ ID NO: 4077654 - RNA, 18 nt, Streptococcus pneumoniae R6
gucaucagaaaaaaggca

SEQ ID NO: 4077655 - RNA, 16 nt, Streptococcus pneumoniae R6
gucaucagcagagaaa

SEQ ID NO: 4077656 - RNA, 21 nt, Streptococcus pneumoniae R6
gucauccuuacggucaaaguc

SEQ ID NO: 4077657 - RNA, 20 nt, Streptococcus pneumoniae R6
gucaucuuauagcgacuaua

SEQ ID NO: 4077658 - RNA, 12 nt, Streptococcus pneumoniae R6
gucaucuuccaa

SEQ ID NO: 4077659 - RNA, 17 nt, Streptococcus pneumoniae R6
gucaucuuccaagaccu

SEQ ID NO: 4077660 - RNA, 20 nt, Streptococcus pneumoniae R6
gucaucuuggauuauauaug

SEQ ID NO: 4077661 - RNA, 15 nt, Streptococcus pneumoniae R6
gucaugacuagugaa

SEQ ID NO: 4077662 - RNA, 16 nt, Streptococcus pneumoniae R6
gucaugacuagugaag

SEQ ID NO: 4077663 - RNA, 22 nt, Streptococcus pneumoniae R6
gucaugcaaaaaaaaugaaaaa

SEQ ID NO: 4077664 - RNA, 15 nt, Streptococcus pneumoniae R6
gucaugccuuuuuca

SEQ ID NO: 4077665 - RNA, 21 nt, Streptococcus pneumoniae R6
gucaugccuuuuucaaucaau

SEQ ID NO: 4077666 - RNA, 14 nt, Streptococcus pneumoniae R6
gucaugcgaaacag

SEQ ID NO: 4077667 - RNA, 22 nt, Streptococcus pneumoniae R6
gucauguagcgcuugaaacuca

SEQ ID NO: 4077668 - RNA, 17 nt, Streptococcus pneumoniae R6
gucauguuagaaaaaug

SEQ ID NO: 4077669 - RNA, 18 nt, Streptococcus pneumoniae R6
gucauuugagauaaggac

SEQ ID NO: 4077670 - RNA, 13 nt, Streptococcus pneumoniae R6
gucauuuuccaca

SEQ ID NO: 4077671 - RNA, 14 nt, Streptococcus pneumoniae R6
gucauuuuuuccaa

SEQ ID NO: 4077672 - RNA, 13 nt, Streptococcus pneumoniae R6
guccaaaagaccg

SEQ ID NO: 4077673 - RNA, 22 nt, Streptococcus pneumoniae R6
guccaaaccaacauagauaaag

SEQ ID NO: 4077674 - RNA, 19 nt, Streptococcus pneumoniae R6
guccaaacguccagccuug

SEQ ID NO: 4077675 - RNA, 15 nt, Streptococcus pneumoniae R6
gucuucaugcuggca

SEQ ID NO: 4077676 - RNA, 22 nt, Streptococcus pneumoniae R6
gucuucaugcuggcagaaacug

SEQ ID NO: 4077677 - RNA, 17 nt, Streptococcus pneumoniae R6
gucuuccauuucuuugu

SEQ ID NO: 4077678 - RNA, 18 nt, Streptococcus pneumoniae R6
gucuuccgaauaacucaa

SEQ ID NO: 4077679 - RNA, 14 nt, Streptococcus pneumoniae R6
gucuucgauaucuu

SEQ ID NO: 4077680 - RNA, 18 nt, Streptococcus pneumoniae R6
gucuucuccuaaaauuga

SEQ ID NO: 4077681 - RNA, 17 nt, Streptococcus pneumoniae R6
gucuucuuuucuuuuag

SEQ ID NO: 4077682 - RNA, 22 nt, Streptococcus pneumoniae R6
gucuucuuuucuuuuagugagu

SEQ ID NO: 4077683 - RNA, 17 nt, Streptococcus pneumoniae R6
gucuugcauuuuaauuu

SEQ ID NO: 4077684 - RNA, 18 nt, Streptococcus pneumoniae R6
gucuuggauuuuugauuc

SEQ ID NO: 4077685 - RNA, 15 nt, Streptococcus pneumoniae R6
gucuuggucugucaa

SEQ ID NO: 4077686 - RNA, 17 nt, Streptococcus pneumoniae R6
gucuuguucuuguuuca

SEQ ID NO: 4077687 - RNA, 12 nt, Streptococcus pneumoniae R6
gucuuuaaaauu

SEQ ID NO: 4077688 - RNA, 22 nt, Streptococcus pneumoniae R6
gucuuuaucgauucuugcaaac

SEQ ID NO: 4077689 - RNA, 21 nt, Streptococcus pneumoniae R6
gucuuucaagcgaacaucucc

SEQ ID NO: 4077690 - RNA, 15 nt, Streptococcus pneumoniae R6
gucuuucauuucugu

SEQ ID NO: 4077691 - RNA, 19 nt, Streptococcus pneumoniae R6
gucuuucuucguuuuuacu

SEQ ID NO: 4077692 - RNA, 11 nt, Streptococcus pneumoniae R6
gucuuugauaa

SEQ ID NO: 4077693 - RNA, 21 nt, Streptococcus pneumoniae R6
gucuuugcccccaucuccuug

SEQ ID NO: 4077694 - RNA, 17 nt, Streptococcus pneumoniae R6
gucuuugucagcauggc

SEQ ID NO: 4077695 - RNA, 17 nt, Streptococcus pneumoniae R6
gucuuuucggauggcua

SEQ ID NO: 4077696 - RNA, 19 nt, Streptococcus pneumoniae R6
gucuuuugucuugcuugcu

SEQ ID NO: 4077697 - RNA, 17 nt, Streptococcus pneumoniae R6
gugaaaggaagagagcu

SEQ ID NO: 4077698 - RNA, 21 nt, Streptococcus pneumoniae R6
gugaaagugggcugauuuuga

SEQ ID NO: 4077699 - RNA, 21 nt, Streptococcus pneumoniae R6
gugaaaguuagccucucuaaa

SEQ ID NO: 4077700 - RNA, 18 nt, Streptococcus pneumoniae R6
gugaacaagccuagucuu

SEQ ID NO: 4077701 - RNA, 15 nt, Streptococcus pneumoniae R6
gugaaggcuuuaaau

SEQ ID NO: 4077702 - RNA, 15 nt, Streptococcus pneumoniae R6
gugaaguugaaagau

SEQ ID NO: 4077703 - RNA, 17 nt, Streptococcus pneumoniae R6
gugaauaggcauaauac

SEQ ID NO: 4077704 - RNA, 14 nt, Streptococcus pneumoniae R6
gugaauauucuugg

SEQ ID NO: 4077705 - RNA, 17 nt, Streptococcus pneumoniae R6
gugaaucaucacuagua

SEQ ID NO: 4077706 - RNA, 23 nt, Streptococcus pneumoniae R6
gugaaugauucugaaauaacuca

SEQ ID NO: 4077707 - RNA, 20 nt, Streptococcus pneumoniae R6
gugaauggauuuaucaguau

SEQ ID NO: 4077708 - RNA, 13 nt, Streptococcus pneumoniae R6
gugaauuauagua

SEQ ID NO: 4077709 - RNA, 17 nt, Streptococcus pneumoniae R6
gugaauuucauuaaaug

SEQ ID NO: 4077710 - RNA, 18 nt, Streptococcus pneumoniae R6
gugaauuugcuacaaaua

SEQ ID NO: 4077711 - RNA, 22 nt, Streptococcus pneumoniae R6
gugacaaagaccuuugaaaacu

SEQ ID NO: 4077712 - RNA, 15 nt, Streptococcus pneumoniae R6
gugacaguaaaaaau

SEQ ID NO: 4077713 - RNA, 15 nt, Streptococcus pneumoniae R6
gugacauagaugcuu

SEQ ID NO: 4077714 - RNA, 20 nt, Streptococcus pneumoniae R6
gugacauaugauugucuccu

SEQ ID NO: 4077715 - RNA, 21 nt, Streptococcus pneumoniae R6
gugacauaugauugucuccuu

SEQ ID NO: 4077716 - RNA, 22 nt, Streptococcus pneumoniae R6
gugacauaugauugucuccuuu

SEQ ID NO: 4077717 - RNA, 20 nt, Streptococcus pneumoniae R6
gugaccagugauaacgaaua

SEQ ID NO: 4077718 - RNA, 19 nt, Streptococcus pneumoniae R6
gugacuucauuauuaugaa

SEQ ID NO: 4077719 - RNA, 16 nt, Streptococcus pneumoniae R6
gugagaagagggagaa

SEQ ID NO: 4077720 - RNA, 14 nt, Streptococcus pneumoniae R6
gugagacaagcaau

SEQ ID NO: 4077721 - RNA, 18 nt, Streptococcus pneumoniae R6
gugagaggaggugaaacu

SEQ ID NO: 4077722 - RNA, 16 nt, Streptococcus pneumoniae R6
gugagauaguaucaaa

SEQ ID NO: 4077723 - RNA, 20 nt, Streptococcus pneumoniae R6
gugagcuuugguuucagcua

SEQ ID NO: 4077724 - RNA, 13 nt, Streptococcus pneumoniae R6
gugaguuccuguu

SEQ ID NO: 4077725 - RNA, 15 nt, Streptococcus pneumoniae R6
gugauaaguaaagcu

SEQ ID NO: 4077726 - RNA, 17 nt, Streptococcus pneumoniae R6
gugauaaucauaaagcc

SEQ ID NO: 4077727 - RNA, 21 nt, Streptococcus pneumoniae R6
gugauaaugauuuggcaaauu

SEQ ID NO: 4077728 - RNA, 18 nt, Streptococcus pneumoniae R6
gugaugagggucaacuug

SEQ ID NO: 4077729 - RNA, 15 nt, Streptococcus pneumoniae R6
gugauguaauuucug

SEQ ID NO: 4077730 - RNA, 20 nt, Streptococcus pneumoniae R6
gugauuauagguuccuucug

SEQ ID NO: 4077731 - RNA, 13 nt, Streptococcus pneumoniae R6
gugauuguguccu

SEQ ID NO: 4077732 - RNA, 14 nt, Streptococcus pneumoniae R6
gugauuuaaauguu

SEQ ID NO: 4077733 - RNA, 16 nt, Streptococcus pneumoniae R6
gugauuuaccauaguu

SEQ ID NO: 4077734 - RNA, 17 nt, Streptococcus pneumoniae R6
gugauuuuauauaaaau

SEQ ID NO: 4077735 - RNA, 21 nt, Streptococcus pneumoniae R6
gugcaauccaaguuuggcaga

SEQ ID NO: 4077736 - RNA, 22 nt, Streptococcus pneumoniae R6
gugcacacgaaucugauggguu

SEQ ID NO: 4077737 - RNA, 13 nt, Streptococcus pneumoniae R6
gugcagucuuuuu

SEQ ID NO: 4077738 - RNA, 19 nt, Streptococcus pneumoniae R6
gugcaguuuucauucuacu

SEQ ID NO: 4077739 - RNA, 12 nt, Streptococcus pneumoniae R6
gugcaugaguua

SEQ ID NO: 4077740 - RNA, 16 nt, Streptococcus pneumoniae R6
gugccccaguucuuca

SEQ ID NO: 4077741 - RNA, 19 nt, Streptococcus pneumoniae R6
gugcccuggggucggcaga

SEQ ID NO: 4077742 - RNA, 15 nt, Streptococcus pneumoniae R6
gugccugcauggcuc

SEQ ID NO: 4077743 - RNA, 21 nt, Streptococcus pneumoniae R6
gugcgaaugcuucuuggauac

SEQ ID NO: 4077744 - RNA, 15 nt, Streptococcus pneumoniae R6
gugcgagacaaaaaa

SEQ ID NO: 4077745 - RNA, 17 nt, Streptococcus pneumoniae R6
gugcgcgucgaagguua

SEQ ID NO: 4077746 - RNA, 14 nt, Streptococcus pneumoniae R6
gugcucuuaaacaa

SEQ ID NO: 4077747 - RNA, 15 nt, Streptococcus pneumoniae R6
gugcuggcauguccu

SEQ ID NO: 4077748 - RNA, 21 nt, Streptococcus pneumoniae R6
gugcuucuuuguaggcuucuu

SEQ ID NO: 4077749 - RNA, 16 nt, Streptococcus pneumoniae R6
guggaaaauagaaaaa

SEQ ID NO: 4077750 - RNA, 12 nt, Streptococcus pneumoniae R6
guggaugaaacu

SEQ ID NO: 4077751 - RNA, 15 nt, Streptococcus pneumoniae R6
guggauggaacugac

SEQ ID NO: 4077752 - RNA, 18 nt, Streptococcus pneumoniae R6
guggauuggcucaaucaa

SEQ ID NO: 4077753 - RNA, 23 nt, Streptococcus pneumoniae R6
guggauuuucacgagucacugug

SEQ ID NO: 4077754 - RNA, 20 nt, Streptococcus pneumoniae R6
guggauuuuucuucuuuucu

SEQ ID NO: 4077755 - RNA, 17 nt, Streptococcus pneumoniae R6
guggcagcauugucauu

SEQ ID NO: 4077756 - RNA, 17 nt, Streptococcus pneumoniae R6
gugggcuauuccauauu

SEQ ID NO: 4077757 - RNA, 13 nt, Streptococcus pneumoniae R6
gugggucaucaag

SEQ ID NO: 4077758 - RNA, 19 nt, Streptococcus pneumoniae R6
guguaauaaacuggguuga

SEQ ID NO: 4077759 - RNA, 20 nt, Streptococcus pneumoniae R6
guguacuauucuaguuucaa

SEQ ID NO: 4077760 - RNA, 23 nt, Streptococcus pneumoniae R6
guguacuauucuaguuucaaucu

SEQ ID NO: 4077761 - RNA, 19 nt, Streptococcus pneumoniae R6
guguaggggauaaugagga

SEQ ID NO: 4077762 - RNA, 13 nt, Streptococcus pneumoniae R6
guguaucaggaau

SEQ ID NO: 4077763 - RNA, 13 nt, Streptococcus pneumoniae R6
guguauggagcuu

SEQ ID NO: 4077764 - RNA, 18 nt, Streptococcus pneumoniae R6
guguauuguacuuuccaa

SEQ ID NO: 4077765 - RNA, 22 nt, Streptococcus pneumoniae R6
gugucauaguccugaaaaucau

SEQ ID NO: 4077766 - RNA, 14 nt, Streptococcus pneumoniae R6
gugugacagguuug

SEQ ID NO: 4077767 - RNA, 16 nt, Streptococcus pneumoniae R6
gugugacccaagauag

SEQ ID NO: 4077768 - RNA, 20 nt, Streptococcus pneumoniae R6
gugugagaggggcuagagau

SEQ ID NO: 4077769 - RNA, 16 nt, Streptococcus pneumoniae R6
gugugcgucgaagguu

SEQ ID NO: 4077770 - RNA, 19 nt, Streptococcus pneumoniae R6
gugugggcuuuuuucuauc

SEQ ID NO: 4077771 - RNA, 14 nt, Streptococcus pneumoniae R6
guguguucugcagg

SEQ ID NO: 4077772 - RNA, 15 nt, Streptococcus pneumoniae R6
guguuaauuggaaaa

SEQ ID NO: 4077773 - RNA, 17 nt, Streptococcus pneumoniae R6
guguuaucugaaaauua

SEQ ID NO: 4077774 - RNA, 11 nt, Streptococcus pneumoniae R6
guguucaaaaa

SEQ ID NO: 4077775 - RNA, 14 nt, Streptococcus pneumoniae R6
guguucaaaaaccu

SEQ ID NO: 4077776 - RNA, 16 nt, Streptococcus pneumoniae R6
guguucacgaaagcaa

SEQ ID NO: 4077777 - RNA, 14 nt, Streptococcus pneumoniae R6
guguucuaaaauaa

SEQ ID NO: 4077778 - RNA, 20 nt, Streptococcus pneumoniae R6
guucuauccacaaccucaaa

SEQ ID NO: 4077779 - RNA, 20 nt, Streptococcus pneumoniae R6
guucuauccacaaccuuaaa

SEQ ID NO: 4077780 - RNA, 21 nt, Streptococcus pneumoniae R6
guucuaucugcaaccucaaaa

SEQ ID NO: 4077781 - RNA, 19 nt, Streptococcus pneumoniae R6
guucuaucugcaaccuuaa

SEQ ID NO: 4077782 - RNA, 22 nt, Streptococcus pneumoniae R6
guucuaucugcaaccuuaaaac

SEQ ID NO: 4077783 - RNA, 20 nt, Streptococcus pneumoniae R6
guucuaucugccaccucaaa

SEQ ID NO: 4077784 - RNA, 13 nt, Streptococcus pneumoniae R6
guucuaugaguau

SEQ ID NO: 4077785 - RNA, 18 nt, Streptococcus pneumoniae R6
guucuauggcuuguucaa

SEQ ID NO: 4077786 - RNA, 19 nt, Streptococcus pneumoniae R6
guucucaaucaagauagcu

SEQ ID NO: 4077787 - RNA, 17 nt, Streptococcus pneumoniae R6
guucuccggcuuucaca

SEQ ID NO: 4077788 - RNA, 20 nt, Streptococcus pneumoniae R6
guucucugagauacuccaaa

SEQ ID NO: 4077789 - RNA, 21 nt, Streptococcus pneumoniae R6
guucucuuugcauuucaucuu

SEQ ID NO: 4077790 - RNA, 16 nt, Streptococcus pneumoniae R6
guucugccuauuuuuu

SEQ ID NO: 4077791 - RNA, 14 nt, Streptococcus pneumoniae R6
guucuggagaagca

SEQ ID NO: 4077792 - RNA, 16 nt, Streptococcus pneumoniae R6
guucugguaggaguuu

SEQ ID NO: 4077793 - RNA, 15 nt, Streptococcus pneumoniae R6
guucuguaaugaaau

SEQ ID NO: 4077794 - RNA, 13 nt, Streptococcus pneumoniae R6
guucuguacugca

SEQ ID NO: 4077795 - RNA, 20 nt, Streptococcus pneumoniae R6
guucugucaaaccaugaggu

SEQ ID NO: 4077796 - RNA, 19 nt, Streptococcus pneumoniae R6
guucuguucuuauuucauu

SEQ ID NO: 4077797 - RNA, 12 nt, Streptococcus pneumoniae R6
guucuuccacuc

SEQ ID NO: 4077798 - RNA, 16 nt, Streptococcus pneumoniae R6
guucuugaaaugaagu

SEQ ID NO: 4077799 - RNA, 12 nt, Streptococcus pneumoniae R6
guucuuguuuca

SEQ ID NO: 4077800 - RNA, 19 nt, Streptococcus pneumoniae R6
guucuuuaaagguaucaac

SEQ ID NO: 4077801 - RNA, 12 nt, Streptococcus pneumoniae R6
guucuuuagaaa

SEQ ID NO: 4077802 - RNA, 20 nt, Streptococcus pneumoniae R6
guucuuuagaaagguuuuaa

SEQ ID NO: 4077803 - RNA, 21 nt, Streptococcus pneumoniae R6
guucuuuuacaauguugucaa

SEQ ID NO: 4077804 - RNA, 18 nt, Streptococcus pneumoniae R6
guucuuuucauaaagaga

SEQ ID NO: 4077805 - RNA, 20 nt, Streptococcus pneumoniae R6
guucuuuucucuagcuuuua

SEQ ID NO: 4077806 - RNA, 23 nt, Streptococcus pneumoniae R6
guucuuuucuguugauauuucca

SEQ ID NO: 4077807 - RNA, 12 nt, Streptococcus pneumoniae R6
guucuuuuucaa

SEQ ID NO: 4077808 - RNA, 19 nt, Streptococcus pneumoniae R6
guugaaaaaaagcuaagcu

SEQ ID NO: 4077809 - RNA, 11 nt, Streptococcus pneumoniae R6
guugaaauugg

SEQ ID NO: 4077810 - RNA, 15 nt, Streptococcus pneumoniae R6
guugaacuuuagaaa

SEQ ID NO: 4077811 - RNA, 19 nt, Streptococcus pneumoniae R6
guugaagaaaagcuaagcu

SEQ ID NO: 4077812 - RNA, 15 nt, Streptococcus pneumoniae R6
guugaagauuucauc

SEQ ID NO: 4077813 - RNA, 18 nt, Streptococcus pneumoniae R6
guugaagucagcuaagcu

SEQ ID NO: 4077814 - RNA, 21 nt, Streptococcus pneumoniae R6
guugaagucagcuaagcucga

SEQ ID NO: 4077815 - RNA, 18 nt, Streptococcus pneumoniae R6
guugaagucagcuaggcu

SEQ ID NO: 4077816 - RNA, 15 nt, Streptococcus pneumoniae R6
guugaaugagcuucc

SEQ ID NO: 4077817 - RNA, 16 nt, Streptococcus pneumoniae R6
guugaaugccuccaag

SEQ ID NO: 4077818 - RNA, 16 nt, Streptococcus pneumoniae R6
guugacaaagagccaa

SEQ ID NO: 4077819 - RNA, 21 nt, Streptococcus pneumoniae R6
guugacaaagagccauaaaaa

SEQ ID NO: 4077820 - RNA, 17 nt, Streptococcus pneumoniae R6
guugacaaucuuuucuu

SEQ ID NO: 4077821 - RNA, 23 nt, Streptococcus pneumoniae R6
guugaccauuucaauagcuccuu

SEQ ID NO: 4077822 - RNA, 18 nt, Streptococcus pneumoniae R6
guugaccuuggcuuccga

SEQ ID NO: 4077823 - RNA, 17 nt, Streptococcus pneumoniae R6
guugagaagugggagaa

SEQ ID NO: 4077824 - RNA, 20 nt, Streptococcus pneumoniae R6
guugagaagugggagaaaag

SEQ ID NO: 4077825 - RNA, 17 nt, Streptococcus pneumoniae R6
guugagcauacugcccu

SEQ ID NO: 4077826 - RNA, 19 nt, Streptococcus pneumoniae R6
guugaguuguguacucaac

SEQ ID NO: 4077827 - RNA, 16 nt, Streptococcus pneumoniae R6
guugauaaucuuaucu

SEQ ID NO: 4077828 - RNA, 21 nt, Streptococcus pneumoniae R6
guugauucaugacaucuucca

SEQ ID NO: 4077829 - RNA, 23 nt, Streptococcus pneumoniae R6
guugauuuaacaacguuucuagc

SEQ ID NO: 4077830 - RNA, 16 nt, Streptococcus pneumoniae R6
guugcaaauuuauaaa

SEQ ID NO: 4077831 - RNA, 16 nt, Streptococcus pneumoniae R6
guugcaaguuuuagau

SEQ ID NO: 4077832 - RNA, 16 nt, Streptococcus pneumoniae R6
guugcaccaagucaua

SEQ ID NO: 4077833 - RNA, 18 nt, Streptococcus pneumoniae R6
guugcagauagaacugac

SEQ ID NO: 4077834 - RNA, 18 nt, Streptococcus pneumoniae R6
guugccuaaaacuccaac

SEQ ID NO: 4077835 - RNA, 12 nt, Streptococcus pneumoniae R6
guugcucaaagu

SEQ ID NO: 4077836 - RNA, 21 nt, Streptococcus pneumoniae R6
guugcugucguagucuaggau

SEQ ID NO: 4077837 - RNA, 14 nt, Streptococcus pneumoniae R6
guugcuucaucucc

SEQ ID NO: 4077838 - RNA, 15 nt, Streptococcus pneumoniae R6
guugcuuuucuucaa

SEQ ID NO: 4077839 - RNA, 13 nt, Streptococcus pneumoniae R6
guuggauuuccac

SEQ ID NO: 4077840 - RNA, 20 nt, Streptococcus pneumoniae R6
guuggauuuccacuaaaggu

SEQ ID NO: 4077841 - RNA, 14 nt, Streptococcus pneumoniae R6
guuggccaacuucu

SEQ ID NO: 4077842 - RNA, 13 nt, Streptococcus pneumoniae R6
guuggcugucauu

SEQ ID NO: 4077843 - RNA, 22 nt, Streptococcus pneumoniae R6
guugggcagacgaguuaaaaca

SEQ ID NO: 4077844 - RNA, 20 nt, Streptococcus pneumoniae R6
guugguaagagaaauuucug

SEQ ID NO: 4077845 - RNA, 13 nt, Streptococcus pneumoniae R6
guuggucucccaa

SEQ ID NO: 4077846 - RNA, 18 nt, Streptococcus pneumoniae R6
guuggugaauuugcuaca

SEQ ID NO: 4077847 - RNA, 19 nt, Streptococcus pneumoniae R6
guuguaaucuuagcaaaga

SEQ ID NO: 4077848 - RNA, 23 nt, Streptococcus pneumoniae R6
guuguaaucuuagcaaagauauu

SEQ ID NO: 4077849 - RNA, 21 nt, Streptococcus pneumoniae R6
guuguacaagaaaagugcaaa

SEQ ID NO: 4077850 - RNA, 23 nt, Streptococcus pneumoniae R6
guuguagauggaacugacgaagu

SEQ ID NO: 4077851 - RNA, 16 nt, Streptococcus pneumoniae R6
guugucaaaccacaac

SEQ ID NO: 4077852 - RNA, 17 nt, Streptococcus pneumoniae R6
guugucgcuugagagaa

SEQ ID NO: 4077853 - RNA, 18 nt, Streptococcus pneumoniae R6
guuguggauagaacugac

SEQ ID NO: 4077854 - RNA, 23 nt, Streptococcus pneumoniae R6
guuguggauagaacugacgaagu

SEQ ID NO: 4077855 - RNA, 14 nt, Streptococcus pneumoniae R6
guuguggaugaaac

SEQ ID NO: 4077856 - RNA, 23 nt, Streptococcus pneumoniae R6
guuguggaugaaacugacgaagu

SEQ ID NO: 4077857 - RNA, 16 nt, Streptococcus pneumoniae R6
guuuaaacucagguuu

SEQ ID NO: 4077858 - RNA, 18 nt, Streptococcus pneumoniae R6
guuuaaagacaguugcau

SEQ ID NO: 4077859 - RNA, 14 nt, Streptococcus pneumoniae R6
guuuaaaucauaau

SEQ ID NO: 4077860 - RNA, 18 nt, Streptococcus pneumoniae R6
guuuaacuguuccuucua

SEQ ID NO: 4077861 - RNA, 18 nt, Streptococcus pneumoniae R6
guuuaccaauuuuuccuu

SEQ ID NO: 4077862 - RNA, 23 nt, Streptococcus pneumoniae R6
guuuacgaaucucuuuccacacu

SEQ ID NO: 4077863 - RNA, 14 nt, Streptococcus pneumoniae R6
guuuacuauccuca

SEQ ID NO: 4077864 - RNA, 16 nt, Streptococcus pneumoniae R6
guuuauagauaaaugu

SEQ ID NO: 4077865 - RNA, 17 nt, Streptococcus pneumoniae R6
guuuauauaguagccaa

SEQ ID NO: 4077866 - RNA, 17 nt, Streptococcus pneumoniae R6
guuuauaucuaauaauu

SEQ ID NO: 4077867 - RNA, 11 nt, Streptococcus pneumoniae R6
guuuaucaaua

SEQ ID NO: 4077868 - RNA, 18 nt, Streptococcus pneumoniae R6
guuuaugguauuuguaaa

SEQ ID NO: 4077869 - RNA, 14 nt, Streptococcus pneumoniae R6
guuuauuuuuuauc

SEQ ID NO: 4077870 - RNA, 15 nt, Streptococcus pneumoniae R6
guuucaaaugaaaua

SEQ ID NO: 4077871 - RNA, 20 nt, Streptococcus pneumoniae R6
guuucaaaugaaauauuuuu

SEQ ID NO: 4077872 - RNA, 16 nt, Streptococcus pneumoniae R6
guuucaacugaugaga

SEQ ID NO: 4077873 - RNA, 13 nt, Streptococcus pneumoniae R6
guuucaauauacu

SEQ ID NO: 4077874 - RNA, 14 nt, Streptococcus pneumoniae R6
guuucaaucguuuc

SEQ ID NO: 4077875 - RNA, 16 nt, Streptococcus pneumoniae R6
guuucagccacuauuu

SEQ ID NO: 4077876 - RNA, 20 nt, Streptococcus pneumoniae R6
guuucagccacuauuuuauc

SEQ ID NO: 4077877 - RNA, 18 nt, Streptococcus pneumoniae R6
guuucaggaaguuuuuuc

SEQ ID NO: 4077878 - RNA, 22 nt, Streptococcus pneumoniae R6
guuucauuguauccuaaaucau

SEQ ID NO: 4077879 - RNA, 17 nt, Streptococcus pneumoniae R6
guuuccaacgacuucca

SEQ ID NO: 4077880 - RNA, 14 nt, Streptococcus pneumoniae R6
uaaaacaaaauucu

SEQ ID NO: 4077881 - RNA, 12 nt, Streptococcus pneumoniae R6
uaaaacaaagaa

SEQ ID NO: 4077882 - RNA, 15 nt, Streptococcus pneumoniae R6
uaaaacaaagaaaaa

SEQ ID NO: 4077883 - RNA, 22 nt, Streptococcus pneumoniae R6
uaaaacauucuuaucaauugau

SEQ ID NO: 4077884 - RNA, 12 nt, Streptococcus pneumoniae R6
uaaaacauuuau

SEQ ID NO: 4077885 - RNA, 16 nt, Streptococcus pneumoniae R6
uaaaacauuuauagaa

SEQ ID NO: 4077886 - RNA, 19 nt, Streptococcus pneumoniae R6
uaaaacauuuccgauuuca

SEQ ID NO: 4077887 - RNA, 14 nt, Streptococcus pneumoniae R6
uaaaaccaaaggca

SEQ ID NO: 4077888 - RNA, 15 nt, Streptococcus pneumoniae R6
uaaaaccuguuugaa

SEQ ID NO: 4077889 - RNA, 17 nt, Streptococcus pneumoniae R6
uaaaaccuugauacugu

SEQ ID NO: 4077890 - RNA, 18 nt, Streptococcus pneumoniae R6
uaaaaccuugauacugua

SEQ ID NO: 4077891 - RNA, 21 nt, Streptococcus pneumoniae R6
uaaaacgaaaggauuauaaaa

SEQ ID NO: 4077892 - RNA, 18 nt, Streptococcus pneumoniae R6
uaaaacgcauaguaucag

SEQ ID NO: 4077893 - RNA, 16 nt, Streptococcus pneumoniae R6
uaaaacggagaauaag

SEQ ID NO: 4077894 - RNA, 15 nt, Streptococcus pneumoniae R6
uaaaacgucguaauc

SEQ ID NO: 4077895 - RNA, 17 nt, Streptococcus pneumoniae R6
uaaaacguugguaaaag

SEQ ID NO: 4077896 - RNA, 14 nt, Streptococcus pneumoniae R6
uaaaacuaaagcuu

SEQ ID NO: 4077897 - RNA, 14 nt, Streptococcus pneumoniae R6
uaaaacuagugaag

SEQ ID NO: 4077898 - RNA, 16 nt, Streptococcus pneumoniae R6
uaaaacuauugacuuu

SEQ ID NO: 4077899 - RNA, 15 nt, Streptococcus pneumoniae R6
uaaaacucauuaaua

SEQ ID NO: 4077900 - RNA, 21 nt, Streptococcus pneumoniae R6
uaaaacugacgugguuuaaaa

SEQ ID NO: 4077901 - RNA, 17 nt, Streptococcus pneumoniae R6
uaaaacuguaugagaaa

SEQ ID NO: 4077902 - RNA, 18 nt, Streptococcus pneumoniae R6
uaaaacuguaugagaaac

SEQ ID NO: 4077903 - RNA, 19 nt, Streptococcus pneumoniae R6
uaaaacuguaugagaaaca

SEQ ID NO: 4077904 - RNA, 21 nt, Streptococcus pneumoniae R6
uaaaacuucgauaguacuauu

SEQ ID NO: 4077905 - RNA, 15 nt, Streptococcus pneumoniae R6
uaaaacuuuuaaaau

SEQ ID NO: 4077906 - RNA, 19 nt, Streptococcus pneumoniae R6
uaaaacuuuuaaaauccau

SEQ ID NO: 4077907 - RNA, 14 nt, Streptococcus pneumoniae R6
uaaaagaauucacu

SEQ ID NO: 4077908 - RNA, 21 nt, Streptococcus pneumoniae R6
uaaaagaggagguaaauccca

SEQ ID NO: 4077909 - RNA, 19 nt, Streptococcus pneumoniae R6
uaaaagauaaucaucugga

SEQ ID NO: 4077910 - RNA, 21 nt, Streptococcus pneumoniae R6
uaaaagauuucuauaaauuca

SEQ ID NO: 4077911 - RNA, 22 nt, Streptococcus pneumoniae R6
uaaaagauuucuauaaauucau

SEQ ID NO: 4077912 - RNA, 22 nt, Streptococcus pneumoniae R6
uaaaagcaaaaacgcauaguau

SEQ ID NO: 4077913 - RNA, 22 nt, Streptococcus pneumoniae R6
uaaaagcgauuggaccagccaa

SEQ ID NO: 4077914 - RNA, 18 nt, Streptococcus pneumoniae R6
uaaaaggcucauaaaugg

SEQ ID NO: 4077915 - RNA, 14 nt, Streptococcus pneumoniae R6
uaaaagguauugca

SEQ ID NO: 4077916 - RNA, 14 nt, Streptococcus pneumoniae R6
uaaaaguaagagaa

SEQ ID NO: 4077917 - RNA, 16 nt, Streptococcus pneumoniae R6
uaaaaguaagagaaac

SEQ ID NO: 4077918 - RNA, 20 nt, Streptococcus pneumoniae R6
uaaaaguacuuucagaacau

SEQ ID NO: 4077919 - RNA, 13 nt, Streptococcus pneumoniae R6
uaaaagucauacu

SEQ ID NO: 4077920 - RNA, 19 nt, Streptococcus pneumoniae R6
uaaaaguuuccccugccaa

SEQ ID NO: 4077921 - RNA, 15 nt, Streptococcus pneumoniae R6
uaaaauaacucaauu

SEQ ID NO: 4077922 - RNA, 13 nt, Streptococcus pneumoniae R6
uaaaauaaguuca

SEQ ID NO: 4077923 - RNA, 15 nt, Streptococcus pneumoniae R6
uaaaauaauuaaaau

SEQ ID NO: 4077924 - RNA, 17 nt, Streptococcus pneumoniae R6
uaaaauagggcaugcca

SEQ ID NO: 4077925 - RNA, 18 nt, Streptococcus pneumoniae R6
uaaaauaguacgaaacaa

SEQ ID NO: 4077926 - RNA, 19 nt, Streptococcus pneumoniae R6
uaaaauaguggcugaaacu

SEQ ID NO: 4077927 - RNA, 15 nt, Streptococcus pneumoniae R6
uaaaauaguuaggca

SEQ ID NO: 4077928 - RNA, 16 nt, Streptococcus pneumoniae R6
uaaaauauaguagauu

SEQ ID NO: 4077929 - RNA, 21 nt, Streptococcus pneumoniae R6
uaaaauauaguagauugaaau

SEQ ID NO: 4077930 - RNA, 13 nt, Streptococcus pneumoniae R6
uaaaauaucugua

SEQ ID NO: 4077931 - RNA, 13 nt, Streptococcus pneumoniae R6
uaaaauauuagca

SEQ ID NO: 4077932 - RNA, 14 nt, Streptococcus pneumoniae R6
uaaaauauuucuag

SEQ ID NO: 4077933 - RNA, 19 nt, Streptococcus pneumoniae R6
uaaaaucaagguuuuugaa

SEQ ID NO: 4077934 - RNA, 21 nt, Streptococcus pneumoniae R6
uaaaaucaagguuuuugaaca

SEQ ID NO: 4077935 - RNA, 14 nt, Streptococcus pneumoniae R6
uaaaaucacaaaaa

SEQ ID NO: 4077936 - RNA, 12 nt, Streptococcus pneumoniae R6
uaaaaucaggaa

SEQ ID NO: 4077937 - RNA, 20 nt, Streptococcus pneumoniae R6
uaaaaucaggucuuauagaa

SEQ ID NO: 4077938 - RNA, 21 nt, Streptococcus pneumoniae R6
uaaaaucagguguucaaaaac

SEQ ID NO: 4077939 - RNA, 20 nt, Streptococcus pneumoniae R6
uaaaaucaucgccaaaucau

SEQ ID NO: 4077940 - RNA, 17 nt, Streptococcus pneumoniae R6
uaaaaucccauauuugg

SEQ ID NO: 4077941 - RNA, 13 nt, Streptococcus pneumoniae R6
uaaaaucucuuua

SEQ ID NO: 4077942 - RNA, 17 nt, Streptococcus pneumoniae R6
uaaaaucugaagaaagc

SEQ ID NO: 4077943 - RNA, 19 nt, Streptococcus pneumoniae R6
uaaaaucugaagaaagcaa

SEQ ID NO: 4077944 - RNA, 20 nt, Streptococcus pneumoniae R6
uaaaaucugaagaaagcaau

SEQ ID NO: 4077945 - RNA, 21 nt, Streptococcus pneumoniae R6
uaaaaucugaagaaagcaauu

SEQ ID NO: 4077946 - RNA, 15 nt, Streptococcus pneumoniae R6
uaaaaucuugucaag

SEQ ID NO: 4077947 - RNA, 15 nt, Streptococcus pneumoniae R6
uaaaaucuuugaaca

SEQ ID NO: 4077948 - RNA, 16 nt, Streptococcus pneumoniae R6
uaaaaucuuugaacau

SEQ ID NO: 4077949 - RNA, 13 nt, Streptococcus pneumoniae R6
uaaaaucuuuuac

SEQ ID NO: 4077950 - RNA, 14 nt, Streptococcus pneumoniae R6
uaaaaucuuuuacu

SEQ ID NO: 4077951 - RNA, 20 nt, Streptococcus pneumoniae R6
uaaaaucuuuuacuucugaa

SEQ ID NO: 4077952 - RNA, 12 nt, Streptococcus pneumoniae R6
uaaaaugaaaua

SEQ ID NO: 4077953 - RNA, 14 nt, Streptococcus pneumoniae R6
uaaaaugaaauaau

SEQ ID NO: 4077954 - RNA, 17 nt, Streptococcus pneumoniae R6
uaaaaugagucuaucaa

SEQ ID NO: 4077955 - RNA, 16 nt, Streptococcus pneumoniae R6
uaaaaugccaaagaaa

SEQ ID NO: 4077956 - RNA, 16 nt, Streptococcus pneumoniae R6
uaaaauuaaaaagagu

SEQ ID NO: 4077957 - RNA, 19 nt, Streptococcus pneumoniae R6
uaaaauuccuuuaaaaaca

SEQ ID NO: 4077958 - RNA, 21 nt, Streptococcus pneumoniae R6
uaaaauuccuuuaaaaacaau

SEQ ID NO: 4077959 - RNA, 17 nt, Streptococcus pneumoniae R6
uaaaauucguuucauua

SEQ ID NO: 4077960 - RNA, 20 nt, Streptococcus pneumoniae R6
uaaaauucguuucauuauuu

SEQ ID NO: 4077961 - RNA, 15 nt, Streptococcus pneumoniae R6
uaaaauugauaauag

SEQ ID NO: 4077962 - RNA, 23 nt, Streptococcus pneumoniae R6
uaaaauugcuuucuucagauuuu

SEQ ID NO: 4077963 - RNA, 15 nt, Streptococcus pneumoniae R6
uaaaauuguuucaug

SEQ ID NO: 4077964 - RNA, 14 nt, Streptococcus pneumoniae R6
uaaaauuuaaaaau

SEQ ID NO: 4077965 - RNA, 16 nt, Streptococcus pneumoniae R6
uaaaauuuaaaaauag

SEQ ID NO: 4077966 - RNA, 13 nt, Streptococcus pneumoniae R6
uaaaauuugaaca

SEQ ID NO: 4077967 - RNA, 19 nt, Streptococcus pneumoniae R6
uaaacaaacuccucuccag

SEQ ID NO: 4077968 - RNA, 21 nt, Streptococcus pneumoniae R6
uaaacaaacuccucuccagca

SEQ ID NO: 4077969 - RNA, 16 nt, Streptococcus pneumoniae R6
uaaacaaagagguuuu

SEQ ID NO: 4077970 - RNA, 21 nt, Streptococcus pneumoniae R6
uaaacaaaggaguuaaccucg

SEQ ID NO: 4077971 - RNA, 14 nt, Streptococcus pneumoniae R6
uaaacaaagucuga

SEQ ID NO: 4077972 - RNA, 16 nt, Streptococcus pneumoniae R6
uaaacaaagucugaaa

SEQ ID NO: 4077973 - RNA, 20 nt, Streptococcus pneumoniae R6
uaaacaaaugacuuucuaau

SEQ ID NO: 4077974 - RNA, 22 nt, Streptococcus pneumoniae R6
uaaacaaguugcuugaaaacuc

SEQ ID NO: 4077975 - RNA, 20 nt, Streptococcus pneumoniae R6
uaaacacacuauguggcuug

SEQ ID NO: 4077976 - RNA, 13 nt, Streptococcus pneumoniae R6
uaaacacuucacu

SEQ ID NO: 4077977 - RNA, 14 nt, Streptococcus pneumoniae R6
uaaacacuucacua

SEQ ID NO: 4077978 - RNA, 21 nt, Streptococcus pneumoniae R6
uaaacagggcaucuaagcauu

SEQ ID NO: 4077979 - RNA, 22 nt, Streptococcus pneumoniae R6
uaaacagucccauaaaacuaua

SEQ ID NO: 4077980 - RNA, 17 nt, Streptococcus pneumoniae R6
uaaacaugucuauagaa

SEQ ID NO: 4077981 - RNA, 12 nt, Streptococcus pneumoniae R6
uaaacauuugau

SEQ ID NO: 4077982 - RNA, 15 nt, Streptococcus pneumoniae R6
uaaaccaccagagug

SEQ ID NO: 4077983 - RNA, 19 nt, Streptococcus pneumoniae R6
uaaaucuaggacaaagcgc

SEQ ID NO: 4077984 - RNA, 18 nt, Streptococcus pneumoniae R6
uaaaucuguacuaagcau

SEQ ID NO: 4077985 - RNA, 14 nt, Streptococcus pneumoniae R6
uaaaucuuauauuu

SEQ ID NO: 4077986 - RNA, 14 nt, Streptococcus pneumoniae R6
uaaaucuuccuagg

SEQ ID NO: 4077987 - RNA, 21 nt, Streptococcus pneumoniae R6
uaaaucuucggauaaauuaau

SEQ ID NO: 4077988 - RNA, 22 nt, Streptococcus pneumoniae R6
uaaaucuucggauaaauuaauu

SEQ ID NO: 4077989 - RNA, 22 nt, Streptococcus pneumoniae R6
uaaaucuugcccuucuagaguc

SEQ ID NO: 4077990 - RNA, 14 nt, Streptococcus pneumoniae R6
uaaaucuuuaacau

SEQ ID NO: 4077991 - RNA, 16 nt, Streptococcus pneumoniae R6
uaaaugcauacgaaaa

SEQ ID NO: 4077992 - RNA, 22 nt, Streptococcus pneumoniae R6
uaaauguaguuggauuuccacu

SEQ ID NO: 4077993 - RNA, 21 nt, Streptococcus pneumoniae R6
uaaauguuucauuuuugagug

SEQ ID NO: 4077994 - RNA, 13 nt, Streptococcus pneumoniae R6
uaaauguuuucuc

SEQ ID NO: 4077995 - RNA, 14 nt, Streptococcus pneumoniae R6
uaaauguuuucuca

SEQ ID NO: 4077996 - RNA, 20 nt, Streptococcus pneumoniae R6
uaaauguuuucucauagcca

SEQ ID NO: 4077997 - RNA, 17 nt, Streptococcus pneumoniae R6
uaaauuaguuuuuagaa

SEQ ID NO: 4077998 - RNA, 16 nt, Streptococcus pneumoniae R6
uaaauuauaaauuauu

SEQ ID NO: 4077999 - RNA, 17 nt, Streptococcus pneumoniae R6
uaaauuauacucuuaga

SEQ ID NO: 4078000 - RNA, 18 nt, Streptococcus pneumoniae R6
uaaauuauacucuuagaa

SEQ ID NO: 4078001 - RNA, 17 nt, Streptococcus pneumoniae R6
uaaauuauuaaaauccc

SEQ ID NO: 4078002 - RNA, 13 nt, Streptococcus pneumoniae R6
uaaauuauuucuu

SEQ ID NO: 4078003 - RNA, 21 nt, Streptococcus pneumoniae R6
uaaauucaguaugcuauaucu

SEQ ID NO: 4078004 - RNA, 19 nt, Streptococcus pneumoniae R6
uaaauuccaaauuagaaaa

SEQ ID NO: 4078005 - RNA, 22 nt, Streptococcus pneumoniae R6
uaaauuccaaauuagaaaaaga

SEQ ID NO: 4078006 - RNA, 15 nt, Streptococcus pneumoniae R6
uaaauucugucacaa

SEQ ID NO: 4078007 - RNA, 17 nt, Streptococcus pneumoniae R6
uaaauugcgauuuugcc

SEQ ID NO: 4078008 - RNA, 19 nt, Streptococcus pneumoniae R6
uaaauugcuggagaaucau

SEQ ID NO: 4078009 - RNA, 21 nt, Streptococcus pneumoniae R6
uaaauugucuaaaaauuuaaa

SEQ ID NO: 4078010 - RNA, 21 nt, Streptococcus pneumoniae R6
uaaauuuaacauuaacaucac

SEQ ID NO: 4078011 - RNA, 16 nt, Streptococcus pneumoniae R6
uaaauuuacuuaaaau

SEQ ID NO: 4078012 - RNA, 17 nt, Streptococcus pneumoniae R6
uaaauuuacuuaaaauu

SEQ ID NO: 4078013 - RNA, 21 nt, Streptococcus pneumoniae R6
uaaauuuagaucaucaaccuc

SEQ ID NO: 4078014 - RNA, 19 nt, Streptococcus pneumoniae R6
uaaauuucgaaaaaugcuc

SEQ ID NO: 4078015 - RNA, 19 nt, Streptococcus pneumoniae R6
uaaauuuggugcuaagucc

SEQ ID NO: 4078016 - RNA, 17 nt, Streptococcus pneumoniae R6
uaaauuuuuuucucaau

SEQ ID NO: 4078017 - RNA, 14 nt, Streptococcus pneumoniae R6
uaacaaaagagcua

SEQ ID NO: 4078018 - RNA, 16 nt, Streptococcus pneumoniae R6
uaacaaaauuauuaaa

SEQ ID NO: 4078019 - RNA, 15 nt, Streptococcus pneumoniae R6
uaacaaaccaagaau

SEQ ID NO: 4078020 - RNA, 22 nt, Streptococcus pneumoniae R6
uaacaaagcuacgacuuucaag

SEQ ID NO: 4078021 - RNA, 15 nt, Streptococcus pneumoniae R6
uaacaauaaucuaug

SEQ ID NO: 4078022 - RNA, 20 nt, Streptococcus pneumoniae R6
uaacacccugcaugagcugu

SEQ ID NO: 4078023 - RNA, 12 nt, Streptococcus pneumoniae R6
uaacaccucuuc

SEQ ID NO: 4078024 - RNA, 21 nt, Streptococcus pneumoniae R6
uaacacgagaaacaauaaaau

SEQ ID NO: 4078025 - RNA, 22 nt, Streptococcus pneumoniae R6
uaacacgagaaacaauaaaauc

SEQ ID NO: 4078026 - RNA, 16 nt, Streptococcus pneumoniae R6
uaacacuuuucaaaaa

SEQ ID NO: 4078027 - RNA, 19 nt, Streptococcus pneumoniae R6
uaacagagaagaaauucca

SEQ ID NO: 4078028 - RNA, 21 nt, Streptococcus pneumoniae R6
uaacagccaaaaguccaaaga

SEQ ID NO: 4078029 - RNA, 23 nt, Streptococcus pneumoniae R6
uaacagccaaaaguccaaagaug

SEQ ID NO: 4078030 - RNA, 21 nt, Streptococcus pneumoniae R6
uaacagccaucagagaggucc

SEQ ID NO: 4078031 - RNA, 17 nt, Streptococcus pneumoniae R6
uaacagucuuagcaaaa

SEQ ID NO: 4078032 - RNA, 21 nt, Streptococcus pneumoniae R6
uaacaguuuuuaauuuuucuu

SEQ ID NO: 4078033 - RNA, 19 nt, Streptococcus pneumoniae R6
uaacauauuucuagaaauu

SEQ ID NO: 4078034 - RNA, 21 nt, Streptococcus pneumoniae R6
uaacauauuucuagaaauuaa

SEQ ID NO: 4078035 - RNA, 22 nt, Streptococcus pneumoniae R6
uaacauauuucuagaaauuaau

SEQ ID NO: 4078036 - RNA, 14 nt, Streptococcus pneumoniae R6
uaacauauuuucaa

SEQ ID NO: 4078037 - RNA, 17 nt, Streptococcus pneumoniae R6
uaacaucaauaaccauc

SEQ ID NO: 4078038 - RNA, 20 nt, Streptococcus pneumoniae R6
uaacauccugagucuaucua

SEQ ID NO: 4078039 - RNA, 21 nt, Streptococcus pneumoniae R6
uaacaucugcuauaauaguaa

SEQ ID NO: 4078040 - RNA, 14 nt, Streptococcus pneumoniae R6
uaacaucuuuugau

SEQ ID NO: 4078041 - RNA, 22 nt, Streptococcus pneumoniae R6
uaacaucuuuugauagaugacu

SEQ ID NO: 4078042 - RNA, 17 nt, Streptococcus pneumoniae R6
uaacauucuacaucauu

SEQ ID NO: 4078043 - RNA, 17 nt, Streptococcus pneumoniae R6
uaacauuugagugagca

SEQ ID NO: 4078044 - RNA, 13 nt, Streptococcus pneumoniae R6
uaaccaaaccaac

SEQ ID NO: 4078045 - RNA, 11 nt, Streptococcus pneumoniae R6
uaaccaaauaa

SEQ ID NO: 4078046 - RNA, 12 nt, Streptococcus pneumoniae R6
uaaccaaauaau

SEQ ID NO: 4078047 - RNA, 17 nt, Streptococcus pneumoniae R6
uaaccaaaucagauaag

SEQ ID NO: 4078048 - RNA, 22 nt, Streptococcus pneumoniae R6
uaaccaaguucuaaauaaucuc

SEQ ID NO: 4078049 - RNA, 22 nt, Streptococcus pneumoniae R6
uaaccaaguuuguaucuuccuu

SEQ ID NO: 4078050 - RNA, 15 nt, Streptococcus pneumoniae R6
uaaccagaucuuaga

SEQ ID NO: 4078051 - RNA, 15 nt, Streptococcus pneumoniae R6
uaacccaaacaagcc

SEQ ID NO: 4078052 - RNA, 20 nt, Streptococcus pneumoniae R6
uaacccaaacaagccuuuau

SEQ ID NO: 4078053 - RNA, 20 nt, Streptococcus pneumoniae R6
uaacccacucgccaguugcu

SEQ ID NO: 4078054 - RNA, 19 nt, Streptococcus pneumoniae R6
uaaccucuugaaguucauu

SEQ ID NO: 4078055 - RNA, 15 nt, Streptococcus pneumoniae R6
uaaccuuaaucaaau

SEQ ID NO: 4078056 - RNA, 19 nt, Streptococcus pneumoniae R6
uaaccuuaggaaugaauuu

SEQ ID NO: 4078057 - RNA, 19 nt, Streptococcus pneumoniae R6
uaacgaagucuauugaaaa

SEQ ID NO: 4078058 - RNA, 17 nt, Streptococcus pneumoniae R6
uaacgaauccaacucuu

SEQ ID NO: 4078059 - RNA, 16 nt, Streptococcus pneumoniae R6
uaacgacauagucaaa

SEQ ID NO: 4078060 - RNA, 22 nt, Streptococcus pneumoniae R6
uaacgacauagucaaagaguuu

SEQ ID NO: 4078061 - RNA, 13 nt, Streptococcus pneumoniae R6
uaacgaguaaaag

SEQ ID NO: 4078062 - RNA, 15 nt, Streptococcus pneumoniae R6
uaacgagucaaaaaa

SEQ ID NO: 4078063 - RNA, 20 nt, Streptococcus pneumoniae R6
uaacgagucaaaaaaggagu

SEQ ID NO: 4078064 - RNA, 21 nt, Streptococcus pneumoniae R6
uaacgagugggacauguucau

SEQ ID NO: 4078065 - RNA, 19 nt, Streptococcus pneumoniae R6
uaacggcauccgcaagaga

SEQ ID NO: 4078066 - RNA, 17 nt, Streptococcus pneumoniae R6
uaacguucuucaacauc

SEQ ID NO: 4078067 - RNA, 19 nt, Streptococcus pneumoniae R6
uaacguucuuuucaagaac

SEQ ID NO: 4078068 - RNA, 18 nt, Streptococcus pneumoniae R6
uaacuaacgccaaauccu

SEQ ID NO: 4078069 - RNA, 23 nt, Streptococcus pneumoniae R6
uaacuaggcuagcaaauuuaaua

SEQ ID NO: 4078070 - RNA, 21 nt, Streptococcus pneumoniae R6
uaacucaaguuaugcauuuuc

SEQ ID NO: 4078071 - RNA, 15 nt, Streptococcus pneumoniae R6
uaacucuaagcuacc

SEQ ID NO: 4078072 - RNA, 14 nt, Streptococcus pneumoniae R6
uaacucuuuuuugg

SEQ ID NO: 4078073 - RNA, 14 nt, Streptococcus pneumoniae R6
uaacugcgauacga

SEQ ID NO: 4078074 - RNA, 23 nt, Streptococcus pneumoniae R6
uaacugcgauacgaucugaaaua

SEQ ID NO: 4078075 - RNA, 15 nt, Streptococcus pneumoniae R6
uaacugcuaaaagau

SEQ ID NO: 4078076 - RNA, 22 nt, Streptococcus pneumoniae R6
uaacugcugcuuggaaggaagc

SEQ ID NO: 4078077 - RNA, 15 nt, Streptococcus pneumoniae R6
uaacugcuucacuag

SEQ ID NO: 4078078 - RNA, 17 nt, Streptococcus pneumoniae R6
uaacugcuucacuaguc

SEQ ID NO: 4078079 - RNA, 22 nt, Streptococcus pneumoniae R6
uaacugcuuugagaucuuuuuc

SEQ ID NO: 4078080 - RNA, 13 nt, Streptococcus pneumoniae R6
uaacuggaaagau

SEQ ID NO: 4078081 - RNA, 22 nt, Streptococcus pneumoniae R6
uaacuggaaagauaacugcuag

SEQ ID NO: 4078082 - RNA, 14 nt, Streptococcus pneumoniae R6
uaacuuauuuuaac

SEQ ID NO: 4078083 - RNA, 13 nt, Streptococcus pneumoniae R6
uaacuucaauaga

SEQ ID NO: 4078084 - RNA, 15 nt, Streptococcus pneumoniae R6
uaacuucaauagacu

SEQ ID NO: 4078085 - RNA, 22 nt, Streptococcus pneumoniae R6
uaaggcacuagcuccaaacaua

SEQ ID NO: 4078086 - RNA, 22 nt, Streptococcus pneumoniae R6
uaaggcagugacuaccaaucgu

SEQ ID NO: 4078087 - RNA, 18 nt, Streptococcus pneumoniae R6
uaaggcaucuuaacauuc

SEQ ID NO: 4078088 - RNA, 22 nt, Streptococcus pneumoniae R6
uaaggcaucuuaacauucuccc

SEQ ID NO: 4078089 - RNA, 16 nt, Streptococcus pneumoniae R6
uaaggccugauaagau

SEQ ID NO: 4078090 - RNA, 18 nt, Streptococcus pneumoniae R6
uaaggucauuugaaucau

SEQ ID NO: 4078091 - RNA, 17 nt, Streptococcus pneumoniae R6
uaagguuagcugcacca

SEQ ID NO: 4078092 - RNA, 14 nt, Streptococcus pneumoniae R6
uaagguucauuaga

SEQ ID NO: 4078093 - RNA, 16 nt, Streptococcus pneumoniae R6
uaagguuguagaugga

SEQ ID NO: 4078094 - RNA, 19 nt, Streptococcus pneumoniae R6
uaaguaaguacaugcaaag

SEQ ID NO: 4078095 - RNA, 21 nt, Streptococcus pneumoniae R6
uaaguaaguacaugcaaagua

SEQ ID NO: 4078096 - RNA, 22 nt, Streptococcus pneumoniae R6
uaaguaaucucugauaauauuu

SEQ ID NO: 4078097 - RNA, 16 nt, Streptococcus pneumoniae R6
uaaguaccgacuucug

SEQ ID NO: 4078098 - RNA, 14 nt, Streptococcus pneumoniae R6
uaaguaguaaccac

SEQ ID NO: 4078099 - RNA, 21 nt, Streptococcus pneumoniae R6
uaaguauagacgaaaagucau

SEQ ID NO: 4078100 - RNA, 16 nt, Streptococcus pneumoniae R6
uaaguauccaucacag

SEQ ID NO: 4078101 - RNA, 12 nt, Streptococcus pneumoniae R6
uaagucaacauc

SEQ ID NO: 4078102 - RNA, 14 nt, Streptococcus pneumoniae R6
uaagucauaacauu

SEQ ID NO: 4078103 - RNA, 23 nt, Streptococcus pneumoniae R6
uaagucaugagaguuuuuggcau

SEQ ID NO: 4078104 - RNA, 21 nt, Streptococcus pneumoniae R6
uaagucaugcaaaaaaaauga

SEQ ID NO: 4078105 - RNA, 14 nt, Streptococcus pneumoniae R6
uaaguccgaaaaau

SEQ ID NO: 4078106 - RNA, 21 nt, Streptococcus pneumoniae R6
uaaguccgaaaaauuucucug

SEQ ID NO: 4078107 - RNA, 18 nt, Streptococcus pneumoniae R6
uaagucugcuuuauagug

SEQ ID NO: 4078108 - RNA, 12 nt, Streptococcus pneumoniae R6
uaagugauuuaa

SEQ ID NO: 4078109 - RNA, 22 nt, Streptococcus pneumoniae R6
uaaguggguggguaaaggaaag

SEQ ID NO: 4078110 - RNA, 19 nt, Streptococcus pneumoniae R6
uaagugguaucgcuagacu

SEQ ID NO: 4078111 - RNA, 14 nt, Streptococcus pneumoniae R6
uaaguguuaugaau

SEQ ID NO: 4078112 - RNA, 19 nt, Streptococcus pneumoniae R6
uaaguguuaugaauaacuu

SEQ ID NO: 4078113 - RNA, 19 nt, Streptococcus pneumoniae R6
uaaguuaaauuauuaaaau

SEQ ID NO: 4078114 - RNA, 22 nt, Streptococcus pneumoniae R6
uaaguuauuucuccuaaagaaa

SEQ ID NO: 4078115 - RNA, 20 nt, Streptococcus pneumoniae R6
uaaguuccuguuguaauuuu

SEQ ID NO: 4078116 - RNA, 14 nt, Streptococcus pneumoniae R6
uaaguuucuucuuu

SEQ ID NO: 4078117 - RNA, 21 nt, Streptococcus pneumoniae R6
uaaguuuuuccaucuuuuauu

SEQ ID NO: 4078118 - RNA, 23 nt, Streptococcus pneumoniae R6
uaaguuuuuugauuucuucugga

SEQ ID NO: 4078119 - RNA, 20 nt, Streptococcus pneumoniae R6
uaauaaaaagagaagaaaua

SEQ ID NO: 4078120 - RNA, 13 nt, Streptococcus pneumoniae R6
uaauaaaaugaaa

SEQ ID NO: 4078121 - RNA, 16 nt, Streptococcus pneumoniae R6
uaauaaaaugaaauaa

SEQ ID NO: 4078122 - RNA, 21 nt, Streptococcus pneumoniae R6
uaauaaaaugaaauaagaaua

SEQ ID NO: 4078123 - RNA, 23 nt, Streptococcus pneumoniae R6
uaauaaacuggguugaagauuuc

SEQ ID NO: 4078124 - RNA, 22 nt, Streptococcus pneumoniae R6
uaauaacucgaucaacaaacau

SEQ ID NO: 4078125 - RNA, 13 nt, Streptococcus pneumoniae R6
uaauaacucucau

SEQ ID NO: 4078126 - RNA, 16 nt, Streptococcus pneumoniae R6
uaauaacucucaucua

SEQ ID NO: 4078127 - RNA, 17 nt, Streptococcus pneumoniae R6
uaauaacucucaucuau

SEQ ID NO: 4078128 - RNA, 21 nt, Streptococcus pneumoniae R6
uaauaagcuuugaaaauucca

SEQ ID NO: 4078129 - RNA, 18 nt, Streptococcus pneumoniae R6
uaauaaucaauauagucu

SEQ ID NO: 4078130 - RNA, 18 nt, Streptococcus pneumoniae R6
uaauaauuucaaaaucuu

SEQ ID NO: 4078131 - RNA, 20 nt, Streptococcus pneumoniae R6
uaauaauuuucacaaacaaa

SEQ ID NO: 4078132 - RNA, 13 nt, Streptococcus pneumoniae R6
uaauaauuuuuca

SEQ ID NO: 4078133 - RNA, 20 nt, Streptococcus pneumoniae R6
uaauaauuuuucauuuaaua

SEQ ID NO: 4078134 - RNA, 12 nt, Streptococcus pneumoniae R6
uaauacaaaaaa

SEQ ID NO: 4078135 - RNA, 16 nt, Streptococcus pneumoniae R6
uaauacaagcucaucu

SEQ ID NO: 4078136 - RNA, 13 nt, Streptococcus pneumoniae R6
uaauacaauugcu

SEQ ID NO: 4078137 - RNA, 13 nt, Streptococcus pneumoniae R6
uaauacauuuugu

SEQ ID NO: 4078138 - RNA, 19 nt, Streptococcus pneumoniae R6
uaauacauuuuguaaaaaa

SEQ ID NO: 4078139 - RNA, 16 nt, Streptococcus pneumoniae R6
uaauacgaccaaucuu

SEQ ID NO: 4078140 - RNA, 22 nt, Streptococcus pneumoniae R6
uaauacucugugaaaaucauag

SEQ ID NO: 4078141 - RNA, 20 nt, Streptococcus pneumoniae R6
uaauacuguggaauauagag

SEQ ID NO: 4078142 - RNA, 22 nt, Streptococcus pneumoniae R6
uaauacuugaacuauuguagau

SEQ ID NO: 4078143 - RNA, 21 nt, Streptococcus pneumoniae R6
uaauagaaauuuugaaauaau

SEQ ID NO: 4078144 - RNA, 16 nt, Streptococcus pneumoniae R6
uaauagacuuccugca

SEQ ID NO: 4078145 - RNA, 16 nt, Streptococcus pneumoniae R6
uaauagcacuuaaaaa

SEQ ID NO: 4078146 - RNA, 19 nt, Streptococcus pneumoniae R6
uaauagcgaugaagagaga

SEQ ID NO: 4078147 - RNA, 17 nt, Streptococcus pneumoniae R6
uaauagguacaaaaaua

SEQ ID NO: 4078148 - RNA, 14 nt, Streptococcus pneumoniae R6
uaauaguaagagca

SEQ ID NO: 4078149 - RNA, 23 nt, Streptococcus pneumoniae R6
uaauagugggaauuuguaaaguu

SEQ ID NO: 4078150 - RNA, 22 nt, Streptococcus pneumoniae R6
uaauaguggugugucugaagau

SEQ ID NO: 4078151 - RNA, 14 nt, Streptococcus pneumoniae R6
uaauaguuauaaag

SEQ ID NO: 4078152 - RNA, 20 nt, Streptococcus pneumoniae R6
uaauaguuaucguaauuaaa

SEQ ID NO: 4078153 - RNA, 12 nt, Streptococcus pneumoniae R6
uaauauaaacuu

SEQ ID NO: 4078154 - RNA, 18 nt, Streptococcus pneumoniae R6
uaauauaacuaguuaaua

SEQ ID NO: 4078155 - RNA, 19 nt, Streptococcus pneumoniae R6
uaauauacuugauauaguu

SEQ ID NO: 4078156 - RNA, 16 nt, Streptococcus pneumoniae R6
uaauauagggcuuuuu

SEQ ID NO: 4078157 - RNA, 14 nt, Streptococcus pneumoniae R6
uaauauaggucaga

SEQ ID NO: 4078158 - RNA, 14 nt, Streptococcus pneumoniae R6
uaauauauaaaauu

SEQ ID NO: 4078159 - RNA, 22 nt, Streptococcus pneumoniae R6
uaauaucagccagagcaccaac

SEQ ID NO: 4078160 - RNA, 19 nt, Streptococcus pneumoniae R6
uaauaucauaaugagcucc

SEQ ID NO: 4078161 - RNA, 20 nt, Streptococcus pneumoniae R6
uaauauccgauagcaucauu

SEQ ID NO: 4078162 - RNA, 14 nt, Streptococcus pneumoniae R6
uaauaucuccagau

SEQ ID NO: 4078163 - RNA, 15 nt, Streptococcus pneumoniae R6
uaauauguaaagagu

SEQ ID NO: 4078164 - RNA, 15 nt, Streptococcus pneumoniae R6
uaauauguauuuaua

SEQ ID NO: 4078165 - RNA, 20 nt, Streptococcus pneumoniae R6
uaauauguauuuauaguauu

SEQ ID NO: 4078166 - RNA, 22 nt, Streptococcus pneumoniae R6
uaauauuaccaccacguauaau

SEQ ID NO: 4078167 - RNA, 21 nt, Streptococcus pneumoniae R6
uaauauuacuucuaaaacauu

SEQ ID NO: 4078168 - RNA, 15 nt, Streptococcus pneumoniae R6
uaauauugagugcuu

SEQ ID NO: 4078169 - RNA, 22 nt, Streptococcus pneumoniae R6
uaauauuuaauuguauacguuu

SEQ ID NO: 4078170 - RNA, 11 nt, Streptococcus pneumoniae R6
uaauauuuccc

SEQ ID NO: 4078171 - RNA, 13 nt, Streptococcus pneumoniae R6
uaaucaaaacuau

SEQ ID NO: 4078172 - RNA, 18 nt, Streptococcus pneumoniae R6
uaaucaaaauauguuuuc

SEQ ID NO: 4078173 - RNA, 19 nt, Streptococcus pneumoniae R6
uaaucaaaauauguuuucu

SEQ ID NO: 4078174 - RNA, 12 nt, Streptococcus pneumoniae R6
uaaucaaauuau

SEQ ID NO: 4078175 - RNA, 15 nt, Streptococcus pneumoniae R6
uaaucaauauagaag

SEQ ID NO: 4078176 - RNA, 15 nt, Streptococcus pneumoniae R6
uaaucaauuaucauu

SEQ ID NO: 4078177 - RNA, 21 nt, Streptococcus pneumoniae R6
uaaucaccguccccaaaaaua

SEQ ID NO: 4078178 - RNA, 23 nt, Streptococcus pneumoniae R6
uaaucaccuaguccaagacguuc

SEQ ID NO: 4078179 - RNA, 20 nt, Streptococcus pneumoniae R6
uaaucacguugcuuauacuc

SEQ ID NO: 4078180 - RNA, 14 nt, Streptococcus pneumoniae R6
uaaucacugcagca

SEQ ID NO: 4078181 - RNA, 15 nt, Streptococcus pneumoniae R6
uaaucacuuggaaaa

SEQ ID NO: 4078182 - RNA, 21 nt, Streptococcus pneumoniae R6
uaaucagaauggguuaaaauu

SEQ ID NO: 4078183 - RNA, 15 nt, Streptococcus pneumoniae R6
uaaucagauaaacaa

SEQ ID NO: 4078184 - RNA, 12 nt, Streptococcus pneumoniae R6
uaaucauacaca

SEQ ID NO: 4078185 - RNA, 18 nt, Streptococcus pneumoniae R6
uaaucauagugagauugu

SEQ ID NO: 4078186 - RNA, 11 nt, Streptococcus pneumoniae R6
uaaucaucugg

SEQ ID NO: 4078187 - RNA, 21 nt, Streptococcus pneumoniae R6
uaauuuuucaauaucuuuauu

SEQ ID NO: 4078188 - RNA, 12 nt, Streptococcus pneumoniae R6
uaauuuuucauu

SEQ ID NO: 4078189 - RNA, 12 nt, Streptococcus pneumoniae R6
uaauuuuucuuu

SEQ ID NO: 4078190 - RNA, 13 nt, Streptococcus pneumoniae R6
uacaaaaaagcca

SEQ ID NO: 4078191 - RNA, 11 nt, Streptococcus pneumoniae R6
uacaaaaacaa

SEQ ID NO: 4078192 - RNA, 12 nt, Streptococcus pneumoniae R6
uacaaaaauaua

SEQ ID NO: 4078193 - RNA, 23 nt, Streptococcus pneumoniae R6
uacaaaaauauaauggucuggau

SEQ ID NO: 4078194 - RNA, 13 nt, Streptococcus pneumoniae R6
uacaaacucucau

SEQ ID NO: 4078195 - RNA, 15 nt, Streptococcus pneumoniae R6
uacaaagaauaaaau

SEQ ID NO: 4078196 - RNA, 16 nt, Streptococcus pneumoniae R6
uacaaagaauaaaaua

SEQ ID NO: 4078197 - RNA, 23 nt, Streptococcus pneumoniae R6
uacaaagggaugauguuaucaaa

SEQ ID NO: 4078198 - RNA, 17 nt, Streptococcus pneumoniae R6
uacaaaguauuuuuucu

SEQ ID NO: 4078199 - RNA, 18 nt, Streptococcus pneumoniae R6
uacaaauaaacggacaaa

SEQ ID NO: 4078200 - RNA, 22 nt, Streptococcus pneumoniae R6
uacaaauauucaccacaugaca

SEQ ID NO: 4078201 - RNA, 16 nt, Streptococcus pneumoniae R6
uacaaaucccaugaca

SEQ ID NO: 4078202 - RNA, 17 nt, Streptococcus pneumoniae R6
uacaaaucccaugacaa

SEQ ID NO: 4078203 - RNA, 12 nt, Streptococcus pneumoniae R6
uacaaauugauu

SEQ ID NO: 4078204 - RNA, 20 nt, Streptococcus pneumoniae R6
uacaaauuguaaggauuuac

SEQ ID NO: 4078205 - RNA, 22 nt, Streptococcus pneumoniae R6
uacaaauuguaaggauuuacuu

SEQ ID NO: 4078206 - RNA, 17 nt, Streptococcus pneumoniae R6
uacaaauuuauacuaau

SEQ ID NO: 4078207 - RNA, 14 nt, Streptococcus pneumoniae R6
uacaaccucaaagc

SEQ ID NO: 4078208 - RNA, 14 nt, Streptococcus pneumoniae R6
uacaaccuuaaaac

SEQ ID NO: 4078209 - RNA, 19 nt, Streptococcus pneumoniae R6
uacaaccuuaaaacagugu

SEQ ID NO: 4078210 - RNA, 13 nt, Streptococcus pneumoniae R6
uacaacuuaaaaa

SEQ ID NO: 4078211 - RNA, 15 nt, Streptococcus pneumoniae R6
uacaacuuaaaaaga

SEQ ID NO: 4078212 - RNA, 16 nt, Streptococcus pneumoniae R6
uacaacuuaaaaagag

SEQ ID NO: 4078213 - RNA, 17 nt, Streptococcus pneumoniae R6
uacaagaaaagugcaaa

SEQ ID NO: 4078214 - RNA, 21 nt, Streptococcus pneumoniae R6
uacaagaacagucucuguaua

SEQ ID NO: 4078215 - RNA, 23 nt, Streptococcus pneumoniae R6
uacaaggaagccuucuuuuccac

SEQ ID NO: 4078216 - RNA, 18 nt, Streptococcus pneumoniae R6
uacaaggacauugacuuu

SEQ ID NO: 4078217 - RNA, 17 nt, Streptococcus pneumoniae R6
uacaaguguuuucacuu

SEQ ID NO: 4078218 - RNA, 19 nt, Streptococcus pneumoniae R6
uacaauaacacccuuguaa

SEQ ID NO: 4078219 - RNA, 13 nt, Streptococcus pneumoniae R6
uacaauauaucca

SEQ ID NO: 4078220 - RNA, 14 nt, Streptococcus pneumoniae R6
uacaauaucuccag

SEQ ID NO: 4078221 - RNA, 22 nt, Streptococcus pneumoniae R6
uacaauauuuguuguccuaaua

SEQ ID NO: 4078222 - RNA, 17 nt, Streptococcus pneumoniae R6
uacaaugucuaaaucuu

SEQ ID NO: 4078223 - RNA, 21 nt, Streptococcus pneumoniae R6
uacaauucauaaagugcugua

SEQ ID NO: 4078224 - RNA, 19 nt, Streptococcus pneumoniae R6
uacaauugcucuucugaaa

SEQ ID NO: 4078225 - RNA, 20 nt, Streptococcus pneumoniae R6
uacaauugcucuucugaaau

SEQ ID NO: 4078226 - RNA, 15 nt, Streptococcus pneumoniae R6
uacaauuguaaaaag

SEQ ID NO: 4078227 - RNA, 23 nt, Streptococcus pneumoniae R6
uacacaaaauaggcuccauaaua

SEQ ID NO: 4078228 - RNA, 13 nt, Streptococcus pneumoniae R6
uacacacuuaaau

SEQ ID NO: 4078229 - RNA, 18 nt, Streptococcus pneumoniae R6
uacacaggaauacuaaaa

SEQ ID NO: 4078230 - RNA, 22 nt, Streptococcus pneumoniae R6
uacacauccaguguauggagcu

SEQ ID NO: 4078231 - RNA, 23 nt, Streptococcus pneumoniae R6
uacacauguuaacaaauucgacu

SEQ ID NO: 4078232 - RNA, 18 nt, Streptococcus pneumoniae R6
uacacauuauguaaacaa

SEQ ID NO: 4078233 - RNA, 20 nt, Streptococcus pneumoniae R6
uacacccacgucacaaagaa

SEQ ID NO: 4078234 - RNA, 21 nt, Streptococcus pneumoniae R6
uacaccuaaaacuuugaugau

SEQ ID NO: 4078235 - RNA, 15 nt, Streptococcus pneumoniae R6
uacaccuaauccacu

SEQ ID NO: 4078236 - RNA, 17 nt, Streptococcus pneumoniae R6
uacacguacuuuaaaau

SEQ ID NO: 4078237 - RNA, 16 nt, Streptococcus pneumoniae R6
uacacguuuuugucua

SEQ ID NO: 4078238 - RNA, 22 nt, Streptococcus pneumoniae R6
uacacuucugcuucuaaaacau

SEQ ID NO: 4078239 - RNA, 23 nt, Streptococcus pneumoniae R6
uacacuucugcuucuaaaacauu

SEQ ID NO: 4078240 - RNA, 15 nt, Streptococcus pneumoniae R6
uacagaaagaacaaa

SEQ ID NO: 4078241 - RNA, 14 nt, Streptococcus pneumoniae R6
uacagaacauuuua

SEQ ID NO: 4078242 - RNA, 13 nt, Streptococcus pneumoniae R6
uacagaagaaaaa

SEQ ID NO: 4078243 - RNA, 15 nt, Streptococcus pneumoniae R6
uacagagaaagucag

SEQ ID NO: 4078244 - RNA, 16 nt, Streptococcus pneumoniae R6
uacagaguacuaaaua

SEQ ID NO: 4078245 - RNA, 13 nt, Streptococcus pneumoniae R6
uacagauaaaaau

SEQ ID NO: 4078246 - RNA, 14 nt, Streptococcus pneumoniae R6
uacagauaaaaauc

SEQ ID NO: 4078247 - RNA, 14 nt, Streptococcus pneumoniae R6
uacagcaaaaaauu

SEQ ID NO: 4078248 - RNA, 20 nt, Streptococcus pneumoniae R6
uacagcuuuuuucuuugccu

SEQ ID NO: 4078249 - RNA, 21 nt, Streptococcus pneumoniae R6
uacaggcaggacaaaagauaa

SEQ ID NO: 4078250 - RNA, 13 nt, Streptococcus pneumoniae R6
uacaguauuuaua

SEQ ID NO: 4078251 - RNA, 17 nt, Streptococcus pneumoniae R6
uacauaaccagauauag

SEQ ID NO: 4078252 - RNA, 15 nt, Streptococcus pneumoniae R6
uacauaauuuaaaau

SEQ ID NO: 4078253 - RNA, 21 nt, Streptococcus pneumoniae R6
uacauaauuuaaaauacgcaa

SEQ ID NO: 4078254 - RNA, 22 nt, Streptococcus pneumoniae R6
uacauacccaugcuuuucuauu

SEQ ID NO: 4078255 - RNA, 18 nt, Streptococcus pneumoniae R6
uacauacuuuaucuucua

SEQ ID NO: 4078256 - RNA, 15 nt, Streptococcus pneumoniae R6
uacauagaauaauuu

SEQ ID NO: 4078257 - RNA, 16 nt, Streptococcus pneumoniae R6
uacauagacuucccag

SEQ ID NO: 4078258 - RNA, 19 nt, Streptococcus pneumoniae R6
uacauagagagacagcagu

SEQ ID NO: 4078259 - RNA, 14 nt, Streptococcus pneumoniae R6
uacauaguuucaua

SEQ ID NO: 4078260 - RNA, 17 nt, Streptococcus pneumoniae R6
uacaucaaaaucacaga

SEQ ID NO: 4078261 - RNA, 19 nt, Streptococcus pneumoniae R6
uacaucaaaaucacagacc

SEQ ID NO: 4078262 - RNA, 20 nt, Streptococcus pneumoniae R6
uacaucaaaaucacagaccg

SEQ ID NO: 4078263 - RNA, 12 nt, Streptococcus pneumoniae R6
uacaucaagcuc

SEQ ID NO: 4078264 - RNA, 15 nt, Streptococcus pneumoniae R6
uacauccaguaccau

SEQ ID NO: 4078265 - RNA, 22 nt, Streptococcus pneumoniae R6
uacaucucuuguaacccaaaca

SEQ ID NO: 4078266 - RNA, 23 nt, Streptococcus pneumoniae R6
uacaugcaaaguaaaguaaggag

SEQ ID NO: 4078267 - RNA, 14 nt, Streptococcus pneumoniae R6
uacaugucaggguu

SEQ ID NO: 4078268 - RNA, 15 nt, Streptococcus pneumoniae R6
uacauucccaaacaa

SEQ ID NO: 4078269 - RNA, 16 nt, Streptococcus pneumoniae R6
uacauucccaaacaaa

SEQ ID NO: 4078270 - RNA, 17 nt, Streptococcus pneumoniae R6
uacauugaaauuaaaau

SEQ ID NO: 4078271 - RNA, 16 nt, Streptococcus pneumoniae R6
uacauugauugcuuca

SEQ ID NO: 4078272 - RNA, 22 nt, Streptococcus pneumoniae R6
uacauuuagaaagguaaaauau

SEQ ID NO: 4078273 - RNA, 14 nt, Streptococcus pneumoniae R6
uacauuugaguuuc

SEQ ID NO: 4078274 - RNA, 17 nt, Streptococcus pneumoniae R6
uacauuugaguuucucu

SEQ ID NO: 4078275 - RNA, 19 nt, Streptococcus pneumoniae R6
uacauuuugauuacacaau

SEQ ID NO: 4078276 - RNA, 16 nt, Streptococcus pneumoniae R6
uacauuuuuugaaaua

SEQ ID NO: 4078277 - RNA, 15 nt, Streptococcus pneumoniae R6
uaccaaaaccuucuu

SEQ ID NO: 4078278 - RNA, 16 nt, Streptococcus pneumoniae R6
uaccaaccaguugcca

SEQ ID NO: 4078279 - RNA, 18 nt, Streptococcus pneumoniae R6
uaccaaccaguugccaua

SEQ ID NO: 4078280 - RNA, 21 nt, Streptococcus pneumoniae R6
uaccaaccaguugccauagcu

SEQ ID NO: 4078281 - RNA, 18 nt, Streptococcus pneumoniae R6
uaccaacgcccucacacg

SEQ ID NO: 4078282 - RNA, 23 nt, Streptococcus pneumoniae R6
uaccaacuacuaaaccaauaaua

SEQ ID NO: 4078283 - RNA, 23 nt, Streptococcus pneumoniae R6
uaccaaguucauuuuuuauggug

SEQ ID NO: 4078284 - RNA, 19 nt, Streptococcus pneumoniae R6
uaccaauacaggaaaacca

SEQ ID NO: 4078285 - RNA, 14 nt, Streptococcus pneumoniae R6
uaccaauuuuuccu

SEQ ID NO: 4078286 - RNA, 15 nt, Streptococcus pneumoniae R6
uaccaauuuuuccuu

SEQ ID NO: 4078287 - RNA, 15 nt, Streptococcus pneumoniae R6
uaccacacuaaauuu

SEQ ID NO: 4078288 - RNA, 17 nt, Streptococcus pneumoniae R6
uaccaccuuuaaauccu

SEQ ID NO: 4078289 - RNA, 19 nt, Streptococcus pneumoniae R6
uaccaccuuuaaauccugc

SEQ ID NO: 4078290 - RNA, 14 nt, Streptococcus pneumoniae R6
uacucuuucaguuu

SEQ ID NO: 4078291 - RNA, 17 nt, Streptococcus pneumoniae R6
uacucuuugauuuucau

SEQ ID NO: 4078292 - RNA, 18 nt, Streptococcus pneumoniae R6
uacucuuugauuuucauu

SEQ ID NO: 4078293 - RNA, 15 nt, Streptococcus pneumoniae R6
uacucuuuuuucaug

SEQ ID NO: 4078294 - RNA, 16 nt, Streptococcus pneumoniae R6
uacugaaacaacaucu

SEQ ID NO: 4078295 - RNA, 18 nt, Streptococcus pneumoniae R6
uacugaaacaacaucuuu

SEQ ID NO: 4078296 - RNA, 11 nt, Streptococcus pneumoniae R6
uacugaaucaa

SEQ ID NO: 4078297 - RNA, 22 nt, Streptococcus pneumoniae R6
uacugacuucgucaguucuauc

SEQ ID NO: 4078298 - RNA, 14 nt, Streptococcus pneumoniae R6
uacugauaaaacug

SEQ ID NO: 4078299 - RNA, 19 nt, Streptococcus pneumoniae R6
uacugauguaacuguuuua

SEQ ID NO: 4078300 - RNA, 15 nt, Streptococcus pneumoniae R6
uacugauuucgucag

SEQ ID NO: 4078301 - RNA, 19 nt, Streptococcus pneumoniae R6
uacugccgccaccuccgcc

SEQ ID NO: 4078302 - RNA, 23 nt, Streptococcus pneumoniae R6
uacuggauaaaguuaugaaaaag

SEQ ID NO: 4078303 - RNA, 20 nt, Streptococcus pneumoniae R6
uacugggcacggugauuuuu

SEQ ID NO: 4078304 - RNA, 21 nt, Streptococcus pneumoniae R6
uacugguacuauuuaauguuu

SEQ ID NO: 4078305 - RNA, 20 nt, Streptococcus pneumoniae R6
uacuguacguuuuaucauag

SEQ ID NO: 4078306 - RNA, 17 nt, Streptococcus pneumoniae R6
uacugucaagucuugcu

SEQ ID NO: 4078307 - RNA, 13 nt, Streptococcus pneumoniae R6
uacuguuauagau

SEQ ID NO: 4078308 - RNA, 17 nt, Streptococcus pneumoniae R6
uacuguucuaaauucag

SEQ ID NO: 4078309 - RNA, 18 nt, Streptococcus pneumoniae R6
uacuuaaaauuguuucau

SEQ ID NO: 4078310 - RNA, 22 nt, Streptococcus pneumoniae R6
uacuuaaaauuguuucauguaa

SEQ ID NO: 4078311 - RNA, 21 nt, Streptococcus pneumoniae R6
uacuuaaacgugcuauaucaa

SEQ ID NO: 4078312 - RNA, 13 nt, Streptococcus pneumoniae R6
uacuuaauuuaau

SEQ ID NO: 4078313 - RNA, 14 nt, Streptococcus pneumoniae R6
uacuuaccgagaau

SEQ ID NO: 4078314 - RNA, 21 nt, Streptococcus pneumoniae R6
uacuuacuuaacccuuuuuau

SEQ ID NO: 4078315 - RNA, 14 nt, Streptococcus pneumoniae R6
uacuuagauuuucu

SEQ ID NO: 4078316 - RNA, 18 nt, Streptococcus pneumoniae R6
uacuuagcuaauuuucua

SEQ ID NO: 4078317 - RNA, 18 nt, Streptococcus pneumoniae R6
uacuucaaauccuuuauu

SEQ ID NO: 4078318 - RNA, 14 nt, Streptococcus pneumoniae R6
uacuucacuucugu

SEQ ID NO: 4078319 - RNA, 16 nt, Streptococcus pneumoniae R6
uacuucacuucuguaa

SEQ ID NO: 4078320 - RNA, 20 nt, Streptococcus pneumoniae R6
uacuucauguuuuccuaauu

SEQ ID NO: 4078321 - RNA, 12 nt, Streptococcus pneumoniae R6
uacuucuaaaac

SEQ ID NO: 4078322 - RNA, 15 nt, Streptococcus pneumoniae R6
uacuucuaaaacauu

SEQ ID NO: 4078323 - RNA, 11 nt, Streptococcus pneumoniae R6
uacuucuuugu

SEQ ID NO: 4078324 - RNA, 14 nt, Streptococcus pneumoniae R6
uacuucuuuuucuc

SEQ ID NO: 4078325 - RNA, 20 nt, Streptococcus pneumoniae R6
uacuugagacuguuugagau

SEQ ID NO: 4078326 - RNA, 12 nt, Streptococcus pneumoniae R6
uacuugauuuuu

SEQ ID NO: 4078327 - RNA, 14 nt, Streptococcus pneumoniae R6
uacuugcaaacuuu

SEQ ID NO: 4078328 - RNA, 21 nt, Streptococcus pneumoniae R6
uacuugcauuuagauaguacc

SEQ ID NO: 4078329 - RNA, 17 nt, Streptococcus pneumoniae R6
uacuugcguuucuucuu

SEQ ID NO: 4078330 - RNA, 21 nt, Streptococcus pneumoniae R6
uacuugguugucccaagagua

SEQ ID NO: 4078331 - RNA, 13 nt, Streptococcus pneumoniae R6
uacuuuauuuucu

SEQ ID NO: 4078332 - RNA, 16 nt, Streptococcus pneumoniae R6
uacuuuauuuucucau

SEQ ID NO: 4078333 - RNA, 14 nt, Streptococcus pneumoniae R6
uacuuuguuuagac

SEQ ID NO: 4078334 - RNA, 14 nt, Streptococcus pneumoniae R6
uacuuuuuccuggu

SEQ ID NO: 4078335 - RNA, 15 nt, Streptococcus pneumoniae R6
uacuuuuucuuccuu

SEQ ID NO: 4078336 - RNA, 23 nt, Streptococcus pneumoniae R6
uagaaaaaagcuugaguggaaaa

SEQ ID NO: 4078337 - RNA, 20 nt, Streptococcus pneumoniae R6
uagaaaaagacuugaaauac

SEQ ID NO: 4078338 - RNA, 14 nt, Streptococcus pneumoniae R6
uagaaaaagucuga

SEQ ID NO: 4078339 - RNA, 15 nt, Streptococcus pneumoniae R6
uagaaaaaguucaau

SEQ ID NO: 4078340 - RNA, 17 nt, Streptococcus pneumoniae R6
uagaaaaaguucaauuu

SEQ ID NO: 4078341 - RNA, 19 nt, Streptococcus pneumoniae R6
uagaaaacaacuuauaaaa

SEQ ID NO: 4078342 - RNA, 23 nt, Streptococcus pneumoniae R6
uagaaaacaacuuauaaaaaaca

SEQ ID NO: 4078343 - RNA, 18 nt, Streptococcus pneumoniae R6
uagaaaaggaguagaaaa

SEQ ID NO: 4078344 - RNA, 20 nt, Streptococcus pneumoniae R6
uagaaaaggaguagaaaaug

SEQ ID NO: 4078345 - RNA, 22 nt, Streptococcus pneumoniae R6
uagaaaaggaguagaaaaugaa

SEQ ID NO: 4078346 - RNA, 13 nt, Streptococcus pneumoniae R6
uagaaaaucucuu

SEQ ID NO: 4078347 - RNA, 15 nt, Streptococcus pneumoniae R6
uagaaaaucucuuca

SEQ ID NO: 4078348 - RNA, 16 nt, Streptococcus pneumoniae R6
uagaaaaucucuucaa

SEQ ID NO: 4078349 - RNA, 17 nt, Streptococcus pneumoniae R6
uagaaaaucucuucaaa

SEQ ID NO: 4078350 - RNA, 13 nt, Streptococcus pneumoniae R6
uagaaaaugaaau

SEQ ID NO: 4078351 - RNA, 15 nt, Streptococcus pneumoniae R6
uagaaaaugaaauuu

SEQ ID NO: 4078352 - RNA, 19 nt, Streptococcus pneumoniae R6
uagaaaaugaaauuuuucu

SEQ ID NO: 4078353 - RNA, 14 nt, Streptococcus pneumoniae R6
uagaaaauucaaau

SEQ ID NO: 4078354 - RNA, 20 nt, Streptococcus pneumoniae R6
uagaaacaucgaaagcaaau

SEQ ID NO: 4078355 - RNA, 20 nt, Streptococcus pneumoniae R6
uagaaacguuguuaaaucaa

SEQ ID NO: 4078356 - RNA, 21 nt, Streptococcus pneumoniae R6
uagaaacguuguuaaaucaac

SEQ ID NO: 4078357 - RNA, 20 nt, Streptococcus pneumoniae R6
uagaaagauuugcuggauag

SEQ ID NO: 4078358 - RNA, 20 nt, Streptococcus pneumoniae R6
uagaaagguaaaauauagaa

SEQ ID NO: 4078359 - RNA, 19 nt, Streptococcus pneumoniae R6
uagaaagguuuuaaagaca

SEQ ID NO: 4078360 - RNA, 21 nt, Streptococcus pneumoniae R6
uagaaagguuuuaaagacagu

SEQ ID NO: 4078361 - RNA, 21 nt, Streptococcus pneumoniae R6
uagaaagucauuuguuuagug

SEQ ID NO: 4078362 - RNA, 12 nt, Streptococcus pneumoniae R6
uagaaagucuuu

SEQ ID NO: 4078363 - RNA, 12 nt, Streptococcus pneumoniae R6
uagaaauaaaac

SEQ ID NO: 4078364 - RNA, 15 nt, Streptococcus pneumoniae R6
uagaaauaaaacucu

SEQ ID NO: 4078365 - RNA, 21 nt, Streptococcus pneumoniae R6
uagaaauagagguguacuauu

SEQ ID NO: 4078366 - RNA, 20 nt, Streptococcus pneumoniae R6
uagaaauagggauuaauaau

SEQ ID NO: 4078367 - RNA, 14 nt, Streptococcus pneumoniae R6
uagaaauauaguaa

SEQ ID NO: 4078368 - RNA, 15 nt, Streptococcus pneumoniae R6
uagaaauaucugcac

SEQ ID NO: 4078369 - RNA, 16 nt, Streptococcus pneumoniae R6
uagaaauauuuuagca

SEQ ID NO: 4078370 - RNA, 13 nt, Streptococcus pneumoniae R6
uagaaaucgauuu

SEQ ID NO: 4078371 - RNA, 21 nt, Streptococcus pneumoniae R6
uagaaaucucuuuuuucucca

SEQ ID NO: 4078372 - RNA, 11 nt, Streptococcus pneumoniae R6
uagaaauuaau

SEQ ID NO: 4078373 - RNA, 13 nt, Streptococcus pneumoniae R6
uagaaauuaauuu

SEQ ID NO: 4078374 - RNA, 18 nt, Streptococcus pneumoniae R6
uagaaauuaauuuuacuu

SEQ ID NO: 4078375 - RNA, 23 nt, Streptococcus pneumoniae R6
uagaaauuaauuuuacuuuccug

SEQ ID NO: 4078376 - RNA, 18 nt, Streptococcus pneumoniae R6
uagaaauugaaguaauaa

SEQ ID NO: 4078377 - RNA, 17 nt, Streptococcus pneumoniae R6
uagaaauuuugaaauaa

SEQ ID NO: 4078378 - RNA, 16 nt, Streptococcus pneumoniae R6
uagaacaccaaagccc

SEQ ID NO: 4078379 - RNA, 21 nt, Streptococcus pneumoniae R6
uagaaccgaaaaucuccucua

SEQ ID NO: 4078380 - RNA, 15 nt, Streptococcus pneumoniae R6
uagaacuaguaaauu

SEQ ID NO: 4078381 - RNA, 19 nt, Streptococcus pneumoniae R6
uagaacugacgaaaucagu

SEQ ID NO: 4078382 - RNA, 16 nt, Streptococcus pneumoniae R6
uagaagauuuccucca

SEQ ID NO: 4078383 - RNA, 17 nt, Streptococcus pneumoniae R6
uagaagcaagacaaaaa

SEQ ID NO: 4078384 - RNA, 23 nt, Streptococcus pneumoniae R6
uagaagcaagacaaaaacucaau

SEQ ID NO: 4078385 - RNA, 22 nt, Streptococcus pneumoniae R6
uagaagcuucuuggaauucugg

SEQ ID NO: 4078386 - RNA, 15 nt, Streptococcus pneumoniae R6
uagaaggucaagaga

SEQ ID NO: 4078387 - RNA, 18 nt, Streptococcus pneumoniae R6
uagaaggucaagagaaaa

SEQ ID NO: 4078388 - RNA, 19 nt, Streptococcus pneumoniae R6
uagaaggucaagagaaaac

SEQ ID NO: 4078389 - RNA, 15 nt, Streptococcus pneumoniae R6
uagaaguaguuuagg

SEQ ID NO: 4078390 - RNA, 17 nt, Streptococcus pneumoniae R6
uagaagucucagugggc

SEQ ID NO: 4078391 - RNA, 17 nt, Streptococcus pneumoniae R6
uagaaguggauuuucuu

SEQ ID NO: 4078392 - RNA, 17 nt, Streptococcus pneumoniae R6
uagaauaaggaaaacau

SEQ ID NO: 4078393 - RNA, 14 nt, Streptococcus pneumoniae R6
uagcaauuguuucg

SEQ ID NO: 4078394 - RNA, 16 nt, Streptococcus pneumoniae R6
uagcaauuuguggaaa

SEQ ID NO: 4078395 - RNA, 21 nt, Streptococcus pneumoniae R6
uagcacaugacaaauucucca

SEQ ID NO: 4078396 - RNA, 14 nt, Streptococcus pneumoniae R6
uagcaccaaaagca

SEQ ID NO: 4078397 - RNA, 12 nt, Streptococcus pneumoniae R6
uagcaccauauu

SEQ ID NO: 4078398 - RNA, 23 nt, Streptococcus pneumoniae R6
uagcaccauauuuguugcucuua

SEQ ID NO: 4078399 - RNA, 13 nt, Streptococcus pneumoniae R6
uagcacuuaaaaa

SEQ ID NO: 4078400 - RNA, 14 nt, Streptococcus pneumoniae R6
uagcacuuuuccau

SEQ ID NO: 4078401 - RNA, 21 nt, Streptococcus pneumoniae R6
uagcacuuuuccauuguuuua

SEQ ID NO: 4078402 - RNA, 22 nt, Streptococcus pneumoniae R6
uagcagacuucuuuuuuacuuc

SEQ ID NO: 4078403 - RNA, 17 nt, Streptococcus pneumoniae R6
uagcagcgguuccauua

SEQ ID NO: 4078404 - RNA, 21 nt, Streptococcus pneumoniae R6
uagcagcgguuccauuaaagc

SEQ ID NO: 4078405 - RNA, 16 nt, Streptococcus pneumoniae R6
uagcagcuuucaaagc

SEQ ID NO: 4078406 - RNA, 13 nt, Streptococcus pneumoniae R6
uagcaguaacuuc

SEQ ID NO: 4078407 - RNA, 15 nt, Streptococcus pneumoniae R6
uagcaguaacuucug

SEQ ID NO: 4078408 - RNA, 16 nt, Streptococcus pneumoniae R6
uagcauaaaagccucc

SEQ ID NO: 4078409 - RNA, 15 nt, Streptococcus pneumoniae R6
uagcauaauagcaga

SEQ ID NO: 4078410 - RNA, 20 nt, Streptococcus pneumoniae R6
uagcauaauagcagaaaaau

SEQ ID NO: 4078411 - RNA, 14 nt, Streptococcus pneumoniae R6
uagcauauuuuguu

SEQ ID NO: 4078412 - RNA, 13 nt, Streptococcus pneumoniae R6
uagcauccaccac

SEQ ID NO: 4078413 - RNA, 21 nt, Streptococcus pneumoniae R6
uagcauccaucccauuuauau

SEQ ID NO: 4078414 - RNA, 12 nt, Streptococcus pneumoniae R6
uagcauccccag

SEQ ID NO: 4078415 - RNA, 23 nt, Streptococcus pneumoniae R6
uagcaucuugcucgaccaagcca

SEQ ID NO: 4078416 - RNA, 17 nt, Streptococcus pneumoniae R6
uagcaucuuguguuuuu

SEQ ID NO: 4078417 - RNA, 19 nt, Streptococcus pneumoniae R6
uagccacucuggcaauuua

SEQ ID NO: 4078418 - RNA, 15 nt, Streptococcus pneumoniae R6
uagccagugagaaga

SEQ ID NO: 4078419 - RNA, 17 nt, Streptococcus pneumoniae R6
uagccagugagaagaag

SEQ ID NO: 4078420 - RNA, 14 nt, Streptococcus pneumoniae R6
uagccauaaaacau

SEQ ID NO: 4078421 - RNA, 16 nt, Streptococcus pneumoniae R6
uagccauaaaacauuu

SEQ ID NO: 4078422 - RNA, 22 nt, Streptococcus pneumoniae R6
uagccauaaaacauuuccgauu

SEQ ID NO: 4078423 - RNA, 21 nt, Streptococcus pneumoniae R6
uagccauaaaacauuucggau

SEQ ID NO: 4078424 - RNA, 16 nt, Streptococcus pneumoniae R6
uagccauacguuucau

SEQ ID NO: 4078425 - RNA, 17 nt, Streptococcus pneumoniae R6
uagccauguuuuucucc

SEQ ID NO: 4078426 - RNA, 18 nt, Streptococcus pneumoniae R6
uagccauguuuuucuccu

SEQ ID NO: 4078427 - RNA, 23 nt, Streptococcus pneumoniae R6
uagccauucccaucaauaucgua

SEQ ID NO: 4078428 - RNA, 18 nt, Streptococcus pneumoniae R6
uagcccgagcucaaauca

SEQ ID NO: 4078429 - RNA, 20 nt, Streptococcus pneumoniae R6
uagcccguuggcuaaagaua

SEQ ID NO: 4078430 - RNA, 19 nt, Streptococcus pneumoniae R6
uagcccuucauaaaggaac

SEQ ID NO: 4078431 - RNA, 19 nt, Streptococcus pneumoniae R6
uagcccuucggauaaaauc

SEQ ID NO: 4078432 - RNA, 18 nt, Streptococcus pneumoniae R6
uagccgacuccaugccaa

SEQ ID NO: 4078433 - RNA, 19 nt, Streptococcus pneumoniae R6
uagccgcacgugcucaaaa

SEQ ID NO: 4078434 - RNA, 20 nt, Streptococcus pneumoniae R6
uagccgcagguugcucaaaa

SEQ ID NO: 4078435 - RNA, 14 nt, Streptococcus pneumoniae R6
uagccuccauucag

SEQ ID NO: 4078436 - RNA, 17 nt, Streptococcus pneumoniae R6
uagccuccuaguuugcu

SEQ ID NO: 4078437 - RNA, 23 nt, Streptococcus pneumoniae R6
uagccucuacaccauaaauauuu

SEQ ID NO: 4078438 - RNA, 14 nt, Streptococcus pneumoniae R6
uagccucucuaaag

SEQ ID NO: 4078439 - RNA, 21 nt, Streptococcus pneumoniae R6
uagccuguaugaugggcucuu

SEQ ID NO: 4078440 - RNA, 23 nt, Streptococcus pneumoniae R6
uagccuucuggucugauuuucau

SEQ ID NO: 4078441 - RNA, 23 nt, Streptococcus pneumoniae R6
uagccuugaccagaaauaaaagu

SEQ ID NO: 4078442 - RNA, 24 nt, Streptococcus pneumoniae R6
uagccuuugucguuccaaguggca

SEQ ID NO: 4078443 - RNA, 23 nt, Streptococcus pneumoniae R6
uagcgaaaucguggcucuacgaa

SEQ ID NO: 4078444 - RNA, 15 nt, Streptococcus pneumoniae R6
uagcgaaauuccauu

SEQ ID NO: 4078445 - RNA, 14 nt, Streptococcus pneumoniae R6
uagcgacuauaaaa

SEQ ID NO: 4078446 - RNA, 19 nt, Streptococcus pneumoniae R6
uagcgauagauguuuucaa

SEQ ID NO: 4078447 - RNA, 23 nt, Streptococcus pneumoniae R6
uagcgauagauguuuucaaaaau

SEQ ID NO: 4078448 - RNA, 15 nt, Streptococcus pneumoniae R6
uagcgauugaauaug

SEQ ID NO: 4078449 - RNA, 15 nt, Streptococcus pneumoniae R6
uagcgcaucaacaug

SEQ ID NO: 4078450 - RNA, 15 nt, Streptococcus pneumoniae R6
uagcgcaugguuaua

SEQ ID NO: 4078451 - RNA, 17 nt, Streptococcus pneumoniae R6
uagcgcuugaaacucau

SEQ ID NO: 4078452 - RNA, 21 nt, Streptococcus pneumoniae R6
uagcgcuugaaacucaucuug

SEQ ID NO: 4078453 - RNA, 21 nt, Streptococcus pneumoniae R6
uagcggcuuguccguuuucau

SEQ ID NO: 4078454 - RNA, 21 nt, Streptococcus pneumoniae R6
uagcguaacugguaagaagua

SEQ ID NO: 4078455 - RNA, 13 nt, Streptococcus pneumoniae R6
uagcgucaaagaa

SEQ ID NO: 4078456 - RNA, 17 nt, Streptococcus pneumoniae R6
uagcgugcccaaaaauu

SEQ ID NO: 4078457 - RNA, 22 nt, Streptococcus pneumoniae R6
uagcuaaaccuuauuuuuuaug

SEQ ID NO: 4078458 - RNA, 22 nt, Streptococcus pneumoniae R6
uagcuagucuucacuuucccuu

SEQ ID NO: 4078459 - RNA, 22 nt, Streptococcus pneumoniae R6
uagcuaucuccucauauuuauu

SEQ ID NO: 4078460 - RNA, 16 nt, Streptococcus pneumoniae R6
uagcuauuucuugcuu

SEQ ID NO: 4078461 - RNA, 18 nt, Streptococcus pneumoniae R6
uagcuccuccaaguccaa

SEQ ID NO: 4078462 - RNA, 13 nt, Streptococcus pneumoniae R6
uagcucucucuga

SEQ ID NO: 4078463 - RNA, 14 nt, Streptococcus pneumoniae R6
uagcugagaagccc

SEQ ID NO: 4078464 - RNA, 20 nt, Streptococcus pneumoniae R6
uagcugagaagcccauaucu

SEQ ID NO: 4078465 - RNA, 18 nt, Streptococcus pneumoniae R6
uagcugauuuuuggauau

SEQ ID NO: 4078466 - RNA, 16 nt, Streptococcus pneumoniae R6
uagcugcaccacagua

SEQ ID NO: 4078467 - RNA, 16 nt, Streptococcus pneumoniae R6
uagcugcagcugagga

SEQ ID NO: 4078468 - RNA, 18 nt, Streptococcus pneumoniae R6
uagcugcggcuuucuuca

SEQ ID NO: 4078469 - RNA, 18 nt, Streptococcus pneumoniae R6
uagcugcguucacuucau

SEQ ID NO: 4078470 - RNA, 20 nt, Streptococcus pneumoniae R6
uagcuggugagaagagggag

SEQ ID NO: 4078471 - RNA, 14 nt, Streptococcus pneumoniae R6
uagcugucaaauca

SEQ ID NO: 4078472 - RNA, 20 nt, Streptococcus pneumoniae R6
uagcuuccuaguuugcucuu

SEQ ID NO: 4078473 - RNA, 21 nt, Streptococcus pneumoniae R6
uagcuuccuaguuugcucuuu

SEQ ID NO: 4078474 - RNA, 22 nt, Streptococcus pneumoniae R6
uagcuugaacaaaauuaucaac

SEQ ID NO: 4078475 - RNA, 20 nt, Streptococcus pneumoniae R6
uagcuugcuccauucuuuua

SEQ ID NO: 4078476 - RNA, 17 nt, Streptococcus pneumoniae R6
uagcuuggucaguaaga

SEQ ID NO: 4078477 - RNA, 14 nt, Streptococcus pneumoniae R6
uagcuuuuauaaau

SEQ ID NO: 4078478 - RNA, 11 nt, Streptococcus pneumoniae R6
uagcuuuucuu

SEQ ID NO: 4078479 - RNA, 13 nt, Streptococcus pneumoniae R6
uagcuuuucuuca

SEQ ID NO: 4078480 - RNA, 14 nt, Streptococcus pneumoniae R6
uagcuuuucuucaa

SEQ ID NO: 4078481 - RNA, 16 nt, Streptococcus pneumoniae R6
uagcuuuugcagcacc

SEQ ID NO: 4078482 - RNA, 17 nt, Streptococcus pneumoniae R6
uagcuuuugcagcacca

SEQ ID NO: 4078483 - RNA, 17 nt, Streptococcus pneumoniae R6
uaggaaaacaugaagua

SEQ ID NO: 4078484 - RNA, 18 nt, Streptococcus pneumoniae R6
uaggaaauucaaaugaau

SEQ ID NO: 4078485 - RNA, 16 nt, Streptococcus pneumoniae R6
uaggaacuuuaguucc

SEQ ID NO: 4078486 - RNA, 17 nt, Streptococcus pneumoniae R6
uaggaauauuauauaaa

SEQ ID NO: 4078487 - RNA, 14 nt, Streptococcus pneumoniae R6
uaggaauauugaaa

SEQ ID NO: 4078488 - RNA, 15 nt, Streptococcus pneumoniae R6
uaggaaucccuggag

SEQ ID NO: 4078489 - RNA, 19 nt, Streptococcus pneumoniae R6
uaggacaagaagaucagag

SEQ ID NO: 4078490 - RNA, 19 nt, Streptococcus pneumoniae R6
uaggacaucauaaaucaau

SEQ ID NO: 4078491 - RNA, 15 nt, Streptococcus pneumoniae R6
uaggacgauaaaaac

SEQ ID NO: 4078492 - RNA, 17 nt, Streptococcus pneumoniae R6
uaggacuuccuuuucuu

SEQ ID NO: 4078493 - RNA, 20 nt, Streptococcus pneumoniae R6
uaggagacucuugagggcac

SEQ ID NO: 4078494 - RNA, 13 nt, Streptococcus pneumoniae R6
uaggagauucugu

SEQ ID NO: 4078495 - RNA, 14 nt, Streptococcus pneumoniae R6
uaguguauaagguu

SEQ ID NO: 4078496 - RNA, 17 nt, Streptococcus pneumoniae R6
uagugugggacuccuac

SEQ ID NO: 4078497 - RNA, 13 nt, Streptococcus pneumoniae R6
uaguuaaaaaaga

SEQ ID NO: 4078498 - RNA, 12 nt, Streptococcus pneumoniae R6
uaguuaauacug

SEQ ID NO: 4078499 - RNA, 17 nt, Streptococcus pneumoniae R6
uaguuaauugauaaggu

SEQ ID NO: 4078500 - RNA, 17 nt, Streptococcus pneumoniae R6
uaguuacuccuuuuuug

SEQ ID NO: 4078501 - RNA, 21 nt, Streptococcus pneumoniae R6
uaguuauaaaggcuugaggau

SEQ ID NO: 4078502 - RNA, 18 nt, Streptococcus pneumoniae R6
uaguuauccuuuccucga

SEQ ID NO: 4078503 - RNA, 12 nt, Streptococcus pneumoniae R6
uaguuaugaaac

SEQ ID NO: 4078504 - RNA, 22 nt, Streptococcus pneumoniae R6
uaguucaagugcuuuugugauu

SEQ ID NO: 4078505 - RNA, 18 nt, Streptococcus pneumoniae R6
uaguucagaauuuucuua

SEQ ID NO: 4078506 - RNA, 16 nt, Streptococcus pneumoniae R6
uaguucauaagagcua

SEQ ID NO: 4078507 - RNA, 14 nt, Streptococcus pneumoniae R6
uaguucaugauuga

SEQ ID NO: 4078508 - RNA, 19 nt, Streptococcus pneumoniae R6
uaguucuuccaauuucuuu

SEQ ID NO: 4078509 - RNA, 19 nt, Streptococcus pneumoniae R6
uaguucuugaaaugaaguu

SEQ ID NO: 4078510 - RNA, 11 nt, Streptococcus pneumoniae R6
uaguugacaaa

SEQ ID NO: 4078511 - RNA, 12 nt, Streptococcus pneumoniae R6
uaguugacaaag

SEQ ID NO: 4078512 - RNA, 17 nt, Streptococcus pneumoniae R6
uaguuggauuuccacua

SEQ ID NO: 4078513 - RNA, 14 nt, Streptococcus pneumoniae R6
uaguuggccaacuu

SEQ ID NO: 4078514 - RNA, 23 nt, Streptococcus pneumoniae R6
uaguugguauucuucgugaaaga

SEQ ID NO: 4078515 - RNA, 14 nt, Streptococcus pneumoniae R6
uaguugguuuccuu

SEQ ID NO: 4078516 - RNA, 12 nt, Streptococcus pneumoniae R6
uaguuuaaauca

SEQ ID NO: 4078517 - RNA, 20 nt, Streptococcus pneumoniae R6
uaguuuaaaucauaauccaa

SEQ ID NO: 4078518 - RNA, 15 nt, Streptococcus pneumoniae R6
uaguuuaaucaaaau

SEQ ID NO: 4078519 - RNA, 13 nt, Streptococcus pneumoniae R6
uaguuuaugaaca

SEQ ID NO: 4078520 - RNA, 20 nt, Streptococcus pneumoniae R6
uaguuuaugguauuuguaaa

SEQ ID NO: 4078521 - RNA, 22 nt, Streptococcus pneumoniae R6
uaguuuaugguauuuguaaaau

SEQ ID NO: 4078522 - RNA, 13 nt, Streptococcus pneumoniae R6
uaguuucauaacu

SEQ ID NO: 4078523 - RNA, 17 nt, Streptococcus pneumoniae R6
uaguuuccuaguuugcu

SEQ ID NO: 4078524 - RNA, 20 nt, Streptococcus pneumoniae R6
uaguuuccuaguuugcucuu

SEQ ID NO: 4078525 - RNA, 15 nt, Streptococcus pneumoniae R6
uaguuugcaaauuau

SEQ ID NO: 4078526 - RNA, 16 nt, Streptococcus pneumoniae R6
uaguuugcuuuuugau

SEQ ID NO: 4078527 - RNA, 17 nt, Streptococcus pneumoniae R6
uaguuuugguuuuucuu

SEQ ID NO: 4078528 - RNA, 19 nt, Streptococcus pneumoniae R6
uaguuuugguuuuucuuca

SEQ ID NO: 4078529 - RNA, 15 nt, Streptococcus pneumoniae R6
uaguuuuuagaagcu

SEQ ID NO: 4078530 - RNA, 23 nt, Streptococcus pneumoniae R6
uaguuuuuagaagcuucuuggaa

SEQ ID NO: 4078531 - RNA, 19 nt, Streptococcus pneumoniae R6
uaguuuuugaaguuuucua

SEQ ID NO: 4078532 - RNA, 20 nt, Streptococcus pneumoniae R6
uaguuuuuugcguuucugga

SEQ ID NO: 4078533 - RNA, 14 nt, Streptococcus pneumoniae R6
uauaaaaaagugaa

SEQ ID NO: 4078534 - RNA, 15 nt, Streptococcus pneumoniae R6
uauaaaaagcuauag

SEQ ID NO: 4078535 - RNA, 17 nt, Streptococcus pneumoniae R6
uauaaaacauucuuauc

SEQ ID NO: 4078536 - RNA, 20 nt, Streptococcus pneumoniae R6
uauaaaacgcaucauaucaa

SEQ ID NO: 4078537 - RNA, 18 nt, Streptococcus pneumoniae R6
uauaaaagcucauuuccu

SEQ ID NO: 4078538 - RNA, 12 nt, Streptococcus pneumoniae R6
uauaaaauaacg

SEQ ID NO: 4078539 - RNA, 17 nt, Streptococcus pneumoniae R6
uauaaaauaauuaaaau

SEQ ID NO: 4078540 - RNA, 14 nt, Streptococcus pneumoniae R6
uauaaaauuuaaua

SEQ ID NO: 4078541 - RNA, 14 nt, Streptococcus pneumoniae R6
uauaaaauuuugac

SEQ ID NO: 4078542 - RNA, 19 nt, Streptococcus pneumoniae R6
uauaaaccaaaggaagcug

SEQ ID NO: 4078543 - RNA, 16 nt, Streptococcus pneumoniae R6
uauaaacgaauagaaa

SEQ ID NO: 4078544 - RNA, 14 nt, Streptococcus pneumoniae R6
uauaaacuuugguu

SEQ ID NO: 4078545 - RNA, 20 nt, Streptococcus pneumoniae R6
uauaaacuuugguuauaaaa

SEQ ID NO: 4078546 - RNA, 12 nt, Streptococcus pneumoniae R6
uauaaagauacg

SEQ ID NO: 4078547 - RNA, 13 nt, Streptococcus pneumoniae R6
uauaaauauagaa

SEQ ID NO: 4078548 - RNA, 20 nt, Streptococcus pneumoniae R6
uauaaauauaguaaaaugaa

SEQ ID NO: 4078549 - RNA, 15 nt, Streptococcus pneumoniae R6
uauaaaucaauuuuc

SEQ ID NO: 4078550 - RNA, 17 nt, Streptococcus pneumoniae R6
uauaaaucaauuuuccu

SEQ ID NO: 4078551 - RNA, 22 nt, Streptococcus pneumoniae R6
uauaaauucauuugauuuuccu

SEQ ID NO: 4078552 - RNA, 14 nt, Streptococcus pneumoniae R6
uauaaauuuuccag

SEQ ID NO: 4078553 - RNA, 17 nt, Streptococcus pneumoniae R6
uauaacuuguuuacguu

SEQ ID NO: 4078554 - RNA, 15 nt, Streptococcus pneumoniae R6
uauaagaagcauaga

SEQ ID NO: 4078555 - RNA, 18 nt, Streptococcus pneumoniae R6
uauaagauauacuaaaag

SEQ ID NO: 4078556 - RNA, 16 nt, Streptococcus pneumoniae R6
uauaagcccaaaucau

SEQ ID NO: 4078557 - RNA, 15 nt, Streptococcus pneumoniae R6
uauaagcuuaguuua

SEQ ID NO: 4078558 - RNA, 16 nt, Streptococcus pneumoniae R6
uauaagucuuugauuu

SEQ ID NO: 4078559 - RNA, 21 nt, Streptococcus pneumoniae R6
uauaaguuguuuucuauagaa

SEQ ID NO: 4078560 - RNA, 18 nt, Streptococcus pneumoniae R6
uauaauaaaaugaaauaa

SEQ ID NO: 4078561 - RNA, 13 nt, Streptococcus pneumoniae R6
uauaauaaauugu

SEQ ID NO: 4078562 - RNA, 20 nt, Streptococcus pneumoniae R6
uauaauagguggauaaaagu

SEQ ID NO: 4078563 - RNA, 22 nt, Streptococcus pneumoniae R6
uauaauagguggauaaaagucu

SEQ ID NO: 4078564 - RNA, 11 nt, Streptococcus pneumoniae R6
uauaauaucac

SEQ ID NO: 4078565 - RNA, 14 nt, Streptococcus pneumoniae R6
uauaauauguauuu

SEQ ID NO: 4078566 - RNA, 15 nt, Streptococcus pneumoniae R6
uauaauauuuaauug

SEQ ID NO: 4078567 - RNA, 17 nt, Streptococcus pneumoniae R6
uauaaucaauauagaag

SEQ ID NO: 4078568 - RNA, 15 nt, Streptococcus pneumoniae R6
uauaaucauuaaaau

SEQ ID NO: 4078569 - RNA, 16 nt, Streptococcus pneumoniae R6
uauaaucauuaaaaua

SEQ ID NO: 4078570 - RNA, 17 nt, Streptococcus pneumoniae R6
uauaaucauuaaaauaa

SEQ ID NO: 4078571 - RNA, 21 nt, Streptococcus pneumoniae R6
uauaaucauuaaaauaacuca

SEQ ID NO: 4078572 - RNA, 18 nt, Streptococcus pneumoniae R6
uauaaucguuuaaaacac

SEQ ID NO: 4078573 - RNA, 18 nt, Streptococcus pneumoniae R6
uauaauggcuuauuccaa

SEQ ID NO: 4078574 - RNA, 22 nt, Streptococcus pneumoniae R6
uauaauggcuuauuccaauuga

SEQ ID NO: 4078575 - RNA, 18 nt, Streptococcus pneumoniae R6
uauaauggcuuguuccaa

SEQ ID NO: 4078576 - RNA, 18 nt, Streptococcus pneumoniae R6
uauaauuauauauaaaaa

SEQ ID NO: 4078577 - RNA, 17 nt, Streptococcus pneumoniae R6
uauaauucuaacaccuu

SEQ ID NO: 4078578 - RNA, 22 nt, Streptococcus pneumoniae R6
uauaauucuaacaccuuuauua

SEQ ID NO: 4078579 - RNA, 19 nt, Streptococcus pneumoniae R6
uauaauuguaaacaaaaau

SEQ ID NO: 4078580 - RNA, 14 nt, Streptococcus pneumoniae R6
uauaauuuuaaaga

SEQ ID NO: 4078581 - RNA, 11 nt, Streptococcus pneumoniae R6
uauacaaaaaa

SEQ ID NO: 4078582 - RNA, 14 nt, Streptococcus pneumoniae R6
uauacacuaaacaa

SEQ ID NO: 4078583 - RNA, 13 nt, Streptococcus pneumoniae R6
uauacacuuaaau

SEQ ID NO: 4078584 - RNA, 21 nt, Streptococcus pneumoniae R6
uauacaguccucccuuguuuu

SEQ ID NO: 4078585 - RNA, 21 nt, Streptococcus pneumoniae R6
uauacaucuucccacaauaaa

SEQ ID NO: 4078586 - RNA, 18 nt, Streptococcus pneumoniae R6
uauaccaaaaaaacucca

SEQ ID NO: 4078587 - RNA, 12 nt, Streptococcus pneumoniae R6
uauaccacacua

SEQ ID NO: 4078588 - RNA, 16 nt, Streptococcus pneumoniae R6
uauacccaaaacacaa

SEQ ID NO: 4078589 - RNA, 13 nt, Streptococcus pneumoniae R6
uauacguuuucuu

SEQ ID NO: 4078590 - RNA, 20 nt, Streptococcus pneumoniae R6
uauacguuuuuugauuuuaa

SEQ ID NO: 4078591 - RNA, 16 nt, Streptococcus pneumoniae R6
uauacuaaaagcgauu

SEQ ID NO: 4078592 - RNA, 19 nt, Streptococcus pneumoniae R6
uauacuauaguagcucaga

SEQ ID NO: 4078593 - RNA, 16 nt, Streptococcus pneumoniae R6
uauacuauuuuuguca

SEQ ID NO: 4078594 - RNA, 13 nt, Streptococcus pneumoniae R6
uauacucaucugc

SEQ ID NO: 4078595 - RNA, 19 nt, Streptococcus pneumoniae R6
uauacucaucuguuuucaa

SEQ ID NO: 4078596 - RNA, 13 nt, Streptococcus pneumoniae R6
uauacucuuagaa

SEQ ID NO: 4078597 - RNA, 13 nt, Streptococcus pneumoniae R6
uauacuuuucucu

SEQ ID NO: 4078598 - RNA, 12 nt, Streptococcus pneumoniae R6
uauacuuuuuca

SEQ ID NO: 4078599 - RNA, 18 nt, Streptococcus pneumoniae R6
uaucaggggauuaagaaa

SEQ ID NO: 4078600 - RNA, 21 nt, Streptococcus pneumoniae R6
uaucagguauugaaaaaacuu

SEQ ID NO: 4078601 - RNA, 23 nt, Streptococcus pneumoniae R6
uaucaguaaucucaaaacagugu

SEQ ID NO: 4078602 - RNA, 20 nt, Streptococcus pneumoniae R6
uaucauagaaauauuuacuu

SEQ ID NO: 4078603 - RNA, 16 nt, Streptococcus pneumoniae R6
uaucaucaaucaagau

SEQ ID NO: 4078604 - RNA, 21 nt, Streptococcus pneumoniae R6
uaucauccagauuuuucuggg

SEQ ID NO: 4078605 - RNA, 17 nt, Streptococcus pneumoniae R6
uaucaucgauuuuuuca

SEQ ID NO: 4078606 - RNA, 20 nt, Streptococcus pneumoniae R6
uaucaucgauuuuuucacca

SEQ ID NO: 4078607 - RNA, 21 nt, Streptococcus pneumoniae R6
uaucaugcuuuacuaguucuc

SEQ ID NO: 4078608 - RNA, 22 nt, Streptococcus pneumoniae R6
uaucaugggguguuuuucuauu

SEQ ID NO: 4078609 - RNA, 18 nt, Streptococcus pneumoniae R6
uaucauuaaguaaucucu

SEQ ID NO: 4078610 - RNA, 20 nt, Streptococcus pneumoniae R6
uaucauuauggaccaugcaa

SEQ ID NO: 4078611 - RNA, 16 nt, Streptococcus pneumoniae R6
uaucauucgacuaauu

SEQ ID NO: 4078612 - RNA, 19 nt, Streptococcus pneumoniae R6
uaucauucuuauuuggcaa

SEQ ID NO: 4078613 - RNA, 12 nt, Streptococcus pneumoniae R6
uaucauuuccau

SEQ ID NO: 4078614 - RNA, 20 nt, Streptococcus pneumoniae R6
uaucauuuugaaaucuauuu

SEQ ID NO: 4078615 - RNA, 22 nt, Streptococcus pneumoniae R6
uauccaaaaccauucaaaauac

SEQ ID NO: 4078616 - RNA, 18 nt, Streptococcus pneumoniae R6
uauccaaagauuaaucuu

SEQ ID NO: 4078617 - RNA, 18 nt, Streptococcus pneumoniae R6
uauccaacagagaaaauu

SEQ ID NO: 4078618 - RNA, 14 nt, Streptococcus pneumoniae R6
uauccaacucagga

SEQ ID NO: 4078619 - RNA, 17 nt, Streptococcus pneumoniae R6
uauccaacucaggaaag

SEQ ID NO: 4078620 - RNA, 20 nt, Streptococcus pneumoniae R6
uauccaaucuauuuaugaaa

SEQ ID NO: 4078621 - RNA, 22 nt, Streptococcus pneumoniae R6
uauccaaucuauuuaugaaaaa

SEQ ID NO: 4078622 - RNA, 17 nt, Streptococcus pneumoniae R6
uauccacaaccucaaaa

SEQ ID NO: 4078623 - RNA, 19 nt, Streptococcus pneumoniae R6
uauccacaaccuuaaaacg

SEQ ID NO: 4078624 - RNA, 15 nt, Streptococcus pneumoniae R6
uauccacaucaucaa

SEQ ID NO: 4078625 - RNA, 15 nt, Streptococcus pneumoniae R6
uauccaguuauucuu

SEQ ID NO: 4078626 - RNA, 16 nt, Streptococcus pneumoniae R6
uauccaucacaguuua

SEQ ID NO: 4078627 - RNA, 16 nt, Streptococcus pneumoniae R6
uauccauguuaugauu

SEQ ID NO: 4078628 - RNA, 20 nt, Streptococcus pneumoniae R6
uauccauuagcuaaaucuaa

SEQ ID NO: 4078629 - RNA, 15 nt, Streptococcus pneumoniae R6
uauccauucacaaca

SEQ ID NO: 4078630 - RNA, 21 nt, Streptococcus pneumoniae R6
uauccauucacaacaucuucu

SEQ ID NO: 4078631 - RNA, 14 nt, Streptococcus pneumoniae R6
uauccauucuuaaa

SEQ ID NO: 4078632 - RNA, 22 nt, Streptococcus pneumoniae R6
uauccauuuggguaggucuuuu

SEQ ID NO: 4078633 - RNA, 19 nt, Streptococcus pneumoniae R6
uauccauuuuucaaaucaa

SEQ ID NO: 4078634 - RNA, 21 nt, Streptococcus pneumoniae R6
uaucccagagcuauaagccca

SEQ ID NO: 4078635 - RNA, 14 nt, Streptococcus pneumoniae R6
uauccgaagggcua

SEQ ID NO: 4078636 - RNA, 21 nt, Streptococcus pneumoniae R6
uauccgcaaccucaaaacagu

SEQ ID NO: 4078637 - RNA, 23 nt, Streptococcus pneumoniae R6
uauccgcaaccucaaaacagugu

SEQ ID NO: 4078638 - RNA, 19 nt, Streptococcus pneumoniae R6
uauccgugaguucucuagu

SEQ ID NO: 4078639 - RNA, 17 nt, Streptococcus pneumoniae R6
uauccuaaaaaagagcu

SEQ ID NO: 4078640 - RNA, 12 nt, Streptococcus pneumoniae R6
uauccuauucuu

SEQ ID NO: 4078641 - RNA, 14 nt, Streptococcus pneumoniae R6
uauccuauucuuga

SEQ ID NO: 4078642 - RNA, 15 nt, Streptococcus pneumoniae R6
uauccuauuucacuc

SEQ ID NO: 4078643 - RNA, 15 nt, Streptococcus pneumoniae R6
uauccuguucuuguu

SEQ ID NO: 4078644 - RNA, 22 nt, Streptococcus pneumoniae R6
uauccuguucuuguuucaauug

SEQ ID NO: 4078645 - RNA, 17 nt, Streptococcus pneumoniae R6
uauccuuaucgucauca

SEQ ID NO: 4078646 - RNA, 15 nt, Streptococcus pneumoniae R6
uauccuuauuuugca

SEQ ID NO: 4078647 - RNA, 16 nt, Streptococcus pneumoniae R6
uaucgaccucuaccaa

SEQ ID NO: 4078648 - RNA, 22 nt, Streptococcus pneumoniae R6
uaucguaacggcuuucaguuuc

SEQ ID NO: 4078649 - RNA, 16 nt, Streptococcus pneumoniae R6
uaucguagcuuuucuu

SEQ ID NO: 4078650 - RNA, 14 nt, Streptococcus pneumoniae R6
uaucguuauuagca

SEQ ID NO: 4078651 - RNA, 21 nt, Streptococcus pneumoniae R6
uaucguuuuacggacauguau

SEQ ID NO: 4078652 - RNA, 13 nt, Streptococcus pneumoniae R6
uaucuaaaaaaau

SEQ ID NO: 4078653 - RNA, 21 nt, Streptococcus pneumoniae R6
uaucuaacaauaagauaucac

SEQ ID NO: 4078654 - RNA, 12 nt, Streptococcus pneumoniae R6
uaucuaauaauu

SEQ ID NO: 4078655 - RNA, 23 nt, Streptococcus pneumoniae R6
uaucuaauacccauuuauggaaa

SEQ ID NO: 4078656 - RNA, 18 nt, Streptococcus pneumoniae R6
uaucuaaucacguugcuu

SEQ ID NO: 4078657 - RNA, 19 nt, Streptococcus pneumoniae R6
uaucuauaaacaaaggagu

SEQ ID NO: 4078658 - RNA, 14 nt, Streptococcus pneumoniae R6
uaucucacacaaag

SEQ ID NO: 4078659 - RNA, 18 nt, Streptococcus pneumoniae R6
uaucuccagauagagcua

SEQ ID NO: 4078660 - RNA, 14 nt, Streptococcus pneumoniae R6
uaucuccuuugauu

SEQ ID NO: 4078661 - RNA, 18 nt, Streptococcus pneumoniae R6
uaucucuacauucccaaa

SEQ ID NO: 4078662 - RNA, 23 nt, Streptococcus pneumoniae R6
uaucucuaggaauaucaaaguuu

SEQ ID NO: 4078663 - RNA, 13 nt, Streptococcus pneumoniae R6
uaucucuaucucu

SEQ ID NO: 4078664 - RNA, 18 nt, Streptococcus pneumoniae R6
uaucucuuugaaggugau

SEQ ID NO: 4078665 - RNA, 19 nt, Streptococcus pneumoniae R6
uaucugaaaauuaaucaga

SEQ ID NO: 4078666 - RNA, 15 nt, Streptococcus pneumoniae R6
uaucugaauaccuaa

SEQ ID NO: 4078667 - RNA, 13 nt, Streptococcus pneumoniae R6
uaucugauagagu

SEQ ID NO: 4078668 - RNA, 16 nt, Streptococcus pneumoniae R6
uaucugaugcugacaa

SEQ ID NO: 4078669 - RNA, 14 nt, Streptococcus pneumoniae R6
uaucugcaaccuca

SEQ ID NO: 4078670 - RNA, 23 nt, Streptococcus pneumoniae R6
uaucugcaaccucaaaacagugu

SEQ ID NO: 4078671 - RNA, 15 nt, Streptococcus pneumoniae R6
uaucugcaaccuuaa

SEQ ID NO: 4078672 - RNA, 23 nt, Streptococcus pneumoniae R6
uaucugcaaccuuaaaacagugu

SEQ ID NO: 4078673 - RNA, 14 nt, Streptococcus pneumoniae R6
uaucugccaccuca

SEQ ID NO: 4078674 - RNA, 15 nt, Streptococcus pneumoniae R6
uaucugcuaaaacaa

SEQ ID NO: 4078675 - RNA, 18 nt, Streptococcus pneumoniae R6
uaucugcuaaaacaaaau

SEQ ID NO: 4078676 - RNA, 14 nt, Streptococcus pneumoniae R6
uaucuggcauuccu

SEQ ID NO: 4078677 - RNA, 13 nt, Streptococcus pneumoniae R6
uaucugguugcca

SEQ ID NO: 4078678 - RNA, 18 nt, Streptococcus pneumoniae R6
uaucuuaauucucuuauu

SEQ ID NO: 4078679 - RNA, 19 nt, Streptococcus pneumoniae R6
uaucuuacuguccuucuuu

SEQ ID NO: 4078680 - RNA, 16 nt, Streptococcus pneumoniae R6
uaucuuaucacccaaa

SEQ ID NO: 4078681 - RNA, 21 nt, Streptococcus pneumoniae R6
uaucuuauuuuucuauuuaaa

SEQ ID NO: 4078682 - RNA, 24 nt, Streptococcus pneumoniae R6
uaucuucauuuugcacaauauagc

SEQ ID NO: 4078683 - RNA, 20 nt, Streptococcus pneumoniae R6
uaucuuccaguuuauaacuu

SEQ ID NO: 4078684 - RNA, 19 nt, Streptococcus pneumoniae R6
uaucuugaauauuuuucuu

SEQ ID NO: 4078685 - RNA, 15 nt, Streptococcus pneumoniae R6
uaucuugauuuucuu

SEQ ID NO: 4078686 - RNA, 22 nt, Streptococcus pneumoniae R6
uaucuuguccacucgaaacaag

SEQ ID NO: 4078687 - RNA, 16 nt, Streptococcus pneumoniae R6
uaucuuuccuucgcuu

SEQ ID NO: 4078688 - RNA, 14 nt, Streptococcus pneumoniae R6
uaucuuugauuuua

SEQ ID NO: 4078689 - RNA, 20 nt, Streptococcus pneumoniae R6
uaucuuuggacauagccaau

SEQ ID NO: 4078690 - RNA, 21 nt, Streptococcus pneumoniae R6
uaucuuugggacgauuuucaa

SEQ ID NO: 4078691 - RNA, 18 nt, Streptococcus pneumoniae R6
uaugaaaaagauuuuuua

SEQ ID NO: 4078692 - RNA, 21 nt, Streptococcus pneumoniae R6
uaugaaaaagauuuuuuaaaa

SEQ ID NO: 4078693 - RNA, 17 nt, Streptococcus pneumoniae R6
uaugaaauuuaaaaaga

SEQ ID NO: 4078694 - RNA, 15 nt, Streptococcus pneumoniae R6
uaugaacaaaucgau

SEQ ID NO: 4078695 - RNA, 15 nt, Streptococcus pneumoniae R6
uaugaacugguuuuc

SEQ ID NO: 4078696 - RNA, 22 nt, Streptococcus pneumoniae R6
uaugaauaacuucaauaucuuu

SEQ ID NO: 4078697 - RNA, 12 nt, Streptococcus pneumoniae R6
uaugacaucuug

SEQ ID NO: 4078698 - RNA, 18 nt, Streptococcus pneumoniae R6
uaugaggagaaagaagag

SEQ ID NO: 4078699 - RNA, 18 nt, Streptococcus pneumoniae R6
uaugaggugcuuuuugau

SEQ ID NO: 4078700 - RNA, 18 nt, Streptococcus pneumoniae R6
uaugaguuaccuaaauua

SEQ ID NO: 4078701 - RNA, 21 nt, Streptococcus pneumoniae R6
uauugagcgcaggaagaaaga

SEQ ID NO: 4078702 - RNA, 22 nt, Streptococcus pneumoniae R6
uauugagcgcaggaagaaagag

SEQ ID NO: 4078703 - RNA, 14 nt, Streptococcus pneumoniae R6
uauugaguucacaa

SEQ ID NO: 4078704 - RNA, 13 nt, Streptococcus pneumoniae R6
uauugaguuuuuu

SEQ ID NO: 4078705 - RNA, 14 nt, Streptococcus pneumoniae R6
uauugaugaaguaa

SEQ ID NO: 4078706 - RNA, 13 nt, Streptococcus pneumoniae R6
uauugcaagagaa

SEQ ID NO: 4078707 - RNA, 18 nt, Streptococcus pneumoniae R6
uauugcagccaauuucuu

SEQ ID NO: 4078708 - RNA, 20 nt, Streptococcus pneumoniae R6
uauugcagccaauuucuuua

SEQ ID NO: 4078709 - RNA, 21 nt, Streptococcus pneumoniae R6
uauugcagccaauuucuuuag

SEQ ID NO: 4078710 - RNA, 20 nt, Streptococcus pneumoniae R6
uauuggaacuaaaguuccua

SEQ ID NO: 4078711 - RNA, 19 nt, Streptococcus pneumoniae R6
uauuggaugaguuuacuau

SEQ ID NO: 4078712 - RNA, 21 nt, Streptococcus pneumoniae R6
uauuggcuacgacugcuucug

SEQ ID NO: 4078713 - RNA, 15 nt, Streptococcus pneumoniae R6
uauugguggcuucca

SEQ ID NO: 4078714 - RNA, 17 nt, Streptococcus pneumoniae R6
uauugguggcuuccagu

SEQ ID NO: 4078715 - RNA, 18 nt, Streptococcus pneumoniae R6
uauuguacuuuccaauca

SEQ ID NO: 4078716 - RNA, 16 nt, Streptococcus pneumoniae R6
uauuguagcauauuuu

SEQ ID NO: 4078717 - RNA, 13 nt, Streptococcus pneumoniae R6
uauuguauuuaug

SEQ ID NO: 4078718 - RNA, 21 nt, Streptococcus pneumoniae R6
uauugucacgaaccacacuuu

SEQ ID NO: 4078719 - RNA, 16 nt, Streptococcus pneumoniae R6
uauugucuacauugau

SEQ ID NO: 4078720 - RNA, 22 nt, Streptococcus pneumoniae R6
uauuguuaauggucuucaugcu

SEQ ID NO: 4078721 - RNA, 17 nt, Streptococcus pneumoniae R6
uauuguuccuaaaacag

SEQ ID NO: 4078722 - RNA, 17 nt, Streptococcus pneumoniae R6
uauuguucuaguuuuuu

SEQ ID NO: 4078723 - RNA, 18 nt, Streptococcus pneumoniae R6
uauuuaaucauuuaauaa

SEQ ID NO: 4078724 - RNA, 19 nt, Streptococcus pneumoniae R6
uauuuacaaguguuuucac

SEQ ID NO: 4078725 - RNA, 21 nt, Streptococcus pneumoniae R6
uauuuacaaguguuuucacuu

SEQ ID NO: 4078726 - RNA, 16 nt, Streptococcus pneumoniae R6
uauuuacagaaagaac

SEQ ID NO: 4078727 - RNA, 23 nt, Streptococcus pneumoniae R6
uauuuacagaaagaacaaaaaau

SEQ ID NO: 4078728 - RNA, 19 nt, Streptococcus pneumoniae R6
uauuuacauaauuuaaaau

SEQ ID NO: 4078729 - RNA, 20 nt, Streptococcus pneumoniae R6
uauuuacauaauuuaaaaua

SEQ ID NO: 4078730 - RNA, 14 nt, Streptococcus pneumoniae R6
uauuuaccaaaaag

SEQ ID NO: 4078731 - RNA, 22 nt, Streptococcus pneumoniae R6
uauuuacgacaacgguaucuug

SEQ ID NO: 4078732 - RNA, 15 nt, Streptococcus pneumoniae R6
uauuuacuaauuaau

SEQ ID NO: 4078733 - RNA, 15 nt, Streptococcus pneumoniae R6
uauuuacuguuuuag

SEQ ID NO: 4078734 - RNA, 13 nt, Streptococcus pneumoniae R6
uauuuacuuacca

SEQ ID NO: 4078735 - RNA, 23 nt, Streptococcus pneumoniae R6
uauuuagauucaguugcauaaau

SEQ ID NO: 4078736 - RNA, 16 nt, Streptococcus pneumoniae R6
uauuuagcaaccauuu

SEQ ID NO: 4078737 - RNA, 23 nt, Streptococcus pneumoniae R6
uauuuaggggucaugacuaguga

SEQ ID NO: 4078738 - RNA, 18 nt, Streptococcus pneumoniae R6
uauuuauagaauuuuuug

SEQ ID NO: 4078739 - RNA, 19 nt, Streptococcus pneumoniae R6
uauuuauaguaauuccaca

SEQ ID NO: 4078740 - RNA, 16 nt, Streptococcus pneumoniae R6
uauuuauuaauuucau

SEQ ID NO: 4078741 - RNA, 15 nt, Streptococcus pneumoniae R6
uauuuauuauaaaau

SEQ ID NO: 4078742 - RNA, 12 nt, Streptococcus pneumoniae R6
uauuuauuuaca

SEQ ID NO: 4078743 - RNA, 13 nt, Streptococcus pneumoniae R6
uauuuauuuacuu

SEQ ID NO: 4078744 - RNA, 14 nt, Streptococcus pneumoniae R6
uauuuauuuacuua

SEQ ID NO: 4078745 - RNA, 16 nt, Streptococcus pneumoniae R6
uauuucacauuuucaa

SEQ ID NO: 4078746 - RNA, 20 nt, Streptococcus pneumoniae R6
uauuucacuccacuauaaaa

SEQ ID NO: 4078747 - RNA, 19 nt, Streptococcus pneumoniae R6
uauuucagauucagucuac

SEQ ID NO: 4078748 - RNA, 16 nt, Streptococcus pneumoniae R6
uauuucaguuuacuau

SEQ ID NO: 4078749 - RNA, 18 nt, Streptococcus pneumoniae R6
uauuucauacgauaaaaa

SEQ ID NO: 4078750 - RNA, 14 nt, Streptococcus pneumoniae R6
uauuucauuuuaau

SEQ ID NO: 4078751 - RNA, 14 nt, Streptococcus pneumoniae R6
uauuucauuuuacu

SEQ ID NO: 4078752 - RNA, 16 nt, Streptococcus pneumoniae R6
uauuucauuuuacuau

SEQ ID NO: 4078753 - RNA, 18 nt, Streptococcus pneumoniae R6
uauuucauuuuacuauau

SEQ ID NO: 4078754 - RNA, 12 nt, Streptococcus pneumoniae R6
uauuuccaucaa

SEQ ID NO: 4078755 - RNA, 14 nt, Streptococcus pneumoniae R6
uauuuccaucaacu

SEQ ID NO: 4078756 - RNA, 18 nt, Streptococcus pneumoniae R6
uauuuccaucaacuagag

SEQ ID NO: 4078757 - RNA, 18 nt, Streptococcus pneumoniae R6
uauuucuaagcuaccucu

SEQ ID NO: 4078758 - RNA, 16 nt, Streptococcus pneumoniae R6
uauuucuagaaauuaa

SEQ ID NO: 4078759 - RNA, 17 nt, Streptococcus pneumoniae R6
uauuucuaugauaaaac

SEQ ID NO: 4078760 - RNA, 22 nt, Streptococcus pneumoniae R6
uauuucuccuaaagaaaaaguu

SEQ ID NO: 4078761 - RNA, 22 nt, Streptococcus pneumoniae R6
uauuucuuaguuacagccaugg

SEQ ID NO: 4078762 - RNA, 16 nt, Streptococcus pneumoniae R6
uauuucuucuuuucau

SEQ ID NO: 4078763 - RNA, 16 nt, Streptococcus pneumoniae R6
uauuucuuguuuucua

SEQ ID NO: 4078764 - RNA, 22 nt, Streptococcus pneumoniae R6
uauuugaaaaauauacaaaaaa

SEQ ID NO: 4078765 - RNA, 15 nt, Streptococcus pneumoniae R6
uauuuggcauauuuu

SEQ ID NO: 4078766 - RNA, 13 nt, Streptococcus pneumoniae R6
uauuuguaaaauu

SEQ ID NO: 4078767 - RNA, 22 nt, Streptococcus pneumoniae R6
uauuuguuguccuaauaaacuu

SEQ ID NO: 4078768 - RNA, 17 nt, Streptococcus pneumoniae R6
uauuuucauagaggaag

SEQ ID NO: 4078769 - RNA, 19 nt, Streptococcus pneumoniae R6
uauuuucccaguagcuauu

SEQ ID NO: 4078770 - RNA, 21 nt, Streptococcus pneumoniae R6
uauuuucuuagcaauucuaaa

SEQ ID NO: 4078771 - RNA, 22 nt, Streptococcus pneumoniae R6
uauuuucuucuuuauaauauuu

SEQ ID NO: 4078772 - RNA, 14 nt, Streptococcus pneumoniae R6
uauuuucuuugauu

SEQ ID NO: 4078773 - RNA, 15 nt, Streptococcus pneumoniae R6
uauuuugaauauacc

SEQ ID NO: 4078774 - RNA, 14 nt, Streptococcus pneumoniae R6
uauuuuuacucaag

SEQ ID NO: 4078775 - RNA, 22 nt, Streptococcus pneumoniae R6
uauuuuugaaaguacuuuuaau

SEQ ID NO: 4078776 - RNA, 14 nt, Streptococcus pneumoniae R6
uauuuuugagcaga

SEQ ID NO: 4078777 - RNA, 22 nt, Streptococcus pneumoniae R6
uauuuuuggagugauagaaaag

SEQ ID NO: 4078778 - RNA, 12 nt, Streptococcus pneumoniae R6
uauuuuuuacuu

SEQ ID NO: 4078779 - RNA, 17 nt, Streptococcus pneumoniae R6
uauuuuuucuguaaaau

SEQ ID NO: 4078780 - RNA, 14 nt, Streptococcus pneumoniae R6
uauuuuuuuacuua

SEQ ID NO: 4078781 - RNA, 16 nt, Streptococcus pneumoniae R6
uauuuuuuuacuuaau

SEQ ID NO: 4078782 - RNA, 21 nt, Streptococcus pneumoniae R6
ucaaaaaaauucuucacaucc

SEQ ID NO: 4078783 - RNA, 18 nt, Streptococcus pneumoniae R6
ucaaaaaaguuaaaucuu

SEQ ID NO: 4078784 - RNA, 14 nt, Streptococcus pneumoniae R6
ucaaaaaauaugau

SEQ ID NO: 4078785 - RNA, 21 nt, Streptococcus pneumoniae R6
ucaaaaaaucucacuauucau

SEQ ID NO: 4078786 - RNA, 13 nt, Streptococcus pneumoniae R6
ucaaaaacauaau

SEQ ID NO: 4078787 - RNA, 20 nt, Streptococcus pneumoniae R6
ucaaaaacaucucagaauaa

SEQ ID NO: 4078788 - RNA, 18 nt, Streptococcus pneumoniae R6
ucaaaaaccuugauuuua

SEQ ID NO: 4078789 - RNA, 12 nt, Streptococcus pneumoniae R6
ucaaaaagaagg

SEQ ID NO: 4078790 - RNA, 13 nt, Streptococcus pneumoniae R6
ucaaaaagaaguu

SEQ ID NO: 4078791 - RNA, 15 nt, Streptococcus pneumoniae R6
ucaaaaagaucaguu

SEQ ID NO: 4078792 - RNA, 13 nt, Streptococcus pneumoniae R6
ucaaaaagcauuc

SEQ ID NO: 4078793 - RNA, 15 nt, Streptococcus pneumoniae R6
ucaaaaagcauucua

SEQ ID NO: 4078794 - RNA, 20 nt, Streptococcus pneumoniae R6
ucaaaaagcauucuauucca

SEQ ID NO: 4078795 - RNA, 12 nt, Streptococcus pneumoniae R6
ucaaaaagggaa

SEQ ID NO: 4078796 - RNA, 20 nt, Streptococcus pneumoniae R6
ucaaaaaucucuucaaacaa

SEQ ID NO: 4078797 - RNA, 13 nt, Streptococcus pneumoniae R6
ucaaaaaugaagu

SEQ ID NO: 4078798 - RNA, 21 nt, Streptococcus pneumoniae R6
ucaaaaauugguguaaauaga

SEQ ID NO: 4078799 - RNA, 22 nt, Streptococcus pneumoniae R6
ucaaaaauugguguaaauagaa

SEQ ID NO: 4078800 - RNA, 16 nt, Streptococcus pneumoniae R6
ucaaaacacuguuuua

SEQ ID NO: 4078801 - RNA, 19 nt, Streptococcus pneumoniae R6
ucaaaacacuguuuugagg

SEQ ID NO: 4078802 - RNA, 13 nt, Streptococcus pneumoniae R6
ucaaaacaguguu

SEQ ID NO: 4078803 - RNA, 16 nt, Streptococcus pneumoniae R6
ucaaaacaguguuuug

SEQ ID NO: 4078804 - RNA, 19 nt, Streptococcus pneumoniae R6
ucaaccuugcuucuuuccu

SEQ ID NO: 4078805 - RNA, 17 nt, Streptococcus pneumoniae R6
ucaacgaaaauaauuag

SEQ ID NO: 4078806 - RNA, 15 nt, Streptococcus pneumoniae R6
ucaacuagagcccaa

SEQ ID NO: 4078807 - RNA, 14 nt, Streptococcus pneumoniae R6
ucaacucaagaauu

SEQ ID NO: 4078808 - RNA, 13 nt, Streptococcus pneumoniae R6
ucaacuccuuacu

SEQ ID NO: 4078809 - RNA, 14 nt, Streptococcus pneumoniae R6
ucaacuccuuacuu

SEQ ID NO: 4078810 - RNA, 15 nt, Streptococcus pneumoniae R6
ucaacucuauuuuug

SEQ ID NO: 4078811 - RNA, 12 nt, Streptococcus pneumoniae R6
ucaacugccugg

SEQ ID NO: 4078812 - RNA, 19 nt, Streptococcus pneumoniae R6
ucaacugcguauuccauug

SEQ ID NO: 4078813 - RNA, 15 nt, Streptococcus pneumoniae R6
ucaacugcuguuuuc

SEQ ID NO: 4078814 - RNA, 18 nt, Streptococcus pneumoniae R6
ucaacugcuguuuucaug

SEQ ID NO: 4078815 - RNA, 17 nt, Streptococcus pneumoniae R6
ucaacugcuuuuucaau

SEQ ID NO: 4078816 - RNA, 19 nt, Streptococcus pneumoniae R6
ucaacugcuuuuucaauca

SEQ ID NO: 4078817 - RNA, 17 nt, Streptococcus pneumoniae R6
ucaacuggcauccccag

SEQ ID NO: 4078818 - RNA, 15 nt, Streptococcus pneumoniae R6
ucaacuguagugggu

SEQ ID NO: 4078819 - RNA, 13 nt, Streptococcus pneumoniae R6
ucaacuuccuuaa

SEQ ID NO: 4078820 - RNA, 16 nt, Streptococcus pneumoniae R6
ucaagaacaauuucac

SEQ ID NO: 4078821 - RNA, 14 nt, Streptococcus pneumoniae R6
ucaagaagagggcu

SEQ ID NO: 4078822 - RNA, 21 nt, Streptococcus pneumoniae R6
ucaagaaucgucacgcuacca

SEQ ID NO: 4078823 - RNA, 17 nt, Streptococcus pneumoniae R6
ucaagaaugaaaguuua

SEQ ID NO: 4078824 - RNA, 18 nt, Streptococcus pneumoniae R6
ucaagacaaggauaaaaa

SEQ ID NO: 4078825 - RNA, 15 nt, Streptococcus pneumoniae R6
ucaagaccauggcgu

SEQ ID NO: 4078826 - RNA, 19 nt, Streptococcus pneumoniae R6
ucaagaccauuuccaucuc

SEQ ID NO: 4078827 - RNA, 13 nt, Streptococcus pneumoniae R6
ucaagacuugggc

SEQ ID NO: 4078828 - RNA, 22 nt, Streptococcus pneumoniae R6
ucaagagucuccucaaaaacag

SEQ ID NO: 4078829 - RNA, 16 nt, Streptococcus pneumoniae R6
ucaagauaagaaaaaa

SEQ ID NO: 4078830 - RNA, 15 nt, Streptococcus pneumoniae R6
ucaagauaaggaauu

SEQ ID NO: 4078831 - RNA, 17 nt, Streptococcus pneumoniae R6
ucaagauauucuugauu

SEQ ID NO: 4078832 - RNA, 16 nt, Streptococcus pneumoniae R6
ucaagcaaaacaaauu

SEQ ID NO: 4078833 - RNA, 13 nt, Streptococcus pneumoniae R6
ucaagcaaaucaa

SEQ ID NO: 4078834 - RNA, 19 nt, Streptococcus pneumoniae R6
ucaagcaaaucaaagcuag

SEQ ID NO: 4078835 - RNA, 21 nt, Streptococcus pneumoniae R6
ucaagcaaaucaaagcuagca

SEQ ID NO: 4078836 - RNA, 20 nt, Streptococcus pneumoniae R6
ucaagcaguaauauaggaga

SEQ ID NO: 4078837 - RNA, 19 nt, Streptococcus pneumoniae R6
ucaagccgagcucuuuuug

SEQ ID NO: 4078838 - RNA, 19 nt, Streptococcus pneumoniae R6
ucaagccuuauugcucuug

SEQ ID NO: 4078839 - RNA, 15 nt, Streptococcus pneumoniae R6
ucaagcgaacaucuc

SEQ ID NO: 4078840 - RNA, 17 nt, Streptococcus pneumoniae R6
ucaagcgguucagcuca

SEQ ID NO: 4078841 - RNA, 19 nt, Streptococcus pneumoniae R6
ucaagcguuuuucuucugu

SEQ ID NO: 4078842 - RNA, 21 nt, Streptococcus pneumoniae R6
ucaaggauuucuuugaaaucu

SEQ ID NO: 4078843 - RNA, 16 nt, Streptococcus pneumoniae R6
ucaagggcagacauau

SEQ ID NO: 4078844 - RNA, 23 nt, Streptococcus pneumoniae R6
ucaagguuuuauacucuuagaaa

SEQ ID NO: 4078845 - RNA, 18 nt, Streptococcus pneumoniae R6
ucaagguuuuucuguacu

SEQ ID NO: 4078846 - RNA, 19 nt, Streptococcus pneumoniae R6
ucaagguuuuucuguacug

SEQ ID NO: 4078847 - RNA, 17 nt, Streptococcus pneumoniae R6
ucaagguuuuucuuaua

SEQ ID NO: 4078848 - RNA, 16 nt, Streptococcus pneumoniae R6
ucaagguuuuugaaaa

SEQ ID NO: 4078849 - RNA, 13 nt, Streptococcus pneumoniae R6
ucaaguaacuuug

SEQ ID NO: 4078850 - RNA, 13 nt, Streptococcus pneumoniae R6
ucaagucaacuug

SEQ ID NO: 4078851 - RNA, 22 nt, Streptococcus pneumoniae R6
ucaagugacauaugauugucuc

SEQ ID NO: 4078852 - RNA, 20 nt, Streptococcus pneumoniae R6
ucaagugaguuaggagccaa

SEQ ID NO: 4078853 - RNA, 21 nt, Streptococcus pneumoniae R6
ucaagugcuuuugugauuuua

SEQ ID NO: 4078854 - RNA, 21 nt, Streptococcus pneumoniae R6
ucaaguucacucaaaccugau

SEQ ID NO: 4078855 - RNA, 18 nt, Streptococcus pneumoniae R6
ucaauaacacgagaaaca

SEQ ID NO: 4078856 - RNA, 17 nt, Streptococcus pneumoniae R6
ucaauaaccaucauuuu

SEQ ID NO: 4078857 - RNA, 18 nt, Streptococcus pneumoniae R6
ucaauaagcccgaaaaau

SEQ ID NO: 4078858 - RNA, 18 nt, Streptococcus pneumoniae R6
ucaauaaguccgaaaaau

SEQ ID NO: 4078859 - RNA, 13 nt, Streptococcus pneumoniae R6
ucaauaauccuaa

SEQ ID NO: 4078860 - RNA, 18 nt, Streptococcus pneumoniae R6
ucaauacagaagaaaaac

SEQ ID NO: 4078861 - RNA, 15 nt, Streptococcus pneumoniae R6
ucaauaccaaagaag

SEQ ID NO: 4078862 - RNA, 16 nt, Streptococcus pneumoniae R6
ucaauaccaaagaagu

SEQ ID NO: 4078863 - RNA, 22 nt, Streptococcus pneumoniae R6
ucaauagcauugucacaaagga

SEQ ID NO: 4078864 - RNA, 16 nt, Streptococcus pneumoniae R6
ucaauauagaaguagu

SEQ ID NO: 4078865 - RNA, 15 nt, Streptococcus pneumoniae R6
ucaauaucuuuauug

SEQ ID NO: 4078866 - RNA, 12 nt, Streptococcus pneumoniae R6
ucaauauguuug

SEQ ID NO: 4078867 - RNA, 21 nt, Streptococcus pneumoniae R6
ucaauauuagaugauuuuucu

SEQ ID NO: 4078868 - RNA, 22 nt, Streptococcus pneumoniae R6
ucaauauuaugcguuuuuucug

SEQ ID NO: 4078869 - RNA, 15 nt, Streptococcus pneumoniae R6
ucaaucaaagcuccc

SEQ ID NO: 4078870 - RNA, 14 nt, Streptococcus pneumoniae R6
ucaaucaauccaaa

SEQ ID NO: 4078871 - RNA, 13 nt, Streptococcus pneumoniae R6
ucaaucaauuuaa

SEQ ID NO: 4078872 - RNA, 14 nt, Streptococcus pneumoniae R6
ucaaucaauuuaau

SEQ ID NO: 4078873 - RNA, 17 nt, Streptococcus pneumoniae R6
ucaaucagauagguuuu

SEQ ID NO: 4078874 - RNA, 22 nt, Streptococcus pneumoniae R6
ucaauccaucuccaaccaucaa

SEQ ID NO: 4078875 - RNA, 23 nt, Streptococcus pneumoniae R6
ucaauccaucuccaaccaucaaa

SEQ ID NO: 4078876 - RNA, 15 nt, Streptococcus pneumoniae R6
ucaauccauuauaca

SEQ ID NO: 4078877 - RNA, 20 nt, Streptococcus pneumoniae R6
ucaauccccaagggaccaaa

SEQ ID NO: 4078878 - RNA, 18 nt, Streptococcus pneumoniae R6
ucaauccgaguuuuucag

SEQ ID NO: 4078879 - RNA, 18 nt, Streptococcus pneumoniae R6
ucaauccguucugagaua

SEQ ID NO: 4078880 - RNA, 15 nt, Streptococcus pneumoniae R6
ucaauccugaagaau

SEQ ID NO: 4078881 - RNA, 14 nt, Streptococcus pneumoniae R6
ucaauccuuuucug

SEQ ID NO: 4078882 - RNA, 21 nt, Streptococcus pneumoniae R6
ucaaucgcuuaauuucuauca

SEQ ID NO: 4078883 - RNA, 18 nt, Streptococcus pneumoniae R6
ucaaucuacuauagaaaa

SEQ ID NO: 4078884 - RNA, 17 nt, Streptococcus pneumoniae R6
ucaaucugcuauaguca

SEQ ID NO: 4078885 - RNA, 16 nt, Streptococcus pneumoniae R6
ucaaucuuaucaauca

SEQ ID NO: 4078886 - RNA, 17 nt, Streptococcus pneumoniae R6
ucaaucuuaucaaucaa

SEQ ID NO: 4078887 - RNA, 19 nt, Streptococcus pneumoniae R6
ucaaucuugucuaaaaaua

SEQ ID NO: 4078888 - RNA, 20 nt, Streptococcus pneumoniae R6
ucaaucuugucuaaaaauag

SEQ ID NO: 4078889 - RNA, 21 nt, Streptococcus pneumoniae R6
ucaaucuugucuaaaaauagg

SEQ ID NO: 4078890 - RNA, 14 nt, Streptococcus pneumoniae R6
ucaaugaaaaucaa

SEQ ID NO: 4078891 - RNA, 20 nt, Streptococcus pneumoniae R6
ucaaugaaaaucaaagugca

SEQ ID NO: 4078892 - RNA, 18 nt, Streptococcus pneumoniae R6
ucaaugaguccgaaaaau

SEQ ID NO: 4078893 - RNA, 22 nt, Streptococcus pneumoniae R6
ucaaugaguccgaaaaauuucu

SEQ ID NO: 4078894 - RNA, 21 nt, Streptococcus pneumoniae R6
ucaaugauaaaagucuccugu

SEQ ID NO: 4078895 - RNA, 15 nt, Streptococcus pneumoniae R6
ucaaugauuugaaca

SEQ ID NO: 4078896 - RNA, 17 nt, Streptococcus pneumoniae R6
ucaaugauuugaacauu

SEQ ID NO: 4078897 - RNA, 15 nt, Streptococcus pneumoniae R6
ucaauggacuauagu

SEQ ID NO: 4078898 - RNA, 22 nt, Streptococcus pneumoniae R6
ucaauggcaaaaaauugagaaa

SEQ ID NO: 4078899 - RNA, 16 nt, Streptococcus pneumoniae R6
ucaaugugaccaguga

SEQ ID NO: 4078900 - RNA, 23 nt, Streptococcus pneumoniae R6
ucaauguuuuauuacauaaguuu

SEQ ID NO: 4078901 - RNA, 19 nt, Streptococcus pneumoniae R6
ucaauuaagaaauuuucuu

SEQ ID NO: 4078902 - RNA, 16 nt, Streptococcus pneumoniae R6
ucaauuagaaaauuca

SEQ ID NO: 4078903 - RNA, 20 nt, Streptococcus pneumoniae R6
ucaauuauagacacauucgu

SEQ ID NO: 4078904 - RNA, 18 nt, Streptococcus pneumoniae R6
ucaauuaucauuuccauu

SEQ ID NO: 4078905 - RNA, 15 nt, Streptococcus pneumoniae R6
ucaauucacuauagu

SEQ ID NO: 4078906 - RNA, 21 nt, Streptococcus pneumoniae R6
ucaauucacuauaguuuaauu

SEQ ID NO: 4078907 - RNA, 17 nt, Streptococcus pneumoniae R6
ucagcagucguuccuuu

SEQ ID NO: 4078908 - RNA, 17 nt, Streptococcus pneumoniae R6
ucagcauaaucugccuu

SEQ ID NO: 4078909 - RNA, 15 nt, Streptococcus pneumoniae R6
ucagcauauuuccca

SEQ ID NO: 4078910 - RNA, 13 nt, Streptococcus pneumoniae R6
ucagcauggcccg

SEQ ID NO: 4078911 - RNA, 17 nt, Streptococcus pneumoniae R6
ucagcauuuccuagcca

SEQ ID NO: 4078912 - RNA, 22 nt, Streptococcus pneumoniae R6
ucagcauuuccuagccaauagg

SEQ ID NO: 4078913 - RNA, 16 nt, Streptococcus pneumoniae R6
ucagccagagcaccaa

SEQ ID NO: 4078914 - RNA, 17 nt, Streptococcus pneumoniae R6
ucagcgauuucuucacg

SEQ ID NO: 4078915 - RNA, 18 nt, Streptococcus pneumoniae R6
ucagcguaauagucuaau

SEQ ID NO: 4078916 - RNA, 17 nt, Streptococcus pneumoniae R6
ucagcuaaaauguuuuu

SEQ ID NO: 4078917 - RNA, 21 nt, Streptococcus pneumoniae R6
ucagcucaaaacacuguuuua

SEQ ID NO: 4078918 - RNA, 21 nt, Streptococcus pneumoniae R6
ucagcucaaaacaugguuuug

SEQ ID NO: 4078919 - RNA, 14 nt, Streptococcus pneumoniae R6
ucagcucaacugcg

SEQ ID NO: 4078920 - RNA, 19 nt, Streptococcus pneumoniae R6
ucagcucucugauuuucag

SEQ ID NO: 4078921 - RNA, 13 nt, Streptococcus pneumoniae R6
ucagcucuuuuuu

SEQ ID NO: 4078922 - RNA, 20 nt, Streptococcus pneumoniae R6
ucagcugggcuaaugggcca

SEQ ID NO: 4078923 - RNA, 12 nt, Streptococcus pneumoniae R6
ucagcugucuga

SEQ ID NO: 4078924 - RNA, 15 nt, Streptococcus pneumoniae R6
ucagcuucguaauca

SEQ ID NO: 4078925 - RNA, 13 nt, Streptococcus pneumoniae R6
ucagcuuuuucag

SEQ ID NO: 4078926 - RNA, 12 nt, Streptococcus pneumoniae R6
ucaggaaagacu

SEQ ID NO: 4078927 - RNA, 14 nt, Streptococcus pneumoniae R6
ucaggaauaaaucc

SEQ ID NO: 4078928 - RNA, 19 nt, Streptococcus pneumoniae R6
ucaggauaaaaccaaaaag

SEQ ID NO: 4078929 - RNA, 21 nt, Streptococcus pneumoniae R6
ucaggauugauaaaauuuaaa

SEQ ID NO: 4078930 - RNA, 15 nt, Streptococcus pneumoniae R6
ucaggauuuuuucau

SEQ ID NO: 4078931 - RNA, 23 nt, Streptococcus pneumoniae R6
ucaggccuacaauuggaaauaac

SEQ ID NO: 4078932 - RNA, 23 nt, Streptococcus pneumoniae R6
ucaggcuuuuucuguacuauaaa

SEQ ID NO: 4078933 - RNA, 14 nt, Streptococcus pneumoniae R6
ucagggucaaagua

SEQ ID NO: 4078934 - RNA, 21 nt, Streptococcus pneumoniae R6
ucagggucuuuguucugaaag

SEQ ID NO: 4078935 - RNA, 22 nt, Streptococcus pneumoniae R6
ucagggucuuuguucugaaagu

SEQ ID NO: 4078936 - RNA, 16 nt, Streptococcus pneumoniae R6
ucagguauugaaaaaa

SEQ ID NO: 4078937 - RNA, 20 nt, Streptococcus pneumoniae R6
ucagguauugaaaaaacuug

SEQ ID NO: 4078938 - RNA, 13 nt, Streptococcus pneumoniae R6
ucagguguucaaa

SEQ ID NO: 4078939 - RNA, 15 nt, Streptococcus pneumoniae R6
ucagguuucucuaca

SEQ ID NO: 4078940 - RNA, 22 nt, Streptococcus pneumoniae R6
ucaguaaaaaaaacauauauuc

SEQ ID NO: 4078941 - RNA, 19 nt, Streptococcus pneumoniae R6
ucaguaacguuagcaaaga

SEQ ID NO: 4078942 - RNA, 15 nt, Streptococcus pneumoniae R6
ucaguauauugaaau

SEQ ID NO: 4078943 - RNA, 19 nt, Streptococcus pneumoniae R6
ucaguauauugaaaugaaa

SEQ ID NO: 4078944 - RNA, 22 nt, Streptococcus pneumoniae R6
ucaguaugcuauaucuuauuuu

SEQ ID NO: 4078945 - RNA, 18 nt, Streptococcus pneumoniae R6
ucaguauuuggauuauga

SEQ ID NO: 4078946 - RNA, 19 nt, Streptococcus pneumoniae R6
ucagucaaacguuuaacug

SEQ ID NO: 4078947 - RNA, 17 nt, Streptococcus pneumoniae R6
ucagucacauauauaau

SEQ ID NO: 4078948 - RNA, 17 nt, Streptococcus pneumoniae R6
ucagucugaccaccauu

SEQ ID NO: 4078949 - RNA, 15 nt, Streptococcus pneumoniae R6
ucagucugguuccca

SEQ ID NO: 4078950 - RNA, 14 nt, Streptococcus pneumoniae R6
ucagugacuugugu

SEQ ID NO: 4078951 - RNA, 19 nt, Streptococcus pneumoniae R6
ucagugguucacuggcauu

SEQ ID NO: 4078952 - RNA, 20 nt, Streptococcus pneumoniae R6
ucaguuauauugacagaaga

SEQ ID NO: 4078953 - RNA, 16 nt, Streptococcus pneumoniae R6
ucaguucauuuuuccu

SEQ ID NO: 4078954 - RNA, 17 nt, Streptococcus pneumoniae R6
ucaguucauuuuuccuu

SEQ ID NO: 4078955 - RNA, 22 nt, Streptococcus pneumoniae R6
ucaguucccugcauuucuuuua

SEQ ID NO: 4078956 - RNA, 16 nt, Streptococcus pneumoniae R6
ucaguugcauaaaucg

SEQ ID NO: 4078957 - RNA, 13 nt, Streptococcus pneumoniae R6
ucaguuucaucca

SEQ ID NO: 4078958 - RNA, 19 nt, Streptococcus pneumoniae R6
ucaguuucauccacaaccu

SEQ ID NO: 4078959 - RNA, 15 nt, Streptococcus pneumoniae R6
ucaguuucaucuaca

SEQ ID NO: 4078960 - RNA, 18 nt, Streptococcus pneumoniae R6
ucaguuucuauuucauuu

SEQ ID NO: 4078961 - RNA, 15 nt, Streptococcus pneumoniae R6
ucaguuuuauuuuug

SEQ ID NO: 4078962 - RNA, 16 nt, Streptococcus pneumoniae R6
ucaguuuuuucacaaa

SEQ ID NO: 4078963 - RNA, 20 nt, Streptococcus pneumoniae R6
ucaguuuuuucacaaauucu

SEQ ID NO: 4078964 - RNA, 13 nt, Streptococcus pneumoniae R6
ucauaaaaauaag

SEQ ID NO: 4078965 - RNA, 16 nt, Streptococcus pneumoniae R6
ucauaaacaagagcaa

SEQ ID NO: 4078966 - RNA, 19 nt, Streptococcus pneumoniae R6
ucauaaaccucgauaccug

SEQ ID NO: 4078967 - RNA, 16 nt, Streptococcus pneumoniae R6
ucauaaagagaaggag

SEQ ID NO: 4078968 - RNA, 14 nt, Streptococcus pneumoniae R6
ucauaaagccaguc

SEQ ID NO: 4078969 - RNA, 13 nt, Streptococcus pneumoniae R6
ucauaacugcuaa

SEQ ID NO: 4078970 - RNA, 22 nt, Streptococcus pneumoniae R6
ucauaagcaacuuuacgaaauu

SEQ ID NO: 4078971 - RNA, 20 nt, Streptococcus pneumoniae R6
ucauaagcuagucuacuugu

SEQ ID NO: 4078972 - RNA, 16 nt, Streptococcus pneumoniae R6
ucauaaggaagucugu

SEQ ID NO: 4078973 - RNA, 20 nt, Streptococcus pneumoniae R6
ucauaaucuguuuaaauuca

SEQ ID NO: 4078974 - RNA, 17 nt, Streptococcus pneumoniae R6
ucauaccaguuuuugau

SEQ ID NO: 4078975 - RNA, 15 nt, Streptococcus pneumoniae R6
ucauacgauugaaag

SEQ ID NO: 4078976 - RNA, 21 nt, Streptococcus pneumoniae R6
ucauacgauugaaaggaaucu

SEQ ID NO: 4078977 - RNA, 15 nt, Streptococcus pneumoniae R6
ucauacucauuuaaa

SEQ ID NO: 4078978 - RNA, 19 nt, Streptococcus pneumoniae R6
ucauacugccaagauagag

SEQ ID NO: 4078979 - RNA, 23 nt, Streptococcus pneumoniae R6
ucauacuuagcuaauuuucuacc

SEQ ID NO: 4078980 - RNA, 17 nt, Streptococcus pneumoniae R6
ucauacuuggagaaccu

SEQ ID NO: 4078981 - RNA, 17 nt, Streptococcus pneumoniae R6
ucauagaaauauuuacu

SEQ ID NO: 4078982 - RNA, 14 nt, Streptococcus pneumoniae R6
ucauagaaauuuuu

SEQ ID NO: 4078983 - RNA, 17 nt, Streptococcus pneumoniae R6
ucauagacuuaauuguc

SEQ ID NO: 4078984 - RNA, 18 nt, Streptococcus pneumoniae R6
ucauauaaauauagaaac

SEQ ID NO: 4078985 - RNA, 13 nt, Streptococcus pneumoniae R6
ucauauaauaaau

SEQ ID NO: 4078986 - RNA, 21 nt, Streptococcus pneumoniae R6
ucauauacacuaaacaaauga

SEQ ID NO: 4078987 - RNA, 15 nt, Streptococcus pneumoniae R6
ucauaucaagguuuu

SEQ ID NO: 4078988 - RNA, 17 nt, Streptococcus pneumoniae R6
ucauaucaaucucugca

SEQ ID NO: 4078989 - RNA, 20 nt, Streptococcus pneumoniae R6
ucauaucauaacacuauuaa

SEQ ID NO: 4078990 - RNA, 17 nt, Streptococcus pneumoniae R6
ucauauccccagacaua

SEQ ID NO: 4078991 - RNA, 22 nt, Streptococcus pneumoniae R6
ucauaucuaccugcaccagauu

SEQ ID NO: 4078992 - RNA, 16 nt, Streptococcus pneumoniae R6
ucauaucuuauuucaa

SEQ ID NO: 4078993 - RNA, 20 nt, Streptococcus pneumoniae R6
ucauaugggacuuuuuuucu

SEQ ID NO: 4078994 - RNA, 18 nt, Streptococcus pneumoniae R6
ucauauucuuuuacacuc

SEQ ID NO: 4078995 - RNA, 15 nt, Streptococcus pneumoniae R6
ucauauuuauuaauu

SEQ ID NO: 4078996 - RNA, 13 nt, Streptococcus pneumoniae R6
ucauauuuucaga

SEQ ID NO: 4078997 - RNA, 14 nt, Streptococcus pneumoniae R6
ucauauuuucuggg

SEQ ID NO: 4078998 - RNA, 22 nt, Streptococcus pneumoniae R6
ucauauuuucugggaagacugu

SEQ ID NO: 4078999 - RNA, 12 nt, Streptococcus pneumoniae R6
ucauauuuuuug

SEQ ID NO: 4079000 - RNA, 20 nt, Streptococcus pneumoniae R6
ucaucaaaggucucuucuuc

SEQ ID NO: 4079001 - RNA, 23 nt, Streptococcus pneumoniae R6
ucaucaaaugacuaaccuugucc

SEQ ID NO: 4079002 - RNA, 12 nt, Streptococcus pneumoniae R6
ucaucaagcuuu

SEQ ID NO: 4079003 - RNA, 16 nt, Streptococcus pneumoniae R6
ucaucaagcuuucacu

SEQ ID NO: 4079004 - RNA, 17 nt, Streptococcus pneumoniae R6
ucaucaagcuuucacua

SEQ ID NO: 4079005 - RNA, 17 nt, Streptococcus pneumoniae R6
ucaucagguuaaaggaa

SEQ ID NO: 4079006 - RNA, 20 nt, Streptococcus pneumoniae R6
ucaucagucaaucuacuugu

SEQ ID NO: 4079007 - RNA, 13 nt, Streptococcus pneumoniae R6
ucaucauaaaaau

SEQ ID NO: 4079008 - RNA, 14 nt, Streptococcus pneumoniae R6
ucaucauaaaaaua

SEQ ID NO: 4079009 - RNA, 14 nt, Streptococcus pneumoniae R6
ucauccacaaccuc

SEQ ID NO: 4079010 - RNA, 17 nt, Streptococcus pneumoniae R6
ucauuuccaaugaugag

SEQ ID NO: 4079011 - RNA, 12 nt, Streptococcus pneumoniae R6
ucauuucuucaa

SEQ ID NO: 4079012 - RNA, 13 nt, Streptococcus pneumoniae R6
ucauuucuucaac

SEQ ID NO: 4079013 - RNA, 13 nt, Streptococcus pneumoniae R6
ucauuugauuuuc

SEQ ID NO: 4079014 - RNA, 15 nt, Streptococcus pneumoniae R6
ucauuugauuuuccu

SEQ ID NO: 4079015 - RNA, 20 nt, Streptococcus pneumoniae R6
ucauuugauuuuccuaauca

SEQ ID NO: 4079016 - RNA, 16 nt, Streptococcus pneumoniae R6
ucauuuggcuauaaaa

SEQ ID NO: 4079017 - RNA, 14 nt, Streptococcus pneumoniae R6
ucauuuuacuauau

SEQ ID NO: 4079018 - RNA, 16 nt, Streptococcus pneumoniae R6
ucauuuuauuauuaau

SEQ ID NO: 4079019 - RNA, 23 nt, Streptococcus pneumoniae R6
ucauuuuauuauuaauauauaaa

SEQ ID NO: 4079020 - RNA, 17 nt, Streptococcus pneumoniae R6
ucauuuuccacaagaac

SEQ ID NO: 4079021 - RNA, 18 nt, Streptococcus pneumoniae R6
ucauuuucuacuaaaauu

SEQ ID NO: 4079022 - RNA, 19 nt, Streptococcus pneumoniae R6
ucauuuucuacuaaaauua

SEQ ID NO: 4079023 - RNA, 13 nt, Streptococcus pneumoniae R6
ucauuuucuuaaa

SEQ ID NO: 4079024 - RNA, 23 nt, Streptococcus pneumoniae R6
ucauuuucuugauuuguucucuu

SEQ ID NO: 4079025 - RNA, 20 nt, Streptococcus pneumoniae R6
ucauuuucuuuacuucugag

SEQ ID NO: 4079026 - RNA, 17 nt, Streptococcus pneumoniae R6
ucauuuuguaaccuuuu

SEQ ID NO: 4079027 - RNA, 12 nt, Streptococcus pneumoniae R6
ucauuuuuccuu

SEQ ID NO: 4079028 - RNA, 21 nt, Streptococcus pneumoniae R6
ucauuuuugaacagugauagc

SEQ ID NO: 4079029 - RNA, 21 nt, Streptococcus pneumoniae R6
ucauuuuugagugguuucugg

SEQ ID NO: 4079030 - RNA, 15 nt, Streptococcus pneumoniae R6
uccaaaaauaaaucu

SEQ ID NO: 4079031 - RNA, 18 nt, Streptococcus pneumoniae R6
uccaaaacaaccaauuuc

SEQ ID NO: 4079032 - RNA, 18 nt, Streptococcus pneumoniae R6
uccaaaagaccguuugaa

SEQ ID NO: 4079033 - RNA, 21 nt, Streptococcus pneumoniae R6
uccaaaaguuggacaaaauga

SEQ ID NO: 4079034 - RNA, 17 nt, Streptococcus pneumoniae R6
uccaaacaacaauacuu

SEQ ID NO: 4079035 - RNA, 23 nt, Streptococcus pneumoniae R6
uccaaaccaacauagauaaagac

SEQ ID NO: 4079036 - RNA, 20 nt, Streptococcus pneumoniae R6
uccaaacgaauguuguuacu

SEQ ID NO: 4079037 - RNA, 24 nt, Streptococcus pneumoniae R6
uccaaacgauuaucuaacaauaag

SEQ ID NO: 4079038 - RNA, 23 nt, Streptococcus pneumoniae R6
uccaaagaaauggucggcauucu

SEQ ID NO: 4079039 - RNA, 12 nt, Streptococcus pneumoniae R6
uccaaagaagua

SEQ ID NO: 4079040 - RNA, 13 nt, Streptococcus pneumoniae R6
uccaaagaaguag

SEQ ID NO: 4079041 - RNA, 16 nt, Streptococcus pneumoniae R6
uccaaagauagaaucc

SEQ ID NO: 4079042 - RNA, 19 nt, Streptococcus pneumoniae R6
uccaaagauagaauccauu

SEQ ID NO: 4079043 - RNA, 20 nt, Streptococcus pneumoniae R6
uccaaagaugagaggagaaa

SEQ ID NO: 4079044 - RNA, 23 nt, Streptococcus pneumoniae R6
uccaaaguagcuugcuccauucu

SEQ ID NO: 4079045 - RNA, 19 nt, Streptococcus pneumoniae R6
uccaaauggcaugaggaga

SEQ ID NO: 4079046 - RNA, 13 nt, Streptococcus pneumoniae R6
uccaaaugguugg

SEQ ID NO: 4079047 - RNA, 16 nt, Streptococcus pneumoniae R6
uccaaauuagaaaaag

SEQ ID NO: 4079048 - RNA, 21 nt, Streptococcus pneumoniae R6
uccaacagagaaaauucuaaa

SEQ ID NO: 4079049 - RNA, 15 nt, Streptococcus pneumoniae R6
uccaacauuguuugu

SEQ ID NO: 4079050 - RNA, 15 nt, Streptococcus pneumoniae R6
uccaaccaucaaaau

SEQ ID NO: 4079051 - RNA, 15 nt, Streptococcus pneumoniae R6
uccaacgacuuccag

SEQ ID NO: 4079052 - RNA, 17 nt, Streptococcus pneumoniae R6
uccaacugcaaguccag

SEQ ID NO: 4079053 - RNA, 17 nt, Streptococcus pneumoniae R6
uccaagaaagagaauaa

SEQ ID NO: 4079054 - RNA, 22 nt, Streptococcus pneumoniae R6
uccaagacuuucaauucuucac

SEQ ID NO: 4079055 - RNA, 16 nt, Streptococcus pneumoniae R6
uccaagauucaacauc

SEQ ID NO: 4079056 - RNA, 17 nt, Streptococcus pneumoniae R6
uccaagauucaacauca

SEQ ID NO: 4079057 - RNA, 21 nt, Streptococcus pneumoniae R6
uccaagcaaggcuagugggag

SEQ ID NO: 4079058 - RNA, 16 nt, Streptococcus pneumoniae R6
uccaagccuuacucuu

SEQ ID NO: 4079059 - RNA, 19 nt, Streptococcus pneumoniae R6
uccaaggaaaguucuuccc

SEQ ID NO: 4079060 - RNA, 12 nt, Streptococcus pneumoniae R6
uccaaggcauuc

SEQ ID NO: 4079061 - RNA, 15 nt, Streptococcus pneumoniae R6
uccaaggcugaaauu

SEQ ID NO: 4079062 - RNA, 19 nt, Streptococcus pneumoniae R6
uccaagucguaagucuucg

SEQ ID NO: 4079063 - RNA, 17 nt, Streptococcus pneumoniae R6
uccaaguggaagucugu

SEQ ID NO: 4079064 - RNA, 22 nt, Streptococcus pneumoniae R6
uccaaguggaauucauuuucuu

SEQ ID NO: 4079065 - RNA, 17 nt, Streptococcus pneumoniae R6
uccaaguuccucuuuca

SEQ ID NO: 4079066 - RNA, 17 nt, Streptococcus pneumoniae R6
uccaauaauagaaaaca

SEQ ID NO: 4079067 - RNA, 22 nt, Streptococcus pneumoniae R6
uccaauaauagaaaacagacaa

SEQ ID NO: 4079068 - RNA, 16 nt, Streptococcus pneumoniae R6
uccaauaauucaccua

SEQ ID NO: 4079069 - RNA, 16 nt, Streptococcus pneumoniae R6
uccaauauguucuaaa

SEQ ID NO: 4079070 - RNA, 18 nt, Streptococcus pneumoniae R6
uccaaucucuugaacaua

SEQ ID NO: 4079071 - RNA, 13 nt, Streptococcus pneumoniae R6
uccaauucaaagu

SEQ ID NO: 4079072 - RNA, 21 nt, Streptococcus pneumoniae R6
uccaauucugcuuuuaaauag

SEQ ID NO: 4079073 - RNA, 13 nt, Streptococcus pneumoniae R6
uccaauucuucag

SEQ ID NO: 4079074 - RNA, 14 nt, Streptococcus pneumoniae R6
uccaauugaggaag

SEQ ID NO: 4079075 - RNA, 11 nt, Streptococcus pneumoniae R6
uccaauuucua

SEQ ID NO: 4079076 - RNA, 15 nt, Streptococcus pneumoniae R6
uccaauuucuuuuca

SEQ ID NO: 4079077 - RNA, 17 nt, Streptococcus pneumoniae R6
uccaauuucuuuucauu

SEQ ID NO: 4079078 - RNA, 16 nt, Streptococcus pneumoniae R6
uccaauuuguuuucaa

SEQ ID NO: 4079079 - RNA, 19 nt, Streptococcus pneumoniae R6
uccacaaccucaaaacaau

SEQ ID NO: 4079080 - RNA, 22 nt, Streptococcus pneumoniae R6
uccacaaccuuaaaacaguguu

SEQ ID NO: 4079081 - RNA, 15 nt, Streptococcus pneumoniae R6
uccacagaccugucc

SEQ ID NO: 4079082 - RNA, 15 nt, Streptococcus pneumoniae R6
uccaccacuugcuua

SEQ ID NO: 4079083 - RNA, 19 nt, Streptococcus pneumoniae R6
uccaccagcuauuaagaaa

SEQ ID NO: 4079084 - RNA, 17 nt, Streptococcus pneumoniae R6
uccaccauaguguuucu

SEQ ID NO: 4079085 - RNA, 15 nt, Streptococcus pneumoniae R6
uccaccuugaucuuc

SEQ ID NO: 4079086 - RNA, 18 nt, Streptococcus pneumoniae R6
uccaccuugaucuuccau

SEQ ID NO: 4079087 - RNA, 18 nt, Streptococcus pneumoniae R6
uccacgcgcacgaagggc

SEQ ID NO: 4079088 - RNA, 14 nt, Streptococcus pneumoniae R6
uccacggcucauga

SEQ ID NO: 4079089 - RNA, 18 nt, Streptococcus pneumoniae R6
uccacguuucuaauaauu

SEQ ID NO: 4079090 - RNA, 20 nt, Streptococcus pneumoniae R6
uccacuauaauaaaaugaaa

SEQ ID NO: 4079091 - RNA, 22 nt, Streptococcus pneumoniae R6
uccacuauaauaaaaugaaaua

SEQ ID NO: 4079092 - RNA, 15 nt, Streptococcus pneumoniae R6
uccacucagacagcu

SEQ ID NO: 4079093 - RNA, 13 nt, Streptococcus pneumoniae R6
uccacugaaucgu

SEQ ID NO: 4079094 - RNA, 18 nt, Streptococcus pneumoniae R6
uccacuugggaaaccaaa

SEQ ID NO: 4079095 - RNA, 19 nt, Streptococcus pneumoniae R6
uccagaacuucaauaauuu

SEQ ID NO: 4079096 - RNA, 17 nt, Streptococcus pneumoniae R6
uccagaagccuucaucc

SEQ ID NO: 4079097 - RNA, 20 nt, Streptococcus pneumoniae R6
uccagaccaccuuccuuggu

SEQ ID NO: 4079098 - RNA, 18 nt, Streptococcus pneumoniae R6
uccagacucaauugugca

SEQ ID NO: 4079099 - RNA, 15 nt, Streptococcus pneumoniae R6
uccagagcauucuuu

SEQ ID NO: 4079100 - RNA, 16 nt, Streptococcus pneumoniae R6
uccagauuaggaacua

SEQ ID NO: 4079101 - RNA, 16 nt, Streptococcus pneumoniae R6
uccagcacuaaaacgu

SEQ ID NO: 4079102 - RNA, 21 nt, Streptococcus pneumoniae R6
uccagcauaacgacagaagaa

SEQ ID NO: 4079103 - RNA, 22 nt, Streptococcus pneumoniae R6
uccagcauaacgacagaagaag

SEQ ID NO: 4079104 - RNA, 18 nt, Streptococcus pneumoniae R6
uccagcuauuaaguccuu

SEQ ID NO: 4079105 - RNA, 22 nt, Streptococcus pneumoniae R6
uccagcuauuaaguccuuccca

SEQ ID NO: 4079106 - RNA, 11 nt, Streptococcus pneumoniae R6
uccagcugaga

SEQ ID NO: 4079107 - RNA, 15 nt, Streptococcus pneumoniae R6
uccaguaacuuuacc

SEQ ID NO: 4079108 - RNA, 16 nt, Streptococcus pneumoniae R6
uccagucccaaguucc

SEQ ID NO: 4079109 - RNA, 14 nt, Streptococcus pneumoniae R6
uccaguuaucugca

SEQ ID NO: 4079110 - RNA, 15 nt, Streptococcus pneumoniae R6
uccaguuauucuuaa

SEQ ID NO: 4079111 - RNA, 15 nt, Streptococcus pneumoniae R6
uccaguuuauaacuu

SEQ ID NO: 4079112 - RNA, 14 nt, Streptococcus pneumoniae R6
uccaguuuggacca

SEQ ID NO: 4079113 - RNA, 16 nt, Streptococcus pneumoniae R6
uccgaguuuuucagcc

SEQ ID NO: 4079114 - RNA, 13 nt, Streptococcus pneumoniae R6
uccgauagcauca

SEQ ID NO: 4079115 - RNA, 14 nt, Streptococcus pneumoniae R6
uccgauagcaucau

SEQ ID NO: 4079116 - RNA, 19 nt, Streptococcus pneumoniae R6
uccgauguguuggguagca

SEQ ID NO: 4079117 - RNA, 21 nt, Streptococcus pneumoniae R6
uccgauuaacgauggacuuua

SEQ ID NO: 4079118 - RNA, 14 nt, Streptococcus pneumoniae R6
uccgauuucagaau

SEQ ID NO: 4079119 - RNA, 15 nt, Streptococcus pneumoniae R6
uccgauuucagaauc

SEQ ID NO: 4079120 - RNA, 15 nt, Streptococcus pneumoniae R6
uccgcuugggaaacc

SEQ ID NO: 4079121 - RNA, 18 nt, Streptococcus pneumoniae R6
uccgcuugggaaaccaaa

SEQ ID NO: 4079122 - RNA, 15 nt, Streptococcus pneumoniae R6
uccggaaaccaaagg

SEQ ID NO: 4079123 - RNA, 14 nt, Streptococcus pneumoniae R6
uccggcuuucacaa

SEQ ID NO: 4079124 - RNA, 18 nt, Streptococcus pneumoniae R6
uccgguaaaguugaaaug

SEQ ID NO: 4079125 - RNA, 21 nt, Streptococcus pneumoniae R6
uccgguuccuuauucugaaag

SEQ ID NO: 4079126 - RNA, 13 nt, Streptococcus pneumoniae R6
uccguaaaagaca

SEQ ID NO: 4079127 - RNA, 14 nt, Streptococcus pneumoniae R6
uccgucgcauauuu

SEQ ID NO: 4079128 - RNA, 18 nt, Streptococcus pneumoniae R6
uccgugauuguuuuuaaa

SEQ ID NO: 4079129 - RNA, 17 nt, Streptococcus pneumoniae R6
uccguuuuucuccucua

SEQ ID NO: 4079130 - RNA, 13 nt, Streptococcus pneumoniae R6
uccguuuuuuaaa

SEQ ID NO: 4079131 - RNA, 18 nt, Streptococcus pneumoniae R6
uccuaaaacuagugaagc

SEQ ID NO: 4079132 - RNA, 19 nt, Streptococcus pneumoniae R6
uccuaaacagaauuggcua

SEQ ID NO: 4079133 - RNA, 14 nt, Streptococcus pneumoniae R6
uccuaaagaaaaag

SEQ ID NO: 4079134 - RNA, 21 nt, Streptococcus pneumoniae R6
uccuaaauagaagauaaagag

SEQ ID NO: 4079135 - RNA, 14 nt, Streptococcus pneumoniae R6
uccuaaauccucua

SEQ ID NO: 4079136 - RNA, 18 nt, Streptococcus pneumoniae R6
uccuaauaaacuugauua

SEQ ID NO: 4079137 - RNA, 16 nt, Streptococcus pneumoniae R6
uccuacugauaucuuu

SEQ ID NO: 4079138 - RNA, 19 nt, Streptococcus pneumoniae R6
uccuacuugcuucccauuu

SEQ ID NO: 4079139 - RNA, 18 nt, Streptococcus pneumoniae R6
uccuagccuauuuuuuau

SEQ ID NO: 4079140 - RNA, 23 nt, Streptococcus pneumoniae R6
uccuagccuauuuuuuauuucaa

SEQ ID NO: 4079141 - RNA, 17 nt, Streptococcus pneumoniae R6
uccuagucuacaaauuc

SEQ ID NO: 4079142 - RNA, 20 nt, Streptococcus pneumoniae R6
uccuagucuacaaauucaaa

SEQ ID NO: 4079143 - RNA, 22 nt, Streptococcus pneumoniae R6
uccuaguuggugacugacuaaa

SEQ ID NO: 4079144 - RNA, 14 nt, Streptococcus pneumoniae R6
uccuaguuugcucu

SEQ ID NO: 4079145 - RNA, 22 nt, Streptococcus pneumoniae R6
uccuauagaaaaggaguagaaa

SEQ ID NO: 4079146 - RNA, 14 nt, Streptococcus pneumoniae R6
uccuaucaaguuca

SEQ ID NO: 4079147 - RNA, 16 nt, Streptococcus pneumoniae R6
uccuauucuugauuua

SEQ ID NO: 4079148 - RNA, 14 nt, Streptococcus pneumoniae R6
uccuauucuuguuu

SEQ ID NO: 4079149 - RNA, 15 nt, Streptococcus pneumoniae R6
uccuauucuuguuuc

SEQ ID NO: 4079150 - RNA, 21 nt, Streptococcus pneumoniae R6
uccuauuuucuucuuuauaau

SEQ ID NO: 4079151 - RNA, 14 nt, Streptococcus pneumoniae R6
uccucaaaaugaaa

SEQ ID NO: 4079152 - RNA, 17 nt, Streptococcus pneumoniae R6
uccucaaaauucugucu

SEQ ID NO: 4079153 - RNA, 22 nt, Streptococcus pneumoniae R6
uccucaaaauucugucuuagac

SEQ ID NO: 4079154 - RNA, 22 nt, Streptococcus pneumoniae R6
uccucaaugaauccgaaaaauu

SEQ ID NO: 4079155 - RNA, 22 nt, Streptococcus pneumoniae R6
uccucaaugaguccgaaaaauu

SEQ ID NO: 4079156 - RNA, 16 nt, Streptococcus pneumoniae R6
uccucaauguuuuauu

SEQ ID NO: 4079157 - RNA, 14 nt, Streptococcus pneumoniae R6
uccucauauucuuu

SEQ ID NO: 4079158 - RNA, 19 nt, Streptococcus pneumoniae R6
uccucauauucuuuuacac

SEQ ID NO: 4079159 - RNA, 17 nt, Streptococcus pneumoniae R6
uccucauauuuauuaau

SEQ ID NO: 4079160 - RNA, 16 nt, Streptococcus pneumoniae R6
uccucauuucaauaga

SEQ ID NO: 4079161 - RNA, 15 nt, Streptococcus pneumoniae R6
uccucauuuucuagu

SEQ ID NO: 4079162 - RNA, 16 nt, Streptococcus pneumoniae R6
uccuccauaaaaagac

SEQ ID NO: 4079163 - RNA, 14 nt, Streptococcus pneumoniae R6
uccucccauauuug

SEQ ID NO: 4079164 - RNA, 17 nt, Streptococcus pneumoniae R6
uccucccauauuuggca

SEQ ID NO: 4079165 - RNA, 22 nt, Streptococcus pneumoniae R6
uccucccugcgacaaaauugau

SEQ ID NO: 4079166 - RNA, 18 nt, Streptococcus pneumoniae R6
uccucccuucuuucucaa

SEQ ID NO: 4079167 - RNA, 16 nt, Streptococcus pneumoniae R6
uccucgagcaguucca

SEQ ID NO: 4079168 - RNA, 14 nt, Streptococcus pneumoniae R6
uccucgcaagagac

SEQ ID NO: 4079169 - RNA, 18 nt, Streptococcus pneumoniae R6
uccucguagcggauuuuc

SEQ ID NO: 4079170 - RNA, 22 nt, Streptococcus pneumoniae R6
uccucguagcggauuuucaaaa

SEQ ID NO: 4079171 - RNA, 20 nt, Streptococcus pneumoniae R6
uccucuacauacccaugcuu

SEQ ID NO: 4079172 - RNA, 21 nt, Streptococcus pneumoniae R6
uccucugguagcaacuaucug

SEQ ID NO: 4079173 - RNA, 19 nt, Streptococcus pneumoniae R6
uccucuugauuuuuuuuaa

SEQ ID NO: 4079174 - RNA, 14 nt, Streptococcus pneumoniae R6
uccugaaaaucauc

SEQ ID NO: 4079175 - RNA, 15 nt, Streptococcus pneumoniae R6
uccugaagaauggga

SEQ ID NO: 4079176 - RNA, 18 nt, Streptococcus pneumoniae R6
uccugagaugacaacaug

SEQ ID NO: 4079177 - RNA, 23 nt, Streptococcus pneumoniae R6
uccugauaaaagauagagaaaga

SEQ ID NO: 4079178 - RNA, 19 nt, Streptococcus pneumoniae R6
uccugauagaguuguucac

SEQ ID NO: 4079179 - RNA, 18 nt, Streptococcus pneumoniae R6
uccugaucgauuuguucu

SEQ ID NO: 4079180 - RNA, 17 nt, Streptococcus pneumoniae R6
uccugauuaaaaucaua

SEQ ID NO: 4079181 - RNA, 15 nt, Streptococcus pneumoniae R6
uccugauuaccaacu

SEQ ID NO: 4079182 - RNA, 22 nt, Streptococcus pneumoniae R6
uccugauuaccaacuacuccuc

SEQ ID NO: 4079183 - RNA, 19 nt, Streptococcus pneumoniae R6
uccugcaaaucuacuggca

SEQ ID NO: 4079184 - RNA, 17 nt, Streptococcus pneumoniae R6
uccugcaaggcauaaac

SEQ ID NO: 4079185 - RNA, 14 nt, Streptococcus pneumoniae R6
uccugcaaguuuau

SEQ ID NO: 4079186 - RNA, 20 nt, Streptococcus pneumoniae R6
uccugcaaguuuaugccuug

SEQ ID NO: 4079187 - RNA, 21 nt, Streptococcus pneumoniae R6
uccugcauuacacaagaucca

SEQ ID NO: 4079188 - RNA, 17 nt, Streptococcus pneumoniae R6
uccugcccacuaaaaau

SEQ ID NO: 4079189 - RNA, 13 nt, Streptococcus pneumoniae R6
uccugcgacuacu

SEQ ID NO: 4079190 - RNA, 14 nt, Streptococcus pneumoniae R6
uccugcucaaaaua

SEQ ID NO: 4079191 - RNA, 23 nt, Streptococcus pneumoniae R6
uccuggaaucagaacacuuccaa

SEQ ID NO: 4079192 - RNA, 14 nt, Streptococcus pneumoniae R6
uccuggcguaguaa

SEQ ID NO: 4079193 - RNA, 16 nt, Streptococcus pneumoniae R6
uccugggaaauuccag

SEQ ID NO: 4079194 - RNA, 22 nt, Streptococcus pneumoniae R6
uccuggucuuuuuuagcucuug

SEQ ID NO: 4079195 - RNA, 19 nt, Streptococcus pneumoniae R6
uccuguaagaacuuuuuaa

SEQ ID NO: 4079196 - RNA, 15 nt, Streptococcus pneumoniae R6
uccugucauggcuga

SEQ ID NO: 4079197 - RNA, 16 nt, Streptococcus pneumoniae R6
uccugucuauacacga

SEQ ID NO: 4079198 - RNA, 14 nt, Streptococcus pneumoniae R6
uccugucuuauuuc

SEQ ID NO: 4079199 - RNA, 15 nt, Streptococcus pneumoniae R6
uccuguugcuucauc

SEQ ID NO: 4079200 - RNA, 16 nt, Streptococcus pneumoniae R6
uccuguuguauuuaua

SEQ ID NO: 4079201 - RNA, 15 nt, Streptococcus pneumoniae R6
uccuguuucaaagua

SEQ ID NO: 4079202 - RNA, 13 nt, Streptococcus pneumoniae R6
uccuguuucagga

SEQ ID NO: 4079203 - RNA, 21 nt, Streptococcus pneumoniae R6
uccuuaaauuuuauacaaauu

SEQ ID NO: 4079204 - RNA, 19 nt, Streptococcus pneumoniae R6
uccuuacucaaauaaaaga

SEQ ID NO: 4079205 - RNA, 14 nt, Streptococcus pneumoniae R6
uccuuacuuuuuau

SEQ ID NO: 4079206 - RNA, 22 nt, Streptococcus pneumoniae R6
uccuuaugacgaaugauaauca

SEQ ID NO: 4079207 - RNA, 15 nt, Streptococcus pneumoniae R6
uccuuauucugaaag

SEQ ID NO: 4079208 - RNA, 17 nt, Streptococcus pneumoniae R6
uccuuauucugaaagug

SEQ ID NO: 4079209 - RNA, 23 nt, Streptococcus pneumoniae R6
uccuuauucuggaagugaaaaag

SEQ ID NO: 4079210 - RNA, 22 nt, Streptococcus pneumoniae R6
uccuuauugaugauguuuaaaa

SEQ ID NO: 4079211 - RNA, 23 nt, Streptococcus pneumoniae R6
uccuuauugaugauguuuaaaau

SEQ ID NO: 4079212 - RNA, 13 nt, Streptococcus pneumoniae R6
uccuuauuuugca

SEQ ID NO: 4079213 - RNA, 18 nt, Streptococcus pneumoniae R6
uccuucaagggcagacau

SEQ ID NO: 4079214 - RNA, 17 nt, Streptococcus pneumoniae R6
uccuucaugaaauuauu

SEQ ID NO: 4079215 - RNA, 13 nt, Streptococcus pneumoniae R6
uccuucauuucca

SEQ ID NO: 4079216 - RNA, 19 nt, Streptococcus pneumoniae R6
ucggauuuuucuuuuaaaa

SEQ ID NO: 4079217 - RNA, 16 nt, Streptococcus pneumoniae R6
ucggcaugcugacaaa

SEQ ID NO: 4079218 - RNA, 20 nt, Streptococcus pneumoniae R6
ucggcaugcugacaaagaga

SEQ ID NO: 4079219 - RNA, 22 nt, Streptococcus pneumoniae R6
ucggcauucuucucuugaaaau

SEQ ID NO: 4079220 - RNA, 17 nt, Streptococcus pneumoniae R6
ucggccaauucuucuuc

SEQ ID NO: 4079221 - RNA, 22 nt, Streptococcus pneumoniae R6
ucggcuguucgcaagauagaac

SEQ ID NO: 4079222 - RNA, 14 nt, Streptococcus pneumoniae R6
ucggcuguuuuuuc

SEQ ID NO: 4079223 - RNA, 19 nt, Streptococcus pneumoniae R6
ucggcuguuuuuucuuauc

SEQ ID NO: 4079224 - RNA, 23 nt, Streptococcus pneumoniae R6
ucgggcaguuccgauguguuggg

SEQ ID NO: 4079225 - RNA, 17 nt, Streptococcus pneumoniae R6
ucggucuuggaccagga

SEQ ID NO: 4079226 - RNA, 16 nt, Streptococcus pneumoniae R6
ucggucuuguuuuuau

SEQ ID NO: 4079227 - RNA, 19 nt, Streptococcus pneumoniae R6
ucgguuagaccaucuagaa

SEQ ID NO: 4079228 - RNA, 15 nt, Streptococcus pneumoniae R6
ucguaaauaauauua

SEQ ID NO: 4079229 - RNA, 13 nt, Streptococcus pneumoniae R6
ucguaaccuucuu

SEQ ID NO: 4079230 - RNA, 16 nt, Streptococcus pneumoniae R6
ucguaaccuucuucug

SEQ ID NO: 4079231 - RNA, 14 nt, Streptococcus pneumoniae R6
ucguacaauauuug

SEQ ID NO: 4079232 - RNA, 16 nt, Streptococcus pneumoniae R6
ucguacuauuucagau

SEQ ID NO: 4079233 - RNA, 13 nt, Streptococcus pneumoniae R6
ucguagagaagga

SEQ ID NO: 4079234 - RNA, 13 nt, Streptococcus pneumoniae R6
ucguauaccauaa

SEQ ID NO: 4079235 - RNA, 23 nt, Streptococcus pneumoniae R6
ucguauaguagaaguguauuauu

SEQ ID NO: 4079236 - RNA, 15 nt, Streptococcus pneumoniae R6
ucguauugaaugcuu

SEQ ID NO: 4079237 - RNA, 19 nt, Streptococcus pneumoniae R6
ucgucaauaauagcuugca

SEQ ID NO: 4079238 - RNA, 21 nt, Streptococcus pneumoniae R6
ucgucacgacgcaguucuuca

SEQ ID NO: 4079239 - RNA, 22 nt, Streptococcus pneumoniae R6
ucgucacgacgcaguucuucau

SEQ ID NO: 4079240 - RNA, 13 nt, Streptococcus pneumoniae R6
ucgucagaggaag

SEQ ID NO: 4079241 - RNA, 12 nt, Streptococcus pneumoniae R6
ucgucaguucca

SEQ ID NO: 4079242 - RNA, 16 nt, Streptococcus pneumoniae R6
ucgucaguucuaucca

SEQ ID NO: 4079243 - RNA, 13 nt, Streptococcus pneumoniae R6
ucgucaguuucau

SEQ ID NO: 4079244 - RNA, 16 nt, Streptococcus pneumoniae R6
ucgucaguuucaucca

SEQ ID NO: 4079245 - RNA, 16 nt, Streptococcus pneumoniae R6
ucgucaguuucaucua

SEQ ID NO: 4079246 - RNA, 14 nt, Streptococcus pneumoniae R6
ucgucauuuaaaga

SEQ ID NO: 4079247 - RNA, 16 nt, Streptococcus pneumoniae R6
ucguccagcacuaaaa

SEQ ID NO: 4079248 - RNA, 14 nt, Streptococcus pneumoniae R6
ucguccuugauuua

SEQ ID NO: 4079249 - RNA, 17 nt, Streptococcus pneumoniae R6
ucgucuggauugaccaa

SEQ ID NO: 4079250 - RNA, 15 nt, Streptococcus pneumoniae R6
ucgugaguuccuguu

SEQ ID NO: 4079251 - RNA, 21 nt, Streptococcus pneumoniae R6
ucgugcaaucucacguaacau

SEQ ID NO: 4079252 - RNA, 20 nt, Streptococcus pneumoniae R6
ucgugcauuucauccccauu

SEQ ID NO: 4079253 - RNA, 17 nt, Streptococcus pneumoniae R6
ucguuaaaagcaaaaac

SEQ ID NO: 4079254 - RNA, 22 nt, Streptococcus pneumoniae R6
ucguuacggggguaagagacuu

SEQ ID NO: 4079255 - RNA, 16 nt, Streptococcus pneumoniae R6
ucguuacuauaagacu

SEQ ID NO: 4079256 - RNA, 13 nt, Streptococcus pneumoniae R6
ucguuaucacugg

SEQ ID NO: 4079257 - RNA, 13 nt, Streptococcus pneumoniae R6
ucguucacccuug

SEQ ID NO: 4079258 - RNA, 22 nt, Streptococcus pneumoniae R6
ucguucacccuugcuuuuucuu

SEQ ID NO: 4079259 - RNA, 15 nt, Streptococcus pneumoniae R6
ucguucaggacaguc

SEQ ID NO: 4079260 - RNA, 16 nt, Streptococcus pneumoniae R6
ucguucaggacaguca

SEQ ID NO: 4079261 - RNA, 19 nt, Streptococcus pneumoniae R6
ucguucaggacagucaaau

SEQ ID NO: 4079262 - RNA, 20 nt, Streptococcus pneumoniae R6
ucguucaggacagucaaauc

SEQ ID NO: 4079263 - RNA, 11 nt, Streptococcus pneumoniae R6
ucguuccuuua

SEQ ID NO: 4079264 - RNA, 14 nt, Streptococcus pneumoniae R6
ucguuccuuuaaaa

SEQ ID NO: 4079265 - RNA, 15 nt, Streptococcus pneumoniae R6
ucguuccuuuaaaau

SEQ ID NO: 4079266 - RNA, 15 nt, Streptococcus pneumoniae R6
ucguucugucugcug

SEQ ID NO: 4079267 - RNA, 22 nt, Streptococcus pneumoniae R6
ucguugaaugaaaugaggcuga

SEQ ID NO: 4079268 - RNA, 12 nt, Streptococcus pneumoniae R6
ucguuuaaaaca

SEQ ID NO: 4079269 - RNA, 20 nt, Streptococcus pneumoniae R6
ucguuuccuuccaugauaga

SEQ ID NO: 4079270 - RNA, 22 nt, Streptococcus pneumoniae R6
ucguuugauaaguuugaugaga

SEQ ID NO: 4079271 - RNA, 20 nt, Streptococcus pneumoniae R6
ucguuugguguaauaaacug

SEQ ID NO: 4079272 - RNA, 15 nt, Streptococcus pneumoniae R6
ucuaaaaaggcguuc

SEQ ID NO: 4079273 - RNA, 13 nt, Streptococcus pneumoniae R6
ucuaaaaauguuu

SEQ ID NO: 4079274 - RNA, 17 nt, Streptococcus pneumoniae R6
ucuaaaacauugugaga

SEQ ID NO: 4079275 - RNA, 19 nt, Streptococcus pneumoniae R6
ucuaaaacauugugagaaa

SEQ ID NO: 4079276 - RNA, 23 nt, Streptococcus pneumoniae R6
ucuaaaacauuguuagaaaucaa

SEQ ID NO: 4079277 - RNA, 13 nt, Streptococcus pneumoniae R6
ucuaaaauaaguu

SEQ ID NO: 4079278 - RNA, 20 nt, Streptococcus pneumoniae R6
ucuaaaauaguacgaaacaa

SEQ ID NO: 4079279 - RNA, 18 nt, Streptococcus pneumoniae R6
ucuaaacaauguucucau

SEQ ID NO: 4079280 - RNA, 18 nt, Streptococcus pneumoniae R6
ucuaaacuguacaagaac

SEQ ID NO: 4079281 - RNA, 21 nt, Streptococcus pneumoniae R6
ucuaaagaauuugaaaaaaau

SEQ ID NO: 4079282 - RNA, 14 nt, Streptococcus pneumoniae R6
ucuaaagaguauaa

SEQ ID NO: 4079283 - RNA, 12 nt, Streptococcus pneumoniae R6
ucuaaaguaagu

SEQ ID NO: 4079284 - RNA, 21 nt, Streptococcus pneumoniae R6
ucuaaauaagguuuagcaaaa

SEQ ID NO: 4079285 - RNA, 17 nt, Streptococcus pneumoniae R6
ucuaaauaauacuugga

SEQ ID NO: 4079286 - RNA, 15 nt, Streptococcus pneumoniae R6
ucuaaauacaaaaau

SEQ ID NO: 4079287 - RNA, 16 nt, Streptococcus pneumoniae R6
ucuaaauacaaaaaua

SEQ ID NO: 4079288 - RNA, 17 nt, Streptococcus pneumoniae R6
ucuaaauacaaaaauag

SEQ ID NO: 4079289 - RNA, 17 nt, Streptococcus pneumoniae R6
ucuaaauucaauucacu

SEQ ID NO: 4079290 - RNA, 11 nt, Streptococcus pneumoniae R6
ucuaacaucuu

SEQ ID NO: 4079291 - RNA, 20 nt, Streptococcus pneumoniae R6
ucuaacauuauugauuccgu

SEQ ID NO: 4079292 - RNA, 15 nt, Streptococcus pneumoniae R6
ucuaacugaagcugu

SEQ ID NO: 4079293 - RNA, 21 nt, Streptococcus pneumoniae R6
ucuaacuguuugggggcagua

SEQ ID NO: 4079294 - RNA, 17 nt, Streptococcus pneumoniae R6
ucuaacuucaauagacu

SEQ ID NO: 4079295 - RNA, 17 nt, Streptococcus pneumoniae R6
ucuaagauguucaaucu

SEQ ID NO: 4079296 - RNA, 18 nt, Streptococcus pneumoniae R6
ucuaagcgaccaucuuga

SEQ ID NO: 4079297 - RNA, 17 nt, Streptococcus pneumoniae R6
ucuaagguauauucaaa

SEQ ID NO: 4079298 - RNA, 15 nt, Streptococcus pneumoniae R6
ucuaagguuucaaaa

SEQ ID NO: 4079299 - RNA, 13 nt, Streptococcus pneumoniae R6
ucuaaguaacuaa

SEQ ID NO: 4079300 - RNA, 21 nt, Streptococcus pneumoniae R6
ucuaauaauuuuucauuuaau

SEQ ID NO: 4079301 - RNA, 22 nt, Streptococcus pneumoniae R6
ucuaauaauuuuucauuuaaua

SEQ ID NO: 4079302 - RNA, 20 nt, Streptococcus pneumoniae R6
ucuaauguacgaauuagguu

SEQ ID NO: 4079303 - RNA, 17 nt, Streptococcus pneumoniae R6
ucuaauuaaauaaaaua

SEQ ID NO: 4079304 - RNA, 21 nt, Streptococcus pneumoniae R6
ucuaauuauuucaauuaguuu

SEQ ID NO: 4079305 - RNA, 14 nt, Streptococcus pneumoniae R6
ucuaauucccuuaa

SEQ ID NO: 4079306 - RNA, 14 nt, Streptococcus pneumoniae R6
ucuaauuuuugagc

SEQ ID NO: 4079307 - RNA, 13 nt, Streptococcus pneumoniae R6
ucuacaaauguuu

SEQ ID NO: 4079308 - RNA, 15 nt, Streptococcus pneumoniae R6
ucuacaaccucaaaa

SEQ ID NO: 4079309 - RNA, 19 nt, Streptococcus pneumoniae R6
ucuacaaccucaaaaacau

SEQ ID NO: 4079310 - RNA, 21 nt, Streptococcus pneumoniae R6
ucuacaaccucaaaaacaugu

SEQ ID NO: 4079311 - RNA, 18 nt, Streptococcus pneumoniae R6
ucuacaaccucaaaacac

SEQ ID NO: 4079312 - RNA, 15 nt, Streptococcus pneumoniae R6
ucuacaacgucuuuu

SEQ ID NO: 4079313 - RNA, 22 nt, Streptococcus pneumoniae R6
ucuacacccacgucacaaagaa

SEQ ID NO: 4079314 - RNA, 17 nt, Streptococcus pneumoniae R6
ucuacaucauugucaaa

SEQ ID NO: 4079315 - RNA, 14 nt, Streptococcus pneumoniae R6
ucuaccaagcccuc

SEQ ID NO: 4079316 - RNA, 16 nt, Streptococcus pneumoniae R6
ucuaccuauucauaua

SEQ ID NO: 4079317 - RNA, 14 nt, Streptococcus pneumoniae R6
ucuacgacaaccuu

SEQ ID NO: 4079318 - RNA, 12 nt, Streptococcus pneumoniae R6
ucuacuaaaauu

SEQ ID NO: 4079319 - RNA, 21 nt, Streptococcus pneumoniae R6
ucuccauaggccaagucuuuu

SEQ ID NO: 4079320 - RNA, 12 nt, Streptococcus pneumoniae R6
ucuccauccuca

SEQ ID NO: 4079321 - RNA, 17 nt, Streptococcus pneumoniae R6
ucuccauuacuugcauu

SEQ ID NO: 4079322 - RNA, 22 nt, Streptococcus pneumoniae R6
ucuccauuuuggauauaagaag

SEQ ID NO: 4079323 - RNA, 19 nt, Streptococcus pneumoniae R6
ucucccccugauaauacuu

SEQ ID NO: 4079324 - RNA, 19 nt, Streptococcus pneumoniae R6
ucucccgcccuuuuuucuc

SEQ ID NO: 4079325 - RNA, 18 nt, Streptococcus pneumoniae R6
ucuccgaagacuuuaaaa

SEQ ID NO: 4079326 - RNA, 20 nt, Streptococcus pneumoniae R6
ucuccgaagacuuuaaaaau

SEQ ID NO: 4079327 - RNA, 21 nt, Streptococcus pneumoniae R6
ucuccgaagacuuuaaaaauu

SEQ ID NO: 4079328 - RNA, 20 nt, Streptococcus pneumoniae R6
ucuccgaggauuucccaagu

SEQ ID NO: 4079329 - RNA, 14 nt, Streptococcus pneumoniae R6
ucuccgcuuuuauc

SEQ ID NO: 4079330 - RNA, 17 nt, Streptococcus pneumoniae R6
ucuccggcuuucacaaa

SEQ ID NO: 4079331 - RNA, 13 nt, Streptococcus pneumoniae R6
ucuccguuuuuaa

SEQ ID NO: 4079332 - RNA, 18 nt, Streptococcus pneumoniae R6
ucuccuacuugcuuccca

SEQ ID NO: 4079333 - RNA, 18 nt, Streptococcus pneumoniae R6
ucuccuagucuacaaauu

SEQ ID NO: 4079334 - RNA, 16 nt, Streptococcus pneumoniae R6
ucuccuuagucucaaa

SEQ ID NO: 4079335 - RNA, 16 nt, Streptococcus pneumoniae R6
ucuccuuuaguuuauu

SEQ ID NO: 4079336 - RNA, 21 nt, Streptococcus pneumoniae R6
ucuccuuugagguuaaucaau

SEQ ID NO: 4079337 - RNA, 17 nt, Streptococcus pneumoniae R6
ucucgcaagaggucaua

SEQ ID NO: 4079338 - RNA, 17 nt, Streptococcus pneumoniae R6
ucucguaaacaaagagg

SEQ ID NO: 4079339 - RNA, 12 nt, Streptococcus pneumoniae R6
ucucuaaaaaua

SEQ ID NO: 4079340 - RNA, 17 nt, Streptococcus pneumoniae R6
ucucuaaaaauaaaaaa

SEQ ID NO: 4079341 - RNA, 18 nt, Streptococcus pneumoniae R6
ucucuaaaucuucuaaua

SEQ ID NO: 4079342 - RNA, 15 nt, Streptococcus pneumoniae R6
ucucuacaaauaaga

SEQ ID NO: 4079343 - RNA, 23 nt, Streptococcus pneumoniae R6
ucucuacauucccaaacaaaaaa

SEQ ID NO: 4079344 - RNA, 19 nt, Streptococcus pneumoniae R6
ucucuagaaaucucuuuuu

SEQ ID NO: 4079345 - RNA, 21 nt, Streptococcus pneumoniae R6
ucucuaggaauaucaaaguuu

SEQ ID NO: 4079346 - RNA, 18 nt, Streptococcus pneumoniae R6
ucucuagguuaaagguuu

SEQ ID NO: 4079347 - RNA, 20 nt, Streptococcus pneumoniae R6
ucucuaucucuuaaaaaagu

SEQ ID NO: 4079348 - RNA, 16 nt, Streptococcus pneumoniae R6
ucucuccuuaucaaaa

SEQ ID NO: 4079349 - RNA, 12 nt, Streptococcus pneumoniae R6
ucucucgugauu

SEQ ID NO: 4079350 - RNA, 14 nt, Streptococcus pneumoniae R6
ucucucuauaauaa

SEQ ID NO: 4079351 - RNA, 16 nt, Streptococcus pneumoniae R6
ucucugauaauauuuu

SEQ ID NO: 4079352 - RNA, 18 nt, Streptococcus pneumoniae R6
ucucuggguacucuuuuu

SEQ ID NO: 4079353 - RNA, 15 nt, Streptococcus pneumoniae R6
ucucugguuccuuau

SEQ ID NO: 4079354 - RNA, 16 nt, Streptococcus pneumoniae R6
ucucugguuccuuauu

SEQ ID NO: 4079355 - RNA, 19 nt, Streptococcus pneumoniae R6
ucucugucccaucauuucu

SEQ ID NO: 4079356 - RNA, 19 nt, Streptococcus pneumoniae R6
ucucuuaauaucagccaga

SEQ ID NO: 4079357 - RNA, 13 nt, Streptococcus pneumoniae R6
ucucuuagaucua

SEQ ID NO: 4079358 - RNA, 19 nt, Streptococcus pneumoniae R6
ucucuuauuguauaguaga

SEQ ID NO: 4079359 - RNA, 22 nt, Streptococcus pneumoniae R6
ucucuucaaaccacgucagcuu

SEQ ID NO: 4079360 - RNA, 22 nt, Streptococcus pneumoniae R6
ucucuucaauccgcgucaacgu

SEQ ID NO: 4079361 - RNA, 20 nt, Streptococcus pneumoniae R6
ucucuugaagacuuuuuaaa

SEQ ID NO: 4079362 - RNA, 15 nt, Streptococcus pneumoniae R6
ucucuuguuguugua

SEQ ID NO: 4079363 - RNA, 17 nt, Streptococcus pneumoniae R6
ucucuuguuuaagagca

SEQ ID NO: 4079364 - RNA, 14 nt, Streptococcus pneumoniae R6
ucucuuuguucuuu

SEQ ID NO: 4079365 - RNA, 14 nt, Streptococcus pneumoniae R6
ucucuuuucuuauc

SEQ ID NO: 4079366 - RNA, 16 nt, Streptococcus pneumoniae R6
ucucuuuucuuaucug

SEQ ID NO: 4079367 - RNA, 20 nt, Streptococcus pneumoniae R6
ucucuuuuuugauguucaaa

SEQ ID NO: 4079368 - RNA, 10 nt, Streptococcus pneumoniae R6
ucugaaaaag

SEQ ID NO: 4079369 - RNA, 23 nt, Streptococcus pneumoniae R6
ucugaaaagacguauucagucau

SEQ ID NO: 4079370 - RNA, 15 nt, Streptococcus pneumoniae R6
ucugaaagugaaaaa

SEQ ID NO: 4079371 - RNA, 16 nt, Streptococcus pneumoniae R6
ucugaaagugaaaaag

SEQ ID NO: 4079372 - RNA, 20 nt, Streptococcus pneumoniae R6
ucugaaauaguacgaaacaa

SEQ ID NO: 4079373 - RNA, 17 nt, Streptococcus pneumoniae R6
ucugaagacaaaucauu

SEQ ID NO: 4079374 - RNA, 19 nt, Streptococcus pneumoniae R6
ucugaagacaaaucauuuu

SEQ ID NO: 4079375 - RNA, 23 nt, Streptococcus pneumoniae R6
ucugaagacaaaucauuuugacc

SEQ ID NO: 4079376 - RNA, 24 nt, Streptococcus pneumoniae R6
ucugaaguuggccgaugaugguaa

SEQ ID NO: 4079377 - RNA, 18 nt, Streptococcus pneumoniae R6
ucugaauagcuuaaaauc

SEQ ID NO: 4079378 - RNA, 15 nt, Streptococcus pneumoniae R6
ucugacgagaaauag

SEQ ID NO: 4079379 - RNA, 16 nt, Streptococcus pneumoniae R6
ucugacuagcaucuug

SEQ ID NO: 4079380 - RNA, 20 nt, Streptococcus pneumoniae R6
ucugacuaucuuguugaaug

SEQ ID NO: 4079381 - RNA, 23 nt, Streptococcus pneumoniae R6
ucugagguuaaaaucuuuuacuu

SEQ ID NO: 4079382 - RNA, 15 nt, Streptococcus pneumoniae R6
ucugaguauuuagca

SEQ ID NO: 4079383 - RNA, 15 nt, Streptococcus pneumoniae R6
ucugauauuauacgu

SEQ ID NO: 4079384 - RNA, 20 nt, Streptococcus pneumoniae R6
ucugaugaaccuucaucaaa

SEQ ID NO: 4079385 - RNA, 20 nt, Streptococcus pneumoniae R6
ucugaugcacuauuuuccaa

SEQ ID NO: 4079386 - RNA, 15 nt, Streptococcus pneumoniae R6
ucugaugcugacaag

SEQ ID NO: 4079387 - RNA, 16 nt, Streptococcus pneumoniae R6
ucugaugcugacaagu

SEQ ID NO: 4079388 - RNA, 17 nt, Streptococcus pneumoniae R6
ucugauggauuuauagu

SEQ ID NO: 4079389 - RNA, 21 nt, Streptococcus pneumoniae R6
ucugauuugggguugagaagu

SEQ ID NO: 4079390 - RNA, 12 nt, Streptococcus pneumoniae R6
ucugcaaaccac

SEQ ID NO: 4079391 - RNA, 16 nt, Streptococcus pneumoniae R6
ucugcaacaacagcug

SEQ ID NO: 4079392 - RNA, 15 nt, Streptococcus pneumoniae R6
ucugcaaccucaaaa

SEQ ID NO: 4079393 - RNA, 17 nt, Streptococcus pneumoniae R6
ucugcaaccucuacaau

SEQ ID NO: 4079394 - RNA, 15 nt, Streptococcus pneumoniae R6
ucugcaaccuuaaaa

SEQ ID NO: 4079395 - RNA, 16 nt, Streptococcus pneumoniae R6
ucugcaaccuuaaaac

SEQ ID NO: 4079396 - RNA, 20 nt, Streptococcus pneumoniae R6
ucugcaauggcaauaaacau

SEQ ID NO: 4079397 - RNA, 19 nt, Streptococcus pneumoniae R6
ucugcagguuuugugacca

SEQ ID NO: 4079398 - RNA, 22 nt, Streptococcus pneumoniae R6
ucugcauaagcuggucuuuuuu

SEQ ID NO: 4079399 - RNA, 23 nt, Streptococcus pneumoniae R6
ucugcauaagcuggucuuuuuug

SEQ ID NO: 4079400 - RNA, 21 nt, Streptococcus pneumoniae R6
ucugcaucguucaauggaaug

SEQ ID NO: 4079401 - RNA, 15 nt, Streptococcus pneumoniae R6
ucugcauggacaacc

SEQ ID NO: 4079402 - RNA, 20 nt, Streptococcus pneumoniae R6
ucugccagauuccugaaaua

SEQ ID NO: 4079403 - RNA, 21 nt, Streptococcus pneumoniae R6
ucugcccaaagacagguuuca

SEQ ID NO: 4079404 - RNA, 16 nt, Streptococcus pneumoniae R6
ucugccuuccuugucu

SEQ ID NO: 4079405 - RNA, 19 nt, Streptococcus pneumoniae R6
ucugccuuuuuauccaaaa

SEQ ID NO: 4079406 - RNA, 15 nt, Streptococcus pneumoniae R6
ucugcuaacugcugg

SEQ ID NO: 4079407 - RNA, 21 nt, Streptococcus pneumoniae R6
ucugcuaacugcuggauagag

SEQ ID NO: 4079408 - RNA, 14 nt, Streptococcus pneumoniae R6
ucugcuaauuuuau

SEQ ID NO: 4079409 - RNA, 22 nt, Streptococcus pneumoniae R6
ucugcuagacuaacuucuuauu

SEQ ID NO: 4079410 - RNA, 18 nt, Streptococcus pneumoniae R6
ucugcuauagucaauuga

SEQ ID NO: 4079411 - RNA, 14 nt, Streptococcus pneumoniae R6
ucugcuauuucuaa

SEQ ID NO: 4079412 - RNA, 12 nt, Streptococcus pneumoniae R6
ucugcuccuccg

SEQ ID NO: 4079413 - RNA, 16 nt, Streptococcus pneumoniae R6
ucugcucgcuggagau

SEQ ID NO: 4079414 - RNA, 18 nt, Streptococcus pneumoniae R6
ucugcucgcuggagauag

SEQ ID NO: 4079415 - RNA, 14 nt, Streptococcus pneumoniae R6
ucugcugacugauu

SEQ ID NO: 4079416 - RNA, 19 nt, Streptococcus pneumoniae R6
ucugcuucuuuuuuuacua

SEQ ID NO: 4079417 - RNA, 15 nt, Streptococcus pneumoniae R6
ucugcuugcaucaaa

SEQ ID NO: 4079418 - RNA, 21 nt, Streptococcus pneumoniae R6
ucugcuuuuuauacaguccuc

SEQ ID NO: 4079419 - RNA, 19 nt, Streptococcus pneumoniae R6
ucuggaagugaaaaagcaa

SEQ ID NO: 4079420 - RNA, 18 nt, Streptococcus pneumoniae R6
ucuggagaagcaccaguu

SEQ ID NO: 4079421 - RNA, 17 nt, Streptococcus pneumoniae R6
ucuucagaaauuuucuu

SEQ ID NO: 4079422 - RNA, 18 nt, Streptococcus pneumoniae R6
ucuucagaaauuuucuua

SEQ ID NO: 4079423 - RNA, 13 nt, Streptococcus pneumoniae R6
ucuucagcaaaac

SEQ ID NO: 4079424 - RNA, 17 nt, Streptococcus pneumoniae R6
ucuucagcagcuaaaaa

SEQ ID NO: 4079425 - RNA, 17 nt, Streptococcus pneumoniae R6
ucuucagccuuauauuu

SEQ ID NO: 4079426 - RNA, 18 nt, Streptococcus pneumoniae R6
ucuucagccuuauauuuu

SEQ ID NO: 4079427 - RNA, 18 nt, Streptococcus pneumoniae R6
ucuucaucuugucuucaa

SEQ ID NO: 4079428 - RNA, 18 nt, Streptococcus pneumoniae R6
ucuucaugauuagaaaua

SEQ ID NO: 4079429 - RNA, 21 nt, Streptococcus pneumoniae R6
ucuucauggaucauuucuucu

SEQ ID NO: 4079430 - RNA, 20 nt, Streptococcus pneumoniae R6
ucuucauucaaagaaccugc

SEQ ID NO: 4079431 - RNA, 23 nt, Streptococcus pneumoniae R6
ucuucauucaaagaaccugcagu

SEQ ID NO: 4079432 - RNA, 19 nt, Streptococcus pneumoniae R6
ucuuccaaagguugcuuga

SEQ ID NO: 4079433 - RNA, 18 nt, Streptococcus pneumoniae R6
ucuuccaaaguucgaaag

SEQ ID NO: 4079434 - RNA, 20 nt, Streptococcus pneumoniae R6
ucuuccaauuucuuuucauu

SEQ ID NO: 4079435 - RNA, 17 nt, Streptococcus pneumoniae R6
ucuuccagcucaucauc

SEQ ID NO: 4079436 - RNA, 13 nt, Streptococcus pneumoniae R6
ucuuccaucuucu

SEQ ID NO: 4079437 - RNA, 15 nt, Streptococcus pneumoniae R6
ucuuccauuucuuug

SEQ ID NO: 4079438 - RNA, 12 nt, Streptococcus pneumoniae R6
ucuucccacaau

SEQ ID NO: 4079439 - RNA, 15 nt, Streptococcus pneumoniae R6
ucuucccacaauaaa

SEQ ID NO: 4079440 - RNA, 17 nt, Streptococcus pneumoniae R6
ucuucccguagguuuuc

SEQ ID NO: 4079441 - RNA, 21 nt, Streptococcus pneumoniae R6
ucuucccguagguuuucuccu

SEQ ID NO: 4079442 - RNA, 22 nt, Streptococcus pneumoniae R6
ucuucccguagguuuucuccuu

SEQ ID NO: 4079443 - RNA, 23 nt, Streptococcus pneumoniae R6
ucuuccgaauaacucaaaagcuu

SEQ ID NO: 4079444 - RNA, 23 nt, Streptococcus pneumoniae R6
ucuuccgaauagcucaaaagcuu

SEQ ID NO: 4079445 - RNA, 16 nt, Streptococcus pneumoniae R6
ucuuccuacugauauc

SEQ ID NO: 4079446 - RNA, 19 nt, Streptococcus pneumoniae R6
ucuucgaaaaucucugcaa

SEQ ID NO: 4079447 - RNA, 19 nt, Streptococcus pneumoniae R6
ucuucgaaaaucucuucaa

SEQ ID NO: 4079448 - RNA, 16 nt, Streptococcus pneumoniae R6
ucuucgaccuacauug

SEQ ID NO: 4079449 - RNA, 14 nt, Streptococcus pneumoniae R6
ucuucgauaucuug

SEQ ID NO: 4079450 - RNA, 23 nt, Streptococcus pneumoniae R6
ucuucggaauagcucaaaaguuu

SEQ ID NO: 4079451 - RNA, 22 nt, Streptococcus pneumoniae R6
ucuucggagaagaaaacagaaa

SEQ ID NO: 4079452 - RNA, 20 nt, Streptococcus pneumoniae R6
ucuucggauuuuucuuuuaa

SEQ ID NO: 4079453 - RNA, 13 nt, Streptococcus pneumoniae R6
ucuucgugaaaga

SEQ ID NO: 4079454 - RNA, 15 nt, Streptococcus pneumoniae R6
ucuucguuuuuacua

SEQ ID NO: 4079455 - RNA, 22 nt, Streptococcus pneumoniae R6
ucuucuaaaaaggcguucaucc

SEQ ID NO: 4079456 - RNA, 16 nt, Streptococcus pneumoniae R6
ucuucuaauaccaaua

SEQ ID NO: 4079457 - RNA, 18 nt, Streptococcus pneumoniae R6
ucuucuaguugguuuccu

SEQ ID NO: 4079458 - RNA, 21 nt, Streptococcus pneumoniae R6
ucuucuaguugguuuccuugg

SEQ ID NO: 4079459 - RNA, 20 nt, Streptococcus pneumoniae R6
ucuucucacguccuagcucu

SEQ ID NO: 4079460 - RNA, 12 nt, Streptococcus pneumoniae R6
ucuucucaggcu

SEQ ID NO: 4079461 - RNA, 19 nt, Streptococcus pneumoniae R6
ucuucucaggcuuuuucug

SEQ ID NO: 4079462 - RNA, 20 nt, Streptococcus pneumoniae R6
ucuucucaggcuuuuucugu

SEQ ID NO: 4079463 - RNA, 18 nt, Streptococcus pneumoniae R6
ucuucuccaguuuuaauc

SEQ ID NO: 4079464 - RNA, 15 nt, Streptococcus pneumoniae R6
ucuucuccgaagacu

SEQ ID NO: 4079465 - RNA, 20 nt, Streptococcus pneumoniae R6
ucuucuccuaaaauugacuu

SEQ ID NO: 4079466 - RNA, 19 nt, Streptococcus pneumoniae R6
ucuucugggagaaauuccu

SEQ ID NO: 4079467 - RNA, 17 nt, Streptococcus pneumoniae R6
ucuucugguuuggcaaa

SEQ ID NO: 4079468 - RNA, 23 nt, Streptococcus pneumoniae R6
ucuucuguacauuagaauucagc

SEQ ID NO: 4079469 - RNA, 15 nt, Streptococcus pneumoniae R6
ucuucuguaccaaua

SEQ ID NO: 4079470 - RNA, 19 nt, Streptococcus pneumoniae R6
ucuucuucgcuuucuucau

SEQ ID NO: 4079471 - RNA, 15 nt, Streptococcus pneumoniae R6
ucuucuucugaagca

SEQ ID NO: 4079472 - RNA, 15 nt, Streptococcus pneumoniae R6
ucuucuugauacuga

SEQ ID NO: 4079473 - RNA, 16 nt, Streptococcus pneumoniae R6
ucuucuuuauaauauu

SEQ ID NO: 4079474 - RNA, 12 nt, Streptococcus pneumoniae R6
ucuucuuuucuu

SEQ ID NO: 4079475 - RNA, 16 nt, Streptococcus pneumoniae R6
ucuugaaaaugaaaga

SEQ ID NO: 4079476 - RNA, 22 nt, Streptococcus pneumoniae R6
ucuugaaaaugaaagagcagga

SEQ ID NO: 4079477 - RNA, 22 nt, Streptococcus pneumoniae R6
ucuugaaaugaaguuagguuuu

SEQ ID NO: 4079478 - RNA, 15 nt, Streptococcus pneumoniae R6
ucuugaaguccuucu

SEQ ID NO: 4079479 - RNA, 19 nt, Streptococcus pneumoniae R6
ucuugaaguucauuuucuu

SEQ ID NO: 4079480 - RNA, 23 nt, Streptococcus pneumoniae R6
ucuugacaaagaaaaaacaaagu

SEQ ID NO: 4079481 - RNA, 22 nt, Streptococcus pneumoniae R6
ucuugaccaacuuuaagagcuu

SEQ ID NO: 4079482 - RNA, 18 nt, Streptococcus pneumoniae R6
ucuugaccagcgauagcu

SEQ ID NO: 4079483 - RNA, 18 nt, Streptococcus pneumoniae R6
ucuugacgauaggugaua

SEQ ID NO: 4079484 - RNA, 17 nt, Streptococcus pneumoniae R6
ucuugagcgauuuuaau

SEQ ID NO: 4079485 - RNA, 23 nt, Streptococcus pneumoniae R6
ucuugagcgauuuuaaugaccag

SEQ ID NO: 4079486 - RNA, 23 nt, Streptococcus pneumoniae R6
ucuugagcuaggguguuuucaau

SEQ ID NO: 4079487 - RNA, 16 nt, Streptococcus pneumoniae R6
ucuugaggaagagcuu

SEQ ID NO: 4079488 - RNA, 21 nt, Streptococcus pneumoniae R6
ucuugagggcacggucacgaa

SEQ ID NO: 4079489 - RNA, 21 nt, Streptococcus pneumoniae R6
ucuugauuuaggguacuuucu

SEQ ID NO: 4079490 - RNA, 18 nt, Streptococcus pneumoniae R6
ucuugauuuucuuuaaaa

SEQ ID NO: 4079491 - RNA, 18 nt, Streptococcus pneumoniae R6
ucuugauuuuuuuuaaaa

SEQ ID NO: 4079492 - RNA, 18 nt, Streptococcus pneumoniae R6
ucuugcaaacuuuccaau

SEQ ID NO: 4079493 - RNA, 23 nt, Streptococcus pneumoniae R6
ucuugcaaacuuuccaauauguu

SEQ ID NO: 4079494 - RNA, 20 nt, Streptococcus pneumoniae R6
ucuugcauucguucuuggua

SEQ ID NO: 4079495 - RNA, 14 nt, Streptococcus pneumoniae R6
ucuugcauuuuaau

SEQ ID NO: 4079496 - RNA, 19 nt, Streptococcus pneumoniae R6
ucuugcauuuuaauuucaa

SEQ ID NO: 4079497 - RNA, 23 nt, Streptococcus pneumoniae R6
ucuugcauuuuaauuucaaugua

SEQ ID NO: 4079498 - RNA, 17 nt, Streptococcus pneumoniae R6
ucuugcccuucuagagu

SEQ ID NO: 4079499 - RNA, 15 nt, Streptococcus pneumoniae R6
ucuugcuugcuacaa

SEQ ID NO: 4079500 - RNA, 22 nt, Streptococcus pneumoniae R6
ucuugcuuuuuuauauggaaaa

SEQ ID NO: 4079501 - RNA, 16 nt, Streptococcus pneumoniae R6
ucuuggaagaaaucca

SEQ ID NO: 4079502 - RNA, 15 nt, Streptococcus pneumoniae R6
ucuuggcaaaguuuu

SEQ ID NO: 4079503 - RNA, 18 nt, Streptococcus pneumoniae R6
ucuuggcagaaagguaag

SEQ ID NO: 4079504 - RNA, 17 nt, Streptococcus pneumoniae R6
ucuuggcgaauauagac

SEQ ID NO: 4079505 - RNA, 18 nt, Streptococcus pneumoniae R6
ucuuggcgaauauagaca

SEQ ID NO: 4079506 - RNA, 16 nt, Streptococcus pneumoniae R6
ucuuggucuagcaaga

SEQ ID NO: 4079507 - RNA, 13 nt, Streptococcus pneumoniae R6
ucuuguaagaaag

SEQ ID NO: 4079508 - RNA, 12 nt, Streptococcus pneumoniae R6
ucuugucaaaga

SEQ ID NO: 4079509 - RNA, 16 nt, Streptococcus pneumoniae R6
ucuuguccuaaauaga

SEQ ID NO: 4079510 - RNA, 23 nt, Streptococcus pneumoniae R6
ucuugucuucaaaggucaaauca

SEQ ID NO: 4079511 - RNA, 18 nt, Streptococcus pneumoniae R6
ucuugugagaauauuuac

SEQ ID NO: 4079512 - RNA, 21 nt, Streptococcus pneumoniae R6
ucuugugcugacauugaagag

SEQ ID NO: 4079513 - RNA, 21 nt, Streptococcus pneumoniae R6
ucuuguuaagagguuuuacua

SEQ ID NO: 4079514 - RNA, 13 nt, Streptococcus pneumoniae R6
ucuuguucugccu

SEQ ID NO: 4079515 - RNA, 22 nt, Streptococcus pneumoniae R6
ucuuguugaaugagcuuccagu

SEQ ID NO: 4079516 - RNA, 23 nt, Streptococcus pneumoniae R6
ucuuguugaaugagcuuccagua

SEQ ID NO: 4079517 - RNA, 13 nt, Streptococcus pneumoniae R6
ucuuguugaugua

SEQ ID NO: 4079518 - RNA, 12 nt, Streptococcus pneumoniae R6
ucuuguuucucg

SEQ ID NO: 4079519 - RNA, 15 nt, Streptococcus pneumoniae R6
ucuuuaaaaaauuuu

SEQ ID NO: 4079520 - RNA, 17 nt, Streptococcus pneumoniae R6
ucuuuaaaaucugaaaa

SEQ ID NO: 4079521 - RNA, 17 nt, Streptococcus pneumoniae R6
ucuuuaaaauuauaaaa

SEQ ID NO: 4079522 - RNA, 17 nt, Streptococcus pneumoniae R6
ucuuuacguccaccaca

SEQ ID NO: 4079523 - RNA, 14 nt, Streptococcus pneumoniae R6
ugaaacaaauaaau

SEQ ID NO: 4079524 - RNA, 16 nt, Streptococcus pneumoniae R6
ugaaacacccuagccu

SEQ ID NO: 4079525 - RNA, 13 nt, Streptococcus pneumoniae R6
ugaaacagaggug

SEQ ID NO: 4079526 - RNA, 13 nt, Streptococcus pneumoniae R6
ugaaacagcugcg

SEQ ID NO: 4079527 - RNA, 22 nt, Streptococcus pneumoniae R6
ugaaaccaguuccuuugucuuu

SEQ ID NO: 4079528 - RNA, 19 nt, Streptococcus pneumoniae R6
ugaaaccauuagauuucag

SEQ ID NO: 4079529 - RNA, 12 nt, Streptococcus pneumoniae R6
ugaaaccccaag

SEQ ID NO: 4079530 - RNA, 20 nt, Streptococcus pneumoniae R6
ugaaacuaauagguacaaaa

SEQ ID NO: 4079531 - RNA, 21 nt, Streptococcus pneumoniae R6
ugaaacuaauagguacaaaaa

SEQ ID NO: 4079532 - RNA, 15 nt, Streptococcus pneumoniae R6
ugaaacuagaauagg

SEQ ID NO: 4079533 - RNA, 17 nt, Streptococcus pneumoniae R6
ugaaacugacgaaguca

SEQ ID NO: 4079534 - RNA, 19 nt, Streptococcus pneumoniae R6
ugaaacugacgaagucagc

SEQ ID NO: 4079535 - RNA, 22 nt, Streptococcus pneumoniae R6
ugaaacugacgaagucagcuca

SEQ ID NO: 4079536 - RNA, 19 nt, Streptococcus pneumoniae R6
ugaaacugacgaagucagu

SEQ ID NO: 4079537 - RNA, 18 nt, Streptococcus pneumoniae R6
ugaaacuguggaaaauag

SEQ ID NO: 4079538 - RNA, 20 nt, Streptococcus pneumoniae R6
ugaaacuguggaaaauagaa

SEQ ID NO: 4079539 - RNA, 20 nt, Streptococcus pneumoniae R6
ugaaagaugaagcaaucaau

SEQ ID NO: 4079540 - RNA, 16 nt, Streptococcus pneumoniae R6
ugaaagcagaugagug

SEQ ID NO: 4079541 - RNA, 14 nt, Streptococcus pneumoniae R6
ugaaaggaagagag

SEQ ID NO: 4079542 - RNA, 15 nt, Streptococcus pneumoniae R6
ugaaaggagcgauug

SEQ ID NO: 4079543 - RNA, 22 nt, Streptococcus pneumoniae R6
ugaaaggauuggauccugcauu

SEQ ID NO: 4079544 - RNA, 21 nt, Streptococcus pneumoniae R6
ugaaagucuuggaaaauggua

SEQ ID NO: 4079545 - RNA, 14 nt, Streptococcus pneumoniae R6
ugaaagugaaaaag

SEQ ID NO: 4079546 - RNA, 17 nt, Streptococcus pneumoniae R6
ugaaagugaaaaaguaa

SEQ ID NO: 4079547 - RNA, 19 nt, Streptococcus pneumoniae R6
ugaaagugaaaaaguaaga

SEQ ID NO: 4079548 - RNA, 22 nt, Streptococcus pneumoniae R6
ugaaagugagaagcccaguacu

SEQ ID NO: 4079549 - RNA, 21 nt, Streptococcus pneumoniae R6
ugaaagugggcugauuuugaa

SEQ ID NO: 4079550 - RNA, 23 nt, Streptococcus pneumoniae R6
ugaaagugggcugauuuugaaaa

SEQ ID NO: 4079551 - RNA, 16 nt, Streptococcus pneumoniae R6
ugaaaguuuaucucuu

SEQ ID NO: 4079552 - RNA, 15 nt, Streptococcus pneumoniae R6
ugaaauaaaaugcug

SEQ ID NO: 4079553 - RNA, 23 nt, Streptococcus pneumoniae R6
ugaaauaacucauaauagucucu

SEQ ID NO: 4079554 - RNA, 13 nt, Streptococcus pneumoniae R6
ugaaauaagaaau

SEQ ID NO: 4079555 - RNA, 21 nt, Streptococcus pneumoniae R6
ugaaauaagauaugaacaaau

SEQ ID NO: 4079556 - RNA, 15 nt, Streptococcus pneumoniae R6
ugaaauaagauguga

SEQ ID NO: 4079557 - RNA, 21 nt, Streptococcus pneumoniae R6
ugaaauaagaugugaacaucu

SEQ ID NO: 4079558 - RNA, 17 nt, Streptococcus pneumoniae R6
ugaaauaagggcaaaga

SEQ ID NO: 4079559 - RNA, 20 nt, Streptococcus pneumoniae R6
ugaaauaagggcaaagaaaa

SEQ ID NO: 4079560 - RNA, 17 nt, Streptococcus pneumoniae R6
ugaaauaauaacaggac

SEQ ID NO: 4079561 - RNA, 19 nt, Streptococcus pneumoniae R6
ugaaauaauaacaggacaa

SEQ ID NO: 4079562 - RNA, 21 nt, Streptococcus pneumoniae R6
ugaaauaauaacaggacaaau

SEQ ID NO: 4079563 - RNA, 21 nt, Streptococcus pneumoniae R6
ugaaauaauacucaaugaaaa

SEQ ID NO: 4079564 - RNA, 15 nt, Streptococcus pneumoniae R6
ugaaauacuaaaaaa

SEQ ID NO: 4079565 - RNA, 16 nt, Streptococcus pneumoniae R6
ugaaauacuaaaaaaa

SEQ ID NO: 4079566 - RNA, 18 nt, Streptococcus pneumoniae R6
ugaaauauaauagauuga

SEQ ID NO: 4079567 - RNA, 14 nt, Streptococcus pneumoniae R6
ugaaauauuuuuua

SEQ ID NO: 4079568 - RNA, 15 nt, Streptococcus pneumoniae R6
ugaaaucagaaaaaa

SEQ ID NO: 4079569 - RNA, 17 nt, Streptococcus pneumoniae R6
ugaaaugaaauaaaauu

SEQ ID NO: 4079570 - RNA, 22 nt, Streptococcus pneumoniae R6
ugaaaugaccugcauacguuca

SEQ ID NO: 4079571 - RNA, 19 nt, Streptococcus pneumoniae R6
ugaaaugguguauuaucaa

SEQ ID NO: 4079572 - RNA, 15 nt, Streptococcus pneumoniae R6
ugaaauguuccaagu

SEQ ID NO: 4079573 - RNA, 15 nt, Streptococcus pneumoniae R6
ugaaauuaaauauga

SEQ ID NO: 4079574 - RNA, 19 nt, Streptococcus pneumoniae R6
ugaaauuccucuaguuggu

SEQ ID NO: 4079575 - RNA, 20 nt, Streptococcus pneumoniae R6
ugaaauuccucuaguuggua

SEQ ID NO: 4079576 - RNA, 23 nt, Streptococcus pneumoniae R6
ugaaauuggaguguguccaugug

SEQ ID NO: 4079577 - RNA, 20 nt, Streptococcus pneumoniae R6
ugaaauuguucacgauuggg

SEQ ID NO: 4079578 - RNA, 16 nt, Streptococcus pneumoniae R6
ugaaauuuaaaaagaa

SEQ ID NO: 4079579 - RNA, 17 nt, Streptococcus pneumoniae R6
ugaaauuuaaaaagaaa

SEQ ID NO: 4079580 - RNA, 12 nt, Streptococcus pneumoniae R6
ugaacaaaauua

SEQ ID NO: 4079581 - RNA, 22 nt, Streptococcus pneumoniae R6
ugaacaaaauuaucaacugaga

SEQ ID NO: 4079582 - RNA, 12 nt, Streptococcus pneumoniae R6
ugaacaaauuaa

SEQ ID NO: 4079583 - RNA, 17 nt, Streptococcus pneumoniae R6
ugaacaagccuagucuu

SEQ ID NO: 4079584 - RNA, 16 nt, Streptococcus pneumoniae R6
ugaacaaggacagcaa

SEQ ID NO: 4079585 - RNA, 14 nt, Streptococcus pneumoniae R6
ugaacacaguguac

SEQ ID NO: 4079586 - RNA, 20 nt, Streptococcus pneumoniae R6
ugaacaucucuaucaggaaa

SEQ ID NO: 4079587 - RNA, 23 nt, Streptococcus pneumoniae R6
ugaacauuuuccgagacagagac

SEQ ID NO: 4079588 - RNA, 19 nt, Streptococcus pneumoniae R6
ugaaccucuucauucaaag

SEQ ID NO: 4079589 - RNA, 13 nt, Streptococcus pneumoniae R6
ugaaccugcuuua

SEQ ID NO: 4079590 - RNA, 22 nt, Streptococcus pneumoniae R6
ugaaccuuucuucauagcagca

SEQ ID NO: 4079591 - RNA, 23 nt, Streptococcus pneumoniae R6
ugaacgacaugcguuaaaaguua

SEQ ID NO: 4079592 - RNA, 19 nt, Streptococcus pneumoniae R6
ugaacggagauaguaccau

SEQ ID NO: 4079593 - RNA, 20 nt, Streptococcus pneumoniae R6
ugaacggagauaguaccauu

SEQ ID NO: 4079594 - RNA, 15 nt, Streptococcus pneumoniae R6
ugaacuauuuuauuu

SEQ ID NO: 4079595 - RNA, 18 nt, Streptococcus pneumoniae R6
ugaacugcauuuuuucau

SEQ ID NO: 4079596 - RNA, 20 nt, Streptococcus pneumoniae R6
ugaacugcauuuuuucauug

SEQ ID NO: 4079597 - RNA, 13 nt, Streptococcus pneumoniae R6
ugaacuuuagaaa

SEQ ID NO: 4079598 - RNA, 22 nt, Streptococcus pneumoniae R6
ugaacuuucgaaugguguuaau

SEQ ID NO: 4079599 - RNA, 19 nt, Streptococcus pneumoniae R6
ugaagaaagcgaagaucua

SEQ ID NO: 4079600 - RNA, 19 nt, Streptococcus pneumoniae R6
ugaagacaucauauaaaua

SEQ ID NO: 4079601 - RNA, 22 nt, Streptococcus pneumoniae R6
ugaagaccacgaugaugauugg

SEQ ID NO: 4079602 - RNA, 16 nt, Streptococcus pneumoniae R6
ugaagacuuuuuaaag

SEQ ID NO: 4079603 - RNA, 16 nt, Streptococcus pneumoniae R6
ugaagaguauaagucu

SEQ ID NO: 4079604 - RNA, 18 nt, Streptococcus pneumoniae R6
ugaagaguauuauucuuc

SEQ ID NO: 4079605 - RNA, 18 nt, Streptococcus pneumoniae R6
ugaagauugauaaaggca

SEQ ID NO: 4079606 - RNA, 21 nt, Streptococcus pneumoniae R6
ugaagcaaaucaacuggcauc

SEQ ID NO: 4079607 - RNA, 21 nt, Streptococcus pneumoniae R6
ugaagccuucuccuaggauuu

SEQ ID NO: 4079608 - RNA, 18 nt, Streptococcus pneumoniae R6
ugaagcuuuauugucucu

SEQ ID NO: 4079609 - RNA, 17 nt, Streptococcus pneumoniae R6
ugaaggaacuaacucau

SEQ ID NO: 4079610 - RNA, 21 nt, Streptococcus pneumoniae R6
ugaaggaacuaacucaucaaa

SEQ ID NO: 4079611 - RNA, 14 nt, Streptococcus pneumoniae R6
ugaaggaggagcuu

SEQ ID NO: 4079612 - RNA, 18 nt, Streptococcus pneumoniae R6
ugaaggcuuuaaaugcug

SEQ ID NO: 4079613 - RNA, 14 nt, Streptococcus pneumoniae R6
ugaaggucuucuug

SEQ ID NO: 4079614 - RNA, 15 nt, Streptococcus pneumoniae R6
ugaaggucuucuuga

SEQ ID NO: 4079615 - RNA, 13 nt, Streptococcus pneumoniae R6
ugaaguaaauauu

SEQ ID NO: 4079616 - RNA, 14 nt, Streptococcus pneumoniae R6
ugaaguaaauauuu

SEQ ID NO: 4079617 - RNA, 14 nt, Streptococcus pneumoniae R6
ugaaguaaauguga

SEQ ID NO: 4079618 - RNA, 17 nt, Streptococcus pneumoniae R6
ugaagucguguuuuuuc

SEQ ID NO: 4079619 - RNA, 16 nt, Streptococcus pneumoniae R6
ugaaguguuuuuucau

SEQ ID NO: 4079620 - RNA, 23 nt, Streptococcus pneumoniae R6
ugaaguuaaguuuuuugacuucu

SEQ ID NO: 4079621 - RNA, 18 nt, Streptococcus pneumoniae R6
ugaaguucacguaaauug

SEQ ID NO: 4079622 - RNA, 14 nt, Streptococcus pneumoniae R6
ugaaguucauuuuc

SEQ ID NO: 4079623 - RNA, 15 nt, Streptococcus pneumoniae R6
ugaaguucauuuucu

SEQ ID NO: 4079624 - RNA, 19 nt, Streptococcus pneumoniae R6
ugaaguuccucuuuuuccc

SEQ ID NO: 4079625 - RNA, 21 nt, Streptococcus pneumoniae R6
ugacuacauuuuuugaaauaa

SEQ ID NO: 4079626 - RNA, 16 nt, Streptococcus pneumoniae R6
ugacuagcaaucaaaa

SEQ ID NO: 4079627 - RNA, 20 nt, Streptococcus pneumoniae R6
ugacuagcaaucaaaauugu

SEQ ID NO: 4079628 - RNA, 21 nt, Streptococcus pneumoniae R6
ugacuauagcguuuugaaacu

SEQ ID NO: 4079629 - RNA, 18 nt, Streptococcus pneumoniae R6
ugacucguuacuauaaga

SEQ ID NO: 4079630 - RNA, 22 nt, Streptococcus pneumoniae R6
ugacugaaaguuuuccaaagga

SEQ ID NO: 4079631 - RNA, 20 nt, Streptococcus pneumoniae R6
ugacugacuaaaacuuguga

SEQ ID NO: 4079632 - RNA, 17 nt, Streptococcus pneumoniae R6
ugacugauggaaguaau

SEQ ID NO: 4079633 - RNA, 15 nt, Streptococcus pneumoniae R6
ugacuggccucugca

SEQ ID NO: 4079634 - RNA, 21 nt, Streptococcus pneumoniae R6
ugacugucaauauagagugac

SEQ ID NO: 4079635 - RNA, 19 nt, Streptococcus pneumoniae R6
ugacuuagccauguuuuuc

SEQ ID NO: 4079636 - RNA, 20 nt, Streptococcus pneumoniae R6
ugacuucaacccacuacagu

SEQ ID NO: 4079637 - RNA, 23 nt, Streptococcus pneumoniae R6
ugacuucauuauuaugaaaacca

SEQ ID NO: 4079638 - RNA, 17 nt, Streptococcus pneumoniae R6
ugacuucgucaguucca

SEQ ID NO: 4079639 - RNA, 22 nt, Streptococcus pneumoniae R6
ugacuucgucaguuccauccac

SEQ ID NO: 4079640 - RNA, 21 nt, Streptococcus pneumoniae R6
ugacuucgucaguucuaucca

SEQ ID NO: 4079641 - RNA, 22 nt, Streptococcus pneumoniae R6
ugacuucgucaguucuauccac

SEQ ID NO: 4079642 - RNA, 20 nt, Streptococcus pneumoniae R6
ugacuucgucaguucuaucu

SEQ ID NO: 4079643 - RNA, 15 nt, Streptococcus pneumoniae R6
ugacuucgucaguuu

SEQ ID NO: 4079644 - RNA, 17 nt, Streptococcus pneumoniae R6
ugacuucgucaguuuca

SEQ ID NO: 4079645 - RNA, 22 nt, Streptococcus pneumoniae R6
ugacuucgucaguuucaucuac

SEQ ID NO: 4079646 - RNA, 18 nt, Streptococcus pneumoniae R6
ugacuucuguaagucauu

SEQ ID NO: 4079647 - RNA, 21 nt, Streptococcus pneumoniae R6
ugacuucuguaagucauuuuc

SEQ ID NO: 4079648 - RNA, 19 nt, Streptococcus pneumoniae R6
ugacuugccuucaacaccg

SEQ ID NO: 4079649 - RNA, 16 nt, Streptococcus pneumoniae R6
ugacuuguguuuuucc

SEQ ID NO: 4079650 - RNA, 20 nt, Streptococcus pneumoniae R6
ugacuuuccacaauuuucau

SEQ ID NO: 4079651 - RNA, 21 nt, Streptococcus pneumoniae R6
ugacuuuccacaauuuucaua

SEQ ID NO: 4079652 - RNA, 13 nt, Streptococcus pneumoniae R6
ugacuuucuaauu

SEQ ID NO: 4079653 - RNA, 16 nt, Streptococcus pneumoniae R6
ugacuuucuaauuauu

SEQ ID NO: 4079654 - RNA, 20 nt, Streptococcus pneumoniae R6
ugacuuucuaauuauuucaa

SEQ ID NO: 4079655 - RNA, 13 nt, Streptococcus pneumoniae R6
ugacuuuucuaau

SEQ ID NO: 4079656 - RNA, 15 nt, Streptococcus pneumoniae R6
ugacuuuugaaaaaa

SEQ ID NO: 4079657 - RNA, 20 nt, Streptococcus pneumoniae R6
ugacuuuugaaaaaaauguc

SEQ ID NO: 4079658 - RNA, 22 nt, Streptococcus pneumoniae R6
ugagaaacagcuccugaaauaa

SEQ ID NO: 4079659 - RNA, 20 nt, Streptococcus pneumoniae R6
ugagaaacuuagcgaaauuc

SEQ ID NO: 4079660 - RNA, 20 nt, Streptococcus pneumoniae R6
ugagaaaguuaaaaaaacua

SEQ ID NO: 4079661 - RNA, 18 nt, Streptococcus pneumoniae R6
ugagaaaucguuucuaau

SEQ ID NO: 4079662 - RNA, 14 nt, Streptococcus pneumoniae R6
ugagaaauuucaac

SEQ ID NO: 4079663 - RNA, 20 nt, Streptococcus pneumoniae R6
ugagaaccucuguauaaaua

SEQ ID NO: 4079664 - RNA, 24 nt, Streptococcus pneumoniae R6
ugagaaccucuguauaaauagcua

SEQ ID NO: 4079665 - RNA, 13 nt, Streptococcus pneumoniae R6
ugagaagaacauu

SEQ ID NO: 4079666 - RNA, 17 nt, Streptococcus pneumoniae R6
ugagaagccaaaaucau

SEQ ID NO: 4079667 - RNA, 20 nt, Streptococcus pneumoniae R6
ugagaagcccaguacuagac

SEQ ID NO: 4079668 - RNA, 13 nt, Streptococcus pneumoniae R6
ugagaaggcuggu

SEQ ID NO: 4079669 - RNA, 17 nt, Streptococcus pneumoniae R6
ugagaauggccgcagca

SEQ ID NO: 4079670 - RNA, 13 nt, Streptococcus pneumoniae R6
ugagaauugcuuu

SEQ ID NO: 4079671 - RNA, 15 nt, Streptococcus pneumoniae R6
ugagaauugcuuuaa

SEQ ID NO: 4079672 - RNA, 19 nt, Streptococcus pneumoniae R6
ugagacagcauagaaguuu

SEQ ID NO: 4079673 - RNA, 16 nt, Streptococcus pneumoniae R6
ugagagcgacuuuuuc

SEQ ID NO: 4079674 - RNA, 22 nt, Streptococcus pneumoniae R6
ugagagcuuauuuuugcaagug

SEQ ID NO: 4079675 - RNA, 15 nt, Streptococcus pneumoniae R6
ugagauaauacaauu

SEQ ID NO: 4079676 - RNA, 12 nt, Streptococcus pneumoniae R6
ugagauacucca

SEQ ID NO: 4079677 - RNA, 18 nt, Streptococcus pneumoniae R6
ugagauacuccaaaacau

SEQ ID NO: 4079678 - RNA, 20 nt, Streptococcus pneumoniae R6
ugagauacuccaaaacaucu

SEQ ID NO: 4079679 - RNA, 13 nt, Streptococcus pneumoniae R6
ugagauauuucuu

SEQ ID NO: 4079680 - RNA, 19 nt, Streptococcus pneumoniae R6
ugagauauuucuucuuuuc

SEQ ID NO: 4079681 - RNA, 17 nt, Streptococcus pneumoniae R6
ugagaugagacagcaua

SEQ ID NO: 4079682 - RNA, 20 nt, Streptococcus pneumoniae R6
ugagauguccgccuuugaua

SEQ ID NO: 4079683 - RNA, 19 nt, Streptococcus pneumoniae R6
ugagauuauugguggcuuc

SEQ ID NO: 4079684 - RNA, 15 nt, Streptococcus pneumoniae R6
ugagauuggauuuuc

SEQ ID NO: 4079685 - RNA, 13 nt, Streptococcus pneumoniae R6
ugagcagaacaau

SEQ ID NO: 4079686 - RNA, 14 nt, Streptococcus pneumoniae R6
ugagcaucaggaaa

SEQ ID NO: 4079687 - RNA, 23 nt, Streptococcus pneumoniae R6
ugagcauguagucaaucaaaaug

SEQ ID NO: 4079688 - RNA, 20 nt, Streptococcus pneumoniae R6
ugagccacuauuuauuuaau

SEQ ID NO: 4079689 - RNA, 16 nt, Streptococcus pneumoniae R6
ugagccguuucuuugg

SEQ ID NO: 4079690 - RNA, 18 nt, Streptococcus pneumoniae R6
ugagccguuucuuuggga

SEQ ID NO: 4079691 - RNA, 14 nt, Streptococcus pneumoniae R6
ugagcgaaaucaac

SEQ ID NO: 4079692 - RNA, 13 nt, Streptococcus pneumoniae R6
ugagcgguuuuag

SEQ ID NO: 4079693 - RNA, 17 nt, Streptococcus pneumoniae R6
ugagcgucuuucuuauc

SEQ ID NO: 4079694 - RNA, 22 nt, Streptococcus pneumoniae R6
ugagcuaauuuugccaguuuug

SEQ ID NO: 4079695 - RNA, 23 nt, Streptococcus pneumoniae R6
ugagcuagggauuugauaagaau

SEQ ID NO: 4079696 - RNA, 15 nt, Streptococcus pneumoniae R6
ugagcucuuuuggga

SEQ ID NO: 4079697 - RNA, 14 nt, Streptococcus pneumoniae R6
ugagcuggaagaau

SEQ ID NO: 4079698 - RNA, 22 nt, Streptococcus pneumoniae R6
ugagcuggcucaucuggcuuuc

SEQ ID NO: 4079699 - RNA, 13 nt, Streptococcus pneumoniae R6
ugagcuuuaaaau

SEQ ID NO: 4079700 - RNA, 13 nt, Streptococcus pneumoniae R6
ugaggaaaucccu

SEQ ID NO: 4079701 - RNA, 22 nt, Streptococcus pneumoniae R6
ugaggaccagguuuuucaccag

SEQ ID NO: 4079702 - RNA, 19 nt, Streptococcus pneumoniae R6
ugaggcaacaaaguaacca

SEQ ID NO: 4079703 - RNA, 22 nt, Streptococcus pneumoniae R6
ugaggcugacgcgaucuggcag

SEQ ID NO: 4079704 - RNA, 21 nt, Streptococcus pneumoniae R6
ugagguugcagauaagacuga

SEQ ID NO: 4079705 - RNA, 16 nt, Streptococcus pneumoniae R6
ugagguuguagauaga

SEQ ID NO: 4079706 - RNA, 18 nt, Streptococcus pneumoniae R6
ugaguaacggcuuccugu

SEQ ID NO: 4079707 - RNA, 21 nt, Streptococcus pneumoniae R6
ugaguaacggcuuccugugcu

SEQ ID NO: 4079708 - RNA, 18 nt, Streptococcus pneumoniae R6
ugaguacggcaaggcaaa

SEQ ID NO: 4079709 - RNA, 15 nt, Streptococcus pneumoniae R6
ugaguacuugcugga

SEQ ID NO: 4079710 - RNA, 14 nt, Streptococcus pneumoniae R6
ugaguauaaaugga

SEQ ID NO: 4079711 - RNA, 22 nt, Streptococcus pneumoniae R6
ugaguaugaguuaccuaaauua

SEQ ID NO: 4079712 - RNA, 22 nt, Streptococcus pneumoniae R6
ugaguauuaauuaggaaagaau

SEQ ID NO: 4079713 - RNA, 13 nt, Streptococcus pneumoniae R6
ugaguauuuagca

SEQ ID NO: 4079714 - RNA, 19 nt, Streptococcus pneumoniae R6
ugagucagggaaaaaacuc

SEQ ID NO: 4079715 - RNA, 14 nt, Streptococcus pneumoniae R6
ugaguccgaaaaau

SEQ ID NO: 4079716 - RNA, 20 nt, Streptococcus pneumoniae R6
ugaguccgaaaaauuucuca

SEQ ID NO: 4079717 - RNA, 14 nt, Streptococcus pneumoniae R6
ugaguguaaaaaga

SEQ ID NO: 4079718 - RNA, 21 nt, Streptococcus pneumoniae R6
ugaguguaaaaagaaaguccu

SEQ ID NO: 4079719 - RNA, 20 nt, Streptococcus pneumoniae R6
ugaguguaaacugacaacuu

SEQ ID NO: 4079720 - RNA, 19 nt, Streptococcus pneumoniae R6
ugaguuaccuaaauuauga

SEQ ID NO: 4079721 - RNA, 21 nt, Streptococcus pneumoniae R6
ugaguucucguuuguuuuuuc

SEQ ID NO: 4079722 - RNA, 22 nt, Streptococcus pneumoniae R6
ugaguuguuuugucgcuuuuca

SEQ ID NO: 4079723 - RNA, 13 nt, Streptococcus pneumoniae R6
ugaguuucugcau

SEQ ID NO: 4079724 - RNA, 14 nt, Streptococcus pneumoniae R6
ugaguuuuaaucuc

SEQ ID NO: 4079725 - RNA, 15 nt, Streptococcus pneumoniae R6
ugaguuuucuugugu

SEQ ID NO: 4079726 - RNA, 22 nt, Streptococcus pneumoniae R6
ugaguuuucuuguguuuaaaua

SEQ ID NO: 4079727 - RNA, 23 nt, Streptococcus pneumoniae R6
ugauuucaauuuuaaauuuuucu

SEQ ID NO: 4079728 - RNA, 21 nt, Streptococcus pneumoniae R6
ugauuucauaagguaccuccu

SEQ ID NO: 4079729 - RNA, 18 nt, Streptococcus pneumoniae R6
ugauuuccaaucuucucc

SEQ ID NO: 4079730 - RNA, 15 nt, Streptococcus pneumoniae R6
ugauuucggccaauu

SEQ ID NO: 4079731 - RNA, 19 nt, Streptococcus pneumoniae R6
ugauuucuccgcuuccaga

SEQ ID NO: 4079732 - RNA, 11 nt, Streptococcus pneumoniae R6
ugauuucugga

SEQ ID NO: 4079733 - RNA, 18 nt, Streptococcus pneumoniae R6
ugauuucuggauuuccau

SEQ ID NO: 4079734 - RNA, 17 nt, Streptococcus pneumoniae R6
ugauuucuguaaaaaua

SEQ ID NO: 4079735 - RNA, 11 nt, Streptococcus pneumoniae R6
ugauuucuucu

SEQ ID NO: 4079736 - RNA, 17 nt, Streptococcus pneumoniae R6
ugauuucuucuggauga

SEQ ID NO: 4079737 - RNA, 22 nt, Streptococcus pneumoniae R6
ugauuugcaggcuguuuuggau

SEQ ID NO: 4079738 - RNA, 18 nt, Streptococcus pneumoniae R6
ugauuuggacuauucguu

SEQ ID NO: 4079739 - RNA, 19 nt, Streptococcus pneumoniae R6
ugauuugguugaagaggua

SEQ ID NO: 4079740 - RNA, 19 nt, Streptococcus pneumoniae R6
ugauuuguccaucuguaau

SEQ ID NO: 4079741 - RNA, 24 nt, Streptococcus pneumoniae R6
ugauuuguccaucuguaauaugaa

SEQ ID NO: 4079742 - RNA, 14 nt, Streptococcus pneumoniae R6
ugauuuuaaagaaa

SEQ ID NO: 4079743 - RNA, 15 nt, Streptococcus pneumoniae R6
ugauuuuaaagacuu

SEQ ID NO: 4079744 - RNA, 22 nt, Streptococcus pneumoniae R6
ugauuuuaaaugaguaugaaaa

SEQ ID NO: 4079745 - RNA, 15 nt, Streptococcus pneumoniae R6
ugauuuuauauaaaa

SEQ ID NO: 4079746 - RNA, 15 nt, Streptococcus pneumoniae R6
ugauuuucauugagu

SEQ ID NO: 4079747 - RNA, 22 nt, Streptococcus pneumoniae R6
ugauuuucauugaguaugaaau

SEQ ID NO: 4079748 - RNA, 18 nt, Streptococcus pneumoniae R6
ugauuuugagacuaagga

SEQ ID NO: 4079749 - RNA, 18 nt, Streptococcus pneumoniae R6
ugauuuuguaaaaauaga

SEQ ID NO: 4079750 - RNA, 23 nt, Streptococcus pneumoniae R6
ugauuuugugcucuuaaacaaga

SEQ ID NO: 4079751 - RNA, 13 nt, Streptococcus pneumoniae R6
ugauuuuuuacug

SEQ ID NO: 4079752 - RNA, 19 nt, Streptococcus pneumoniae R6
ugauuuuuucauagcacua

SEQ ID NO: 4079753 - RNA, 19 nt, Streptococcus pneumoniae R6
ugauuuuuucauucgcaaa

SEQ ID NO: 4079754 - RNA, 11 nt, Streptococcus pneumoniae R6
ugcaaaaaaac

SEQ ID NO: 4079755 - RNA, 13 nt, Streptococcus pneumoniae R6
ugcaaaagucagg

SEQ ID NO: 4079756 - RNA, 19 nt, Streptococcus pneumoniae R6
ugcaaacggaucaagccac

SEQ ID NO: 4079757 - RNA, 12 nt, Streptococcus pneumoniae R6
ugcaaacuuuuu

SEQ ID NO: 4079758 - RNA, 21 nt, Streptococcus pneumoniae R6
ugcaaagacagggccuuagca

SEQ ID NO: 4079759 - RNA, 14 nt, Streptococcus pneumoniae R6
ugcaaagaugauga

SEQ ID NO: 4079760 - RNA, 17 nt, Streptococcus pneumoniae R6
ugcaaaguaaaguaagg

SEQ ID NO: 4079761 - RNA, 24 nt, Streptococcus pneumoniae R6
ugcaaaguauuccaccauucuuuc

SEQ ID NO: 4079762 - RNA, 16 nt, Streptococcus pneumoniae R6
ugcaaauuauuuacag

SEQ ID NO: 4079763 - RNA, 16 nt, Streptococcus pneumoniae R6
ugcaacaacagcuguc

SEQ ID NO: 4079764 - RNA, 22 nt, Streptococcus pneumoniae R6
ugcaacaacagcugucgcaccu

SEQ ID NO: 4079765 - RNA, 15 nt, Streptococcus pneumoniae R6
ugcaaccucaaaaca

SEQ ID NO: 4079766 - RNA, 17 nt, Streptococcus pneumoniae R6
ugcaaccucaaaacagu

SEQ ID NO: 4079767 - RNA, 19 nt, Streptococcus pneumoniae R6
ugcaaccucuacaauaaca

SEQ ID NO: 4079768 - RNA, 15 nt, Streptococcus pneumoniae R6
ugcaaccuuaaaaca

SEQ ID NO: 4079769 - RNA, 15 nt, Streptococcus pneumoniae R6
ugcaagaaaguagag

SEQ ID NO: 4079770 - RNA, 11 nt, Streptococcus pneumoniae R6
ugcaagacaca

SEQ ID NO: 4079771 - RNA, 19 nt, Streptococcus pneumoniae R6
ugcaagagggcuucaaucu

SEQ ID NO: 4079772 - RNA, 14 nt, Streptococcus pneumoniae R6
ugcaagauauucau

SEQ ID NO: 4079773 - RNA, 16 nt, Streptococcus pneumoniae R6
ugcaagcccuuauuuc

SEQ ID NO: 4079774 - RNA, 16 nt, Streptococcus pneumoniae R6
ugcaaggcaagacuga

SEQ ID NO: 4079775 - RNA, 17 nt, Streptococcus pneumoniae R6
ugcaaggcaagacugac

SEQ ID NO: 4079776 - RNA, 12 nt, Streptococcus pneumoniae R6
ugcaaggcaaug

SEQ ID NO: 4079777 - RNA, 19 nt, Streptococcus pneumoniae R6
ugcaaggcauaaacuugca

SEQ ID NO: 4079778 - RNA, 15 nt, Streptococcus pneumoniae R6
ugcaaguagaacgcu

SEQ ID NO: 4079779 - RNA, 14 nt, Streptococcus pneumoniae R6
ugcaaguccagaac

SEQ ID NO: 4079780 - RNA, 21 nt, Streptococcus pneumoniae R6
ugcaaguucuucucuuuucuu

SEQ ID NO: 4079781 - RNA, 22 nt, Streptococcus pneumoniae R6
ugcaaguucuucucuuuucuua

SEQ ID NO: 4079782 - RNA, 16 nt, Streptococcus pneumoniae R6
ugcaaucaaguaacuu

SEQ ID NO: 4079783 - RNA, 19 nt, Streptococcus pneumoniae R6
ugcaaucauuucaaagccu

SEQ ID NO: 4079784 - RNA, 23 nt, Streptococcus pneumoniae R6
ugcaaucucuguuaagaaauaaa

SEQ ID NO: 4079785 - RNA, 16 nt, Streptococcus pneumoniae R6
ugcaaugagccaagga

SEQ ID NO: 4079786 - RNA, 22 nt, Streptococcus pneumoniae R6
ugcaauucuuuagcagaugcuu

SEQ ID NO: 4079787 - RNA, 15 nt, Streptococcus pneumoniae R6
ugcaauuuaucaguu

SEQ ID NO: 4079788 - RNA, 20 nt, Streptococcus pneumoniae R6
ugcaauuuaucaguuaucuu

SEQ ID NO: 4079789 - RNA, 19 nt, Streptococcus pneumoniae R6
ugcacaaagaaccaguacu

SEQ ID NO: 4079790 - RNA, 23 nt, Streptococcus pneumoniae R6
ugcacaauauagccuaagacaac

SEQ ID NO: 4079791 - RNA, 16 nt, Streptococcus pneumoniae R6
ugcacacgaaucugau

SEQ ID NO: 4079792 - RNA, 21 nt, Streptococcus pneumoniae R6
ugcacacucagaacccuuauu

SEQ ID NO: 4079793 - RNA, 23 nt, Streptococcus pneumoniae R6
ugcaccaccgauauggccugcua

SEQ ID NO: 4079794 - RNA, 14 nt, Streptococcus pneumoniae R6
ugcacggacuucug

SEQ ID NO: 4079795 - RNA, 18 nt, Streptococcus pneumoniae R6
ugcacggguuuaacuaaa

SEQ ID NO: 4079796 - RNA, 16 nt, Streptococcus pneumoniae R6
ugcacuuuccucuuga

SEQ ID NO: 4079797 - RNA, 16 nt, Streptococcus pneumoniae R6
ugcacuuugauuuuua

SEQ ID NO: 4079798 - RNA, 12 nt, Streptococcus pneumoniae R6
ugcagaaggcuu

SEQ ID NO: 4079799 - RNA, 17 nt, Streptococcus pneumoniae R6
ugcagaaggcuuucuaa

SEQ ID NO: 4079800 - RNA, 18 nt, Streptococcus pneumoniae R6
ugcagaauacucuuucag

SEQ ID NO: 4079801 - RNA, 14 nt, Streptococcus pneumoniae R6
ugcagauaaagcug

SEQ ID NO: 4079802 - RNA, 14 nt, Streptococcus pneumoniae R6
ugcagaugaaagcu

SEQ ID NO: 4079803 - RNA, 22 nt, Streptococcus pneumoniae R6
ugcagcaacgucuucaauacca

SEQ ID NO: 4079804 - RNA, 16 nt, Streptococcus pneumoniae R6
ugcagcugaggaaauc

SEQ ID NO: 4079805 - RNA, 15 nt, Streptococcus pneumoniae R6
ugcagcugcggcuuu

SEQ ID NO: 4079806 - RNA, 20 nt, Streptococcus pneumoniae R6
ugcagcugcggcuuuuucuu

SEQ ID NO: 4079807 - RNA, 19 nt, Streptococcus pneumoniae R6
ugcaggcugcucaaaacac

SEQ ID NO: 4079808 - RNA, 15 nt, Streptococcus pneumoniae R6
ugcagucuuuuugcu

SEQ ID NO: 4079809 - RNA, 14 nt, Streptococcus pneumoniae R6
ugcaguuuucauuc

SEQ ID NO: 4079810 - RNA, 20 nt, Streptococcus pneumoniae R6
ugcaguuuucauucuacuau

SEQ ID NO: 4079811 - RNA, 14 nt, Streptococcus pneumoniae R6
ugcauaauuuccau

SEQ ID NO: 4079812 - RNA, 14 nt, Streptococcus pneumoniae R6
ugcaucaaaucacg

SEQ ID NO: 4079813 - RNA, 19 nt, Streptococcus pneumoniae R6
ugcaucaacuauucuuuuu

SEQ ID NO: 4079814 - RNA, 23 nt, Streptococcus pneumoniae R6
ugcaucagaugggucaagauuuc

SEQ ID NO: 4079815 - RNA, 18 nt, Streptococcus pneumoniae R6
ugcaucguggaucauggu

SEQ ID NO: 4079816 - RNA, 17 nt, Streptococcus pneumoniae R6
ugcaucguucaauggaa

SEQ ID NO: 4079817 - RNA, 19 nt, Streptococcus pneumoniae R6
ugcaucugccagaaauucc

SEQ ID NO: 4079818 - RNA, 22 nt, Streptococcus pneumoniae R6
ugcaucugcguuaacuucaaga

SEQ ID NO: 4079819 - RNA, 21 nt, Streptococcus pneumoniae R6
ugcauguaucacaguaaguac

SEQ ID NO: 4079820 - RNA, 11 nt, Streptococcus pneumoniae R6
ugcauuaaaaa

SEQ ID NO: 4079821 - RNA, 19 nt, Streptococcus pneumoniae R6
ugcauuauccauaauaaua

SEQ ID NO: 4079822 - RNA, 16 nt, Streptococcus pneumoniae R6
ugcauuuagauaguac

SEQ ID NO: 4079823 - RNA, 19 nt, Streptococcus pneumoniae R6
ugcauuuagauaguaccaa

SEQ ID NO: 4079824 - RNA, 21 nt, Streptococcus pneumoniae R6
ugcauuuagauaguaccaagu

SEQ ID NO: 4079825 - RNA, 20 nt, Streptococcus pneumoniae R6
ugccaauugcucaacuucuu

SEQ ID NO: 4079826 - RNA, 15 nt, Streptococcus pneumoniae R6
ugccaccucaaaacg

SEQ ID NO: 4079827 - RNA, 21 nt, Streptococcus pneumoniae R6
ugccagaaaaagucaauaaua

SEQ ID NO: 4079828 - RNA, 21 nt, Streptococcus pneumoniae R6
ugccagauggacugaccaccu

SEQ ID NO: 4079829 - RNA, 19 nt, Streptococcus pneumoniae R6
ugcucugccagcugagcua

SEQ ID NO: 4079830 - RNA, 16 nt, Streptococcus pneumoniae R6
ugcucuuaucuguccu

SEQ ID NO: 4079831 - RNA, 23 nt, Streptococcus pneumoniae R6
ugcucuucauuggacaaguuagc

SEQ ID NO: 4079832 - RNA, 19 nt, Streptococcus pneumoniae R6
ugcucuuugaaacggagga

SEQ ID NO: 4079833 - RNA, 17 nt, Streptococcus pneumoniae R6
ugcucuuugauuuucau

SEQ ID NO: 4079834 - RNA, 18 nt, Streptococcus pneumoniae R6
ugcucuuugauuuucauu

SEQ ID NO: 4079835 - RNA, 20 nt, Streptococcus pneumoniae R6
ugcugaaaugguguauuauc

SEQ ID NO: 4079836 - RNA, 15 nt, Streptococcus pneumoniae R6
ugcugacaaagagau

SEQ ID NO: 4079837 - RNA, 19 nt, Streptococcus pneumoniae R6
ugcugacgugguuugaaga

SEQ ID NO: 4079838 - RNA, 15 nt, Streptococcus pneumoniae R6
ugcugacugauuuac

SEQ ID NO: 4079839 - RNA, 16 nt, Streptococcus pneumoniae R6
ugcuggcagaaacugu

SEQ ID NO: 4079840 - RNA, 21 nt, Streptococcus pneumoniae R6
ugcuggcagaaacuguccgag

SEQ ID NO: 4079841 - RNA, 21 nt, Streptococcus pneumoniae R6
ugcuggcggaaguuggucucc

SEQ ID NO: 4079842 - RNA, 17 nt, Streptococcus pneumoniae R6
ugcugggucaaacggcc

SEQ ID NO: 4079843 - RNA, 18 nt, Streptococcus pneumoniae R6
ugcuguccucaaaaugaa

SEQ ID NO: 4079844 - RNA, 15 nt, Streptococcus pneumoniae R6
ugcuguuuauaucua

SEQ ID NO: 4079845 - RNA, 18 nt, Streptococcus pneumoniae R6
ugcuuaaauaggccucuu

SEQ ID NO: 4079846 - RNA, 21 nt, Streptococcus pneumoniae R6
ugcuuacaugcguuucagcau

SEQ ID NO: 4079847 - RNA, 18 nt, Streptococcus pneumoniae R6
ugcuuagaaccgaaaauc

SEQ ID NO: 4079848 - RNA, 19 nt, Streptococcus pneumoniae R6
ugcuuauuucacauuuuca

SEQ ID NO: 4079849 - RNA, 21 nt, Streptococcus pneumoniae R6
ugcuucaucauuuuauucaua

SEQ ID NO: 4079850 - RNA, 16 nt, Streptococcus pneumoniae R6
ugcuuccaaaaauucu

SEQ ID NO: 4079851 - RNA, 14 nt, Streptococcus pneumoniae R6
ugcuuccauuucca

SEQ ID NO: 4079852 - RNA, 16 nt, Streptococcus pneumoniae R6
ugcuucccauuuaggc

SEQ ID NO: 4079853 - RNA, 18 nt, Streptococcus pneumoniae R6
ugcuucgauaacaagguu

SEQ ID NO: 4079854 - RNA, 22 nt, Streptococcus pneumoniae R6
ugcuucgauaacaagguuaguc

SEQ ID NO: 4079855 - RNA, 16 nt, Streptococcus pneumoniae R6
ugcuucuguugucaaa

SEQ ID NO: 4079856 - RNA, 12 nt, Streptococcus pneumoniae R6
ugcuugaaaacu

SEQ ID NO: 4079857 - RNA, 15 nt, Streptococcus pneumoniae R6
ugcuugaauucccuu

SEQ ID NO: 4079858 - RNA, 16 nt, Streptococcus pneumoniae R6
ugcuugauuaagggca

SEQ ID NO: 4079859 - RNA, 17 nt, Streptococcus pneumoniae R6
ugcuugggaaugaugac

SEQ ID NO: 4079860 - RNA, 15 nt, Streptococcus pneumoniae R6
ugcuugucaucuucc

SEQ ID NO: 4079861 - RNA, 17 nt, Streptococcus pneumoniae R6
ugcuugugaucaauuca

SEQ ID NO: 4079862 - RNA, 22 nt, Streptococcus pneumoniae R6
ugcuuuaguaccagcucguucu

SEQ ID NO: 4079863 - RNA, 18 nt, Streptococcus pneumoniae R6
ugcuuucaaaaagcauuc

SEQ ID NO: 4079864 - RNA, 20 nt, Streptococcus pneumoniae R6
ugcuuucaauuguuuauaaa

SEQ ID NO: 4079865 - RNA, 21 nt, Streptococcus pneumoniae R6
ugcuuuccauuaauucgauuu

SEQ ID NO: 4079866 - RNA, 20 nt, Streptococcus pneumoniae R6
ugcuuuccucagcaggagca

SEQ ID NO: 4079867 - RNA, 15 nt, Streptococcus pneumoniae R6
ugcuuuccuucauac

SEQ ID NO: 4079868 - RNA, 17 nt, Streptococcus pneumoniae R6
ugcuuuccuuucaaaau

SEQ ID NO: 4079869 - RNA, 22 nt, Streptococcus pneumoniae R6
ugcuuucgcgauugauuuccaa

SEQ ID NO: 4079870 - RNA, 20 nt, Streptococcus pneumoniae R6
ugcuuucugcaguuucucua

SEQ ID NO: 4079871 - RNA, 14 nt, Streptococcus pneumoniae R6
ugcuuucuucagau

SEQ ID NO: 4079872 - RNA, 21 nt, Streptococcus pneumoniae R6
ugcuuugagaucuuuuucgcu

SEQ ID NO: 4079873 - RNA, 17 nt, Streptococcus pneumoniae R6
ugcuuugagcaaccugc

SEQ ID NO: 4079874 - RNA, 11 nt, Streptococcus pneumoniae R6
ugcuuugaggu

SEQ ID NO: 4079875 - RNA, 17 nt, Streptococcus pneumoniae R6
ugcuuugcugacuugcc

SEQ ID NO: 4079876 - RNA, 16 nt, Streptococcus pneumoniae R6
ugcuuugugucaucag

SEQ ID NO: 4079877 - RNA, 18 nt, Streptococcus pneumoniae R6
ugcuuuuacaauaucucc

SEQ ID NO: 4079878 - RNA, 24 nt, Streptococcus pneumoniae R6
ugcuuuucguacauaguuucauaa

SEQ ID NO: 4079879 - RNA, 15 nt, Streptococcus pneumoniae R6
ugcuuuuucaagcau

SEQ ID NO: 4079880 - RNA, 20 nt, Streptococcus pneumoniae R6
ugcuuuuucaaugcccuuga

SEQ ID NO: 4079881 - RNA, 14 nt, Streptococcus pneumoniae R6
ugcuuuuucuuuuu

SEQ ID NO: 4079882 - RNA, 15 nt, Streptococcus pneumoniae R6
ugcuuuuucuuuuua

SEQ ID NO: 4079883 - RNA, 15 nt, Streptococcus pneumoniae R6
uggaaaaaagucuuu

SEQ ID NO: 4079884 - RNA, 17 nt, Streptococcus pneumoniae R6
uggaaaaaauaaaaaaa

SEQ ID NO: 4079885 - RNA, 13 nt, Streptococcus pneumoniae R6
uggaaaaaaugaa

SEQ ID NO: 4079886 - RNA, 14 nt, Streptococcus pneumoniae R6
uggaaaaaaugaaa

SEQ ID NO: 4079887 - RNA, 14 nt, Streptococcus pneumoniae R6
uggaaaaaccuuca

SEQ ID NO: 4079888 - RNA, 17 nt, Streptococcus pneumoniae R6
uggaaaagcaagagcug

SEQ ID NO: 4079889 - RNA, 11 nt, Streptococcus pneumoniae R6
uggaaaauaaa

SEQ ID NO: 4079890 - RNA, 13 nt, Streptococcus pneumoniae R6
uggaaaccaagaa

SEQ ID NO: 4079891 - RNA, 22 nt, Streptococcus pneumoniae R6
uggaaacucucguaaacaaaga

SEQ ID NO: 4079892 - RNA, 23 nt, Streptococcus pneumoniae R6
uggaaacucucguaaacaaagag

SEQ ID NO: 4079893 - RNA, 23 nt, Streptococcus pneumoniae R6
uggaaaggauaugaggagaaaga

SEQ ID NO: 4079894 - RNA, 20 nt, Streptococcus pneumoniae R6
uggaaaugauaauugauuaa

SEQ ID NO: 4079895 - RNA, 17 nt, Streptococcus pneumoniae R6
uggaaauuauaaaacca

SEQ ID NO: 4079896 - RNA, 19 nt, Streptococcus pneumoniae R6
uggaacugacgaagucagc

SEQ ID NO: 4079897 - RNA, 14 nt, Streptococcus pneumoniae R6
uggaagaaugagug

SEQ ID NO: 4079898 - RNA, 21 nt, Streptococcus pneumoniae R6
uggaagaguauuacaaucaua

SEQ ID NO: 4079899 - RNA, 18 nt, Streptococcus pneumoniae R6
uggaaggcuguaguuuua

SEQ ID NO: 4079900 - RNA, 20 nt, Streptococcus pneumoniae R6
uggaaggcuugguccuuaac

SEQ ID NO: 4079901 - RNA, 20 nt, Streptococcus pneumoniae R6
uggaaguucuacgauuucag

SEQ ID NO: 4079902 - RNA, 13 nt, Streptococcus pneumoniae R6
uggaaguuucaaa

SEQ ID NO: 4079903 - RNA, 15 nt, Streptococcus pneumoniae R6
uggaaguuuuccuuu

SEQ ID NO: 4079904 - RNA, 22 nt, Streptococcus pneumoniae R6
uggaauaagguaauugaagagc

SEQ ID NO: 4079905 - RNA, 21 nt, Streptococcus pneumoniae R6
uggaauaguccucccuucuuu

SEQ ID NO: 4079906 - RNA, 19 nt, Streptococcus pneumoniae R6
uggaauaguugaaaucaag

SEQ ID NO: 4079907 - RNA, 17 nt, Streptococcus pneumoniae R6
uggaauauuuacuaauu

SEQ ID NO: 4079908 - RNA, 20 nt, Streptococcus pneumoniae R6
uggaaugacgaaacgaagaa

SEQ ID NO: 4079909 - RNA, 13 nt, Streptococcus pneumoniae R6
uggaauucuggau

SEQ ID NO: 4079910 - RNA, 15 nt, Streptococcus pneumoniae R6
uggacaacaaugaga

SEQ ID NO: 4079911 - RNA, 13 nt, Streptococcus pneumoniae R6
uggacaccgagaa

SEQ ID NO: 4079912 - RNA, 23 nt, Streptococcus pneumoniae R6
uggacaggguugguuaaaaguug

SEQ ID NO: 4079913 - RNA, 15 nt, Streptococcus pneumoniae R6
uggacguucuucaag

SEQ ID NO: 4079914 - RNA, 16 nt, Streptococcus pneumoniae R6
uggacguucuucaaga

SEQ ID NO: 4079915 - RNA, 20 nt, Streptococcus pneumoniae R6
uggacguucuucaagagcuu

SEQ ID NO: 4079916 - RNA, 21 nt, Streptococcus pneumoniae R6
uggacguuuucgagccaauac

SEQ ID NO: 4079917 - RNA, 20 nt, Streptococcus pneumoniae R6
uggacucacuaaaauucuau

SEQ ID NO: 4079918 - RNA, 17 nt, Streptococcus pneumoniae R6
uggacugaccaccugua

SEQ ID NO: 4079919 - RNA, 15 nt, Streptococcus pneumoniae R6
uggacuguuauagau

SEQ ID NO: 4079920 - RNA, 21 nt, Streptococcus pneumoniae R6
uggacuuuaucaccuccuucu

SEQ ID NO: 4079921 - RNA, 16 nt, Streptococcus pneumoniae R6
uggagacagcaccaac

SEQ ID NO: 4079922 - RNA, 24 nt, Streptococcus pneumoniae R6
uggagaguucacggauucucucag

SEQ ID NO: 4079923 - RNA, 18 nt, Streptococcus pneumoniae R6
uggagauuuuucaauaga

SEQ ID NO: 4079924 - RNA, 19 nt, Streptococcus pneumoniae R6
uggagcaagugguucucca

SEQ ID NO: 4079925 - RNA, 16 nt, Streptococcus pneumoniae R6
uggaggcaauggccug

SEQ ID NO: 4079926 - RNA, 19 nt, Streptococcus pneumoniae R6
uggagguguucuaucacau

SEQ ID NO: 4079927 - RNA, 15 nt, Streptococcus pneumoniae R6
uggaguaaaaaaaga

SEQ ID NO: 4079928 - RNA, 18 nt, Streptococcus pneumoniae R6
uggaguagcauccccagu

SEQ ID NO: 4079929 - RNA, 20 nt, Streptococcus pneumoniae R6
uggaguguucuaaaauaagu

SEQ ID NO: 4079930 - RNA, 15 nt, Streptococcus pneumoniae R6
uggaguucaccagua

SEQ ID NO: 4079931 - RNA, 23 nt, Streptococcus pneumoniae R6
ugggacuaaagauugagaaacua

SEQ ID NO: 4079932 - RNA, 22 nt, Streptococcus pneumoniae R6
ugggagaauuucauuuuauuau

SEQ ID NO: 4079933 - RNA, 21 nt, Streptococcus pneumoniae R6
ugggcuauuccauauucaauu

SEQ ID NO: 4079934 - RNA, 20 nt, Streptococcus pneumoniae R6
ugggcucccacuuucaaguc

SEQ ID NO: 4079935 - RNA, 15 nt, Streptococcus pneumoniae R6
ugggcugauuuugaa

SEQ ID NO: 4079936 - RNA, 14 nt, Streptococcus pneumoniae R6
ugggcuuacaucaa

SEQ ID NO: 4079937 - RNA, 22 nt, Streptococcus pneumoniae R6
ugggcuuacaucaaaaacaucu

SEQ ID NO: 4079938 - RNA, 14 nt, Streptococcus pneumoniae R6
ugggcuucuguaau

SEQ ID NO: 4079939 - RNA, 15 nt, Streptococcus pneumoniae R6
uggggucagaaagaa

SEQ ID NO: 4079940 - RNA, 14 nt, Streptococcus pneumoniae R6
uggguaaaggaaag

SEQ ID NO: 4079941 - RNA, 16 nt, Streptococcus pneumoniae R6
uggguacucuuuuuuc

SEQ ID NO: 4079942 - RNA, 14 nt, Streptococcus pneumoniae R6
uggguaucuuuauc

SEQ ID NO: 4079943 - RNA, 22 nt, Streptococcus pneumoniae R6
ugggucaaucuugucuaaaaau

SEQ ID NO: 4079944 - RNA, 14 nt, Streptococcus pneumoniae R6
ugggucucagucug

SEQ ID NO: 4079945 - RNA, 18 nt, Streptococcus pneumoniae R6
ugggugaaguguuuuuuc

SEQ ID NO: 4079946 - RNA, 12 nt, Streptococcus pneumoniae R6
uggguugaaaaa

SEQ ID NO: 4079947 - RNA, 19 nt, Streptococcus pneumoniae R6
uggguuucuucuagcuuca

SEQ ID NO: 4079948 - RNA, 20 nt, Streptococcus pneumoniae R6
ugguaaaagagcaagaacuu

SEQ ID NO: 4079949 - RNA, 12 nt, Streptococcus pneumoniae R6
ugguaacagucu

SEQ ID NO: 4079950 - RNA, 14 nt, Streptococcus pneumoniae R6
ugguaagaaguaac

SEQ ID NO: 4079951 - RNA, 15 nt, Streptococcus pneumoniae R6
ugguaagaguugaaa

SEQ ID NO: 4079952 - RNA, 18 nt, Streptococcus pneumoniae R6
ugguaauaccuuuuauga

SEQ ID NO: 4079953 - RNA, 16 nt, Streptococcus pneumoniae R6
ugguacaguugggauu

SEQ ID NO: 4079954 - RNA, 21 nt, Streptococcus pneumoniae R6
ugguagggugaagaguugggu

SEQ ID NO: 4079955 - RNA, 20 nt, Streptococcus pneumoniae R6
ugguaguuuaccccaaauuc

SEQ ID NO: 4079956 - RNA, 19 nt, Streptococcus pneumoniae R6
ugguauacgaaaaauccac

SEQ ID NO: 4079957 - RNA, 23 nt, Streptococcus pneumoniae R6
ugguaucaaaggcaagacuuggu

SEQ ID NO: 4079958 - RNA, 17 nt, Streptococcus pneumoniae R6
ugguauccaaaacaacc

SEQ ID NO: 4079959 - RNA, 22 nt, Streptococcus pneumoniae R6
ugguaucugcuaaaacaaaauu

SEQ ID NO: 4079960 - RNA, 18 nt, Streptococcus pneumoniae R6
ugguaugaucuauuccua

SEQ ID NO: 4079961 - RNA, 19 nt, Streptococcus pneumoniae R6
ugguauguguauucgucca

SEQ ID NO: 4079962 - RNA, 22 nt, Streptococcus pneumoniae R6
ugguauucauuaagucaacauc

SEQ ID NO: 4079963 - RNA, 22 nt, Streptococcus pneumoniae R6
ugguauuuaaaaccuccaaagu

SEQ ID NO: 4079964 - RNA, 16 nt, Streptococcus pneumoniae R6
ugguauuuguaaaauu

SEQ ID NO: 4079965 - RNA, 14 nt, Streptococcus pneumoniae R6
ugguauuuuuucaa

SEQ ID NO: 4079966 - RNA, 19 nt, Streptococcus pneumoniae R6
uggucaauccgaguuuuuc

SEQ ID NO: 4079967 - RNA, 21 nt, Streptococcus pneumoniae R6
uggucaauccgaguuuuucag

SEQ ID NO: 4079968 - RNA, 19 nt, Streptococcus pneumoniae R6
uggucacauugaaaaugug

SEQ ID NO: 4079969 - RNA, 21 nt, Streptococcus pneumoniae R6
uggucacauugaaaaugugaa

SEQ ID NO: 4079970 - RNA, 19 nt, Streptococcus pneumoniae R6
uggucacuauggagaaucg

SEQ ID NO: 4079971 - RNA, 18 nt, Streptococcus pneumoniae R6
uggucagaggggugcuga

SEQ ID NO: 4079972 - RNA, 19 nt, Streptococcus pneumoniae R6
uggucagaggggugcugag

SEQ ID NO: 4079973 - RNA, 13 nt, Streptococcus pneumoniae R6
uggucagauugua

SEQ ID NO: 4079974 - RNA, 21 nt, Streptococcus pneumoniae R6
uggucagauuguaaaggauga

SEQ ID NO: 4079975 - RNA, 24 nt, Streptococcus pneumoniae R6
ugguccagcuucaaaucccaugua

SEQ ID NO: 4079976 - RNA, 16 nt, Streptococcus pneumoniae R6
uggucgauaucuucca

SEQ ID NO: 4079977 - RNA, 20 nt, Streptococcus pneumoniae R6
uggucggcucguccagcacu

SEQ ID NO: 4079978 - RNA, 16 nt, Streptococcus pneumoniae R6
uggucuagcaagaguu

SEQ ID NO: 4079979 - RNA, 19 nt, Streptococcus pneumoniae R6
uggucuagcuauuucuugc

SEQ ID NO: 4079980 - RNA, 15 nt, Streptococcus pneumoniae R6
uggucuauccagccu

SEQ ID NO: 4079981 - RNA, 16 nt, Streptococcus pneumoniae R6
uggucugauuuucauu

SEQ ID NO: 4079982 - RNA, 18 nt, Streptococcus pneumoniae R6
uggucuugcuuuuuuaua

SEQ ID NO: 4079983 - RNA, 15 nt, Streptococcus pneumoniae R6
uggugagauaaaacg

SEQ ID NO: 4079984 - RNA, 15 nt, Streptococcus pneumoniae R6
uggugccgaaacuuc

SEQ ID NO: 4079985 - RNA, 15 nt, Streptococcus pneumoniae R6
uggugcuaauucuuu

SEQ ID NO: 4079986 - RNA, 17 nt, Streptococcus pneumoniae R6
uggugcuagggcaagga

SEQ ID NO: 4079987 - RNA, 14 nt, Streptococcus pneumoniae R6
ugguguuucaaguc

SEQ ID NO: 4079988 - RNA, 13 nt, Streptococcus pneumoniae R6
ugguuaaaaguug

SEQ ID NO: 4079989 - RNA, 21 nt, Streptococcus pneumoniae R6
ugguuaaaauugcuuucuuca

SEQ ID NO: 4079990 - RNA, 13 nt, Streptococcus pneumoniae R6
ugguuaagugcau

SEQ ID NO: 4079991 - RNA, 21 nt, Streptococcus pneumoniae R6
ugguuaauguugguaagagaa

SEQ ID NO: 4079992 - RNA, 14 nt, Streptococcus pneumoniae R6
ugguuacugacuuc

SEQ ID NO: 4079993 - RNA, 18 nt, Streptococcus pneumoniae R6
ugguuagaaaaucaagua

SEQ ID NO: 4079994 - RNA, 23 nt, Streptococcus pneumoniae R6
ugguuaggugaauuagugaagug

SEQ ID NO: 4079995 - RNA, 16 nt, Streptococcus pneumoniae R6
ugguuccaauagucau

SEQ ID NO: 4079996 - RNA, 16 nt, Streptococcus pneumoniae R6
ugguuccacgacggac

SEQ ID NO: 4079997 - RNA, 20 nt, Streptococcus pneumoniae R6
ugguuccauuuaacaaacca

SEQ ID NO: 4079998 - RNA, 12 nt, Streptococcus pneumoniae R6
ugguugauuuac

SEQ ID NO: 4079999 - RNA, 13 nt, Streptococcus pneumoniae R6
ugguugggaaaau

SEQ ID NO: 4080000 - RNA, 14 nt, Streptococcus pneumoniae R6
ugguugucaaacca

SEQ ID NO: 4080001 - RNA, 23 nt, Streptococcus pneumoniae R6
ugguugucaaaccacaacgggca

SEQ ID NO: 4080002 - RNA, 17 nt, Streptococcus pneumoniae R6
ugguuguccauuugaaa

SEQ ID NO: 4080003 - RNA, 16 nt, Streptococcus pneumoniae R6
ugguuuaaaaagaguu

SEQ ID NO: 4080004 - RNA, 17 nt, Streptococcus pneumoniae R6
ugguuuuuaaggacuga

SEQ ID NO: 4080005 - RNA, 18 nt, Streptococcus pneumoniae R6
ugguuuuuaggcaauaaa

SEQ ID NO: 4080006 - RNA, 23 nt, Streptococcus pneumoniae R6
ugguuuuuaggcaauaaaauaug

SEQ ID NO: 4080007 - RNA, 12 nt, Streptococcus pneumoniae R6
ugguuuuuuaag

SEQ ID NO: 4080008 - RNA, 11 nt, Streptococcus pneumoniae R6
uguaaaaagaa

SEQ ID NO: 4080009 - RNA, 23 nt, Streptococcus pneumoniae R6
uguaaaaagagggauuuuguauu

SEQ ID NO: 4080010 - RNA, 21 nt, Streptococcus pneumoniae R6
uguaaaaucuuugcauuaucu

SEQ ID NO: 4080011 - RNA, 16 nt, Streptococcus pneumoniae R6
uguaaagaguacaguc

SEQ ID NO: 4080012 - RNA, 17 nt, Streptococcus pneumoniae R6
uguaaagcgaaaggaga

SEQ ID NO: 4080013 - RNA, 19 nt, Streptococcus pneumoniae R6
uguaaaggaugacaauagc

SEQ ID NO: 4080014 - RNA, 15 nt, Streptococcus pneumoniae R6
uguaaaguagcaaaa

SEQ ID NO: 4080015 - RNA, 21 nt, Streptococcus pneumoniae R6
uguaaaguuaauugaauuuca

SEQ ID NO: 4080016 - RNA, 22 nt, Streptococcus pneumoniae R6
uguaaaguuaauugaauuucaa

SEQ ID NO: 4080017 - RNA, 12 nt, Streptococcus pneumoniae R6
uguaaauagaaa

SEQ ID NO: 4080018 - RNA, 18 nt, Streptococcus pneumoniae R6
uguaaauagaaaccagcu

SEQ ID NO: 4080019 - RNA, 18 nt, Streptococcus pneumoniae R6
uguaaaucauuuucuuga

SEQ ID NO: 4080020 - RNA, 15 nt, Streptococcus pneumoniae R6
uguaaauuuauuggu

SEQ ID NO: 4080021 - RNA, 20 nt, Streptococcus pneumoniae R6
uguaacaucgaaguuguguu

SEQ ID NO: 4080022 - RNA, 20 nt, Streptococcus pneumoniae R6
uguaacccaaacaagccuuu

SEQ ID NO: 4080023 - RNA, 15 nt, Streptococcus pneumoniae R6
uguaacguucuucaa

SEQ ID NO: 4080024 - RNA, 22 nt, Streptococcus pneumoniae R6
uguaagaacuuuuuaaaguauu

SEQ ID NO: 4080025 - RNA, 13 nt, Streptococcus pneumoniae R6
uguaagauagaga

SEQ ID NO: 4080026 - RNA, 23 nt, Streptococcus pneumoniae R6
uguaagccauauuggaugaguuu

SEQ ID NO: 4080027 - RNA, 17 nt, Streptococcus pneumoniae R6
uguaagcuagcaacaga

SEQ ID NO: 4080028 - RNA, 13 nt, Streptococcus pneumoniae R6
uguaaggugcaaa

SEQ ID NO: 4080029 - RNA, 19 nt, Streptococcus pneumoniae R6
uguaagucauuuucuuuua

SEQ ID NO: 4080030 - RNA, 14 nt, Streptococcus pneumoniae R6
uguaagucugcuuu

SEQ ID NO: 4080031 - RNA, 20 nt, Streptococcus pneumoniae R6
uguaaguuucuucuuuagca

SEQ ID NO: 4080032 - RNA, 16 nt, Streptococcus pneumoniae R6
uguaaugaaauacuga

SEQ ID NO: 4080033 - RNA, 17 nt, Streptococcus pneumoniae R6
ugucuaaaaauuuaaaa

SEQ ID NO: 4080034 - RNA, 16 nt, Streptococcus pneumoniae R6
ugucuacauucuuuuu

SEQ ID NO: 4080035 - RNA, 20 nt, Streptococcus pneumoniae R6
ugucuagauucgaucugaua

SEQ ID NO: 4080036 - RNA, 14 nt, Streptococcus pneumoniae R6
ugucuauuugcuuu

SEQ ID NO: 4080037 - RNA, 15 nt, Streptococcus pneumoniae R6
ugucucgauuucucu

SEQ ID NO: 4080038 - RNA, 20 nt, Streptococcus pneumoniae R6
ugucucgcuccguuaggugc

SEQ ID NO: 4080039 - RNA, 23 nt, Streptococcus pneumoniae R6
ugucucugaaaacaaguucuuuu

SEQ ID NO: 4080040 - RNA, 22 nt, Streptococcus pneumoniae R6
ugucugaacugccccccaaaag

SEQ ID NO: 4080041 - RNA, 17 nt, Streptococcus pneumoniae R6
ugucuuaccacaaacaa

SEQ ID NO: 4080042 - RNA, 20 nt, Streptococcus pneumoniae R6
ugucuuacuugcguuucuuc

SEQ ID NO: 4080043 - RNA, 15 nt, Streptococcus pneumoniae R6
ugucuuauccaaacu

SEQ ID NO: 4080044 - RNA, 13 nt, Streptococcus pneumoniae R6
ugucuuauuucau

SEQ ID NO: 4080045 - RNA, 14 nt, Streptococcus pneumoniae R6
ugucuugacugcau

SEQ ID NO: 4080046 - RNA, 17 nt, Streptococcus pneumoniae R6
ugucuuggauuuuugau

SEQ ID NO: 4080047 - RNA, 15 nt, Streptococcus pneumoniae R6
ugucuugguauaucu

SEQ ID NO: 4080048 - RNA, 15 nt, Streptococcus pneumoniae R6
ugucuuuaguagucu

SEQ ID NO: 4080049 - RNA, 14 nt, Streptococcus pneumoniae R6
ugucuuugauuuac

SEQ ID NO: 4080050 - RNA, 14 nt, Streptococcus pneumoniae R6
ugucuuuuaaauau

SEQ ID NO: 4080051 - RNA, 14 nt, Streptococcus pneumoniae R6
ugucuuuucaaagu

SEQ ID NO: 4080052 - RNA, 23 nt, Streptococcus pneumoniae R6
ugugaaaaucauagagcaaacua

SEQ ID NO: 4080053 - RNA, 19 nt, Streptococcus pneumoniae R6
ugugaaagcucuucuaaaa

SEQ ID NO: 4080054 - RNA, 16 nt, Streptococcus pneumoniae R6
ugugaaauuugugaua

SEQ ID NO: 4080055 - RNA, 18 nt, Streptococcus pneumoniae R6
ugugaacaucucuaucag

SEQ ID NO: 4080056 - RNA, 23 nt, Streptococcus pneumoniae R6
ugugaacaucucuaucaggaaag

SEQ ID NO: 4080057 - RNA, 17 nt, Streptococcus pneumoniae R6
ugugaauauucuuggca

SEQ ID NO: 4080058 - RNA, 14 nt, Streptococcus pneumoniae R6
ugugaaucaucacu

SEQ ID NO: 4080059 - RNA, 18 nt, Streptococcus pneumoniae R6
ugugaaugccuguuccaa

SEQ ID NO: 4080060 - RNA, 23 nt, Streptococcus pneumoniae R6
ugugacacuagcuggugagaaga

SEQ ID NO: 4080061 - RNA, 23 nt, Streptococcus pneumoniae R6
ugugaccugcuuucugcaguuuc

SEQ ID NO: 4080062 - RNA, 20 nt, Streptococcus pneumoniae R6
ugugacuguuucagagacag

SEQ ID NO: 4080063 - RNA, 18 nt, Streptococcus pneumoniae R6
ugugagauaguaucaaau

SEQ ID NO: 4080064 - RNA, 13 nt, Streptococcus pneumoniae R6
ugugauaaaaugu

SEQ ID NO: 4080065 - RNA, 14 nt, Streptococcus pneumoniae R6
ugugauaaaaugua

SEQ ID NO: 4080066 - RNA, 20 nt, Streptococcus pneumoniae R6
ugugauaaaggccuuggccu

SEQ ID NO: 4080067 - RNA, 18 nt, Streptococcus pneumoniae R6
ugugauuucuaaaacauu

SEQ ID NO: 4080068 - RNA, 13 nt, Streptococcus pneumoniae R6
ugugauuuuaaau

SEQ ID NO: 4080069 - RNA, 12 nt, Streptococcus pneumoniae R6
ugugauuuuccu

SEQ ID NO: 4080070 - RNA, 16 nt, Streptococcus pneumoniae R6
ugugccacaauaccca

SEQ ID NO: 4080071 - RNA, 14 nt, Streptococcus pneumoniae R6
ugugccagccauaa

SEQ ID NO: 4080072 - RNA, 21 nt, Streptococcus pneumoniae R6
ugugccagccauaagcuacau

SEQ ID NO: 4080073 - RNA, 19 nt, Streptococcus pneumoniae R6
ugugccauuguuucguuuc

SEQ ID NO: 4080074 - RNA, 12 nt, Streptococcus pneumoniae R6
ugugccccugau

SEQ ID NO: 4080075 - RNA, 16 nt, Streptococcus pneumoniae R6
uguggaugaaacugac

SEQ ID NO: 4080076 - RNA, 15 nt, Streptococcus pneumoniae R6
uguggcuaucuguca

SEQ ID NO: 4080077 - RNA, 18 nt, Streptococcus pneumoniae R6
uguggcuaucugucacaa

SEQ ID NO: 4080078 - RNA, 20 nt, Streptococcus pneumoniae R6
ugugggaauguuugcuucau

SEQ ID NO: 4080079 - RNA, 13 nt, Streptococcus pneumoniae R6
uguggugcuucug

SEQ ID NO: 4080080 - RNA, 20 nt, Streptococcus pneumoniae R6
uguguaaaaaaguaaaaagg

SEQ ID NO: 4080081 - RNA, 11 nt, Streptococcus pneumoniae R6
uguguaaguga

SEQ ID NO: 4080082 - RNA, 17 nt, Streptococcus pneumoniae R6
uguguacuguucuaaau

SEQ ID NO: 4080083 - RNA, 23 nt, Streptococcus pneumoniae R6
uguguacuguucuaaauucagua

SEQ ID NO: 4080084 - RNA, 13 nt, Streptococcus pneumoniae R6
uguguauggagga

SEQ ID NO: 4080085 - RNA, 18 nt, Streptococcus pneumoniae R6
ugugucuugcauuuuaau

SEQ ID NO: 4080086 - RNA, 20 nt, Streptococcus pneumoniae R6
ugugugccaguugcuguaau

SEQ ID NO: 4080087 - RNA, 16 nt, Streptococcus pneumoniae R6
uguguuggguagcaua

SEQ ID NO: 4080088 - RNA, 19 nt, Streptococcus pneumoniae R6
uguuaaagccaucuaaaac

SEQ ID NO: 4080089 - RNA, 17 nt, Streptococcus pneumoniae R6
uguuaaaguuccggaaa

SEQ ID NO: 4080090 - RNA, 20 nt, Streptococcus pneumoniae R6
uguuaaaucauuauuuaacu

SEQ ID NO: 4080091 - RNA, 13 nt, Streptococcus pneumoniae R6
uguuaacccacuc

SEQ ID NO: 4080092 - RNA, 13 nt, Streptococcus pneumoniae R6
uguuaagaaauaa

SEQ ID NO: 4080093 - RNA, 17 nt, Streptococcus pneumoniae R6
uguuaagaaauaaaaua

SEQ ID NO: 4080094 - RNA, 16 nt, Streptococcus pneumoniae R6
uguuaagcguuuucua

SEQ ID NO: 4080095 - RNA, 20 nt, Streptococcus pneumoniae R6
uguuaagcuccaauuuauuu

SEQ ID NO: 4080096 - RNA, 17 nt, Streptococcus pneumoniae R6
uguuaagugcuucuuug

SEQ ID NO: 4080097 - RNA, 19 nt, Streptococcus pneumoniae R6
uguuaagugguugauaaau

SEQ ID NO: 4080098 - RNA, 20 nt, Streptococcus pneumoniae R6
uguuacacguacuuuaaaau

SEQ ID NO: 4080099 - RNA, 16 nt, Streptococcus pneumoniae R6
uguuacagacaaaacu

SEQ ID NO: 4080100 - RNA, 16 nt, Streptococcus pneumoniae R6
uguuaccacaggagcu

SEQ ID NO: 4080101 - RNA, 16 nt, Streptococcus pneumoniae R6
uguuaccugauaagau

SEQ ID NO: 4080102 - RNA, 19 nt, Streptococcus pneumoniae R6
uguuacugauuucgucagu

SEQ ID NO: 4080103 - RNA, 13 nt, Streptococcus pneumoniae R6
uguuagaaaaaug

SEQ ID NO: 4080104 - RNA, 20 nt, Streptococcus pneumoniae R6
uguuagaaaaaugcaaagac

SEQ ID NO: 4080105 - RNA, 14 nt, Streptococcus pneumoniae R6
uguuagaagacuuu

SEQ ID NO: 4080106 - RNA, 14 nt, Streptococcus pneumoniae R6
uguuagauuuauaa

SEQ ID NO: 4080107 - RNA, 22 nt, Streptococcus pneumoniae R6
uguuaguucuugaaaugaaguu

SEQ ID NO: 4080108 - RNA, 23 nt, Streptococcus pneumoniae R6
uguuauacauccguuuuucuccu

SEQ ID NO: 4080109 - RNA, 15 nt, Streptococcus pneumoniae R6
uguuauagaaguacu

SEQ ID NO: 4080110 - RNA, 20 nt, Streptococcus pneumoniae R6
uguuauagauucaauauacu

SEQ ID NO: 4080111 - RNA, 15 nt, Streptococcus pneumoniae R6
uguuauagguaaaau

SEQ ID NO: 4080112 - RNA, 18 nt, Streptococcus pneumoniae R6
uguuaucguuuuaucugc

SEQ ID NO: 4080113 - RNA, 19 nt, Streptococcus pneumoniae R6
uguuaucguuuuaucugca

SEQ ID NO: 4080114 - RNA, 13 nt, Streptococcus pneumoniae R6
uguuaucugaaaa

SEQ ID NO: 4080115 - RNA, 17 nt, Streptococcus pneumoniae R6
uguuaucuucgcaacug

SEQ ID NO: 4080116 - RNA, 18 nt, Streptococcus pneumoniae R6
uguuaugcaacuuuuuua

SEQ ID NO: 4080117 - RNA, 18 nt, Streptococcus pneumoniae R6
uguuauugaaacagcuaa

SEQ ID NO: 4080118 - RNA, 13 nt, Streptococcus pneumoniae R6
uguuauuuuucuu

SEQ ID NO: 4080119 - RNA, 16 nt, Streptococcus pneumoniae R6
uguuauuuuucuuuuu

SEQ ID NO: 4080120 - RNA, 19 nt, Streptococcus pneumoniae R6
uguucaaaaaccuugauuu

SEQ ID NO: 4080121 - RNA, 16 nt, Streptococcus pneumoniae R6
uguucaaagugguguu

SEQ ID NO: 4080122 - RNA, 16 nt, Streptococcus pneumoniae R6
uguucaauccacuugu

SEQ ID NO: 4080123 - RNA, 18 nt, Streptococcus pneumoniae R6
uguucaauccacuuguaa

SEQ ID NO: 4080124 - RNA, 19 nt, Streptococcus pneumoniae R6
uguucaauggguucaucuc

SEQ ID NO: 4080125 - RNA, 22 nt, Streptococcus pneumoniae R6
uguucacuuuuuguuuaauacu

SEQ ID NO: 4080126 - RNA, 22 nt, Streptococcus pneumoniae R6
uguucagagcgauaaaaauccu

SEQ ID NO: 4080127 - RNA, 18 nt, Streptococcus pneumoniae R6
uguucagguguuucuggu

SEQ ID NO: 4080128 - RNA, 22 nt, Streptococcus pneumoniae R6
uguucaucaucuagaugaauua

SEQ ID NO: 4080129 - RNA, 13 nt, Streptococcus pneumoniae R6
uguucaucauuaa

SEQ ID NO: 4080130 - RNA, 20 nt, Streptococcus pneumoniae R6
uguucaucuucuuucuccuu

SEQ ID NO: 4080131 - RNA, 20 nt, Streptococcus pneumoniae R6
uguucauguucgaucuaagg

SEQ ID NO: 4080132 - RNA, 19 nt, Streptococcus pneumoniae R6
uguuccaaagccacuugcg

SEQ ID NO: 4080133 - RNA, 20 nt, Streptococcus pneumoniae R6
uguuccaacauuguuuguac

SEQ ID NO: 4080134 - RNA, 16 nt, Streptococcus pneumoniae R6
uguuccaauugauuaa

SEQ ID NO: 4080135 - RNA, 12 nt, Streptococcus pneumoniae R6
uguuccagacuc

SEQ ID NO: 4080136 - RNA, 19 nt, Streptococcus pneumoniae R6
uuaaagacagucugaaaaa

SEQ ID NO: 4080137 - RNA, 21 nt, Streptococcus pneumoniae R6
uuaaagacagucugaaaaaga

SEQ ID NO: 4080138 - RNA, 17 nt, Streptococcus pneumoniae R6
uuaaagacuuuuuucca

SEQ ID NO: 4080139 - RNA, 22 nt, Streptococcus pneumoniae R6
uuaaagauuccuccgagaagua

SEQ ID NO: 4080140 - RNA, 13 nt, Streptococcus pneumoniae R6
uuaaagcaaauua

SEQ ID NO: 4080141 - RNA, 17 nt, Streptococcus pneumoniae R6
uuaaagccaucuaaaac

SEQ ID NO: 4080142 - RNA, 15 nt, Streptococcus pneumoniae R6
uuaaagcggucuuua

SEQ ID NO: 4080143 - RNA, 19 nt, Streptococcus pneumoniae R6
uuaaaguuaauagaagaac

SEQ ID NO: 4080144 - RNA, 20 nt, Streptococcus pneumoniae R6
uuaaaguuauuggaacuaaa

SEQ ID NO: 4080145 - RNA, 16 nt, Streptococcus pneumoniae R6
uuaaaguuuaacccac

SEQ ID NO: 4080146 - RNA, 13 nt, Streptococcus pneumoniae R6
uuaaauaaaucuc

SEQ ID NO: 4080147 - RNA, 14 nt, Streptococcus pneumoniae R6
uuaaauaauagaaa

SEQ ID NO: 4080148 - RNA, 15 nt, Streptococcus pneumoniae R6
uuaaauagaaaaaca

SEQ ID NO: 4080149 - RNA, 21 nt, Streptococcus pneumoniae R6
uuaaauagcguagucuuuuaa

SEQ ID NO: 4080150 - RNA, 16 nt, Streptococcus pneumoniae R6
uuaaauaguucuucca

SEQ ID NO: 4080151 - RNA, 18 nt, Streptococcus pneumoniae R6
uuaaauaugaacaaauca

SEQ ID NO: 4080152 - RNA, 16 nt, Streptococcus pneumoniae R6
uuaaaucauccauaua

SEQ ID NO: 4080153 - RNA, 20 nt, Streptococcus pneumoniae R6
uuaaauccgauaauauauag

SEQ ID NO: 4080154 - RNA, 17 nt, Streptococcus pneumoniae R6
uuaaaucgcuauaaaua

SEQ ID NO: 4080155 - RNA, 15 nt, Streptococcus pneumoniae R6
uuaaaucuuauauuu

SEQ ID NO: 4080156 - RNA, 21 nt, Streptococcus pneumoniae R6
uuaaauuauaaauuauuucuu

SEQ ID NO: 4080157 - RNA, 13 nt, Streptococcus pneumoniae R6
uuaaauucauuaa

SEQ ID NO: 4080158 - RNA, 14 nt, Streptococcus pneumoniae R6
uuaaauucauuaaa

SEQ ID NO: 4080159 - RNA, 20 nt, Streptococcus pneumoniae R6
uuaaauuuuauacaaauuaa

SEQ ID NO: 4080160 - RNA, 17 nt, Streptococcus pneumoniae R6
uuaaauuuuucugcaaa

SEQ ID NO: 4080161 - RNA, 19 nt, Streptococcus pneumoniae R6
uuaaauuuuucugcaaaaa

SEQ ID NO: 4080162 - RNA, 22 nt, Streptococcus pneumoniae R6
uuaaauuuuucugcaaaaaaua

SEQ ID NO: 4080163 - RNA, 14 nt, Streptococcus pneumoniae R6
uuaaauuuuuguuu

SEQ ID NO: 4080164 - RNA, 13 nt, Streptococcus pneumoniae R6
uuaacaaaaagaa

SEQ ID NO: 4080165 - RNA, 13 nt, Streptococcus pneumoniae R6
uuaacaaaaauuu

SEQ ID NO: 4080166 - RNA, 15 nt, Streptococcus pneumoniae R6
uuaacaaaauuauua

SEQ ID NO: 4080167 - RNA, 18 nt, Streptococcus pneumoniae R6
uuaacaaagaaaacgccu

SEQ ID NO: 4080168 - RNA, 14 nt, Streptococcus pneumoniae R6
uuaacaauggcugg

SEQ ID NO: 4080169 - RNA, 20 nt, Streptococcus pneumoniae R6
uuaacaauguuuuagaaauc

SEQ ID NO: 4080170 - RNA, 15 nt, Streptococcus pneumoniae R6
uuaacagauuuuucu

SEQ ID NO: 4080171 - RNA, 13 nt, Streptococcus pneumoniae R6
uuaaccacaaaaa

SEQ ID NO: 4080172 - RNA, 21 nt, Streptococcus pneumoniae R6
uuaaccucuugaaguucauuu

SEQ ID NO: 4080173 - RNA, 22 nt, Streptococcus pneumoniae R6
uuaacgaucaaucaauuuaauc

SEQ ID NO: 4080174 - RNA, 21 nt, Streptococcus pneumoniae R6
uuaacgccucccaauuaaaau

SEQ ID NO: 4080175 - RNA, 14 nt, Streptococcus pneumoniae R6
uuaacuaaaucuuu

SEQ ID NO: 4080176 - RNA, 18 nt, Streptococcus pneumoniae R6
uuaacuacuugauaaaag

SEQ ID NO: 4080177 - RNA, 15 nt, Streptococcus pneumoniae R6
uuaacucuuuuuugg

SEQ ID NO: 4080178 - RNA, 20 nt, Streptococcus pneumoniae R6
uuaacuucaagaacuuuaac

SEQ ID NO: 4080179 - RNA, 12 nt, Streptococcus pneumoniae R6
uuaacuuuguau

SEQ ID NO: 4080180 - RNA, 15 nt, Streptococcus pneumoniae R6
uuaacuuuguauaau

SEQ ID NO: 4080181 - RNA, 11 nt, Streptococcus pneumoniae R6
uuaacuuuuuu

SEQ ID NO: 4080182 - RNA, 12 nt, Streptococcus pneumoniae R6
uuaagaacucuu

SEQ ID NO: 4080183 - RNA, 21 nt, Streptococcus pneumoniae R6
uuaagaagucaucuaucaaaa

SEQ ID NO: 4080184 - RNA, 22 nt, Streptococcus pneumoniae R6
uuaagaagucaucuaucaaaag

SEQ ID NO: 4080185 - RNA, 18 nt, Streptococcus pneumoniae R6
uuaagagacuuugguauu

SEQ ID NO: 4080186 - RNA, 23 nt, Streptococcus pneumoniae R6
uuaagagaguuacggguuuuaaa

SEQ ID NO: 4080187 - RNA, 17 nt, Streptococcus pneumoniae R6
uuaagauuguccucaau

SEQ ID NO: 4080188 - RNA, 18 nt, Streptococcus pneumoniae R6
uuaagauuuuaccuauaa

SEQ ID NO: 4080189 - RNA, 13 nt, Streptococcus pneumoniae R6
uuaagcaaaaaaa

SEQ ID NO: 4080190 - RNA, 14 nt, Streptococcus pneumoniae R6
uuaagcaaaaaaag

SEQ ID NO: 4080191 - RNA, 19 nt, Streptococcus pneumoniae R6
uuaagguugcagauagaac

SEQ ID NO: 4080192 - RNA, 19 nt, Streptococcus pneumoniae R6
uuaagguuguagauggaac

SEQ ID NO: 4080193 - RNA, 23 nt, Streptococcus pneumoniae R6
uuaagguuguagauggaacugac

SEQ ID NO: 4080194 - RNA, 19 nt, Streptococcus pneumoniae R6
uuaagguuguggauggaac

SEQ ID NO: 4080195 - RNA, 21 nt, Streptococcus pneumoniae R6
uuaagugcguugauaaucuua

SEQ ID NO: 4080196 - RNA, 16 nt, Streptococcus pneumoniae R6
uuaagugugaagucgu

SEQ ID NO: 4080197 - RNA, 19 nt, Streptococcus pneumoniae R6
uuaaguuuuuugauuucuu

SEQ ID NO: 4080198 - RNA, 13 nt, Streptococcus pneumoniae R6
uuaauaauuuuca

SEQ ID NO: 4080199 - RNA, 12 nt, Streptococcus pneumoniae R6
uuaauacucaau

SEQ ID NO: 4080200 - RNA, 15 nt, Streptococcus pneumoniae R6
uuaauacucaaugaa

SEQ ID NO: 4080201 - RNA, 14 nt, Streptococcus pneumoniae R6
uuaauauauaaaaa

SEQ ID NO: 4080202 - RNA, 15 nt, Streptococcus pneumoniae R6
uuaauauauaaaaaa

SEQ ID NO: 4080203 - RNA, 22 nt, Streptococcus pneumoniae R6
uuaaucagaauggguuaaaauu

SEQ ID NO: 4080204 - RNA, 16 nt, Streptococcus pneumoniae R6
uuaaucauguaccuaa

SEQ ID NO: 4080205 - RNA, 22 nt, Streptococcus pneumoniae R6
uuaaucauguuuuuaagcuacu

SEQ ID NO: 4080206 - RNA, 21 nt, Streptococcus pneumoniae R6
uuaaucauuuaauaaugaaga

SEQ ID NO: 4080207 - RNA, 23 nt, Streptococcus pneumoniae R6
uuaaucgauuauuuuuucucaag

SEQ ID NO: 4080208 - RNA, 20 nt, Streptococcus pneumoniae R6
uuaaucucuccuuaucaaaa

SEQ ID NO: 4080209 - RNA, 17 nt, Streptococcus pneumoniae R6
uuaaugaccagaauagc

SEQ ID NO: 4080210 - RNA, 20 nt, Streptococcus pneumoniae R6
uuaaugugggaagauuuacu

SEQ ID NO: 4080211 - RNA, 23 nt, Streptococcus pneumoniae R6
uuaauguuuucccuuugauagca

SEQ ID NO: 4080212 - RNA, 16 nt, Streptococcus pneumoniae R6
uuaauuagaaaaaaau

SEQ ID NO: 4080213 - RNA, 18 nt, Streptococcus pneumoniae R6
uuaauuaggaaagaaugu

SEQ ID NO: 4080214 - RNA, 14 nt, Streptococcus pneumoniae R6
uuaauuauuuucaa

SEQ ID NO: 4080215 - RNA, 15 nt, Streptococcus pneumoniae R6
uuaauugaauuucaa

SEQ ID NO: 4080216 - RNA, 15 nt, Streptococcus pneumoniae R6
uuaauugauaagguu

SEQ ID NO: 4080217 - RNA, 15 nt, Streptococcus pneumoniae R6
uuaauuuaaugcagu

SEQ ID NO: 4080218 - RNA, 13 nt, Streptococcus pneumoniae R6
uuaauuuauagaa

SEQ ID NO: 4080219 - RNA, 12 nt, Streptococcus pneumoniae R6
uuaauuuauuua

SEQ ID NO: 4080220 - RNA, 14 nt, Streptococcus pneumoniae R6
uuaauuuauuuaau

SEQ ID NO: 4080221 - RNA, 14 nt, Streptococcus pneumoniae R6
uuaauuucaaugua

SEQ ID NO: 4080222 - RNA, 11 nt, Streptococcus pneumoniae R6
uuaauuucuau

SEQ ID NO: 4080223 - RNA, 18 nt, Streptococcus pneumoniae R6
uuacaaaaaaucaaaaaa

SEQ ID NO: 4080224 - RNA, 14 nt, Streptococcus pneumoniae R6
uuacaaauaccaua

SEQ ID NO: 4080225 - RNA, 15 nt, Streptococcus pneumoniae R6
uuacaaauaccauaa

SEQ ID NO: 4080226 - RNA, 17 nt, Streptococcus pneumoniae R6
uuacaauccugcgaaau

SEQ ID NO: 4080227 - RNA, 19 nt, Streptococcus pneumoniae R6
uuacaauccugcgaaaucu

SEQ ID NO: 4080228 - RNA, 21 nt, Streptococcus pneumoniae R6
uuacaauucauaaagugcugu

SEQ ID NO: 4080229 - RNA, 15 nt, Streptococcus pneumoniae R6
uuacaauuguaaaaa

SEQ ID NO: 4080230 - RNA, 17 nt, Streptococcus pneumoniae R6
uuacaauuguaaaaaga

SEQ ID NO: 4080231 - RNA, 13 nt, Streptococcus pneumoniae R6
uuacacguacuuu

SEQ ID NO: 4080232 - RNA, 18 nt, Streptococcus pneumoniae R6
uuacacguacuuuaaaau

SEQ ID NO: 4080233 - RNA, 19 nt, Streptococcus pneumoniae R6
uuacacguacuuuaaaauc

SEQ ID NO: 4080234 - RNA, 22 nt, Streptococcus pneumoniae R6
uuacagacaaaacuggcaaaau

SEQ ID NO: 4080235 - RNA, 23 nt, Streptococcus pneumoniae R6
uuacagacaaaacuggcaaaauu

SEQ ID NO: 4080236 - RNA, 20 nt, Streptococcus pneumoniae R6
uuacagaguacuaaauauaa

SEQ ID NO: 4080237 - RNA, 20 nt, Streptococcus pneumoniae R6
uuacaguuauuuuaguaaaa

SEQ ID NO: 4080238 - RNA, 21 nt, Streptococcus pneumoniae R6
uuacaguuauuuuaguaaaaa

SEQ ID NO: 4080239 - RNA, 15 nt, Streptococcus pneumoniae R6
uuaggaaauucaaau

SEQ ID NO: 4080240 - RNA, 21 nt, Streptococcus pneumoniae R6
uuaggaacacguaaauuauac

SEQ ID NO: 4080241 - RNA, 20 nt, Streptococcus pneumoniae R6
uuaggacuaaauacaaaaac

SEQ ID NO: 4080242 - RNA, 12 nt, Streptococcus pneumoniae R6
uuaggcaauaaa

SEQ ID NO: 4080243 - RNA, 17 nt, Streptococcus pneumoniae R6
uuagggaaauuauuuau

SEQ ID NO: 4080244 - RNA, 14 nt, Streptococcus pneumoniae R6
uuagggauacucca

SEQ ID NO: 4080245 - RNA, 22 nt, Streptococcus pneumoniae R6
uuaggugaaaugucuauuuucu

SEQ ID NO: 4080246 - RNA, 20 nt, Streptococcus pneumoniae R6
uuaguaaaaacguuuuucaa

SEQ ID NO: 4080247 - RNA, 21 nt, Streptococcus pneumoniae R6
uuaguaaacagucccauaaaa

SEQ ID NO: 4080248 - RNA, 14 nt, Streptococcus pneumoniae R6
uuaguaaauacuac

SEQ ID NO: 4080249 - RNA, 20 nt, Streptococcus pneumoniae R6
uuaguagaaaaugaaauaca

SEQ ID NO: 4080250 - RNA, 17 nt, Streptococcus pneumoniae R6
uuaguauaguaaacuga

SEQ ID NO: 4080251 - RNA, 13 nt, Streptococcus pneumoniae R6
uuaguauccuuga

SEQ ID NO: 4080252 - RNA, 15 nt, Streptococcus pneumoniae R6
uuagucggaaucuuu

SEQ ID NO: 4080253 - RNA, 19 nt, Streptococcus pneumoniae R6
uuagucuauucuuuccuuu

SEQ ID NO: 4080254 - RNA, 13 nt, Streptococcus pneumoniae R6
uuaguuaaaauaa

SEQ ID NO: 4080255 - RNA, 21 nt, Streptococcus pneumoniae R6
uuaguuaaaauaaguuagaau

SEQ ID NO: 4080256 - RNA, 23 nt, Streptococcus pneumoniae R6
uuaguucucaggaauuaauggca

SEQ ID NO: 4080257 - RNA, 13 nt, Streptococcus pneumoniae R6
uuaguuuaaaauu

SEQ ID NO: 4080258 - RNA, 13 nt, Streptococcus pneumoniae R6
uuauaaaaaacaa

SEQ ID NO: 4080259 - RNA, 16 nt, Streptococcus pneumoniae R6
uuauaaaaaacacaaa

SEQ ID NO: 4080260 - RNA, 21 nt, Streptococcus pneumoniae R6
uuauaaaaaacacaaaaggag

SEQ ID NO: 4080261 - RNA, 18 nt, Streptococcus pneumoniae R6
uuauaaaagcucauuucc

SEQ ID NO: 4080262 - RNA, 22 nt, Streptococcus pneumoniae R6
uuauaaauauaguaaaaugaaa

SEQ ID NO: 4080263 - RNA, 15 nt, Streptococcus pneumoniae R6
uuauaaauuauuucu

SEQ ID NO: 4080264 - RNA, 20 nt, Streptococcus pneumoniae R6
uuauaauaaaaugaaauaag

SEQ ID NO: 4080265 - RNA, 18 nt, Streptococcus pneumoniae R6
uuauaauauaaacuuuuu

SEQ ID NO: 4080266 - RNA, 20 nt, Streptococcus pneumoniae R6
uuauaauguauugaaucuag

SEQ ID NO: 4080267 - RNA, 12 nt, Streptococcus pneumoniae R6
uuauaauuucaa

SEQ ID NO: 4080268 - RNA, 15 nt, Streptococcus pneumoniae R6
uuauacaaacuacua

SEQ ID NO: 4080269 - RNA, 15 nt, Streptococcus pneumoniae R6
uuauacaucuuccca

SEQ ID NO: 4080270 - RNA, 15 nt, Streptococcus pneumoniae R6
uuauaccaaaaaaac

SEQ ID NO: 4080271 - RNA, 14 nt, Streptococcus pneumoniae R6
uuauacucaucugc

SEQ ID NO: 4080272 - RNA, 15 nt, Streptococcus pneumoniae R6
uuauacucuuagaaa

SEQ ID NO: 4080273 - RNA, 17 nt, Streptococcus pneumoniae R6
uuauacucuuagaaaau

SEQ ID NO: 4080274 - RNA, 14 nt, Streptococcus pneumoniae R6
uuauacucuucaaa

SEQ ID NO: 4080275 - RNA, 15 nt, Streptococcus pneumoniae R6
uuauacuuuuaauau

SEQ ID NO: 4080276 - RNA, 16 nt, Streptococcus pneumoniae R6
uuauagaaaauuaacu

SEQ ID NO: 4080277 - RNA, 17 nt, Streptococcus pneumoniae R6
uuauagaaaauuaacuu

SEQ ID NO: 4080278 - RNA, 19 nt, Streptococcus pneumoniae R6
uuauagaauauauuucuca

SEQ ID NO: 4080279 - RNA, 16 nt, Streptococcus pneumoniae R6
uuauagauucaauaua

SEQ ID NO: 4080280 - RNA, 14 nt, Streptococcus pneumoniae R6
uuauagcauucuuc

SEQ ID NO: 4080281 - RNA, 18 nt, Streptococcus pneumoniae R6
uuauagcgacuauaaaaa

SEQ ID NO: 4080282 - RNA, 18 nt, Streptococcus pneumoniae R6
uuauaggacguuuucaga

SEQ ID NO: 4080283 - RNA, 20 nt, Streptococcus pneumoniae R6
uuauagucgcuauaagauga

SEQ ID NO: 4080284 - RNA, 14 nt, Streptococcus pneumoniae R6
uuauagucuuuuca

SEQ ID NO: 4080285 - RNA, 14 nt, Streptococcus pneumoniae R6
uuauaguuuaagua

SEQ ID NO: 4080286 - RNA, 17 nt, Streptococcus pneumoniae R6
uuauaguuuucacuauu

SEQ ID NO: 4080287 - RNA, 20 nt, Streptococcus pneumoniae R6
uuauaguuuugauuauuuuu

SEQ ID NO: 4080288 - RNA, 12 nt, Streptococcus pneumoniae R6
uuauauaaaaag

SEQ ID NO: 4080289 - RNA, 22 nt, Streptococcus pneumoniae R6
uuauauaaaaagaaaugucauc

SEQ ID NO: 4080290 - RNA, 21 nt, Streptococcus pneumoniae R6
uuauauaaaauaauuaaaaug

SEQ ID NO: 4080291 - RNA, 13 nt, Streptococcus pneumoniae R6
uuauauauaaaaa

SEQ ID NO: 4080292 - RNA, 14 nt, Streptococcus pneumoniae R6
uuauaugcgaacua

SEQ ID NO: 4080293 - RNA, 16 nt, Streptococcus pneumoniae R6
uuauaugcgaacuagc

SEQ ID NO: 4080294 - RNA, 14 nt, Streptococcus pneumoniae R6
uuauauugacagaa

SEQ ID NO: 4080295 - RNA, 21 nt, Streptococcus pneumoniae R6
uuauauuuaggggucaugacu

SEQ ID NO: 4080296 - RNA, 12 nt, Streptococcus pneumoniae R6
uuauauuucucu

SEQ ID NO: 4080297 - RNA, 20 nt, Streptococcus pneumoniae R6
uuaucaaaaucgauagccaa

SEQ ID NO: 4080298 - RNA, 11 nt, Streptococcus pneumoniae R6
uuaucaaaucg

SEQ ID NO: 4080299 - RNA, 18 nt, Streptococcus pneumoniae R6
uuaucaaaucgaucuguu

SEQ ID NO: 4080300 - RNA, 20 nt, Streptococcus pneumoniae R6
uuaucaaaucgaucuguucu

SEQ ID NO: 4080301 - RNA, 17 nt, Streptococcus pneumoniae R6
uuaucaaguucuuccac

SEQ ID NO: 4080302 - RNA, 16 nt, Streptococcus pneumoniae R6
uuaucaaucaaacgcu

SEQ ID NO: 4080303 - RNA, 18 nt, Streptococcus pneumoniae R6
uuaucacucaguuucuga

SEQ ID NO: 4080304 - RNA, 21 nt, Streptococcus pneumoniae R6
uuaucauagaaauuuuuacuu

SEQ ID NO: 4080305 - RNA, 22 nt, Streptococcus pneumoniae R6
uuaucauuaaagaccaaagaaa

SEQ ID NO: 4080306 - RNA, 13 nt, Streptococcus pneumoniae R6
uuaucauuccaga

SEQ ID NO: 4080307 - RNA, 15 nt, Streptococcus pneumoniae R6
uuaucauuuccauug

SEQ ID NO: 4080308 - RNA, 16 nt, Streptococcus pneumoniae R6
uuaucauuuugaaauc

SEQ ID NO: 4080309 - RNA, 17 nt, Streptococcus pneumoniae R6
uuauccaaacuagauag

SEQ ID NO: 4080310 - RNA, 20 nt, Streptococcus pneumoniae R6
uuauccgaacccuguuuuau

SEQ ID NO: 4080311 - RNA, 20 nt, Streptococcus pneumoniae R6
uuauccgaagggcuauuuuu

SEQ ID NO: 4080312 - RNA, 13 nt, Streptococcus pneumoniae R6
uuauccuaggaag

SEQ ID NO: 4080313 - RNA, 17 nt, Streptococcus pneumoniae R6
uuaucguaauuaaaguu

SEQ ID NO: 4080314 - RNA, 16 nt, Streptococcus pneumoniae R6
uuaucuaagacugcuu

SEQ ID NO: 4080315 - RNA, 16 nt, Streptococcus pneumoniae R6
uuaucuagaauuucuu

SEQ ID NO: 4080316 - RNA, 15 nt, Streptococcus pneumoniae R6
uuaucuagugcuaua

SEQ ID NO: 4080317 - RNA, 21 nt, Streptococcus pneumoniae R6
uuaucugaaaauuaaucagaa

SEQ ID NO: 4080318 - RNA, 18 nt, Streptococcus pneumoniae R6
uuaucugcaaccucaaaa

SEQ ID NO: 4080319 - RNA, 16 nt, Streptococcus pneumoniae R6
uuaucuuaauucucuu

SEQ ID NO: 4080320 - RNA, 20 nt, Streptococcus pneumoniae R6
uuaucuuaucacccaaaacu

SEQ ID NO: 4080321 - RNA, 17 nt, Streptococcus pneumoniae R6
uuaucuuuaaacuuuuc

SEQ ID NO: 4080322 - RNA, 13 nt, Streptococcus pneumoniae R6
uuaucuuuccuuc

SEQ ID NO: 4080323 - RNA, 16 nt, Streptococcus pneumoniae R6
uuaugaaaaccaagaa

SEQ ID NO: 4080324 - RNA, 19 nt, Streptococcus pneumoniae R6
uuaugaaauuuaaaaagaa

SEQ ID NO: 4080325 - RNA, 22 nt, Streptococcus pneumoniae R6
uuaugacgaaugauaaucaaac

SEQ ID NO: 4080326 - RNA, 13 nt, Streptococcus pneumoniae R6
uuaugauauauuu

SEQ ID NO: 4080327 - RNA, 17 nt, Streptococcus pneumoniae R6
uuaugaucuuaaauuuu

SEQ ID NO: 4080328 - RNA, 16 nt, Streptococcus pneumoniae R6
uuaugaugcaaaaggu

SEQ ID NO: 4080329 - RNA, 15 nt, Streptococcus pneumoniae R6
uuaugcaacuuuuuu

SEQ ID NO: 4080330 - RNA, 21 nt, Streptococcus pneumoniae R6
uuaugcuuggugagaaaguuu

SEQ ID NO: 4080331 - RNA, 14 nt, Streptococcus pneumoniae R6
uuauggaugacuaa

SEQ ID NO: 4080332 - RNA, 22 nt, Streptococcus pneumoniae R6
uuaugggaauuaggcucuuugu

SEQ ID NO: 4080333 - RNA, 19 nt, Streptococcus pneumoniae R6
uuaugggagcaagcuccua

SEQ ID NO: 4080334 - RNA, 16 nt, Streptococcus pneumoniae R6
uuauguccuaaaacua

SEQ ID NO: 4080335 - RNA, 16 nt, Streptococcus pneumoniae R6
uuauguucuaagaacu

SEQ ID NO: 4080336 - RNA, 15 nt, Streptococcus pneumoniae R6
uuauguuuuaaauaa

SEQ ID NO: 4080337 - RNA, 12 nt, Streptococcus pneumoniae R6
uuauuaacaaaa

SEQ ID NO: 4080338 - RNA, 15 nt, Streptococcus pneumoniae R6
uuauuaacaaaagag

SEQ ID NO: 4080339 - RNA, 15 nt, Streptococcus pneumoniae R6
uuauuacaacaauaa

SEQ ID NO: 4080340 - RNA, 15 nt, Streptococcus pneumoniae R6
uuauuacaucuaucu

SEQ ID NO: 4080341 - RNA, 14 nt, Streptococcus pneumoniae R6
uuauuauuuccuca

SEQ ID NO: 4080342 - RNA, 14 nt, Streptococcus pneumoniae R6
uucagcguuuucua

SEQ ID NO: 4080343 - RNA, 18 nt, Streptococcus pneumoniae R6
uucagcuaaaauguuuuu

SEQ ID NO: 4080344 - RNA, 18 nt, Streptococcus pneumoniae R6
uucagcuacgacaccuga

SEQ ID NO: 4080345 - RNA, 17 nt, Streptococcus pneumoniae R6
uucagcuuuggcaacug

SEQ ID NO: 4080346 - RNA, 19 nt, Streptococcus pneumoniae R6
uucaggugcgagagcuuug

SEQ ID NO: 4080347 - RNA, 22 nt, Streptococcus pneumoniae R6
uucagguggguuuucuguuuau

SEQ ID NO: 4080348 - RNA, 19 nt, Streptococcus pneumoniae R6
uucaguaauaucuccagau

SEQ ID NO: 4080349 - RNA, 17 nt, Streptococcus pneumoniae R6
uucaguagauuaaaggc

SEQ ID NO: 4080350 - RNA, 15 nt, Streptococcus pneumoniae R6
uucaguuucauaauc

SEQ ID NO: 4080351 - RNA, 16 nt, Streptococcus pneumoniae R6
uucaguuucauaauca

SEQ ID NO: 4080352 - RNA, 13 nt, Streptococcus pneumoniae R6
uucaguuucuauu

SEQ ID NO: 4080353 - RNA, 19 nt, Streptococcus pneumoniae R6
uucauaaagagaaggagga

SEQ ID NO: 4080354 - RNA, 14 nt, Streptococcus pneumoniae R6
uucauaaaguuuuc

SEQ ID NO: 4080355 - RNA, 20 nt, Streptococcus pneumoniae R6
uucauaacuacaguauagca

SEQ ID NO: 4080356 - RNA, 13 nt, Streptococcus pneumoniae R6
uucauaacuucac

SEQ ID NO: 4080357 - RNA, 15 nt, Streptococcus pneumoniae R6
uucauacauuucgau

SEQ ID NO: 4080358 - RNA, 20 nt, Streptococcus pneumoniae R6
uucauaccagaagccuuguu

SEQ ID NO: 4080359 - RNA, 16 nt, Streptococcus pneumoniae R6
uucauacgauaaaaau

SEQ ID NO: 4080360 - RNA, 14 nt, Streptococcus pneumoniae R6
uucauagaaaucaa

SEQ ID NO: 4080361 - RNA, 15 nt, Streptococcus pneumoniae R6
uucauagcacuauug

SEQ ID NO: 4080362 - RNA, 19 nt, Streptococcus pneumoniae R6
uucauagcacuauuguauu

SEQ ID NO: 4080363 - RNA, 19 nt, Streptococcus pneumoniae R6
uucauagcugcguucacuu

SEQ ID NO: 4080364 - RNA, 14 nt, Streptococcus pneumoniae R6
uucauagguuuauu

SEQ ID NO: 4080365 - RNA, 20 nt, Streptococcus pneumoniae R6
uucauaguuacuccuuuuuu

SEQ ID NO: 4080366 - RNA, 13 nt, Streptococcus pneumoniae R6
uucauaguucuau

SEQ ID NO: 4080367 - RNA, 18 nt, Streptococcus pneumoniae R6
uucauauaauaaauugua

SEQ ID NO: 4080368 - RNA, 21 nt, Streptococcus pneumoniae R6
uucauaucaugggguguuuuu

SEQ ID NO: 4080369 - RNA, 13 nt, Streptococcus pneumoniae R6
uucauauccccag

SEQ ID NO: 4080370 - RNA, 14 nt, Streptococcus pneumoniae R6
uucauauccccaga

SEQ ID NO: 4080371 - RNA, 17 nt, Streptococcus pneumoniae R6
uucauaucuuauuucaa

SEQ ID NO: 4080372 - RNA, 18 nt, Streptococcus pneumoniae R6
uucauaucuuauuucaau

SEQ ID NO: 4080373 - RNA, 20 nt, Streptococcus pneumoniae R6
uucaucaaagcuaguuguuu

SEQ ID NO: 4080374 - RNA, 18 nt, Streptococcus pneumoniae R6
uucaucaacccccauacc

SEQ ID NO: 4080375 - RNA, 18 nt, Streptococcus pneumoniae R6
uucaucaagagacagaaa

SEQ ID NO: 4080376 - RNA, 20 nt, Streptococcus pneumoniae R6
uucaucagguuaaaggaaac

SEQ ID NO: 4080377 - RNA, 16 nt, Streptococcus pneumoniae R6
uucaucauaucaguga

SEQ ID NO: 4080378 - RNA, 15 nt, Streptococcus pneumoniae R6
uucauccacaaccuc

SEQ ID NO: 4080379 - RNA, 15 nt, Streptococcus pneumoniae R6
uucauccccauuugu

SEQ ID NO: 4080380 - RNA, 15 nt, Streptococcus pneumoniae R6
uucaucgagauggag

SEQ ID NO: 4080381 - RNA, 18 nt, Streptococcus pneumoniae R6
uucaucgccuacaugugu

SEQ ID NO: 4080382 - RNA, 14 nt, Streptococcus pneumoniae R6
uucaucuacaaccu

SEQ ID NO: 4080383 - RNA, 18 nt, Streptococcus pneumoniae R6
uucaucuacaaccucaaa

SEQ ID NO: 4080384 - RNA, 19 nt, Streptococcus pneumoniae R6
uucaucuacaaccucaaaa

SEQ ID NO: 4080385 - RNA, 20 nt, Streptococcus pneumoniae R6
uucaucuccugucaauucca

SEQ ID NO: 4080386 - RNA, 16 nt, Streptococcus pneumoniae R6
uucaucucucuauaau

SEQ ID NO: 4080387 - RNA, 14 nt, Streptococcus pneumoniae R6
uucaugaaauuauu

SEQ ID NO: 4080388 - RNA, 17 nt, Streptococcus pneumoniae R6
uucaugaaauuauuuca

SEQ ID NO: 4080389 - RNA, 17 nt, Streptococcus pneumoniae R6
uucaugacagauucauc

SEQ ID NO: 4080390 - RNA, 17 nt, Streptococcus pneumoniae R6
uucaugacaucuuccaa

SEQ ID NO: 4080391 - RNA, 15 nt, Streptococcus pneumoniae R6
uucaugauugauaau

SEQ ID NO: 4080392 - RNA, 20 nt, Streptococcus pneumoniae R6
uucaugcuugccugaacgcu

SEQ ID NO: 4080393 - RNA, 15 nt, Streptococcus pneumoniae R6
uucauggaugcaauu

SEQ ID NO: 4080394 - RNA, 22 nt, Streptococcus pneumoniae R6
uucauggcaaauucaccaauuu

SEQ ID NO: 4080395 - RNA, 22 nt, Streptococcus pneumoniae R6
uucauggcauggaaagcaucuc

SEQ ID NO: 4080396 - RNA, 16 nt, Streptococcus pneumoniae R6
uucauguauuccaaga

SEQ ID NO: 4080397 - RNA, 13 nt, Streptococcus pneumoniae R6
uucauuaaaugga

SEQ ID NO: 4080398 - RNA, 20 nt, Streptococcus pneumoniae R6
uucauuaaauggaauaguau

SEQ ID NO: 4080399 - RNA, 24 nt, Streptococcus pneumoniae R6
uucauuaaauggaauaguaucuga

SEQ ID NO: 4080400 - RNA, 19 nt, Streptococcus pneumoniae R6
uucauuauuaugaaaacca

SEQ ID NO: 4080401 - RNA, 14 nt, Streptococcus pneumoniae R6
uucauucuacuaua

SEQ ID NO: 4080402 - RNA, 17 nt, Streptococcus pneumoniae R6
uucauugagcuuuaaaa

SEQ ID NO: 4080403 - RNA, 21 nt, Streptococcus pneumoniae R6
uucauuucgacugaaaauauu

SEQ ID NO: 4080404 - RNA, 22 nt, Streptococcus pneumoniae R6
uucauuuggucaaaaucauacu

SEQ ID NO: 4080405 - RNA, 15 nt, Streptococcus pneumoniae R6
uucauuuuacaucug

SEQ ID NO: 4080406 - RNA, 17 nt, Streptococcus pneumoniae R6
uucauuuuacuauaaaa

SEQ ID NO: 4080407 - RNA, 14 nt, Streptococcus pneumoniae R6
uucauuuucuuaaa

SEQ ID NO: 4080408 - RNA, 15 nt, Streptococcus pneumoniae R6
uucauuuucuuuacu

SEQ ID NO: 4080409 - RNA, 18 nt, Streptococcus pneumoniae R6
uucauuuugcacaauaua

SEQ ID NO: 4080410 - RNA, 12 nt, Streptococcus pneumoniae R6
uucauuuuuccu

SEQ ID NO: 4080411 - RNA, 13 nt, Streptococcus pneumoniae R6
uucauuuuuccuu

SEQ ID NO: 4080412 - RNA, 20 nt, Streptococcus pneumoniae R6
uucauuuuugagugguuucu

SEQ ID NO: 4080413 - RNA, 20 nt, Streptococcus pneumoniae R6
uuccaaaaggcaucuuguca

SEQ ID NO: 4080414 - RNA, 21 nt, Streptococcus pneumoniae R6
uuccaaacauacaauauaucc

SEQ ID NO: 4080415 - RNA, 18 nt, Streptococcus pneumoniae R6
uuccaaacguggaaacuc

SEQ ID NO: 4080416 - RNA, 12 nt, Streptococcus pneumoniae R6
uuccaaagaagu

SEQ ID NO: 4080417 - RNA, 17 nt, Streptococcus pneumoniae R6
uuccaaaguucgaaagg

SEQ ID NO: 4080418 - RNA, 19 nt, Streptococcus pneumoniae R6
uuccaaaucuuuggaggca

SEQ ID NO: 4080419 - RNA, 19 nt, Streptococcus pneumoniae R6
uuccaaauuagaaaaagac

SEQ ID NO: 4080420 - RNA, 14 nt, Streptococcus pneumoniae R6
uuccaacauuguuu

SEQ ID NO: 4080421 - RNA, 18 nt, Streptococcus pneumoniae R6
uuccaagaccuuaaacuu

SEQ ID NO: 4080422 - RNA, 19 nt, Streptococcus pneumoniae R6
uuccaagagaccuuucaua

SEQ ID NO: 4080423 - RNA, 21 nt, Streptococcus pneumoniae R6
uuccaagcgaugauauccugu

SEQ ID NO: 4080424 - RNA, 12 nt, Streptococcus pneumoniae R6
uuccaaggaaag

SEQ ID NO: 4080425 - RNA, 18 nt, Streptococcus pneumoniae R6
uuccaagguagcaacagc

SEQ ID NO: 4080426 - RNA, 17 nt, Streptococcus pneumoniae R6
uuccaauaauagaaaac

SEQ ID NO: 4080427 - RNA, 16 nt, Streptococcus pneumoniae R6
uuccaaucuucuccag

SEQ ID NO: 4080428 - RNA, 16 nt, Streptococcus pneumoniae R6
uuccaccauucuuucc

SEQ ID NO: 4080429 - RNA, 14 nt, Streptococcus pneumoniae R6
uuccacccagaaau

SEQ ID NO: 4080430 - RNA, 22 nt, Streptococcus pneumoniae R6
uuccacucgcugacacuggcau

SEQ ID NO: 4080431 - RNA, 20 nt, Streptococcus pneumoniae R6
uuccacuuguggcaaggagu

SEQ ID NO: 4080432 - RNA, 17 nt, Streptococcus pneumoniae R6
uuccagaacuucaauaa

SEQ ID NO: 4080433 - RNA, 18 nt, Streptococcus pneumoniae R6
uuccagacucaucuguag

SEQ ID NO: 4080434 - RNA, 21 nt, Streptococcus pneumoniae R6
uuccagauugugccccugaua

SEQ ID NO: 4080435 - RNA, 22 nt, Streptococcus pneumoniae R6
uuccagcgguaucaaucauauc

SEQ ID NO: 4080436 - RNA, 19 nt, Streptococcus pneumoniae R6
uuccagugauuuggaagua

SEQ ID NO: 4080437 - RNA, 22 nt, Streptococcus pneumoniae R6
uuccauaccuaaacuuugagcc

SEQ ID NO: 4080438 - RNA, 18 nt, Streptococcus pneumoniae R6
uuccauagcgugagcgga

SEQ ID NO: 4080439 - RNA, 23 nt, Streptococcus pneumoniae R6
uuccauauccgacuugguaaaau

SEQ ID NO: 4080440 - RNA, 20 nt, Streptococcus pneumoniae R6
uuccauccacaaccuuaaaa

SEQ ID NO: 4080441 - RNA, 21 nt, Streptococcus pneumoniae R6
uuccaucguuccugucuuauu

SEQ ID NO: 4080442 - RNA, 17 nt, Streptococcus pneumoniae R6
uuccaucugcagccuca

SEQ ID NO: 4080443 - RNA, 22 nt, Streptococcus pneumoniae R6
uuccaucugcagccucaaaaca

SEQ ID NO: 4080444 - RNA, 14 nt, Streptococcus pneumoniae R6
uucuaaauucaauu

SEQ ID NO: 4080445 - RNA, 15 nt, Streptococcus pneumoniae R6
uucuaacucagcuuc

SEQ ID NO: 4080446 - RNA, 14 nt, Streptococcus pneumoniae R6
uucuaaggaaaaag

SEQ ID NO: 4080447 - RNA, 21 nt, Streptococcus pneumoniae R6
uucuaaucgauuuguucauau

SEQ ID NO: 4080448 - RNA, 16 nt, Streptococcus pneumoniae R6
uucuaaugaguuguuu

SEQ ID NO: 4080449 - RNA, 14 nt, Streptococcus pneumoniae R6
uucuaauuaaauaa

SEQ ID NO: 4080450 - RNA, 17 nt, Streptococcus pneumoniae R6
uucuaauuaaaucaucc

SEQ ID NO: 4080451 - RNA, 15 nt, Streptococcus pneumoniae R6
uucuaauuauuucaa

SEQ ID NO: 4080452 - RNA, 18 nt, Streptococcus pneumoniae R6
uucuacuccuuuucuaua

SEQ ID NO: 4080453 - RNA, 14 nt, Streptococcus pneumoniae R6
uucuacugaaauug

SEQ ID NO: 4080454 - RNA, 16 nt, Streptococcus pneumoniae R6
uucuacuucuaaaaca

SEQ ID NO: 4080455 - RNA, 16 nt, Streptococcus pneumoniae R6
uucuagaaacacacga

SEQ ID NO: 4080456 - RNA, 23 nt, Streptococcus pneumoniae R6
uucuagaguccaagauucaacau

SEQ ID NO: 4080457 - RNA, 21 nt, Streptococcus pneumoniae R6
uucuagccccucggauuuuau

SEQ ID NO: 4080458 - RNA, 13 nt, Streptococcus pneumoniae R6
uucuaguccaucu

SEQ ID NO: 4080459 - RNA, 15 nt, Streptococcus pneumoniae R6
uucuaguuucaaucu

SEQ ID NO: 4080460 - RNA, 18 nt, Streptococcus pneumoniae R6
uucuaguuucaaucuacu

SEQ ID NO: 4080461 - RNA, 13 nt, Streptococcus pneumoniae R6
uucuauacuuuuu

SEQ ID NO: 4080462 - RNA, 17 nt, Streptococcus pneumoniae R6
uucuauaggauuuauuu

SEQ ID NO: 4080463 - RNA, 13 nt, Streptococcus pneumoniae R6
uucuauauuuaua

SEQ ID NO: 4080464 - RNA, 14 nt, Streptococcus pneumoniae R6
uucuauauuuauau

SEQ ID NO: 4080465 - RNA, 23 nt, Streptococcus pneumoniae R6
uucuaucaacucaagaauuauuu

SEQ ID NO: 4080466 - RNA, 17 nt, Streptococcus pneumoniae R6
uucuaucagcuuaucaa

SEQ ID NO: 4080467 - RNA, 17 nt, Streptococcus pneumoniae R6
uucuauccacaaccuca

SEQ ID NO: 4080468 - RNA, 19 nt, Streptococcus pneumoniae R6
uucuauccacaaccucaaa

SEQ ID NO: 4080469 - RNA, 15 nt, Streptococcus pneumoniae R6
uucuaucuacaaccu

SEQ ID NO: 4080470 - RNA, 17 nt, Streptococcus pneumoniae R6
uucuaucugcaaccuca

SEQ ID NO: 4080471 - RNA, 19 nt, Streptococcus pneumoniae R6
uucuaucugcaaccucaaa

SEQ ID NO: 4080472 - RNA, 22 nt, Streptococcus pneumoniae R6
uucuaucugcaaccuuaaaaca

SEQ ID NO: 4080473 - RNA, 16 nt, Streptococcus pneumoniae R6
uucuaugcaaguucuu

SEQ ID NO: 4080474 - RNA, 19 nt, Streptococcus pneumoniae R6
uucuauggcuuguucaauu

SEQ ID NO: 4080475 - RNA, 14 nt, Streptococcus pneumoniae R6
uucuauugaaauga

SEQ ID NO: 4080476 - RNA, 22 nt, Streptococcus pneumoniae R6
uucuauuuaaaucgcuucugua

SEQ ID NO: 4080477 - RNA, 16 nt, Streptococcus pneumoniae R6
uucucaaaacuaguuu

SEQ ID NO: 4080478 - RNA, 16 nt, Streptococcus pneumoniae R6
uucucaaccacaaaaa

SEQ ID NO: 4080479 - RNA, 23 nt, Streptococcus pneumoniae R6
uucucaauagcacgcgcaacgcc

SEQ ID NO: 4080480 - RNA, 15 nt, Streptococcus pneumoniae R6
uucucaaugauuuga

SEQ ID NO: 4080481 - RNA, 16 nt, Streptococcus pneumoniae R6
uucucacguccuagcu

SEQ ID NO: 4080482 - RNA, 20 nt, Streptococcus pneumoniae R6
uucucagggucuuuguucug

SEQ ID NO: 4080483 - RNA, 14 nt, Streptococcus pneumoniae R6
uucucauagccaua

SEQ ID NO: 4080484 - RNA, 19 nt, Streptococcus pneumoniae R6
uucucauagccauaaaaca

SEQ ID NO: 4080485 - RNA, 23 nt, Streptococcus pneumoniae R6
uucucaucuauuuuuacucaagg

SEQ ID NO: 4080486 - RNA, 18 nt, Streptococcus pneumoniae R6
uucucaucuuauuucaau

SEQ ID NO: 4080487 - RNA, 20 nt, Streptococcus pneumoniae R6
uucuccaaucaaauugugca

SEQ ID NO: 4080488 - RNA, 12 nt, Streptococcus pneumoniae R6
uucuccacagac

SEQ ID NO: 4080489 - RNA, 20 nt, Streptococcus pneumoniae R6
uucucccuuuugcucggcau

SEQ ID NO: 4080490 - RNA, 22 nt, Streptococcus pneumoniae R6
uucuccgaagacuuuaaaaauu

SEQ ID NO: 4080491 - RNA, 13 nt, Streptococcus pneumoniae R6
uucuccgcuucca

SEQ ID NO: 4080492 - RNA, 22 nt, Streptococcus pneumoniae R6
uucuccgcuuccagagcucuuu

SEQ ID NO: 4080493 - RNA, 14 nt, Streptococcus pneumoniae R6
uucuccgugaacaa

SEQ ID NO: 4080494 - RNA, 21 nt, Streptococcus pneumoniae R6
uucuccuacuugcuucccauu

SEQ ID NO: 4080495 - RNA, 17 nt, Streptococcus pneumoniae R6
uucucggacuuuuucca

SEQ ID NO: 4080496 - RNA, 22 nt, Streptococcus pneumoniae R6
uucucggacuuuuuccaaaucu

SEQ ID NO: 4080497 - RNA, 17 nt, Streptococcus pneumoniae R6
uucucggucuuguuuuu

SEQ ID NO: 4080498 - RNA, 21 nt, Streptococcus pneumoniae R6
uucucuacaguuggagcaucu

SEQ ID NO: 4080499 - RNA, 22 nt, Streptococcus pneumoniae R6
uucucuagaaaucucuuuuuuc

SEQ ID NO: 4080500 - RNA, 16 nt, Streptococcus pneumoniae R6
uucucucugaauagaa

SEQ ID NO: 4080501 - RNA, 14 nt, Streptococcus pneumoniae R6
uucucucuuacuau

SEQ ID NO: 4080502 - RNA, 12 nt, Streptococcus pneumoniae R6
uucucugacuuu

SEQ ID NO: 4080503 - RNA, 18 nt, Streptococcus pneumoniae R6
uucucugagaccuuuauu

SEQ ID NO: 4080504 - RNA, 21 nt, Streptococcus pneumoniae R6
uucucuguuaccacaggagcu

SEQ ID NO: 4080505 - RNA, 18 nt, Streptococcus pneumoniae R6
uucucuuucuaaaauagu

SEQ ID NO: 4080506 - RNA, 13 nt, Streptococcus pneumoniae R6
uucucuuugaaug

SEQ ID NO: 4080507 - RNA, 20 nt, Streptococcus pneumoniae R6
uucugaaaagacguauucag

SEQ ID NO: 4080508 - RNA, 22 nt, Streptococcus pneumoniae R6
uucugaaauaacucauaauagu

SEQ ID NO: 4080509 - RNA, 19 nt, Streptococcus pneumoniae R6
uucugaagcaucaaauccu

SEQ ID NO: 4080510 - RNA, 15 nt, Streptococcus pneumoniae R6
uucugaaguuaaguu

SEQ ID NO: 4080511 - RNA, 21 nt, Streptococcus pneumoniae R6
uucugaauagcuuaaaaucuu

SEQ ID NO: 4080512 - RNA, 18 nt, Streptococcus pneumoniae R6
uucugagucugugauuga

SEQ ID NO: 4080513 - RNA, 13 nt, Streptococcus pneumoniae R6
uucugauuucaaa

SEQ ID NO: 4080514 - RNA, 16 nt, Streptococcus pneumoniae R6
uucugauuuugaaaau

SEQ ID NO: 4080515 - RNA, 22 nt, Streptococcus pneumoniae R6
uucugauuuugaaaauuuuucc

SEQ ID NO: 4080516 - RNA, 11 nt, Streptococcus pneumoniae R6
uucugcaaaaa

SEQ ID NO: 4080517 - RNA, 13 nt, Streptococcus pneumoniae R6
uucugcaaaaaau

SEQ ID NO: 4080518 - RNA, 14 nt, Streptococcus pneumoniae R6
uucugcaaucaagg

SEQ ID NO: 4080519 - RNA, 15 nt, Streptococcus pneumoniae R6
uucugcaguuucucu

SEQ ID NO: 4080520 - RNA, 14 nt, Streptococcus pneumoniae R6
uucugcuagacgac

SEQ ID NO: 4080521 - RNA, 15 nt, Streptococcus pneumoniae R6
uucugcugucagcaa

SEQ ID NO: 4080522 - RNA, 13 nt, Streptococcus pneumoniae R6
uucugcuucuaaa

SEQ ID NO: 4080523 - RNA, 17 nt, Streptococcus pneumoniae R6
uucugcuucuaaaacau

SEQ ID NO: 4080524 - RNA, 18 nt, Streptococcus pneumoniae R6
uucugcuucuaaaacauu

SEQ ID NO: 4080525 - RNA, 16 nt, Streptococcus pneumoniae R6
uucuggaagugaaaca

SEQ ID NO: 4080526 - RNA, 15 nt, Streptococcus pneumoniae R6
uucuggauuuccauu

SEQ ID NO: 4080527 - RNA, 18 nt, Streptococcus pneumoniae R6
uucugggauggucacaga

SEQ ID NO: 4080528 - RNA, 17 nt, Streptococcus pneumoniae R6
uucuggucugauuuuca

SEQ ID NO: 4080529 - RNA, 14 nt, Streptococcus pneumoniae R6
uucuguaauuucua

SEQ ID NO: 4080530 - RNA, 18 nt, Streptococcus pneumoniae R6
uucuguacugcacaggac

SEQ ID NO: 4080531 - RNA, 21 nt, Streptococcus pneumoniae R6
uucuguacugccccccaaaag

SEQ ID NO: 4080532 - RNA, 12 nt, Streptococcus pneumoniae R6
uucugucaugcg

SEQ ID NO: 4080533 - RNA, 14 nt, Streptococcus pneumoniae R6
uucuguuucuaguc

SEQ ID NO: 4080534 - RNA, 15 nt, Streptococcus pneumoniae R6
uucuuaaguuaaauu

SEQ ID NO: 4080535 - RNA, 12 nt, Streptococcus pneumoniae R6
uucuuaauagcu

SEQ ID NO: 4080536 - RNA, 20 nt, Streptococcus pneumoniae R6
uucuuacacguuuuugucua

SEQ ID NO: 4080537 - RNA, 15 nt, Streptococcus pneumoniae R6
uucuuacuaccuacu

SEQ ID NO: 4080538 - RNA, 17 nt, Streptococcus pneumoniae R6
uucuuagaaaucgauuu

SEQ ID NO: 4080539 - RNA, 14 nt, Streptococcus pneumoniae R6
uucuuagcaauucu

SEQ ID NO: 4080540 - RNA, 15 nt, Streptococcus pneumoniae R6
uucuuauacaaauaa

SEQ ID NO: 4080541 - RNA, 18 nt, Streptococcus pneumoniae R6
uucuuauacaaauaaacg

SEQ ID NO: 4080542 - RNA, 11 nt, Streptococcus pneumoniae R6
uucuuauauua

SEQ ID NO: 4080543 - RNA, 18 nt, Streptococcus pneumoniae R6
uucuuauauuaaaaaaag

SEQ ID NO: 4080544 - RNA, 16 nt, Streptococcus pneumoniae R6
uucuuauucuuggcgu

SEQ ID NO: 4080545 - RNA, 16 nt, Streptococcus pneumoniae R6
uucuuauuucauuuua

SEQ ID NO: 4080546 - RNA, 15 nt, Streptococcus pneumoniae R6
uucuucacauccucu

SEQ ID NO: 4080547 - RNA, 13 nt, Streptococcus pneumoniae R6
uugacauccuuuu

SEQ ID NO: 4080548 - RNA, 15 nt, Streptococcus pneumoniae R6
uugacaucugugauu

SEQ ID NO: 4080549 - RNA, 18 nt, Streptococcus pneumoniae R6
uugacauuuaagccuuuu

SEQ ID NO: 4080550 - RNA, 18 nt, Streptococcus pneumoniae R6
uugaccaaagacugggug

SEQ ID NO: 4080551 - RNA, 15 nt, Streptococcus pneumoniae R6
uugaccaaagcauca

SEQ ID NO: 4080552 - RNA, 17 nt, Streptococcus pneumoniae R6
uugaccagaaauaaaag

SEQ ID NO: 4080553 - RNA, 13 nt, Streptococcus pneumoniae R6
uugaccucuggau

SEQ ID NO: 4080554 - RNA, 23 nt, Streptococcus pneumoniae R6
uugaccuguugaugcaucaagug

SEQ ID NO: 4080555 - RNA, 13 nt, Streptococcus pneumoniae R6
uugaccuguuuuc

SEQ ID NO: 4080556 - RNA, 17 nt, Streptococcus pneumoniae R6
uugacgaagaaaccaag

SEQ ID NO: 4080557 - RNA, 20 nt, Streptococcus pneumoniae R6
uugacgaagaaaccaagcaa

SEQ ID NO: 4080558 - RNA, 18 nt, Streptococcus pneumoniae R6
uugacgagugaagaauug

SEQ ID NO: 4080559 - RNA, 15 nt, Streptococcus pneumoniae R6
uugacgauauuucca

SEQ ID NO: 4080560 - RNA, 16 nt, Streptococcus pneumoniae R6
uugacgauuuucucuu

SEQ ID NO: 4080561 - RNA, 19 nt, Streptococcus pneumoniae R6
uugacgauuuucucuuugu

SEQ ID NO: 4080562 - RNA, 14 nt, Streptococcus pneumoniae R6
uugacgauuuuuuc

SEQ ID NO: 4080563 - RNA, 17 nt, Streptococcus pneumoniae R6
uugacgcgguuugaaga

SEQ ID NO: 4080564 - RNA, 19 nt, Streptococcus pneumoniae R6
uugacguugcaaguuccca

SEQ ID NO: 4080565 - RNA, 21 nt, Streptococcus pneumoniae R6
uugacuaaaaacucuucuuuu

SEQ ID NO: 4080566 - RNA, 22 nt, Streptococcus pneumoniae R6
uugacuauauuucuauacuuuu

SEQ ID NO: 4080567 - RNA, 15 nt, Streptococcus pneumoniae R6
uugacuauauuucuu

SEQ ID NO: 4080568 - RNA, 22 nt, Streptococcus pneumoniae R6
uugacuccccauuuaccaagcu

SEQ ID NO: 4080569 - RNA, 12 nt, Streptococcus pneumoniae R6
uugacucugcug

SEQ ID NO: 4080570 - RNA, 10 nt, Streptococcus pneumoniae R6
uugacugagu

SEQ ID NO: 4080571 - RNA, 22 nt, Streptococcus pneumoniae R6
uugacuuccaaaauuaaaaugu

SEQ ID NO: 4080572 - RNA, 15 nt, Streptococcus pneumoniae R6
uugacuuuucuaauc

SEQ ID NO: 4080573 - RNA, 22 nt, Streptococcus pneumoniae R6
uugagaaaauaugggcuuacau

SEQ ID NO: 4080574 - RNA, 17 nt, Streptococcus pneumoniae R6
uugagaaagcacuugcu

SEQ ID NO: 4080575 - RNA, 19 nt, Streptococcus pneumoniae R6
uugagaaagcacuugcuuu

SEQ ID NO: 4080576 - RNA, 19 nt, Streptococcus pneumoniae R6
uugagaaaguuaaaaaaac

SEQ ID NO: 4080577 - RNA, 18 nt, Streptococcus pneumoniae R6
uugagaagugggagaaaa

SEQ ID NO: 4080578 - RNA, 23 nt, Streptococcus pneumoniae R6
uugagaagugggagaaaaguuuc

SEQ ID NO: 4080579 - RNA, 20 nt, Streptococcus pneumoniae R6
uugagacuggcgauuuuagg

SEQ ID NO: 4080580 - RNA, 20 nt, Streptococcus pneumoniae R6
uugagagaagcaagugacaa

SEQ ID NO: 4080581 - RNA, 22 nt, Streptococcus pneumoniae R6
uugagagaagcaagugacaaag

SEQ ID NO: 4080582 - RNA, 15 nt, Streptococcus pneumoniae R6
uugagaucucuuaga

SEQ ID NO: 4080583 - RNA, 15 nt, Streptococcus pneumoniae R6
uugagcaagaccgau

SEQ ID NO: 4080584 - RNA, 14 nt, Streptococcus pneumoniae R6
uugagcaaucccua

SEQ ID NO: 4080585 - RNA, 14 nt, Streptococcus pneumoniae R6
uugagcgaaaucaa

SEQ ID NO: 4080586 - RNA, 22 nt, Streptococcus pneumoniae R6
uugagcgcaggaagaaagagga

SEQ ID NO: 4080587 - RNA, 19 nt, Streptococcus pneumoniae R6
uugagcuacguucugucaa

SEQ ID NO: 4080588 - RNA, 20 nt, Streptococcus pneumoniae R6
uugagcuacguucugucaaa

SEQ ID NO: 4080589 - RNA, 13 nt, Streptococcus pneumoniae R6
uugagcucauccu

SEQ ID NO: 4080590 - RNA, 18 nt, Streptococcus pneumoniae R6
uugagcugacuucgucag

SEQ ID NO: 4080591 - RNA, 23 nt, Streptococcus pneumoniae R6
uugagcugacuucgucagucuua

SEQ ID NO: 4080592 - RNA, 20 nt, Streptococcus pneumoniae R6
uugagcugcugugaugaggg

SEQ ID NO: 4080593 - RNA, 21 nt, Streptococcus pneumoniae R6
uugaggaagguuuuaaagaca

SEQ ID NO: 4080594 - RNA, 21 nt, Streptococcus pneumoniae R6
uugaggaaguaccaaggaaga

SEQ ID NO: 4080595 - RNA, 12 nt, Streptococcus pneumoniae R6
uugaggauaaaa

SEQ ID NO: 4080596 - RNA, 20 nt, Streptococcus pneumoniae R6
uugaggccgauagagccacc

SEQ ID NO: 4080597 - RNA, 23 nt, Streptococcus pneumoniae R6
uugagguuguagauagaacugac

SEQ ID NO: 4080598 - RNA, 23 nt, Streptococcus pneumoniae R6
uugagguuguggaugaaacugac

SEQ ID NO: 4080599 - RNA, 19 nt, Streptococcus pneumoniae R6
uugagguuuuagauaagac

SEQ ID NO: 4080600 - RNA, 17 nt, Streptococcus pneumoniae R6
uugaguaaauaaaacaa

SEQ ID NO: 4080601 - RNA, 23 nt, Streptococcus pneumoniae R6
uugaguaauuccccaucuucaac

SEQ ID NO: 4080602 - RNA, 22 nt, Streptococcus pneumoniae R6
uugaguaauucuccaauuaaug

SEQ ID NO: 4080603 - RNA, 22 nt, Streptococcus pneumoniae R6
uugaguauaaacgaauagaaaa

SEQ ID NO: 4080604 - RNA, 22 nt, Streptococcus pneumoniae R6
uugaguaugaguuaccuaaauu

SEQ ID NO: 4080605 - RNA, 16 nt, Streptococcus pneumoniae R6
uugagucuuuuuccaa

SEQ ID NO: 4080606 - RNA, 19 nt, Streptococcus pneumoniae R6
uugagugcuuuuguacugc

SEQ ID NO: 4080607 - RNA, 12 nt, Streptococcus pneumoniae R6
uugaguucacaa

SEQ ID NO: 4080608 - RNA, 17 nt, Streptococcus pneumoniae R6
uugaguucacaaaugag

SEQ ID NO: 4080609 - RNA, 16 nt, Streptococcus pneumoniae R6
uugaguugggauaaac

SEQ ID NO: 4080610 - RNA, 13 nt, Streptococcus pneumoniae R6
uugaguuucucuu

SEQ ID NO: 4080611 - RNA, 17 nt, Streptococcus pneumoniae R6
uugaguuuuugaagaau

SEQ ID NO: 4080612 - RNA, 15 nt, Streptococcus pneumoniae R6
uugaguuuuuuauuu

SEQ ID NO: 4080613 - RNA, 18 nt, Streptococcus pneumoniae R6
uugauaaaauuuaaaaau

SEQ ID NO: 4080614 - RNA, 18 nt, Streptococcus pneumoniae R6
uugauaaccacagacuga

SEQ ID NO: 4080615 - RNA, 21 nt, Streptococcus pneumoniae R6
uugauaaccuuaaucaaauua

SEQ ID NO: 4080616 - RNA, 22 nt, Streptococcus pneumoniae R6
uugauaagauaaaguggucuuu

SEQ ID NO: 4080617 - RNA, 21 nt, Streptococcus pneumoniae R6
uugauaagauaauaaauaguu

SEQ ID NO: 4080618 - RNA, 17 nt, Streptococcus pneumoniae R6
uugauaauaaagaagag

SEQ ID NO: 4080619 - RNA, 15 nt, Streptococcus pneumoniae R6
uugauaauaccagca

SEQ ID NO: 4080620 - RNA, 21 nt, Streptococcus pneumoniae R6
uugauaauagcacuuaaaaag

SEQ ID NO: 4080621 - RNA, 22 nt, Streptococcus pneumoniae R6
uugauaaugcguuuagcaucuu

SEQ ID NO: 4080622 - RNA, 13 nt, Streptococcus pneumoniae R6
uugauacaaguuc

SEQ ID NO: 4080623 - RNA, 17 nt, Streptococcus pneumoniae R6
uugauacucuucgaaaa

SEQ ID NO: 4080624 - RNA, 17 nt, Streptococcus pneumoniae R6
uugauacuuauccuuuu

SEQ ID NO: 4080625 - RNA, 17 nt, Streptococcus pneumoniae R6
uugauagaaagcaaggc

SEQ ID NO: 4080626 - RNA, 21 nt, Streptococcus pneumoniae R6
uugauagaugacuucuuaauc

SEQ ID NO: 4080627 - RNA, 12 nt, Streptococcus pneumoniae R6
uugauagcagaa

SEQ ID NO: 4080628 - RNA, 16 nt, Streptococcus pneumoniae R6
uugauagcauuuggaa

SEQ ID NO: 4080629 - RNA, 17 nt, Streptococcus pneumoniae R6
uugauauaguuaaaaaa

SEQ ID NO: 4080630 - RNA, 20 nt, Streptococcus pneumoniae R6
uugauauaguuaaaaaagau

SEQ ID NO: 4080631 - RNA, 17 nt, Streptococcus pneumoniae R6
uugauauauaaaugaaa

SEQ ID NO: 4080632 - RNA, 23 nt, Streptococcus pneumoniae R6
uugauaugaugcguuuuauaauu

SEQ ID NO: 4080633 - RNA, 17 nt, Streptococcus pneumoniae R6
uugauauucuuaucaaa

SEQ ID NO: 4080634 - RNA, 20 nt, Streptococcus pneumoniae R6
uugauauuggcugcuugcaa

SEQ ID NO: 4080635 - RNA, 16 nt, Streptococcus pneumoniae R6
uugauauuuauagaaa

SEQ ID NO: 4080636 - RNA, 12 nt, Streptococcus pneumoniae R6
uugauauuucca

SEQ ID NO: 4080637 - RNA, 14 nt, Streptococcus pneumoniae R6
uugauauuuccauc

SEQ ID NO: 4080638 - RNA, 19 nt, Streptococcus pneumoniae R6
uugaucaauugucugaagu

SEQ ID NO: 4080639 - RNA, 23 nt, Streptococcus pneumoniae R6
uugaucccuugacguugcaaguu

SEQ ID NO: 4080640 - RNA, 21 nt, Streptococcus pneumoniae R6
uugaucgaguuauuaacaaaa

SEQ ID NO: 4080641 - RNA, 17 nt, Streptococcus pneumoniae R6
uugaucuagcucucucu

SEQ ID NO: 4080642 - RNA, 23 nt, Streptococcus pneumoniae R6
uugaucuuccauuucuuuugcaa

SEQ ID NO: 4080643 - RNA, 14 nt, Streptococcus pneumoniae R6
uugaugaaaaaaag

SEQ ID NO: 4080644 - RNA, 16 nt, Streptococcus pneumoniae R6
uugaugaaagauauuu

SEQ ID NO: 4080645 - RNA, 13 nt, Streptococcus pneumoniae R6
uugaugaacugcu

SEQ ID NO: 4080646 - RNA, 14 nt, Streptococcus pneumoniae R6
uugaugaggaaaga

SEQ ID NO: 4080647 - RNA, 16 nt, Streptococcus pneumoniae R6
uugaugaguaaguuuu

SEQ ID NO: 4080648 - RNA, 13 nt, Streptococcus pneumoniae R6
uugauggagcugg

SEQ ID NO: 4080649 - RNA, 16 nt, Streptococcus pneumoniae R6
uuggaauaaggcagcu

SEQ ID NO: 4080650 - RNA, 20 nt, Streptococcus pneumoniae R6
uuggaauaguccucccuucu

SEQ ID NO: 4080651 - RNA, 14 nt, Streptococcus pneumoniae R6
uuggaaugacgaaa

SEQ ID NO: 4080652 - RNA, 20 nt, Streptococcus pneumoniae R6
uuggaaugacgaaacgaaga

SEQ ID NO: 4080653 - RNA, 15 nt, Streptococcus pneumoniae R6
uuggacauagccaau

SEQ ID NO: 4080654 - RNA, 17 nt, Streptococcus pneumoniae R6
uuggaccagccaaucgc

SEQ ID NO: 4080655 - RNA, 22 nt, Streptococcus pneumoniae R6
uuggaggcaauacguuuucaaa

SEQ ID NO: 4080656 - RNA, 16 nt, Streptococcus pneumoniae R6
uuggagugauagaaaa

SEQ ID NO: 4080657 - RNA, 13 nt, Streptococcus pneumoniae R6
uuggaguuguaau

SEQ ID NO: 4080658 - RNA, 21 nt, Streptococcus pneumoniae R6
uuggaguuguaaucuuagcaa

SEQ ID NO: 4080659 - RNA, 13 nt, Streptococcus pneumoniae R6
uuggauacaagga

SEQ ID NO: 4080660 - RNA, 20 nt, Streptococcus pneumoniae R6
uuggauauaggaggguuggc

SEQ ID NO: 4080661 - RNA, 13 nt, Streptococcus pneumoniae R6
uuggauauucaau

SEQ ID NO: 4080662 - RNA, 16 nt, Streptococcus pneumoniae R6
uuggauuaauccccau

SEQ ID NO: 4080663 - RNA, 14 nt, Streptococcus pneumoniae R6
uuggcaaaguuuuu

SEQ ID NO: 4080664 - RNA, 14 nt, Streptococcus pneumoniae R6
uuggcaaccaaguc

SEQ ID NO: 4080665 - RNA, 17 nt, Streptococcus pneumoniae R6
uuggcaacgacaggagu

SEQ ID NO: 4080666 - RNA, 14 nt, Streptococcus pneumoniae R6
uuggcaauucaauu

SEQ ID NO: 4080667 - RNA, 22 nt, Streptococcus pneumoniae R6
uuggcacaccacgaaguccuug

SEQ ID NO: 4080668 - RNA, 18 nt, Streptococcus pneumoniae R6
uuggcagccucuuucuug

SEQ ID NO: 4080669 - RNA, 21 nt, Streptococcus pneumoniae R6
uuggcaguucuugcucaauca

SEQ ID NO: 4080670 - RNA, 19 nt, Streptococcus pneumoniae R6
uuggcaguugguuauacau

SEQ ID NO: 4080671 - RNA, 18 nt, Streptococcus pneumoniae R6
uuggcccuaccugcucca

SEQ ID NO: 4080672 - RNA, 22 nt, Streptococcus pneumoniae R6
uuggccgcaagcagcuaaaagc

SEQ ID NO: 4080673 - RNA, 21 nt, Streptococcus pneumoniae R6
uuggcgaauauagacaaaauc

SEQ ID NO: 4080674 - RNA, 14 nt, Streptococcus pneumoniae R6
uuggcguaacaaaa

SEQ ID NO: 4080675 - RNA, 12 nt, Streptococcus pneumoniae R6
uuggcucaucug

SEQ ID NO: 4080676 - RNA, 14 nt, Streptococcus pneumoniae R6
uuggcugauuucuu

SEQ ID NO: 4080677 - RNA, 15 nt, Streptococcus pneumoniae R6
uugggaaauucuaau

SEQ ID NO: 4080678 - RNA, 16 nt, Streptococcus pneumoniae R6
uugggaaauucuaauu

SEQ ID NO: 4080679 - RNA, 23 nt, Streptococcus pneumoniae R6
uugggacagaaaugcccaauucu

SEQ ID NO: 4080680 - RNA, 21 nt, Streptococcus pneumoniae R6
uugggacgauuuucaaaaaga

SEQ ID NO: 4080681 - RNA, 17 nt, Streptococcus pneumoniae R6
uuggggggcaguucaua

SEQ ID NO: 4080682 - RNA, 18 nt, Streptococcus pneumoniae R6
uugggguuuggaaaugau

SEQ ID NO: 4080683 - RNA, 14 nt, Streptococcus pneumoniae R6
uugguaagagaaau

SEQ ID NO: 4080684 - RNA, 23 nt, Streptococcus pneumoniae R6
uugguaagagaaauuucugaaac

SEQ ID NO: 4080685 - RNA, 19 nt, Streptococcus pneumoniae R6
uugguaauagaucucuacu

SEQ ID NO: 4080686 - RNA, 19 nt, Streptococcus pneumoniae R6
uugguaaugcuccaauaca

SEQ ID NO: 4080687 - RNA, 14 nt, Streptococcus pneumoniae R6
uugguaauuuucaa

SEQ ID NO: 4080688 - RNA, 23 nt, Streptococcus pneumoniae R6
uugguaggguucuucgaaaguca

SEQ ID NO: 4080689 - RNA, 19 nt, Streptococcus pneumoniae R6
uugguauuacuuaccacua

SEQ ID NO: 4080690 - RNA, 21 nt, Streptococcus pneumoniae R6
uugguauucuucgugaaagac

SEQ ID NO: 4080691 - RNA, 15 nt, Streptococcus pneumoniae R6
uuggucauuaaauuu

SEQ ID NO: 4080692 - RNA, 19 nt, Streptococcus pneumoniae R6
uuggucgcuuccaauuugg

SEQ ID NO: 4080693 - RNA, 12 nt, Streptococcus pneumoniae R6
uuggucuagcaa

SEQ ID NO: 4080694 - RNA, 20 nt, Streptococcus pneumoniae R6
uuggucuagcaagaguuuuu

SEQ ID NO: 4080695 - RNA, 17 nt, Streptococcus pneumoniae R6
uuggugagaaaguuuuu

SEQ ID NO: 4080696 - RNA, 15 nt, Streptococcus pneumoniae R6
uuggugcaaacggau

SEQ ID NO: 4080697 - RNA, 15 nt, Streptococcus pneumoniae R6
uugguguugagaaag

SEQ ID NO: 4080698 - RNA, 19 nt, Streptococcus pneumoniae R6
uugguguuugguugaccag

SEQ ID NO: 4080699 - RNA, 18 nt, Streptococcus pneumoniae R6
uugguuauacauagcuaa

SEQ ID NO: 4080700 - RNA, 15 nt, Streptococcus pneumoniae R6
uugguucuucacuau

SEQ ID NO: 4080701 - RNA, 22 nt, Streptococcus pneumoniae R6
uugguugcuacaucuucuccaa

SEQ ID NO: 4080702 - RNA, 21 nt, Streptococcus pneumoniae R6
uuguaaaggaugacaauagcu

SEQ ID NO: 4080703 - RNA, 19 nt, Streptococcus pneumoniae R6
uuguaaaggguucuacaaa

SEQ ID NO: 4080704 - RNA, 18 nt, Streptococcus pneumoniae R6
uuguaaccgauauuuccu

SEQ ID NO: 4080705 - RNA, 14 nt, Streptococcus pneumoniae R6
uuguaaccuuuuug

SEQ ID NO: 4080706 - RNA, 15 nt, Streptococcus pneumoniae R6
uuguaagucugcuuu

SEQ ID NO: 4080707 - RNA, 16 nt, Streptococcus pneumoniae R6
uuguagaugaaacuga

SEQ ID NO: 4080708 - RNA, 21 nt, Streptococcus pneumoniae R6
uuguagcccuucauaaaggaa

SEQ ID NO: 4080709 - RNA, 17 nt, Streptococcus pneumoniae R6
uuguaggcuuucaacug

SEQ ID NO: 4080710 - RNA, 20 nt, Streptococcus pneumoniae R6
uuguaggcuuucaacugcuu

SEQ ID NO: 4080711 - RNA, 14 nt, Streptococcus pneumoniae R6
uuguagucugcugc

SEQ ID NO: 4080712 - RNA, 22 nt, Streptococcus pneumoniae R6
uuguagucugcugccaauugcu

SEQ ID NO: 4080713 - RNA, 22 nt, Streptococcus pneumoniae R6
uuguaguucgugccaaucucaa

SEQ ID NO: 4080714 - RNA, 14 nt, Streptococcus pneumoniae R6
uuguaguucucaau

SEQ ID NO: 4080715 - RNA, 19 nt, Streptococcus pneumoniae R6
uuguauagugaauugaaau

SEQ ID NO: 4080716 - RNA, 21 nt, Streptococcus pneumoniae R6
uuguauagugaauugaaauaa

SEQ ID NO: 4080717 - RNA, 15 nt, Streptococcus pneumoniae R6
uuguaucaauuugua

SEQ ID NO: 4080718 - RNA, 15 nt, Streptococcus pneumoniae R6
uuguaugaaaaguuu

SEQ ID NO: 4080719 - RNA, 16 nt, Streptococcus pneumoniae R6
uuguaugaaaaguuuu

SEQ ID NO: 4080720 - RNA, 17 nt, Streptococcus pneumoniae R6
uuguaugaaaaguuuua

SEQ ID NO: 4080721 - RNA, 14 nt, Streptococcus pneumoniae R6
uuguaugagaggca

SEQ ID NO: 4080722 - RNA, 11 nt, Streptococcus pneumoniae R6
uuguauuuaua

SEQ ID NO: 4080723 - RNA, 23 nt, Streptococcus pneumoniae R6
uugucaaacaagaccucaauaug

SEQ ID NO: 4080724 - RNA, 23 nt, Streptococcus pneumoniae R6
uugucaaauuacgaugcuuuucu

SEQ ID NO: 4080725 - RNA, 15 nt, Streptococcus pneumoniae R6
uugucaaguuuggac

SEQ ID NO: 4080726 - RNA, 17 nt, Streptococcus pneumoniae R6
uugucaauuuccauuua

SEQ ID NO: 4080727 - RNA, 14 nt, Streptococcus pneumoniae R6
uugucacaaaggau

SEQ ID NO: 4080728 - RNA, 12 nt, Streptococcus pneumoniae R6
uugucacacaaa

SEQ ID NO: 4080729 - RNA, 16 nt, Streptococcus pneumoniae R6
uugucacgaaccacac

SEQ ID NO: 4080730 - RNA, 18 nt, Streptococcus pneumoniae R6
uugucaguaaaaaaaaca

SEQ ID NO: 4080731 - RNA, 18 nt, Streptococcus pneumoniae R6
uugucaucguuccaguuu

SEQ ID NO: 4080732 - RNA, 22 nt, Streptococcus pneumoniae R6
uugucaugucauguuagaaaaa

SEQ ID NO: 4080733 - RNA, 14 nt, Streptococcus pneumoniae R6
uuguccauaacgag

SEQ ID NO: 4080734 - RNA, 15 nt, Streptococcus pneumoniae R6
uuguccaucuguaau

SEQ ID NO: 4080735 - RNA, 15 nt, Streptococcus pneumoniae R6
uugucccaagaguag

SEQ ID NO: 4080736 - RNA, 17 nt, Streptococcus pneumoniae R6
uugucccaucauuccuu

SEQ ID NO: 4080737 - RNA, 23 nt, Streptococcus pneumoniae R6
uugucccaucauuccuucaaggg

SEQ ID NO: 4080738 - RNA, 15 nt, Streptococcus pneumoniae R6
uugucccuuuuucac

SEQ ID NO: 4080739 - RNA, 19 nt, Streptococcus pneumoniae R6
uuguccucaaugaauccga

SEQ ID NO: 4080740 - RNA, 14 nt, Streptococcus pneumoniae R6
uuguccugaaugau

SEQ ID NO: 4080741 - RNA, 21 nt, Streptococcus pneumoniae R6
uuguccuguguaagugacaaa

SEQ ID NO: 4080742 - RNA, 20 nt, Streptococcus pneumoniae R6
uuguccuuuagaaagguuuu

SEQ ID NO: 4080743 - RNA, 13 nt, Streptococcus pneumoniae R6
uuguccuuucuuu

SEQ ID NO: 4080744 - RNA, 16 nt, Streptococcus pneumoniae R6
uugucgucauaccagu

SEQ ID NO: 4080745 - RNA, 20 nt, Streptococcus pneumoniae R6
uugucgucauaccaguuuuu

SEQ ID NO: 4080746 - RNA, 14 nt, Streptococcus pneumoniae R6
uugucuaacuuuuu

SEQ ID NO: 4080747 - RNA, 16 nt, Streptococcus pneumoniae R6
uugucuaagcgaaaca

SEQ ID NO: 4080748 - RNA, 22 nt, Streptococcus pneumoniae R6
uugucuagauucgaucugauau

SEQ ID NO: 4080749 - RNA, 15 nt, Streptococcus pneumoniae R6
uugucuauaguuaaa

SEQ ID NO: 4080750 - RNA, 18 nt, Streptococcus pneumoniae R6
uugucuuugauuuacuau

SEQ ID NO: 4080751 - RNA, 18 nt, Streptococcus pneumoniae R6
uugugaaagcucuucuaa

SEQ ID NO: 4080752 - RNA, 16 nt, Streptococcus pneumoniae R6
uuuacuauauaucaug

SEQ ID NO: 4080753 - RNA, 20 nt, Streptococcus pneumoniae R6
uuuacucuccuccauaaaaa

SEQ ID NO: 4080754 - RNA, 13 nt, Streptococcus pneumoniae R6
uuuacuguugcug

SEQ ID NO: 4080755 - RNA, 12 nt, Streptococcus pneumoniae R6
uuuacuucauua

SEQ ID NO: 4080756 - RNA, 14 nt, Streptococcus pneumoniae R6
uuuacuucauuaug

SEQ ID NO: 4080757 - RNA, 15 nt, Streptococcus pneumoniae R6
uuuacuucauuuuug

SEQ ID NO: 4080758 - RNA, 13 nt, Streptococcus pneumoniae R6
uuuacuucuuugg

SEQ ID NO: 4080759 - RNA, 19 nt, Streptococcus pneumoniae R6
uuuacuuuauuuucucauc

SEQ ID NO: 4080760 - RNA, 21 nt, Streptococcus pneumoniae R6
uuuagaaauagagguguacua

SEQ ID NO: 4080761 - RNA, 21 nt, Streptococcus pneumoniae R6
uuuagaagcagagguguacua

SEQ ID NO: 4080762 - RNA, 21 nt, Streptococcus pneumoniae R6
uuuagaaguagauguguacua

SEQ ID NO: 4080763 - RNA, 21 nt, Streptococcus pneumoniae R6
uuuagaagugccaguguacua

SEQ ID NO: 4080764 - RNA, 13 nt, Streptococcus pneumoniae R6
uuuagacauuaua

SEQ ID NO: 4080765 - RNA, 15 nt, Streptococcus pneumoniae R6
uuuagauaagacuga

SEQ ID NO: 4080766 - RNA, 15 nt, Streptococcus pneumoniae R6
uuuagcagagaagag

SEQ ID NO: 4080767 - RNA, 16 nt, Streptococcus pneumoniae R6
uuuagcucuugcaaua

SEQ ID NO: 4080768 - RNA, 17 nt, Streptococcus pneumoniae R6
uuuagcuugcaaugagc

SEQ ID NO: 4080769 - RNA, 14 nt, Streptococcus pneumoniae R6
uuuaggaauauuau

SEQ ID NO: 4080770 - RNA, 19 nt, Streptococcus pneumoniae R6
uuuaggaauauuauauaaa

SEQ ID NO: 4080771 - RNA, 20 nt, Streptococcus pneumoniae R6
uuuaggagaaaaagaaguaa

SEQ ID NO: 4080772 - RNA, 19 nt, Streptococcus pneumoniae R6
uuuaguagaaaaugaaaua

SEQ ID NO: 4080773 - RNA, 19 nt, Streptococcus pneumoniae R6
uuuaguauaguaaacugaa

SEQ ID NO: 4080774 - RNA, 13 nt, Streptococcus pneumoniae R6
uuuaguaucaagc

SEQ ID NO: 4080775 - RNA, 19 nt, Streptococcus pneumoniae R6
uuuagucuauucuuuccuu

SEQ ID NO: 4080776 - RNA, 12 nt, Streptococcus pneumoniae R6
uuuagugaugua

SEQ ID NO: 4080777 - RNA, 16 nt, Streptococcus pneumoniae R6
uuuaguguauaugaag

SEQ ID NO: 4080778 - RNA, 16 nt, Streptococcus pneumoniae R6
uuuaguuccaauaacu

SEQ ID NO: 4080779 - RNA, 16 nt, Streptococcus pneumoniae R6
uuuaguucuguacugc

SEQ ID NO: 4080780 - RNA, 17 nt, Streptococcus pneumoniae R6
uuuaguuuuaccuuaau

SEQ ID NO: 4080781 - RNA, 17 nt, Streptococcus pneumoniae R6
uuuaguuuuaucuuaau

SEQ ID NO: 4080782 - RNA, 12 nt, Streptococcus pneumoniae R6
uuuauaaacuuu

SEQ ID NO: 4080783 - RNA, 18 nt, Streptococcus pneumoniae R6
uuuauaaaucuucuaaau

SEQ ID NO: 4080784 - RNA, 19 nt, Streptococcus pneumoniae R6
uuuauaauauaaacuuuuu

SEQ ID NO: 4080785 - RNA, 13 nt, Streptococcus pneumoniae R6
uuuauaauaucac

SEQ ID NO: 4080786 - RNA, 16 nt, Streptococcus pneumoniae R6
uuuauaaucauuaaaa

SEQ ID NO: 4080787 - RNA, 13 nt, Streptococcus pneumoniae R6
uuuauaauuuuaa

SEQ ID NO: 4080788 - RNA, 15 nt, Streptococcus pneumoniae R6
uuuauaauuuuaaag

SEQ ID NO: 4080789 - RNA, 14 nt, Streptococcus pneumoniae R6
uuuauacucaauga

SEQ ID NO: 4080790 - RNA, 22 nt, Streptococcus pneumoniae R6
uuuauacucaucugcuuucaaa

SEQ ID NO: 4080791 - RNA, 16 nt, Streptococcus pneumoniae R6
uuuauagaaaaauuuu

SEQ ID NO: 4080792 - RNA, 15 nt, Streptococcus pneumoniae R6
uuuauagaaaauuaa

SEQ ID NO: 4080793 - RNA, 20 nt, Streptococcus pneumoniae R6
uuuauagaauauauuucuca

SEQ ID NO: 4080794 - RNA, 20 nt, Streptococcus pneumoniae R6
uuuauagugguuauggaaaa

SEQ ID NO: 4080795 - RNA, 14 nt, Streptococcus pneumoniae R6
uuuauauaaaauaa

SEQ ID NO: 4080796 - RNA, 14 nt, Streptococcus pneumoniae R6
uuuauaugauuuca

SEQ ID NO: 4080797 - RNA, 23 nt, Streptococcus pneumoniae R6
uuuauaugauuucaauuuuaaau

SEQ ID NO: 4080798 - RNA, 19 nt, Streptococcus pneumoniae R6
uuuaucaccuccuucucca

SEQ ID NO: 4080799 - RNA, 20 nt, Streptococcus pneumoniae R6
uuuaucaccuccuucuccaa

SEQ ID NO: 4080800 - RNA, 22 nt, Streptococcus pneumoniae R6
uuuaucaguaaucucaaaacag

SEQ ID NO: 4080801 - RNA, 13 nt, Streptococcus pneumoniae R6
uuuaucaguauau

SEQ ID NO: 4080802 - RNA, 21 nt, Streptococcus pneumoniae R6
uuuaucauagaaauauuuacu

SEQ ID NO: 4080803 - RNA, 17 nt, Streptococcus pneumoniae R6
uuuaucauuuugaaauc

SEQ ID NO: 4080804 - RNA, 18 nt, Streptococcus pneumoniae R6
uuuauccaaggcauucau

SEQ ID NO: 4080805 - RNA, 16 nt, Streptococcus pneumoniae R6
uuuauccaaucuauuu

SEQ ID NO: 4080806 - RNA, 22 nt, Streptococcus pneumoniae R6
uuuauccaaucuauuuaugaaa

SEQ ID NO: 4080807 - RNA, 17 nt, Streptococcus pneumoniae R6
uuuauccauucacaaca

SEQ ID NO: 4080808 - RNA, 16 nt, Streptococcus pneumoniae R6
uuuaucgaaaagacuu

SEQ ID NO: 4080809 - RNA, 14 nt, Streptococcus pneumoniae R6
uuuaucugcaaccu

SEQ ID NO: 4080810 - RNA, 20 nt, Streptococcus pneumoniae R6
uuuaucugcaaccucaaagc

SEQ ID NO: 4080811 - RNA, 13 nt, Streptococcus pneumoniae R6
uuuaucuuuccuu

SEQ ID NO: 4080812 - RNA, 12 nt, Streptococcus pneumoniae R6
uuuaucuuugaa

SEQ ID NO: 4080813 - RNA, 15 nt, Streptococcus pneumoniae R6
uuuaugaaaaaguuu

SEQ ID NO: 4080814 - RNA, 20 nt, Streptococcus pneumoniae R6
uuuaugccguuucaacaauc

SEQ ID NO: 4080815 - RNA, 18 nt, Streptococcus pneumoniae R6
uuuaugcguuuuaucaua

SEQ ID NO: 4080816 - RNA, 16 nt, Streptococcus pneumoniae R6
uuuaugcuucaacucu

SEQ ID NO: 4080817 - RNA, 23 nt, Streptococcus pneumoniae R6
uuuaugcuuggugagaaaguuuu

SEQ ID NO: 4080818 - RNA, 22 nt, Streptococcus pneumoniae R6
uuuauggaaaaaaugaaauuaa

SEQ ID NO: 4080819 - RNA, 20 nt, Streptococcus pneumoniae R6
uuuauuaagcccuacuguac

SEQ ID NO: 4080820 - RNA, 13 nt, Streptococcus pneumoniae R6
uuuauuaaguaga

SEQ ID NO: 4080821 - RNA, 22 nt, Streptococcus pneumoniae R6
uuuauuacuucaauuucuaaug

SEQ ID NO: 4080822 - RNA, 18 nt, Streptococcus pneumoniae R6
uuuauuauuaauauauaa

SEQ ID NO: 4080823 - RNA, 22 nt, Streptococcus pneumoniae R6
uuuauucagacuauauaugcac

SEQ ID NO: 4080824 - RNA, 21 nt, Streptococcus pneumoniae R6
uuuauucagccaaggcuccca

SEQ ID NO: 4080825 - RNA, 14 nt, Streptococcus pneumoniae R6
uuuauuccauggua

SEQ ID NO: 4080826 - RNA, 18 nt, Streptococcus pneumoniae R6
uuuauucgauuacaauca

SEQ ID NO: 4080827 - RNA, 17 nt, Streptococcus pneumoniae R6
uuuauucuuaaauccac

SEQ ID NO: 4080828 - RNA, 17 nt, Streptococcus pneumoniae R6
uuuauugguuaaaugca

SEQ ID NO: 4080829 - RNA, 22 nt, Streptococcus pneumoniae R6
uuuauuguagcauauuuuguuu

SEQ ID NO: 4080830 - RNA, 17 nt, Streptococcus pneumoniae R6
uuuauugucucuaaaaa

SEQ ID NO: 4080831 - RNA, 15 nt, Streptococcus pneumoniae R6
uuuauuuaagcaaaa

SEQ ID NO: 4080832 - RNA, 15 nt, Streptococcus pneumoniae R6
uuuauuuaaucauuu

SEQ ID NO: 4080833 - RNA, 16 nt, Streptococcus pneumoniae R6
uuuauuuaaucauuua

SEQ ID NO: 4080834 - RNA, 20 nt, Streptococcus pneumoniae R6
uuuauuuaccgaaaaauuaa

SEQ ID NO: 4080835 - RNA, 12 nt, Streptococcus pneumoniae R6
uuuauuucuuga

SEQ ID NO: 4080836 - RNA, 19 nt, Streptococcus pneumoniae R6
uuuauuuucucaucaaaug

SEQ ID NO: 4080837 - RNA, 13 nt, Streptococcus pneumoniae R6
uuuauuuuuaugc

SEQ ID NO: 4080838 - RNA, 13 nt, Streptococcus pneumoniae R6
uuucaaaaaauau

SEQ ID NO: 4080839 - RNA, 21 nt, Streptococcus pneumoniae R6
uuucaaaaaauugcacuuucc

SEQ ID NO: 4080840 - RNA, 20 nt, Streptococcus pneumoniae R6
uuucaaaaacgacagauucu

SEQ ID NO: 4080841 - RNA, 22 nt, Streptococcus pneumoniae R6
uuucaaaaauucugccaacuua

SEQ ID NO: 4080842 - RNA, 21 nt, Streptococcus pneumoniae R6
uuucaaaagcuaauagagcug

SEQ ID NO: 4080843 - RNA, 22 nt, Streptococcus pneumoniae R6
uuucaaaagcuaauagagcuga

SEQ ID NO: 4080844 - RNA, 16 nt, Streptococcus pneumoniae R6
uuucaaaaucagaaaa

SEQ ID NO: 4080845 - RNA, 21 nt, Streptococcus pneumoniae R6
uuucaaaaugacaauuuuucc

SEQ ID NO: 4080846 - RNA, 13 nt, Streptococcus pneumoniae R6
uuucaaagaagag

SEQ ID NO: 4080847 - RNA, 17 nt, Streptococcus pneumoniae R6
uuucaaagaguauuaaa

SEQ ID NO: 4080848 - RNA, 21 nt, Streptococcus pneumoniae R6
uuucaaagccuguccuguuag

SEQ ID NO: 4080849 - RNA, 14 nt, Streptococcus pneumoniae R6
uuucaaagccuucc

SEQ ID NO: 4080850 - RNA, 23 nt, Streptococcus pneumoniae R6
uuucaaagcgggauuuaaaauaa

SEQ ID NO: 4080851 - RNA, 18 nt, Streptococcus pneumoniae R6
uuucaaaggcuuuuucuu

SEQ ID NO: 4080852 - RNA, 18 nt, Streptococcus pneumoniae R6
uuucaaaguuaacuuuuc

SEQ ID NO: 4080853 - RNA, 14 nt, Streptococcus pneumoniae R6
uuucaaaugaaaua

SEQ ID NO: 4080854 - RNA, 16 nt, Streptococcus pneumoniae R6
uuucaaaugaaauauu

SEQ ID NO: 4080855 - RNA, 15 nt, Streptococcus pneumoniae R6
uuucgaagcuugcuu

SEQ ID NO: 4080856 - RNA, 15 nt, Streptococcus pneumoniae R6
uuucgaguaacauca

SEQ ID NO: 4080857 - RNA, 19 nt, Streptococcus pneumoniae R6
uuucgauugaaauucgcuu

SEQ ID NO: 4080858 - RNA, 14 nt, Streptococcus pneumoniae R6
uuucgcuauuuaaa

SEQ ID NO: 4080859 - RNA, 13 nt, Streptococcus pneumoniae R6
uuucggcuguucu

SEQ ID NO: 4080860 - RNA, 13 nt, Streptococcus pneumoniae R6
uuucggcuuuagc

SEQ ID NO: 4080861 - RNA, 21 nt, Streptococcus pneumoniae R6
uuucguacuauuucagauuca

SEQ ID NO: 4080862 - RNA, 19 nt, Streptococcus pneumoniae R6
uuucgucaccaaauuucau

SEQ ID NO: 4080863 - RNA, 18 nt, Streptococcus pneumoniae R6
uuucgucuuccauuucuu

SEQ ID NO: 4080864 - RNA, 15 nt, Streptococcus pneumoniae R6
uuucguuccagacuc

SEQ ID NO: 4080865 - RNA, 17 nt, Streptococcus pneumoniae R6
uuucguuugauaaguuu

SEQ ID NO: 4080866 - RNA, 14 nt, Streptococcus pneumoniae R6
uuucuaaaaaauug

SEQ ID NO: 4080867 - RNA, 15 nt, Streptococcus pneumoniae R6
uuucuaaaacauugu

SEQ ID NO: 4080868 - RNA, 20 nt, Streptococcus pneumoniae R6
uuucuaaaacauugugagaa

SEQ ID NO: 4080869 - RNA, 14 nt, Streptococcus pneumoniae R6
uuucuaaaauagug

SEQ ID NO: 4080870 - RNA, 16 nt, Streptococcus pneumoniae R6
uuucuaaagaauuuga

SEQ ID NO: 4080871 - RNA, 15 nt, Streptococcus pneumoniae R6
uuucuaaagcaauuu

SEQ ID NO: 4080872 - RNA, 19 nt, Streptococcus pneumoniae R6
uuucuaaauuuaacauuaa

SEQ ID NO: 4080873 - RNA, 23 nt, Streptococcus pneumoniae R6
uuucuaauacaagcucaucuuug

SEQ ID NO: 4080874 - RNA, 15 nt, Streptococcus pneumoniae R6
uuucuaauuauuuca

SEQ ID NO: 4080875 - RNA, 13 nt, Streptococcus pneumoniae R6
uuucuaauuguaa

SEQ ID NO: 4080876 - RNA, 21 nt, Streptococcus pneumoniae R6
uuucuacaauucgcuauuuuu

SEQ ID NO: 4080877 - RNA, 23 nt, Streptococcus pneumoniae R6
uuucuacagcuguaucaauugcu

SEQ ID NO: 4080878 - RNA, 21 nt, Streptococcus pneumoniae R6
uuucuaccgaucucaucuuca

SEQ ID NO: 4080879 - RNA, 14 nt, Streptococcus pneumoniae R6
uuucuacuaaaauu

SEQ ID NO: 4080880 - RNA, 18 nt, Streptococcus pneumoniae R6
uuucuacuccuuuucuau

SEQ ID NO: 4080881 - RNA, 22 nt, Streptococcus pneumoniae R6
uuucuacuguauacuuuuucag

SEQ ID NO: 4080882 - RNA, 23 nt, Streptococcus pneumoniae R6
uuucuagaaauuaauuugacuuu

SEQ ID NO: 4080883 - RNA, 13 nt, Streptococcus pneumoniae R6
uuucuaguuugcu

SEQ ID NO: 4080884 - RNA, 14 nt, Streptococcus pneumoniae R6
uuucuaguuugcuc

SEQ ID NO: 4080885 - RNA, 18 nt, Streptococcus pneumoniae R6
uuucuaguuugcucuuug

SEQ ID NO: 4080886 - RNA, 19 nt, Streptococcus pneumoniae R6
uuucuauaaauucauuuga

SEQ ID NO: 4080887 - RNA, 22 nt, Streptococcus pneumoniae R6
uuucuauagaaagcuuacauca

SEQ ID NO: 4080888 - RNA, 21 nt, Streptococcus pneumoniae R6
uuucuauaguagauugaaaua

SEQ ID NO: 4080889 - RNA, 13 nt, Streptococcus pneumoniae R6
uuucuauauuuau

SEQ ID NO: 4080890 - RNA, 18 nt, Streptococcus pneumoniae R6
uuucuaucaacucaagaa

SEQ ID NO: 4080891 - RNA, 16 nt, Streptococcus pneumoniae R6
uuucucaaaaaaguua

SEQ ID NO: 4080892 - RNA, 19 nt, Streptococcus pneumoniae R6
uuucucacuuaauucuuca

SEQ ID NO: 4080893 - RNA, 20 nt, Streptococcus pneumoniae R6
uuucucacuuaauucuucau

SEQ ID NO: 4080894 - RNA, 20 nt, Streptococcus pneumoniae R6
uuucuccaaagccuucuugg

SEQ ID NO: 4080895 - RNA, 14 nt, Streptococcus pneumoniae R6
uuucuccauagauu

SEQ ID NO: 4080896 - RNA, 17 nt, Streptococcus pneumoniae R6
uuucuccauagauuucu

SEQ ID NO: 4080897 - RNA, 19 nt, Streptococcus pneumoniae R6
uuucuccgaggauuuccca

SEQ ID NO: 4080898 - RNA, 21 nt, Streptococcus pneumoniae R6
uuucuccuauuuucuucuuua

SEQ ID NO: 4080899 - RNA, 16 nt, Streptococcus pneumoniae R6
uuucuccuguuucaaa

SEQ ID NO: 4080900 - RNA, 19 nt, Streptococcus pneumoniae R6
uuucucuauucuuuuuugg

SEQ ID NO: 4080901 - RNA, 15 nt, Streptococcus pneumoniae R6
uuucugaaaucaaca

SEQ ID NO: 4080902 - RNA, 20 nt, Streptococcus pneumoniae R6
uuucugauagauuuauuuuu

SEQ ID NO: 4080903 - RNA, 17 nt, Streptococcus pneumoniae R6
uuucugccauauguccu

SEQ ID NO: 4080904 - RNA, 18 nt, Streptococcus pneumoniae R6
uuucuggauaacugaaau

SEQ ID NO: 4080905 - RNA, 22 nt, Streptococcus pneumoniae R6
uuucuggauuuccauuuuccau

SEQ ID NO: 4080906 - RNA, 18 nt, Streptococcus pneumoniae R6
uuucuggcagauagagac

SEQ ID NO: 4080907 - RNA, 13 nt, Streptococcus pneumoniae R6
uuucuggcucuuu

SEQ ID NO: 4080908 - RNA, 20 nt, Streptococcus pneumoniae R6
uuucuggucuagcuauuucu

SEQ ID NO: 4080909 - RNA, 21 nt, Streptococcus pneumoniae R6
uuucuggucuagcuauuucuu

SEQ ID NO: 4080910 - RNA, 20 nt, Streptococcus pneumoniae R6
uuucuggucuuuuugcucau

SEQ ID NO: 4080911 - RNA, 16 nt, Streptococcus pneumoniae R6
uuucuguaauuucuac

SEQ ID NO: 4080912 - RNA, 20 nt, Streptococcus pneumoniae R6
uuucuguaauuucuacugua

SEQ ID NO: 4080913 - RNA, 15 nt, Streptococcus pneumoniae R6
uuucuguggauacuu

SEQ ID NO: 4080914 - RNA, 18 nt, Streptococcus pneumoniae R6
uuucuguugauauuucca

SEQ ID NO: 4080915 - RNA, 19 nt, Streptococcus pneumoniae R6
uuucuguugauauuuccau

SEQ ID NO: 4080916 - RNA, 17 nt, Streptococcus pneumoniae R6
uuucuguuuaauagcuu

SEQ ID NO: 4080917 - RNA, 15 nt, Streptococcus pneumoniae R6
uuucuuaucuugucc

SEQ ID NO: 4080918 - RNA, 20 nt, Streptococcus pneumoniae R6
uuucuucaacccacuacagu

SEQ ID NO: 4080919 - RNA, 16 nt, Streptococcus pneumoniae R6
uuucuucaauugguuu

SEQ ID NO: 4080920 - RNA, 13 nt, Streptococcus pneumoniae R6
uuucuuccuuucu

SEQ ID NO: 4080921 - RNA, 16 nt, Streptococcus pneumoniae R6
uuucuucgaaauucca

SEQ ID NO: 4080922 - RNA, 14 nt, Streptococcus pneumoniae R6
uuucuucuucguca

SEQ ID NO: 4080923 - RNA, 17 nt, Streptococcus pneumoniae R6
uuucuucuuucacuuca

SEQ ID NO: 4080924 - RNA, 21 nt, Streptococcus pneumoniae R6
uuucuugagaagagcuucuuu

SEQ ID NO: 4080925 - RNA, 20 nt, Streptococcus pneumoniae R6
uuucuugaugaaagauauuu

SEQ ID NO: 4080926 - RNA, 14 nt, Streptococcus pneumoniae R6
uuucuugauuuguu

SEQ ID NO: 4080927 - RNA, 16 nt, Streptococcus pneumoniae R6
uuucuuggucauuuga

SEQ ID NO: 4080928 - RNA, 13 nt, Streptococcus pneumoniae R6
uuucuuuaaaaaa

SEQ ID NO: 4080929 - RNA, 17 nt, Streptococcus pneumoniae R6
uuucuuuaaucuugacu

SEQ ID NO: 4080930 - RNA, 14 nt, Streptococcus pneumoniae R6
uuucuuuaucuuug

SEQ ID NO: 4080931 - RNA, 21 nt, Streptococcus pneumoniae R6
uuucuuucucacuuaauucuu

SEQ ID NO: 4080932 - RNA, 21 nt, Streptococcus pneumoniae R6
uuucuuuggcaccuuuguaug

SEQ ID NO: 4080933 - RNA, 20 nt, Streptococcus pneumoniae R6
uuucuuuuuugaaguuuuca

SEQ ID NO: 4080934 - RNA, 17 nt, Streptococcus pneumoniae R6
uuugaaaaaaauuuuau

SEQ ID NO: 4080935 - RNA, 12 nt, Streptococcus pneumoniae R6
uuugaaaaacua

SEQ ID NO: 4080936 - RNA, 13 nt, Streptococcus pneumoniae R6
uuugaaaaacuag

SEQ ID NO: 4080937 - RNA, 17 nt, Streptococcus pneumoniae R6
uuugaaaggaaagcaua

SEQ ID NO: 4080938 - RNA, 12 nt, Streptococcus pneumoniae R6
uuugaacaaagu

SEQ ID NO: 4080939 - RNA, 21 nt, Streptococcus pneumoniae R6
uuugaacaaauguugaaucau

SEQ ID NO: 4080940 - RNA, 17 nt, Streptococcus pneumoniae R6
uuugaacaccugauuuu

SEQ ID NO: 4080941 - RNA, 19 nt, Streptococcus pneumoniae R6
uuugaacaccugauuuuau

SEQ ID NO: 4080942 - RNA, 12 nt, Streptococcus pneumoniae R6
uuugaacuugaa

SEQ ID NO: 4080943 - RNA, 13 nt, Streptococcus pneumoniae R6
uuugaacuugaau

SEQ ID NO: 4080944 - RNA, 19 nt, Streptococcus pneumoniae R6
uuugaacuugugcaacuuc

SEQ ID NO: 4080945 - RNA, 16 nt, Streptococcus pneumoniae R6
uuugaagaguauuauu

SEQ ID NO: 4080946 - RNA, 13 nt, Streptococcus pneumoniae R6
uuugaagauaucg

SEQ ID NO: 4080947 - RNA, 14 nt, Streptococcus pneumoniae R6
uuugaaguuuucaa

SEQ ID NO: 4080948 - RNA, 15 nt, Streptococcus pneumoniae R6
uuugaauauccccug

SEQ ID NO: 4080949 - RNA, 20 nt, Streptococcus pneumoniae R6
uuugaaugccaaaauuccau

SEQ ID NO: 4080950 - RNA, 13 nt, Streptococcus pneumoniae R6
uuugaauuccaaa

SEQ ID NO: 4080951 - RNA, 14 nt, Streptococcus pneumoniae R6
uuugaauuucaugg

SEQ ID NO: 4080952 - RNA, 16 nt, Streptococcus pneumoniae R6
uuugacaaguaaguag

SEQ ID NO: 4080953 - RNA, 18 nt, Streptococcus pneumoniae R6
uuugacaaguaaguagca

SEQ ID NO: 4080954 - RNA, 21 nt, Streptococcus pneumoniae R6
uuugacaaguaaguagcaucu

SEQ ID NO: 4080955 - RNA, 19 nt, Streptococcus pneumoniae R6
uuugacguucuucugcagu

SEQ ID NO: 4080956 - RNA, 14 nt, Streptococcus pneumoniae R6
uuugacuguccuga

SEQ ID NO: 4080957 - RNA, 13 nt, Streptococcus pneumoniae R6
uuugacuuccaaa

SEQ ID NO: 4080958 - RNA, 18 nt, Streptococcus pneumoniae R6
uuuuaaauuuacuuaaaa

SEQ ID NO: 4080959 - RNA, 13 nt, Streptococcus pneumoniae R6
uuuuaaauuuggu

SEQ ID NO: 4080960 - RNA, 13 nt, Streptococcus pneumoniae R6
uuuuaacaaaaau

SEQ ID NO: 4080961 - RNA, 14 nt, Streptococcus pneumoniae R6
uuuuaacaaaaauu

SEQ ID NO: 4080962 - RNA, 15 nt, Streptococcus pneumoniae R6
uuuuaacaaaaauuu

SEQ ID NO: 4080963 - RNA, 13 nt, Streptococcus pneumoniae R6
uuuuaacagauuu

SEQ ID NO: 4080964 - RNA, 19 nt, Streptococcus pneumoniae R6
uuuuaaccagaucuuagaa

SEQ ID NO: 4080965 - RNA, 22 nt, Streptococcus pneumoniae R6
uuuuaaccagaucuuagaagca

SEQ ID NO: 4080966 - RNA, 13 nt, Streptococcus pneumoniae R6
uuuuaacuucagc

SEQ ID NO: 4080967 - RNA, 16 nt, Streptococcus pneumoniae R6
uuuuaagaaagaucuu

SEQ ID NO: 4080968 - RNA, 17 nt, Streptococcus pneumoniae R6
uuuuaaggacugaaaua

SEQ ID NO: 4080969 - RNA, 22 nt, Streptococcus pneumoniae R6
uuuuaagguuguagauggaacu

SEQ ID NO: 4080970 - RNA, 22 nt, Streptococcus pneumoniae R6
uuuuaagguuguggauggaacu

SEQ ID NO: 4080971 - RNA, 15 nt, Streptococcus pneumoniae R6
uuuuaauuauuuuca

SEQ ID NO: 4080972 - RNA, 19 nt, Streptococcus pneumoniae R6
uuuuaauucuuuuucaaau

SEQ ID NO: 4080973 - RNA, 13 nt, Streptococcus pneumoniae R6
uuuuaauuuuucu

SEQ ID NO: 4080974 - RNA, 19 nt, Streptococcus pneumoniae R6
uuuuaauuuuucuuuguag

SEQ ID NO: 4080975 - RNA, 14 nt, Streptococcus pneumoniae R6
uuuuacaaauacca

SEQ ID NO: 4080976 - RNA, 20 nt, Streptococcus pneumoniae R6
uuuuacaauuguaaaaagag

SEQ ID NO: 4080977 - RNA, 17 nt, Streptococcus pneumoniae R6
uuuuacaucuguuuuaa

SEQ ID NO: 4080978 - RNA, 17 nt, Streptococcus pneumoniae R6
uuuuacuauaaaauaag

SEQ ID NO: 4080979 - RNA, 15 nt, Streptococcus pneumoniae R6
uuuuacucaaggacu

SEQ ID NO: 4080980 - RNA, 21 nt, Streptococcus pneumoniae R6
uuuuacucuaguuuuuauaau

SEQ ID NO: 4080981 - RNA, 22 nt, Streptococcus pneumoniae R6
uuuuacuuauaauuaaaaguuu

SEQ ID NO: 4080982 - RNA, 16 nt, Streptococcus pneumoniae R6
uuuuacuucuucccca

SEQ ID NO: 4080983 - RNA, 22 nt, Streptococcus pneumoniae R6
uuuuagaugagaaagauuuuca

SEQ ID NO: 4080984 - RNA, 23 nt, Streptococcus pneumoniae R6
uuuuagaugagaaagauuuucaa

SEQ ID NO: 4080985 - RNA, 22 nt, Streptococcus pneumoniae R6
uuuuagauugcuuuccaauaau

SEQ ID NO: 4080986 - RNA, 14 nt, Streptococcus pneumoniae R6
uuuuagauuuuuua

SEQ ID NO: 4080987 - RNA, 20 nt, Streptococcus pneumoniae R6
uuuuaggaauauuauauaaa

SEQ ID NO: 4080988 - RNA, 18 nt, Streptococcus pneumoniae R6
uuuuaggacauaaauaug

SEQ ID NO: 4080989 - RNA, 17 nt, Streptococcus pneumoniae R6
uuuuaggcaauaaaaua

SEQ ID NO: 4080990 - RNA, 14 nt, Streptococcus pneumoniae R6
uuuuaguucuacuu

SEQ ID NO: 4080991 - RNA, 14 nt, Streptococcus pneumoniae R6
uuuuaguuugcauu

SEQ ID NO: 4080992 - RNA, 21 nt, Streptococcus pneumoniae R6
uuuuaguuugcauuggcuauu

SEQ ID NO: 4080993 - RNA, 14 nt, Streptococcus pneumoniae R6
uuuuauaauagaaa

SEQ ID NO: 4080994 - RNA, 13 nt, Streptococcus pneumoniae R6
uuuuauaauauca

SEQ ID NO: 4080995 - RNA, 19 nt, Streptococcus pneumoniae R6
uuuuauaauaucacuaaau

SEQ ID NO: 4080996 - RNA, 13 nt, Streptococcus pneumoniae R6
uuuuauacucaau

SEQ ID NO: 4080997 - RNA, 20 nt, Streptococcus pneumoniae R6
uuuuauacuuuuaauauuuc

SEQ ID NO: 4080998 - RNA, 20 nt, Streptococcus pneumoniae R6
uuuuauaggcucuuugucaa

SEQ ID NO: 4080999 - RNA, 21 nt, Streptococcus pneumoniae R6
uuuuauauaaaauaauuaaaa

SEQ ID NO: 4081000 - RNA, 17 nt, Streptococcus pneumoniae R6
uuuuauauauaaaauuu

SEQ ID NO: 4081001 - RNA, 23 nt, Streptococcus pneumoniae R6
uuuuauauccuaaaaaagagcug

SEQ ID NO: 4081002 - RNA, 23 nt, Streptococcus pneumoniae R6
uuuuauaugauuucaauuuuaaa

SEQ ID NO: 4081003 - RNA, 22 nt, Streptococcus pneumoniae R6
uuuuaucauagaaauauuuacu

SEQ ID NO: 4081004 - RNA, 16 nt, Streptococcus pneumoniae R6
uuuuauccauuuuuca

SEQ ID NO: 4081005 - RNA, 21 nt, Streptococcus pneumoniae R6
uuuuauccucaaaauucuguc

SEQ ID NO: 4081006 - RNA, 17 nt, Streptococcus pneumoniae R6
uuuuaucgaaaagacuu

SEQ ID NO: 4081007 - RNA, 13 nt, Streptococcus pneumoniae R6
uuuuaucugcaau

SEQ ID NO: 4081008 - RNA, 15 nt, Streptococcus pneumoniae R6
uuuuaucuuugaaau

SEQ ID NO: 4081009 - RNA, 13 nt, Streptococcus pneumoniae R6
uuuuauuacauaa

SEQ ID NO: 4081010 - RNA, 22 nt, Streptococcus pneumoniae R6
uuuuauuauguagagacuuaua

SEQ ID NO: 4081011 - RNA, 13 nt, Streptococcus pneumoniae R6
uuuuauuauuaau

SEQ ID NO: 4081012 - RNA, 23 nt, Streptococcus pneumoniae R6
uuuuauuauuuccucaauguuuu

SEQ ID NO: 4081013 - RNA, 11 nt, Streptococcus pneumoniae R6
uuuuauuuaag

SEQ ID NO: 4081014 - RNA, 13 nt, Streptococcus pneumoniae R6
uuuuauuucaaau

SEQ ID NO: 4081015 - RNA, 22 nt, Streptococcus pneumoniae R6
uuuuauuuucccaguagcuauu

SEQ ID NO: 4081016 - RNA, 13 nt, Streptococcus pneumoniae R6
uuuucaaaaaaau

SEQ ID NO: 4081017 - RNA, 12 nt, Streptococcus pneumoniae R6
uuuucaaaaaau

SEQ ID NO: 4081018 - RNA, 20 nt, Streptococcus pneumoniae R6
uuuucaaaacugguccagag

SEQ ID NO: 4081019 - RNA, 15 nt, Streptococcus pneumoniae R6
uuuucaaaaucagaa

SEQ ID NO: 4081020 - RNA, 22 nt, Streptococcus pneumoniae R6
uuuucaaaaucagaaaaacgca

SEQ ID NO: 4081021 - RNA, 12 nt, Streptococcus pneumoniae R6
uuuucaaaauga

SEQ ID NO: 4081022 - RNA, 20 nt, Streptococcus pneumoniae R6
uuuucaaaaugacaauuuuu

SEQ ID NO: 4081023 - RNA, 23 nt, Streptococcus pneumoniae R6
uuuucaaaaugacaauuuuucca

SEQ ID NO: 4081024 - RNA, 15 nt, Streptococcus pneumoniae R6
uuuucaaagacuucu

SEQ ID NO: 4081025 - RNA, 17 nt, Streptococcus pneumoniae R6
uuuucaaaguuccgaaa

SEQ ID NO: 4081026 - RNA, 13 nt, Streptococcus pneumoniae R6
uuuucaaaguuuc

SEQ ID NO: 4081027 - RNA, 18 nt, Streptococcus pneumoniae R6
uuuucaaauguauuugaa

SEQ ID NO: 4081028 - RNA, 22 nt, Streptococcus pneumoniae R6
uuuucaaauucuuuagaaaacu

SEQ ID NO: 4081029 - RNA, 15 nt, Streptococcus pneumoniae R6
uuuucaaucaagaca

SEQ ID NO: 4081030 - RNA, 21 nt, Streptococcus pneumoniae R6
uuuucaaucaaugucaacaua

SEQ ID NO: 4081031 - RNA, 20 nt, Streptococcus pneumoniae R6
uuuucaauuugauuaaaguu

SEQ ID NO: 4081032 - RNA, 19 nt, Streptococcus pneumoniae R6
uuuucacauuuucaaaaac

SEQ ID NO: 4081033 - RNA, 17 nt, Streptococcus pneumoniae R6
uuuucaccagaaaguac

SEQ ID NO: 4081034 - RNA, 21 nt, Streptococcus pneumoniae R6
uuuucacgauucaucaagaga

SEQ ID NO: 4081035 - RNA, 15 nt, Streptococcus pneumoniae R6
uuuucagaacuuuua

SEQ ID NO: 4081036 - RNA, 18 nt, Streptococcus pneumoniae R6
uuuucaguuuuauuuuug

SEQ ID NO: 4081037 - RNA, 16 nt, Streptococcus pneumoniae R6
uuuucauaaagagaag

SEQ ID NO: 4081038 - RNA, 11 nt, Streptococcus pneumoniae R6
uuuucauaagc

SEQ ID NO: 4081039 - RNA, 16 nt, Streptococcus pneumoniae R6
uuuucauaauuuuuuu

SEQ ID NO: 4081040 - RNA, 14 nt, Streptococcus pneumoniae R6
uuuucauagaaauc

SEQ ID NO: 4081041 - RNA, 14 nt, Streptococcus pneumoniae R6
uuuucauuccaaac

SEQ ID NO: 4081042 - RNA, 18 nt, Streptococcus pneumoniae R6
uuuucauuccaaacgucu

SEQ ID NO: 4081043 - RNA, 13 nt, Streptococcus pneumoniae R6
uuuucauucuacu

SEQ ID NO: 4081044 - RNA, 18 nt, Streptococcus pneumoniae R6
uuuucauugagcuuuaaa

SEQ ID NO: 4081045 - RNA, 19 nt, Streptococcus pneumoniae R6
uuuucauugaguaugaaau

SEQ ID NO: 4081046 - RNA, 22 nt, Streptococcus pneumoniae R6
uuuucauugaguaugaaauaag

SEQ ID NO: 4081047 - RNA, 22 nt, Streptococcus pneumoniae R6
uuuucauugaguauuauuucau

SEQ ID NO: 4081048 - RNA, 15 nt, Streptococcus pneumoniae R6
uuuuccaaacauaca

SEQ ID NO: 4081049 - RNA, 16 nt, Streptococcus pneumoniae R6
uuuuccgaccucagac

SEQ ID NO: 4081050 - RNA, 19 nt, Streptococcus pneumoniae R6
uuuuccgaccucagacucg

SEQ ID NO: 4081051 - RNA, 20 nt, Streptococcus pneumoniae R6
uuuuccuaaucaauuuguuc

SEQ ID NO: 4081052 - RNA, 18 nt, Streptococcus pneumoniae R6
uuuuccugauuaaaauca

SEQ ID NO: 4081053 - RNA, 15 nt, Streptococcus pneumoniae R6
uuuuccuugaccuua

SEQ ID NO: 4081054 - RNA, 20 nt, Streptococcus pneumoniae R6
uuuuccuugaccuuaucagu

SEQ ID NO: 4081055 - RNA, 17 nt, Streptococcus pneumoniae R6
uuuucgaaaauucuuug

SEQ ID NO: 4081056 - RNA, 18 nt, Streptococcus pneumoniae R6
uuuucgaagaguauaaaa

SEQ ID NO: 4081057 - RNA, 20 nt, Streptococcus pneumoniae R6
uuuucgaagaguauaaaauc

SEQ ID NO: 4081058 - RNA, 21 nt, Streptococcus pneumoniae R6
uuuucgaagaguauaaaauca

SEQ ID NO: 4081059 - RNA, 23 nt, Streptococcus pneumoniae R6
uuuucgcuuggauuuucaaggua

SEQ ID NO: 4081060 - RNA, 16 nt, Streptococcus pneumoniae R6
uuuuucggcaguuuuu

SEQ ID NO: 4081061 - RNA, 19 nt, Streptococcus pneumoniae R6
uuuuucggcaguuuuuucu

SEQ ID NO: 4081062 - RNA, 19 nt, Streptococcus pneumoniae R6
uuuuucucaaucaguuuuu

SEQ ID NO: 4081063 - RNA, 21 nt, Streptococcus pneumoniae R6
uuuuucucaucuauuuuuacu

SEQ ID NO: 4081064 - RNA, 13 nt, Streptococcus pneumoniae R6
uuuuucuuuguuc

SEQ ID NO: 4081065 - RNA, 20 nt, Streptococcus pneumoniae R6
uuuuugaaagucauauuucu

SEQ ID NO: 4081066 - RNA, 13 nt, Streptococcus pneumoniae R6
uuuuugaacaccu

SEQ ID NO: 4081067 - RNA, 21 nt, Streptococcus pneumoniae R6
uuuuugaaguuuucaaaguuu

SEQ ID NO: 4081068 - RNA, 14 nt, Streptococcus pneumoniae R6
uuuuugauaagaua

SEQ ID NO: 4081069 - RNA, 23 nt, Streptococcus pneumoniae R6
uuuuugauacaaguucaucuuca

SEQ ID NO: 4081070 - RNA, 20 nt, Streptococcus pneumoniae R6
uuuuugauacagccuucuuu

SEQ ID NO: 4081071 - RNA, 13 nt, Streptococcus pneumoniae R6
uuuuugauaugag

SEQ ID NO: 4081072 - RNA, 11 nt, Streptococcus pneumoniae R6
uuuuugauguu

SEQ ID NO: 4081073 - RNA, 15 nt, Streptococcus pneumoniae R6
uuuuugauguucaaa

SEQ ID NO: 4081074 - RNA, 15 nt, Streptococcus pneumoniae R6
uuuuugauuucuucu

SEQ ID NO: 4081075 - RNA, 17 nt, Streptococcus pneumoniae R6
uuuuugcaagugcucca

SEQ ID NO: 4081076 - RNA, 19 nt, Streptococcus pneumoniae R6
uuuuugcccucuaaauaca

SEQ ID NO: 4081077 - RNA, 16 nt, Streptococcus pneumoniae R6
uuuuugccuaaaauuc

SEQ ID NO: 4081078 - RNA, 17 nt, Streptococcus pneumoniae R6
uuuuugccuaaaauuca

SEQ ID NO: 4081079 - RNA, 21 nt, Streptococcus pneumoniae R6
uuuuuggauuggauaguuuuu

SEQ ID NO: 4081080 - RNA, 21 nt, Streptococcus pneumoniae R6
uuuuuggcaaccucgauggcu

SEQ ID NO: 4081081 - RNA, 12 nt, Streptococcus pneumoniae R6
uuuuuguauauu

SEQ ID NO: 4081082 - RNA, 23 nt, Streptococcus pneumoniae R6
uuuuuguuagauuuauaauuuca

SEQ ID NO: 4081083 - RNA, 22 nt, Streptococcus pneumoniae R6
uuuuuuauaacaguauacugga

SEQ ID NO: 4081084 - RNA, 16 nt, Streptococcus pneumoniae R6
uuuuuuauaagcaauu

SEQ ID NO: 4081085 - RNA, 14 nt, Streptococcus pneumoniae R6
uuuuuuauaauauc

SEQ ID NO: 4081086 - RNA, 12 nt, Streptococcus pneumoniae R6
uuuuuucuaauu

SEQ ID NO: 4081087 - RNA, 12 nt, Streptococcus pneumoniae R6
uuuuuucucaau

SEQ ID NO: 4081088 - RNA, 11 nt, Streptococcus pneumoniae R6
uuuuuucucug

SEQ ID NO: 4081089 - RNA, 12 nt, Streptococcus pneumoniae R6
uuuuuucugaag

SEQ ID NO: 4081090 - RNA, 22 nt, Streptococcus pneumoniae R6
uuuuuugauuggcuuugacuua

SEQ ID NO: 4081091 - RNA, 13 nt, Streptococcus pneumoniae R6
uuuuuugauuuca

SEQ ID NO: 4081092 - RNA, 12 nt, Streptococcus pneumoniae R6
aaaaaaaaaagu

SEQ ID NO: 4081093 - RNA, 12 nt, Streptococcus pneumoniae R6
aaaaaaacaaua

SEQ ID NO: 4081094 - RNA, 14 nt, Streptococcus pneumoniae R6
aaaaaaacuuaaaa

SEQ ID NO: 4081095 - RNA, 13 nt, Streptococcus pneumoniae R6
aaaaaaaugaaaa

SEQ ID NO: 4081096 - RNA, 23 nt, Streptococcus pneumoniae R6
aaaaaaauuuggaaaauaguuuu

SEQ ID NO: 4081097 - RNA, 17 nt, Streptococcus pneumoniae R6
aaaaaaauuuuauuuaa

SEQ ID NO: 4081098 - RNA, 15 nt, Streptococcus pneumoniae R6
aaaaaaauuuuuaaa

SEQ ID NO: 4081099 - RNA, 17 nt, Streptococcus pneumoniae R6
aaaaaacaaaguauuaa

SEQ ID NO: 4081100 - RNA, 12 nt, Streptococcus pneumoniae R6
aaaaaacaauaa

SEQ ID NO: 4081101 - RNA, 13 nt, Streptococcus pneumoniae R6
aaaaaacaauaaa

SEQ ID NO: 4081102 - RNA, 20 nt, Streptococcus pneumoniae R6
aaaaaaccccagcauaaaca

SEQ ID NO: 4081103 - RNA, 23 nt, Streptococcus pneumoniae R6
aaaaaacuacguuuugcuaauca

SEQ ID NO: 4081104 - RNA, 20 nt, Streptococcus pneumoniae R6
aaaaaagaagcagaaaaauu

SEQ ID NO: 4081105 - RNA, 13 nt, Streptococcus pneumoniae R6
aaaaaaggaguaa

SEQ ID NO: 4081106 - RNA, 18 nt, Streptococcus pneumoniae R6
aaaaaaggaguaacuaug

SEQ ID NO: 4081107 - RNA, 17 nt, Streptococcus pneumoniae R6
aaaaaaguauacucuaa

SEQ ID NO: 4081108 - RNA, 23 nt, Streptococcus pneumoniae R6
aaaaaagugguaucauauaaaua

SEQ ID NO: 4081109 - RNA, 21 nt, Streptococcus pneumoniae R6
aaaaaauacaguauccacauu

SEQ ID NO: 4081110 - RNA, 13 nt, Streptococcus pneumoniae R6
aaaaaauaucuuu

SEQ ID NO: 4081111 - RNA, 20 nt, Streptococcus pneumoniae R6
aaaaaaucaagggaaaauga

SEQ ID NO: 4081112 - RNA, 20 nt, Streptococcus pneumoniae R6
aaaaaaugaaauuaaauaug

SEQ ID NO: 4081113 - RNA, 13 nt, Streptococcus pneumoniae R6
aaaaaaugauaau

SEQ ID NO: 4081114 - RNA, 16 nt, Streptococcus pneumoniae R6
aaaaaaugucauaauu

SEQ ID NO: 4081115 - RNA, 14 nt, Streptococcus pneumoniae R6
aaaaaauuucauuu

SEQ ID NO: 4081116 - RNA, 22 nt, Streptococcus pneumoniae R6
aaaaaauuuuauuuaagcaaaa

SEQ ID NO: 4081117 - RNA, 15 nt, Streptococcus pneumoniae R6
aaaaaauuuuuaaag

SEQ ID NO: 4081118 - RNA, 13 nt, Streptococcus pneumoniae R6
aaaaacaaagaga

SEQ ID NO: 4081119 - RNA, 23 nt, Streptococcus pneumoniae R6
aaaaacaaaguauuaaaauaagu

SEQ ID NO: 4081120 - RNA, 19 nt, Streptococcus pneumoniae R6
aaaaacgacagauucuacu

SEQ ID NO: 4081121 - RNA, 16 nt, Streptococcus pneumoniae R6
aaaaacgcauaauauc

SEQ ID NO: 4081122 - RNA, 15 nt, Streptococcus pneumoniae R6
aaaaacgcauaguau

SEQ ID NO: 4081123 - RNA, 19 nt, Streptococcus pneumoniae R6
aaaaacguuuuucaaaccu

SEQ ID NO: 4081124 - RNA, 17 nt, Streptococcus pneumoniae R6
aaaaacuagaauagaaa

SEQ ID NO: 4081125 - RNA, 23 nt, Streptococcus pneumoniae R6
aaaaacuauggcagagaaucguu

SEQ ID NO: 4081126 - RNA, 23 nt, Streptococcus pneumoniae R6
aaaaacucugcuuuucagcagag

SEQ ID NO: 4081127 - RNA, 13 nt, Streptococcus pneumoniae R6
aaaaacucuucuu

SEQ ID NO: 4081128 - RNA, 14 nt, Streptococcus pneumoniae R6
aaaaacugguuccu

SEQ ID NO: 4081129 - RNA, 22 nt, Streptococcus pneumoniae R6
aaaaacugguuccuuuuuaggu

SEQ ID NO: 4081130 - RNA, 17 nt, Streptococcus pneumoniae R6
aaaaacuuaaaaaucuu

SEQ ID NO: 4081131 - RNA, 14 nt, Streptococcus pneumoniae R6
aaaaacuuacuaca

SEQ ID NO: 4081132 - RNA, 17 nt, Streptococcus pneumoniae R6
aaaaacuugauacuaug

SEQ ID NO: 4081133 - RNA, 16 nt, Streptococcus pneumoniae R6
aaaaagaaauauauag

SEQ ID NO: 4081134 - RNA, 18 nt, Streptococcus pneumoniae R6
aaaaagaagcagaaaaau

SEQ ID NO: 4081135 - RNA, 21 nt, Streptococcus pneumoniae R6
aaaaagacuuagcaaaucagc

SEQ ID NO: 4081136 - RNA, 21 nt, Streptococcus pneumoniae R6
aaaaagacuugaaauacuaaa

SEQ ID NO: 4081137 - RNA, 14 nt, Streptococcus pneumoniae R6
aaaaagagcugcca

SEQ ID NO: 4081138 - RNA, 24 nt, Streptococcus pneumoniae R6
aaaaagagggauucuuauauuaaa

SEQ ID NO: 4081139 - RNA, 21 nt, Streptococcus pneumoniae R6
aaaaagauaagguucaaaaaa

SEQ ID NO: 4081140 - RNA, 14 nt, Streptococcus pneumoniae R6
aaaaagauuugaaa

SEQ ID NO: 4081141 - RNA, 18 nt, Streptococcus pneumoniae R6
aaaaagauuugaaacuaa

SEQ ID NO: 4081142 - RNA, 19 nt, Streptococcus pneumoniae R6
aaaaagccuccagauugga

SEQ ID NO: 4081143 - RNA, 19 nt, Streptococcus pneumoniae R6
aaaaagcuauagauaaggu

SEQ ID NO: 4081144 - RNA, 16 nt, Streptococcus pneumoniae R6
aaaaagcuucauuuau

SEQ ID NO: 4081145 - RNA, 15 nt, Streptococcus pneumoniae R6
aaaaagcuuuaagac

SEQ ID NO: 4081146 - RNA, 15 nt, Streptococcus pneumoniae R6
aaaaaggaaccaguu

SEQ ID NO: 4081147 - RNA, 22 nt, Streptococcus pneumoniae R6
aaaaaggaaucagauuuuagaa

SEQ ID NO: 4081148 - RNA, 18 nt, Streptococcus pneumoniae R6
aaaaagggauaaguugau

SEQ ID NO: 4081149 - RNA, 22 nt, Streptococcus pneumoniae R6
aaaaagggggaacguuuuuaaa

SEQ ID NO: 4081150 - RNA, 22 nt, Streptococcus pneumoniae R6
aaaaagggggcaaaacuuucau

SEQ ID NO: 4081151 - RNA, 11 nt, Streptococcus pneumoniae R6
aaaaaggucau

SEQ ID NO: 4081152 - RNA, 12 nt, Streptococcus pneumoniae R6
aaaaaguaaauc

SEQ ID NO: 4081153 - RNA, 14 nt, Streptococcus pneumoniae R6
aaaaaguaaaucuu

SEQ ID NO: 4081154 - RNA, 22 nt, Streptococcus pneumoniae R6
aaaaaguauacucuaauugaaa

SEQ ID NO: 4081155 - RNA, 16 nt, Streptococcus pneumoniae R6
aaaaagucguuaaaag

SEQ ID NO: 4081156 - RNA, 15 nt, Streptococcus pneumoniae R6
aaaaagugaaaggaa

SEQ ID NO: 4081157 - RNA, 16 nt, Streptococcus pneumoniae R6
aaaaagugaaaggaag

SEQ ID NO: 4081158 - RNA, 16 nt, Streptococcus pneumoniae R6
aaaaagugaacaaagc

SEQ ID NO: 4081159 - RNA, 17 nt, Streptococcus pneumoniae R6
aaaaagugauguaauuu

SEQ ID NO: 4081160 - RNA, 18 nt, Streptococcus pneumoniae R6
aaaaaguggaaagagcag

SEQ ID NO: 4081161 - RNA, 22 nt, Streptococcus pneumoniae R6
aaaaagugguaucauauaaaua

SEQ ID NO: 4081162 - RNA, 20 nt, Streptococcus pneumoniae R6
aaaaaguguugacaagugaa

SEQ ID NO: 4081163 - RNA, 22 nt, Streptococcus pneumoniae R6
aaaaaguguuugauaucuauca

SEQ ID NO: 4081164 - RNA, 23 nt, Streptococcus pneumoniae R6
aaaaaguguuugauaucuaucaa

SEQ ID NO: 4081165 - RNA, 19 nt, Streptococcus pneumoniae R6
aaaaaguuaaaucuuauau

SEQ ID NO: 4081166 - RNA, 20 nt, Streptococcus pneumoniae R6
aaaaaguuagacaauuaauu

SEQ ID NO: 4081167 - RNA, 22 nt, Streptococcus pneumoniae R6
aaaaaguucucuuucuaaaaua

SEQ ID NO: 4081168 - RNA, 16 nt, Streptococcus pneumoniae R6
aaaaauaaaaaaauuu

SEQ ID NO: 4081169 - RNA, 14 nt, Streptococcus pneumoniae R6
aaaaauaaaaaaga

SEQ ID NO: 4081170 - RNA, 23 nt, Streptococcus pneumoniae R6
aaaaauaaaaaagagaguuacaa

SEQ ID NO: 4081171 - RNA, 22 nt, Streptococcus pneumoniae R6
aaaaauaaauaaaacucuugaa

SEQ ID NO: 4081172 - RNA, 12 nt, Streptococcus pneumoniae R6
aaaaauaaaucu

SEQ ID NO: 4081173 - RNA, 14 nt, Streptococcus pneumoniae R6
aaaaauaaaucuau

SEQ ID NO: 4081174 - RNA, 13 nt, Streptococcus pneumoniae R6
aaaaauaaucaaa

SEQ ID NO: 4081175 - RNA, 20 nt, Streptococcus pneumoniae R6
aaaaauacaguauccacauu

SEQ ID NO: 4081176 - RNA, 16 nt, Streptococcus pneumoniae R6
aaaaauagaaggagau

SEQ ID NO: 4081177 - RNA, 21 nt, Streptococcus pneumoniae R6
aaaaauagauuuuuaaauucu

SEQ ID NO: 4081178 - RNA, 19 nt, Streptococcus pneumoniae R6
aaaaauaggcagaacaaga

SEQ ID NO: 4081179 - RNA, 17 nt, Streptococcus pneumoniae R6
aaaaauagggaaauccu

SEQ ID NO: 4081180 - RNA, 17 nt, Streptococcus pneumoniae R6
aaaaauaguauaccaca

SEQ ID NO: 4081181 - RNA, 21 nt, Streptococcus pneumoniae R6
aaaaauauaaaaaccuaucau

SEQ ID NO: 4081182 - RNA, 16 nt, Streptococcus pneumoniae R6
aaaaauauacaaaaaa

SEQ ID NO: 4081183 - RNA, 14 nt, Streptococcus pneumoniae R6
aaaaauauaguaua

SEQ ID NO: 4081184 - RNA, 13 nt, Streptococcus pneumoniae R6
aaaaauaugcuau

SEQ ID NO: 4081185 - RNA, 14 nt, Streptococcus pneumoniae R6
aaaaauauggcaca

SEQ ID NO: 4081186 - RNA, 16 nt, Streptococcus pneumoniae R6
aaaaauccagauaggu

SEQ ID NO: 4081187 - RNA, 12 nt, Streptococcus pneumoniae R6
aaaaauccccca

SEQ ID NO: 4081188 - RNA, 19 nt, Streptococcus pneumoniae R6
aaaaauccgaagaaggcca

SEQ ID NO: 4081189 - RNA, 21 nt, Streptococcus pneumoniae R6
aaaaauccuguacggauuggu

SEQ ID NO: 4081190 - RNA, 13 nt, Streptococcus pneumoniae R6
aaaaauccuuuuu

SEQ ID NO: 4081191 - RNA, 22 nt, Streptococcus pneumoniae R6
aaaaaucguguuucauauguaa

SEQ ID NO: 4081192 - RNA, 12 nt, Streptococcus pneumoniae R6
aaaaaucuauuu

SEQ ID NO: 4081193 - RNA, 18 nt, Streptococcus pneumoniae R6
aaaaaucuguuaaaaaau

SEQ ID NO: 4081194 - RNA, 19 nt, Streptococcus pneumoniae R6
aaaaaucuguuaaaaaaua

SEQ ID NO: 4081195 - RNA, 15 nt, Streptococcus pneumoniae R6
aaaaaugaaaaaaau

SEQ ID NO: 4081196 - RNA, 19 nt, Streptococcus pneumoniae R6
aaaaaugaagcaaacauuc

SEQ ID NO: 4081197 - RNA, 18 nt, Streptococcus pneumoniae R6
aaaaaugauaauagauau

SEQ ID NO: 4081198 - RNA, 15 nt, Streptococcus pneumoniae R6
aaaaaugcaaagacc

SEQ ID NO: 4081199 - RNA, 22 nt, Streptococcus pneumoniae R6
aaaaaugcaugagcaugaucau

SEQ ID NO: 4081200 - RNA, 14 nt, Streptococcus pneumoniae R6
aaaaaugucauaau

SEQ ID NO: 4081201 - RNA, 19 nt, Streptococcus pneumoniae R6
aaaaauuaaggcgauugcu

SEQ ID NO: 4081202 - RNA, 15 nt, Streptococcus pneumoniae R6
aaaaauuagaaaaag

SEQ ID NO: 4081203 - RNA, 22 nt, Streptococcus pneumoniae R6
aaaaauucuuacuaccuacuuu

SEQ ID NO: 4081204 - RNA, 21 nt, Streptococcus pneumoniae R6
aaaaauugauuugacuuccaa

SEQ ID NO: 4081205 - RNA, 16 nt, Streptococcus pneumoniae R6
aaaaauuucuccgguu

SEQ ID NO: 4081206 - RNA, 12 nt, Streptococcus pneumoniae R6
aaaaauuuggaa

SEQ ID NO: 4081207 - RNA, 19 nt, Streptococcus pneumoniae R6
aaaaauuuucaaaaucaga

SEQ ID NO: 4081208 - RNA, 14 nt, Streptococcus pneumoniae R6
aaaaauuuuuaaag

SEQ ID NO: 4081209 - RNA, 21 nt, Streptococcus pneumoniae R6
aaaaauuuuuuucuaauuaaa

SEQ ID NO: 4081210 - RNA, 17 nt, Streptococcus pneumoniae R6
aaaacaaaauucuuccu

SEQ ID NO: 4081211 - RNA, 15 nt, Streptococcus pneumoniae R6
aaaacaaagaaaaag

SEQ ID NO: 4081212 - RNA, 13 nt, Streptococcus pneumoniae R6
aaaacaaagagau

SEQ ID NO: 4081213 - RNA, 20 nt, Streptococcus pneumoniae R6
aaaacaaaguauuaaaauaa

SEQ ID NO: 4081214 - RNA, 18 nt, Streptococcus pneumoniae R6
aaaacaaccaauuucuua

SEQ ID NO: 4081215 - RNA, 11 nt, Streptococcus pneumoniae R6
aaaacaacuua

SEQ ID NO: 4081216 - RNA, 22 nt, Streptococcus pneumoniae R6
aaaacaacuuauaaaaaacaca

SEQ ID NO: 4081217 - RNA, 17 nt, Streptococcus pneumoniae R6
aaaacaaguucuuuucu

SEQ ID NO: 4081218 - RNA, 16 nt, Streptococcus pneumoniae R6
aaaacaauaaaucugu

SEQ ID NO: 4081219 - RNA, 18 nt, Streptococcus pneumoniae R6
aaaacaauaucagcugcc

SEQ ID NO: 4081220 - RNA, 22 nt, Streptococcus pneumoniae R6
aaaacaauguuuugaucugacu

SEQ ID NO: 4081221 - RNA, 16 nt, Streptococcus pneumoniae R6
aaaacaauugcccaaa

SEQ ID NO: 4081222 - RNA, 16 nt, Streptococcus pneumoniae R6
aaaacacaaaaggagg

SEQ ID NO: 4081223 - RNA, 20 nt, Streptococcus pneumoniae R6
aaaacaccccaugauaugaa

SEQ ID NO: 4081224 - RNA, 16 nt, Streptococcus pneumoniae R6
aaaacaccuucugcuu

SEQ ID NO: 4081225 - RNA, 22 nt, Streptococcus pneumoniae R6
aaaacaccuucugcuucuaaau

SEQ ID NO: 4081226 - RNA, 21 nt, Streptococcus pneumoniae R6
aaaacacuguuuugagguugu

SEQ ID NO: 4081227 - RNA, 17 nt, Streptococcus pneumoniae R6
aaaacagaaaaaucugu

SEQ ID NO: 4081228 - RNA, 21 nt, Streptococcus pneumoniae R6
aaaacagaggcuggacaaaaa

SEQ ID NO: 4081229 - RNA, 16 nt, Streptococcus pneumoniae R6
aaaacaguguuuuaag

SEQ ID NO: 4081230 - RNA, 22 nt, Streptococcus pneumoniae R6
aaaacaguguuuugaucugacu

SEQ ID NO: 4081231 - RNA, 15 nt, Streptococcus pneumoniae R6
aaaacaguuacauca

SEQ ID NO: 4081232 - RNA, 14 nt, Streptococcus pneumoniae R6
aaaacauaauuuua

SEQ ID NO: 4081233 - RNA, 17 nt, Streptococcus pneumoniae R6
aaaacaucugguuuaau

SEQ ID NO: 4081234 - RNA, 22 nt, Streptococcus pneumoniae R6
aaaacaugaaguaaauauuucu

SEQ ID NO: 4081235 - RNA, 23 nt, Streptococcus pneumoniae R6
aaaacauuguuaaaaauugauuu

SEQ ID NO: 4081236 - RNA, 20 nt, Streptococcus pneumoniae R6
aaaacauuguuagaauucga

SEQ ID NO: 4081237 - RNA, 22 nt, Streptococcus pneumoniae R6
aaaacauuuauagaaauuaauu

SEQ ID NO: 4081238 - RNA, 13 nt, Streptococcus pneumoniae R6
aaaaccaaaaagu

SEQ ID NO: 4081239 - RNA, 16 nt, Streptococcus pneumoniae R6
aaaaccaaaacucaag

SEQ ID NO: 4081240 - RNA, 13 nt, Streptococcus pneumoniae R6
aaaaccaaaggca

SEQ ID NO: 4081241 - RNA, 14 nt, Streptococcus pneumoniae R6
aaaaccaaucaauu

SEQ ID NO: 4081242 - RNA, 21 nt, Streptococcus pneumoniae R6
aaaaccaauucccaaacaucu

SEQ ID NO: 4081243 - RNA, 22 nt, Streptococcus pneumoniae R6
aaaaccaauucccaaacaucug

SEQ ID NO: 4081244 - RNA, 14 nt, Streptococcus pneumoniae R6
aaaaccaguccugg

SEQ ID NO: 4081245 - RNA, 18 nt, Streptococcus pneumoniae R6
aaaaccauucaaaauacu

SEQ ID NO: 4081246 - RNA, 20 nt, Streptococcus pneumoniae R6
aaaaccauucaaaauacuag

SEQ ID NO: 4081247 - RNA, 14 nt, Streptococcus pneumoniae R6
aaaacccaccugaa

SEQ ID NO: 4081248 - RNA, 20 nt, Streptococcus pneumoniae R6
aaaaccccagcauaaacagg

SEQ ID NO: 4081249 - RNA, 23 nt, Streptococcus pneumoniae R6
aaaaccccagcauaaacagggca

SEQ ID NO: 4081250 - RNA, 21 nt, Streptococcus pneumoniae R6
aaaaccuuguuuuaaaauguu

SEQ ID NO: 4081251 - RNA, 13 nt, Streptococcus pneumoniae R6
aaaacgaaaggau

SEQ ID NO: 4081252 - RNA, 17 nt, Streptococcus pneumoniae R6
aaaacgcauaauaccaa

SEQ ID NO: 4081253 - RNA, 20 nt, Streptococcus pneumoniae R6
aaaacgcauaauaucaaggu

SEQ ID NO: 4081254 - RNA, 20 nt, Streptococcus pneumoniae R6
aaaacgcauaauaucaaguu

SEQ ID NO: 4081255 - RNA, 19 nt, Streptococcus pneumoniae R6
aaaacgcauccuaucaagu

SEQ ID NO: 4081256 - RNA, 20 nt, Streptococcus pneumoniae R6
aaaacgcauccuaucaaguu

SEQ ID NO: 4081257 - RNA, 21 nt, Streptococcus pneumoniae R6
aaaacgcauccuaucaaguuc

SEQ ID NO: 4081258 - RNA, 18 nt, Streptococcus pneumoniae R6
aaaacgccugcuuuuugc

SEQ ID NO: 4081259 - RNA, 18 nt, Streptococcus pneumoniae R6
aaaacgguaacaaaacua

SEQ ID NO: 4081260 - RNA, 13 nt, Streptococcus pneumoniae R6
aaaacgguugagc

SEQ ID NO: 4081261 - RNA, 20 nt, Streptococcus pneumoniae R6
aaaacguacaguaucaaggu

SEQ ID NO: 4081262 - RNA, 19 nt, Streptococcus pneumoniae R6
aaaacguaguuuuuuuugu

SEQ ID NO: 4081263 - RNA, 13 nt, Streptococcus pneumoniae R6
aaaacguucccaa

SEQ ID NO: 4081264 - RNA, 17 nt, Streptococcus pneumoniae R6
aaaacguugguaaaagc

SEQ ID NO: 4081265 - RNA, 22 nt, Streptococcus pneumoniae R6
aaaacguuguuuucacgauuca

SEQ ID NO: 4081266 - RNA, 14 nt, Streptococcus pneumoniae R6
aaaacguuuuucaa

SEQ ID NO: 4081267 - RNA, 19 nt, Streptococcus pneumoniae R6
aaaacguuuuucaaaccuu

SEQ ID NO: 4081268 - RNA, 20 nt, Streptococcus pneumoniae R6
aaaacguuuuucaaaccuuc

SEQ ID NO: 4081269 - RNA, 16 nt, Streptococcus pneumoniae R6
aaaacuaaaguguaau

SEQ ID NO: 4081270 - RNA, 16 nt, Streptococcus pneumoniae R6
aaaacuaauuuagaga

SEQ ID NO: 4081271 - RNA, 20 nt, Streptococcus pneumoniae R6
aaaacuagaauagaaacaaa

SEQ ID NO: 4081272 - RNA, 23 nt, Streptococcus pneumoniae R6
aaaacuagaauagaaacaaaaua

SEQ ID NO: 4081273 - RNA, 17 nt, Streptococcus pneumoniae R6
aaaacuagcaaugccaa

SEQ ID NO: 4081274 - RNA, 21 nt, Streptococcus pneumoniae R6
aaaacuaguuuaaaucauaau

SEQ ID NO: 4081275 - RNA, 13 nt, Streptococcus pneumoniae R6
aaaacuauauucu

SEQ ID NO: 4081276 - RNA, 18 nt, Streptococcus pneumoniae R6
aaaacuauugacuuuucu

SEQ ID NO: 4081277 - RNA, 22 nt, Streptococcus pneumoniae R6
aaaacuccaaacgcgauacaau

SEQ ID NO: 4081278 - RNA, 23 nt, Streptococcus pneumoniae R6
aaaacucuccugggaaauuccag

SEQ ID NO: 4081279 - RNA, 15 nt, Streptococcus pneumoniae R6
aaaacucuuaucuaa

SEQ ID NO: 4081280 - RNA, 14 nt, Streptococcus pneumoniae R6
aaaacugaacaaga

SEQ ID NO: 4081281 - RNA, 23 nt, Streptococcus pneumoniae R6
aaaacugaacaagacgaaccaau

SEQ ID NO: 4081282 - RNA, 14 nt, Streptococcus pneumoniae R6
aaaacugaugaagu

SEQ ID NO: 4081283 - RNA, 17 nt, Streptococcus pneumoniae R6
aaaacugaugaagucaa

SEQ ID NO: 4081284 - RNA, 22 nt, Streptococcus pneumoniae R6
aaaacuguaaaguagcaaaaca

SEQ ID NO: 4081285 - RNA, 14 nt, Streptococcus pneumoniae R6
aaaacuuacuacac

SEQ ID NO: 4081286 - RNA, 22 nt, Streptococcus pneumoniae R6
aaaacuugugauuuaguagcau

SEQ ID NO: 4081287 - RNA, 12 nt, Streptococcus pneumoniae R6
aaaacuuuuaaa

SEQ ID NO: 4081288 - RNA, 19 nt, Streptococcus pneumoniae R6
aaaacuuuuuaaaaaaucu

SEQ ID NO: 4081289 - RNA, 21 nt, Streptococcus pneumoniae R6
aaaagaacaaguaaagaguca

SEQ ID NO: 4081290 - RNA, 22 nt, Streptococcus pneumoniae R6
aaaagaaggguuagucauuccc

SEQ ID NO: 4081291 - RNA, 15 nt, Streptococcus pneumoniae R6
aaaagaaguaaaucu

SEQ ID NO: 4081292 - RNA, 21 nt, Streptococcus pneumoniae R6
aaaagaauuaggaaaacauga

SEQ ID NO: 4081293 - RNA, 17 nt, Streptococcus pneumoniae R6
aaaagacguauucaguc

SEQ ID NO: 4081294 - RNA, 13 nt, Streptococcus pneumoniae R6
aaaagacuugaaa

SEQ ID NO: 4081295 - RNA, 14 nt, Streptococcus pneumoniae R6
aaaagagcaagaac

SEQ ID NO: 4081296 - RNA, 21 nt, Streptococcus pneumoniae R6
aaaagagccucauaaaaggua

SEQ ID NO: 4081297 - RNA, 22 nt, Streptococcus pneumoniae R6
aaaagaggagguaaaucccaag

SEQ ID NO: 4081298 - RNA, 21 nt, Streptococcus pneumoniae R6
aaaagagggauucuuauauua

SEQ ID NO: 4081299 - RNA, 20 nt, Streptococcus pneumoniae R6
aaaagagggauuuuguauuu

SEQ ID NO: 4081300 - RNA, 21 nt, Streptococcus pneumoniae R6
aaaagaguuucgaaaagaauu

SEQ ID NO: 4081301 - RNA, 19 nt, Streptococcus pneumoniae R6
aaaagauagagaaagaaaa

SEQ ID NO: 4081302 - RNA, 15 nt, Streptococcus pneumoniae R6
aaaagauagagacua

SEQ ID NO: 4081303 - RNA, 18 nt, Streptococcus pneumoniae R6
aaaagauagcuaugaaua

SEQ ID NO: 4081304 - RNA, 14 nt, Streptococcus pneumoniae R6
aaaagauguuagaa

SEQ ID NO: 4081305 - RNA, 14 nt, Streptococcus pneumoniae R6
aaaagauuucuaua

SEQ ID NO: 4081306 - RNA, 21 nt, Streptococcus pneumoniae R6
aaaagauuucuauaaauucau

SEQ ID NO: 4081307 - RNA, 16 nt, Streptococcus pneumoniae R6
aaaagauuugaaacua

SEQ ID NO: 4081308 - RNA, 15 nt, Streptococcus pneumoniae R6
aaaagauuuuuuaaa

SEQ ID NO: 4081309 - RNA, 14 nt, Streptococcus pneumoniae R6
aaaagcaagagcug

SEQ ID NO: 4081310 - RNA, 17 nt, Streptococcus pneumoniae R6
aaaagcacucaauauua

SEQ ID NO: 4081311 - RNA, 21 nt, Streptococcus pneumoniae R6
aaaagcauucuauuccaucuc

SEQ ID NO: 4081312 - RNA, 11 nt, Streptococcus pneumoniae R6
aaaagcuaagc

SEQ ID NO: 4081313 - RNA, 16 nt, Streptococcus pneumoniae R6
aaaagcuaauagagcu

SEQ ID NO: 4081314 - RNA, 15 nt, Streptococcus pneumoniae R6
aaaagcuacuauaaa

SEQ ID NO: 4081315 - RNA, 22 nt, Streptococcus pneumoniae R6
aaaagcuacuauaaaagaggag

SEQ ID NO: 4081316 - RNA, 14 nt, Streptococcus pneumoniae R6
aaaagcucauuuga

SEQ ID NO: 4081317 - RNA, 20 nt, Streptococcus pneumoniae R6
aaaagcuucauuuaucuucu

SEQ ID NO: 4081318 - RNA, 22 nt, Streptococcus pneumoniae R6
aaaagcuucucggacuuuuucc

SEQ ID NO: 4081319 - RNA, 23 nt, Streptococcus pneumoniae R6
aaaagcuucucggacuuuuucca

SEQ ID NO: 4081320 - RNA, 19 nt, Streptococcus pneumoniae R6
aaaagcuugaguggaaaaa

SEQ ID NO: 4081321 - RNA, 21 nt, Streptococcus pneumoniae R6
aaaagcuugaguggaaaaacc

SEQ ID NO: 4081322 - RNA, 22 nt, Streptococcus pneumoniae R6
aaaagcuugaguggaaaaaccu

SEQ ID NO: 4081323 - RNA, 23 nt, Streptococcus pneumoniae R6
aaaagcuugaguggaaaaaccuu

SEQ ID NO: 4081324 - RNA, 14 nt, Streptococcus pneumoniae R6
aaaagcuuuaaaac

SEQ ID NO: 4081325 - RNA, 15 nt, Streptococcus pneumoniae R6
aaaaggcauccaauc

SEQ ID NO: 4081326 - RNA, 19 nt, Streptococcus pneumoniae R6
aaaaggcucauaaauggag

SEQ ID NO: 4081327 - RNA, 23 nt, Streptococcus pneumoniae R6
aaaagggacaaaacuuuuuaaaa

SEQ ID NO: 4081328 - RNA, 19 nt, Streptococcus pneumoniae R6
aaaagggacuggauuuuaa

SEQ ID NO: 4081329 - RNA, 20 nt, Streptococcus pneumoniae R6
aaaagggacuggauuuuaag

SEQ ID NO: 4081330 - RNA, 21 nt, Streptococcus pneumoniae R6
aaaagggggaacguuuuuaaa

SEQ ID NO: 4081331 - RNA, 24 nt, Streptococcus pneumoniae R6
aaaagguucuuuuauccuguucuu

SEQ ID NO: 4081332 - RNA, 14 nt, Streptococcus pneumoniae R6
aaaaguaaaaaggg

SEQ ID NO: 4081333 - RNA, 18 nt, Streptococcus pneumoniae R6
aaaaguagagucuguucu

SEQ ID NO: 4081334 - RNA, 17 nt, Streptococcus pneumoniae R6
aaaaguaggacgauaaa

SEQ ID NO: 4081335 - RNA, 22 nt, Streptococcus pneumoniae R6
aaaaguauacucuaauugaaaa

SEQ ID NO: 4081336 - RNA, 15 nt, Streptococcus pneumoniae R6
aaaagucaggccugc

SEQ ID NO: 4081337 - RNA, 17 nt, Streptococcus pneumoniae R6
aaaaguccaaagaugag

SEQ ID NO: 4081338 - RNA, 13 nt, Streptococcus pneumoniae R6
aaaagucgaguuc

SEQ ID NO: 4081339 - RNA, 16 nt, Streptococcus pneumoniae R6
aaaagucguuaaaagc

SEQ ID NO: 4081340 - RNA, 23 nt, Streptococcus pneumoniae R6
aaaagucugggaaaaauuuucaa

SEQ ID NO: 4081341 - RNA, 22 nt, Streptococcus pneumoniae R6
aaaagucuugacaaagaaaaaa

SEQ ID NO: 4081342 - RNA, 14 nt, Streptococcus pneumoniae R6
aaaagucuuuaaaa

SEQ ID NO: 4081343 - RNA, 15 nt, Streptococcus pneumoniae R6
aaaagucuuuaaaau

SEQ ID NO: 4081344 - RNA, 22 nt, Streptococcus pneumoniae R6
aaaagugagauauauugacuuu

SEQ ID NO: 4081345 - RNA, 23 nt, Streptococcus pneumoniae R6
aaaagugcaugaguuagauagau

SEQ ID NO: 4081346 - RNA, 16 nt, Streptococcus pneumoniae R6
aaaagugguaucauau

SEQ ID NO: 4081347 - RNA, 20 nt, Streptococcus pneumoniae R6
aaaaguuagacagaaaaaau

SEQ ID NO: 4081348 - RNA, 19 nt, Streptococcus pneumoniae R6
aaaaguucucuuucuaaaa

SEQ ID NO: 4081349 - RNA, 22 nt, Streptococcus pneumoniae R6
aaaaguucucuuucuaaaauag

SEQ ID NO: 4081350 - RNA, 23 nt, Streptococcus pneumoniae R6
aaaaguucucuuucuaaaauagu

SEQ ID NO: 4081351 - RNA, 18 nt, Streptococcus pneumoniae R6
aaaaguuguggaaaggau

SEQ ID NO: 4081352 - RNA, 17 nt, Streptococcus pneumoniae R6
aaaaguuuaaaaaaacu

SEQ ID NO: 4081353 - RNA, 18 nt, Streptococcus pneumoniae R6
aaaaguuuccaaucagau

SEQ ID NO: 4081354 - RNA, 20 nt, Streptococcus pneumoniae R6
aaaaguuuuagcuucuguau

SEQ ID NO: 4081355 - RNA, 21 nt, Streptococcus pneumoniae R6
aaaauaaaaaagagaguuaca

SEQ ID NO: 4081356 - RNA, 20 nt, Streptococcus pneumoniae R6
aaaauaacucuguaaucucu

SEQ ID NO: 4081357 - RNA, 23 nt, Streptococcus pneumoniae R6
aaaauaaguuagaauauguaagu

SEQ ID NO: 4081358 - RNA, 17 nt, Streptococcus pneumoniae R6
aaaauaaguucaacaaa

SEQ ID NO: 4081359 - RNA, 12 nt, Streptococcus pneumoniae R6
aaaauaaguucu

SEQ ID NO: 4081360 - RNA, 19 nt, Streptococcus pneumoniae R6
aaaauaauuuuuuucagaa

SEQ ID NO: 4081361 - RNA, 21 nt, Streptococcus pneumoniae R6
aaaauacaguauccacauucg

SEQ ID NO: 4081362 - RNA, 13 nt, Streptococcus pneumoniae R6
aaaauacaucuau

SEQ ID NO: 4081363 - RNA, 19 nt, Streptococcus pneumoniae R6
aaaauacucaucaugaaua

SEQ ID NO: 4081364 - RNA, 20 nt, Streptococcus pneumoniae R6
aaaauacugauaaaaacaug

SEQ ID NO: 4081365 - RNA, 16 nt, Streptococcus pneumoniae R6
aaaauagauaaauacu

SEQ ID NO: 4081366 - RNA, 12 nt, Streptococcus pneumoniae R6
aaaauaggcucc

SEQ ID NO: 4081367 - RNA, 17 nt, Streptococcus pneumoniae R6
aaaauagggcaugccaa

SEQ ID NO: 4081368 - RNA, 19 nt, Streptococcus pneumoniae R6
aaaauaguggcugaaacug

SEQ ID NO: 4081369 - RNA, 16 nt, Streptococcus pneumoniae R6
aaaauaguuuuugcaa

SEQ ID NO: 4081370 - RNA, 15 nt, Streptococcus pneumoniae R6
aaaauauacaaaaaa

SEQ ID NO: 4081371 - RNA, 19 nt, Streptococcus pneumoniae R6
aaaauaugcauaauuucca

SEQ ID NO: 4081372 - RNA, 21 nt, Streptococcus pneumoniae R6
aaaauaugcuauugaaaggaa

SEQ ID NO: 4081373 - RNA, 18 nt, Streptococcus pneumoniae R6
aaaauauguuuucuuugc

SEQ ID NO: 4081374 - RNA, 15 nt, Streptococcus pneumoniae R6
aaaauauuagcaaaa

SEQ ID NO: 4081375 - RNA, 20 nt, Streptococcus pneumoniae R6
aaaauauuucgcuuauaaac

SEQ ID NO: 4081376 - RNA, 12 nt, Streptococcus pneumoniae R6
aaaaucaaagac

SEQ ID NO: 4081377 - RNA, 13 nt, Streptococcus pneumoniae R6
aaaaucaaagagu

SEQ ID NO: 4081378 - RNA, 18 nt, Streptococcus pneumoniae R6
aaaaucaagggaaaauga

SEQ ID NO: 4081379 - RNA, 21 nt, Streptococcus pneumoniae R6
aaaaucaagggaaaaugaaac

SEQ ID NO: 4081380 - RNA, 18 nt, Streptococcus pneumoniae R6
aaaaucaagguuuuugaa

SEQ ID NO: 4081381 - RNA, 14 nt, Streptococcus pneumoniae R6
aaaaucacaaaaac

SEQ ID NO: 4081382 - RNA, 16 nt, Streptococcus pneumoniae R6
aaaaucacaucugcua

SEQ ID NO: 4081383 - RNA, 17 nt, Streptococcus pneumoniae R6
aaaaucacaucugcuag

SEQ ID NO: 4081384 - RNA, 14 nt, Streptococcus pneumoniae R6
aaaaucagaaaaac

SEQ ID NO: 4081385 - RNA, 20 nt, Streptococcus pneumoniae R6
aaaaucaggaaggucacuuu

SEQ ID NO: 4081386 - RNA, 17 nt, Streptococcus pneumoniae R6
aaaaucaggucuuauag

SEQ ID NO: 4081387 - RNA, 18 nt, Streptococcus pneumoniae R6
aaaaucauacuuggagaa

SEQ ID NO: 4081388 - RNA, 22 nt, Streptococcus pneumoniae R6
aaaaucauacuuggagaaccua

SEQ ID NO: 4081389 - RNA, 15 nt, Streptococcus pneumoniae R6
aaaaucauagaaaaa

SEQ ID NO: 4081390 - RNA, 13 nt, Streptococcus pneumoniae R6
aaaaucaucgcca

SEQ ID NO: 4081391 - RNA, 19 nt, Streptococcus pneumoniae R6
aaaaucaucugcaucaaga

SEQ ID NO: 4081392 - RNA, 17 nt, Streptococcus pneumoniae R6
aaaaucaugacaaucaa

SEQ ID NO: 4081393 - RNA, 15 nt, Streptococcus pneumoniae R6
aaaaucauuauauuu

SEQ ID NO: 4081394 - RNA, 12 nt, Streptococcus pneumoniae R6
aaaaucauugcu

SEQ ID NO: 4081395 - RNA, 23 nt, Streptococcus pneumoniae R6
aaaauccacuugggaaaccaaac

SEQ ID NO: 4081396 - RNA, 14 nt, Streptococcus pneumoniae R6
aaaaucccccaagc

SEQ ID NO: 4081397 - RNA, 19 nt, Streptococcus pneumoniae R6
aaaaucccccaagcauuau

SEQ ID NO: 4081398 - RNA, 22 nt, Streptococcus pneumoniae R6
aaaauccgcuugggaaaccaaa

SEQ ID NO: 4081399 - RNA, 23 nt, Streptococcus pneumoniae R6
aaaauccgcuugggaaaccaaac

SEQ ID NO: 4081400 - RNA, 17 nt, Streptococcus pneumoniae R6
aaaauccguuuuuuaaa

SEQ ID NO: 4081401 - RNA, 19 nt, Streptococcus pneumoniae R6
aaaauccguuuuuugaagu

SEQ ID NO: 4081402 - RNA, 20 nt, Streptococcus pneumoniae R6
aaaauccguuuuuugaaguu

SEQ ID NO: 4081403 - RNA, 18 nt, Streptococcus pneumoniae R6
aaaauccucugaguauuu

SEQ ID NO: 4081404 - RNA, 23 nt, Streptococcus pneumoniae R6
aaaauccucugaguauuuagcaa

SEQ ID NO: 4081405 - RNA, 19 nt, Streptococcus pneumoniae R6
aaaauccuuuuuuugaagu

SEQ ID NO: 4081406 - RNA, 20 nt, Streptococcus pneumoniae R6
aaaaucgcaaguuuuuccca

SEQ ID NO: 4081407 - RNA, 23 nt, Streptococcus pneumoniae R6
aaaaucuagucaucagaaaaaag

SEQ ID NO: 4081408 - RNA, 12 nt, Streptococcus pneumoniae R6
aaaaucuccucu

SEQ ID NO: 4081409 - RNA, 13 nt, Streptococcus pneumoniae R6
aaaaucucuucaa

SEQ ID NO: 4081410 - RNA, 12 nt, Streptococcus pneumoniae R6
aaaaucucuuua

SEQ ID NO: 4081411 - RNA, 19 nt, Streptococcus pneumoniae R6
aaaaucugaagaaagcaau

SEQ ID NO: 4081412 - RNA, 16 nt, Streptococcus pneumoniae R6
aaaaucuguuaaaaaa

SEQ ID NO: 4081413 - RNA, 13 nt, Streptococcus pneumoniae R6
aaaaugaaaaaaa

SEQ ID NO: 4081414 - RNA, 14 nt, Streptococcus pneumoniae R6
aaaaugaaaaaaau

SEQ ID NO: 4081415 - RNA, 16 nt, Streptococcus pneumoniae R6
aaaaugaaaaaaauua

SEQ ID NO: 4081416 - RNA, 12 nt, Streptococcus pneumoniae R6
aaaaugaaagag

SEQ ID NO: 4081417 - RNA, 12 nt, Streptococcus pneumoniae R6
aaaaugaaauac

SEQ ID NO: 4081418 - RNA, 13 nt, Streptococcus pneumoniae R6
aaaaugaaauuaa

SEQ ID NO: 4081419 - RNA, 21 nt, Streptococcus pneumoniae R6
aaaaugaggaaaaucuuccca

SEQ ID NO: 4081420 - RNA, 23 nt, Streptococcus pneumoniae R6
aaaaugagucuaucaaacaggau

SEQ ID NO: 4081421 - RNA, 19 nt, Streptococcus pneumoniae R6
aaaaugaugcuuacugcug

SEQ ID NO: 4081422 - RNA, 12 nt, Streptococcus pneumoniae R6
aaaaugauuuuu

SEQ ID NO: 4081423 - RNA, 16 nt, Streptococcus pneumoniae R6
aaaaugauuuuuuacu

SEQ ID NO: 4081424 - RNA, 17 nt, Streptococcus pneumoniae R6
aaaaugcaccaaaacag

SEQ ID NO: 4081425 - RNA, 18 nt, Streptococcus pneumoniae R6
aaaaugcaccaaaacagg

SEQ ID NO: 4081426 - RNA, 18 nt, Streptococcus pneumoniae R6
aaaaugccaaagaaagau

SEQ ID NO: 4081427 - RNA, 19 nt, Streptococcus pneumoniae R6
aaaaugccaaagaaagauu

SEQ ID NO: 4081428 - RNA, 14 nt, Streptococcus pneumoniae R6
aaaaugccuuaucu

SEQ ID NO: 4081429 - RNA, 21 nt, Streptococcus pneumoniae R6
aaaauggcgaguccuacgaac

SEQ ID NO: 4081430 - RNA, 20 nt, Streptococcus pneumoniae R6
aaaauggucacugacagcau

SEQ ID NO: 4081431 - RNA, 16 nt, Streptococcus pneumoniae R6
aaaaugguuccaaaag

SEQ ID NO: 4081432 - RNA, 17 nt, Streptococcus pneumoniae R6
aaaaugugauuucugua

SEQ ID NO: 4081433 - RNA, 23 nt, Streptococcus pneumoniae R6
aaaauguucaguuucuauuucau

SEQ ID NO: 4081434 - RNA, 15 nt, Streptococcus pneumoniae R6
aaaauguuuuaagaa

SEQ ID NO: 4081435 - RNA, 15 nt, Streptococcus pneumoniae R6
aaaauuaaaaagagu

SEQ ID NO: 4081436 - RNA, 11 nt, Streptococcus pneumoniae R6
aaaauuaaaau

SEQ ID NO: 4081437 - RNA, 20 nt, Streptococcus pneumoniae R6
aaaauuauguuuuugaauaa

SEQ ID NO: 4081438 - RNA, 18 nt, Streptococcus pneumoniae R6
aaaauucacaaaauccuu

SEQ ID NO: 4081439 - RNA, 20 nt, Streptococcus pneumoniae R6
aaaauucccuuauccacauc

SEQ ID NO: 4081440 - RNA, 18 nt, Streptococcus pneumoniae R6
aaaauuccuuuaaaaaca

SEQ ID NO: 4081441 - RNA, 21 nt, Streptococcus pneumoniae R6
aaaauucguuucauuauuucu

SEQ ID NO: 4081442 - RNA, 17 nt, Streptococcus pneumoniae R6
aaaauucuuugaaauca

SEQ ID NO: 4081443 - RNA, 24 nt, Streptococcus pneumoniae R6
aaaauugauaauaguaugucugaa

SEQ ID NO: 4081444 - RNA, 22 nt, Streptococcus pneumoniae R6
aaaauugauuugacuuccaaaa

SEQ ID NO: 4081445 - RNA, 14 nt, Streptococcus pneumoniae R6
aaaauuguuaaagu

SEQ ID NO: 4081446 - RNA, 17 nt, Streptococcus pneumoniae R6
aaaauuguugucccuuu

SEQ ID NO: 4081447 - RNA, 13 nt, Streptococcus pneumoniae R6
aaaauuuaaaaau

SEQ ID NO: 4081448 - RNA, 22 nt, Streptococcus pneumoniae R6
aaaauuucauuucgacugaaaa

SEQ ID NO: 4081449 - RNA, 22 nt, Streptococcus pneumoniae R6
aaaauuucucagggucuuuguu

SEQ ID NO: 4081450 - RNA, 13 nt, Streptococcus pneumoniae R6
aaaauuuggaaaa

SEQ ID NO: 4081451 - RNA, 21 nt, Streptococcus pneumoniae R6
aaaauuuuaucuuugaaauaa

SEQ ID NO: 4081452 - RNA, 23 nt, Streptococcus pneumoniae R6
aaaauuuuaucuuugaaauaauc

SEQ ID NO: 4081453 - RNA, 22 nt, Streptococcus pneumoniae R6
aaaauuuuauuuaagcaaaaaa

SEQ ID NO: 4081454 - RNA, 18 nt, Streptococcus pneumoniae R6
aaaauuuucaaaaucaga

SEQ ID NO: 4081455 - RNA, 11 nt, Streptococcus pneumoniae R6
aaaauuuuuaa

SEQ ID NO: 4081456 - RNA, 15 nt, Streptococcus pneumoniae R6
aaaauuuuuuucuaa

SEQ ID NO: 4081457 - RNA, 13 nt, Streptococcus pneumoniae R6
aaacaaaaaaccc

SEQ ID NO: 4081458 - RNA, 20 nt, Streptococcus pneumoniae R6
aaacaaaaauccagauaggu

SEQ ID NO: 4081459 - RNA, 10 nt, Streptococcus pneumoniae R6
aaacaaaagu

SEQ ID NO: 4081460 - RNA, 15 nt, Streptococcus pneumoniae R6
aaacaaaagucuucu

SEQ ID NO: 4081461 - RNA, 11 nt, Streptococcus pneumoniae R6
aaacaaaauua

SEQ ID NO: 4081462 - RNA, 19 nt, Streptococcus pneumoniae R6
aaacaaaauucuuccuacu

SEQ ID NO: 4081463 - RNA, 13 nt, Streptococcus pneumoniae R6
aaacaaagaaaaa

SEQ ID NO: 4081464 - RNA, 23 nt, Streptococcus pneumoniae R6
aaacaaauuguuauuaagauuac

SEQ ID NO: 4081465 - RNA, 13 nt, Streptococcus pneumoniae R6
aaacaacaaugga

SEQ ID NO: 4081466 - RNA, 20 nt, Streptococcus pneumoniae R6
aaacaaccaauuucuuaaua

SEQ ID NO: 4081467 - RNA, 16 nt, Streptococcus pneumoniae R6
aaacaaccgauaagaa

SEQ ID NO: 4081468 - RNA, 15 nt, Streptococcus pneumoniae R6
aaacaacgucagcuu

SEQ ID NO: 4081469 - RNA, 17 nt, Streptococcus pneumoniae R6
aaacaacgucagcuuug

SEQ ID NO: 4081470 - RNA, 13 nt, Streptococcus pneumoniae R6
aaacaagaacaag

SEQ ID NO: 4081471 - RNA, 14 nt, Streptococcus pneumoniae R6
aaacaagaacaaga

SEQ ID NO: 4081472 - RNA, 16 nt, Streptococcus pneumoniae R6
aaacaagagcaaggaa

SEQ ID NO: 4081473 - RNA, 15 nt, Streptococcus pneumoniae R6
aaacaagauaggaga

SEQ ID NO: 4081474 - RNA, 22 nt, Streptococcus pneumoniae R6
aaacaagauaggagaccagcua

SEQ ID NO: 4081475 - RNA, 17 nt, Streptococcus pneumoniae R6
aaacaagccuuuaucug

SEQ ID NO: 4081476 - RNA, 17 nt, Streptococcus pneumoniae R6
aaacaaggcagagaugu

SEQ ID NO: 4081477 - RNA, 17 nt, Streptococcus pneumoniae R6
aaacaagggauuuuucu

SEQ ID NO: 4081478 - RNA, 19 nt, Streptococcus pneumoniae R6
aaacaaggugaacuugacc

SEQ ID NO: 4081479 - RNA, 14 nt, Streptococcus pneumoniae R6
aaacaaguucuuuu

SEQ ID NO: 4081480 - RNA, 12 nt, Streptococcus pneumoniae R6
aaacaaugaaaa

SEQ ID NO: 4081481 - RNA, 13 nt, Streptococcus pneumoniae R6
aaacaaugaaaau

SEQ ID NO: 4081482 - RNA, 18 nt, Streptococcus pneumoniae R6
aaacaauguucucauauu

SEQ ID NO: 4081483 - RNA, 17 nt, Streptococcus pneumoniae R6
aaacaauugcuaaaaca

SEQ ID NO: 4081484 - RNA, 14 nt, Streptococcus pneumoniae R6
aaacacacgaagca

SEQ ID NO: 4081485 - RNA, 16 nt, Streptococcus pneumoniae R6
aaacacauuuuuagaa

SEQ ID NO: 4081486 - RNA, 15 nt, Streptococcus pneumoniae R6
aaacacuaccaagca

SEQ ID NO: 4081487 - RNA, 18 nt, Streptococcus pneumoniae R6
aaacacuaccaagcacga

SEQ ID NO: 4081488 - RNA, 15 nt, Streptococcus pneumoniae R6
aaacacugauuucaa

SEQ ID NO: 4081489 - RNA, 12 nt, Streptococcus pneumoniae R6
aaacacuguuuu

SEQ ID NO: 4081490 - RNA, 15 nt, Streptococcus pneumoniae R6
aaacacuguuuuaag

SEQ ID NO: 4081491 - RNA, 23 nt, Streptococcus pneumoniae R6
aaacacuguuuugagguugcaga

SEQ ID NO: 4081492 - RNA, 21 nt, Streptococcus pneumoniae R6
aaacagaaaaaucuguuaaaa

SEQ ID NO: 4081493 - RNA, 13 nt, Streptococcus pneumoniae R6
aaacagacaaaac

SEQ ID NO: 4081494 - RNA, 23 nt, Streptococcus pneumoniae R6
aaacagaggcuggacaaaaacuc

SEQ ID NO: 4081495 - RNA, 18 nt, Streptococcus pneumoniae R6
aaacagcuccugaaauaa

SEQ ID NO: 4081496 - RNA, 20 nt, Streptococcus pneumoniae R6
aaacaggaguucuuuuacaa

SEQ ID NO: 4081497 - RNA, 15 nt, Streptococcus pneumoniae R6
aaacaguaauaaaga

SEQ ID NO: 4081498 - RNA, 23 nt, Streptococcus pneumoniae R6
aaacagucccauaaaacuauaau

SEQ ID NO: 4081499 - RNA, 17 nt, Streptococcus pneumoniae R6
aaacaguguuuuaagcu

SEQ ID NO: 4081500 - RNA, 19 nt, Streptococcus pneumoniae R6
aaacaguguuuugagcagc

SEQ ID NO: 4081501 - RNA, 20 nt, Streptococcus pneumoniae R6
aaacaguguuuugagcugac

SEQ ID NO: 4081502 - RNA, 18 nt, Streptococcus pneumoniae R6
aaacaguuacaucaguau

SEQ ID NO: 4081503 - RNA, 21 nt, Streptococcus pneumoniae R6
aaacaguuagacaauuaauuu

SEQ ID NO: 4081504 - RNA, 20 nt, Streptococcus pneumoniae R6
aaacauaacgggaaucccaa

SEQ ID NO: 4081505 - RNA, 23 nt, Streptococcus pneumoniae R6
aaacauacugaacucaacuuccu

SEQ ID NO: 4081506 - RNA, 15 nt, Streptococcus pneumoniae R6
aaacaucuaccuauu

SEQ ID NO: 4081507 - RNA, 22 nt, Streptococcus pneumoniae R6
aaacaucuaccuauucauauau

SEQ ID NO: 4081508 - RNA, 17 nt, Streptococcus pneumoniae R6
aaacaucucagaauaau

SEQ ID NO: 4081509 - RNA, 19 nt, Streptococcus pneumoniae R6
aaacaugguuuugagguug

SEQ ID NO: 4081510 - RNA, 21 nt, Streptococcus pneumoniae R6
aaacauguuuuugagguugua

SEQ ID NO: 4081511 - RNA, 13 nt, Streptococcus pneumoniae R6
aaacauucccaca

SEQ ID NO: 4081512 - RNA, 15 nt, Streptococcus pneumoniae R6
aaacauucuuagaaa

SEQ ID NO: 4081513 - RNA, 21 nt, Streptococcus pneumoniae R6
aaacauugacuugcuguuuuc

SEQ ID NO: 4081514 - RNA, 22 nt, Streptococcus pneumoniae R6
aaacauugacuugcuguuuucu

SEQ ID NO: 4081515 - RNA, 10 nt, Streptococcus pneumoniae R6
aaacauugug

SEQ ID NO: 4081516 - RNA, 12 nt, Streptococcus pneumoniae R6
aaacauugugag

SEQ ID NO: 4081517 - RNA, 23 nt, Streptococcus pneumoniae R6
aaacauuguuaaaaauugauuug

SEQ ID NO: 4081518 - RNA, 14 nt, Streptococcus pneumoniae R6
aaacauuguuagaa

SEQ ID NO: 4081519 - RNA, 17 nt, Streptococcus pneumoniae R6
aaacauuuauagaaauu

SEQ ID NO: 4081520 - RNA, 22 nt, Streptococcus pneumoniae R6
aaacauuugauuuuguaaaaau

SEQ ID NO: 4081521 - RNA, 23 nt, Streptococcus pneumoniae R6
aaacauuugauuuuguaaaaaua

SEQ ID NO: 4081522 - RNA, 14 nt, Streptococcus pneumoniae R6
aaaccaaaggaagc

SEQ ID NO: 4081523 - RNA, 16 nt, Streptococcus pneumoniae R6
aaaccaagaaccuugg

SEQ ID NO: 4081524 - RNA, 13 nt, Streptococcus pneumoniae R6
aaaccaagaaguc

SEQ ID NO: 4081525 - RNA, 13 nt, Streptococcus pneumoniae R6
aaaccaauuuuaa

SEQ ID NO: 4081526 - RNA, 14 nt, Streptococcus pneumoniae R6
aaaccaauuuuaag

SEQ ID NO: 4081527 - RNA, 23 nt, Streptococcus pneumoniae R6
aaaccaccagaguggauuugguu

SEQ ID NO: 4081528 - RNA, 18 nt, Streptococcus pneumoniae R6
aaaccaccgacaacccag

SEQ ID NO: 4081529 - RNA, 18 nt, Streptococcus pneumoniae R6
aaaccacgucagcuuuau

SEQ ID NO: 4081530 - RNA, 18 nt, Streptococcus pneumoniae R6
aaaccagguucuucaauc

SEQ ID NO: 4081531 - RNA, 16 nt, Streptococcus pneumoniae R6
aaaccaguccuggaaa

SEQ ID NO: 4081532 - RNA, 23 nt, Streptococcus pneumoniae R6
aaaccaguccuggaaaaacgugg

SEQ ID NO: 4081533 - RNA, 21 nt, Streptococcus pneumoniae R6
aaaccaguccuugaaaaacgu

SEQ ID NO: 4081534 - RNA, 13 nt, Streptococcus pneumoniae R6
aaaccaguucaua

SEQ ID NO: 4081535 - RNA, 22 nt, Streptococcus pneumoniae R6
aaaccaucaucagcauaaucug

SEQ ID NO: 4081536 - RNA, 23 nt, Streptococcus pneumoniae R6
aaaccaucguguaggggauaaug

SEQ ID NO: 4081537 - RNA, 20 nt, Streptococcus pneumoniae R6
aaaccauguuuuucaauagc

SEQ ID NO: 4081538 - RNA, 16 nt, Streptococcus pneumoniae R6
aaaccauucaaaauac

SEQ ID NO: 4081539 - RNA, 20 nt, Streptococcus pneumoniae R6
aaaccgcgauuuuuugauac

SEQ ID NO: 4081540 - RNA, 18 nt, Streptococcus pneumoniae R6
aaaccgcgucagcuuuau

SEQ ID NO: 4081541 - RNA, 12 nt, Streptococcus pneumoniae R6
aaaccgucauca

SEQ ID NO: 4081542 - RNA, 19 nt, Streptococcus pneumoniae R6
aaaccguguucugucaugc

SEQ ID NO: 4081543 - RNA, 16 nt, Streptococcus pneumoniae R6
aaaccuguuugaauca

SEQ ID NO: 4081544 - RNA, 18 nt, Streptococcus pneumoniae R6
aaaccuuauuuuuuaugg

SEQ ID NO: 4081545 - RNA, 18 nt, Streptococcus pneumoniae R6
aaaccuucccacaauaaa

SEQ ID NO: 4081546 - RNA, 13 nt, Streptococcus pneumoniae R6
aaaccuugaagag

SEQ ID NO: 4081547 - RNA, 14 nt, Streptococcus pneumoniae R6
aaaccuugauuuua

SEQ ID NO: 4081548 - RNA, 17 nt, Streptococcus pneumoniae R6
aaaccuugcaaaacagg

SEQ ID NO: 4081549 - RNA, 13 nt, Streptococcus pneumoniae R6
aaaccuuguucuu

SEQ ID NO: 4081550 - RNA, 15 nt, Streptococcus pneumoniae R6
aaaccuuguuuuuuc

SEQ ID NO: 4081551 - RNA, 19 nt, Streptococcus pneumoniae R6
aaaccuuuugggcacgaag

SEQ ID NO: 4081552 - RNA, 20 nt, Streptococcus pneumoniae R6
aaacgaacgccuuaaaaaac

SEQ ID NO: 4081553 - RNA, 16 nt, Streptococcus pneumoniae R6
aaacgaagaaggaaga

SEQ ID NO: 4081554 - RNA, 20 nt, Streptococcus pneumoniae R6
aaacgacuagauaaaagaau

SEQ ID NO: 4081555 - RNA, 14 nt, Streptococcus pneumoniae R6
aaacgagucaagaa

SEQ ID NO: 4081556 - RNA, 14 nt, Streptococcus pneumoniae R6
aaacgauaaauucc

SEQ ID NO: 4081557 - RNA, 17 nt, Streptococcus pneumoniae R6
aaacgauuuuuuucaaa

SEQ ID NO: 4081558 - RNA, 18 nt, Streptococcus pneumoniae R6
aaacgcaagcaacaaaaa

SEQ ID NO: 4081559 - RNA, 22 nt, Streptococcus pneumoniae R6
aaacggaggauuuuugaauauu

SEQ ID NO: 4081560 - RNA, 16 nt, Streptococcus pneumoniae R6
aaacggcauaaaaucu

SEQ ID NO: 4081561 - RNA, 15 nt, Streptococcus pneumoniae R6
aaacguaauuucauu

SEQ ID NO: 4081562 - RNA, 19 nt, Streptococcus pneumoniae R6
aaacguccaaggcugaaau

SEQ ID NO: 4081563 - RNA, 20 nt, Streptococcus pneumoniae R6
aaacguccagccuugucuug

SEQ ID NO: 4081564 - RNA, 21 nt, Streptococcus pneumoniae R6
aaacgugcuauaucaaaacca

SEQ ID NO: 4081565 - RNA, 23 nt, Streptococcus pneumoniae R6
aaacgugcuauaucaaaaccagu

SEQ ID NO: 4081566 - RNA, 21 nt, Streptococcus pneumoniae R6
aaacguuuaucacucaguuua

SEQ ID NO: 4081567 - RNA, 20 nt, Streptococcus pneumoniae R6
aaacuaagcuucaaaaaagu

SEQ ID NO: 4081568 - RNA, 20 nt, Streptococcus pneumoniae R6
aaacuaaugagccuuaucau

SEQ ID NO: 4081569 - RNA, 18 nt, Streptococcus pneumoniae R6
aaacuaauguaaaaaagu

SEQ ID NO: 4081570 - RNA, 21 nt, Streptococcus pneumoniae R6
aaacuaauuuagagaaugaaa

SEQ ID NO: 4081571 - RNA, 22 nt, Streptococcus pneumoniae R6
aaacuacacccgcauaaauacu

SEQ ID NO: 4081572 - RNA, 20 nt, Streptococcus pneumoniae R6
aaacuacguuuugcuaauca

SEQ ID NO: 4081573 - RNA, 13 nt, Streptococcus pneumoniae R6
aaacuacuauuua

SEQ ID NO: 4081574 - RNA, 22 nt, Streptococcus pneumoniae R6
aaacuagaauaauacacuucua

SEQ ID NO: 4081575 - RNA, 16 nt, Streptococcus pneumoniae R6
aaacuagaauaggaca

SEQ ID NO: 4081576 - RNA, 20 nt, Streptococcus pneumoniae R6
aaacuagaauaggacaucau

SEQ ID NO: 4081577 - RNA, 16 nt, Streptococcus pneumoniae R6
aaacuagcaaugccaa

SEQ ID NO: 4081578 - RNA, 20 nt, Streptococcus pneumoniae R6
aaacuagcugcgggcugcuc

SEQ ID NO: 4081579 - RNA, 16 nt, Streptococcus pneumoniae R6
aaacuaggauuuucuu

SEQ ID NO: 4081580 - RNA, 19 nt, Streptococcus pneumoniae R6
aaacuagucgcagguugcu

SEQ ID NO: 4081581 - RNA, 15 nt, Streptococcus pneumoniae R6
aaacuaguuuaaaag

SEQ ID NO: 4081582 - RNA, 18 nt, Streptococcus pneumoniae R6
aaacuaguuuaaaagacu

SEQ ID NO: 4081583 - RNA, 15 nt, Streptococcus pneumoniae R6
aaacuaguuuaaauc

SEQ ID NO: 4081584 - RNA, 16 nt, Streptococcus pneumoniae R6
aaacuaguuuugagaa

SEQ ID NO: 4081585 - RNA, 22 nt, Streptococcus pneumoniae R6
aaacuaugaugugcuauucuaa

SEQ ID NO: 4081586 - RNA, 15 nt, Streptococcus pneumoniae R6
aaacuauguacgaaa

SEQ ID NO: 4081587 - RNA, 15 nt, Streptococcus pneumoniae R6
aaacucaaauguaag

SEQ ID NO: 4081588 - RNA, 22 nt, Streptococcus pneumoniae R6
aaacucaauuucaggagaaaau

SEQ ID NO: 4081589 - RNA, 22 nt, Streptococcus pneumoniae R6
aaacucagguuucucuacaguu

SEQ ID NO: 4081590 - RNA, 15 nt, Streptococcus pneumoniae R6
aaacucaguuaaaau

SEQ ID NO: 4081591 - RNA, 23 nt, Streptococcus pneumoniae R6
aaacuccaaacgcgauacaauaa

SEQ ID NO: 4081592 - RNA, 21 nt, Streptococcus pneumoniae R6
aaacucccacucaaagcguuc

SEQ ID NO: 4081593 - RNA, 22 nt, Streptococcus pneumoniae R6
aaacuccucuccagcagugguu

SEQ ID NO: 4081594 - RNA, 14 nt, Streptococcus pneumoniae R6
aaacucuaaacaaa

SEQ ID NO: 4081595 - RNA, 14 nt, Streptococcus pneumoniae R6
aaacucuuacaaaa

SEQ ID NO: 4081596 - RNA, 16 nt, Streptococcus pneumoniae R6
aaacugaacaaauuaa

SEQ ID NO: 4081597 - RNA, 14 nt, Streptococcus pneumoniae R6
aaacugacaacuug

SEQ ID NO: 4081598 - RNA, 13 nt, Streptococcus pneumoniae R6
aaacugacguggu

SEQ ID NO: 4081599 - RNA, 22 nt, Streptococcus pneumoniae R6
aaacugacgugguuuaaaaaga

SEQ ID NO: 4081600 - RNA, 17 nt, Streptococcus pneumoniae R6
aaacugcgaagaaauca

SEQ ID NO: 4081601 - RNA, 17 nt, Streptococcus pneumoniae R6
aaacugcguuuugauua

SEQ ID NO: 4081602 - RNA, 14 nt, Streptococcus pneumoniae R6
aaacugcuuagaac

SEQ ID NO: 4081603 - RNA, 14 nt, Streptococcus pneumoniae R6
aaacuggagcauuu

SEQ ID NO: 4081604 - RNA, 16 nt, Streptococcus pneumoniae R6
aaacuggguugaagau

SEQ ID NO: 4081605 - RNA, 16 nt, Streptococcus pneumoniae R6
aaacugguccagagau

SEQ ID NO: 4081606 - RNA, 14 nt, Streptococcus pneumoniae R6
aaacuggugauaag

SEQ ID NO: 4081607 - RNA, 19 nt, Streptococcus pneumoniae R6
aaacuguaaaguagcaaaa

SEQ ID NO: 4081608 - RNA, 20 nt, Streptococcus pneumoniae R6
aaacuguaaaguagcaaaac

SEQ ID NO: 4081609 - RNA, 21 nt, Streptococcus pneumoniae R6
aaacuguaaaguagcaaaaca

SEQ ID NO: 4081610 - RNA, 22 nt, Streptococcus pneumoniae R6
aaacuguaaaguagcaaaacac

SEQ ID NO: 4081611 - RNA, 15 nt, Streptococcus pneumoniae R6
aaacuguacaagaac

SEQ ID NO: 4081612 - RNA, 17 nt, Streptococcus pneumoniae R6
aaacuguacaagaacaa

SEQ ID NO: 4081613 - RNA, 14 nt, Streptococcus pneumoniae R6
aaacuguccacaaa

SEQ ID NO: 4081614 - RNA, 12 nt, Streptococcus pneumoniae R6
aaacugugauau

SEQ ID NO: 4081615 - RNA, 16 nt, Streptococcus pneumoniae R6
aaacuuacuacacagc

SEQ ID NO: 4081616 - RNA, 14 nt, Streptococcus pneumoniae R6
aaacuuagcgaaau

SEQ ID NO: 4081617 - RNA, 12 nt, Streptococcus pneumoniae R6
aaacuuaggaag

SEQ ID NO: 4081618 - RNA, 14 nt, Streptococcus pneumoniae R6
aaacuuaggaagca

SEQ ID NO: 4081619 - RNA, 19 nt, Streptococcus pneumoniae R6
aaacuucacgguuuguauu

SEQ ID NO: 4081620 - RNA, 17 nt, Streptococcus pneumoniae R6
aaacuucuggcuuaaca

SEQ ID NO: 4081621 - RNA, 15 nt, Streptococcus pneumoniae R6
aaacuugcucagagg

SEQ ID NO: 4081622 - RNA, 18 nt, Streptococcus pneumoniae R6
aaacuugcucagaggaga

SEQ ID NO: 4081623 - RNA, 17 nt, Streptococcus pneumoniae R6
aaacuugguaauuugaa

SEQ ID NO: 4081624 - RNA, 16 nt, Streptococcus pneumoniae R6
aaacuuguaagucaag

SEQ ID NO: 4081625 - RNA, 22 nt, Streptococcus pneumoniae R6
aaacuuguaggcuucuugacca

SEQ ID NO: 4081626 - RNA, 17 nt, Streptococcus pneumoniae R6
aaacuuuauauccuugu

SEQ ID NO: 4081627 - RNA, 18 nt, Streptococcus pneumoniae R6
aaacuuuauauccuuguu

SEQ ID NO: 4081628 - RNA, 18 nt, Streptococcus pneumoniae R6
aaacuuuuuaguuuuuga

SEQ ID NO: 4081629 - RNA, 12 nt, Streptococcus pneumoniae R6
aaagaaaaaaca

SEQ ID NO: 4081630 - RNA, 13 nt, Streptococcus pneumoniae R6
aaagaaagauucc

SEQ ID NO: 4081631 - RNA, 22 nt, Streptococcus pneumoniae R6
aaagaacaucuacaauugaaac

SEQ ID NO: 4081632 - RNA, 21 nt, Streptococcus pneumoniae R6
aaagaaccacgguaaaauacu

SEQ ID NO: 4081633 - RNA, 18 nt, Streptococcus pneumoniae R6
aaagaaccaguacuuuca

SEQ ID NO: 4081634 - RNA, 20 nt, Streptococcus pneumoniae R6
aaagaaccaguacuuucaac

SEQ ID NO: 4081635 - RNA, 21 nt, Streptococcus pneumoniae R6
aaagaaccugcaguucccaca

SEQ ID NO: 4081636 - RNA, 15 nt, Streptococcus pneumoniae R6
aaagaagagguuguu

SEQ ID NO: 4081637 - RNA, 23 nt, Streptococcus pneumoniae R6
aaagaaggagccagcugaaaaaa

SEQ ID NO: 4081638 - RNA, 19 nt, Streptococcus pneumoniae R6
aaagaaggauugagaagcc

SEQ ID NO: 4081639 - RNA, 23 nt, Streptococcus pneumoniae R6
aaagaaggauugagaagccaaaa

SEQ ID NO: 4081640 - RNA, 17 nt, Streptococcus pneumoniae R6
aaagaaggguuagucau

SEQ ID NO: 4081641 - RNA, 18 nt, Streptococcus pneumoniae R6
aaagaauccaucugauaa

SEQ ID NO: 4081642 - RNA, 16 nt, Streptococcus pneumoniae R6
aaagaauuugaaaaaa

SEQ ID NO: 4081643 - RNA, 19 nt, Streptococcus pneumoniae R6
aaagacaauguucuuuucu

SEQ ID NO: 4081644 - RNA, 18 nt, Streptococcus pneumoniae R6
aaagacacauggaaggcc

SEQ ID NO: 4081645 - RNA, 14 nt, Streptococcus pneumoniae R6
aaagacagucugaa

SEQ ID NO: 4081646 - RNA, 18 nt, Streptococcus pneumoniae R6
aaagacagucugaaaaag

SEQ ID NO: 4081647 - RNA, 19 nt, Streptococcus pneumoniae R6
aaagacagucugaaaaaga

SEQ ID NO: 4081648 - RNA, 15 nt, Streptococcus pneumoniae R6
aaagacaguugcauu

SEQ ID NO: 4081649 - RNA, 15 nt, Streptococcus pneumoniae R6
aaagaccaugaggaa

SEQ ID NO: 4081650 - RNA, 18 nt, Streptococcus pneumoniae R6
aaagaccguuugaaaaag

SEQ ID NO: 4081651 - RNA, 19 nt, Streptococcus pneumoniae R6
aaagaccuacccaaaugga

SEQ ID NO: 4081652 - RNA, 14 nt, Streptococcus pneumoniae R6
aaagaccuuugaaa

SEQ ID NO: 4081653 - RNA, 22 nt, Streptococcus pneumoniae R6
aaagaccuuugaaaacugaaca

SEQ ID NO: 4081654 - RNA, 17 nt, Streptococcus pneumoniae R6
aaagacucuugcccuug

SEQ ID NO: 4081655 - RNA, 22 nt, Streptococcus pneumoniae R6
aaagacuggugagauaaaacgu

SEQ ID NO: 4081656 - RNA, 16 nt, Streptococcus pneumoniae R6
aaagacuucuugagcu

SEQ ID NO: 4081657 - RNA, 20 nt, Streptococcus pneumoniae R6
aaagacuucuugagcuaggg

SEQ ID NO: 4081658 - RNA, 23 nt, Streptococcus pneumoniae R6
aaagacuugaccggagaaagaau

SEQ ID NO: 4081659 - RNA, 15 nt, Streptococcus pneumoniae R6
aaagacuuuuuucca

SEQ ID NO: 4081660 - RNA, 18 nt, Streptococcus pneumoniae R6
aaagacuuuuuucuauag

SEQ ID NO: 4081661 - RNA, 20 nt, Streptococcus pneumoniae R6
aaagagccagaaaaaucccu

SEQ ID NO: 4081662 - RNA, 14 nt, Streptococcus pneumoniae R6
aaagagccauaaaa

SEQ ID NO: 4081663 - RNA, 18 nt, Streptococcus pneumoniae R6
aaagagccgaaaaaauag

SEQ ID NO: 4081664 - RNA, 17 nt, Streptococcus pneumoniae R6
aaagagcugcauuugua

SEQ ID NO: 4081665 - RNA, 16 nt, Streptococcus pneumoniae R6
aaagaggaagaggaca

SEQ ID NO: 4081666 - RNA, 20 nt, Streptococcus pneumoniae R6
aaagaggcgaugaucucucu

SEQ ID NO: 4081667 - RNA, 21 nt, Streptococcus pneumoniae R6
aaagaggcgaugaucucucug

SEQ ID NO: 4081668 - RNA, 15 nt, Streptococcus pneumoniae R6
aaagagggauuuugu

SEQ ID NO: 4081669 - RNA, 21 nt, Streptococcus pneumoniae R6
aaagaggucgaagccauccuu

SEQ ID NO: 4081670 - RNA, 14 nt, Streptococcus pneumoniae R6
aaagaguagaaauu

SEQ ID NO: 4081671 - RNA, 17 nt, Streptococcus pneumoniae R6
aaagagucaagacaagg

SEQ ID NO: 4081672 - RNA, 19 nt, Streptococcus pneumoniae R6
aaagagucccuuagaaaaa

SEQ ID NO: 4081673 - RNA, 21 nt, Streptococcus pneumoniae R6
aaagagucccuuagaaaaacg

SEQ ID NO: 4081674 - RNA, 22 nt, Streptococcus pneumoniae R6
aaagagucccuuagaaaaacga

SEQ ID NO: 4081675 - RNA, 15 nt, Streptococcus pneumoniae R6
aaagaguuuucugau

SEQ ID NO: 4081676 - RNA, 19 nt, Streptococcus pneumoniae R6
aaagaguuuuuuaucuuug

SEQ ID NO: 4081677 - RNA, 20 nt, Streptococcus pneumoniae R6
aaagauaacugcuagaaaug

SEQ ID NO: 4081678 - RNA, 20 nt, Streptococcus pneumoniae R6
aaagauaagcgcuagcaaaa

SEQ ID NO: 4081679 - RNA, 21 nt, Streptococcus pneumoniae R6
aaagauagagaaagaaaaacu

SEQ ID NO: 4081680 - RNA, 15 nt, Streptococcus pneumoniae R6
aaagauagaugauuu

SEQ ID NO: 4081681 - RNA, 22 nt, Streptococcus pneumoniae R6
aaagauaucgguuuaucuccca

SEQ ID NO: 4081682 - RNA, 15 nt, Streptococcus pneumoniae R6
aaagaugagaggaga

SEQ ID NO: 4081683 - RNA, 13 nt, Streptococcus pneumoniae R6
aaagaugauauca

SEQ ID NO: 4081684 - RNA, 12 nt, Streptococcus pneumoniae R6
aaagauuugaaa

SEQ ID NO: 4081685 - RNA, 16 nt, Streptococcus pneumoniae R6
aaagauuugcuggaua

SEQ ID NO: 4081686 - RNA, 15 nt, Streptococcus pneumoniae R6
aaagauuuuuuccuu

SEQ ID NO: 4081687 - RNA, 14 nt, Streptococcus pneumoniae R6
aaagcaaaagaaca

SEQ ID NO: 4081688 - RNA, 13 nt, Streptococcus pneumoniae R6
aaagcaaauagca

SEQ ID NO: 4081689 - RNA, 14 nt, Streptococcus pneumoniae R6
aaagcaacuaaaau

SEQ ID NO: 4081690 - RNA, 19 nt, Streptococcus pneumoniae R6
aaagcaacuaaaaucauag

SEQ ID NO: 4081691 - RNA, 19 nt, Streptococcus pneumoniae R6
aaagcacggagaacaauau

SEQ ID NO: 4081692 - RNA, 21 nt, Streptococcus pneumoniae R6
aaagcacugauuugagguugu

SEQ ID NO: 4081693 - RNA, 21 nt, Streptococcus pneumoniae R6
aaagcacugccauuaauuccu

SEQ ID NO: 4081694 - RNA, 22 nt, Streptococcus pneumoniae R6
aaagcacugccauuaauuccug

SEQ ID NO: 4081695 - RNA, 18 nt, Streptococcus pneumoniae R6
aaagcacuugcuuuugau

SEQ ID NO: 4081696 - RNA, 22 nt, Streptococcus pneumoniae R6
aaagcagaugaguguaaaaaga

SEQ ID NO: 4081697 - RNA, 23 nt, Streptococcus pneumoniae R6
aaagcagaugaguguaaaaagaa

SEQ ID NO: 4081698 - RNA, 15 nt, Streptococcus pneumoniae R6
aaagcagaugcaaaa

SEQ ID NO: 4081699 - RNA, 18 nt, Streptococcus pneumoniae R6
aaagcaggaguuuucccu

SEQ ID NO: 4081700 - RNA, 19 nt, Streptococcus pneumoniae R6
aaagcaguacuuugagcaa

SEQ ID NO: 4081701 - RNA, 14 nt, Streptococcus pneumoniae R6
aaagcagugcuuug

SEQ ID NO: 4081702 - RNA, 21 nt, Streptococcus pneumoniae R6
aaagcauagagaaaaacagcu

SEQ ID NO: 4081703 - RNA, 21 nt, Streptococcus pneumoniae R6
aaagccaaucaaaaaaucuca

SEQ ID NO: 4081704 - RNA, 20 nt, Streptococcus pneumoniae R6
aaagccacuauaauaauuua

SEQ ID NO: 4081705 - RNA, 14 nt, Streptococcus pneumoniae R6
aaagcccuauauua

SEQ ID NO: 4081706 - RNA, 21 nt, Streptococcus pneumoniae R6
aaagcccuucauaagcuaguc

SEQ ID NO: 4081707 - RNA, 21 nt, Streptococcus pneumoniae R6
aaagccgacccaggcaaagag

SEQ ID NO: 4081708 - RNA, 15 nt, Streptococcus pneumoniae R6
aaagccuugcuuucu

SEQ ID NO: 4081709 - RNA, 14 nt, Streptococcus pneumoniae R6
aaagcgaaaggaga

SEQ ID NO: 4081710 - RNA, 19 nt, Streptococcus pneumoniae R6
aaagcgaaaggagaaaaaa

SEQ ID NO: 4081711 - RNA, 21 nt, Streptococcus pneumoniae R6
aaagcgaacaaccgacaaguc

SEQ ID NO: 4081712 - RNA, 19 nt, Streptococcus pneumoniae R6
aaagcgaccguauuuuugu

SEQ ID NO: 4081713 - RNA, 13 nt, Streptococcus pneumoniae R6
aaagcgauaaaaa

SEQ ID NO: 4081714 - RNA, 19 nt, Streptococcus pneumoniae R6
aaagcgauaaaaauccguu

SEQ ID NO: 4081715 - RNA, 16 nt, Streptococcus pneumoniae R6
aaagcgggauuuaaaa

SEQ ID NO: 4081716 - RNA, 15 nt, Streptococcus pneumoniae R6
aaagcguucaaagac

SEQ ID NO: 4081717 - RNA, 14 nt, Streptococcus pneumoniae R6
aaagcguuuauaua

SEQ ID NO: 4081718 - RNA, 15 nt, Streptococcus pneumoniae R6
aaagcuaaagaugau

SEQ ID NO: 4081719 - RNA, 19 nt, Streptococcus pneumoniae R6
aaagcuaaagaugaugguu

SEQ ID NO: 4081720 - RNA, 18 nt, Streptococcus pneumoniae R6
aaagcuaaauccuuuuuu

SEQ ID NO: 4081721 - RNA, 13 nt, Streptococcus pneumoniae R6
aaagcuaagcucg

SEQ ID NO: 4081722 - RNA, 16 nt, Streptococcus pneumoniae R6
aaagcuaagcucgaga

SEQ ID NO: 4081723 - RNA, 18 nt, Streptococcus pneumoniae R6
aaagcuacuuuuuuacca

SEQ ID NO: 4081724 - RNA, 23 nt, Streptococcus pneumoniae R6
aaagcuagucgcagguugcucaa

SEQ ID NO: 4081725 - RNA, 13 nt, Streptococcus pneumoniae R6
aaagcuccauaca

SEQ ID NO: 4081726 - RNA, 18 nt, Streptococcus pneumoniae R6
aaagcuccauacacugga

SEQ ID NO: 4081727 - RNA, 21 nt, Streptococcus pneumoniae R6
aaagcuccauacacuggaugu

SEQ ID NO: 4081728 - RNA, 13 nt, Streptococcus pneumoniae R6
aaagcucuucuaa

SEQ ID NO: 4081729 - RNA, 14 nt, Streptococcus pneumoniae R6
aaagcugaauucua

SEQ ID NO: 4081730 - RNA, 14 nt, Streptococcus pneumoniae R6
aaagcuguauuggu

SEQ ID NO: 4081731 - RNA, 14 nt, Streptococcus pneumoniae R6
aaagcugugcuuug

SEQ ID NO: 4081732 - RNA, 18 nt, Streptococcus pneumoniae R6
aaagcuucauuuaucuuc

SEQ ID NO: 4081733 - RNA, 22 nt, Streptococcus pneumoniae R6
aaagcuucucggacuuuuucca

SEQ ID NO: 4081734 - RNA, 12 nt, Streptococcus pneumoniae R6
aaagcuugaccu

SEQ ID NO: 4081735 - RNA, 17 nt, Streptococcus pneumoniae R6
aaagcuuguuuaaaauc

SEQ ID NO: 4081736 - RNA, 18 nt, Streptococcus pneumoniae R6
aaaggaaaaugauuuuuu

SEQ ID NO: 4081737 - RNA, 16 nt, Streptococcus pneumoniae R6
aaaggaaaccuaauca

SEQ ID NO: 4081738 - RNA, 14 nt, Streptococcus pneumoniae R6
aaaggaaccaaaug

SEQ ID NO: 4081739 - RNA, 21 nt, Streptococcus pneumoniae R6
aaaggaagagagcuccaaaug

SEQ ID NO: 4081740 - RNA, 23 nt, Streptococcus pneumoniae R6
aaaggaauuuuauuuucugauaa

SEQ ID NO: 4081741 - RNA, 14 nt, Streptococcus pneumoniae R6
aaaggacaaauuuu

SEQ ID NO: 4081742 - RNA, 21 nt, Streptococcus pneumoniae R6
aaaggacuaugaucagcauuu

SEQ ID NO: 4081743 - RNA, 23 nt, Streptococcus pneumoniae R6
aaaggacuugaguaaugaacuca

SEQ ID NO: 4081744 - RNA, 22 nt, Streptococcus pneumoniae R6
aaaggacuuuaaagcggucuuu

SEQ ID NO: 4081745 - RNA, 15 nt, Streptococcus pneumoniae R6
aaaggagaaaaaaua

SEQ ID NO: 4081746 - RNA, 19 nt, Streptococcus pneumoniae R6
aaaggagaagauuucagaa

SEQ ID NO: 4081747 - RNA, 21 nt, Streptococcus pneumoniae R6
aaaggagaggagaauuuuuga

SEQ ID NO: 4081748 - RNA, 21 nt, Streptococcus pneumoniae R6
aaaggagauaguaucccauuc

SEQ ID NO: 4081749 - RNA, 13 nt, Streptococcus pneumoniae R6
aaaggaguaacua

SEQ ID NO: 4081750 - RNA, 15 nt, Streptococcus pneumoniae R6
aaaggaguagaaaau

SEQ ID NO: 4081751 - RNA, 17 nt, Streptococcus pneumoniae R6
aaaggaguagaaaauga

SEQ ID NO: 4081752 - RNA, 21 nt, Streptococcus pneumoniae R6
aaaggaguagaaaaugaaauu

SEQ ID NO: 4081753 - RNA, 14 nt, Streptococcus pneumoniae R6
aaaggauaugagga

SEQ ID NO: 4081754 - RNA, 22 nt, Streptococcus pneumoniae R6
aaaggauaugaggagaaagaag

SEQ ID NO: 4081755 - RNA, 13 nt, Streptococcus pneumoniae R6
aaaggauuauaaa

SEQ ID NO: 4081756 - RNA, 17 nt, Streptococcus pneumoniae R6
aaaggauuuaguucugu

SEQ ID NO: 4081757 - RNA, 16 nt, Streptococcus pneumoniae R6
aaaggauuucugcuuu

SEQ ID NO: 4081758 - RNA, 20 nt, Streptococcus pneumoniae R6
aaaggcaucuugucaaagag

SEQ ID NO: 4081759 - RNA, 20 nt, Streptococcus pneumoniae R6
aaaggccuuggccuuaucaa

SEQ ID NO: 4081760 - RNA, 21 nt, Streptococcus pneumoniae R6
aaaggcgauugaaacaugagg

SEQ ID NO: 4081761 - RNA, 19 nt, Streptococcus pneumoniae R6
aaaggcuuugcgcuugaua

SEQ ID NO: 4081762 - RNA, 20 nt, Streptococcus pneumoniae R6
aaaggcuuugcgcuugauaa

SEQ ID NO: 4081763 - RNA, 16 nt, Streptococcus pneumoniae R6
aaaggcuuuuucuucu

SEQ ID NO: 4081764 - RNA, 22 nt, Streptococcus pneumoniae R6
aaagggaaaucugaaaaauuaa

SEQ ID NO: 4081765 - RNA, 22 nt, Streptococcus pneumoniae R6
aaagggacaaaacuuuuuaaaa

SEQ ID NO: 4081766 - RNA, 20 nt, Streptococcus pneumoniae R6
aaagggaugauguuaucaaa

SEQ ID NO: 4081767 - RNA, 20 nt, Streptococcus pneumoniae R6
aaagggggaacguuuuuaaa

SEQ ID NO: 4081768 - RNA, 14 nt, Streptococcus pneumoniae R6
aaagguaacuccuu

SEQ ID NO: 4081769 - RNA, 21 nt, Streptococcus pneumoniae R6
aaagguaauccaauugaggaa

SEQ ID NO: 4081770 - RNA, 20 nt, Streptococcus pneumoniae R6
aaaggucaucagcagagaaa

SEQ ID NO: 4081771 - RNA, 22 nt, Streptococcus pneumoniae R6
aaaggucaucagcagagaaaga

SEQ ID NO: 4081772 - RNA, 23 nt, Streptococcus pneumoniae R6
aaaggucaucagcagagaaagaa

SEQ ID NO: 4081773 - RNA, 14 nt, Streptococcus pneumoniae R6
aaaggucucuucuu

SEQ ID NO: 4081774 - RNA, 14 nt, Streptococcus pneumoniae R6
aaagguuuuaaaga

SEQ ID NO: 4081775 - RNA, 13 nt, Streptococcus pneumoniae R6
aaaguaaaauaca

SEQ ID NO: 4081776 - RNA, 13 nt, Streptococcus pneumoniae R6
aaaguaaaauuaa

SEQ ID NO: 4081777 - RNA, 18 nt, Streptococcus pneumoniae R6
aaaguaagaauguugcuu

SEQ ID NO: 4081778 - RNA, 13 nt, Streptococcus pneumoniae R6
aaaguaagagaaa

SEQ ID NO: 4081779 - RNA, 14 nt, Streptococcus pneumoniae R6
aaaguaaucucuaa

SEQ ID NO: 4081780 - RNA, 16 nt, Streptococcus pneumoniae R6
aaaguaaugccaggcc

SEQ ID NO: 4081781 - RNA, 15 nt, Streptococcus pneumoniae R6
aaaguaauuugagua

SEQ ID NO: 4081782 - RNA, 22 nt, Streptococcus pneumoniae R6
aaaguaauuugaguaaaagaca

SEQ ID NO: 4081783 - RNA, 17 nt, Streptococcus pneumoniae R6
aaaguacagauuugaaa

SEQ ID NO: 4081784 - RNA, 21 nt, Streptococcus pneumoniae R6
aaaguacugccuugagguuuu

SEQ ID NO: 4081785 - RNA, 17 nt, Streptococcus pneumoniae R6
aaaguacuugagaaucu

SEQ ID NO: 4081786 - RNA, 22 nt, Streptococcus pneumoniae R6
aaaguacuuuuaauauacuuga

SEQ ID NO: 4081787 - RNA, 17 nt, Streptococcus pneumoniae R6
aaaguagaguccaaaga

SEQ ID NO: 4081788 - RNA, 18 nt, Streptococcus pneumoniae R6
aaaguagaguccaaagac

SEQ ID NO: 4081789 - RNA, 20 nt, Streptococcus pneumoniae R6
aaaguagaguccaaagacca

SEQ ID NO: 4081790 - RNA, 16 nt, Streptococcus pneumoniae R6
aaaguagcaaaacacu

SEQ ID NO: 4081791 - RNA, 23 nt, Streptococcus pneumoniae R6
aaaguagcgcccuuguucuccaa

SEQ ID NO: 4081792 - RNA, 19 nt, Streptococcus pneumoniae R6
aaaguagcucuuuuguuaa

SEQ ID NO: 4081793 - RNA, 22 nt, Streptococcus pneumoniae R6
aaaguaggucccaucauagccg

SEQ ID NO: 4081794 - RNA, 21 nt, Streptococcus pneumoniae R6
aaaguagugaaugauucugaa

SEQ ID NO: 4081795 - RNA, 21 nt, Streptococcus pneumoniae R6
aaaguauacucuaauugaaaa

SEQ ID NO: 4081796 - RNA, 15 nt, Streptococcus pneumoniae R6
aaaguauauuuagua

SEQ ID NO: 4081797 - RNA, 12 nt, Streptococcus pneumoniae R6
aaaguauuaaaa

SEQ ID NO: 4081798 - RNA, 13 nt, Streptococcus pneumoniae R6
aaaguauuaaaau

SEQ ID NO: 4081799 - RNA, 15 nt, Streptococcus pneumoniae R6
aaaguauuaaaauaa

SEQ ID NO: 4081800 - RNA, 16 nt, Streptococcus pneumoniae R6
aaaguauuaaaauaag

SEQ ID NO: 4081801 - RNA, 13 nt, Streptococcus pneumoniae R6
aaagucaaacaau

SEQ ID NO: 4081802 - RNA, 12 nt, Streptococcus pneumoniae R6
aaagucaaauua

SEQ ID NO: 4081803 - RNA, 13 nt, Streptococcus pneumoniae R6
aaagucaacagag

SEQ ID NO: 4081804 - RNA, 13 nt, Streptococcus pneumoniae R6
aaagucaauuucu

SEQ ID NO: 4081805 - RNA, 23 nt, Streptococcus pneumoniae R6
aaagucaauuucucuacaaauaa

SEQ ID NO: 4081806 - RNA, 21 nt, Streptococcus pneumoniae R6
aaagucaggccugcacuaagg

SEQ ID NO: 4081807 - RNA, 19 nt, Streptococcus pneumoniae R6
aaaguccauauuagggcaa

SEQ ID NO: 4081808 - RNA, 18 nt, Streptococcus pneumoniae R6
aaaguccucauuucaaua

SEQ ID NO: 4081809 - RNA, 17 nt, Streptococcus pneumoniae R6
aaagucggaaggcauga

SEQ ID NO: 4081810 - RNA, 16 nt, Streptococcus pneumoniae R6
aaagucugaaucaaaa

SEQ ID NO: 4081811 - RNA, 22 nt, Streptococcus pneumoniae R6
aaagucugaaucaaaaaugaag

SEQ ID NO: 4081812 - RNA, 17 nt, Streptococcus pneumoniae R6
aaagucugggaaaaauu

SEQ ID NO: 4081813 - RNA, 15 nt, Streptococcus pneumoniae R6
aaagucuuauaauau

SEQ ID NO: 4081814 - RNA, 20 nt, Streptococcus pneumoniae R6
aaagucuucggagaagaaaa

SEQ ID NO: 4081815 - RNA, 14 nt, Streptococcus pneumoniae R6
aaagucuugacaaa

SEQ ID NO: 4081816 - RNA, 16 nt, Streptococcus pneumoniae R6
aaagucuuggaaaaug

SEQ ID NO: 4081817 - RNA, 20 nt, Streptococcus pneumoniae R6
aaagucuuuaaaaucugaaa

SEQ ID NO: 4081818 - RNA, 13 nt, Streptococcus pneumoniae R6
aaagugaaaaagu

SEQ ID NO: 4081819 - RNA, 15 nt, Streptococcus pneumoniae R6
aaagugaaaaaguaa

SEQ ID NO: 4081820 - RNA, 16 nt, Streptococcus pneumoniae R6
aaagugaaaaaguaag

SEQ ID NO: 4081821 - RNA, 12 nt, Streptococcus pneumoniae R6
aaagugaaagga

SEQ ID NO: 4081822 - RNA, 20 nt, Streptococcus pneumoniae R6
aaagugauguaauuucugaa

SEQ ID NO: 4081823 - RNA, 17 nt, Streptococcus pneumoniae R6
aaagugcaaauaagaaa

SEQ ID NO: 4081824 - RNA, 16 nt, Streptococcus pneumoniae R6
aaaguggaaagagcag

SEQ ID NO: 4081825 - RNA, 14 nt, Streptococcus pneumoniae R6
aaaguggagguguu

SEQ ID NO: 4081826 - RNA, 16 nt, Streptococcus pneumoniae R6
aaaguggauuuuucuu

SEQ ID NO: 4081827 - RNA, 16 nt, Streptococcus pneumoniae R6
aaaguggcugugauau

SEQ ID NO: 4081828 - RNA, 20 nt, Streptococcus pneumoniae R6
aaagugggcugauuuugaaa

SEQ ID NO: 4081829 - RNA, 15 nt, Streptococcus pneumoniae R6
aaaguggguuuuaac

SEQ ID NO: 4081830 - RNA, 16 nt, Streptococcus pneumoniae R6
aaaguggguuuuaacu

SEQ ID NO: 4081831 - RNA, 17 nt, Streptococcus pneumoniae R6
aaaguggguuuuaacua

SEQ ID NO: 4081832 - RNA, 18 nt, Streptococcus pneumoniae R6
aaaguggucguuuuucau

SEQ ID NO: 4081833 - RNA, 15 nt, Streptococcus pneumoniae R6
aaaguggucuuuuuu

SEQ ID NO: 4081834 - RNA, 20 nt, Streptococcus pneumoniae R6
aaagugguguuacgauuuca

SEQ ID NO: 4081835 - RNA, 14 nt, Streptococcus pneumoniae R6
aaaguguagcagau

SEQ ID NO: 4081836 - RNA, 13 nt, Streptococcus pneumoniae R6
aaaguuaaaaaaa

SEQ ID NO: 4081837 - RNA, 15 nt, Streptococcus pneumoniae R6
aaaguuaaaaaaacu

SEQ ID NO: 4081838 - RNA, 16 nt, Streptococcus pneumoniae R6
aaaguuaacuuuucca

SEQ ID NO: 4081839 - RNA, 17 nt, Streptococcus pneumoniae R6
aaaguuaaucucuccuu

SEQ ID NO: 4081840 - RNA, 22 nt, Streptococcus pneumoniae R6
aaaguuaaucucuccuuaucaa

SEQ ID NO: 4081841 - RNA, 21 nt, Streptococcus pneumoniae R6
aaaguuacuugauugcaaagc

SEQ ID NO: 4081842 - RNA, 14 nt, Streptococcus pneumoniae R6
aaaguuagaaauaa

SEQ ID NO: 4081843 - RNA, 19 nt, Streptococcus pneumoniae R6
aaaguuagacagaaaaaau

SEQ ID NO: 4081844 - RNA, 20 nt, Streptococcus pneumoniae R6
aaaguuaguugaguuguuau

SEQ ID NO: 4081845 - RNA, 19 nt, Streptococcus pneumoniae R6
aaaguuaugaaaaagauuu

SEQ ID NO: 4081846 - RNA, 18 nt, Streptococcus pneumoniae R6
aaaguuccuaaaaccaaa

SEQ ID NO: 4081847 - RNA, 21 nt, Streptococcus pneumoniae R6
aaaguucucuuucuaaaauag

SEQ ID NO: 4081848 - RNA, 13 nt, Streptococcus pneumoniae R6
aaaguucuucccc

SEQ ID NO: 4081849 - RNA, 15 nt, Streptococcus pneumoniae R6
aaaguugaagacacu

SEQ ID NO: 4081850 - RNA, 18 nt, Streptococcus pneumoniae R6
aaaguuguccgagcagga

SEQ ID NO: 4081851 - RNA, 16 nt, Streptococcus pneumoniae R6
aaaguuuaaaaaaacu

SEQ ID NO: 4081852 - RNA, 17 nt, Streptococcus pneumoniae R6
aaaguuucgaaaaccaa

SEQ ID NO: 4081853 - RNA, 19 nt, Streptococcus pneumoniae R6
aaaguuucgaaaaccaaag

SEQ ID NO: 4081854 - RNA, 16 nt, Streptococcus pneumoniae R6
aaaguuuucuuuguuc

SEQ ID NO: 4081855 - RNA, 12 nt, Streptococcus pneumoniae R6
aaauaaaacaaa

SEQ ID NO: 4081856 - RNA, 13 nt, Streptococcus pneumoniae R6
aaauaaaacaaaa

SEQ ID NO: 4081857 - RNA, 19 nt, Streptococcus pneumoniae R6
aaauaaaauuccuuuaaaa

SEQ ID NO: 4081858 - RNA, 14 nt, Streptococcus pneumoniae R6
aaauaaaauuuuuu

SEQ ID NO: 4081859 - RNA, 21 nt, Streptococcus pneumoniae R6
aaauaaaauuuuuuucaaauu

SEQ ID NO: 4081860 - RNA, 23 nt, Streptococcus pneumoniae R6
aaauaacccaccaagucaucaaa

SEQ ID NO: 4081861 - RNA, 20 nt, Streptococcus pneumoniae R6
aaauaacgccucuacacuau

SEQ ID NO: 4081862 - RNA, 16 nt, Streptococcus pneumoniae R6
aaauaacucauaauag

SEQ ID NO: 4081863 - RNA, 21 nt, Streptococcus pneumoniae R6
aaauaacucauaauagucucu

SEQ ID NO: 4081864 - RNA, 16 nt, Streptococcus pneumoniae R6
aaauaacuguaauuuc

SEQ ID NO: 4081865 - RNA, 15 nt, Streptococcus pneumoniae R6
aaauaagaaagacca

SEQ ID NO: 4081866 - RNA, 14 nt, Streptococcus pneumoniae R6
aaauaagaaauagu

SEQ ID NO: 4081867 - RNA, 17 nt, Streptococcus pneumoniae R6
aaauaagaacaggacaa

SEQ ID NO: 4081868 - RNA, 21 nt, Streptococcus pneumoniae R6
aaauaagccgaagccaaucaa

SEQ ID NO: 4081869 - RNA, 23 nt, Streptococcus pneumoniae R6
aaauaagcucuguuuuuggauuu

SEQ ID NO: 4081870 - RNA, 18 nt, Streptococcus pneumoniae R6
aaauaagguuuagcaaaa

SEQ ID NO: 4081871 - RNA, 21 nt, Streptococcus pneumoniae R6
aaauaagguuuagcaaaagca

SEQ ID NO: 4081872 - RNA, 22 nt, Streptococcus pneumoniae R6
aaauaaguucaacaaaucagaa

SEQ ID NO: 4081873 - RNA, 15 nt, Streptococcus pneumoniae R6
aaauaauaagcuuug

SEQ ID NO: 4081874 - RNA, 20 nt, Streptococcus pneumoniae R6
aaauaauaagcuuugaaaau

SEQ ID NO: 4081875 - RNA, 19 nt, Streptococcus pneumoniae R6
aaauaauacucaaugaaaa

SEQ ID NO: 4081876 - RNA, 20 nt, Streptococcus pneumoniae R6
aaauaauacucaaugaaaau

SEQ ID NO: 4081877 - RNA, 22 nt, Streptococcus pneumoniae R6
aaauaauagacuuccugcaaaa

SEQ ID NO: 4081878 - RNA, 14 nt, Streptococcus pneumoniae R6
aaauaaucaaaacu

SEQ ID NO: 4081879 - RNA, 15 nt, Streptococcus pneumoniae R6
aaauaaucggaagca

SEQ ID NO: 4081880 - RNA, 19 nt, Streptococcus pneumoniae R6
aaauaauuaguucagaauu

SEQ ID NO: 4081881 - RNA, 22 nt, Streptococcus pneumoniae R6
aaauaauuuauccaaaggauuu

SEQ ID NO: 4081882 - RNA, 20 nt, Streptococcus pneumoniae R6
aaauaauuuugauucagauu

SEQ ID NO: 4081883 - RNA, 12 nt, Streptococcus pneumoniae R6
aaauacaaaaac

SEQ ID NO: 4081884 - RNA, 13 nt, Streptococcus pneumoniae R6
aaauacaaaaaca

SEQ ID NO: 4081885 - RNA, 19 nt, Streptococcus pneumoniae R6
aaauacaccuaauccacuc

SEQ ID NO: 4081886 - RNA, 16 nt, Streptococcus pneumoniae R6
aaauaccaaguucauu

SEQ ID NO: 4081887 - RNA, 21 nt, Streptococcus pneumoniae R6
aaauaccaaguucauuuuuua

SEQ ID NO: 4081888 - RNA, 15 nt, Streptococcus pneumoniae R6
aaauacgcaaaauca

SEQ ID NO: 4081889 - RNA, 19 nt, Streptococcus pneumoniae R6
aaauacuaaaaaaaaaaag

SEQ ID NO: 4081890 - RNA, 21 nt, Streptococcus pneumoniae R6
aaauacuagauucuauuuuuu

SEQ ID NO: 4081891 - RNA, 16 nt, Streptococcus pneumoniae R6
aaauacuaucaauaaa

SEQ ID NO: 4081892 - RNA, 18 nt, Streptococcus pneumoniae R6
aaauacuaucaauaaaau

SEQ ID NO: 4081893 - RNA, 16 nt, Streptococcus pneumoniae R6
aaauacucaucaugaa

SEQ ID NO: 4081894 - RNA, 17 nt, Streptococcus pneumoniae R6
aaauacucaucaugaau

SEQ ID NO: 4081895 - RNA, 17 nt, Streptococcus pneumoniae R6
aaauacucggaggacau

SEQ ID NO: 4081896 - RNA, 23 nt, Streptococcus pneumoniae R6
aaauacucggaggacaucacugu

SEQ ID NO: 4081897 - RNA, 11 nt, Streptococcus pneumoniae R6
aaauacuugua

SEQ ID NO: 4081898 - RNA, 17 nt, Streptococcus pneumoniae R6
aaauacuuguagcaauc

SEQ ID NO: 4081899 - RNA, 20 nt, Streptococcus pneumoniae R6
aaauacuuuuuccugguaau

SEQ ID NO: 4081900 - RNA, 12 nt, Streptococcus pneumoniae R6
aaauagaaaaaa

SEQ ID NO: 4081901 - RNA, 13 nt, Streptococcus pneumoniae R6
aaauagaaaaaau

SEQ ID NO: 4081902 - RNA, 13 nt, Streptococcus pneumoniae R6
aaauagaaaacaa

SEQ ID NO: 4081903 - RNA, 15 nt, Streptococcus pneumoniae R6
aaauagaaaacaaaa

SEQ ID NO: 4081904 - RNA, 18 nt, Streptococcus pneumoniae R6
aaauagaaggaguugagc

SEQ ID NO: 4081905 - RNA, 18 nt, Streptococcus pneumoniae R6
aaauagauuggauaaaau

SEQ ID NO: 4081906 - RNA, 14 nt, Streptococcus pneumoniae R6
aaauagauuuuuaa

SEQ ID NO: 4081907 - RNA, 14 nt, Streptococcus pneumoniae R6
aaauagcaguaacu

SEQ ID NO: 4081908 - RNA, 23 nt, Streptococcus pneumoniae R6
aaauagcaguaacuucugucuau

SEQ ID NO: 4081909 - RNA, 16 nt, Streptococcus pneumoniae R6
aaauagccccuagaua

SEQ ID NO: 4081910 - RNA, 20 nt, Streptococcus pneumoniae R6
aaauagccccuagauauuuu

SEQ ID NO: 4081911 - RNA, 18 nt, Streptococcus pneumoniae R6
aaauagcccuucggauaa

SEQ ID NO: 4081912 - RNA, 21 nt, Streptococcus pneumoniae R6
aaauagcccuucggauaaaau

SEQ ID NO: 4081913 - RNA, 20 nt, Streptococcus pneumoniae R6
aaauagcuccuuuaacauuu

SEQ ID NO: 4081914 - RNA, 17 nt, Streptococcus pneumoniae R6
aaauaggaaucaaccaa

SEQ ID NO: 4081915 - RNA, 19 nt, Streptococcus pneumoniae R6
aaauaggccucuucaaaga

SEQ ID NO: 4081916 - RNA, 15 nt, Streptococcus pneumoniae R6
aaauagggauuaaua

SEQ ID NO: 4081917 - RNA, 14 nt, Streptococcus pneumoniae R6
aaauaguucuucca

SEQ ID NO: 4081918 - RNA, 17 nt, Streptococcus pneumoniae R6
aaauaguuuuugcaaua

SEQ ID NO: 4081919 - RNA, 14 nt, Streptococcus pneumoniae R6
aaauauaaucgauu

SEQ ID NO: 4081920 - RNA, 14 nt, Streptococcus pneumoniae R6
aaauauagcaauaa

SEQ ID NO: 4081921 - RNA, 21 nt, Streptococcus pneumoniae R6
aaauaucgaugcccucuucuu

SEQ ID NO: 4081922 - RNA, 22 nt, Streptococcus pneumoniae R6
aaauaucgaugcccucuucuuu

SEQ ID NO: 4081923 - RNA, 16 nt, Streptococcus pneumoniae R6
aaauaucugcacucuc

SEQ ID NO: 4081924 - RNA, 18 nt, Streptococcus pneumoniae R6
aaauaucugcacucucau

SEQ ID NO: 4081925 - RNA, 14 nt, Streptococcus pneumoniae R6
aaauaugaacaaau

SEQ ID NO: 4081926 - RNA, 17 nt, Streptococcus pneumoniae R6
aaauaugaucgauuuau

SEQ ID NO: 4081927 - RNA, 17 nt, Streptococcus pneumoniae R6
aaauaugauggaagacu

SEQ ID NO: 4081928 - RNA, 19 nt, Streptococcus pneumoniae R6
aaauaugauggaagacuga

SEQ ID NO: 4081929 - RNA, 23 nt, Streptococcus pneumoniae R6
aaauaugcuauugaaaggaaaau

SEQ ID NO: 4081930 - RNA, 19 nt, Streptococcus pneumoniae R6
aaauauggcacaaaagguu

SEQ ID NO: 4081931 - RNA, 22 nt, Streptococcus pneumoniae R6
aaauaugggcuuacaucaaaaa

SEQ ID NO: 4081932 - RNA, 14 nt, Streptococcus pneumoniae R6
aaauauucaccaca

SEQ ID NO: 4081933 - RNA, 21 nt, Streptococcus pneumoniae R6
aaauauuguuuuaauauaaua

SEQ ID NO: 4081934 - RNA, 13 nt, Streptococcus pneumoniae R6
aaauauuucgcuu

SEQ ID NO: 4081935 - RNA, 20 nt, Streptococcus pneumoniae R6
aaauauuucgcuuauaaacu

SEQ ID NO: 4081936 - RNA, 20 nt, Streptococcus pneumoniae R6
aaauauuucuagaaauuaau

SEQ ID NO: 4081937 - RNA, 20 nt, Streptococcus pneumoniae R6
aaauauuucuaugauaaaac

SEQ ID NO: 4081938 - RNA, 15 nt, Streptococcus pneumoniae R6
aaauauuuuaaacgu

SEQ ID NO: 4081939 - RNA, 17 nt, Streptococcus pneumoniae R6
aaauauuuuaaacguuu

SEQ ID NO: 4081940 - RNA, 17 nt, Streptococcus pneumoniae R6
aaauauuuuaguauucc

SEQ ID NO: 4081941 - RNA, 22 nt, Streptococcus pneumoniae R6
aaauauuuugcuguuuauaucu

SEQ ID NO: 4081942 - RNA, 14 nt, Streptococcus pneumoniae R6
aaaucaaaaagcaa

SEQ ID NO: 4081943 - RNA, 11 nt, Streptococcus pneumoniae R6
aaaucaaagac

SEQ ID NO: 4081944 - RNA, 13 nt, Streptococcus pneumoniae R6
aaaucaaagagca

SEQ ID NO: 4081945 - RNA, 17 nt, Streptococcus pneumoniae R6
aaaucaaagagcaaacu

SEQ ID NO: 4081946 - RNA, 15 nt, Streptococcus pneumoniae R6
aaaucaaagugcaaa

SEQ ID NO: 4081947 - RNA, 17 nt, Streptococcus pneumoniae R6
aaaucaacugcuguuuu

SEQ ID NO: 4081948 - RNA, 14 nt, Streptococcus pneumoniae R6
aaaucaaugacaau

SEQ ID NO: 4081949 - RNA, 15 nt, Streptococcus pneumoniae R6
aaaucaauuagaaaa

SEQ ID NO: 4081950 - RNA, 13 nt, Streptococcus pneumoniae R6
aaaucaauuucua

SEQ ID NO: 4081951 - RNA, 13 nt, Streptococcus pneumoniae R6
aaaucaauuuuua

SEQ ID NO: 4081952 - RNA, 15 nt, Streptococcus pneumoniae R6
aaaucaauuuuuaac

SEQ ID NO: 4081953 - RNA, 13 nt, Streptococcus pneumoniae R6
aaaucaauuuuuc

SEQ ID NO: 4081954 - RNA, 17 nt, Streptococcus pneumoniae R6
aaaucaauuuuucguau

SEQ ID NO: 4081955 - RNA, 13 nt, Streptococcus pneumoniae R6
aaaucacaaaaac

SEQ ID NO: 4081956 - RNA, 24 nt, Streptococcus pneumoniae R6
aaaucacaaaaacgcauaauguaa

SEQ ID NO: 4081957 - RNA, 19 nt, Streptococcus pneumoniae R6
aaaucacaauuccuaagau

SEQ ID NO: 4081958 - RNA, 13 nt, Streptococcus pneumoniae R6
aaaucacuuaguu

SEQ ID NO: 4081959 - RNA, 13 nt, Streptococcus pneumoniae R6
aaaucagaaaaaa

SEQ ID NO: 4081960 - RNA, 15 nt, Streptococcus pneumoniae R6
aaaucagaaaaaacg

SEQ ID NO: 4081961 - RNA, 16 nt, Streptococcus pneumoniae R6
aaaucagauaagcacc

SEQ ID NO: 4081962 - RNA, 21 nt, Streptococcus pneumoniae R6
aaaucagcuaagccuuuuucu

SEQ ID NO: 4081963 - RNA, 16 nt, Streptococcus pneumoniae R6
aaaucaggaaaucuuc

SEQ ID NO: 4081964 - RNA, 15 nt, Streptococcus pneumoniae R6
aaaucaggauuuuua

SEQ ID NO: 4081965 - RNA, 22 nt, Streptococcus pneumoniae R6
aaaucaggucuuauagaaacau

SEQ ID NO: 4081966 - RNA, 19 nt, Streptococcus pneumoniae R6
aaaucagguguucaaaaac

SEQ ID NO: 4081967 - RNA, 22 nt, Streptococcus pneumoniae R6
aaaucagugugacccaagauag

SEQ ID NO: 4081968 - RNA, 17 nt, Streptococcus pneumoniae R6
aaaucauaauccaacac

SEQ ID NO: 4081969 - RNA, 17 nt, Streptococcus pneumoniae R6
aaaucauacugccaaga

SEQ ID NO: 4081970 - RNA, 16 nt, Streptococcus pneumoniae R6
aaaucauagaaaaaag

SEQ ID NO: 4081971 - RNA, 22 nt, Streptococcus pneumoniae R6
aaaucauagcauagaugacaaa

SEQ ID NO: 4081972 - RNA, 22 nt, Streptococcus pneumoniae R6
aaaucaucaaauugaaauaaga

SEQ ID NO: 4081973 - RNA, 18 nt, Streptococcus pneumoniae R6
aaaucaucauaaaaauaa

SEQ ID NO: 4081974 - RNA, 21 nt, Streptococcus pneumoniae R6
aaaucaucauaaaaauaaaga

SEQ ID NO: 4081975 - RNA, 20 nt, Streptococcus pneumoniae R6
aaaucaucgccaaaucauca

SEQ ID NO: 4081976 - RNA, 15 nt, Streptococcus pneumoniae R6
aaaucauugaguugg

SEQ ID NO: 4081977 - RNA, 19 nt, Streptococcus pneumoniae R6
aaaucauugauaguaacac

SEQ ID NO: 4081978 - RNA, 23 nt, Streptococcus pneumoniae R6
aaaucauuugaaucaaaaauugg

SEQ ID NO: 4081979 - RNA, 19 nt, Streptococcus pneumoniae R6
aaaucauuuucuugauuug

SEQ ID NO: 4081980 - RNA, 20 nt, Streptococcus pneumoniae R6
aaauccacuugggaaaccaa

SEQ ID NO: 4081981 - RNA, 12 nt, Streptococcus pneumoniae R6
aaauccagcuga

SEQ ID NO: 4081982 - RNA, 14 nt, Streptococcus pneumoniae R6
aaaucccaugacaa

SEQ ID NO: 4081983 - RNA, 21 nt, Streptococcus pneumoniae R6
aaaucccaugacaaucauuuc

SEQ ID NO: 4081984 - RNA, 18 nt, Streptococcus pneumoniae R6
aaauccgaagaaggccaa

SEQ ID NO: 4081985 - RNA, 21 nt, Streptococcus pneumoniae R6
aaauccgaagaaggccaaaua

SEQ ID NO: 4081986 - RNA, 20 nt, Streptococcus pneumoniae R6
aaauccgacuucaauaaaau

SEQ ID NO: 4081987 - RNA, 22 nt, Streptococcus pneumoniae R6
aaauccgcuugggaaaccaaac

SEQ ID NO: 4081988 - RNA, 19 nt, Streptococcus pneumoniae R6
aaauccgguguaagggaag

SEQ ID NO: 4081989 - RNA, 22 nt, Streptococcus pneumoniae R6
aaauccguuuuuuaaaauuguu

SEQ ID NO: 4081990 - RNA, 19 nt, Streptococcus pneumoniae R6
aaauccguuuuuugaaguu

SEQ ID NO: 4081991 - RNA, 21 nt, Streptococcus pneumoniae R6
aaauccguuuuuugaaguuuu

SEQ ID NO: 4081992 - RNA, 19 nt, Streptococcus pneumoniae R6
aaauccuaguggaaaagau

SEQ ID NO: 4081993 - RNA, 20 nt, Streptococcus pneumoniae R6
aaauccuaguggaaaagaug

SEQ ID NO: 4081994 - RNA, 14 nt, Streptococcus pneumoniae R6
aaauccuauaccaa

SEQ ID NO: 4081995 - RNA, 16 nt, Streptococcus pneumoniae R6
aaauccucugaguauu

SEQ ID NO: 4081996 - RNA, 23 nt, Streptococcus pneumoniae R6
aaauccucugaguauuuagcaac

SEQ ID NO: 4081997 - RNA, 17 nt, Streptococcus pneumoniae R6
aaauccucugucacaaa

SEQ ID NO: 4081998 - RNA, 20 nt, Streptococcus pneumoniae R6
aaauccucugucacaaagag

SEQ ID NO: 4081999 - RNA, 14 nt, Streptococcus pneumoniae R6
aaauccugcaaaga

SEQ ID NO: 4082000 - RNA, 16 nt, Streptococcus pneumoniae R6
aaauccugcaaagaua

SEQ ID NO: 4082001 - RNA, 17 nt, Streptococcus pneumoniae R6
aaaucgaaacuccauaa

SEQ ID NO: 4082002 - RNA, 15 nt, Streptococcus pneumoniae R6
aaaucgauagccaac

SEQ ID NO: 4082003 - RNA, 14 nt, Streptococcus pneumoniae R6
aaaucgaucaggac

SEQ ID NO: 4082004 - RNA, 16 nt, Streptococcus pneumoniae R6
aaaucgaucauauuua

SEQ ID NO: 4082005 - RNA, 16 nt, Streptococcus pneumoniae R6
aaaucgauuauauuua

SEQ ID NO: 4082006 - RNA, 15 nt, Streptococcus pneumoniae R6
aaaucgauuucuaac

SEQ ID NO: 4082007 - RNA, 20 nt, Streptococcus pneumoniae R6
aaaucgauuucuaacaaugu

SEQ ID NO: 4082008 - RNA, 24 nt, Streptococcus pneumoniae R6
aaaucgauuucuaacaauguuuua

SEQ ID NO: 4082009 - RNA, 15 nt, Streptococcus pneumoniae R6
aaaucgauuugacug

SEQ ID NO: 4082010 - RNA, 18 nt, Streptococcus pneumoniae R6
aaaucgcuauaaauaagg

SEQ ID NO: 4082011 - RNA, 19 nt, Streptococcus pneumoniae R6
aaaucguagucuuucacca

SEQ ID NO: 4082012 - RNA, 11 nt, Streptococcus pneumoniae R6
aaaucuaacuu

SEQ ID NO: 4082013 - RNA, 13 nt, Streptococcus pneumoniae R6
aaaucuacuaucu

SEQ ID NO: 4082014 - RNA, 19 nt, Streptococcus pneumoniae R6
aaaucuagucaucagaaaa

SEQ ID NO: 4082015 - RNA, 17 nt, Streptococcus pneumoniae R6
aaaucucacuauucauc

SEQ ID NO: 4082016 - RNA, 17 nt, Streptococcus pneumoniae R6
aaaucucugcaaaccac

SEQ ID NO: 4082017 - RNA, 19 nt, Streptococcus pneumoniae R6
aaaucucuuugaggucugu

SEQ ID NO: 4082018 - RNA, 21 nt, Streptococcus pneumoniae R6
aaaucugaagaaagcaauuuu

SEQ ID NO: 4082019 - RNA, 22 nt, Streptococcus pneumoniae R6
aaaucugaagaaagcaauuuua

SEQ ID NO: 4082020 - RNA, 22 nt, Streptococcus pneumoniae R6
aaaucugcucaaucuuaucaau

SEQ ID NO: 4082021 - RNA, 20 nt, Streptococcus pneumoniae R6
aaaucuguacuaagcaugau

SEQ ID NO: 4082022 - RNA, 18 nt, Streptococcus pneumoniae R6
aaaucugucuaccuucag

SEQ ID NO: 4082023 - RNA, 16 nt, Streptococcus pneumoniae R6
aaaucuguuaaaaaau

SEQ ID NO: 4082024 - RNA, 17 nt, Streptococcus pneumoniae R6
aaaucuguuaaaaaaua

SEQ ID NO: 4082025 - RNA, 21 nt, Streptococcus pneumoniae R6
aaaucuguuaaaaaauaauca

SEQ ID NO: 4082026 - RNA, 14 nt, Streptococcus pneumoniae R6
aaaucuuaaaaauu

SEQ ID NO: 4082027 - RNA, 16 nt, Streptococcus pneumoniae R6
aaaucuucaaaaaagu

SEQ ID NO: 4082028 - RNA, 17 nt, Streptococcus pneumoniae R6
aaaucuucccacaauaa

SEQ ID NO: 4082029 - RNA, 21 nt, Streptococcus pneumoniae R6
aaaucuuccuacauauguaag

SEQ ID NO: 4082030 - RNA, 19 nt, Streptococcus pneumoniae R6
aaaucuucggauaaauuaa

SEQ ID NO: 4082031 - RNA, 14 nt, Streptococcus pneumoniae R6
aaaucuucucuuga

SEQ ID NO: 4082032 - RNA, 22 nt, Streptococcus pneumoniae R6
aaaucuucuggcacagaaacac

SEQ ID NO: 4082033 - RNA, 20 nt, Streptococcus pneumoniae R6
aaaucuucuguguuugaaca

SEQ ID NO: 4082034 - RNA, 17 nt, Streptococcus pneumoniae R6
aaaucuuguugagcaua

SEQ ID NO: 4082035 - RNA, 15 nt, Streptococcus pneumoniae R6
aaaucuuugauuucu

SEQ ID NO: 4082036 - RNA, 14 nt, Streptococcus pneumoniae R6
aaaucuuuuacuuc

SEQ ID NO: 4082037 - RNA, 14 nt, Streptococcus pneumoniae R6
aaaugaaauaaaau

SEQ ID NO: 4082038 - RNA, 15 nt, Streptococcus pneumoniae R6
aaaugaaauaagaac

SEQ ID NO: 4082039 - RNA, 15 nt, Streptococcus pneumoniae R6
aaaugaaauaauacu

SEQ ID NO: 4082040 - RNA, 14 nt, Streptococcus pneumoniae R6
aaaugaaauauuuu

SEQ ID NO: 4082041 - RNA, 20 nt, Streptococcus pneumoniae R6
aaaugaaauauuuuuuacuu

SEQ ID NO: 4082042 - RNA, 18 nt, Streptococcus pneumoniae R6
aaaugaaauuuuucugcu

SEQ ID NO: 4082043 - RNA, 19 nt, Streptococcus pneumoniae R6
aaaugaaauuuuucugcuu

SEQ ID NO: 4082044 - RNA, 14 nt, Streptococcus pneumoniae R6
aaaugaauuugaaa

SEQ ID NO: 4082045 - RNA, 18 nt, Streptococcus pneumoniae R6
aaaugaauuugaaacaau

SEQ ID NO: 4082046 - RNA, 19 nt, Streptococcus pneumoniae R6
aaaugaauuugaaacaaug

SEQ ID NO: 4082047 - RNA, 15 nt, Streptococcus pneumoniae R6
aaaugacauuccugu

SEQ ID NO: 4082048 - RNA, 14 nt, Streptococcus pneumoniae R6
aaaugagaaauuau

SEQ ID NO: 4082049 - RNA, 22 nt, Streptococcus pneumoniae R6
aaaugagauaagcgauuuuaua

SEQ ID NO: 4082050 - RNA, 14 nt, Streptococcus pneumoniae R6
aaaugaggaaaauc

SEQ ID NO: 4082051 - RNA, 20 nt, Streptococcus pneumoniae R6
aaaugagguaauuaugaaau

SEQ ID NO: 4082052 - RNA, 24 nt, Streptococcus pneumoniae R6
aaaugaguaugaaaagagaauuuu

SEQ ID NO: 4082053 - RNA, 14 nt, Streptococcus pneumoniae R6
aaaugaucagacca

SEQ ID NO: 4082054 - RNA, 23 nt, Streptococcus pneumoniae R6
aaaugaugaaucugaaucaaaau

SEQ ID NO: 4082055 - RNA, 19 nt, Streptococcus pneumoniae R6
aaaugcgccaccaacugca

SEQ ID NO: 4082056 - RNA, 16 nt, Streptococcus pneumoniae R6
aaaugcuucuuugaua

SEQ ID NO: 4082057 - RNA, 23 nt, Streptococcus pneumoniae R6
aaaugcuucuuugauagcauuug

SEQ ID NO: 4082058 - RNA, 16 nt, Streptococcus pneumoniae R6
aaauggcaugaggaga

SEQ ID NO: 4082059 - RNA, 16 nt, Streptococcus pneumoniae R6
aaaugguuccaaaagg

SEQ ID NO: 4082060 - RNA, 17 nt, Streptococcus pneumoniae R6
aaauguaggcuacagaa

SEQ ID NO: 4082061 - RNA, 22 nt, Streptococcus pneumoniae R6
aaauguaguuaauugauaaggu

SEQ ID NO: 4082062 - RNA, 19 nt, Streptococcus pneumoniae R6
aaauguaguuggauuucca

SEQ ID NO: 4082063 - RNA, 23 nt, Streptococcus pneumoniae R6
aaaugucuuggcagaaagguaag

SEQ ID NO: 4082064 - RNA, 18 nt, Streptococcus pneumoniae R6
aaaugugauuucuguaaa

SEQ ID NO: 4082065 - RNA, 14 nt, Streptococcus pneumoniae R6
aaauguucuguaau

SEQ ID NO: 4082066 - RNA, 20 nt, Streptococcus pneumoniae R6
aaauguucuguaaugaaaua

SEQ ID NO: 4082067 - RNA, 19 nt, Streptococcus pneumoniae R6
aaauguuugcucauagcca

SEQ ID NO: 4082068 - RNA, 18 nt, Streptococcus pneumoniae R6
aaauuaacaaucccuuca

SEQ ID NO: 4082069 - RNA, 21 nt, Streptococcus pneumoniae R6
aaauuaauuuauagaaaaauu

SEQ ID NO: 4082070 - RNA, 23 nt, Streptococcus pneumoniae R6
aaauuaauuucuauaaauguuuu

SEQ ID NO: 4082071 - RNA, 19 nt, Streptococcus pneumoniae R6
aaauuacaguuauuuuagu

SEQ ID NO: 4082072 - RNA, 20 nt, Streptococcus pneumoniae R6
aaauuacaguuauuuuagua

SEQ ID NO: 4082073 - RNA, 13 nt, Streptococcus pneumoniae R6
aaauuagaaaaag

SEQ ID NO: 4082074 - RNA, 23 nt, Streptococcus pneumoniae R6
aaauuagaaaaagacuugaaaua

SEQ ID NO: 4082075 - RNA, 20 nt, Streptococcus pneumoniae R6
aaauuagaaaaaguaguuga

SEQ ID NO: 4082076 - RNA, 17 nt, Streptococcus pneumoniae R6
aaauuagggauacucca

SEQ ID NO: 4082077 - RNA, 14 nt, Streptococcus pneumoniae R6
aaauuaguuuuuag

SEQ ID NO: 4082078 - RNA, 16 nt, Streptococcus pneumoniae R6
aaauuaguuuuuagaa

SEQ ID NO: 4082079 - RNA, 19 nt, Streptococcus pneumoniae R6
aaauuaguuuuuagaagcu

SEQ ID NO: 4082080 - RNA, 23 nt, Streptococcus pneumoniae R6
aaauuaguuuuuagaagcuucuu

SEQ ID NO: 4082081 - RNA, 14 nt, Streptococcus pneumoniae R6
aaauuauaaaacca

SEQ ID NO: 4082082 - RNA, 16 nt, Streptococcus pneumoniae R6
aaauuauaaaacgcau

SEQ ID NO: 4082083 - RNA, 20 nt, Streptococcus pneumoniae R6
aaauuauacucuuagaaaau

SEQ ID NO: 4082084 - RNA, 17 nt, Streptococcus pneumoniae R6
aaauuauagucuuuuca

SEQ ID NO: 4082085 - RNA, 20 nt, Streptococcus pneumoniae R6
aaauuauagucuuuucacuu

SEQ ID NO: 4082086 - RNA, 22 nt, Streptococcus pneumoniae R6
aaauuauagucuuuucacuuua

SEQ ID NO: 4082087 - RNA, 15 nt, Streptococcus pneumoniae R6
aaauuaugaugcaua

SEQ ID NO: 4082088 - RNA, 21 nt, Streptococcus pneumoniae R6
aaauuauuaaaaucaaaaaac

SEQ ID NO: 4082089 - RNA, 15 nt, Streptococcus pneumoniae R6
aaauuauucuuaucu

SEQ ID NO: 4082090 - RNA, 23 nt, Streptococcus pneumoniae R6
aaauuauuggucgcuucaaguuu

SEQ ID NO: 4082091 - RNA, 18 nt, Streptococcus pneumoniae R6
aaauuauuuauuuacuua

SEQ ID NO: 4082092 - RNA, 18 nt, Streptococcus pneumoniae R6
aaauucaaacucaaauuu

SEQ ID NO: 4082093 - RNA, 14 nt, Streptococcus pneumoniae R6
aaauucaagaauga

SEQ ID NO: 4082094 - RNA, 19 nt, Streptococcus pneumoniae R6
aaauucaggugauuuacca

SEQ ID NO: 4082095 - RNA, 14 nt, Streptococcus pneumoniae R6
aaauucaguaugcu

SEQ ID NO: 4082096 - RNA, 14 nt, Streptococcus pneumoniae R6
aaauucauuugauu

SEQ ID NO: 4082097 - RNA, 19 nt, Streptococcus pneumoniae R6
aaauuccaaauuagaaaaa

SEQ ID NO: 4082098 - RNA, 20 nt, Streptococcus pneumoniae R6
aaauucccucugacgagaaa

SEQ ID NO: 4082099 - RNA, 20 nt, Streptococcus pneumoniae R6
aaauucccuuauccacauca

SEQ ID NO: 4082100 - RNA, 21 nt, Streptococcus pneumoniae R6
aaauuccuugaugagcaaagg

SEQ ID NO: 4082101 - RNA, 19 nt, Streptococcus pneumoniae R6
aaauucgcuuuuuuaaaug

SEQ ID NO: 4082102 - RNA, 17 nt, Streptococcus pneumoniae R6
aaauucguccuuucuuu

SEQ ID NO: 4082103 - RNA, 16 nt, Streptococcus pneumoniae R6
aaauucucuuuucaua

SEQ ID NO: 4082104 - RNA, 22 nt, Streptococcus pneumoniae R6
aaauucugucuuagacuuucuc

SEQ ID NO: 4082105 - RNA, 15 nt, Streptococcus pneumoniae R6
aaauucuuacuaccu

SEQ ID NO: 4082106 - RNA, 16 nt, Streptococcus pneumoniae R6
aaauucuuacuaccua

SEQ ID NO: 4082107 - RNA, 19 nt, Streptococcus pneumoniae R6
aaauucuuacuaccuacuu

SEQ ID NO: 4082108 - RNA, 14 nt, Streptococcus pneumoniae R6
aaauucuuuagaaa

SEQ ID NO: 4082109 - RNA, 21 nt, Streptococcus pneumoniae R6
aaauucuuugaaaucagaaaa

SEQ ID NO: 4082110 - RNA, 13 nt, Streptococcus pneumoniae R6
aaauugaaauaag

SEQ ID NO: 4082111 - RNA, 18 nt, Streptococcus pneumoniae R6
aaauugacuggaauucuc

SEQ ID NO: 4082112 - RNA, 18 nt, Streptococcus pneumoniae R6
aaauugagucuuuuucca

SEQ ID NO: 4082113 - RNA, 14 nt, Streptococcus pneumoniae R6
aaauugauaauagu

SEQ ID NO: 4082114 - RNA, 24 nt, Streptococcus pneumoniae R6
aaauugauuuauagaaauguuuua

SEQ ID NO: 4082115 - RNA, 21 nt, Streptococcus pneumoniae R6
aaauugauuugacuuccaaaa

SEQ ID NO: 4082116 - RNA, 18 nt, Streptococcus pneumoniae R6
aaauugcgauuuugccaa

SEQ ID NO: 4082117 - RNA, 22 nt, Streptococcus pneumoniae R6
aaauugcuuucuucagauuuua

SEQ ID NO: 4082118 - RNA, 21 nt, Streptococcus pneumoniae R6
aaauuggcucaucugcaauaa

SEQ ID NO: 4082119 - RNA, 14 nt, Streptococcus pneumoniae R6
aaauugguguugga

SEQ ID NO: 4082120 - RNA, 21 nt, Streptococcus pneumoniae R6
aaauugguguuguuuauuacc

SEQ ID NO: 4082121 - RNA, 16 nt, Streptococcus pneumoniae R6
aaauugguuugaauuc

SEQ ID NO: 4082122 - RNA, 21 nt, Streptococcus pneumoniae R6
aaauugguuugaauucuccaa

SEQ ID NO: 4082123 - RNA, 21 nt, Streptococcus pneumoniae R6
aaauugucuaagcgaaacaac

SEQ ID NO: 4082124 - RNA, 22 nt, Streptococcus pneumoniae R6
aaauugucuaagcgaaacaacc

SEQ ID NO: 4082125 - RNA, 21 nt, Streptococcus pneumoniae R6
aaauugugcaguuuucauucu

SEQ ID NO: 4082126 - RNA, 12 nt, Streptococcus pneumoniae R6
aaauuguuucau

SEQ ID NO: 4082127 - RNA, 14 nt, Streptococcus pneumoniae R6
aaauuuaaaaauag

SEQ ID NO: 4082128 - RNA, 20 nt, Streptococcus pneumoniae R6
aaauuuauaauauaaacuuu

SEQ ID NO: 4082129 - RNA, 12 nt, Streptococcus pneumoniae R6
aaauuuauacua

SEQ ID NO: 4082130 - RNA, 13 nt, Streptococcus pneumoniae R6
aaauuuaucaacc

SEQ ID NO: 4082131 - RNA, 12 nt, Streptococcus pneumoniae R6
aaauuucaacaa

SEQ ID NO: 4082132 - RNA, 14 nt, Streptococcus pneumoniae R6
aaauuucaacaaaa

SEQ ID NO: 4082133 - RNA, 15 nt, Streptococcus pneumoniae R6
aaauuucauuuucua

SEQ ID NO: 4082134 - RNA, 19 nt, Streptococcus pneumoniae R6
aaauuucgaaaaaugcucu

SEQ ID NO: 4082135 - RNA, 17 nt, Streptococcus pneumoniae R6
aaauuucgauugucauc

SEQ ID NO: 4082136 - RNA, 15 nt, Streptococcus pneumoniae R6
aaauuucguccuuuc

SEQ ID NO: 4082137 - RNA, 18 nt, Streptococcus pneumoniae R6
aaauuucguccuuucuuu

SEQ ID NO: 4082138 - RNA, 14 nt, Streptococcus pneumoniae R6
aaauuucuaugaua

SEQ ID NO: 4082139 - RNA, 15 nt, Streptococcus pneumoniae R6
aaauuucugaaacua

SEQ ID NO: 4082140 - RNA, 17 nt, Streptococcus pneumoniae R6
aaauuucugaaacuaag

SEQ ID NO: 4082141 - RNA, 17 nt, Streptococcus pneumoniae R6
aaauuugaccauuucaa

SEQ ID NO: 4082142 - RNA, 19 nt, Streptococcus pneumoniae R6
aaauuugaccauuucaacc

SEQ ID NO: 4082143 - RNA, 11 nt, Streptococcus pneumoniae R6
aaauuugacua

SEQ ID NO: 4082144 - RNA, 21 nt, Streptococcus pneumoniae R6
aaauuugacuaaaaacucuuc

SEQ ID NO: 4082145 - RNA, 23 nt, Streptococcus pneumoniae R6
aaauuugacuaaaaacucuucuu

SEQ ID NO: 4082146 - RNA, 12 nt, Streptococcus pneumoniae R6
aaauuuucuuua

SEQ ID NO: 4082147 - RNA, 19 nt, Streptococcus pneumoniae R6
aaauuuuucugcaaaaaau

SEQ ID NO: 4082148 - RNA, 13 nt, Streptococcus pneumoniae R6
aacaaaaaaugcu

SEQ ID NO: 4082149 - RNA, 19 nt, Streptococcus pneumoniae R6
aacaaaaauacggucgcuu

SEQ ID NO: 4082150 - RNA, 22 nt, Streptococcus pneumoniae R6
aacaaaaauuugaucauccaaa

SEQ ID NO: 4082151 - RNA, 12 nt, Streptococcus pneumoniae R6
aacaaaagagcu

SEQ ID NO: 4082152 - RNA, 18 nt, Streptococcus pneumoniae R6
aacaaaauaguucucaac

SEQ ID NO: 4082153 - RNA, 20 nt, Streptococcus pneumoniae R6
aacaaaauauauaauagauu

SEQ ID NO: 4082154 - RNA, 21 nt, Streptococcus pneumoniae R6
aacaaaaucgggagauugagu

SEQ ID NO: 4082155 - RNA, 20 nt, Streptococcus pneumoniae R6
aacaaacaucgugguacaag

SEQ ID NO: 4082156 - RNA, 13 nt, Streptococcus pneumoniae R6
aacaaacuccucu

SEQ ID NO: 4082157 - RNA, 14 nt, Streptococcus pneumoniae R6
aacaaagaaaaaga

SEQ ID NO: 4082158 - RNA, 21 nt, Streptococcus pneumoniae R6
aacaaagcugaauucuaaugu

SEQ ID NO: 4082159 - RNA, 17 nt, Streptococcus pneumoniae R6
aacaaaguucaaagcgg

SEQ ID NO: 4082160 - RNA, 15 nt, Streptococcus pneumoniae R6
aacaaauaaaucauu

SEQ ID NO: 4082161 - RNA, 23 nt, Streptococcus pneumoniae R6
aacaaauaaaucauugauaguaa

SEQ ID NO: 4082162 - RNA, 18 nt, Streptococcus pneumoniae R6
aacaaauccaaucuucua

SEQ ID NO: 4082163 - RNA, 21 nt, Streptococcus pneumoniae R6
aacaaaucgauuaggaaagga

SEQ ID NO: 4082164 - RNA, 21 nt, Streptococcus pneumoniae R6
aacaaaucuuccuagaauaug

SEQ ID NO: 4082165 - RNA, 22 nt, Streptococcus pneumoniae R6
aacaaaugacuuucuaauuauu

SEQ ID NO: 4082166 - RNA, 17 nt, Streptococcus pneumoniae R6
aacaaauuguuauuaag

SEQ ID NO: 4082167 - RNA, 20 nt, Streptococcus pneumoniae R6
aacaaauuguuauuaagauu

SEQ ID NO: 4082168 - RNA, 18 nt, Streptococcus pneumoniae R6
aacaacaauacuuuccaa

SEQ ID NO: 4082169 - RNA, 16 nt, Streptococcus pneumoniae R6
aacaacaauggaaaug

SEQ ID NO: 4082170 - RNA, 17 nt, Streptococcus pneumoniae R6
aacaacagcugucgcac

SEQ ID NO: 4082171 - RNA, 17 nt, Streptococcus pneumoniae R6
aacaaccaauuucuuaa

SEQ ID NO: 4082172 - RNA, 20 nt, Streptococcus pneumoniae R6
aacaaccgacaagucauggg

SEQ ID NO: 4082173 - RNA, 17 nt, Streptococcus pneumoniae R6
aacaagccuagucuucu

SEQ ID NO: 4082174 - RNA, 13 nt, Streptococcus pneumoniae R6
aacaaggacagca

SEQ ID NO: 4082175 - RNA, 17 nt, Streptococcus pneumoniae R6
aacaagggcaaaaaaga

SEQ ID NO: 4082176 - RNA, 22 nt, Streptococcus pneumoniae R6
aacaagggcaaaaaagaaacca

SEQ ID NO: 4082177 - RNA, 15 nt, Streptococcus pneumoniae R6
aacaagucagcucaa

SEQ ID NO: 4082178 - RNA, 18 nt, Streptococcus pneumoniae R6
aacaagucagcucaaagc

SEQ ID NO: 4082179 - RNA, 14 nt, Streptococcus pneumoniae R6
aacaaguucuuuuc

SEQ ID NO: 4082180 - RNA, 15 nt, Streptococcus pneumoniae R6
aacaaguucuuuucu

SEQ ID NO: 4082181 - RNA, 20 nt, Streptococcus pneumoniae R6
aacaaguucuuuucuguuga

SEQ ID NO: 4082182 - RNA, 15 nt, Streptococcus pneumoniae R6
aacaauaaaaucaaa

SEQ ID NO: 4082183 - RNA, 18 nt, Streptococcus pneumoniae R6
aacaauaagagaauuaag

SEQ ID NO: 4082184 - RNA, 13 nt, Streptococcus pneumoniae R6
aacaauaaucuau

SEQ ID NO: 4082185 - RNA, 14 nt, Streptococcus pneumoniae R6
aacaauacuuucca

SEQ ID NO: 4082186 - RNA, 14 nt, Streptococcus pneumoniae R6
aacaaugaaaaaaa

SEQ ID NO: 4082187 - RNA, 15 nt, Streptococcus pneumoniae R6
aacaaugaaaaaaac

SEQ ID NO: 4082188 - RNA, 17 nt, Streptococcus pneumoniae R6
aacaaugaaaaaaacaa

SEQ ID NO: 4082189 - RNA, 19 nt, Streptococcus pneumoniae R6
aacaaugacucccauaaaa

SEQ ID NO: 4082190 - RNA, 20 nt, Streptococcus pneumoniae R6
aacaaugacucccauaaaaa

SEQ ID NO: 4082191 - RNA, 17 nt, Streptococcus pneumoniae R6
aacaaugguaacagucu

SEQ ID NO: 4082192 - RNA, 23 nt, Streptococcus pneumoniae R6
aacaaugguaacagucuuagcaa

SEQ ID NO: 4082193 - RNA, 14 nt, Streptococcus pneumoniae R6
aacaauuaggaacu

SEQ ID NO: 4082194 - RNA, 16 nt, Streptococcus pneumoniae R6
aacaauugcuaaaaca

SEQ ID NO: 4082195 - RNA, 17 nt, Streptococcus pneumoniae R6
aacaauugcuaaaacau

SEQ ID NO: 4082196 - RNA, 21 nt, Streptococcus pneumoniae R6
aacaauuucacaacucuuaua

SEQ ID NO: 4082197 - RNA, 15 nt, Streptococcus pneumoniae R6
aacacacgaagcaua

SEQ ID NO: 4082198 - RNA, 23 nt, Streptococcus pneumoniae R6
aacaccaauuuuacaaauaccau

SEQ ID NO: 4082199 - RNA, 17 nt, Streptococcus pneumoniae R6
aacaccugauacuaugc

SEQ ID NO: 4082200 - RNA, 14 nt, Streptococcus pneumoniae R6
aacacgaaaccagu

SEQ ID NO: 4082201 - RNA, 15 nt, Streptococcus pneumoniae R6
aacacuugcuaggaa

SEQ ID NO: 4082202 - RNA, 17 nt, Streptococcus pneumoniae R6
aacacuuguaaagagua

SEQ ID NO: 4082203 - RNA, 18 nt, Streptococcus pneumoniae R6
aacacuuuucaaaaaucu

SEQ ID NO: 4082204 - RNA, 17 nt, Streptococcus pneumoniae R6
aacagaggcuggacaaa

SEQ ID NO: 4082205 - RNA, 19 nt, Streptococcus pneumoniae R6
aacagauuuuucuguuuuc

SEQ ID NO: 4082206 - RNA, 21 nt, Streptococcus pneumoniae R6
aacagcauuuccaccugcagc

SEQ ID NO: 4082207 - RNA, 22 nt, Streptococcus pneumoniae R6
aacagcauuuccaccugcagca

SEQ ID NO: 4082208 - RNA, 23 nt, Streptococcus pneumoniae R6
aacagccaaaaguccaaagauga

SEQ ID NO: 4082209 - RNA, 19 nt, Streptococcus pneumoniae R6
aacagcgagauugaagcuc

SEQ ID NO: 4082210 - RNA, 15 nt, Streptococcus pneumoniae R6
aacagcuaaagacag

SEQ ID NO: 4082211 - RNA, 16 nt, Streptococcus pneumoniae R6
aacagcuaaagcaccu

SEQ ID NO: 4082212 - RNA, 17 nt, Streptococcus pneumoniae R6
aacagcuaaagcaccug

SEQ ID NO: 4082213 - RNA, 14 nt, Streptococcus pneumoniae R6
aacagcuacaccag

SEQ ID NO: 4082214 - RNA, 18 nt, Streptococcus pneumoniae R6
aacagcuccugaaauaag

SEQ ID NO: 4082215 - RNA, 17 nt, Streptococcus pneumoniae R6
aacagcuccuucaaguu

SEQ ID NO: 4082216 - RNA, 17 nt, Streptococcus pneumoniae R6
aacagcugcgauaagga

SEQ ID NO: 4082217 - RNA, 18 nt, Streptococcus pneumoniae R6
aacagcugcgauaaggaa

SEQ ID NO: 4082218 - RNA, 20 nt, Streptococcus pneumoniae R6
aacagcugcgauaaggaagu

SEQ ID NO: 4082219 - RNA, 19 nt, Streptococcus pneumoniae R6
aacagcugcgauuuuagca

SEQ ID NO: 4082220 - RNA, 17 nt, Streptococcus pneumoniae R6
aacagcuggaaucacau

SEQ ID NO: 4082221 - RNA, 17 nt, Streptococcus pneumoniae R6
aacagcugucgcaccug

SEQ ID NO: 4082222 - RNA, 21 nt, Streptococcus pneumoniae R6
aacaggauauuucuccaaagc

SEQ ID NO: 4082223 - RNA, 18 nt, Streptococcus pneumoniae R6
aacaggauuuuguucuuu

SEQ ID NO: 4082224 - RNA, 23 nt, Streptococcus pneumoniae R6
aacaggauuuuguucuuuuucaa

SEQ ID NO: 4082225 - RNA, 21 nt, Streptococcus pneumoniae R6
aacaguauacuggagaauuga

SEQ ID NO: 4082226 - RNA, 13 nt, Streptococcus pneumoniae R6
aacagucaggaua

SEQ ID NO: 4082227 - RNA, 19 nt, Streptococcus pneumoniae R6
aacagucccauaaaacuau

SEQ ID NO: 4082228 - RNA, 22 nt, Streptococcus pneumoniae R6
aacaguguuuuaagcugacuuc

SEQ ID NO: 4082229 - RNA, 23 nt, Streptococcus pneumoniae R6
aacaguguuuugaggcugcagau

SEQ ID NO: 4082230 - RNA, 22 nt, Streptococcus pneumoniae R6
aacaguguuuugaucugacuuc

SEQ ID NO: 4082231 - RNA, 22 nt, Streptococcus pneumoniae R6
aacaguuacaucaguauuucau

SEQ ID NO: 4082232 - RNA, 12 nt, Streptococcus pneumoniae R6
aacauaacugcu

SEQ ID NO: 4082233 - RNA, 19 nt, Streptococcus pneumoniae R6
aacauaacugcuaaaagau

SEQ ID NO: 4082234 - RNA, 21 nt, Streptococcus pneumoniae R6
aacauaacugcuaaaagauuu

SEQ ID NO: 4082235 - RNA, 19 nt, Streptococcus pneumoniae R6
aacauaauuuuagugcauu

SEQ ID NO: 4082236 - RNA, 17 nt, Streptococcus pneumoniae R6
aacaucccaaggauaga

SEQ ID NO: 4082237 - RNA, 13 nt, Streptococcus pneumoniae R6
aacaucgaaagca

SEQ ID NO: 4082238 - RNA, 18 nt, Streptococcus pneumoniae R6
aacaucgucacuaacaaa

SEQ ID NO: 4082239 - RNA, 22 nt, Streptococcus pneumoniae R6
aacaucuacaauugaaacucua

SEQ ID NO: 4082240 - RNA, 13 nt, Streptococcus pneumoniae R6
aacaucucagaau

SEQ ID NO: 4082241 - RNA, 12 nt, Streptococcus pneumoniae R6
aacaucuccaac

SEQ ID NO: 4082242 - RNA, 22 nt, Streptococcus pneumoniae R6
aacaucucuaucaggaaaguca

SEQ ID NO: 4082243 - RNA, 17 nt, Streptococcus pneumoniae R6
aacaucuggcucauauc

SEQ ID NO: 4082244 - RNA, 21 nt, Streptococcus pneumoniae R6
aacaucugguuuaauccaugg

SEQ ID NO: 4082245 - RNA, 17 nt, Streptococcus pneumoniae R6
aacaucuguccccucac

SEQ ID NO: 4082246 - RNA, 18 nt, Streptococcus pneumoniae R6
aacaucuuauuaucaagu

SEQ ID NO: 4082247 - RNA, 20 nt, Streptococcus pneumoniae R6
aacaucuucuguaccaauac

SEQ ID NO: 4082248 - RNA, 14 nt, Streptococcus pneumoniae R6
aacaucuuugaaga

SEQ ID NO: 4082249 - RNA, 16 nt, Streptococcus pneumoniae R6
aacaucuuugaagaua

SEQ ID NO: 4082250 - RNA, 17 nt, Streptococcus pneumoniae R6
aacaucuuuuccauauc

SEQ ID NO: 4082251 - RNA, 18 nt, Streptococcus pneumoniae R6
aacaugucuauagaacua

SEQ ID NO: 4082252 - RNA, 21 nt, Streptococcus pneumoniae R6
aacauguuuugagcugacuuc

SEQ ID NO: 4082253 - RNA, 13 nt, Streptococcus pneumoniae R6
aacauguuuuuga

SEQ ID NO: 4082254 - RNA, 21 nt, Streptococcus pneumoniae R6
aacauuacccauagauuuuua

SEQ ID NO: 4082255 - RNA, 21 nt, Streptococcus pneumoniae R6
aacauucccacaauaaaacgc

SEQ ID NO: 4082256 - RNA, 19 nt, Streptococcus pneumoniae R6
aacauucucccgcccuuuu

SEQ ID NO: 4082257 - RNA, 12 nt, Streptococcus pneumoniae R6
aacauucuuauc

SEQ ID NO: 4082258 - RNA, 21 nt, Streptococcus pneumoniae R6
aacauucuuaucaauugauuu

SEQ ID NO: 4082259 - RNA, 16 nt, Streptococcus pneumoniae R6
aacauugugagaaauu

SEQ ID NO: 4082260 - RNA, 19 nt, Streptococcus pneumoniae R6
aacauugugagaaauuggu

SEQ ID NO: 4082261 - RNA, 14 nt, Streptococcus pneumoniae R6
aacauugugaggaa

SEQ ID NO: 4082262 - RNA, 16 nt, Streptococcus pneumoniae R6
aacauuguuaaaaauu

SEQ ID NO: 4082263 - RNA, 18 nt, Streptococcus pneumoniae R6
aacauuucuauaaaucaa

SEQ ID NO: 4082264 - RNA, 17 nt, Streptococcus pneumoniae R6
aacauuuuaauuuugga

SEQ ID NO: 4082265 - RNA, 21 nt, Streptococcus pneumoniae R6
aaccaaaaaguggaaagagca

SEQ ID NO: 4082266 - RNA, 14 nt, Streptococcus pneumoniae R6
aaccaaaaucauac

SEQ ID NO: 4082267 - RNA, 13 nt, Streptococcus pneumoniae R6
aaccaaaccaacg

SEQ ID NO: 4082268 - RNA, 14 nt, Streptococcus pneumoniae R6
aaccaaacucacga

SEQ ID NO: 4082269 - RNA, 18 nt, Streptococcus pneumoniae R6
aaccaaaggcauugcgcu

SEQ ID NO: 4082270 - RNA, 16 nt, Streptococcus pneumoniae R6
aaccaaaucagauaag

SEQ ID NO: 4082271 - RNA, 18 nt, Streptococcus pneumoniae R6
aaccaaaucagauaagca

SEQ ID NO: 4082272 - RNA, 17 nt, Streptococcus pneumoniae R6
aaccaacauagauaaag

SEQ ID NO: 4082273 - RNA, 18 nt, Streptococcus pneumoniae R6
aaccaacauagauaaaga

SEQ ID NO: 4082274 - RNA, 12 nt, Streptococcus pneumoniae R6
aaccaacuucuu

SEQ ID NO: 4082275 - RNA, 14 nt, Streptococcus pneumoniae R6
aaccaacuuuuccu

SEQ ID NO: 4082276 - RNA, 23 nt, Streptococcus pneumoniae R6
aaccaauagccgcaaacuugguc

SEQ ID NO: 4082277 - RNA, 19 nt, Streptococcus pneumoniae R6
aaccaauuucucaaaaaag

SEQ ID NO: 4082278 - RNA, 20 nt, Streptococcus pneumoniae R6
aaccaauuucucaaaaaagu

SEQ ID NO: 4082279 - RNA, 21 nt, Streptococcus pneumoniae R6
aaccaauuucucaaaaaaguu

SEQ ID NO: 4082280 - RNA, 12 nt, Streptococcus pneumoniae R6
aaccacaaaaag

SEQ ID NO: 4082281 - RNA, 13 nt, Streptococcus pneumoniae R6
aaccacauaguca

SEQ ID NO: 4082282 - RNA, 22 nt, Streptococcus pneumoniae R6
aaccaccagaguggauuugguu

SEQ ID NO: 4082283 - RNA, 17 nt, Streptococcus pneumoniae R6
aaccaccgacaacccag

SEQ ID NO: 4082284 - RNA, 15 nt, Streptococcus pneumoniae R6
aaccagcuguaucga

SEQ ID NO: 4082285 - RNA, 19 nt, Streptococcus pneumoniae R6
aaccaggaaaccagcugcg

SEQ ID NO: 4082286 - RNA, 21 nt, Streptococcus pneumoniae R6
aaccaguccuggaaaaacgug

SEQ ID NO: 4082287 - RNA, 16 nt, Streptococcus pneumoniae R6
aaccaguccuugaaaa

SEQ ID NO: 4082288 - RNA, 18 nt, Streptococcus pneumoniae R6
aaccaguuccuuugucuu

SEQ ID NO: 4082289 - RNA, 18 nt, Streptococcus pneumoniae R6
aaccaguugaguguugaa

SEQ ID NO: 4082290 - RNA, 14 nt, Streptococcus pneumoniae R6
aaccaguugccaua

SEQ ID NO: 4082291 - RNA, 22 nt, Streptococcus pneumoniae R6
aaccauacauacgguaaggcga

SEQ ID NO: 4082292 - RNA, 23 nt, Streptococcus pneumoniae R6
aaccauaccuacgguaaggcgac

SEQ ID NO: 4082293 - RNA, 13 nt, Streptococcus pneumoniae R6
aacccaaacaagc

SEQ ID NO: 4082294 - RNA, 18 nt, Streptococcus pneumoniae R6
aacccaauagcgauuccc

SEQ ID NO: 4082295 - RNA, 12 nt, Streptococcus pneumoniae R6
aacccaccugaa

SEQ ID NO: 4082296 - RNA, 13 nt, Streptococcus pneumoniae R6
aacccacuacagu

SEQ ID NO: 4082297 - RNA, 22 nt, Streptococcus pneumoniae R6
aacccacuacaguugacaaaga

SEQ ID NO: 4082298 - RNA, 15 nt, Streptococcus pneumoniae R6
aacccauaccagagc

SEQ ID NO: 4082299 - RNA, 16 nt, Streptococcus pneumoniae R6
aaccccgauaacagcc

SEQ ID NO: 4082300 - RNA, 17 nt, Streptococcus pneumoniae R6
aaccccgauaacagccg

SEQ ID NO: 4082301 - RNA, 14 nt, Streptococcus pneumoniae R6
aacccuugauacua

SEQ ID NO: 4082302 - RNA, 15 nt, Streptococcus pneumoniae R6
aaccgaaaaucuccu

SEQ ID NO: 4082303 - RNA, 18 nt, Streptococcus pneumoniae R6
aaccgaugacaaaaauag

SEQ ID NO: 4082304 - RNA, 14 nt, Streptococcus pneumoniae R6
aaccgcaaaagcuu

SEQ ID NO: 4082305 - RNA, 22 nt, Streptococcus pneumoniae R6
aaccuacuguuagaacagucag

SEQ ID NO: 4082306 - RNA, 13 nt, Streptococcus pneumoniae R6
aaccucaaaaaca

SEQ ID NO: 4082307 - RNA, 15 nt, Streptococcus pneumoniae R6
aaccucaaaaacaug

SEQ ID NO: 4082308 - RNA, 13 nt, Streptococcus pneumoniae R6
aaccucaaaacaa

SEQ ID NO: 4082309 - RNA, 15 nt, Streptococcus pneumoniae R6
aaccucaaaacaaug

SEQ ID NO: 4082310 - RNA, 13 nt, Streptococcus pneumoniae R6
aaccucaaaacag

SEQ ID NO: 4082311 - RNA, 14 nt, Streptococcus pneumoniae R6
aaccucaaaacagu

SEQ ID NO: 4082312 - RNA, 15 nt, Streptococcus pneumoniae R6
aaccucaaaacagug

SEQ ID NO: 4082313 - RNA, 12 nt, Streptococcus pneumoniae R6
aaccucaaaacc

SEQ ID NO: 4082314 - RNA, 13 nt, Streptococcus pneumoniae R6
aaccucaaaacca

SEQ ID NO: 4082315 - RNA, 23 nt, Streptococcus pneumoniae R6
aaccucagaauccuuauuuucua

SEQ ID NO: 4082316 - RNA, 16 nt, Streptococcus pneumoniae R6
aaccucuugaaguuca

SEQ ID NO: 4082317 - RNA, 15 nt, Streptococcus pneumoniae R6
aaccugaaaaaauaa

SEQ ID NO: 4082318 - RNA, 15 nt, Streptococcus pneumoniae R6
aaccugaaucuccuc

SEQ ID NO: 4082319 - RNA, 22 nt, Streptococcus pneumoniae R6
aaccugauuggccgcaagcagc

SEQ ID NO: 4082320 - RNA, 21 nt, Streptococcus pneumoniae R6
aaccugcuucagauuguccuc

SEQ ID NO: 4082321 - RNA, 14 nt, Streptococcus pneumoniae R6
aaccugcuuuaaga

SEQ ID NO: 4082322 - RNA, 17 nt, Streptococcus pneumoniae R6
aaccugguacaguuggg

SEQ ID NO: 4082323 - RNA, 15 nt, Streptococcus pneumoniae R6
aaccuuaaaacagug

SEQ ID NO: 4082324 - RNA, 16 nt, Streptococcus pneumoniae R6
aaccuuaaucaaauua

SEQ ID NO: 4082325 - RNA, 17 nt, Streptococcus pneumoniae R6
aaccuuaaucaaauuau

SEQ ID NO: 4082326 - RNA, 22 nt, Streptococcus pneumoniae R6
aaccuuccaagagaccuuucau

SEQ ID NO: 4082327 - RNA, 14 nt, Streptococcus pneumoniae R6
aaccuucuucugug

SEQ ID NO: 4082328 - RNA, 12 nt, Streptococcus pneumoniae R6
aaccuugcaaaa

SEQ ID NO: 4082329 - RNA, 19 nt, Streptococcus pneumoniae R6
aaccuugcuucuuuccuua

SEQ ID NO: 4082330 - RNA, 14 nt, Streptococcus pneumoniae R6
aaccuuggaaauaa

SEQ ID NO: 4082331 - RNA, 21 nt, Streptococcus pneumoniae R6
aaccuugucuucuccuaaaau

SEQ ID NO: 4082332 - RNA, 15 nt, Streptococcus pneumoniae R6
aaccuuguuuuaaaa

SEQ ID NO: 4082333 - RNA, 15 nt, Streptococcus pneumoniae R6
aaccuuucucagaua

SEQ ID NO: 4082334 - RNA, 20 nt, Streptococcus pneumoniae R6
aaccuuucuucauagcagca

SEQ ID NO: 4082335 - RNA, 16 nt, Streptococcus pneumoniae R6
aacgaaccuuggcuug

SEQ ID NO: 4082336 - RNA, 17 nt, Streptococcus pneumoniae R6
aacgaacgccuuaaaaa

SEQ ID NO: 4082337 - RNA, 16 nt, Streptococcus pneumoniae R6
aacgaacuauaaaauc

SEQ ID NO: 4082338 - RNA, 17 nt, Streptococcus pneumoniae R6
aacgaacuauaaaaucu

SEQ ID NO: 4082339 - RNA, 12 nt, Streptococcus pneumoniae R6
aacgaagaagga

SEQ ID NO: 4082340 - RNA, 20 nt, Streptococcus pneumoniae R6
aacgaauacuuuguuuagac

SEQ ID NO: 4082341 - RNA, 13 nt, Streptococcus pneumoniae R6
aacgaauccaacu

SEQ ID NO: 4082342 - RNA, 16 nt, Streptococcus pneumoniae R6
aacgacagaagaagug

SEQ ID NO: 4082343 - RNA, 16 nt, Streptococcus pneumoniae R6
aacgaguaaaagauaa

SEQ ID NO: 4082344 - RNA, 15 nt, Streptococcus pneumoniae R6
aacgauagauccuuc

SEQ ID NO: 4082345 - RNA, 15 nt, Streptococcus pneumoniae R6
aacgauguuugaguu

SEQ ID NO: 4082346 - RNA, 21 nt, Streptococcus pneumoniae R6
aacgauguuugcagcaccagc

SEQ ID NO: 4082347 - RNA, 15 nt, Streptococcus pneumoniae R6
aacgauugaaauaac

SEQ ID NO: 4082348 - RNA, 14 nt, Streptococcus pneumoniae R6
aacgcauaauacca

SEQ ID NO: 4082349 - RNA, 18 nt, Streptococcus pneumoniae R6
aacgcauaauauugagug

SEQ ID NO: 4082350 - RNA, 21 nt, Streptococcus pneumoniae R6
aacgcccucacacggaaguau

SEQ ID NO: 4082351 - RNA, 21 nt, Streptococcus pneumoniae R6
aacgcgauacaauaaaggugu

SEQ ID NO: 4082352 - RNA, 16 nt, Streptococcus pneumoniae R6
aacgcuuaaaggcucu

SEQ ID NO: 4082353 - RNA, 16 nt, Streptococcus pneumoniae R6
aacggcuaguuuuuag

SEQ ID NO: 4082354 - RNA, 17 nt, Streptococcus pneumoniae R6
aacgggcaagggcugca

SEQ ID NO: 4082355 - RNA, 17 nt, Streptococcus pneumoniae R6
aacgguaacaaaacuaa

SEQ ID NO: 4082356 - RNA, 22 nt, Streptococcus pneumoniae R6
aacgguaucuugaauauuuuuc

SEQ ID NO: 4082357 - RNA, 20 nt, Streptococcus pneumoniae R6
aacguacgagauaagcuucu

SEQ ID NO: 4082358 - RNA, 19 nt, Streptococcus pneumoniae R6
aacguaguuuuuuuuguaa

SEQ ID NO: 4082359 - RNA, 17 nt, Streptococcus pneumoniae R6
aacgucuucaauaccaa

SEQ ID NO: 4082360 - RNA, 15 nt, Streptococcus pneumoniae R6
aacguuaaagaguug

SEQ ID NO: 4082361 - RNA, 20 nt, Streptococcus pneumoniae R6
aacguucuuuucaagaacug

SEQ ID NO: 4082362 - RNA, 20 nt, Streptococcus pneumoniae R6
aacguugacuguuucgucuu

SEQ ID NO: 4082363 - RNA, 17 nt, Streptococcus pneumoniae R6
aacguuguuaaaucaac

SEQ ID NO: 4082364 - RNA, 18 nt, Streptococcus pneumoniae R6
aacguuuaucacucaguu

SEQ ID NO: 4082365 - RNA, 22 nt, Streptococcus pneumoniae R6
aacguuuuuacuuuggcaaaga

SEQ ID NO: 4082366 - RNA, 17 nt, Streptococcus pneumoniae R6
aacguuuuucaaaccuu

SEQ ID NO: 4082367 - RNA, 13 nt, Streptococcus pneumoniae R6
aacuaaaaaaucu

SEQ ID NO: 4082368 - RNA, 14 nt, Streptococcus pneumoniae R6
aacuaaaguuccua

SEQ ID NO: 4082369 - RNA, 22 nt, Streptococcus pneumoniae R6
aacuaaaucuucggauaaauua

SEQ ID NO: 4082370 - RNA, 20 nt, Streptococcus pneumoniae R6
aacuaaauuccaaauuagaa

SEQ ID NO: 4082371 - RNA, 19 nt, Streptococcus pneumoniae R6
aacuaagauuuguuuuuca

SEQ ID NO: 4082372 - RNA, 16 nt, Streptococcus pneumoniae R6
aacuaagcuuauauac

SEQ ID NO: 4082373 - RNA, 20 nt, Streptococcus pneumoniae R6
aacuaaugagccuuaucaua

SEQ ID NO: 4082374 - RNA, 22 nt, Streptococcus pneumoniae R6
aacuaauuagucguaaauaaua

SEQ ID NO: 4082375 - RNA, 22 nt, Streptococcus pneumoniae R6
aacuaauuuagagaaugaaaua

SEQ ID NO: 4082376 - RNA, 19 nt, Streptococcus pneumoniae R6
aacuacacccgcauaaaua

SEQ ID NO: 4082377 - RNA, 15 nt, Streptococcus pneumoniae R6
aacuacauaggcuaa

SEQ ID NO: 4082378 - RNA, 20 nt, Streptococcus pneumoniae R6
aacuacuugauaaaaguuau

SEQ ID NO: 4082379 - RNA, 13 nt, Streptococcus pneumoniae R6
aacuagagaagcc

SEQ ID NO: 4082380 - RNA, 15 nt, Streptococcus pneumoniae R6
aacuagauuucugaa

SEQ ID NO: 4082381 - RNA, 15 nt, Streptococcus pneumoniae R6
aacuagcaagugcua

SEQ ID NO: 4082382 - RNA, 24 nt, Streptococcus pneumoniae R6
aacuagcaagugcuaagauaauag

SEQ ID NO: 4082383 - RNA, 12 nt, Streptococcus pneumoniae R6
aacuagcugcag

SEQ ID NO: 4082384 - RNA, 14 nt, Streptococcus pneumoniae R6
aacuaggaaacuag

SEQ ID NO: 4082385 - RNA, 18 nt, Streptococcus pneumoniae R6
aacuaggaaacuagcugc

SEQ ID NO: 4082386 - RNA, 16 nt, Streptococcus pneumoniae R6
aacuaggaagcuagcc

SEQ ID NO: 4082387 - RNA, 12 nt, Streptococcus pneumoniae R6
aacuaguaaauu

SEQ ID NO: 4082388 - RNA, 22 nt, Streptococcus pneumoniae R6
aacuaguaaauugucuaaaaau

SEQ ID NO: 4082389 - RNA, 17 nt, Streptococcus pneumoniae R6
aacuaguuuugagaauc

SEQ ID NO: 4082390 - RNA, 23 nt, Streptococcus pneumoniae R6
aacuauaaaaucugaagaaagca

SEQ ID NO: 4082391 - RNA, 14 nt, Streptococcus pneumoniae R6
aacuauaagauacu

SEQ ID NO: 4082392 - RNA, 21 nt, Streptococcus pneumoniae R6
aacuauccagagcauucuuuu

SEQ ID NO: 4082393 - RNA, 22 nt, Streptococcus pneumoniae R6
aacuauccagagcauucuuuug

SEQ ID NO: 4082394 - RNA, 17 nt, Streptococcus pneumoniae R6
aacuaugaacugguuuu

SEQ ID NO: 4082395 - RNA, 23 nt, Streptococcus pneumoniae R6
aacuauguucugugauaaacuug

SEQ ID NO: 4082396 - RNA, 21 nt, Streptococcus pneumoniae R6
aacuauuaagccuucuccaau

SEQ ID NO: 4082397 - RNA, 17 nt, Streptococcus pneumoniae R6
aacuauucuuuuucuac

SEQ ID NO: 4082398 - RNA, 17 nt, Streptococcus pneumoniae R6
aacuauuguagauuaua

SEQ ID NO: 4082399 - RNA, 12 nt, Streptococcus pneumoniae R6
aacucaaauuua

SEQ ID NO: 4082400 - RNA, 17 nt, Streptococcus pneumoniae R6
aacucaagaauuauuua

SEQ ID NO: 4082401 - RNA, 22 nt, Streptococcus pneumoniae R6
aacucaaggucgcauaggcaau

SEQ ID NO: 4082402 - RNA, 20 nt, Streptococcus pneumoniae R6
aacucaaguuaugcauuuuc

SEQ ID NO: 4082403 - RNA, 13 nt, Streptococcus pneumoniae R6
aacucaauuaaga

SEQ ID NO: 4082404 - RNA, 14 nt, Streptococcus pneumoniae R6
aacucaauuaagaa

SEQ ID NO: 4082405 - RNA, 13 nt, Streptococcus pneumoniae R6
aacucaggaaaga

SEQ ID NO: 4082406 - RNA, 18 nt, Streptococcus pneumoniae R6
aacucauaauagucucuu

SEQ ID NO: 4082407 - RNA, 18 nt, Streptococcus pneumoniae R6
aacucauagcagauaagu

SEQ ID NO: 4082408 - RNA, 22 nt, Streptococcus pneumoniae R6
aacucccuguuccaaagaagua

SEQ ID NO: 4082409 - RNA, 13 nt, Streptococcus pneumoniae R6
aacuccucucagu

SEQ ID NO: 4082410 - RNA, 15 nt, Streptococcus pneumoniae R6
aacuccuugaaucau

SEQ ID NO: 4082411 - RNA, 16 nt, Streptococcus pneumoniae R6
aacucgcgacaacagc

SEQ ID NO: 4082412 - RNA, 17 nt, Streptococcus pneumoniae R6
aacucgggcugaauaua

SEQ ID NO: 4082413 - RNA, 20 nt, Streptococcus pneumoniae R6
aacucuaaacaaacuccucu

SEQ ID NO: 4082414 - RNA, 20 nt, Streptococcus pneumoniae R6
aacucuaaauugaauaaagu

SEQ ID NO: 4082415 - RNA, 21 nt, Streptococcus pneumoniae R6
aacucuaucaggaaagucaaa

SEQ ID NO: 4082416 - RNA, 13 nt, Streptococcus pneumoniae R6
aacucuauuuuug

SEQ ID NO: 4082417 - RNA, 17 nt, Streptococcus pneumoniae R6
aacucucuaguucccac

SEQ ID NO: 4082418 - RNA, 16 nt, Streptococcus pneumoniae R6
aacucugcacguguaa

SEQ ID NO: 4082419 - RNA, 22 nt, Streptococcus pneumoniae R6
aacucuuacaaaaaaucaaaaa

SEQ ID NO: 4082420 - RNA, 15 nt, Streptococcus pneumoniae R6
aacucuuauacuuuu

SEQ ID NO: 4082421 - RNA, 15 nt, Streptococcus pneumoniae R6
aacucuuaucuaauc

SEQ ID NO: 4082422 - RNA, 22 nt, Streptococcus pneumoniae R6
aacucuucaagguuuuauacuc

SEQ ID NO: 4082423 - RNA, 19 nt, Streptococcus pneumoniae R6
aacucuuguccuaaauaga

SEQ ID NO: 4082424 - RNA, 23 nt, Streptococcus pneumoniae R6
aacucuuguucaaagugguguua

SEQ ID NO: 4082425 - RNA, 17 nt, Streptococcus pneumoniae R6
aacugaacaaauuaauu

SEQ ID NO: 4082426 - RNA, 16 nt, Streptococcus pneumoniae R6
aacugaacaagacgaa

SEQ ID NO: 4082427 - RNA, 16 nt, Streptococcus pneumoniae R6
aacugaagcuguuucc

SEQ ID NO: 4082428 - RNA, 20 nt, Streptococcus pneumoniae R6
aacugaaucuggaauaggau

SEQ ID NO: 4082429 - RNA, 19 nt, Streptococcus pneumoniae R6
aacugacgaagucaguaac

SEQ ID NO: 4082430 - RNA, 16 nt, Streptococcus pneumoniae R6
aacugaucccuccauu

SEQ ID NO: 4082431 - RNA, 20 nt, Streptococcus pneumoniae R6
aacugaucccuccauuucau

SEQ ID NO: 4082432 - RNA, 23 nt, Streptococcus pneumoniae R6
aacugaucccuccauuucauagc

SEQ ID NO: 4082433 - RNA, 13 nt, Streptococcus pneumoniae R6
aacugauucuacu

SEQ ID NO: 4082434 - RNA, 16 nt, Streptococcus pneumoniae R6
aacugccccccaaaag

SEQ ID NO: 4082435 - RNA, 16 nt, Streptococcus pneumoniae R6
aacugccugguaaaga

SEQ ID NO: 4082436 - RNA, 19 nt, Streptococcus pneumoniae R6
aacugccugguaaagacuc

SEQ ID NO: 4082437 - RNA, 23 nt, Streptococcus pneumoniae R6
aacugccuuucucucgugauuau

SEQ ID NO: 4082438 - RNA, 18 nt, Streptococcus pneumoniae R6
aacugcgacguuuucucc

SEQ ID NO: 4082439 - RNA, 20 nt, Streptococcus pneumoniae R6
aacugcgacguuuucuccuu

SEQ ID NO: 4082440 - RNA, 16 nt, Streptococcus pneumoniae R6
aacugcguauuccauu

SEQ ID NO: 4082441 - RNA, 20 nt, Streptococcus pneumoniae R6
aacugcguauuccauuggaa

SEQ ID NO: 4082442 - RNA, 20 nt, Streptococcus pneumoniae R6
aacugcuucacuagucauga

SEQ ID NO: 4082443 - RNA, 16 nt, Streptococcus pneumoniae R6
aacugcuugagcugcu

SEQ ID NO: 4082444 - RNA, 13 nt, Streptococcus pneumoniae R6
aacuggaaagaua

SEQ ID NO: 4082445 - RNA, 14 nt, Streptococcus pneumoniae R6
aacuggaaagauaa

SEQ ID NO: 4082446 - RNA, 21 nt, Streptococcus pneumoniae R6
aacuggaucaaugauaccuug

SEQ ID NO: 4082447 - RNA, 12 nt, Streptococcus pneumoniae R6
aacuggcaaaau

SEQ ID NO: 4082448 - RNA, 21 nt, Streptococcus pneumoniae R6
aacugguccagagauaguaga

SEQ ID NO: 4082449 - RNA, 22 nt, Streptococcus pneumoniae R6
aacuggugauaaguaaagcuuu

SEQ ID NO: 4082450 - RNA, 23 nt, Streptococcus pneumoniae R6
aacugguuaauuaauuuauuuaa

SEQ ID NO: 4082451 - RNA, 17 nt, Streptococcus pneumoniae R6
aacugguuccuuuuuag

SEQ ID NO: 4082452 - RNA, 18 nt, Streptococcus pneumoniae R6
aacuguaaaguagcaaaa

SEQ ID NO: 4082453 - RNA, 20 nt, Streptococcus pneumoniae R6
aacuguaaaguagcaaaaca

SEQ ID NO: 4082454 - RNA, 16 nt, Streptococcus pneumoniae R6
aacuguacaagaacaa

SEQ ID NO: 4082455 - RNA, 14 nt, Streptococcus pneumoniae R6
aacuguaguggguu

SEQ ID NO: 4082456 - RNA, 17 nt, Streptococcus pneumoniae R6
aacuguaguggguugaa

SEQ ID NO: 4082457 - RNA, 22 nt, Streptococcus pneumoniae R6
aacuguaguggguugaaaaaaa

SEQ ID NO: 4082458 - RNA, 15 nt, Streptococcus pneumoniae R6
aacuguaugagaaac

SEQ ID NO: 4082459 - RNA, 17 nt, Streptococcus pneumoniae R6
aacuguauugaccaaag

SEQ ID NO: 4082460 - RNA, 19 nt, Streptococcus pneumoniae R6
aacugucuaguguugucaa

SEQ ID NO: 4082461 - RNA, 20 nt, Streptococcus pneumoniae R6
aacuguuuuaggaacaauaa

SEQ ID NO: 4082462 - RNA, 23 nt, Streptococcus pneumoniae R6
aacuguuuuaggaacaauaaaac

SEQ ID NO: 4082463 - RNA, 18 nt, Streptococcus pneumoniae R6
aacuguuuuuucaacagc

SEQ ID NO: 4082464 - RNA, 13 nt, Streptococcus pneumoniae R6
aacuuaaaaagag

SEQ ID NO: 4082465 - RNA, 14 nt, Streptococcus pneumoniae R6
aacuuaaaaagagg

SEQ ID NO: 4082466 - RNA, 22 nt, Streptococcus pneumoniae R6
aacuuacauuugaguuucucuu

SEQ ID NO: 4082467 - RNA, 19 nt, Streptococcus pneumoniae R6
aacuuacgagcacgaguca

SEQ ID NO: 4082468 - RNA, 23 nt, Streptococcus pneumoniae R6
aacuuacuccggcggagccaaug

SEQ ID NO: 4082469 - RNA, 15 nt, Streptococcus pneumoniae R6
aacuuaucagcuagc

SEQ ID NO: 4082470 - RNA, 12 nt, Streptococcus pneumoniae R6
aacuuauuuuaa

SEQ ID NO: 4082471 - RNA, 17 nt, Streptococcus pneumoniae R6
aacuucaagaacuuuaa

SEQ ID NO: 4082472 - RNA, 16 nt, Streptococcus pneumoniae R6
aacuucagauuaguaa

SEQ ID NO: 4082473 - RNA, 18 nt, Streptococcus pneumoniae R6
aacuucagauucacuagc

SEQ ID NO: 4082474 - RNA, 17 nt, Streptococcus pneumoniae R6
aacuucaggauuuuuac

SEQ ID NO: 4082475 - RNA, 22 nt, Streptococcus pneumoniae R6
aacuuccaugacgcacaaacuu

SEQ ID NO: 4082476 - RNA, 19 nt, Streptococcus pneumoniae R6
aacuuccauguuguagucu

SEQ ID NO: 4082477 - RNA, 16 nt, Streptococcus pneumoniae R6
aacuucguacaugaga

SEQ ID NO: 4082478 - RNA, 17 nt, Streptococcus pneumoniae R6
aacuucuaaggaaaaag

SEQ ID NO: 4082479 - RNA, 22 nt, Streptococcus pneumoniae R6
aacuucucauggcgaucauuau

SEQ ID NO: 4082480 - RNA, 17 nt, Streptococcus pneumoniae R6
aacuucugcaauuagua

SEQ ID NO: 4082481 - RNA, 18 nt, Streptococcus pneumoniae R6
aacuucuuuuugauuuau

SEQ ID NO: 4082482 - RNA, 24 nt, Streptococcus pneumoniae R6
aacuucuuuuugauuuauccaacu

SEQ ID NO: 4082483 - RNA, 14 nt, Streptococcus pneumoniae R6
aacuucuuuuugua

SEQ ID NO: 4082484 - RNA, 13 nt, Streptococcus pneumoniae R6
aacuugaaaugau

SEQ ID NO: 4082485 - RNA, 13 nt, Streptococcus pneumoniae R6
aacuuggcaaaau

SEQ ID NO: 4082486 - RNA, 16 nt, Streptococcus pneumoniae R6
aacuugguuugucauc

SEQ ID NO: 4082487 - RNA, 23 nt, Streptococcus pneumoniae R6
aacuugugauuuaguagcaucau

SEQ ID NO: 4082488 - RNA, 23 nt, Streptococcus pneumoniae R6
aacuuguuuuuccugauuaaaau

SEQ ID NO: 4082489 - RNA, 14 nt, Streptococcus pneumoniae R6
aacuuuaagagcuu

SEQ ID NO: 4082490 - RNA, 21 nt, Streptococcus pneumoniae R6
aacuuuaguuugaguugcguc

SEQ ID NO: 4082491 - RNA, 13 nt, Streptococcus pneumoniae R6
aacuuuauaauau

SEQ ID NO: 4082492 - RNA, 15 nt, Streptococcus pneumoniae R6
aacuuucauaaugga

SEQ ID NO: 4082493 - RNA, 17 nt, Streptococcus pneumoniae R6
aacuuucccuucgucug

SEQ ID NO: 4082494 - RNA, 16 nt, Streptococcus pneumoniae R6
aacuuuuaacgcaugu

SEQ ID NO: 4082495 - RNA, 19 nt, Streptococcus pneumoniae R6
aacuuuuaacuucagcuuu

SEQ ID NO: 4082496 - RNA, 16 nt, Streptococcus pneumoniae R6
aacuuuuguauuuuga

SEQ ID NO: 4082497 - RNA, 21 nt, Streptococcus pneumoniae R6
aacuuuuuuauagucuauuuc

SEQ ID NO: 4082498 - RNA, 16 nt, Streptococcus pneumoniae R6
aacuuuuuugagaaau

SEQ ID NO: 4082499 - RNA, 19 nt, Streptococcus pneumoniae R6
aagaaaaaaaguaaaucuu

SEQ ID NO: 4082500 - RNA, 21 nt, Streptococcus pneumoniae R6
aagaaaaacugcuuagaaccg

SEQ ID NO: 4082501 - RNA, 16 nt, Streptococcus pneumoniae R6
aagaaaacagaaaaau

SEQ ID NO: 4082502 - RNA, 21 nt, Streptococcus pneumoniae R6
aagaaaacgccugcuuuuugc

SEQ ID NO: 4082503 - RNA, 18 nt, Streptococcus pneumoniae R6
aagaaaccgucaucagca

SEQ ID NO: 4082504 - RNA, 18 nt, Streptococcus pneumoniae R6
aagaaagaccauagcaaa

SEQ ID NO: 4082505 - RNA, 13 nt, Streptococcus pneumoniae R6
aagaaagaggagu

SEQ ID NO: 4082506 - RNA, 16 nt, Streptococcus pneumoniae R6
aagaaagcaacuaaaa

SEQ ID NO: 4082507 - RNA, 17 nt, Streptococcus pneumoniae R6
aagaaagcagcuuaucu

SEQ ID NO: 4082508 - RNA, 20 nt, Streptococcus pneumoniae R6
aagaaagcauagagaaaaac

SEQ ID NO: 4082509 - RNA, 21 nt, Streptococcus pneumoniae R6
aagaaagcauagagaaaaaca

SEQ ID NO: 4082510 - RNA, 15 nt, Streptococcus pneumoniae R6
aagaaaguccucauu

SEQ ID NO: 4082511 - RNA, 14 nt, Streptococcus pneumoniae R6
aagaaauaguuuag

SEQ ID NO: 4082512 - RNA, 23 nt, Streptococcus pneumoniae R6
aagaaauaguuuagauaaaacua

SEQ ID NO: 4082513 - RNA, 16 nt, Streptococcus pneumoniae R6
aagaaauaugacugua

SEQ ID NO: 4082514 - RNA, 15 nt, Streptococcus pneumoniae R6
aagaaauuauucuua

SEQ ID NO: 4082515 - RNA, 19 nt, Streptococcus pneumoniae R6
aagaaauuccaccugugaa

SEQ ID NO: 4082516 - RNA, 15 nt, Streptococcus pneumoniae R6
aagaaauugauauaa

SEQ ID NO: 4082517 - RNA, 19 nt, Streptococcus pneumoniae R6
aagaaauuuucuuuuuccu

SEQ ID NO: 4082518 - RNA, 14 nt, Streptococcus pneumoniae R6
aagaacaaguaaag

SEQ ID NO: 4082519 - RNA, 18 nt, Streptococcus pneumoniae R6
aagaacaaguaaagaguc

SEQ ID NO: 4082520 - RNA, 18 nt, Streptococcus pneumoniae R6
aagaacaauccaaauaag

SEQ ID NO: 4082521 - RNA, 20 nt, Streptococcus pneumoniae R6
aagaacaauccaaauaagua

SEQ ID NO: 4082522 - RNA, 11 nt, Streptococcus pneumoniae R6
aagaacagucu

SEQ ID NO: 4082523 - RNA, 14 nt, Streptococcus pneumoniae R6
aagaacagucucug

SEQ ID NO: 4082524 - RNA, 21 nt, Streptococcus pneumoniae R6
aagaacaugaaagaugaagca

SEQ ID NO: 4082525 - RNA, 14 nt, Streptococcus pneumoniae R6
aagaacuccaguga

SEQ ID NO: 4082526 - RNA, 17 nt, Streptococcus pneumoniae R6
aagaacuccagugaaaa

SEQ ID NO: 4082527 - RNA, 21 nt, Streptococcus pneumoniae R6
aagaacuccagugaaaacagg

SEQ ID NO: 4082528 - RNA, 23 nt, Streptococcus pneumoniae R6
aagaacuccagugaaaacaggag

SEQ ID NO: 4082529 - RNA, 19 nt, Streptococcus pneumoniae R6
aagaacugcuaccaauuca

SEQ ID NO: 4082530 - RNA, 23 nt, Streptococcus pneumoniae R6
aagaacuugguuugucaucguuc

SEQ ID NO: 4082531 - RNA, 19 nt, Streptococcus pneumoniae R6
aagaacuuuuuaaaguauu

SEQ ID NO: 4082532 - RNA, 16 nt, Streptococcus pneumoniae R6
aagaagacuagaccac

SEQ ID NO: 4082533 - RNA, 11 nt, Streptococcus pneumoniae R6
aagaagagggc

SEQ ID NO: 4082534 - RNA, 21 nt, Streptococcus pneumoniae R6
aagaagagggcuucuucaaca

SEQ ID NO: 4082535 - RNA, 23 nt, Streptococcus pneumoniae R6
aagaagauuggucaaucuuaucu

SEQ ID NO: 4082536 - RNA, 22 nt, Streptococcus pneumoniae R6
aagaagauuuuuuaguucagaa

SEQ ID NO: 4082537 - RNA, 18 nt, Streptococcus pneumoniae R6
aagaagcagaaaaauuuc

SEQ ID NO: 4082538 - RNA, 13 nt, Streptococcus pneumoniae R6
aagaagcuguaaa

SEQ ID NO: 4082539 - RNA, 16 nt, Streptococcus pneumoniae R6
aagaaggauugagaag

SEQ ID NO: 4082540 - RNA, 18 nt, Streptococcus pneumoniae R6
aagaagguauucauaaaa

SEQ ID NO: 4082541 - RNA, 20 nt, Streptococcus pneumoniae R6
aagaagguauucauaaaaua

SEQ ID NO: 4082542 - RNA, 18 nt, Streptococcus pneumoniae R6
aagaagguguuuuuauga

SEQ ID NO: 4082543 - RNA, 12 nt, Streptococcus pneumoniae R6
aagaaguaaauc

SEQ ID NO: 4082544 - RNA, 14 nt, Streptococcus pneumoniae R6
aagaaguaaaucuu

SEQ ID NO: 4082545 - RNA, 18 nt, Streptococcus pneumoniae R6
aagaagugguuuaaaguc

SEQ ID NO: 4082546 - RNA, 13 nt, Streptococcus pneumoniae R6
aagaaguuuuccu

SEQ ID NO: 4082547 - RNA, 17 nt, Streptococcus pneumoniae R6
aagaaguuuuccuugcc

SEQ ID NO: 4082548 - RNA, 19 nt, Streptococcus pneumoniae R6
aagaauaggacgaaucguu

SEQ ID NO: 4082549 - RNA, 16 nt, Streptococcus pneumoniae R6
aagaauaucaagauaa

SEQ ID NO: 4082550 - RNA, 18 nt, Streptococcus pneumoniae R6
aagaauaucaagauaaga

SEQ ID NO: 4082551 - RNA, 15 nt, Streptococcus pneumoniae R6
aagaaucccucuuuu

SEQ ID NO: 4082552 - RNA, 16 nt, Streptococcus pneumoniae R6
aagaauccugccaaug

SEQ ID NO: 4082553 - RNA, 13 nt, Streptococcus pneumoniae R6
aagaaucugcaug

SEQ ID NO: 4082554 - RNA, 13 nt, Streptococcus pneumoniae R6
aagaaucuuuucu

SEQ ID NO: 4082555 - RNA, 14 nt, Streptococcus pneumoniae R6
aagaaugaaaguuu

SEQ ID NO: 4082556 - RNA, 13 nt, Streptococcus pneumoniae R6
aagaaugagugcu

SEQ ID NO: 4082557 - RNA, 16 nt, Streptococcus pneumoniae R6
aagaaugagugcugua

SEQ ID NO: 4082558 - RNA, 20 nt, Streptococcus pneumoniae R6
aagaaugcucagacaauuuc

SEQ ID NO: 4082559 - RNA, 22 nt, Streptococcus pneumoniae R6
aagaaugggauacuaucuccuu

SEQ ID NO: 4082560 - RNA, 17 nt, Streptococcus pneumoniae R6
aagaauuaggaaaacau

SEQ ID NO: 4082561 - RNA, 18 nt, Streptococcus pneumoniae R6
aagaauuaggaaaacaug

SEQ ID NO: 4082562 - RNA, 12 nt, Streptococcus pneumoniae R6
aagaauuuaaaa

SEQ ID NO: 4082563 - RNA, 19 nt, Streptococcus pneumoniae R6
aagaauuuaaaaaucuauu

SEQ ID NO: 4082564 - RNA, 20 nt, Streptococcus pneumoniae R6
aagaauuuaaaaaucuauuu

SEQ ID NO: 4082565 - RNA, 21 nt, Streptococcus pneumoniae R6
aagaauuuaaaaaucuauuuu

SEQ ID NO: 4082566 - RNA, 13 nt, Streptococcus pneumoniae R6
aagaauuugaaaa

SEQ ID NO: 4082567 - RNA, 16 nt, Streptococcus pneumoniae R6
aagaauuugaaaaaaa

SEQ ID NO: 4082568 - RNA, 15 nt, Streptococcus pneumoniae R6
aagaauuugauuauu

SEQ ID NO: 4082569 - RNA, 15 nt, Streptococcus pneumoniae R6
aagacaaaucauuuu

SEQ ID NO: 4082570 - RNA, 12 nt, Streptococcus pneumoniae R6
aagacaauguuc

SEQ ID NO: 4082571 - RNA, 19 nt, Streptococcus pneumoniae R6
aagacaauguucuuuucuc

SEQ ID NO: 4082572 - RNA, 17 nt, Streptococcus pneumoniae R6
aagacacauggaaggcc

SEQ ID NO: 4082573 - RNA, 16 nt, Streptococcus pneumoniae R6
aagacacucaacaagc

SEQ ID NO: 4082574 - RNA, 13 nt, Streptococcus pneumoniae R6
aagacagauuuga

SEQ ID NO: 4082575 - RNA, 13 nt, Streptococcus pneumoniae R6
aagacagcgcugg

SEQ ID NO: 4082576 - RNA, 21 nt, Streptococcus pneumoniae R6
aagacagggccuuagcagacu

SEQ ID NO: 4082577 - RNA, 23 nt, Streptococcus pneumoniae R6
aagacagguuucacaucaaucuu

SEQ ID NO: 4082578 - RNA, 17 nt, Streptococcus pneumoniae R6
aagacagucugaaaaau

SEQ ID NO: 4082579 - RNA, 18 nt, Streptococcus pneumoniae R6
aagacagucugaaaaaua

SEQ ID NO: 4082580 - RNA, 14 nt, Streptococcus pneumoniae R6
aagacaguugcauu

SEQ ID NO: 4082581 - RNA, 17 nt, Streptococcus pneumoniae R6
aagacaucauauaaaua

SEQ ID NO: 4082582 - RNA, 19 nt, Streptococcus pneumoniae R6
aagacaucuucucaggcuu

SEQ ID NO: 4082583 - RNA, 18 nt, Streptococcus pneumoniae R6
aagaccaaagaaaaacuc

SEQ ID NO: 4082584 - RNA, 17 nt, Streptococcus pneumoniae R6
aagaccaccucaucuug

SEQ ID NO: 4082585 - RNA, 15 nt, Streptococcus pneumoniae R6
aagaccauagcaaag

SEQ ID NO: 4082586 - RNA, 15 nt, Streptococcus pneumoniae R6
aagaccaugaggaaa

SEQ ID NO: 4082587 - RNA, 14 nt, Streptococcus pneumoniae R6
aagaccgagaguuc

SEQ ID NO: 4082588 - RNA, 16 nt, Streptococcus pneumoniae R6
aagaccucaauaugcu

SEQ ID NO: 4082589 - RNA, 22 nt, Streptococcus pneumoniae R6
aagaccuuaaacuuguaaguca

SEQ ID NO: 4082590 - RNA, 19 nt, Streptococcus pneumoniae R6
aagacgaaccaaugugcag

SEQ ID NO: 4082591 - RNA, 13 nt, Streptococcus pneumoniae R6
aagacuaaguuag

SEQ ID NO: 4082592 - RNA, 19 nt, Streptococcus pneumoniae R6
aagacuagaaaaagcuuca

SEQ ID NO: 4082593 - RNA, 21 nt, Streptococcus pneumoniae R6
aagacuaggugagcaucagga

SEQ ID NO: 4082594 - RNA, 20 nt, Streptococcus pneumoniae R6
aagacugacgaagucagcuc

SEQ ID NO: 4082595 - RNA, 18 nt, Streptococcus pneumoniae R6
aagacuggugagauaaaa

SEQ ID NO: 4082596 - RNA, 21 nt, Streptococcus pneumoniae R6
aagacuugaaauacuaaaaaa

SEQ ID NO: 4082597 - RNA, 22 nt, Streptococcus pneumoniae R6
aagacuugaaauacuaaaaaaa

SEQ ID NO: 4082598 - RNA, 21 nt, Streptococcus pneumoniae R6
aagacuugaccggagaaagaa

SEQ ID NO: 4082599 - RNA, 20 nt, Streptococcus pneumoniae R6
aagacuuguuagcugauuuu

SEQ ID NO: 4082600 - RNA, 21 nt, Streptococcus pneumoniae R6
aagacuuguuagcugauuuuu

SEQ ID NO: 4082601 - RNA, 19 nt, Streptococcus pneumoniae R6
aagacuuuaaaaauuuuuu

SEQ ID NO: 4082602 - RNA, 17 nt, Streptococcus pneumoniae R6
aagacuuuuauccaccu

SEQ ID NO: 4082603 - RNA, 13 nt, Streptococcus pneumoniae R6
aagagaaacucaa

SEQ ID NO: 4082604 - RNA, 12 nt, Streptococcus pneumoniae R6
aagagaaauuuc

SEQ ID NO: 4082605 - RNA, 19 nt, Streptococcus pneumoniae R6
aagagaccuuucauaaagu

SEQ ID NO: 4082606 - RNA, 20 nt, Streptococcus pneumoniae R6
aagagaccuuucauaaaguu

SEQ ID NO: 4082607 - RNA, 21 nt, Streptococcus pneumoniae R6
aagagaccuuucauaaaguuu

SEQ ID NO: 4082608 - RNA, 20 nt, Streptococcus pneumoniae R6
aagagacuucauuacuauca

SEQ ID NO: 4082609 - RNA, 13 nt, Streptococcus pneumoniae R6
aagagaguuacaa

SEQ ID NO: 4082610 - RNA, 16 nt, Streptococcus pneumoniae R6
aagagaguuacaaacu

SEQ ID NO: 4082611 - RNA, 22 nt, Streptococcus pneumoniae R6
aagagaguuacggguuuuaaac

SEQ ID NO: 4082612 - RNA, 20 nt, Streptococcus pneumoniae R6
aagagaugagagauaaauau

SEQ ID NO: 4082613 - RNA, 21 nt, Streptococcus pneumoniae R6
aagagauugaugcaaaucuca

SEQ ID NO: 4082614 - RNA, 18 nt, Streptococcus pneumoniae R6
aagagauuuucaaagagu

SEQ ID NO: 4082615 - RNA, 14 nt, Streptococcus pneumoniae R6
aagagauuuucgaa

SEQ ID NO: 4082616 - RNA, 24 nt, Streptococcus pneumoniae R6
aagagauuuucgaagaguauaaaa

SEQ ID NO: 4082617 - RNA, 15 nt, Streptococcus pneumoniae R6
aagagcaaaaacaau

SEQ ID NO: 4082618 - RNA, 13 nt, Streptococcus pneumoniae R6
aagagcacugcua

SEQ ID NO: 4082619 - RNA, 15 nt, Streptococcus pneumoniae R6
aagagcaucugccgc

SEQ ID NO: 4082620 - RNA, 17 nt, Streptococcus pneumoniae R6
aagagccgaaaaaauag

SEQ ID NO: 4082621 - RNA, 18 nt, Streptococcus pneumoniae R6
aagagccggaaauugucu

SEQ ID NO: 4082622 - RNA, 15 nt, Streptococcus pneumoniae R6
aagagccucauaaaa

SEQ ID NO: 4082623 - RNA, 20 nt, Streptococcus pneumoniae R6
aagagccucauaaaagguau

SEQ ID NO: 4082624 - RNA, 15 nt, Streptococcus pneumoniae R6
aagagcuucuuucau

SEQ ID NO: 4082625 - RNA, 19 nt, Streptococcus pneumoniae R6
aagaggagguaaaucccaa

SEQ ID NO: 4082626 - RNA, 20 nt, Streptococcus pneumoniae R6
aagaggagguaaaucccaag

SEQ ID NO: 4082627 - RNA, 22 nt, Streptococcus pneumoniae R6
aagaggagugauaaugucguuu

SEQ ID NO: 4082628 - RNA, 20 nt, Streptococcus pneumoniae R6
aagagggcuucaaucucugc

SEQ ID NO: 4082629 - RNA, 22 nt, Streptococcus pneumoniae R6
aagagggcuucuucaacagcug

SEQ ID NO: 4082630 - RNA, 23 nt, Streptococcus pneumoniae R6
aagagguuggucgauuggcagcc

SEQ ID NO: 4082631 - RNA, 12 nt, Streptococcus pneumoniae R6
aagaguaacuuc

SEQ ID NO: 4082632 - RNA, 13 nt, Streptococcus pneumoniae R6
aagaguacagucu

SEQ ID NO: 4082633 - RNA, 21 nt, Streptococcus pneumoniae R6
aagaguacgaacaaguugugc

SEQ ID NO: 4082634 - RNA, 18 nt, Streptococcus pneumoniae R6
aagaguauaaaaucaaau

SEQ ID NO: 4082635 - RNA, 14 nt, Streptococcus pneumoniae R6
aagaguauaaaauu

SEQ ID NO: 4082636 - RNA, 15 nt, Streptococcus pneumoniae R6
aagaguauaaaauuu

SEQ ID NO: 4082637 - RNA, 15 nt, Streptococcus pneumoniae R6
aagaguauuaaacaa

SEQ ID NO: 4082638 - RNA, 14 nt, Streptococcus pneumoniae R6
aagaguauuauucu

SEQ ID NO: 4082639 - RNA, 20 nt, Streptococcus pneumoniae R6
aagagucaagacaaggauaa

SEQ ID NO: 4082640 - RNA, 12 nt, Streptococcus pneumoniae R6
aagagucagcuc

SEQ ID NO: 4082641 - RNA, 19 nt, Streptococcus pneumoniae R6
aagagucccuuagaaaaac

SEQ ID NO: 4082642 - RNA, 23 nt, Streptococcus pneumoniae R6
aagaguccugcccacuaaaaaua

SEQ ID NO: 4082643 - RNA, 17 nt, Streptococcus pneumoniae R6
aagaguggauuuucacg

SEQ ID NO: 4082644 - RNA, 14 nt, Streptococcus pneumoniae R6
aagaguugaggcaa

SEQ ID NO: 4082645 - RNA, 20 nt, Streptococcus pneumoniae R6
aagaguugccuaaaacucca

SEQ ID NO: 4082646 - RNA, 12 nt, Streptococcus pneumoniae R6
aagaguuucaug

SEQ ID NO: 4082647 - RNA, 14 nt, Streptococcus pneumoniae R6
aagaguuucaugag

SEQ ID NO: 4082648 - RNA, 20 nt, Streptococcus pneumoniae R6
aagaguuucgaaaagaauua

SEQ ID NO: 4082649 - RNA, 21 nt, Streptococcus pneumoniae R6
aagauaaaauugauaauagca

SEQ ID NO: 4082650 - RNA, 17 nt, Streptococcus pneumoniae R6
aagauaaaguggucuuu

SEQ ID NO: 4082651 - RNA, 22 nt, Streptococcus pneumoniae R6
aagauaacaguuuuuaauuuuu

SEQ ID NO: 4082652 - RNA, 23 nt, Streptococcus pneumoniae R6
aagauaacaguuuuuaauuuuuc

SEQ ID NO: 4082653 - RNA, 19 nt, Streptococcus pneumoniae R6
aagauaacugcuagaaaug

SEQ ID NO: 4082654 - RNA, 22 nt, Streptococcus pneumoniae R6
aagauaauagcgaugaagagag

SEQ ID NO: 4082655 - RNA, 20 nt, Streptococcus pneumoniae R6
aagauacgaauauccucuuc

SEQ ID NO: 4082656 - RNA, 23 nt, Streptococcus pneumoniae R6
aagauacgaauauccucuucacu

SEQ ID NO: 4082657 - RNA, 17 nt, Streptococcus pneumoniae R6
aagauacuuagauuuuc

SEQ ID NO: 4082658 - RNA, 23 nt, Streptococcus pneumoniae R6
aagauacuugauuuuugccauau

SEQ ID NO: 4082659 - RNA, 13 nt, Streptococcus pneumoniae R6
aagauagaaccca

SEQ ID NO: 4082660 - RNA, 18 nt, Streptococcus pneumoniae R6
aagauagaacuaugaacu

SEQ ID NO: 4082661 - RNA, 19 nt, Streptococcus pneumoniae R6
aagauagagaaagaaaaac

SEQ ID NO: 4082662 - RNA, 22 nt, Streptococcus pneumoniae R6
aagauagagagcuccaaagaag

SEQ ID NO: 4082663 - RNA, 21 nt, Streptococcus pneumoniae R6
aagauagagguuauucaaaaa

SEQ ID NO: 4082664 - RNA, 16 nt, Streptococcus pneumoniae R6
aagauagccaugaacg

SEQ ID NO: 4082665 - RNA, 17 nt, Streptococcus pneumoniae R6
aagauagggcugaagga

SEQ ID NO: 4082666 - RNA, 13 nt, Streptococcus pneumoniae R6
aagauaguaaaga

SEQ ID NO: 4082667 - RNA, 23 nt, Streptococcus pneumoniae R6
aagauaguaaagagcugcugcuu

SEQ ID NO: 4082668 - RNA, 17 nt, Streptococcus pneumoniae R6
aagauagucgauaaaaa

SEQ ID NO: 4082669 - RNA, 18 nt, Streptococcus pneumoniae R6
aagauauagccuguaaaa

SEQ ID NO: 4082670 - RNA, 21 nt, Streptococcus pneumoniae R6
aagauauagccuguaaaaagu

SEQ ID NO: 4082671 - RNA, 19 nt, Streptococcus pneumoniae R6
aagauauuaagaaucuuuu

SEQ ID NO: 4082672 - RNA, 14 nt, Streptococcus pneumoniae R6
aagaucaguucauu

SEQ ID NO: 4082673 - RNA, 21 nt, Streptococcus pneumoniae R6
aagaucaguucauuuuuccuu

SEQ ID NO: 4082674 - RNA, 13 nt, Streptococcus pneumoniae R6
aagaucauuaacu

SEQ ID NO: 4082675 - RNA, 22 nt, Streptococcus pneumoniae R6
aagaucuagaaaggacaaauuu

SEQ ID NO: 4082676 - RNA, 17 nt, Streptococcus pneumoniae R6
aagaucuugucugcaug

SEQ ID NO: 4082677 - RNA, 15 nt, Streptococcus pneumoniae R6
aagaucuuuuuauac

SEQ ID NO: 4082678 - RNA, 20 nt, Streptococcus pneumoniae R6
aagaucuuuuuauacucaau

SEQ ID NO: 4082679 - RNA, 19 nt, Streptococcus pneumoniae R6
aagaugacaucuaaauaau

SEQ ID NO: 4082680 - RNA, 18 nt, Streptococcus pneumoniae R6
aagaugagacuugcaaga

SEQ ID NO: 4082681 - RNA, 20 nt, Streptococcus pneumoniae R6
aagaugagacuugcaagaaa

SEQ ID NO: 4082682 - RNA, 15 nt, Streptococcus pneumoniae R6
aagaugauaucaaga

SEQ ID NO: 4082683 - RNA, 17 nt, Streptococcus pneumoniae R6
aagaugauaucaagaca

SEQ ID NO: 4082684 - RNA, 20 nt, Streptococcus pneumoniae R6
aagaugauuuuucuaaauuu

SEQ ID NO: 4082685 - RNA, 14 nt, Streptococcus pneumoniae R6
aagaugcgaacaaa

SEQ ID NO: 4082686 - RNA, 13 nt, Streptococcus pneumoniae R6
aagauggaaaaac

SEQ ID NO: 4082687 - RNA, 15 nt, Streptococcus pneumoniae R6
aagauguaaaaguuu

SEQ ID NO: 4082688 - RNA, 21 nt, Streptococcus pneumoniae R6
aagauuaauuucagaaaucuu

SEQ ID NO: 4082689 - RNA, 13 nt, Streptococcus pneumoniae R6
aagauuacagauc

SEQ ID NO: 4082690 - RNA, 12 nt, Streptococcus pneumoniae R6
aagauuaugaug

SEQ ID NO: 4082691 - RNA, 15 nt, Streptococcus pneumoniae R6
aagauugauaaaggc

SEQ ID NO: 4082692 - RNA, 20 nt, Streptococcus pneumoniae R6
aagauuuccuccauaaacgc

SEQ ID NO: 4082693 - RNA, 15 nt, Streptococcus pneumoniae R6
aagauuugaaacuaa

SEQ ID NO: 4082694 - RNA, 23 nt, Streptococcus pneumoniae R6
aagauuuuaccuauaacauccug

SEQ ID NO: 4082695 - RNA, 15 nt, Streptococcus pneumoniae R6
aagauuuuuggaaaa

SEQ ID NO: 4082696 - RNA, 22 nt, Streptococcus pneumoniae R6
aagauuuuuggaaaaaauaaaa

SEQ ID NO: 4082697 - RNA, 16 nt, Streptococcus pneumoniae R6
aagauuuuuuaaaaag

SEQ ID NO: 4082698 - RNA, 19 nt, Streptococcus pneumoniae R6
aagauuuuuuaaaaaguuu

SEQ ID NO: 4082699 - RNA, 21 nt, Streptococcus pneumoniae R6
aagauuuuuuggauucucaaa

SEQ ID NO: 4082700 - RNA, 10 nt, Streptococcus pneumoniae R6
aagcaaaaaa

SEQ ID NO: 4082701 - RNA, 12 nt, Streptococcus pneumoniae R6
aagcaaaaaaag

SEQ ID NO: 4082702 - RNA, 15 nt, Streptococcus pneumoniae R6
aagcaaaaaaagccc

SEQ ID NO: 4082703 - RNA, 22 nt, Streptococcus pneumoniae R6
aagcaaaaauggcaucugguuu

SEQ ID NO: 4082704 - RNA, 13 nt, Streptococcus pneumoniae R6
aagcaaaagaaca

SEQ ID NO: 4082705 - RNA, 14 nt, Streptococcus pneumoniae R6
aagcaaaagaacaa

SEQ ID NO: 4082706 - RNA, 18 nt, Streptococcus pneumoniae R6
aagcaaaagccgauaccu

SEQ ID NO: 4082707 - RNA, 19 nt, Streptococcus pneumoniae R6
aagcaaaauggcgaguccu

SEQ ID NO: 4082708 - RNA, 13 nt, Streptococcus pneumoniae R6
aagcaaacauucc

SEQ ID NO: 4082709 - RNA, 17 nt, Streptococcus pneumoniae R6
aagcaacaaaaacgaua

SEQ ID NO: 4082710 - RNA, 23 nt, Streptococcus pneumoniae R6
aagcaacuaaaaaggaaccaggu

SEQ ID NO: 4082711 - RNA, 16 nt, Streptococcus pneumoniae R6
aagcaacuaaaaucau

SEQ ID NO: 4082712 - RNA, 13 nt, Streptococcus pneumoniae R6
aagcaacuuacuc

SEQ ID NO: 4082713 - RNA, 14 nt, Streptococcus pneumoniae R6
aagcaacuuuacga

SEQ ID NO: 4082714 - RNA, 13 nt, Streptococcus pneumoniae R6
aagcaagugacaa

SEQ ID NO: 4082715 - RNA, 13 nt, Streptococcus pneumoniae R6
aagcaauuuugaa

SEQ ID NO: 4082716 - RNA, 22 nt, Streptococcus pneumoniae R6
aagcacacaaaucuucuguaga

SEQ ID NO: 4082717 - RNA, 24 nt, Streptococcus pneumoniae R6
aagcaccuacaacauagacuuuac

SEQ ID NO: 4082718 - RNA, 20 nt, Streptococcus pneumoniae R6
aagcaccuaguacaaagaau

SEQ ID NO: 4082719 - RNA, 18 nt, Streptococcus pneumoniae R6
aagcacggagaacaauau

SEQ ID NO: 4082720 - RNA, 12 nt, Streptococcus pneumoniae R6
aagcagaaaaau

SEQ ID NO: 4082721 - RNA, 18 nt, Streptococcus pneumoniae R6
aagcagaaaaauuucauu

SEQ ID NO: 4082722 - RNA, 17 nt, Streptococcus pneumoniae R6
aagcauagagaaaaaca

SEQ ID NO: 4082723 - RNA, 15 nt, Streptococcus pneumoniae R6
aagcauauuccacau

SEQ ID NO: 4082724 - RNA, 16 nt, Streptococcus pneumoniae R6
aagcauauuccacauu

SEQ ID NO: 4082725 - RNA, 16 nt, Streptococcus pneumoniae R6
aagcauucuauuccau

SEQ ID NO: 4082726 - RNA, 14 nt, Streptococcus pneumoniae R6
aagcauuuaaucca

SEQ ID NO: 4082727 - RNA, 20 nt, Streptococcus pneumoniae R6
aagcauuuucauaaggaagu

SEQ ID NO: 4082728 - RNA, 17 nt, Streptococcus pneumoniae R6
aagcauuuuuuugauaa

SEQ ID NO: 4082729 - RNA, 13 nt, Streptococcus pneumoniae R6
aagccaaaucaau

SEQ ID NO: 4082730 - RNA, 21 nt, Streptococcus pneumoniae R6
aagccaagaguagagagaaag

SEQ ID NO: 4082731 - RNA, 20 nt, Streptococcus pneumoniae R6
aagccauauuggaugaguuu

SEQ ID NO: 4082732 - RNA, 23 nt, Streptococcus pneumoniae R6
aagccauauuggaugaguuuacu

SEQ ID NO: 4082733 - RNA, 13 nt, Streptococcus pneumoniae R6
aagcccaaagaua

SEQ ID NO: 4082734 - RNA, 19 nt, Streptococcus pneumoniae R6
aagcccuauauuauaagac

SEQ ID NO: 4082735 - RNA, 13 nt, Streptococcus pneumoniae R6
aagcccuuuauga

SEQ ID NO: 4082736 - RNA, 17 nt, Streptococcus pneumoniae R6
aagccggcuugucuuug

SEQ ID NO: 4082737 - RNA, 16 nt, Streptococcus pneumoniae R6
aagccuauucccugag

SEQ ID NO: 4082738 - RNA, 16 nt, Streptococcus pneumoniae R6
aagccuccaaucugga

SEQ ID NO: 4082739 - RNA, 17 nt, Streptococcus pneumoniae R6
aagccucuuuauccauc

SEQ ID NO: 4082740 - RNA, 19 nt, Streptococcus pneumoniae R6
aagccugagaugauucuca

SEQ ID NO: 4082741 - RNA, 18 nt, Streptococcus pneumoniae R6
aagccuucguaagcuucc

SEQ ID NO: 4082742 - RNA, 20 nt, Streptococcus pneumoniae R6
aagccuucuccaauugcaag

SEQ ID NO: 4082743 - RNA, 22 nt, Streptococcus pneumoniae R6
aagccuuguuuccaaggaaagu

SEQ ID NO: 4082744 - RNA, 22 nt, Streptococcus pneumoniae R6
aagccuuucgaacuuuggaaga

SEQ ID NO: 4082745 - RNA, 16 nt, Streptococcus pneumoniae R6
aagcgaaaggagaaaa

SEQ ID NO: 4082746 - RNA, 18 nt, Streptococcus pneumoniae R6
aagcgagguuuuuaaagg

SEQ ID NO: 4082747 - RNA, 23 nt, Streptococcus pneumoniae R6
aagcgaugauaagaaucguguug

SEQ ID NO: 4082748 - RNA, 21 nt, Streptococcus pneumoniae R6
aagcgauuaggggggcuauuc

SEQ ID NO: 4082749 - RNA, 22 nt, Streptococcus pneumoniae R6
aagcgcacaagcgcuauuaaaa

SEQ ID NO: 4082750 - RNA, 16 nt, Streptococcus pneumoniae R6
aagcggaugaaccguu

SEQ ID NO: 4082751 - RNA, 13 nt, Streptococcus pneumoniae R6
aagcguguaggaa

SEQ ID NO: 4082752 - RNA, 15 nt, Streptococcus pneumoniae R6
aagcguguaggaaac

SEQ ID NO: 4082753 - RNA, 14 nt, Streptococcus pneumoniae R6
aagcguucaaucag

SEQ ID NO: 4082754 - RNA, 19 nt, Streptococcus pneumoniae R6
aagcuaagaaaguaagaau

SEQ ID NO: 4082755 - RNA, 16 nt, Streptococcus pneumoniae R6
aagcuaauagagcuga

SEQ ID NO: 4082756 - RNA, 14 nt, Streptococcus pneumoniae R6
aagcuacuauaaaa

SEQ ID NO: 4082757 - RNA, 18 nt, Streptococcus pneumoniae R6
aagcuacuauaaaagagg

SEQ ID NO: 4082758 - RNA, 22 nt, Streptococcus pneumoniae R6
aagcuacuauaaaagaggaggu

SEQ ID NO: 4082759 - RNA, 22 nt, Streptococcus pneumoniae R6
aagcuagauuuaaaacugugau

SEQ ID NO: 4082760 - RNA, 19 nt, Streptococcus pneumoniae R6
aagcuagccguagguugcu

SEQ ID NO: 4082761 - RNA, 20 nt, Streptococcus pneumoniae R6
aagcuagucgcagguugcuc

SEQ ID NO: 4082762 - RNA, 21 nt, Streptococcus pneumoniae R6
aagcuauagauaaggucaucu

SEQ ID NO: 4082763 - RNA, 12 nt, Streptococcus pneumoniae R6
aagcucagcauu

SEQ ID NO: 4082764 - RNA, 14 nt, Streptococcus pneumoniae R6
aagcuccuaaauca

SEQ ID NO: 4082765 - RNA, 16 nt, Streptococcus pneumoniae R6
aagcuccuuuagugau

SEQ ID NO: 4082766 - RNA, 22 nt, Streptococcus pneumoniae R6
aagcucgagaaaggacaaauuu

SEQ ID NO: 4082767 - RNA, 23 nt, Streptococcus pneumoniae R6
aagcucgagaaaggggcucuuug

SEQ ID NO: 4082768 - RNA, 17 nt, Streptococcus pneumoniae R6
aagcucgauaaaggaca

SEQ ID NO: 4082769 - RNA, 15 nt, Streptococcus pneumoniae R6
aagcugaauucuaau

SEQ ID NO: 4082770 - RNA, 20 nt, Streptococcus pneumoniae R6
aagcugacgcgguuugaaga

SEQ ID NO: 4082771 - RNA, 23 nt, Streptococcus pneumoniae R6
aagcugacgugguuugaagagau

SEQ ID NO: 4082772 - RNA, 19 nt, Streptococcus pneumoniae R6
aagcugacuucgucaguuc

SEQ ID NO: 4082773 - RNA, 21 nt, Streptococcus pneumoniae R6
aagcugacuucgucaguucua

SEQ ID NO: 4082774 - RNA, 19 nt, Streptococcus pneumoniae R6
aagcugacuucgucaguuu

SEQ ID NO: 4082775 - RNA, 19 nt, Streptococcus pneumoniae R6
aagcugaucaauauucucc

SEQ ID NO: 4082776 - RNA, 14 nt, Streptococcus pneumoniae R6
aagcugaugcgguu

SEQ ID NO: 4082777 - RNA, 15 nt, Streptococcus pneumoniae R6
aagcugaugcgguuu

SEQ ID NO: 4082778 - RNA, 19 nt, Streptococcus pneumoniae R6
aagcuggcuaauaauucca

SEQ ID NO: 4082779 - RNA, 15 nt, Streptococcus pneumoniae R6
aagcuggcuacagau

SEQ ID NO: 4082780 - RNA, 16 nt, Streptococcus pneumoniae R6
aagcuggcuugagguc

SEQ ID NO: 4082781 - RNA, 19 nt, Streptococcus pneumoniae R6
aagcuggcuugagguccca

SEQ ID NO: 4082782 - RNA, 13 nt, Streptococcus pneumoniae R6
aagcuggucuuuu

SEQ ID NO: 4082783 - RNA, 21 nt, Streptococcus pneumoniae R6
aagcuggucuuuuuugagaaa

SEQ ID NO: 4082784 - RNA, 16 nt, Streptococcus pneumoniae R6
aagcugucaagaaauu

SEQ ID NO: 4082785 - RNA, 18 nt, Streptococcus pneumoniae R6
aagcuguuaaaaacucag

SEQ ID NO: 4082786 - RNA, 17 nt, Streptococcus pneumoniae R6
aagcuuccaauaauaga

SEQ ID NO: 4082787 - RNA, 20 nt, Streptococcus pneumoniae R6
aagcuuccaauaauagaaaa

SEQ ID NO: 4082788 - RNA, 17 nt, Streptococcus pneumoniae R6
aagcuucgcagaccaca

SEQ ID NO: 4082789 - RNA, 18 nt, Streptococcus pneumoniae R6
aagcuuguuuaaaaucuc

SEQ ID NO: 4082790 - RNA, 21 nt, Streptococcus pneumoniae R6
aagcuuguuuaaaaucucuuu

SEQ ID NO: 4082791 - RNA, 22 nt, Streptococcus pneumoniae R6
aagcuuguuuaaaaucucuuua

SEQ ID NO: 4082792 - RNA, 24 nt, Streptococcus pneumoniae R6
aagcuuguuuaaaaucucuuuauu

SEQ ID NO: 4082793 - RNA, 20 nt, Streptococcus pneumoniae R6
aagcuuuaagacagaugaca

SEQ ID NO: 4082794 - RNA, 20 nt, Streptococcus pneumoniae R6
aagcuuuauugucucuaaaa

SEQ ID NO: 4082795 - RNA, 16 nt, Streptococcus pneumoniae R6
aagcuuuugaguacuu

SEQ ID NO: 4082796 - RNA, 22 nt, Streptococcus pneumoniae R6
aaggaaaauugauuuauagaaa

SEQ ID NO: 4082797 - RNA, 15 nt, Streptococcus pneumoniae R6
aaggaaaccuaauca

SEQ ID NO: 4082798 - RNA, 17 nt, Streptococcus pneumoniae R6
aaggaagaagcuguaaa

SEQ ID NO: 4082799 - RNA, 19 nt, Streptococcus pneumoniae R6
aaggaagauguaaaaguuu

SEQ ID NO: 4082800 - RNA, 13 nt, Streptococcus pneumoniae R6
aaggaaguugagu

SEQ ID NO: 4082801 - RNA, 13 nt, Streptococcus pneumoniae R6
aaggaauuuuaga

SEQ ID NO: 4082802 - RNA, 17 nt, Streptococcus pneumoniae R6
aaggaauuuuagaaggu

SEQ ID NO: 4082803 - RNA, 16 nt, Streptococcus pneumoniae R6
aaggacaccagcacag

SEQ ID NO: 4082804 - RNA, 16 nt, Streptococcus pneumoniae R6
aaggacacgcuucuuu

SEQ ID NO: 4082805 - RNA, 23 nt, Streptococcus pneumoniae R6
aaggaccugaguucauuacucaa

SEQ ID NO: 4082806 - RNA, 14 nt, Streptococcus pneumoniae R6
aaggacuuagcucu

SEQ ID NO: 4082807 - RNA, 13 nt, Streptococcus pneumoniae R6
aaggagaaaaaau

SEQ ID NO: 4082808 - RNA, 22 nt, Streptococcus pneumoniae R6
aaggagagucagggucaaagua

SEQ ID NO: 4082809 - RNA, 17 nt, Streptococcus pneumoniae R6
aaggagccagcugaaaa

SEQ ID NO: 4082810 - RNA, 14 nt, Streptococcus pneumoniae R6
aaggaggcaaagaa

SEQ ID NO: 4082811 - RNA, 18 nt, Streptococcus pneumoniae R6
aaggaggugauaaagucc

SEQ ID NO: 4082812 - RNA, 22 nt, Streptococcus pneumoniae R6
aaggaguugucuauaguuaaau

SEQ ID NO: 4082813 - RNA, 13 nt, Streptococcus pneumoniae R6
aaggauaaaaagu

SEQ ID NO: 4082814 - RNA, 21 nt, Streptococcus pneumoniae R6
aaggauagcuccuccaagucc

SEQ ID NO: 4082815 - RNA, 13 nt, Streptococcus pneumoniae R6
aaggaugacaaua

SEQ ID NO: 4082816 - RNA, 16 nt, Streptococcus pneumoniae R6
aaggauuguaggugua

SEQ ID NO: 4082817 - RNA, 20 nt, Streptococcus pneumoniae R6
aaggauuucugcuuuuuaua

SEQ ID NO: 4082818 - RNA, 19 nt, Streptococcus pneumoniae R6
aaggauuucuuugaaaucu

SEQ ID NO: 4082819 - RNA, 21 nt, Streptococcus pneumoniae R6
aaggauuuugugaauuuucaa

SEQ ID NO: 4082820 - RNA, 14 nt, Streptococcus pneumoniae R6
aaggcaauuaaaag

SEQ ID NO: 4082821 - RNA, 17 nt, Streptococcus pneumoniae R6
aaggcagauucucuauc

SEQ ID NO: 4082822 - RNA, 14 nt, Streptococcus pneumoniae R6
aaggcagauuucaa

SEQ ID NO: 4082823 - RNA, 18 nt, Streptococcus pneumoniae R6
aaggcaucuuaacauucu

SEQ ID NO: 4082824 - RNA, 22 nt, Streptococcus pneumoniae R6
aaggcaucuugucaaagaguug

SEQ ID NO: 4082825 - RNA, 14 nt, Streptococcus pneumoniae R6
aaggcauuuuuugu

SEQ ID NO: 4082826 - RNA, 23 nt, Streptococcus pneumoniae R6
aaggcccccuuguaguucucaau

SEQ ID NO: 4082827 - RNA, 17 nt, Streptococcus pneumoniae R6
aaggcgaagcugacgug

SEQ ID NO: 4082828 - RNA, 21 nt, Streptococcus pneumoniae R6
aaggcuauagucaaagggaaa

SEQ ID NO: 4082829 - RNA, 15 nt, Streptococcus pneumoniae R6
aaggcucauaguuua

SEQ ID NO: 4082830 - RNA, 13 nt, Streptococcus pneumoniae R6
aaggcugaaauug

SEQ ID NO: 4082831 - RNA, 19 nt, Streptococcus pneumoniae R6
aaggcugcgcaacacacug

SEQ ID NO: 4082832 - RNA, 16 nt, Streptococcus pneumoniae R6
aaggcuggucgagaag

SEQ ID NO: 4082833 - RNA, 13 nt, Streptococcus pneumoniae R6
aaggcuguauaau

SEQ ID NO: 4082834 - RNA, 19 nt, Streptococcus pneumoniae R6
aaggcuugaguauaugggu

SEQ ID NO: 4082835 - RNA, 13 nt, Streptococcus pneumoniae R6
aaggcuuuaccaa

SEQ ID NO: 4082836 - RNA, 17 nt, Streptococcus pneumoniae R6
aaggcuuuaccaaaaau

SEQ ID NO: 4082837 - RNA, 23 nt, Streptococcus pneumoniae R6
aaggcuuuauucuuaaauccaca

SEQ ID NO: 4082838 - RNA, 23 nt, Streptococcus pneumoniae R6
aagggaagguguuaaagauuccu

SEQ ID NO: 4082839 - RNA, 12 nt, Streptococcus pneumoniae R6
aagggauagcga

SEQ ID NO: 4082840 - RNA, 19 nt, Streptococcus pneumoniae R6
aagggaugaaaccccaaga

SEQ ID NO: 4082841 - RNA, 16 nt, Streptococcus pneumoniae R6
aagggcaccaaacuua

SEQ ID NO: 4082842 - RNA, 14 nt, Streptococcus pneumoniae R6
aagggcaguaccug

SEQ ID NO: 4082843 - RNA, 20 nt, Streptococcus pneumoniae R6
aagggcuuuucuaucacucc

SEQ ID NO: 4082844 - RNA, 16 nt, Streptococcus pneumoniae R6
aagguaaaaccaauau

SEQ ID NO: 4082845 - RNA, 12 nt, Streptococcus pneumoniae R6
aagguaaaauau

SEQ ID NO: 4082846 - RNA, 22 nt, Streptococcus pneumoniae R6
aagguaauccaauugaggaagu

SEQ ID NO: 4082847 - RNA, 14 nt, Streptococcus pneumoniae R6
aagguagagacaga

SEQ ID NO: 4082848 - RNA, 19 nt, Streptococcus pneumoniae R6
aagguagagacagaagaua

SEQ ID NO: 4082849 - RNA, 16 nt, Streptococcus pneumoniae R6
aagguaggagugaaaa

SEQ ID NO: 4082850 - RNA, 17 nt, Streptococcus pneumoniae R6
aagguaggagugaaaaa

SEQ ID NO: 4082851 - RNA, 15 nt, Streptococcus pneumoniae R6
aagguauucauaaaa

SEQ ID NO: 4082852 - RNA, 18 nt, Streptococcus pneumoniae R6
aagguauucauaaaauac

SEQ ID NO: 4082853 - RNA, 22 nt, Streptococcus pneumoniae R6
aaggucaaaauuccuaaaauaa

SEQ ID NO: 4082854 - RNA, 14 nt, Streptococcus pneumoniae R6
aaggucaagagaaa

SEQ ID NO: 4082855 - RNA, 15 nt, Streptococcus pneumoniae R6
aaggucaagagaaaa

SEQ ID NO: 4082856 - RNA, 15 nt, Streptococcus pneumoniae R6
aagguccagaagccu

SEQ ID NO: 4082857 - RNA, 20 nt, Streptococcus pneumoniae R6
aagguccagcguccagcagc

SEQ ID NO: 4082858 - RNA, 18 nt, Streptococcus pneumoniae R6
aaggucugacaggcuauu

SEQ ID NO: 4082859 - RNA, 17 nt, Streptococcus pneumoniae R6
aaggucuuucaagcgaa

SEQ ID NO: 4082860 - RNA, 22 nt, Streptococcus pneumoniae R6
aaggucuuucaagcgaacaucu

SEQ ID NO: 4082861 - RNA, 21 nt, Streptococcus pneumoniae R6
aaggucuuuugucuugcuugc

SEQ ID NO: 4082862 - RNA, 14 nt, Streptococcus pneumoniae R6
aaggugaaaagggu

SEQ ID NO: 4082863 - RNA, 21 nt, Streptococcus pneumoniae R6
aaggugagggcugagaaggcu

SEQ ID NO: 4082864 - RNA, 19 nt, Streptococcus pneumoniae R6
aagguuauaccaaaaaaac

SEQ ID NO: 4082865 - RNA, 16 nt, Streptococcus pneumoniae R6
aagguucaaucauuuu

SEQ ID NO: 4082866 - RNA, 19 nt, Streptococcus pneumoniae R6
aagguucaaucauuuugua

SEQ ID NO: 4082867 - RNA, 18 nt, Streptococcus pneumoniae R6
aagguugaugaguaaguu

SEQ ID NO: 4082868 - RNA, 19 nt, Streptococcus pneumoniae R6
aagguugaugaguaaguuu

SEQ ID NO: 4082869 - RNA, 24 nt, Streptococcus pneumoniae R6
aagguuuagcaaaagcagcgacau

SEQ ID NO: 4082870 - RNA, 17 nt, Streptococcus pneumoniae R6
aagguuuccaaaccaac

SEQ ID NO: 4082871 - RNA, 15 nt, Streptococcus pneumoniae R6
aagguuuuaaacaaa

SEQ ID NO: 4082872 - RNA, 16 nt, Streptococcus pneumoniae R6
aagguuuuaccuucaa

SEQ ID NO: 4082873 - RNA, 17 nt, Streptococcus pneumoniae R6
aagguuuuaucugagau

SEQ ID NO: 4082874 - RNA, 22 nt, Streptococcus pneumoniae R6
aagguuuuugaaagucauauuu

SEQ ID NO: 4082875 - RNA, 13 nt, Streptococcus pneumoniae R6
aaguaaagaguca

SEQ ID NO: 4082876 - RNA, 22 nt, Streptococcus pneumoniae R6
aaguaagagaaacucaaaugua

SEQ ID NO: 4082877 - RNA, 15 nt, Streptococcus pneumoniae R6
aaguaaguacaugca

SEQ ID NO: 4082878 - RNA, 18 nt, Streptococcus pneumoniae R6
aaguaaguacaugcaaag

SEQ ID NO: 4082879 - RNA, 16 nt, Streptococcus pneumoniae R6
aaguaaucucugauaa

SEQ ID NO: 4082880 - RNA, 12 nt, Streptococcus pneumoniae R6
aaguacauguca

SEQ ID NO: 4082881 - RNA, 14 nt, Streptococcus pneumoniae R6
aaguaccugacgaa

SEQ ID NO: 4082882 - RNA, 16 nt, Streptococcus pneumoniae R6
aaguagcaaaacacua

SEQ ID NO: 4082883 - RNA, 17 nt, Streptococcus pneumoniae R6
aaguaggacgauaaaaa

SEQ ID NO: 4082884 - RNA, 18 nt, Streptococcus pneumoniae R6
aaguaggccaaacuugaa

SEQ ID NO: 4082885 - RNA, 21 nt, Streptococcus pneumoniae R6
aaguaggucccaucauagccg

SEQ ID NO: 4082886 - RNA, 22 nt, Streptococcus pneumoniae R6
aaguaggucccaucauagccga

SEQ ID NO: 4082887 - RNA, 20 nt, Streptococcus pneumoniae R6
aaguaguguuagauuaggaa

SEQ ID NO: 4082888 - RNA, 18 nt, Streptococcus pneumoniae R6
aaguaguugacaaaguuu

SEQ ID NO: 4082889 - RNA, 19 nt, Streptococcus pneumoniae R6
aaguauacucuaauugaaa

SEQ ID NO: 4082890 - RNA, 20 nt, Streptococcus pneumoniae R6
aaguauacucuaauugaaaa

SEQ ID NO: 4082891 - RNA, 23 nt, Streptococcus pneumoniae R6
aaguauagucaauuaguuuaaga

SEQ ID NO: 4082892 - RNA, 17 nt, Streptococcus pneumoniae R6
aaguaucuacuuugaaa

SEQ ID NO: 4082893 - RNA, 14 nt, Streptococcus pneumoniae R6
aaguauuaaaauaa

SEQ ID NO: 4082894 - RNA, 17 nt, Streptococcus pneumoniae R6
aaguauuaaucacuaau

SEQ ID NO: 4082895 - RNA, 15 nt, Streptococcus pneumoniae R6
aaguauuguaagaau

SEQ ID NO: 4082896 - RNA, 17 nt, Streptococcus pneumoniae R6
aaguauuguaagaauuu

SEQ ID NO: 4082897 - RNA, 21 nt, Streptococcus pneumoniae R6
aaguauuguaagaauuugauu

SEQ ID NO: 4082898 - RNA, 22 nt, Streptococcus pneumoniae R6
aaguauuguaagaauuugauua

SEQ ID NO: 4082899 - RNA, 17 nt, Streptococcus pneumoniae R6
aagucaaagccaaucaa

SEQ ID NO: 4082900 - RNA, 18 nt, Streptococcus pneumoniae R6
aagucaaauuaauuuaua

SEQ ID NO: 4082901 - RNA, 17 nt, Streptococcus pneumoniae R6
aagucaacaucucuugu

SEQ ID NO: 4082902 - RNA, 13 nt, Streptococcus pneumoniae R6
aagucagcuaagc

SEQ ID NO: 4082903 - RNA, 21 nt, Streptococcus pneumoniae R6
aagucagcuaagcucgagaaa

SEQ ID NO: 4082904 - RNA, 22 nt, Streptococcus pneumoniae R6
aagucagcuaagcucgagaaag

SEQ ID NO: 4082905 - RNA, 16 nt, Streptococcus pneumoniae R6
aagucagcucaaaaca

SEQ ID NO: 4082906 - RNA, 17 nt, Streptococcus pneumoniae R6
aagucagcucaaaacac

SEQ ID NO: 4082907 - RNA, 18 nt, Streptococcus pneumoniae R6
aagucagcucaaaacaca

SEQ ID NO: 4082908 - RNA, 21 nt, Streptococcus pneumoniae R6
aagucagcucaaaacacuguu

SEQ ID NO: 4082909 - RNA, 22 nt, Streptococcus pneumoniae R6
aagucagcucaaaacacuguuu

SEQ ID NO: 4082910 - RNA, 19 nt, Streptococcus pneumoniae R6
aagucagcucaaaacagug

SEQ ID NO: 4082911 - RNA, 20 nt, Streptococcus pneumoniae R6
aagucagcucaaaacauguu

SEQ ID NO: 4082912 - RNA, 15 nt, Streptococcus pneumoniae R6
aagucaggcauaccg

SEQ ID NO: 4082913 - RNA, 17 nt, Streptococcus pneumoniae R6
aagucagucacauauau

SEQ ID NO: 4082914 - RNA, 15 nt, Streptococcus pneumoniae R6
aagucauaaacaucu

SEQ ID NO: 4082915 - RNA, 14 nt, Streptococcus pneumoniae R6
aagucauacuuucu

SEQ ID NO: 4082916 - RNA, 14 nt, Streptococcus pneumoniae R6
aagucaucaaaaau

SEQ ID NO: 4082917 - RNA, 18 nt, Streptococcus pneumoniae R6
aagucaucuaucaaaaga

SEQ ID NO: 4082918 - RNA, 22 nt, Streptococcus pneumoniae R6
aaguccaaagaugagaggagaa

SEQ ID NO: 4082919 - RNA, 17 nt, Streptococcus pneumoniae R6
aaguccauaaugucuuc

SEQ ID NO: 4082920 - RNA, 18 nt, Streptococcus pneumoniae R6
aaguccauaaugucuucu

SEQ ID NO: 4082921 - RNA, 21 nt, Streptococcus pneumoniae R6
aaguccauaaugucuucugcu

SEQ ID NO: 4082922 - RNA, 22 nt, Streptococcus pneumoniae R6
aaguccauaaugucuucugcuc

SEQ ID NO: 4082923 - RNA, 22 nt, Streptococcus pneumoniae R6
aaguccauagcgucaaagaagg

SEQ ID NO: 4082924 - RNA, 22 nt, Streptococcus pneumoniae R6
aaguccauauuagggcaaauaa

SEQ ID NO: 4082925 - RNA, 23 nt, Streptococcus pneumoniae R6
aaguccauauuagggcaaauaaa

SEQ ID NO: 4082926 - RNA, 20 nt, Streptococcus pneumoniae R6
aaguccaucguuaaucggag

SEQ ID NO: 4082927 - RNA, 13 nt, Streptococcus pneumoniae R6
aaguccgaaaaau

SEQ ID NO: 4082928 - RNA, 14 nt, Streptococcus pneumoniae R6
aaguccucccacca

SEQ ID NO: 4082929 - RNA, 18 nt, Streptococcus pneumoniae R6
aaguccuuacucaaauaa

SEQ ID NO: 4082930 - RNA, 22 nt, Streptococcus pneumoniae R6
aaguccuucccaucucgugaau

SEQ ID NO: 4082931 - RNA, 21 nt, Streptococcus pneumoniae R6
aagucguucggcuucaucugg

SEQ ID NO: 4082932 - RNA, 13 nt, Streptococcus pneumoniae R6
aagucuagcaauu

SEQ ID NO: 4082933 - RNA, 14 nt, Streptococcus pneumoniae R6
aagucuagcaauuc

SEQ ID NO: 4082934 - RNA, 11 nt, Streptococcus pneumoniae R6
aagucuagcac

SEQ ID NO: 4082935 - RNA, 13 nt, Streptococcus pneumoniae R6
aagucuauuauuu

SEQ ID NO: 4082936 - RNA, 14 nt, Streptococcus pneumoniae R6
aagucucagcaguc

SEQ ID NO: 4082937 - RNA, 19 nt, Streptococcus pneumoniae R6
aagucucagugggcuauuc

SEQ ID NO: 4082938 - RNA, 21 nt, Streptococcus pneumoniae R6
aagucugacgcuggaaauaag

SEQ ID NO: 4082939 - RNA, 18 nt, Streptococcus pneumoniae R6
aagucuguuauuucuuga

SEQ ID NO: 4082940 - RNA, 13 nt, Streptococcus pneumoniae R6
aagucuuauaaua

SEQ ID NO: 4082941 - RNA, 20 nt, Streptococcus pneumoniae R6
aagucuugacaaagaaaaaa

SEQ ID NO: 4082942 - RNA, 17 nt, Streptococcus pneumoniae R6
aagucuugccuucaacc

SEQ ID NO: 4082943 - RNA, 14 nt, Streptococcus pneumoniae R6
aagucuuguuugag

SEQ ID NO: 4082944 - RNA, 18 nt, Streptococcus pneumoniae R6
aagucuuuucggauggcu

SEQ ID NO: 4082945 - RNA, 14 nt, Streptococcus pneumoniae R6
aagugaaaggaaga

SEQ ID NO: 4082946 - RNA, 23 nt, Streptococcus pneumoniae R6
aagugaacaagccuagucuucug

SEQ ID NO: 4082947 - RNA, 22 nt, Streptococcus pneumoniae R6
aagugacagucgcaaagaggaa

SEQ ID NO: 4082948 - RNA, 23 nt, Streptococcus pneumoniae R6
aagugacauaugauugucuccuu

SEQ ID NO: 4082949 - RNA, 16 nt, Streptococcus pneumoniae R6
aagugacuauuaguuu

SEQ ID NO: 4082950 - RNA, 14 nt, Streptococcus pneumoniae R6
aagugauaaugauu

SEQ ID NO: 4082951 - RNA, 19 nt, Streptococcus pneumoniae R6
aagugauuuguuccgauuu

SEQ ID NO: 4082952 - RNA, 14 nt, Streptococcus pneumoniae R6
aagugcguugauaa

SEQ ID NO: 4082953 - RNA, 13 nt, Streptococcus pneumoniae R6
aagugcucacaga

SEQ ID NO: 4082954 - RNA, 15 nt, Streptococcus pneumoniae R6
aagugcuucuuugua

SEQ ID NO: 4082955 - RNA, 16 nt, Streptococcus pneumoniae R6
aagugcuuuugugauu

SEQ ID NO: 4082956 - RNA, 23 nt, Streptococcus pneumoniae R6
aagugcuuuugugauuuuaaauu

SEQ ID NO: 4082957 - RNA, 14 nt, Streptococcus pneumoniae R6
aaguggcauugcuu

SEQ ID NO: 4082958 - RNA, 19 nt, Streptococcus pneumoniae R6
aaguggcauugcuucauaa

SEQ ID NO: 4082959 - RNA, 15 nt, Streptococcus pneumoniae R6
aagugggaacuagag

SEQ ID NO: 4082960 - RNA, 14 nt, Streptococcus pneumoniae R6
aagugggagaaaag

SEQ ID NO: 4082961 - RNA, 11 nt, Streptococcus pneumoniae R6
aagugucuccc

SEQ ID NO: 4082962 - RNA, 19 nt, Streptococcus pneumoniae R6
aagugucuggaaugauaac

SEQ ID NO: 4082963 - RNA, 23 nt, Streptococcus pneumoniae R6
aaguguuacuaucaaugauuuau

SEQ ID NO: 4082964 - RNA, 23 nt, Streptococcus pneumoniae R6
aaguguugaaaacccuugauacu

SEQ ID NO: 4082965 - RNA, 23 nt, Streptococcus pneumoniae R6
aaguguuuaggcaagugucucug

SEQ ID NO: 4082966 - RNA, 12 nt, Streptococcus pneumoniae R6
aaguuaaaaaaa

SEQ ID NO: 4082967 - RNA, 15 nt, Streptococcus pneumoniae R6
aaguuaaaaaaacua

SEQ ID NO: 4082968 - RNA, 16 nt, Streptococcus pneumoniae R6
aaguuaaaaaaacuau

SEQ ID NO: 4082969 - RNA, 15 nt, Streptococcus pneumoniae R6
aaguuaaaaauccug

SEQ ID NO: 4082970 - RNA, 16 nt, Streptococcus pneumoniae R6
aaguuaaauuauuaaa

SEQ ID NO: 4082971 - RNA, 23 nt, Streptococcus pneumoniae R6
aaguuaaucucuccuuaucaaaa

SEQ ID NO: 4082972 - RNA, 13 nt, Streptococcus pneumoniae R6
aaguuacucuauu

SEQ ID NO: 4082973 - RNA, 16 nt, Streptococcus pneumoniae R6
aaguuacucuauugua

SEQ ID NO: 4082974 - RNA, 14 nt, Streptococcus pneumoniae R6
aaguuagaaauaaa

SEQ ID NO: 4082975 - RNA, 15 nt, Streptococcus pneumoniae R6
aaguuagaaauaaaa

SEQ ID NO: 4082976 - RNA, 13 nt, Streptococcus pneumoniae R6
aaguuagaauaag

SEQ ID NO: 4082977 - RNA, 15 nt, Streptococcus pneumoniae R6
aaguuagaauaagga

SEQ ID NO: 4082978 - RNA, 21 nt, Streptococcus pneumoniae R6
aaguuagaauaaggaaaacau

SEQ ID NO: 4082979 - RNA, 17 nt, Streptococcus pneumoniae R6
aaguuagaauauguaag

SEQ ID NO: 4082980 - RNA, 16 nt, Streptococcus pneumoniae R6
aaguuagacaaauaau

SEQ ID NO: 4082981 - RNA, 15 nt, Streptococcus pneumoniae R6
aaguuagacagaaaa

SEQ ID NO: 4082982 - RNA, 17 nt, Streptococcus pneumoniae R6
aaguuagacagaaaaaa

SEQ ID NO: 4082983 - RNA, 18 nt, Streptococcus pneumoniae R6
aaguuagacagaaaaaau

SEQ ID NO: 4082984 - RNA, 19 nt, Streptococcus pneumoniae R6
aaguuagauuuuuucuguc

SEQ ID NO: 4082985 - RNA, 19 nt, Streptococcus pneumoniae R6
aaguuauuggaacuaaagu

SEQ ID NO: 4082986 - RNA, 23 nt, Streptococcus pneumoniae R6
aaguuauuucuccuaaagaaaaa

SEQ ID NO: 4082987 - RNA, 22 nt, Streptococcus pneumoniae R6
aaguucaacaaaucagaaaagu

SEQ ID NO: 4082988 - RNA, 23 nt, Streptococcus pneumoniae R6
aaguucaacaaaucagaaaagua

SEQ ID NO: 4082989 - RNA, 18 nt, Streptococcus pneumoniae R6
aaguucacguaaauugcc

SEQ ID NO: 4082990 - RNA, 17 nt, Streptococcus pneumoniae R6
aaguucacucaaaccug

SEQ ID NO: 4082991 - RNA, 16 nt, Streptococcus pneumoniae R6
aaguucaucuucaaaa

SEQ ID NO: 4082992 - RNA, 14 nt, Streptococcus pneumoniae R6
aaguucauuuucuu

SEQ ID NO: 4082993 - RNA, 16 nt, Streptococcus pneumoniae R6
aaguucauuuucuuua

SEQ ID NO: 4082994 - RNA, 18 nt, Streptococcus pneumoniae R6
aaguuccucuuuuucccc

SEQ ID NO: 4082995 - RNA, 23 nt, Streptococcus pneumoniae R6
aaguucgaugucaccaaacaaau

SEQ ID NO: 4082996 - RNA, 19 nt, Streptococcus pneumoniae R6
aaguucggccguugauuua

SEQ ID NO: 4082997 - RNA, 15 nt, Streptococcus pneumoniae R6
aaguucuucucuuuu

SEQ ID NO: 4082998 - RNA, 17 nt, Streptococcus pneumoniae R6
aaguucuugacgauauu

SEQ ID NO: 4082999 - RNA, 20 nt, Streptococcus pneumoniae R6
aaguucuuuucauaaagaga

SEQ ID NO: 4083000 - RNA, 19 nt, Streptococcus pneumoniae R6
aaguugauucaugacaucu

SEQ ID NO: 4083001 - RNA, 21 nt, Streptococcus pneumoniae R6
aaguuggaauaguccucccuu

SEQ ID NO: 4083002 - RNA, 20 nt, Streptococcus pneumoniae R6
aaguuguaguacugaacaau

SEQ ID NO: 4083003 - RNA, 22 nt, Streptococcus pneumoniae R6
aaguuguaguacugaacaauga

SEQ ID NO: 4083004 - RNA, 23 nt, Streptococcus pneumoniae R6
aaguuuaacccacuuaucauuau

SEQ ID NO: 4083005 - RNA, 18 nt, Streptococcus pneumoniae R6
aaguuuaauguccaugcu

SEQ ID NO: 4083006 - RNA, 19 nt, Streptococcus pneumoniae R6
aaguuuaauguccaugcuu

SEQ ID NO: 4083007 - RNA, 18 nt, Streptococcus pneumoniae R6
aaguuuagauuaaaaaau

SEQ ID NO: 4083008 - RNA, 19 nt, Streptococcus pneumoniae R6
aaguuuauaucuaauaauu

SEQ ID NO: 4083009 - RNA, 21 nt, Streptococcus pneumoniae R6
aaguuuaucuagaauuucuuu

SEQ ID NO: 4083010 - RNA, 23 nt, Streptococcus pneumoniae R6
aaguuuccgaauaccugaaacca

SEQ ID NO: 4083011 - RNA, 16 nt, Streptococcus pneumoniae R6
aaguuucggcaccaau

SEQ ID NO: 4083012 - RNA, 14 nt, Streptococcus pneumoniae R6
aaguuucuguaauu

SEQ ID NO: 4083013 - RNA, 18 nt, Streptococcus pneumoniae R6
aaguuucuguaauuucua

SEQ ID NO: 4083014 - RNA, 13 nt, Streptococcus pneumoniae R6
aaguuugcaaagu

SEQ ID NO: 4083015 - RNA, 17 nt, Streptococcus pneumoniae R6
aaguuuggcagacacca

SEQ ID NO: 4083016 - RNA, 19 nt, Streptococcus pneumoniae R6
aaguuugguuuuuugacug

SEQ ID NO: 4083017 - RNA, 21 nt, Streptococcus pneumoniae R6
aaguuuucaaaguuccgaaaa

SEQ ID NO: 4083018 - RNA, 20 nt, Streptococcus pneumoniae R6
aaguuuuuccaucuuuuauu

SEQ ID NO: 4083019 - RNA, 21 nt, Streptococcus pneumoniae R6
aaguuuuucccaccuuuucuc

SEQ ID NO: 4083020 - RNA, 21 nt, Streptococcus pneumoniae R6
aaguuuuugguaauuuucuuu

SEQ ID NO: 4083021 - RNA, 14 nt, Streptococcus pneumoniae R6
aaguuuuuugauuu

SEQ ID NO: 4083022 - RNA, 19 nt, Streptococcus pneumoniae R6
aaguuuuuugauuucuucu

SEQ ID NO: 4083023 - RNA, 19 nt, Streptococcus pneumoniae R6
aauaaaaagcauaguauca

SEQ ID NO: 4083024 - RNA, 13 nt, Streptococcus pneumoniae R6
aauaaaacaaaaa

SEQ ID NO: 4083025 - RNA, 14 nt, Streptococcus pneumoniae R6
aauaaaacaaaaaa

SEQ ID NO: 4083026 - RNA, 16 nt, Streptococcus pneumoniae R6
aauaaaacaaaaaaga

SEQ ID NO: 4083027 - RNA, 20 nt, Streptococcus pneumoniae R6
aauaaaacgcauaauaccaa

SEQ ID NO: 4083028 - RNA, 19 nt, Streptococcus pneumoniae R6
aauaaaacgcaucauauca

SEQ ID NO: 4083029 - RNA, 13 nt, Streptococcus pneumoniae R6
aauaaaacuuuua

SEQ ID NO: 4083030 - RNA, 22 nt, Streptococcus pneumoniae R6
aauaaaacuuuuaaaauccaua

SEQ ID NO: 4083031 - RNA, 16 nt, Streptococcus pneumoniae R6
aauaaaaugaaauaau

SEQ ID NO: 4083032 - RNA, 19 nt, Streptococcus pneumoniae R6
aauaaaauuccuuuaaaaa

SEQ ID NO: 4083033 - RNA, 19 nt, Streptococcus pneumoniae R6
aauaaaauuuuuuucaaau

SEQ ID NO: 4083034 - RNA, 16 nt, Streptococcus pneumoniae R6
aauaaacuggguugaa

SEQ ID NO: 4083035 - RNA, 17 nt, Streptococcus pneumoniae R6
aauaaacuggguugaag

SEQ ID NO: 4083036 - RNA, 13 nt, Streptococcus pneumoniae R6
aauaaagaaacuu

SEQ ID NO: 4083037 - RNA, 16 nt, Streptococcus pneumoniae R6
aauaaagacacuaaga

SEQ ID NO: 4083038 - RNA, 16 nt, Streptococcus pneumoniae R6
aauaaagccuuucgaa

SEQ ID NO: 4083039 - RNA, 20 nt, Streptococcus pneumoniae R6
aauaaagucaacagaguuuc

SEQ ID NO: 4083040 - RNA, 21 nt, Streptococcus pneumoniae R6
aauaaaucauugauaguaaca

SEQ ID NO: 4083041 - RNA, 15 nt, Streptococcus pneumoniae R6
aauaaauccagcuga

SEQ ID NO: 4083042 - RNA, 16 nt, Streptococcus pneumoniae R6
aauaacaaaccaagaa

SEQ ID NO: 4083043 - RNA, 16 nt, Streptococcus pneumoniae R6
aauaacaaagucuggu

SEQ ID NO: 4083044 - RNA, 17 nt, Streptococcus pneumoniae R6
aauaacaaagucugguu

SEQ ID NO: 4083045 - RNA, 18 nt, Streptococcus pneumoniae R6
aauaacacgagaaacaau

SEQ ID NO: 4083046 - RNA, 15 nt, Streptococcus pneumoniae R6
aauaacacuccauuu

SEQ ID NO: 4083047 - RNA, 14 nt, Streptococcus pneumoniae R6
aauaacauuuccuc

SEQ ID NO: 4083048 - RNA, 22 nt, Streptococcus pneumoniae R6
aauaaccacuagcagccacuuu

SEQ ID NO: 4083049 - RNA, 17 nt, Streptococcus pneumoniae R6
aauaacuucaauaucuu

SEQ ID NO: 4083050 - RNA, 11 nt, Streptococcus pneumoniae R6
aauaagaauac

SEQ ID NO: 4083051 - RNA, 17 nt, Streptococcus pneumoniae R6
aauaagauaugaacaaa

SEQ ID NO: 4083052 - RNA, 17 nt, Streptococcus pneumoniae R6
aauaagaugagaacaaa

SEQ ID NO: 4083053 - RNA, 21 nt, Streptococcus pneumoniae R6
aauaagaugcgaacaaaucaa

SEQ ID NO: 4083054 - RNA, 22 nt, Streptococcus pneumoniae R6
aauaagaugugaacaacucuau

SEQ ID NO: 4083055 - RNA, 21 nt, Streptococcus pneumoniae R6
aauaagauuccacguuucuaa

SEQ ID NO: 4083056 - RNA, 23 nt, Streptococcus pneumoniae R6
aauaagcccgaaaaauuucucug

SEQ ID NO: 4083057 - RNA, 20 nt, Streptococcus pneumoniae R6
aauaagccgaagccaaucaa

SEQ ID NO: 4083058 - RNA, 13 nt, Streptococcus pneumoniae R6
aauaaggaaaaca

SEQ ID NO: 4083059 - RNA, 20 nt, Streptococcus pneumoniae R6
aauaagguugcauagaccaa

SEQ ID NO: 4083060 - RNA, 20 nt, Streptococcus pneumoniae R6
aauaagguuuagcaaaagca

SEQ ID NO: 4083061 - RNA, 23 nt, Streptococcus pneumoniae R6
aauaaguaguguuagauuaggaa

SEQ ID NO: 4083062 - RNA, 14 nt, Streptococcus pneumoniae R6
aauaaguccgaaaa

SEQ ID NO: 4083063 - RNA, 18 nt, Streptococcus pneumoniae R6
aauaaguccgaaaaauuu

SEQ ID NO: 4083064 - RNA, 22 nt, Streptococcus pneumoniae R6
aauaaguccgaaaaauuucucu

SEQ ID NO: 4083065 - RNA, 15 nt, Streptococcus pneumoniae R6
aauaauacaaaaaau

SEQ ID NO: 4083066 - RNA, 16 nt, Streptococcus pneumoniae R6
aauaauacaaaaaaua

SEQ ID NO: 4083067 - RNA, 14 nt, Streptococcus pneumoniae R6
aauaauagaaaaca

SEQ ID NO: 4083068 - RNA, 18 nt, Streptococcus pneumoniae R6
aauaaucaaaauauguuu

SEQ ID NO: 4083069 - RNA, 13 nt, Streptococcus pneumoniae R6
aauaauccuaacu

SEQ ID NO: 4083070 - RNA, 16 nt, Streptococcus pneumoniae R6
aauaaucggaagcagc

SEQ ID NO: 4083071 - RNA, 13 nt, Streptococcus pneumoniae R6
aauaaugaagaca

SEQ ID NO: 4083072 - RNA, 19 nt, Streptococcus pneumoniae R6
aauaaugaagacaucauau

SEQ ID NO: 4083073 - RNA, 20 nt, Streptococcus pneumoniae R6
aauaaugaagacaucauaua

SEQ ID NO: 4083074 - RNA, 17 nt, Streptococcus pneumoniae R6
aauaauguuaaccacaa

SEQ ID NO: 4083075 - RNA, 22 nt, Streptococcus pneumoniae R6
aauaauguuaaccacaaaaagu

SEQ ID NO: 4083076 - RNA, 13 nt, Streptococcus pneumoniae R6
aauaauuaaaaug

SEQ ID NO: 4083077 - RNA, 23 nt, Streptococcus pneumoniae R6
aauaauugacgaagaaaccaagc

SEQ ID NO: 4083078 - RNA, 14 nt, Streptococcus pneumoniae R6
aauaauuuauaaaa

SEQ ID NO: 4083079 - RNA, 17 nt, Streptococcus pneumoniae R6
aauaauuucaaaaucuu

SEQ ID NO: 4083080 - RNA, 13 nt, Streptococcus pneumoniae R6
aauaauuucuuuu

SEQ ID NO: 4083081 - RNA, 14 nt, Streptococcus pneumoniae R6
aauaauuucuuuuu

SEQ ID NO: 4083082 - RNA, 13 nt, Streptococcus pneumoniae R6
aauaauuuuaacu

SEQ ID NO: 4083083 - RNA, 17 nt, Streptococcus pneumoniae R6
aauaauuuugauucaga

SEQ ID NO: 4083084 - RNA, 20 nt, Streptococcus pneumoniae R6
aauaauuuuguuaagacacu

SEQ ID NO: 4083085 - RNA, 23 nt, Streptococcus pneumoniae R6
aauacaaaaaagccaaauccgcu

SEQ ID NO: 4083086 - RNA, 16 nt, Streptococcus pneumoniae R6
aauacaaaaaauaguc

SEQ ID NO: 4083087 - RNA, 13 nt, Streptococcus pneumoniae R6
aauacaaaaacaa

SEQ ID NO: 4083088 - RNA, 20 nt, Streptococcus pneumoniae R6
aauacaaaaaucuaagauaa

SEQ ID NO: 4083089 - RNA, 15 nt, Streptococcus pneumoniae R6
aauacaaauuguaag

SEQ ID NO: 4083090 - RNA, 14 nt, Streptococcus pneumoniae R6
aauacaacaggaaa

SEQ ID NO: 4083091 - RNA, 18 nt, Streptococcus pneumoniae R6
aauacaagcucaucuuug

SEQ ID NO: 4083092 - RNA, 17 nt, Streptococcus pneumoniae R6
aauacagaacuaaaucu

SEQ ID NO: 4083093 - RNA, 14 nt, Streptococcus pneumoniae R6
aauacagauaaaaa

SEQ ID NO: 4083094 - RNA, 16 nt, Streptococcus pneumoniae R6
aauacagauaaaaauc

SEQ ID NO: 4083095 - RNA, 16 nt, Streptococcus pneumoniae R6
aauacaggaaaaccag

SEQ ID NO: 4083096 - RNA, 23 nt, Streptococcus pneumoniae R6
aauacauauucccacaauaaaac

SEQ ID NO: 4083097 - RNA, 17 nt, Streptococcus pneumoniae R6
aauacaugcaaguagaa

SEQ ID NO: 4083098 - RNA, 16 nt, Streptococcus pneumoniae R6
aauacauuuuguaaaa

SEQ ID NO: 4083099 - RNA, 18 nt, Streptococcus pneumoniae R6
aauacauuuuguaaaaaa

SEQ ID NO: 4083100 - RNA, 21 nt, Streptococcus pneumoniae R6
aauaccaaagaagucaccaua

SEQ ID NO: 4083101 - RNA, 18 nt, Streptococcus pneumoniae R6
aauaccaaggcaucacga

SEQ ID NO: 4083102 - RNA, 17 nt, Streptococcus pneumoniae R6
aauaccaauaaaucgcu

SEQ ID NO: 4083103 - RNA, 18 nt, Streptococcus pneumoniae R6
aauacccauuuauggaaa

SEQ ID NO: 4083104 - RNA, 19 nt, Streptococcus pneumoniae R6
aauacccccuuaaaaccau

SEQ ID NO: 4083105 - RNA, 16 nt, Streptococcus pneumoniae R6
aauaccguuaaagcau

SEQ ID NO: 4083106 - RNA, 21 nt, Streptococcus pneumoniae R6
aauacgaagggcaggaaaaag

SEQ ID NO: 4083107 - RNA, 18 nt, Streptococcus pneumoniae R6
aauacgccaaaaccucua

SEQ ID NO: 4083108 - RNA, 22 nt, Streptococcus pneumoniae R6
aauacgucggaacaucuuuucc

SEQ ID NO: 4083109 - RNA, 20 nt, Streptococcus pneumoniae R6
aauacguuuucaaagcuacu

SEQ ID NO: 4083110 - RNA, 16 nt, Streptococcus pneumoniae R6
aauacuaaaauauuuc

SEQ ID NO: 4083111 - RNA, 18 nt, Streptococcus pneumoniae R6
aauacuaaaauauuucua

SEQ ID NO: 4083112 - RNA, 16 nt, Streptococcus pneumoniae R6
aauacuaaggaaaguc

SEQ ID NO: 4083113 - RNA, 19 nt, Streptococcus pneumoniae R6
aauacuaaggaaagucaaa

SEQ ID NO: 4083114 - RNA, 13 nt, Streptococcus pneumoniae R6
aauacuacaauaa

SEQ ID NO: 4083115 - RNA, 17 nt, Streptococcus pneumoniae R6
aauacucaaugaaaauc

SEQ ID NO: 4083116 - RNA, 19 nt, Streptococcus pneumoniae R6
aauacucaaugaaaaucaa

SEQ ID NO: 4083117 - RNA, 17 nt, Streptococcus pneumoniae R6
aauacucugugaaaauc

SEQ ID NO: 4083118 - RNA, 14 nt, Streptococcus pneumoniae R6
aauacugaaacaac

SEQ ID NO: 4083119 - RNA, 17 nt, Streptococcus pneumoniae R6
aauacugauaaaaacau

SEQ ID NO: 4083120 - RNA, 16 nt, Streptococcus pneumoniae R6
aauacugauguaacug

SEQ ID NO: 4083121 - RNA, 23 nt, Streptococcus pneumoniae R6
aauacuguggaauauagaggaua

SEQ ID NO: 4083122 - RNA, 12 nt, Streptococcus pneumoniae R6
aauacuucaaca

SEQ ID NO: 4083123 - RNA, 15 nt, Streptococcus pneumoniae R6
aauacuugaacuauu

SEQ ID NO: 4083124 - RNA, 13 nt, Streptococcus pneumoniae R6
aauacuuuuuccu

SEQ ID NO: 4083125 - RNA, 20 nt, Streptococcus pneumoniae R6
aauacuuuuucguuugguaa

SEQ ID NO: 4083126 - RNA, 13 nt, Streptococcus pneumoniae R6
aauagaaaaaauc

SEQ ID NO: 4083127 - RNA, 13 nt, Streptococcus pneumoniae R6
aauagaaaacaaa

SEQ ID NO: 4083128 - RNA, 19 nt, Streptococcus pneumoniae R6
aauagaaacaaaauauaua

SEQ ID NO: 4083129 - RNA, 14 nt, Streptococcus pneumoniae R6
aauagaagauaaag

SEQ ID NO: 4083130 - RNA, 16 nt, Streptococcus pneumoniae R6
aauagaagauuuccuc

SEQ ID NO: 4083131 - RNA, 21 nt, Streptococcus pneumoniae R6
aauagaagauuuccuccauaa

SEQ ID NO: 4083132 - RNA, 20 nt, Streptococcus pneumoniae R6
aauagaaguggauuuucuuc

SEQ ID NO: 4083133 - RNA, 14 nt, Streptococcus pneumoniae R6
aauagaaguucaau

SEQ ID NO: 4083134 - RNA, 24 nt, Streptococcus pneumoniae R6
aauagacuauaucauauagauaaa

SEQ ID NO: 4083135 - RNA, 15 nt, Streptococcus pneumoniae R6
aauagauaauuuaaa

SEQ ID NO: 4083136 - RNA, 22 nt, Streptococcus pneumoniae R6
aauagauaauuuaaaacucauu

SEQ ID NO: 4083137 - RNA, 20 nt, Streptococcus pneumoniae R6
aauagauguuaagcuccaau

SEQ ID NO: 4083138 - RNA, 14 nt, Streptococcus pneumoniae R6
aauagcaaggauga

SEQ ID NO: 4083139 - RNA, 15 nt, Streptococcus pneumoniae R6
aauagcaaggaugag

SEQ ID NO: 4083140 - RNA, 17 nt, Streptococcus pneumoniae R6
aauagcacuuaaaaagu

SEQ ID NO: 4083141 - RNA, 16 nt, Streptococcus pneumoniae R6
aauagcagaaaaauga

SEQ ID NO: 4083142 - RNA, 19 nt, Streptococcus pneumoniae R6
aauagcagagacauuagaa

SEQ ID NO: 4083143 - RNA, 16 nt, Streptococcus pneumoniae R6
aauagcauccaccacu

SEQ ID NO: 4083144 - RNA, 12 nt, Streptococcus pneumoniae R6
aauagccaagac

SEQ ID NO: 4083145 - RNA, 15 nt, Streptococcus pneumoniae R6
aauagcccacuguga

SEQ ID NO: 4083146 - RNA, 17 nt, Streptococcus pneumoniae R6
aauagcgaugaagagag

SEQ ID NO: 4083147 - RNA, 15 nt, Streptococcus pneumoniae R6
aauagcuacagucau

SEQ ID NO: 4083148 - RNA, 23 nt, Streptococcus pneumoniae R6
aauagcuaguagggaaaccacua

SEQ ID NO: 4083149 - RNA, 16 nt, Streptococcus pneumoniae R6
aauagcucaaaagcuu

SEQ ID NO: 4083150 - RNA, 18 nt, Streptococcus pneumoniae R6
aauagcugaacccuuguc

SEQ ID NO: 4083151 - RNA, 18 nt, Streptococcus pneumoniae R6
aauagcugcggcuuucuu

SEQ ID NO: 4083152 - RNA, 13 nt, Streptococcus pneumoniae R6
aauagcuuaaaau

SEQ ID NO: 4083153 - RNA, 16 nt, Streptococcus pneumoniae R6
aauaggaaucaaccaa

SEQ ID NO: 4083154 - RNA, 19 nt, Streptococcus pneumoniae R6
aauaggaguuuuagaacuc

SEQ ID NO: 4083155 - RNA, 15 nt, Streptococcus pneumoniae R6
aauaggcauaauacu

SEQ ID NO: 4083156 - RNA, 14 nt, Streptococcus pneumoniae R6
aauaggccucuuca

SEQ ID NO: 4083157 - RNA, 17 nt, Streptococcus pneumoniae R6
aauagguacaaaaauau

SEQ ID NO: 4083158 - RNA, 16 nt, Streptococcus pneumoniae R6
aauaguacgaaacaau

SEQ ID NO: 4083159 - RNA, 19 nt, Streptococcus pneumoniae R6
aauaguaugucugaauaua

SEQ ID NO: 4083160 - RNA, 23 nt, Streptococcus pneumoniae R6
aauaguccacugcaauuucuaaa

SEQ ID NO: 4083161 - RNA, 16 nt, Streptococcus pneumoniae R6
aauaguccgacgaagu

SEQ ID NO: 4083162 - RNA, 19 nt, Streptococcus pneumoniae R6
aauagugggaauuuguaaa

SEQ ID NO: 4083163 - RNA, 22 nt, Streptococcus pneumoniae R6
aauagugggaauuuguaaaguu

SEQ ID NO: 4083164 - RNA, 17 nt, Streptococcus pneumoniae R6
aauagugugaccugcuu

SEQ ID NO: 4083165 - RNA, 14 nt, Streptococcus pneumoniae R6
aauaguuaggcaua

SEQ ID NO: 4083166 - RNA, 21 nt, Streptococcus pneumoniae R6
aauaguuaucguaauuaaagu

SEQ ID NO: 4083167 - RNA, 22 nt, Streptococcus pneumoniae R6
aauaguuaucguaauuaaaguu

SEQ ID NO: 4083168 - RNA, 21 nt, Streptococcus pneumoniae R6
aauaguucacugaacuauuuu

SEQ ID NO: 4083169 - RNA, 21 nt, Streptococcus pneumoniae R6
aauaguucagugaacuauuuu

SEQ ID NO: 4083170 - RNA, 16 nt, Streptococcus pneumoniae R6
aauaguugaaaucaag

SEQ ID NO: 4083171 - RNA, 18 nt, Streptococcus pneumoniae R6
aauaguuuaaaacauuuu

SEQ ID NO: 4083172 - RNA, 17 nt, Streptococcus pneumoniae R6
aauaguuuuugcaauau

SEQ ID NO: 4083173 - RNA, 17 nt, Streptococcus pneumoniae R6
aauauaacuaguuaaua

SEQ ID NO: 4083174 - RNA, 23 nt, Streptococcus pneumoniae R6
aauauaacuaguuaauacugacu

SEQ ID NO: 4083175 - RNA, 17 nt, Streptococcus pneumoniae R6
aauauaauaaacuaauu

SEQ ID NO: 4083176 - RNA, 23 nt, Streptococcus pneumoniae R6
aauauaauagauugaaacuagaa

SEQ ID NO: 4083177 - RNA, 16 nt, Streptococcus pneumoniae R6
aauauaauuguaggaa

SEQ ID NO: 4083178 - RNA, 13 nt, Streptococcus pneumoniae R6
aauauacaaaaaa

SEQ ID NO: 4083179 - RNA, 16 nt, Streptococcus pneumoniae R6
aauauagaaguaguuu

SEQ ID NO: 4083180 - RNA, 12 nt, Streptococcus pneumoniae R6
aauauagacaaa

SEQ ID NO: 4083181 - RNA, 14 nt, Streptococcus pneumoniae R6
aauauagaggauau

SEQ ID NO: 4083182 - RNA, 19 nt, Streptococcus pneumoniae R6
aauauagauggucaaaaua

SEQ ID NO: 4083183 - RNA, 23 nt, Streptococcus pneumoniae R6
aauauagccuaagacaaccaaac

SEQ ID NO: 4083184 - RNA, 15 nt, Streptococcus pneumoniae R6
aauauaggccaagau

SEQ ID NO: 4083185 - RNA, 19 nt, Streptococcus pneumoniae R6
aauauagggcuuuuuuugc

SEQ ID NO: 4083186 - RNA, 12 nt, Streptococcus pneumoniae R6
aauauaguaaaa

SEQ ID NO: 4083187 - RNA, 17 nt, Streptococcus pneumoniae R6
aauauaguaaaaugaaa

SEQ ID NO: 4083188 - RNA, 21 nt, Streptococcus pneumoniae R6
aauauagucuauaauggcuug

SEQ ID NO: 4083189 - RNA, 19 nt, Streptococcus pneumoniae R6
aauauagugaaauuaacaa

SEQ ID NO: 4083190 - RNA, 21 nt, Streptococcus pneumoniae R6
aauauagugaaauuaacaaaa

SEQ ID NO: 4083191 - RNA, 23 nt, Streptococcus pneumoniae R6
aauauagugaaauuaacaaaaag

SEQ ID NO: 4083192 - RNA, 11 nt, Streptococcus pneumoniae R6
aauauauaaaa

SEQ ID NO: 4083193 - RNA, 14 nt, Streptococcus pneumoniae R6
aauauauaaaaaau

SEQ ID NO: 4083194 - RNA, 17 nt, Streptococcus pneumoniae R6
aauauauaaaaaauaua

SEQ ID NO: 4083195 - RNA, 19 nt, Streptococcus pneumoniae R6
aauauauuucucaauagca

SEQ ID NO: 4083196 - RNA, 18 nt, Streptococcus pneumoniae R6
aauaucaaaaaaagaagu

SEQ ID NO: 4083197 - RNA, 23 nt, Streptococcus pneumoniae R6
aauaucaaaguuuacgacacauu

SEQ ID NO: 4083198 - RNA, 22 nt, Streptococcus pneumoniae R6
aauaucaagauaagaaaaaaca

SEQ ID NO: 4083199 - RNA, 17 nt, Streptococcus pneumoniae R6
aauaucaagguuuuugc

SEQ ID NO: 4083200 - RNA, 18 nt, Streptococcus pneumoniae R6
aauaucagauauucuaaa

SEQ ID NO: 4083201 - RNA, 22 nt, Streptococcus pneumoniae R6
aauaucagccagagcaccaacc

SEQ ID NO: 4083202 - RNA, 23 nt, Streptococcus pneumoniae R6
aauaucagccagagcaccaacca

SEQ ID NO: 4083203 - RNA, 18 nt, Streptococcus pneumoniae R6
aauaucaucgauuuuuuc

SEQ ID NO: 4083204 - RNA, 22 nt, Streptococcus pneumoniae R6
aauaucaucgauuuuuucacca

SEQ ID NO: 4083205 - RNA, 17 nt, Streptococcus pneumoniae R6
aauauccgauagcauca

SEQ ID NO: 4083206 - RNA, 13 nt, Streptococcus pneumoniae R6
aauauccucuuca

SEQ ID NO: 4083207 - RNA, 18 nt, Streptococcus pneumoniae R6
aauauccuuauauaucca

SEQ ID NO: 4083208 - RNA, 17 nt, Streptococcus pneumoniae R6
aauaucgauaccuucag

SEQ ID NO: 4083209 - RNA, 23 nt, Streptococcus pneumoniae R6
aauaucgaugcccucuucuuuga

SEQ ID NO: 4083210 - RNA, 22 nt, Streptococcus pneumoniae R6
aauaucuauccuaucuucuaga

SEQ ID NO: 4083211 - RNA, 22 nt, Streptococcus pneumoniae R6
aauaucugagauaguauuuuaa

SEQ ID NO: 4083212 - RNA, 14 nt, Streptococcus pneumoniae R6
aauaucugcacucu

SEQ ID NO: 4083213 - RNA, 22 nt, Streptococcus pneumoniae R6
aauaucugcacucucauucauc

SEQ ID NO: 4083214 - RNA, 17 nt, Streptococcus pneumoniae R6
aauaucuggacuuauau

SEQ ID NO: 4083215 - RNA, 21 nt, Streptococcus pneumoniae R6
aauaucuggacuuauaugcua

SEQ ID NO: 4083216 - RNA, 23 nt, Streptococcus pneumoniae R6
aauaucuucggauuuuucuuuua

SEQ ID NO: 4083217 - RNA, 23 nt, Streptococcus pneumoniae R6
aauaucuuuauugaugaagucua

SEQ ID NO: 4083218 - RNA, 19 nt, Streptococcus pneumoniae R6
aauaucuuuuauuuuuaua

SEQ ID NO: 4083219 - RNA, 13 nt, Streptococcus pneumoniae R6
aauaugaacaaaa

SEQ ID NO: 4083220 - RNA, 17 nt, Streptococcus pneumoniae R6
aauaugaacaaaaccug

SEQ ID NO: 4083221 - RNA, 17 nt, Streptococcus pneumoniae R6
aauaugaacauuuuccg

SEQ ID NO: 4083222 - RNA, 15 nt, Streptococcus pneumoniae R6
aauaugcuauugaaa

SEQ ID NO: 4083223 - RNA, 16 nt, Streptococcus pneumoniae R6
aauauggauaauugaa

SEQ ID NO: 4083224 - RNA, 15 nt, Streptococcus pneumoniae R6
aauauggcaacuuuu

SEQ ID NO: 4083225 - RNA, 19 nt, Streptococcus pneumoniae R6
aauaugggcuuacaucaaa

SEQ ID NO: 4083226 - RNA, 22 nt, Streptococcus pneumoniae R6
aauaugggcuuacaucaaaaac

SEQ ID NO: 4083227 - RNA, 14 nt, Streptococcus pneumoniae R6
aauauguauuuaua

SEQ ID NO: 4083228 - RNA, 15 nt, Streptococcus pneumoniae R6
aauauguauuuauag

SEQ ID NO: 4083229 - RNA, 20 nt, Streptococcus pneumoniae R6
aauauguauuuauaguauua

SEQ ID NO: 4083230 - RNA, 13 nt, Streptococcus pneumoniae R6
aauauguauuuca

SEQ ID NO: 4083231 - RNA, 20 nt, Streptococcus pneumoniae R6
aauauguauuucauuuucua

SEQ ID NO: 4083232 - RNA, 13 nt, Streptococcus pneumoniae R6
aauauguuuucuu

SEQ ID NO: 4083233 - RNA, 23 nt, Streptococcus pneumoniae R6
aauauuacguccuguugcuucau

SEQ ID NO: 4083234 - RNA, 21 nt, Streptococcus pneumoniae R6
aauauuacuucuaaaacauuc

SEQ ID NO: 4083235 - RNA, 18 nt, Streptococcus pneumoniae R6
aauauuagcaaaaaagca

SEQ ID NO: 4083236 - RNA, 23 nt, Streptococcus pneumoniae R6
aauauuagucggaaucuuuaaga

SEQ ID NO: 4083237 - RNA, 13 nt, Streptococcus pneumoniae R6
aauauucucuaga

SEQ ID NO: 4083238 - RNA, 15 nt, Streptococcus pneumoniae R6
aauauucuuggcaaa

SEQ ID NO: 4083239 - RNA, 21 nt, Streptococcus pneumoniae R6
aauauuggcuacuguaggcuu

SEQ ID NO: 4083240 - RNA, 21 nt, Streptococcus pneumoniae R6
aauauuguuuuaauauaauau

SEQ ID NO: 4083241 - RNA, 12 nt, Streptococcus pneumoniae R6
aauauuuacuuc

SEQ ID NO: 4083242 - RNA, 18 nt, Streptococcus pneumoniae R6
aauauuuacuucauuuuu

SEQ ID NO: 4083243 - RNA, 19 nt, Streptococcus pneumoniae R6
aauauuucuagaaauuaau

SEQ ID NO: 4083244 - RNA, 23 nt, Streptococcus pneumoniae R6
aauauuuuaaacguuuuuacuuu

SEQ ID NO: 4083245 - RNA, 14 nt, Streptococcus pneumoniae R6
aauauuuuagaagc

SEQ ID NO: 4083246 - RNA, 15 nt, Streptococcus pneumoniae R6
aauauuuuuuacuuu

SEQ ID NO: 4083247 - RNA, 20 nt, Streptococcus pneumoniae R6
aaucaaaaaaauucuucaca

SEQ ID NO: 4083248 - RNA, 12 nt, Streptococcus pneumoniae R6
aaucaaaauaua

SEQ ID NO: 4083249 - RNA, 19 nt, Streptococcus pneumoniae R6
aaucaaacuagcaagugcu

SEQ ID NO: 4083250 - RNA, 14 nt, Streptococcus pneumoniae R6
aaucaaagcuagca

SEQ ID NO: 4083251 - RNA, 14 nt, Streptococcus pneumoniae R6
aaucaaagugcaaa

SEQ ID NO: 4083252 - RNA, 12 nt, Streptococcus pneumoniae R6
aaucaaaucaau

SEQ ID NO: 4083253 - RNA, 13 nt, Streptococcus pneumoniae R6
aaucaaaucaaua

SEQ ID NO: 4083254 - RNA, 20 nt, Streptococcus pneumoniae R6
aaucaaaucgauaaagaaga

SEQ ID NO: 4083255 - RNA, 21 nt, Streptococcus pneumoniae R6
aaucaaauucauucguaaucc

SEQ ID NO: 4083256 - RNA, 15 nt, Streptococcus pneumoniae R6
aaucaaauugugcag

SEQ ID NO: 4083257 - RNA, 21 nt, Streptococcus pneumoniae R6
aaucaaauuuuauccaacuga

SEQ ID NO: 4083258 - RNA, 16 nt, Streptococcus pneumoniae R6
aaucaacauauccaag

SEQ ID NO: 4083259 - RNA, 16 nt, Streptococcus pneumoniae R6
aaucaaccaacuuuug

SEQ ID NO: 4083260 - RNA, 17 nt, Streptococcus pneumoniae R6
aaucaagauacaagucu

SEQ ID NO: 4083261 - RNA, 12 nt, Streptococcus pneumoniae R6
aaucaagcuggc

SEQ ID NO: 4083262 - RNA, 23 nt, Streptococcus pneumoniae R6
aaucaaguaggcucauccccuca

SEQ ID NO: 4083263 - RNA, 23 nt, Streptococcus pneumoniae R6
aaucaaucguccuugauuuagaa

SEQ ID NO: 4083264 - RNA, 18 nt, Streptococcus pneumoniae R6
aaucaauguacuggauaa

SEQ ID NO: 4083265 - RNA, 21 nt, Streptococcus pneumoniae R6
aaucaauugguuaaaagcuca

SEQ ID NO: 4083266 - RNA, 14 nt, Streptococcus pneumoniae R6
aaucaauuucuagc

SEQ ID NO: 4083267 - RNA, 15 nt, Streptococcus pneumoniae R6
aaucaauuuguucgu

SEQ ID NO: 4083268 - RNA, 16 nt, Streptococcus pneumoniae R6
aaucaauuuuacagga

SEQ ID NO: 4083269 - RNA, 20 nt, Streptococcus pneumoniae R6
aaucaauuuuacaggaauau

SEQ ID NO: 4083270 - RNA, 16 nt, Streptococcus pneumoniae R6
aaucaauuuuuaacaa

SEQ ID NO: 4083271 - RNA, 17 nt, Streptococcus pneumoniae R6
aaucaauuuuucggcca

SEQ ID NO: 4083272 - RNA, 12 nt, Streptococcus pneumoniae R6
aaucacaaaaac

SEQ ID NO: 4083273 - RNA, 22 nt, Streptococcus pneumoniae R6
aaucacaugacguucaaaggca

SEQ ID NO: 4083274 - RNA, 17 nt, Streptococcus pneumoniae R6
aaucaccuaaaguagag

SEQ ID NO: 4083275 - RNA, 21 nt, Streptococcus pneumoniae R6
aaucaccuaguccaagacguu

SEQ ID NO: 4083276 - RNA, 20 nt, Streptococcus pneumoniae R6
aaucaccuauucuaagucca

SEQ ID NO: 4083277 - RNA, 16 nt, Streptococcus pneumoniae R6
aaucaccugcaauaau

SEQ ID NO: 4083278 - RNA, 16 nt, Streptococcus pneumoniae R6
aaucacgacuuucuga

SEQ ID NO: 4083279 - RNA, 15 nt, Streptococcus pneumoniae R6
aaucacuugaccaaa

SEQ ID NO: 4083280 - RNA, 16 nt, Streptococcus pneumoniae R6
aaucacuuggaaaaau

SEQ ID NO: 4083281 - RNA, 20 nt, Streptococcus pneumoniae R6
aaucagacuguuuuucuuga

SEQ ID NO: 4083282 - RNA, 14 nt, Streptococcus pneumoniae R6
aaucagcuaaaaau

SEQ ID NO: 4083283 - RNA, 17 nt, Streptococcus pneumoniae R6
aaucagcucucugauuu

SEQ ID NO: 4083284 - RNA, 23 nt, Streptococcus pneumoniae R6
aaucagcucucugauuuucagag

SEQ ID NO: 4083285 - RNA, 19 nt, Streptococcus pneumoniae R6
aaucaggaaaucuucucga

SEQ ID NO: 4083286 - RNA, 16 nt, Streptococcus pneumoniae R6
aaucaggccagaugac

SEQ ID NO: 4083287 - RNA, 21 nt, Streptococcus pneumoniae R6
aaucaguucuuuaaagguauc

SEQ ID NO: 4083288 - RNA, 13 nt, Streptococcus pneumoniae R6
aaucaguuuuugc

SEQ ID NO: 4083289 - RNA, 18 nt, Streptococcus pneumoniae R6
aaucaguuuuuucacaaa

SEQ ID NO: 4083290 - RNA, 23 nt, Streptococcus pneumoniae R6
aaucauaagcaacuuuacgaaau

SEQ ID NO: 4083291 - RNA, 20 nt, Streptococcus pneumoniae R6
aaucauaauccaacaccaau

SEQ ID NO: 4083292 - RNA, 14 nt, Streptococcus pneumoniae R6
aaucauacaccucu

SEQ ID NO: 4083293 - RNA, 24 nt, Streptococcus pneumoniae R6
aaucauacaccucuucugaugcaa

SEQ ID NO: 4083294 - RNA, 16 nt, Streptococcus pneumoniae R6
aaucauacugccaaga

SEQ ID NO: 4083295 - RNA, 22 nt, Streptococcus pneumoniae R6
aaucauacuuggagaaccuaga

SEQ ID NO: 4083296 - RNA, 15 nt, Streptococcus pneumoniae R6
aaucauagaaaaaag

SEQ ID NO: 4083297 - RNA, 20 nt, Streptococcus pneumoniae R6
aaucauagacuuaauugucu

SEQ ID NO: 4083298 - RNA, 23 nt, Streptococcus pneumoniae R6
aaucauagagcaaacuaggaaac

SEQ ID NO: 4083299 - RNA, 20 nt, Streptococcus pneumoniae R6
aaucauagauucaccaguag

SEQ ID NO: 4083300 - RNA, 16 nt, Streptococcus pneumoniae R6
aaucauaucaucaauc

SEQ ID NO: 4083301 - RNA, 13 nt, Streptococcus pneumoniae R6
aaucaucugcauc

SEQ ID NO: 4083302 - RNA, 13 nt, Streptococcus pneumoniae R6
aaucaucuuguuu

SEQ ID NO: 4083303 - RNA, 19 nt, Streptococcus pneumoniae R6
aaucauguaccuaagauua

SEQ ID NO: 4083304 - RNA, 21 nt, Streptococcus pneumoniae R6
aaucauucugaacuaaaaaau

SEQ ID NO: 4083305 - RNA, 13 nt, Streptococcus pneumoniae R6
aaucauugcaaag

SEQ ID NO: 4083306 - RNA, 13 nt, Streptococcus pneumoniae R6
aaucauugcuauc

SEQ ID NO: 4083307 - RNA, 16 nt, Streptococcus pneumoniae R6
aaucauuuaauaauga

SEQ ID NO: 4083308 - RNA, 17 nt, Streptococcus pneumoniae R6
aaucauuuaauaaugaa

SEQ ID NO: 4083309 - RNA, 18 nt, Streptococcus pneumoniae R6
aaucauuuaauaaugaag

SEQ ID NO: 4083310 - RNA, 18 nt, Streptococcus pneumoniae R6
aaucauuuccuucguuuu

SEQ ID NO: 4083311 - RNA, 24 nt, Streptococcus pneumoniae R6
aaucauuuccuucguuuucacaau

SEQ ID NO: 4083312 - RNA, 18 nt, Streptococcus pneumoniae R6
aaucauuugaaucaaaaa

SEQ ID NO: 4083313 - RNA, 19 nt, Streptococcus pneumoniae R6
aaucauuugaaucaaaaau

SEQ ID NO: 4083314 - RNA, 19 nt, Streptococcus pneumoniae R6
aauccaaaagcaggaguuu

SEQ ID NO: 4083315 - RNA, 22 nt, Streptococcus pneumoniae R6
aauccaauugaggaaguaccaa

SEQ ID NO: 4083316 - RNA, 10 nt, Streptococcus pneumoniae R6
aauccacacu

SEQ ID NO: 4083317 - RNA, 23 nt, Streptococcus pneumoniae R6
aauccacggcucaugagauaaua

SEQ ID NO: 4083318 - RNA, 23 nt, Streptococcus pneumoniae R6
aauccacuauaauaaaaugaaau

SEQ ID NO: 4083319 - RNA, 20 nt, Streptococcus pneumoniae R6
aauccacucagacagcugag

SEQ ID NO: 4083320 - RNA, 17 nt, Streptococcus pneumoniae R6
aauccacuugggaaacc

SEQ ID NO: 4083321 - RNA, 18 nt, Streptococcus pneumoniae R6
aauccacuugggaaacca

SEQ ID NO: 4083322 - RNA, 24 nt, Streptococcus pneumoniae R6
aauccacuugggaaaccaaacgga

SEQ ID NO: 4083323 - RNA, 15 nt, Streptococcus pneumoniae R6
aauccagucccuuuu

SEQ ID NO: 4083324 - RNA, 12 nt, Streptococcus pneumoniae R6
aauccaguuaac

SEQ ID NO: 4083325 - RNA, 19 nt, Streptococcus pneumoniae R6
aauccaugaccgaaugaag

SEQ ID NO: 4083326 - RNA, 20 nt, Streptococcus pneumoniae R6
aauccaugaccgaaugaagg

SEQ ID NO: 4083327 - RNA, 15 nt, Streptococcus pneumoniae R6
aaucccaagauagaa

SEQ ID NO: 4083328 - RNA, 18 nt, Streptococcus pneumoniae R6
aaucccaaucauggcugg

SEQ ID NO: 4083329 - RNA, 20 nt, Streptococcus pneumoniae R6
aaucccaaucauggcuggga

SEQ ID NO: 4083330 - RNA, 18 nt, Streptococcus pneumoniae R6
aaucccagauaaagcuga

SEQ ID NO: 4083331 - RNA, 17 nt, Streptococcus pneumoniae R6
aaucccaugacaaucau

SEQ ID NO: 4083332 - RNA, 20 nt, Streptococcus pneumoniae R6
aauccccaagggaccaaauu

SEQ ID NO: 4083333 - RNA, 15 nt, Streptococcus pneumoniae R6
aaucccuuuuuaaga

SEQ ID NO: 4083334 - RNA, 17 nt, Streptococcus pneumoniae R6
aauccgacuucaauaaa

SEQ ID NO: 4083335 - RNA, 14 nt, Streptococcus pneumoniae R6
aauccgaguuuuuc

SEQ ID NO: 4083336 - RNA, 18 nt, Streptococcus pneumoniae R6
aauccgcuugggaaacca

SEQ ID NO: 4083337 - RNA, 19 nt, Streptococcus pneumoniae R6
aauccgcuugggaaaccaa

SEQ ID NO: 4083338 - RNA, 20 nt, Streptococcus pneumoniae R6
aauccgcuugggaaaccaaa

SEQ ID NO: 4083339 - RNA, 24 nt, Streptococcus pneumoniae R6
aauccgcuugggaaaccaaacgga

SEQ ID NO: 4083340 - RNA, 17 nt, Streptococcus pneumoniae R6
aauccguuuuuugaagu

SEQ ID NO: 4083341 - RNA, 17 nt, Streptococcus pneumoniae R6
aauccuaguggaaaaga

SEQ ID NO: 4083342 - RNA, 17 nt, Streptococcus pneumoniae R6
aauccugaagaauggga

SEQ ID NO: 4083343 - RNA, 23 nt, Streptococcus pneumoniae R6
aauccugauuucaaguaaaauca

SEQ ID NO: 4083344 - RNA, 14 nt, Streptococcus pneumoniae R6
aauccugcaaagau

SEQ ID NO: 4083345 - RNA, 19 nt, Streptococcus pneumoniae R6
aauccugcauugugagcaa

SEQ ID NO: 4083346 - RNA, 16 nt, Streptococcus pneumoniae R6
aauccugccaaugguc

SEQ ID NO: 4083347 - RNA, 21 nt, Streptococcus pneumoniae R6
aauccuggucuuuuuuagcuc

SEQ ID NO: 4083348 - RNA, 21 nt, Streptococcus pneumoniae R6
aauccuguuuguguuucugga

SEQ ID NO: 4083349 - RNA, 13 nt, Streptococcus pneumoniae R6
aauccuuauuuuc

SEQ ID NO: 4083350 - RNA, 15 nt, Streptococcus pneumoniae R6
aauccuuauuuucua

SEQ ID NO: 4083351 - RNA, 23 nt, Streptococcus pneumoniae R6
aauccuuauuuucuacucuuucg

SEQ ID NO: 4083352 - RNA, 23 nt, Streptococcus pneumoniae R6
aauccuuguaugacaucuuggag

SEQ ID NO: 4083353 - RNA, 20 nt, Streptococcus pneumoniae R6
aaucgagaagauuuccugau

SEQ ID NO: 4083354 - RNA, 22 nt, Streptococcus pneumoniae R6
aaucgaguaggggauaaucucu

SEQ ID NO: 4083355 - RNA, 21 nt, Streptococcus pneumoniae R6
aaucgaucaggacagucaaau

SEQ ID NO: 4083356 - RNA, 14 nt, Streptococcus pneumoniae R6
aaucgauuaggaaa

SEQ ID NO: 4083357 - RNA, 21 nt, Streptococcus pneumoniae R6
aaucgauugggaaaguaaaau

SEQ ID NO: 4083358 - RNA, 15 nt, Streptococcus pneumoniae R6
aaucgauuuguucau

SEQ ID NO: 4083359 - RNA, 16 nt, Streptococcus pneumoniae R6
aaucgcaaguuuuucc

SEQ ID NO: 4083360 - RNA, 16 nt, Streptococcus pneumoniae R6
aaucgguaggaugaca

SEQ ID NO: 4083361 - RNA, 23 nt, Streptococcus pneumoniae R6
aaucgguaggaugacaacuggga

SEQ ID NO: 4083362 - RNA, 15 nt, Streptococcus pneumoniae R6
aaucguaauuuagaa

SEQ ID NO: 4083363 - RNA, 15 nt, Streptococcus pneumoniae R6
aaucgugaguuccug

SEQ ID NO: 4083364 - RNA, 13 nt, Streptococcus pneumoniae R6
aaucguuccagcg

SEQ ID NO: 4083365 - RNA, 18 nt, Streptococcus pneumoniae R6
aaucguugcaccugaacg

SEQ ID NO: 4083366 - RNA, 16 nt, Streptococcus pneumoniae R6
aaucguuucaaaaaau

SEQ ID NO: 4083367 - RNA, 14 nt, Streptococcus pneumoniae R6
aaucuaaaauagua

SEQ ID NO: 4083368 - RNA, 18 nt, Streptococcus pneumoniae R6
aaucuaaggucauuugaa

SEQ ID NO: 4083369 - RNA, 16 nt, Streptococcus pneumoniae R6
aaucuaagucaaauaa

SEQ ID NO: 4083370 - RNA, 17 nt, Streptococcus pneumoniae R6
aaucuaaucauucugaa

SEQ ID NO: 4083371 - RNA, 11 nt, Streptococcus pneumoniae R6
aaucuacaaag

SEQ ID NO: 4083372 - RNA, 17 nt, Streptococcus pneumoniae R6
aaucuagauacauuuuu

SEQ ID NO: 4083373 - RNA, 13 nt, Streptococcus pneumoniae R6
aaucuaggacaaa

SEQ ID NO: 4083374 - RNA, 15 nt, Streptococcus pneumoniae R6
aaucuaguaaagcua

SEQ ID NO: 4083375 - RNA, 16 nt, Streptococcus pneumoniae R6
aaucuagucaucagaa

SEQ ID NO: 4083376 - RNA, 17 nt, Streptococcus pneumoniae R6
aaucuagucaucagaaa

SEQ ID NO: 4083377 - RNA, 18 nt, Streptococcus pneumoniae R6
aaucuaucuuuuaauuca

SEQ ID NO: 4083378 - RNA, 19 nt, Streptococcus pneumoniae R6
aaucuauuuaugaaaaagu

SEQ ID NO: 4083379 - RNA, 12 nt, Streptococcus pneumoniae R6
aaucucaaaaga

SEQ ID NO: 4083380 - RNA, 14 nt, Streptococcus pneumoniae R6
aaucucaaauccuu

SEQ ID NO: 4083381 - RNA, 21 nt, Streptococcus pneumoniae R6
aaucuccacgcuccacuuccc

SEQ ID NO: 4083382 - RNA, 14 nt, Streptococcus pneumoniae R6
aaucuccucuaccu

SEQ ID NO: 4083383 - RNA, 16 nt, Streptococcus pneumoniae R6
aaucucuagccccucu

SEQ ID NO: 4083384 - RNA, 18 nt, Streptococcus pneumoniae R6
aaucucuagccccucuca

SEQ ID NO: 4083385 - RNA, 24 nt, Streptococcus pneumoniae R6
aaucucuccuuaucaaaaucgaua

SEQ ID NO: 4083386 - RNA, 14 nt, Streptococcus pneumoniae R6
aaucucugauaaua

SEQ ID NO: 4083387 - RNA, 13 nt, Streptococcus pneumoniae R6
aaucucuucaaac

SEQ ID NO: 4083388 - RNA, 14 nt, Streptococcus pneumoniae R6
aaucucuucaaacc

SEQ ID NO: 4083389 - RNA, 16 nt, Streptococcus pneumoniae R6
aaucucuucaaaccac

SEQ ID NO: 4083390 - RNA, 18 nt, Streptococcus pneumoniae R6
aaucucuucaaacuacgu

SEQ ID NO: 4083391 - RNA, 15 nt, Streptococcus pneumoniae R6
aaucucuugaacaua

SEQ ID NO: 4083392 - RNA, 14 nt, Streptococcus pneumoniae R6
aaucugaaauauaa

SEQ ID NO: 4083393 - RNA, 18 nt, Streptococcus pneumoniae R6
aaucugaaauauaauaga

SEQ ID NO: 4083394 - RNA, 12 nt, Streptococcus pneumoniae R6
aaucugaaucaa

SEQ ID NO: 4083395 - RNA, 17 nt, Streptococcus pneumoniae R6
aaucugaaucaaaauua

SEQ ID NO: 4083396 - RNA, 14 nt, Streptococcus pneumoniae R6
aaucugaauguuuc

SEQ ID NO: 4083397 - RNA, 16 nt, Streptococcus pneumoniae R6
aaucugaugaaccuuc

SEQ ID NO: 4083398 - RNA, 17 nt, Streptococcus pneumoniae R6
aaucugaugaaccuuca

SEQ ID NO: 4083399 - RNA, 20 nt, Streptococcus pneumoniae R6
aaucugcaccugauuucucc

SEQ ID NO: 4083400 - RNA, 11 nt, Streptococcus pneumoniae R6
aaucugcauga

SEQ ID NO: 4083401 - RNA, 23 nt, Streptococcus pneumoniae R6
aaucuggagaguacgaaauucgu

SEQ ID NO: 4083402 - RNA, 16 nt, Streptococcus pneumoniae R6
aaucuggugccccagu

SEQ ID NO: 4083403 - RNA, 23 nt, Streptococcus pneumoniae R6
aaucuguacuaagcaugauauga

SEQ ID NO: 4083404 - RNA, 16 nt, Streptococcus pneumoniae R6
aaucugucagugacag

SEQ ID NO: 4083405 - RNA, 17 nt, Streptococcus pneumoniae R6
aaucuguuaaaaaauaa

SEQ ID NO: 4083406 - RNA, 21 nt, Streptococcus pneumoniae R6
aaucuguuaaaaaauaaucaa

SEQ ID NO: 4083407 - RNA, 18 nt, Streptococcus pneumoniae R6
aaucuuaaaaauuacaaa

SEQ ID NO: 4083408 - RNA, 23 nt, Streptococcus pneumoniae R6
aaucuuaaaguuauuggaacuaa

SEQ ID NO: 4083409 - RNA, 20 nt, Streptococcus pneumoniae R6
aaucuuaccaaccucagaau

SEQ ID NO: 4083410 - RNA, 18 nt, Streptococcus pneumoniae R6
aaucuuagucaaaacaau

SEQ ID NO: 4083411 - RNA, 15 nt, Streptococcus pneumoniae R6
aaucuuaucuaagac

SEQ ID NO: 4083412 - RNA, 12 nt, Streptococcus pneumoniae R6
aaucuucaaaaa

SEQ ID NO: 4083413 - RNA, 16 nt, Streptococcus pneumoniae R6
aaucuucaaaaucuca

SEQ ID NO: 4083414 - RNA, 19 nt, Streptococcus pneumoniae R6
aaucuucaaaaucucagcu

SEQ ID NO: 4083415 - RNA, 24 nt, Streptococcus pneumoniae R6
aaucuucccauaguaaaacgcaua

SEQ ID NO: 4083416 - RNA, 17 nt, Streptococcus pneumoniae R6
aaucuucccguagguuu

SEQ ID NO: 4083417 - RNA, 22 nt, Streptococcus pneumoniae R6
aaucuucuagcuaucuccucau

SEQ ID NO: 4083418 - RNA, 19 nt, Streptococcus pneumoniae R6
aaucuucuccaguuuuaau

SEQ ID NO: 4083419 - RNA, 16 nt, Streptococcus pneumoniae R6
aaucuucuuacauaug

SEQ ID NO: 4083420 - RNA, 15 nt, Streptococcus pneumoniae R6
aaucuugucaagaau

SEQ ID NO: 4083421 - RNA, 16 nt, Streptococcus pneumoniae R6
aaucuugucuaaaaau

SEQ ID NO: 4083422 - RNA, 17 nt, Streptococcus pneumoniae R6
aaucuugucuaaaaaua

SEQ ID NO: 4083423 - RNA, 24 nt, Streptococcus pneumoniae R6
aaucuugucuaaaaauagggaaau

SEQ ID NO: 4083424 - RNA, 20 nt, Streptococcus pneumoniae R6
aaucuuuaagauacuugauu

SEQ ID NO: 4083425 - RNA, 14 nt, Streptococcus pneumoniae R6
aaucuuucugcauc

SEQ ID NO: 4083426 - RNA, 12 nt, Streptococcus pneumoniae R6
aaucuuugccac

SEQ ID NO: 4083427 - RNA, 16 nt, Streptococcus pneumoniae R6
aaucuuuuacuucuga

SEQ ID NO: 4083428 - RNA, 17 nt, Streptococcus pneumoniae R6
aaucuuuuacuucugaa

SEQ ID NO: 4083429 - RNA, 21 nt, Streptococcus pneumoniae R6
aaucuuuuacuucugaaguua

SEQ ID NO: 4083430 - RNA, 13 nt, Streptococcus pneumoniae R6
aaugaaaaucaaa

SEQ ID NO: 4083431 - RNA, 16 nt, Streptococcus pneumoniae R6
aaugaaaaucaaagag

SEQ ID NO: 4083432 - RNA, 17 nt, Streptococcus pneumoniae R6
aaugaaaaucauagaaa

SEQ ID NO: 4083433 - RNA, 22 nt, Streptococcus pneumoniae R6
aaugaaagaaacucuaaacaaa

SEQ ID NO: 4083434 - RNA, 17 nt, Streptococcus pneumoniae R6
aaugaaaguuuauaaac

SEQ ID NO: 4083435 - RNA, 14 nt, Streptococcus pneumoniae R6
aaugaaauaaaauu

SEQ ID NO: 4083436 - RNA, 15 nt, Streptococcus pneumoniae R6
aaugaaauuaaauau

SEQ ID NO: 4083437 - RNA, 16 nt, Streptococcus pneumoniae R6
aaugaaauuaaauaug

SEQ ID NO: 4083438 - RNA, 19 nt, Streptococcus pneumoniae R6
aaugaagacaucauauaaa

SEQ ID NO: 4083439 - RNA, 21 nt, Streptococcus pneumoniae R6
aaugaagacaucauauaaaua

SEQ ID NO: 4083440 - RNA, 14 nt, Streptococcus pneumoniae R6
aaugaagcaaacau

SEQ ID NO: 4083441 - RNA, 16 nt, Streptococcus pneumoniae R6
aaugaagcaaacauuc

SEQ ID NO: 4083442 - RNA, 20 nt, Streptococcus pneumoniae R6
aaugaaguucucucaaaagu

SEQ ID NO: 4083443 - RNA, 15 nt, Streptococcus pneumoniae R6
aaugacaauuauaua

SEQ ID NO: 4083444 - RNA, 19 nt, Streptococcus pneumoniae R6
aaugacagugauuaaaacu

SEQ ID NO: 4083445 - RNA, 21 nt, Streptococcus pneumoniae R6
aaugaccugcauacguucaaa

SEQ ID NO: 4083446 - RNA, 20 nt, Streptococcus pneumoniae R6
aaugacuaagcccaaagaua

SEQ ID NO: 4083447 - RNA, 14 nt, Streptococcus pneumoniae R6
aaugacuuucuaau

SEQ ID NO: 4083448 - RNA, 21 nt, Streptococcus pneumoniae R6
aaugagauaagcgauuuuaua

SEQ ID NO: 4083449 - RNA, 17 nt, Streptococcus pneumoniae R6
aaugagccacuauuuau

SEQ ID NO: 4083450 - RNA, 12 nt, Streptococcus pneumoniae R6
aaugaggaaggg

SEQ ID NO: 4083451 - RNA, 18 nt, Streptococcus pneumoniae R6
aaugagguaauuaugaaa

SEQ ID NO: 4083452 - RNA, 18 nt, Streptococcus pneumoniae R6
aaugagucagggaaaaaa

SEQ ID NO: 4083453 - RNA, 15 nt, Streptococcus pneumoniae R6
aaugauaacgagggu

SEQ ID NO: 4083454 - RNA, 17 nt, Streptococcus pneumoniae R6
aaugauaauugauuaag

SEQ ID NO: 4083455 - RNA, 21 nt, Streptococcus pneumoniae R6
aaugauaccuugaucaaucau

SEQ ID NO: 4083456 - RNA, 15 nt, Streptococcus pneumoniae R6
aaugauaucugguau

SEQ ID NO: 4083457 - RNA, 14 nt, Streptococcus pneumoniae R6
aaugauauuuucaa

SEQ ID NO: 4083458 - RNA, 20 nt, Streptococcus pneumoniae R6
aaugauauuuucaaaaaaau

SEQ ID NO: 4083459 - RNA, 15 nt, Streptococcus pneumoniae R6
aaugaucaagaugag

SEQ ID NO: 4083460 - RNA, 14 nt, Streptococcus pneumoniae R6
aaugaucagaccag

SEQ ID NO: 4083461 - RNA, 15 nt, Streptococcus pneumoniae R6
aaugauucugaaaua

SEQ ID NO: 4083462 - RNA, 13 nt, Streptococcus pneumoniae R6
aaugauuucucuu

SEQ ID NO: 4083463 - RNA, 19 nt, Streptococcus pneumoniae R6
aaugauuucuucuuggucu

SEQ ID NO: 4083464 - RNA, 13 nt, Streptococcus pneumoniae R6
aaugauuugaaca

SEQ ID NO: 4083465 - RNA, 14 nt, Streptococcus pneumoniae R6
aaugauuugaacau

SEQ ID NO: 4083466 - RNA, 16 nt, Streptococcus pneumoniae R6
aaugcaguaaaucaua

SEQ ID NO: 4083467 - RNA, 17 nt, Streptococcus pneumoniae R6
aaugcauacgaaaagua

SEQ ID NO: 4083468 - RNA, 12 nt, Streptococcus pneumoniae R6
aaugccaaaauu

SEQ ID NO: 4083469 - RNA, 14 nt, Streptococcus pneumoniae R6
aaugccaaagguaa

SEQ ID NO: 4083470 - RNA, 14 nt, Streptococcus pneumoniae R6
aaugcccaagagac

SEQ ID NO: 4083471 - RNA, 24 nt, Streptococcus pneumoniae R6
aaugccgauucccaaacuuguacu

SEQ ID NO: 4083472 - RNA, 18 nt, Streptococcus pneumoniae R6
aaugccuccaagaaagag

SEQ ID NO: 4083473 - RNA, 18 nt, Streptococcus pneumoniae R6
aaugccuguuccaacauu

SEQ ID NO: 4083474 - RNA, 19 nt, Streptococcus pneumoniae R6
aaugccuguuccaacauug

SEQ ID NO: 4083475 - RNA, 14 nt, Streptococcus pneumoniae R6
aaugcguucaccag

SEQ ID NO: 4083476 - RNA, 19 nt, Streptococcus pneumoniae R6
aaugcuaauuuagaaauag

SEQ ID NO: 4083477 - RNA, 12 nt, Streptococcus pneumoniae R6
aaugcucagaca

SEQ ID NO: 4083478 - RNA, 16 nt, Streptococcus pneumoniae R6
aaugcucagacaauuu

SEQ ID NO: 4083479 - RNA, 15 nt, Streptococcus pneumoniae R6
aaugcuccaauacaa

SEQ ID NO: 4083480 - RNA, 22 nt, Streptococcus pneumoniae R6
aaugcuccaauacaaauuguaa

SEQ ID NO: 4083481 - RNA, 13 nt, Streptococcus pneumoniae R6
aaugcuugcaaau

SEQ ID NO: 4083482 - RNA, 20 nt, Streptococcus pneumoniae R6
aaugcuuuuugaaagcagau

SEQ ID NO: 4083483 - RNA, 13 nt, Streptococcus pneumoniae R6
aauggaaaugaua

SEQ ID NO: 4083484 - RNA, 18 nt, Streptococcus pneumoniae R6
aauggaaguuucaaaauu

SEQ ID NO: 4083485 - RNA, 17 nt, Streptococcus pneumoniae R6
aauggaguaaaaaaaga

SEQ ID NO: 4083486 - RNA, 17 nt, Streptococcus pneumoniae R6
aauggauugaaauaaga

SEQ ID NO: 4083487 - RNA, 17 nt, Streptococcus pneumoniae R6
aauggcaaaaaauugag

SEQ ID NO: 4083488 - RNA, 20 nt, Streptococcus pneumoniae R6
aauggcaaaaaauugagaaa

SEQ ID NO: 4083489 - RNA, 20 nt, Streptococcus pneumoniae R6
aauggcaucugguuuuuccc

SEQ ID NO: 4083490 - RNA, 13 nt, Streptococcus pneumoniae R6
aauggcaugagga

SEQ ID NO: 4083491 - RNA, 15 nt, Streptococcus pneumoniae R6
aauggcaugaggaga

SEQ ID NO: 4083492 - RNA, 23 nt, Streptococcus pneumoniae R6
aauggccuccuucauuaagucau

SEQ ID NO: 4083493 - RNA, 14 nt, Streptococcus pneumoniae R6
aauggccuguucua

SEQ ID NO: 4083494 - RNA, 16 nt, Streptococcus pneumoniae R6
aauggcggcauucaag

SEQ ID NO: 4083495 - RNA, 22 nt, Streptococcus pneumoniae R6
aauggcggcauucaagagacuc

SEQ ID NO: 4083496 - RNA, 18 nt, Streptococcus pneumoniae R6
aauggcuccuguacccaa

SEQ ID NO: 4083497 - RNA, 22 nt, Streptococcus pneumoniae R6
aauggcuucauuaugaguggca

SEQ ID NO: 4083498 - RNA, 23 nt, Streptococcus pneumoniae R6
aauggguuaaaauuuuaucuuug

SEQ ID NO: 4083499 - RNA, 21 nt, Streptococcus pneumoniae R6
aaugguaugucucgacuggua

SEQ ID NO: 4083500 - RNA, 15 nt, Streptococcus pneumoniae R6
aauggucaagaguug

SEQ ID NO: 4083501 - RNA, 14 nt, Streptococcus pneumoniae R6
aaugguuuagaagu

SEQ ID NO: 4083502 - RNA, 15 nt, Streptococcus pneumoniae R6
aauguaaaaaaguug

SEQ ID NO: 4083503 - RNA, 18 nt, Streptococcus pneumoniae R6
aauguaaaaaaguugaag

SEQ ID NO: 4083504 - RNA, 17 nt, Streptococcus pneumoniae R6
aauguaaggugcaaaaa

SEQ ID NO: 4083505 - RNA, 21 nt, Streptococcus pneumoniae R6
aauguaauuguuccauaugau

SEQ ID NO: 4083506 - RNA, 12 nt, Streptococcus pneumoniae R6
aauguacugccc

SEQ ID NO: 4083507 - RNA, 18 nt, Streptococcus pneumoniae R6
aauguacuggauaaaguu

SEQ ID NO: 4083508 - RNA, 17 nt, Streptococcus pneumoniae R6
aauguauuaagaacucu

SEQ ID NO: 4083509 - RNA, 22 nt, Streptococcus pneumoniae R6
aauguauugugguauacuauuu

SEQ ID NO: 4083510 - RNA, 19 nt, Streptococcus pneumoniae R6
aauguccuugauagcagaa

SEQ ID NO: 4083511 - RNA, 16 nt, Streptococcus pneumoniae R6
aaugucgaaccaagag

SEQ ID NO: 4083512 - RNA, 15 nt, Streptococcus pneumoniae R6
aaugucuaaaucuuu

SEQ ID NO: 4083513 - RNA, 14 nt, Streptococcus pneumoniae R6
aaugucucugcuau

SEQ ID NO: 4083514 - RNA, 19 nt, Streptococcus pneumoniae R6
aaugucuuccaaacgugga

SEQ ID NO: 4083515 - RNA, 22 nt, Streptococcus pneumoniae R6
aaugucuucugcucgcuggaga

SEQ ID NO: 4083516 - RNA, 18 nt, Streptococcus pneumoniae R6
aaugucuuggcagaaagg

SEQ ID NO: 4083517 - RNA, 18 nt, Streptococcus pneumoniae R6
aaugugggaaacagauuu

SEQ ID NO: 4083518 - RNA, 13 nt, Streptococcus pneumoniae R6
aauguuaugcaac

SEQ ID NO: 4083519 - RNA, 19 nt, Streptococcus pneumoniae R6
aauguucuguaaugaaaua

SEQ ID NO: 4083520 - RNA, 14 nt, Streptococcus pneumoniae R6
aauguugaaucauu

SEQ ID NO: 4083521 - RNA, 19 nt, Streptococcus pneumoniae R6
aauguugaaucauuuuguu

SEQ ID NO: 4083522 - RNA, 21 nt, Streptococcus pneumoniae R6
aauguugguaagagaaauuuc

SEQ ID NO: 4083523 - RNA, 14 nt, Streptococcus pneumoniae R6
aauguugucaauuu

SEQ ID NO: 4083524 - RNA, 19 nt, Streptococcus pneumoniae R6
aauguugucaauuuccauu

SEQ ID NO: 4083525 - RNA, 15 nt, Streptococcus pneumoniae R6
aauguuuuagaaaua

SEQ ID NO: 4083526 - RNA, 16 nt, Streptococcus pneumoniae R6
aauguuuuauuacaua

SEQ ID NO: 4083527 - RNA, 19 nt, Streptococcus pneumoniae R6
aauguuuuauuacauaagu

SEQ ID NO: 4083528 - RNA, 19 nt, Streptococcus pneumoniae R6
aauguuuucccuuugauag

SEQ ID NO: 4083529 - RNA, 14 nt, Streptococcus pneumoniae R6
aauguuuucucaua

SEQ ID NO: 4083530 - RNA, 14 nt, Streptococcus pneumoniae R6
aauuaaaaagagua

SEQ ID NO: 4083531 - RNA, 21 nt, Streptococcus pneumoniae R6
aauuaaaaugugauuucugua

SEQ ID NO: 4083532 - RNA, 16 nt, Streptococcus pneumoniae R6
aauuaaaucauccaua

SEQ ID NO: 4083533 - RNA, 19 nt, Streptococcus pneumoniae R6
aauuaaaucauccauauaa

SEQ ID NO: 4083534 - RNA, 20 nt, Streptococcus pneumoniae R6
aauuaacugguuaauuaauu

SEQ ID NO: 4083535 - RNA, 22 nt, Streptococcus pneumoniae R6
aauuaacugguuaauuaauuua

SEQ ID NO: 4083536 - RNA, 20 nt, Streptococcus pneumoniae R6
aauuaagugaccuugaugau

SEQ ID NO: 4083537 - RNA, 22 nt, Streptococcus pneumoniae R6
aauuaaguuuuacggaucugaa

SEQ ID NO: 4083538 - RNA, 17 nt, Streptococcus pneumoniae R6
aauuaaucaccuagucc

SEQ ID NO: 4083539 - RNA, 13 nt, Streptococcus pneumoniae R6
aauuaaucagaau

SEQ ID NO: 4083540 - RNA, 16 nt, Streptococcus pneumoniae R6
aauuaauuuauagaaa

SEQ ID NO: 4083541 - RNA, 19 nt, Streptococcus pneumoniae R6
aauuaauuuauagaaaaau

SEQ ID NO: 4083542 - RNA, 21 nt, Streptococcus pneumoniae R6
aauuaauuuauagaaauauuu

SEQ ID NO: 4083543 - RNA, 21 nt, Streptococcus pneumoniae R6
aauuaauuuauccgaagauuu

SEQ ID NO: 4083544 - RNA, 19 nt, Streptococcus pneumoniae R6
aauuaauuuauuuaaucau

SEQ ID NO: 4083545 - RNA, 19 nt, Streptococcus pneumoniae R6
aauuaauuucuagaaauau

SEQ ID NO: 4083546 - RNA, 18 nt, Streptococcus pneumoniae R6
aauuaauuugacuuuucu

SEQ ID NO: 4083547 - RNA, 17 nt, Streptococcus pneumoniae R6
aauuacaguuauuuuag

SEQ ID NO: 4083548 - RNA, 21 nt, Streptococcus pneumoniae R6
aauuacaguuauuuuaguaaa

SEQ ID NO: 4083549 - RNA, 23 nt, Streptococcus pneumoniae R6
aauuacaguuauuuuaguaaaaa

SEQ ID NO: 4083550 - RNA, 22 nt, Streptococcus pneumoniae R6
aauuacaugaaacuguggaaaa

SEQ ID NO: 4083551 - RNA, 22 nt, Streptococcus pneumoniae R6
aauuacugauuggugucaaaaa

SEQ ID NO: 4083552 - RNA, 20 nt, Streptococcus pneumoniae R6
aauuagaaaaaaauuuuuaa

SEQ ID NO: 4083553 - RNA, 12 nt, Streptococcus pneumoniae R6
aauuagaaaaag

SEQ ID NO: 4083554 - RNA, 13 nt, Streptococcus pneumoniae R6
aauuagaaaguca

SEQ ID NO: 4083555 - RNA, 22 nt, Streptococcus pneumoniae R6
aauuagaagcggucaaucgcuu

SEQ ID NO: 4083556 - RNA, 21 nt, Streptococcus pneumoniae R6
aauuagcaagaaauugauaua

SEQ ID NO: 4083557 - RNA, 14 nt, Streptococcus pneumoniae R6
aauuagcaaucacu

SEQ ID NO: 4083558 - RNA, 15 nt, Streptococcus pneumoniae R6
aauuagcaaucacuc

SEQ ID NO: 4083559 - RNA, 18 nt, Streptococcus pneumoniae R6
aauuagccuucauuacuu

SEQ ID NO: 4083560 - RNA, 15 nt, Streptococcus pneumoniae R6
aauuagggauacucc

SEQ ID NO: 4083561 - RNA, 14 nt, Streptococcus pneumoniae R6
aauuaguucagaau

SEQ ID NO: 4083562 - RNA, 15 nt, Streptococcus pneumoniae R6
aauuaguuuuggcua

SEQ ID NO: 4083563 - RNA, 19 nt, Streptococcus pneumoniae R6
aauuauacucuuagaaaau

SEQ ID NO: 4083564 - RNA, 20 nt, Streptococcus pneumoniae R6
aauuauaggacguuuucaga

SEQ ID NO: 4083565 - RNA, 12 nt, Streptococcus pneumoniae R6
aauuauauauaa

SEQ ID NO: 4083566 - RNA, 22 nt, Streptococcus pneumoniae R6
aauuaucauaguacaauaccuu

SEQ ID NO: 4083567 - RNA, 23 nt, Streptococcus pneumoniae R6
aauuauguaaauaaauaucaaaa

SEQ ID NO: 4083568 - RNA, 18 nt, Streptococcus pneumoniae R6
aauuauguuuuugaauaa

SEQ ID NO: 4083569 - RNA, 18 nt, Streptococcus pneumoniae R6
aauuauucucuaucuuuu

SEQ ID NO: 4083570 - RNA, 22 nt, Streptococcus pneumoniae R6
aauuauuggucgcuucaaguuu

SEQ ID NO: 4083571 - RNA, 18 nt, Streptococcus pneumoniae R6
aauuauuucaauuaguuu

SEQ ID NO: 4083572 - RNA, 22 nt, Streptococcus pneumoniae R6
aauuauuuccuugaccaagucc

SEQ ID NO: 4083573 - RNA, 17 nt, Streptococcus pneumoniae R6
aauuauuucuuuuguac

SEQ ID NO: 4083574 - RNA, 14 nt, Streptococcus pneumoniae R6
aauuauuuucaaaa

SEQ ID NO: 4083575 - RNA, 16 nt, Streptococcus pneumoniae R6
aauuauuuucaaaaua

SEQ ID NO: 4083576 - RNA, 13 nt, Streptococcus pneumoniae R6
aauucaaacucaa

SEQ ID NO: 4083577 - RNA, 20 nt, Streptococcus pneumoniae R6
aauucaaaguggguuuuaac

SEQ ID NO: 4083578 - RNA, 22 nt, Streptococcus pneumoniae R6
aauucaaaguggguuuuaacua

SEQ ID NO: 4083579 - RNA, 19 nt, Streptococcus pneumoniae R6
aauucaagaaugacacgua

SEQ ID NO: 4083580 - RNA, 21 nt, Streptococcus pneumoniae R6
aauucaauuuuauacucaucu

SEQ ID NO: 4083581 - RNA, 16 nt, Streptococcus pneumoniae R6
aauucaccaauuuuac

SEQ ID NO: 4083582 - RNA, 17 nt, Streptococcus pneumoniae R6
aauucaccuaaccaaau

SEQ ID NO: 4083583 - RNA, 18 nt, Streptococcus pneumoniae R6
aauucacuauaguuuaau

SEQ ID NO: 4083584 - RNA, 16 nt, Streptococcus pneumoniae R6
aauucagccuuaucca

SEQ ID NO: 4083585 - RNA, 21 nt, Streptococcus pneumoniae R6
aauucaguaugcuauaucuua

SEQ ID NO: 4083586 - RNA, 18 nt, Streptococcus pneumoniae R6
aauucauccgcuaucuua

SEQ ID NO: 4083587 - RNA, 18 nt, Streptococcus pneumoniae R6
aauucauuaaacucugca

SEQ ID NO: 4083588 - RNA, 14 nt, Streptococcus pneumoniae R6
aauucauuugauuu

SEQ ID NO: 4083589 - RNA, 19 nt, Streptococcus pneumoniae R6
aauucauuugauuuuccua

SEQ ID NO: 4083590 - RNA, 23 nt, Streptococcus pneumoniae R6
aauucauuugauuuuccuaauca

SEQ ID NO: 4083591 - RNA, 15 nt, Streptococcus pneumoniae R6
aauucauuuucuuaa

SEQ ID NO: 4083592 - RNA, 17 nt, Streptococcus pneumoniae R6
aauuccaaauuagaaaa

SEQ ID NO: 4083593 - RNA, 21 nt, Streptococcus pneumoniae R6
aauuccaaauuagaaaaagac

SEQ ID NO: 4083594 - RNA, 16 nt, Streptococcus pneumoniae R6
aauuccacgagccaaa

SEQ ID NO: 4083595 - RNA, 15 nt, Streptococcus pneumoniae R6
aauuccauaccuaaa

SEQ ID NO: 4083596 - RNA, 21 nt, Streptococcus pneumoniae R6
aauuccauaccuaaacuuuga

SEQ ID NO: 4083597 - RNA, 18 nt, Streptococcus pneumoniae R6
aauuccccaucuucaacu

SEQ ID NO: 4083598 - RNA, 22 nt, Streptococcus pneumoniae R6
aauucccucugacgagaaauag

SEQ ID NO: 4083599 - RNA, 23 nt, Streptococcus pneumoniae R6
aauucccuuauccacaucaucaa

SEQ ID NO: 4083600 - RNA, 23 nt, Streptococcus pneumoniae R6
aauucccuuuuugauuuuaaaug

SEQ ID NO: 4083601 - RNA, 12 nt, Streptococcus pneumoniae R6
aauuccuaaaau

SEQ ID NO: 4083602 - RNA, 20 nt, Streptococcus pneumoniae R6
aauuccuaagauauuaagaa

SEQ ID NO: 4083603 - RNA, 16 nt, Streptococcus pneumoniae R6
aauuccuacuucaaau

SEQ ID NO: 4083604 - RNA, 14 nt, Streptococcus pneumoniae R6
aauuccuucuugac

SEQ ID NO: 4083605 - RNA, 17 nt, Streptococcus pneumoniae R6
aauuccuugaugagcaa

SEQ ID NO: 4083606 - RNA, 15 nt, Streptococcus pneumoniae R6
aauuccuuuaaaaac

SEQ ID NO: 4083607 - RNA, 17 nt, Streptococcus pneumoniae R6
aauuccuuuaaaaacaa

SEQ ID NO: 4083608 - RNA, 21 nt, Streptococcus pneumoniae R6
aauuccuuuaaaaacaaucac

SEQ ID NO: 4083609 - RNA, 20 nt, Streptococcus pneumoniae R6
aauucgcuuuuuuaaaugcu

SEQ ID NO: 4083610 - RNA, 14 nt, Streptococcus pneumoniae R6
aauucggcuugguu

SEQ ID NO: 4083611 - RNA, 18 nt, Streptococcus pneumoniae R6
aauucggugguauuuaga

SEQ ID NO: 4083612 - RNA, 21 nt, Streptococcus pneumoniae R6
aauucuaaaucuugcccuucu

SEQ ID NO: 4083613 - RNA, 15 nt, Streptococcus pneumoniae R6
aauucuaauuaaaua

SEQ ID NO: 4083614 - RNA, 13 nt, Streptococcus pneumoniae R6
aauucuauaucua

SEQ ID NO: 4083615 - RNA, 14 nt, Streptococcus pneumoniae R6
aauucucuaaguga

SEQ ID NO: 4083616 - RNA, 18 nt, Streptococcus pneumoniae R6
aauucugcuuuuaaauag

SEQ ID NO: 4083617 - RNA, 20 nt, Streptococcus pneumoniae R6
aauucugucacaacugaacg

SEQ ID NO: 4083618 - RNA, 22 nt, Streptococcus pneumoniae R6
aauucugucuuagacuuucuca

SEQ ID NO: 4083619 - RNA, 14 nt, Streptococcus pneumoniae R6
aauucuucagcacu

SEQ ID NO: 4083620 - RNA, 22 nt, Streptococcus pneumoniae R6
aauucuuccuacugauaucuuu

SEQ ID NO: 4083621 - RNA, 13 nt, Streptococcus pneumoniae R6
aauucuuccuuug

SEQ ID NO: 4083622 - RNA, 20 nt, Streptococcus pneumoniae R6
aauucuucuccuacuugcuu

SEQ ID NO: 4083623 - RNA, 14 nt, Streptococcus pneumoniae R6
aauucuucucuuuc

SEQ ID NO: 4083624 - RNA, 13 nt, Streptococcus pneumoniae R6
aauucuucuguuu

SEQ ID NO: 4083625 - RNA, 20 nt, Streptococcus pneumoniae R6
aauucuucuguuucugcaac

SEQ ID NO: 4083626 - RNA, 15 nt, Streptococcus pneumoniae R6
aauucuuuaacaaaa

SEQ ID NO: 4083627 - RNA, 17 nt, Streptococcus pneumoniae R6
aauucuuuagaaaacua

SEQ ID NO: 4083628 - RNA, 21 nt, Streptococcus pneumoniae R6
aauucuuugaaaucagaaaaa

SEQ ID NO: 4083629 - RNA, 11 nt, Streptococcus pneumoniae R6
aauucuuuucg

SEQ ID NO: 4083630 - RNA, 21 nt, Streptococcus pneumoniae R6
aauucuuuucgaaacucuuuu

SEQ ID NO: 4083631 - RNA, 13 nt, Streptococcus pneumoniae R6
aauugaaacaaga

SEQ ID NO: 4083632 - RNA, 15 nt, Streptococcus pneumoniae R6
aauugaaacaagaac

SEQ ID NO: 4083633 - RNA, 15 nt, Streptococcus pneumoniae R6
aauugaauugcuuau

SEQ ID NO: 4083634 - RNA, 14 nt, Streptococcus pneumoniae R6
aauugaauuucaag

SEQ ID NO: 4083635 - RNA, 17 nt, Streptococcus pneumoniae R6
aauugacauggaaauua

SEQ ID NO: 4083636 - RNA, 17 nt, Streptococcus pneumoniae R6
aauugacgaagaaacca

SEQ ID NO: 4083637 - RNA, 19 nt, Streptococcus pneumoniae R6
aauugacgaagaaaccaag

SEQ ID NO: 4083638 - RNA, 20 nt, Streptococcus pneumoniae R6
aauugacgaagaaaccaagc

SEQ ID NO: 4083639 - RNA, 17 nt, Streptococcus pneumoniae R6
aauugacuauagcagau

SEQ ID NO: 4083640 - RNA, 18 nt, Streptococcus pneumoniae R6
aauugacuauagcagauu

SEQ ID NO: 4083641 - RNA, 15 nt, Streptococcus pneumoniae R6
aauugacucucaccu

SEQ ID NO: 4083642 - RNA, 13 nt, Streptococcus pneumoniae R6
aauugacugucaa

SEQ ID NO: 4083643 - RNA, 12 nt, Streptococcus pneumoniae R6
aauugagaaaga

SEQ ID NO: 4083644 - RNA, 16 nt, Streptococcus pneumoniae R6
aauugauaaggacagg

SEQ ID NO: 4083645 - RNA, 16 nt, Streptococcus pneumoniae R6
aauugauaauagcacu

SEQ ID NO: 4083646 - RNA, 11 nt, Streptococcus pneumoniae R6
aauugauuaag

SEQ ID NO: 4083647 - RNA, 19 nt, Streptococcus pneumoniae R6
aauugauuuaccuuccuca

SEQ ID NO: 4083648 - RNA, 20 nt, Streptococcus pneumoniae R6
aauugauuuauagaaauguu

SEQ ID NO: 4083649 - RNA, 22 nt, Streptococcus pneumoniae R6
aauugauuugacuuccaaaauu

SEQ ID NO: 4083650 - RNA, 16 nt, Streptococcus pneumoniae R6
aauugcaggagaaaau

SEQ ID NO: 4083651 - RNA, 20 nt, Streptococcus pneumoniae R6
aauugcaggagaaaaugaaa

SEQ ID NO: 4083652 - RNA, 23 nt, Streptococcus pneumoniae R6
aauugccugauaacgaagagcug

SEQ ID NO: 4083653 - RNA, 22 nt, Streptococcus pneumoniae R6
aauugcgcggguucaauacaaa

SEQ ID NO: 4083654 - RNA, 14 nt, Streptococcus pneumoniae R6
aauugcucuucuga

SEQ ID NO: 4083655 - RNA, 20 nt, Streptococcus pneumoniae R6
aauugcucuucugaaaucuu

SEQ ID NO: 4083656 - RNA, 22 nt, Streptococcus pneumoniae R6
aauugcugcaccuucaacugca

SEQ ID NO: 4083657 - RNA, 24 nt, Streptococcus pneumoniae R6
aauugcuuucuucagauuuuauag

SEQ ID NO: 4083658 - RNA, 21 nt, Streptococcus pneumoniae R6
aauuggaguguguccaugugc

SEQ ID NO: 4083659 - RNA, 21 nt, Streptococcus pneumoniae R6
aauuggaucucugugagauag

SEQ ID NO: 4083660 - RNA, 13 nt, Streptococcus pneumoniae R6
aauuggcacaaaa

SEQ ID NO: 4083661 - RNA, 21 nt, Streptococcus pneumoniae R6
aauugguguaaauagaaacca

SEQ ID NO: 4083662 - RNA, 20 nt, Streptococcus pneumoniae R6
aauugguuugaauucuccaa

SEQ ID NO: 4083663 - RNA, 15 nt, Streptococcus pneumoniae R6
aauugguuuuuuaag

SEQ ID NO: 4083664 - RNA, 14 nt, Streptococcus pneumoniae R6
aauuguaaacaaaa

SEQ ID NO: 4083665 - RNA, 16 nt, Streptococcus pneumoniae R6
aauuguaaacaaaaau

SEQ ID NO: 4083666 - RNA, 15 nt, Streptococcus pneumoniae R6
aauuguaaacuguga

SEQ ID NO: 4083667 - RNA, 19 nt, Streptococcus pneumoniae R6
aauuguaaagcgaaaggag

SEQ ID NO: 4083668 - RNA, 17 nt, Streptococcus pneumoniae R6
aauuguagauguucuuu

SEQ ID NO: 4083669 - RNA, 21 nt, Streptococcus pneumoniae R6
aauuguauagugaacugaauc

SEQ ID NO: 4083670 - RNA, 19 nt, Streptococcus pneumoniae R6
aauugucuaaaaauuuaaa

SEQ ID NO: 4083671 - RNA, 13 nt, Streptococcus pneumoniae R6
aauugucuaacuu

SEQ ID NO: 4083672 - RNA, 20 nt, Streptococcus pneumoniae R6
aauugucuaagcgaaacaac

SEQ ID NO: 4083673 - RNA, 19 nt, Streptococcus pneumoniae R6
aauugugcauaagaaacuc

SEQ ID NO: 4083674 - RNA, 21 nt, Streptococcus pneumoniae R6
aauuguugucccuuuuucacu

SEQ ID NO: 4083675 - RNA, 18 nt, Streptococcus pneumoniae R6
aauuguuuugugcuggaa

SEQ ID NO: 4083676 - RNA, 13 nt, Streptococcus pneumoniae R6
aauuuaaaaagaa

SEQ ID NO: 4083677 - RNA, 14 nt, Streptococcus pneumoniae R6
aauuuaaaaauaga

SEQ ID NO: 4083678 - RNA, 18 nt, Streptococcus pneumoniae R6
aauuuaaaaaucuauuuu

SEQ ID NO: 4083679 - RNA, 14 nt, Streptococcus pneumoniae R6
aauuuaaagagauu

SEQ ID NO: 4083680 - RNA, 12 nt, Streptococcus pneumoniae R6
aauuuaagagua

SEQ ID NO: 4083681 - RNA, 15 nt, Streptococcus pneumoniae R6
aauuuaaucauguac

SEQ ID NO: 4083682 - RNA, 21 nt, Streptococcus pneumoniae R6
aauuuaaucauguaccuaaga

SEQ ID NO: 4083683 - RNA, 21 nt, Streptococcus pneumoniae R6
aauuuaauccacuauaauaaa

SEQ ID NO: 4083684 - RNA, 16 nt, Streptococcus pneumoniae R6
aauuuacguccuugga

SEQ ID NO: 4083685 - RNA, 14 nt, Streptococcus pneumoniae R6
aauuuacuauacuu

SEQ ID NO: 4083686 - RNA, 15 nt, Streptococcus pneumoniae R6
aauuuacuuaaaauu

SEQ ID NO: 4083687 - RNA, 13 nt, Streptococcus pneumoniae R6
aauuuagaaauag

SEQ ID NO: 4083688 - RNA, 14 nt, Streptococcus pneumoniae R6
aauuuagaaauaga

SEQ ID NO: 4083689 - RNA, 18 nt, Streptococcus pneumoniae R6
aauuuagagaaugaaaua

SEQ ID NO: 4083690 - RNA, 23 nt, Streptococcus pneumoniae R6
aauuuauacuaauacauuuugua

SEQ ID NO: 4083691 - RNA, 18 nt, Streptococcus pneumoniae R6
aauuuauagaaaaauuuu

SEQ ID NO: 4083692 - RNA, 13 nt, Streptococcus pneumoniae R6
aauuuauagaaau

SEQ ID NO: 4083693 - RNA, 14 nt, Streptococcus pneumoniae R6
aauuuauagaaaua

SEQ ID NO: 4083694 - RNA, 16 nt, Streptococcus pneumoniae R6
aauuuauagaaauauu

SEQ ID NO: 4083695 - RNA, 14 nt, Streptococcus pneumoniae R6
aauuuaucaguuau

SEQ ID NO: 4083696 - RNA, 13 nt, Streptococcus pneumoniae R6
aauuuaucccaau

SEQ ID NO: 4083697 - RNA, 17 nt, Streptococcus pneumoniae R6
aauuuauccgaagauuu

SEQ ID NO: 4083698 - RNA, 23 nt, Streptococcus pneumoniae R6
aauuuaucuagugcuauaguaga

SEQ ID NO: 4083699 - RNA, 18 nt, Streptococcus pneumoniae R6
aauuuaucuccuacuucc

SEQ ID NO: 4083700 - RNA, 18 nt, Streptococcus pneumoniae R6
aauuuauugguauuaaua

SEQ ID NO: 4083701 - RNA, 12 nt, Streptococcus pneumoniae R6
aauuucaaaauc

SEQ ID NO: 4083702 - RNA, 21 nt, Streptococcus pneumoniae R6
aauuucaaaggcuuuuucuuc

SEQ ID NO: 4083703 - RNA, 16 nt, Streptococcus pneumoniae R6
aauuucaaaguagaua

SEQ ID NO: 4083704 - RNA, 20 nt, Streptococcus pneumoniae R6
aauuucacguccgagugcaa

SEQ ID NO: 4083705 - RNA, 18 nt, Streptococcus pneumoniae R6
aauuucacuagaaaauga

SEQ ID NO: 4083706 - RNA, 18 nt, Streptococcus pneumoniae R6
aauuucagaagaaaaaaa

SEQ ID NO: 4083707 - RNA, 17 nt, Streptococcus pneumoniae R6
aauuucaggagaaaaug

SEQ ID NO: 4083708 - RNA, 18 nt, Streptococcus pneumoniae R6
aauuucaggagaaaaugg

SEQ ID NO: 4083709 - RNA, 21 nt, Streptococcus pneumoniae R6
aauuucauauuuucagauaac

SEQ ID NO: 4083710 - RNA, 17 nt, Streptococcus pneumoniae R6
aauuucauuucuuccga

SEQ ID NO: 4083711 - RNA, 15 nt, Streptococcus pneumoniae R6
aauuuccauaccaaa

SEQ ID NO: 4083712 - RNA, 23 nt, Streptococcus pneumoniae R6
aauuuccauaucuuuagggaaau

SEQ ID NO: 4083713 - RNA, 12 nt, Streptococcus pneumoniae R6
aauuucccauuu

SEQ ID NO: 4083714 - RNA, 22 nt, Streptococcus pneumoniae R6
aauuucgcuauuuaaacugauu

SEQ ID NO: 4083715 - RNA, 15 nt, Streptococcus pneumoniae R6
aauuucgcuguuaaa

SEQ ID NO: 4083716 - RNA, 12 nt, Streptococcus pneumoniae R6
aauuucuaaugu

SEQ ID NO: 4083717 - RNA, 19 nt, Streptococcus pneumoniae R6
aauuucuagaaauauuuua

SEQ ID NO: 4083718 - RNA, 17 nt, Streptococcus pneumoniae R6
aauuucuagcaaaguuu

SEQ ID NO: 4083719 - RNA, 23 nt, Streptococcus pneumoniae R6
aauuucuagcaaaguuuuaggaa

SEQ ID NO: 4083720 - RNA, 17 nt, Streptococcus pneumoniae R6
aauuucuauaaauguuu

SEQ ID NO: 4083721 - RNA, 20 nt, Streptococcus pneumoniae R6
aauuucuauaaauguuuuag

SEQ ID NO: 4083722 - RNA, 15 nt, Streptococcus pneumoniae R6
aauuucuaugauaaa

SEQ ID NO: 4083723 - RNA, 20 nt, Streptococcus pneumoniae R6
aauuucuauuuuaaaaauag

SEQ ID NO: 4083724 - RNA, 13 nt, Streptococcus pneumoniae R6
aauuucuccgguu

SEQ ID NO: 4083725 - RNA, 19 nt, Streptococcus pneumoniae R6
aauuucucuaaaucuucua

SEQ ID NO: 4083726 - RNA, 21 nt, Streptococcus pneumoniae R6
aauuucucuaaaucuucuaau

SEQ ID NO: 4083727 - RNA, 17 nt, Streptococcus pneumoniae R6
aauuucucuacaaauaa

SEQ ID NO: 4083728 - RNA, 18 nt, Streptococcus pneumoniae R6
aauuucucuacaaauaag

SEQ ID NO: 4083729 - RNA, 19 nt, Streptococcus pneumoniae R6
aauuucugaaaucaacaca

SEQ ID NO: 4083730 - RNA, 23 nt, Streptococcus pneumoniae R6
aauuucugccauauguccuucau

SEQ ID NO: 4083731 - RNA, 14 nt, Streptococcus pneumoniae R6
aauuucuuuucauu

SEQ ID NO: 4083732 - RNA, 16 nt, Streptococcus pneumoniae R6
aauuucuuuucauucc

SEQ ID NO: 4083733 - RNA, 17 nt, Streptococcus pneumoniae R6
aauuucuuuucauucca

SEQ ID NO: 4083734 - RNA, 14 nt, Streptococcus pneumoniae R6
aauuugaaaaucuu

SEQ ID NO: 4083735 - RNA, 21 nt, Streptococcus pneumoniae R6
aauuugaacaaaguucaaagc

SEQ ID NO: 4083736 - RNA, 21 nt, Streptococcus pneumoniae R6
aauuugaccauuucaaccuug

SEQ ID NO: 4083737 - RNA, 18 nt, Streptococcus pneumoniae R6
aauuugacgauaaaagua

SEQ ID NO: 4083738 - RNA, 17 nt, Streptococcus pneumoniae R6
aauuugacuguccuuau

SEQ ID NO: 4083739 - RNA, 16 nt, Streptococcus pneumoniae R6
aauuugaguaaaagac

SEQ ID NO: 4083740 - RNA, 13 nt, Streptococcus pneumoniae R6
aauuugauauaua

SEQ ID NO: 4083741 - RNA, 18 nt, Streptococcus pneumoniae R6
aauuugauauauaaauga

SEQ ID NO: 4083742 - RNA, 13 nt, Streptococcus pneumoniae R6
aauuugaugauuu

SEQ ID NO: 4083743 - RNA, 20 nt, Streptococcus pneumoniae R6
aauuugaugauuuggcgaug

SEQ ID NO: 4083744 - RNA, 18 nt, Streptococcus pneumoniae R6
aauuugcuacaaauagug

SEQ ID NO: 4083745 - RNA, 17 nt, Streptococcus pneumoniae R6
aauuuggcguuugaaua

SEQ ID NO: 4083746 - RNA, 13 nt, Streptococcus pneumoniae R6
aauuuguaaaguu

SEQ ID NO: 4083747 - RNA, 18 nt, Streptococcus pneumoniae R6
aauuuuaaauuuuucugc

SEQ ID NO: 4083748 - RNA, 16 nt, Streptococcus pneumoniae R6
aauuuuacaaauacca

SEQ ID NO: 4083749 - RNA, 16 nt, Streptococcus pneumoniae R6
aauuuuacuucuuccc

SEQ ID NO: 4083750 - RNA, 19 nt, Streptococcus pneumoniae R6
aauuuuagugaguccaaaa

SEQ ID NO: 4083751 - RNA, 18 nt, Streptococcus pneumoniae R6
aauuuuauacucaucugu

SEQ ID NO: 4083752 - RNA, 16 nt, Streptococcus pneumoniae R6
aauuuuaucuuugaaa

SEQ ID NO: 4083753 - RNA, 18 nt, Streptococcus pneumoniae R6
aauuuuaucuuugaaaua

SEQ ID NO: 4083754 - RNA, 22 nt, Streptococcus pneumoniae R6
aauuuucaaaaaucauuauauu

SEQ ID NO: 4083755 - RNA, 18 nt, Streptococcus pneumoniae R6
aauuuucaaaaucagaaa

SEQ ID NO: 4083756 - RNA, 16 nt, Streptococcus pneumoniae R6
aauuuucuguggauac

SEQ ID NO: 4083757 - RNA, 15 nt, Streptococcus pneumoniae R6
aauuuucuuuuuccu

SEQ ID NO: 4083758 - RNA, 22 nt, Streptococcus pneumoniae R6
aauuuugacucggccuucuuuu

SEQ ID NO: 4083759 - RNA, 16 nt, Streptococcus pneumoniae R6
aauuuugaggauaaaa

SEQ ID NO: 4083760 - RNA, 14 nt, Streptococcus pneumoniae R6
aauuuugugauaaa

SEQ ID NO: 4083761 - RNA, 15 nt, Streptococcus pneumoniae R6
aauuuuucauuuaau

SEQ ID NO: 4083762 - RNA, 12 nt, Streptococcus pneumoniae R6
aauuuuuccuuu

SEQ ID NO: 4083763 - RNA, 18 nt, Streptococcus pneumoniae R6
aauuuuucugcuucuuuu

SEQ ID NO: 4083764 - RNA, 17 nt, Streptococcus pneumoniae R6
aauuuuuugagcaaguu

SEQ ID NO: 4083765 - RNA, 15 nt, Streptococcus pneumoniae R6
aauuuuuuucagaaa

SEQ ID NO: 4083766 - RNA, 18 nt, Streptococcus pneumoniae R6
aauuuuuuucuaauuaaa

SEQ ID NO: 4083767 - RNA, 22 nt, Streptococcus pneumoniae R6
acaaaaaaagcuuuaaaacuaa

SEQ ID NO: 4083768 - RNA, 12 nt, Streptococcus pneumoniae R6
acaaaaaagcca

SEQ ID NO: 4083769 - RNA, 19 nt, Streptococcus pneumoniae R6
acaaaaaaggucaucagca

SEQ ID NO: 4083770 - RNA, 14 nt, Streptococcus pneumoniae R6
acaaaaaaucaaaa

SEQ ID NO: 4083771 - RNA, 20 nt, Streptococcus pneumoniae R6
acaaaaacgauaaaagcuaa

SEQ ID NO: 4083772 - RNA, 16 nt, Streptococcus pneumoniae R6
acaaaaacucaauuuc

SEQ ID NO: 4083773 - RNA, 19 nt, Streptococcus pneumoniae R6
acaaaaaguccucuuucca

SEQ ID NO: 4083774 - RNA, 15 nt, Streptococcus pneumoniae R6
acaaaacuuuuuaaa

SEQ ID NO: 4083775 - RNA, 12 nt, Streptococcus pneumoniae R6
acaaaagagaaa

SEQ ID NO: 4083776 - RNA, 14 nt, Streptococcus pneumoniae R6
acaaaagauaagau

SEQ ID NO: 4083777 - RNA, 22 nt, Streptococcus pneumoniae R6
acaaaagcguguaggaaaccaa

SEQ ID NO: 4083778 - RNA, 20 nt, Streptococcus pneumoniae R6
acaaaaggcucauaguuuau

SEQ ID NO: 4083779 - RNA, 16 nt, Streptococcus pneumoniae R6
acaaaagguucuuuua

SEQ ID NO: 4083780 - RNA, 20 nt, Streptococcus pneumoniae R6
acaaaauaaaaacaucuacc

SEQ ID NO: 4083781 - RNA, 22 nt, Streptococcus pneumoniae R6
acaaaauaggcuccauaauauc

SEQ ID NO: 4083782 - RNA, 18 nt, Streptococcus pneumoniae R6
acaaaauccgcuugggaa

SEQ ID NO: 4083783 - RNA, 15 nt, Streptococcus pneumoniae R6
acaaaauccuuuguu

SEQ ID NO: 4083784 - RNA, 15 nt, Streptococcus pneumoniae R6
acaaaaucuuaaaaa

SEQ ID NO: 4083785 - RNA, 13 nt, Streptococcus pneumoniae R6
acaaaauuaccau

SEQ ID NO: 4083786 - RNA, 18 nt, Streptococcus pneumoniae R6
acaaaauucguccuuucu

SEQ ID NO: 4083787 - RNA, 19 nt, Streptococcus pneumoniae R6
acaaaauucguccuuucuu

SEQ ID NO: 4083788 - RNA, 21 nt, Streptococcus pneumoniae R6
acaaaauucuuccuacugaua

SEQ ID NO: 4083789 - RNA, 12 nt, Streptococcus pneumoniae R6
acaaaauugaua

SEQ ID NO: 4083790 - RNA, 14 nt, Streptococcus pneumoniae R6
acaaaauuugguuu

SEQ ID NO: 4083791 - RNA, 19 nt, Streptococcus pneumoniae R6
acaaacaaggugaacuuga

SEQ ID NO: 4083792 - RNA, 21 nt, Streptococcus pneumoniae R6
acaaacgcccucucaauuccu

SEQ ID NO: 4083793 - RNA, 16 nt, Streptococcus pneumoniae R6
acaaacuccucuccag

SEQ ID NO: 4083794 - RNA, 14 nt, Streptococcus pneumoniae R6
acaaagaaaaaaca

SEQ ID NO: 4083795 - RNA, 15 nt, Streptococcus pneumoniae R6
acaaagaaaaaacaa

SEQ ID NO: 4083796 - RNA, 16 nt, Streptococcus pneumoniae R6
acaaagaaaaaacaaa

SEQ ID NO: 4083797 - RNA, 15 nt, Streptococcus pneumoniae R6
acaaagaaaaagaag

SEQ ID NO: 4083798 - RNA, 14 nt, Streptococcus pneumoniae R6
acaaagaauaaaau

SEQ ID NO: 4083799 - RNA, 15 nt, Streptococcus pneumoniae R6
acaaagaauaaaaua

SEQ ID NO: 4083800 - RNA, 17 nt, Streptococcus pneumoniae R6
acaaagaccuuugaaaa

SEQ ID NO: 4083801 - RNA, 16 nt, Streptococcus pneumoniae R6
acaaagagauugccca

SEQ ID NO: 4083802 - RNA, 18 nt, Streptococcus pneumoniae R6
acaaagagccaaaaaaga

SEQ ID NO: 4083803 - RNA, 21 nt, Streptococcus pneumoniae R6
acaaagagccaaaaaagaaag

SEQ ID NO: 4083804 - RNA, 14 nt, Streptococcus pneumoniae R6
acaaagagccauaa

SEQ ID NO: 4083805 - RNA, 17 nt, Streptococcus pneumoniae R6
acaaagagccauaaaaa

SEQ ID NO: 4083806 - RNA, 18 nt, Streptococcus pneumoniae R6
acaaagagccauaaaaau

SEQ ID NO: 4083807 - RNA, 20 nt, Streptococcus pneumoniae R6
acaaagagccauaaaaauaa

SEQ ID NO: 4083808 - RNA, 18 nt, Streptococcus pneumoniae R6
acaaagagccgaaaaaau

SEQ ID NO: 4083809 - RNA, 23 nt, Streptococcus pneumoniae R6
acaaagagccggaaauugucuga

SEQ ID NO: 4083810 - RNA, 17 nt, Streptococcus pneumoniae R6
acaaagauaaaauugau

SEQ ID NO: 4083811 - RNA, 18 nt, Streptococcus pneumoniae R6
acaaagauaaaauugaua

SEQ ID NO: 4083812 - RNA, 18 nt, Streptococcus pneumoniae R6
acaaagcuaagaaaguaa

SEQ ID NO: 4083813 - RNA, 11 nt, Streptococcus pneumoniae R6
acaaaggauuu

SEQ ID NO: 4083814 - RNA, 19 nt, Streptococcus pneumoniae R6
acaaaguauuaaaauaagu

SEQ ID NO: 4083815 - RNA, 20 nt, Streptococcus pneumoniae R6
acaaaguauuaaaauaaguu

SEQ ID NO: 4083816 - RNA, 16 nt, Streptococcus pneumoniae R6
acaaagucugaaacag

SEQ ID NO: 4083817 - RNA, 22 nt, Streptococcus pneumoniae R6
acaaaguggagguguucuauca

SEQ ID NO: 4083818 - RNA, 20 nt, Streptococcus pneumoniae R6
acaaauaaacggacaaaacu

SEQ ID NO: 4083819 - RNA, 17 nt, Streptococcus pneumoniae R6
acaaauaccauaaacua

SEQ ID NO: 4083820 - RNA, 16 nt, Streptococcus pneumoniae R6
acaaaucaauuagaaa

SEQ ID NO: 4083821 - RNA, 15 nt, Streptococcus pneumoniae R6
acaaaucaauugcua

SEQ ID NO: 4083822 - RNA, 17 nt, Streptococcus pneumoniae R6
acaaaucagaaaaguaa

SEQ ID NO: 4083823 - RNA, 22 nt, Streptococcus pneumoniae R6
acaaaucagaaaaguaacuauu

SEQ ID NO: 4083824 - RNA, 19 nt, Streptococcus pneumoniae R6
acaaauccaaucuucuagc

SEQ ID NO: 4083825 - RNA, 22 nt, Streptococcus pneumoniae R6
acaaaucuaagucaaauaagaa

SEQ ID NO: 4083826 - RNA, 16 nt, Streptococcus pneumoniae R6
acaaauguuuuagcaa

SEQ ID NO: 4083827 - RNA, 18 nt, Streptococcus pneumoniae R6
acaaauguuuuagcaauc

SEQ ID NO: 4083828 - RNA, 18 nt, Streptococcus pneumoniae R6
acaaauucaaacucaaau

SEQ ID NO: 4083829 - RNA, 22 nt, Streptococcus pneumoniae R6
acaaauucgacugccucucuuc

SEQ ID NO: 4083830 - RNA, 19 nt, Streptococcus pneumoniae R6
acaaauugauuugaauucc

SEQ ID NO: 4083831 - RNA, 18 nt, Streptococcus pneumoniae R6
acaaauuuauacuaauac

SEQ ID NO: 4083832 - RNA, 19 nt, Streptococcus pneumoniae R6
acaaauuucguccuuucuu

SEQ ID NO: 4083833 - RNA, 14 nt, Streptococcus pneumoniae R6
acaaauuugaaaau

SEQ ID NO: 4083834 - RNA, 19 nt, Streptococcus pneumoniae R6
acaacaaaaaaggucauca

SEQ ID NO: 4083835 - RNA, 16 nt, Streptococcus pneumoniae R6
acaacaauacuuucca

SEQ ID NO: 4083836 - RNA, 20 nt, Streptococcus pneumoniae R6
acaacaaugagaaauuuuug

SEQ ID NO: 4083837 - RNA, 16 nt, Streptococcus pneumoniae R6
acaacaccgacagcaa

SEQ ID NO: 4083838 - RNA, 18 nt, Streptococcus pneumoniae R6
acaacagcugucgcaccu

SEQ ID NO: 4083839 - RNA, 15 nt, Streptococcus pneumoniae R6
acaacauaacugcua

SEQ ID NO: 4083840 - RNA, 22 nt, Streptococcus pneumoniae R6
acaacauaaguuguaguacuga

SEQ ID NO: 4083841 - RNA, 17 nt, Streptococcus pneumoniae R6
acaaccacauagucaga

SEQ ID NO: 4083842 - RNA, 16 nt, Streptococcus pneumoniae R6
acaaccgagcuaauuu

SEQ ID NO: 4083843 - RNA, 16 nt, Streptococcus pneumoniae R6
acaaccgauaagaauu

SEQ ID NO: 4083844 - RNA, 16 nt, Streptococcus pneumoniae R6
acaaccucaaaacagu

SEQ ID NO: 4083845 - RNA, 18 nt, Streptococcus pneumoniae R6
acaaccucaaagcagugc

SEQ ID NO: 4083846 - RNA, 16 nt, Streptococcus pneumoniae R6
acaaccugaaguagau

SEQ ID NO: 4083847 - RNA, 13 nt, Streptococcus pneumoniae R6
acaaccuuaaaac

SEQ ID NO: 4083848 - RNA, 14 nt, Streptococcus pneumoniae R6
acaaccuuaaaaca

SEQ ID NO: 4083849 - RNA, 22 nt, Streptococcus pneumoniae R6
acaaccuuaaaacgguguuuug

SEQ ID NO: 4083850 - RNA, 16 nt, Streptococcus pneumoniae R6
acaacgucuuuugccu

SEQ ID NO: 4083851 - RNA, 22 nt, Streptococcus pneumoniae R6
acaacucuuauacuuuucucuu

SEQ ID NO: 4083852 - RNA, 16 nt, Streptococcus pneumoniae R6
acaacugauucuacuu

SEQ ID NO: 4083853 - RNA, 14 nt, Streptococcus pneumoniae R6
acaacuuaaaaaga

SEQ ID NO: 4083854 - RNA, 14 nt, Streptococcus pneumoniae R6
acaacuuauaaaaa

SEQ ID NO: 4083855 - RNA, 14 nt, Streptococcus pneumoniae R6
acaagaaaagugca

SEQ ID NO: 4083856 - RNA, 22 nt, Streptococcus pneumoniae R6
acaagaacucucggucuuguuu

SEQ ID NO: 4083857 - RNA, 15 nt, Streptococcus pneumoniae R6
acaagaccucaauau

SEQ ID NO: 4083858 - RNA, 12 nt, Streptococcus pneumoniae R6
acaagagcaagg

SEQ ID NO: 4083859 - RNA, 19 nt, Streptococcus pneumoniae R6
acaagaguucuagcuuccc

SEQ ID NO: 4083860 - RNA, 13 nt, Streptococcus pneumoniae R6
acaagauaggaga

SEQ ID NO: 4083861 - RNA, 14 nt, Streptococcus pneumoniae R6
acaagcucaucuuu

SEQ ID NO: 4083862 - RNA, 16 nt, Streptococcus pneumoniae R6
acaagcugccaaagca

SEQ ID NO: 4083863 - RNA, 15 nt, Streptococcus pneumoniae R6
acaagggauuuuucu

SEQ ID NO: 4083864 - RNA, 16 nt, Streptococcus pneumoniae R6
acaagggauuuuucug

SEQ ID NO: 4083865 - RNA, 16 nt, Streptococcus pneumoniae R6
acaagggcaaaaaaga

SEQ ID NO: 4083866 - RNA, 18 nt, Streptococcus pneumoniae R6
acaaggugaacuugaccu

SEQ ID NO: 4083867 - RNA, 14 nt, Streptococcus pneumoniae R6
acaagguguuuuag

SEQ ID NO: 4083868 - RNA, 18 nt, Streptococcus pneumoniae R6
acaaguauuguaagaauu

SEQ ID NO: 4083869 - RNA, 21 nt, Streptococcus pneumoniae R6
acaagucagcucaaagcgaca

SEQ ID NO: 4083870 - RNA, 15 nt, Streptococcus pneumoniae R6
acaagucauccauga

SEQ ID NO: 4083871 - RNA, 22 nt, Streptococcus pneumoniae R6
acaagucuuaaaaucacaaaaa

SEQ ID NO: 4083872 - RNA, 22 nt, Streptococcus pneumoniae R6
acaaguuagccacaacuaggaa

SEQ ID NO: 4083873 - RNA, 23 nt, Streptococcus pneumoniae R6
acaaguucaucuucaaaaucaaa

SEQ ID NO: 4083874 - RNA, 13 nt, Streptococcus pneumoniae R6
acaaguucuuuuc

SEQ ID NO: 4083875 - RNA, 15 nt, Streptococcus pneumoniae R6
acaaguucuuuucug

SEQ ID NO: 4083876 - RNA, 19 nt, Streptococcus pneumoniae R6
acaauaaaacgcaucauau

SEQ ID NO: 4083877 - RNA, 16 nt, Streptococcus pneumoniae R6
acaauaaaaucaaaca

SEQ ID NO: 4083878 - RNA, 12 nt, Streptococcus pneumoniae R6
acaauaaagaua

SEQ ID NO: 4083879 - RNA, 19 nt, Streptococcus pneumoniae R6
acaauaacacccuuguaaa

SEQ ID NO: 4083880 - RNA, 17 nt, Streptococcus pneumoniae R6
acaauaauugguacauu

SEQ ID NO: 4083881 - RNA, 19 nt, Streptococcus pneumoniae R6
acaauacccacugcgaaga

SEQ ID NO: 4083882 - RNA, 22 nt, Streptococcus pneumoniae R6
acaauagcuuguuccaauugau

SEQ ID NO: 4083883 - RNA, 23 nt, Streptococcus pneumoniae R6
acaauagcuuguuccaauugauu

SEQ ID NO: 4083884 - RNA, 18 nt, Streptococcus pneumoniae R6
acaauauauccaaaacca

SEQ ID NO: 4083885 - RNA, 13 nt, Streptococcus pneumoniae R6
acaaucaagaccc

SEQ ID NO: 4083886 - RNA, 16 nt, Streptococcus pneumoniae R6
acaaucaagacccaag

SEQ ID NO: 4083887 - RNA, 15 nt, Streptococcus pneumoniae R6
acaauccugcgaaau

SEQ ID NO: 4083888 - RNA, 18 nt, Streptococcus pneumoniae R6
acaaucguuucaaaaaau

SEQ ID NO: 4083889 - RNA, 11 nt, Streptococcus pneumoniae R6
acaaucuaucu

SEQ ID NO: 4083890 - RNA, 21 nt, Streptococcus pneumoniae R6
acaaucuaucuuuuaauucau

SEQ ID NO: 4083891 - RNA, 13 nt, Streptococcus pneumoniae R6
acaaucuuaaagu

SEQ ID NO: 4083892 - RNA, 22 nt, Streptococcus pneumoniae R6
acaaucuuaccaaccucagaau

SEQ ID NO: 4083893 - RNA, 17 nt, Streptococcus pneumoniae R6
acaaucuuuucuuuauc

SEQ ID NO: 4083894 - RNA, 23 nt, Streptococcus pneumoniae R6
acaaugacucccauaaaaauaau

SEQ ID NO: 4083895 - RNA, 17 nt, Streptococcus pneumoniae R6
acaaugcuguuucuaua

SEQ ID NO: 4083896 - RNA, 17 nt, Streptococcus pneumoniae R6
acaauguaccugcaaau

SEQ ID NO: 4083897 - RNA, 17 nt, Streptococcus pneumoniae R6
acaauguagccaucauc

SEQ ID NO: 4083898 - RNA, 19 nt, Streptococcus pneumoniae R6
acaaugucuaaaucuuuaa

SEQ ID NO: 4083899 - RNA, 20 nt, Streptococcus pneumoniae R6
acaaugucuaaaucuuuaac

SEQ ID NO: 4083900 - RNA, 22 nt, Streptococcus pneumoniae R6
acaaugugcucagaaacaagaa

SEQ ID NO: 4083901 - RNA, 17 nt, Streptococcus pneumoniae R6
acaauguuuuagaagua

SEQ ID NO: 4083902 - RNA, 18 nt, Streptococcus pneumoniae R6
acaauguuuuagaaguag

SEQ ID NO: 4083903 - RNA, 18 nt, Streptococcus pneumoniae R6
acaauuauauaaaccaaa

SEQ ID NO: 4083904 - RNA, 15 nt, Streptococcus pneumoniae R6
acaauuccuaagaua

SEQ ID NO: 4083905 - RNA, 21 nt, Streptococcus pneumoniae R6
acaauugcuaaaacauuuaua

SEQ ID NO: 4083906 - RNA, 15 nt, Streptococcus pneumoniae R6
acaauuggaaauaac

SEQ ID NO: 4083907 - RNA, 15 nt, Streptococcus pneumoniae R6
acaauuuaaccaaac

SEQ ID NO: 4083908 - RNA, 18 nt, Streptococcus pneumoniae R6
acaauuuaaccaaaccaa

SEQ ID NO: 4083909 - RNA, 14 nt, Streptococcus pneumoniae R6
acaauuucauuucu

SEQ ID NO: 4083910 - RNA, 20 nt, Streptococcus pneumoniae R6
acaauuuccggcucuuuguc

SEQ ID NO: 4083911 - RNA, 14 nt, Streptococcus pneumoniae R6
acaauuuucaucca

SEQ ID NO: 4083912 - RNA, 13 nt, Streptococcus pneumoniae R6
acacaaaaagucc

SEQ ID NO: 4083913 - RNA, 18 nt, Streptococcus pneumoniae R6
acacaagaguucuagcuu

SEQ ID NO: 4083914 - RNA, 20 nt, Streptococcus pneumoniae R6
acacaaucgggaucugauaa

SEQ ID NO: 4083915 - RNA, 18 nt, Streptococcus pneumoniae R6
acacaaugguuagaaaau

SEQ ID NO: 4083916 - RNA, 21 nt, Streptococcus pneumoniae R6
acacacgaagcauaucagaca

SEQ ID NO: 4083917 - RNA, 23 nt, Streptococcus pneumoniae R6
acacagcuguguuccucuuuuug

SEQ ID NO: 4083918 - RNA, 18 nt, Streptococcus pneumoniae R6
acacauguuaacaaauuc

SEQ ID NO: 4083919 - RNA, 18 nt, Streptococcus pneumoniae R6
acaccaaacauaacagga

SEQ ID NO: 4083920 - RNA, 18 nt, Streptococcus pneumoniae R6
acaccaauuuuacaaaua

SEQ ID NO: 4083921 - RNA, 19 nt, Streptococcus pneumoniae R6
acaccacuuuuggucagag

SEQ ID NO: 4083922 - RNA, 16 nt, Streptococcus pneumoniae R6
acaccaguauucuuuu

SEQ ID NO: 4083923 - RNA, 17 nt, Streptococcus pneumoniae R6
acaccaguauucuuuuu

SEQ ID NO: 4083924 - RNA, 19 nt, Streptococcus pneumoniae R6
acaccaguauucuuuuuaa

SEQ ID NO: 4083925 - RNA, 18 nt, Streptococcus pneumoniae R6
acaccauaaauauuugcu

SEQ ID NO: 4083926 - RNA, 19 nt, Streptococcus pneumoniae R6
acaccaucauagucuuuau

SEQ ID NO: 4083927 - RNA, 13 nt, Streptococcus pneumoniae R6
acacccacgucac

SEQ ID NO: 4083928 - RNA, 21 nt, Streptococcus pneumoniae R6
acacccacgucacaaagaaca

SEQ ID NO: 4083929 - RNA, 14 nt, Streptococcus pneumoniae R6
acacccugcaugag

SEQ ID NO: 4083930 - RNA, 19 nt, Streptococcus pneumoniae R6
acaccgacagcaaggucaa

SEQ ID NO: 4083931 - RNA, 22 nt, Streptococcus pneumoniae R6
acacgaucauccauucuuuuuu

SEQ ID NO: 4083932 - RNA, 12 nt, Streptococcus pneumoniae R6
acacggaaguau

SEQ ID NO: 4083933 - RNA, 15 nt, Streptococcus pneumoniae R6
acacggaaguauauu

SEQ ID NO: 4083934 - RNA, 15 nt, Streptococcus pneumoniae R6
acacuaaacaaauga

SEQ ID NO: 4083935 - RNA, 22 nt, Streptococcus pneumoniae R6
acacuagacagugaaaucauac

SEQ ID NO: 4083936 - RNA, 18 nt, Streptococcus pneumoniae R6
acacuagcuggugagaag

SEQ ID NO: 4083937 - RNA, 23 nt, Streptococcus pneumoniae R6
acacugauuucaaggcauuuuuu

SEQ ID NO: 4083938 - RNA, 12 nt, Streptococcus pneumoniae R6
acacuguuuuaa

SEQ ID NO: 4083939 - RNA, 17 nt, Streptococcus pneumoniae R6
acacuguuuuaagguug

SEQ ID NO: 4083940 - RNA, 15 nt, Streptococcus pneumoniae R6
acacuguuuugaggu

SEQ ID NO: 4083941 - RNA, 14 nt, Streptococcus pneumoniae R6
acacuuccaauaau

SEQ ID NO: 4083942 - RNA, 16 nt, Streptococcus pneumoniae R6
acacuuccaauaaugu

SEQ ID NO: 4083943 - RNA, 13 nt, Streptococcus pneumoniae R6
acacuucuacuau

SEQ ID NO: 4083944 - RNA, 13 nt, Streptococcus pneumoniae R6
acacuucuacuuc

SEQ ID NO: 4083945 - RNA, 23 nt, Streptococcus pneumoniae R6
acacuucugcuucuaaaacauug

SEQ ID NO: 4083946 - RNA, 15 nt, Streptococcus pneumoniae R6
acacuugccuaaaca

SEQ ID NO: 4083947 - RNA, 13 nt, Streptococcus pneumoniae R6
acacuuucauuga

SEQ ID NO: 4083948 - RNA, 22 nt, Streptococcus pneumoniae R6
acagaaacaccuuuaucagcca

SEQ ID NO: 4083949 - RNA, 12 nt, Streptococcus pneumoniae R6
acagaaagaaca

SEQ ID NO: 4083950 - RNA, 13 nt, Streptococcus pneumoniae R6
acagaaagaacaa

SEQ ID NO: 4083951 - RNA, 14 nt, Streptococcus pneumoniae R6
acagaaagaacaaa

SEQ ID NO: 4083952 - RNA, 13 nt, Streptococcus pneumoniae R6
acagaaccuugga

SEQ ID NO: 4083953 - RNA, 14 nt, Streptococcus pneumoniae R6
acagaaccuuggaa

SEQ ID NO: 4083954 - RNA, 15 nt, Streptococcus pneumoniae R6
acagaaccuuggaaa

SEQ ID NO: 4083955 - RNA, 18 nt, Streptococcus pneumoniae R6
acagaaccuuggaaauaa

SEQ ID NO: 4083956 - RNA, 15 nt, Streptococcus pneumoniae R6
acagaagaagugaca

SEQ ID NO: 4083957 - RNA, 17 nt, Streptococcus pneumoniae R6
acagaagcuuuaccauc

SEQ ID NO: 4083958 - RNA, 17 nt, Streptococcus pneumoniae R6
acagaaucccagauaaa

SEQ ID NO: 4083959 - RNA, 20 nt, Streptococcus pneumoniae R6
acagaaucccagauaaagcu

SEQ ID NO: 4083960 - RNA, 14 nt, Streptococcus pneumoniae R6
acagacaaaacuaa

SEQ ID NO: 4083961 - RNA, 16 nt, Streptococcus pneumoniae R6
acagagaaaauucuaa

SEQ ID NO: 4083962 - RNA, 13 nt, Streptococcus pneumoniae R6
acagagaagaaau

SEQ ID NO: 4083963 - RNA, 14 nt, Streptococcus pneumoniae R6
acagagaagaaauu

SEQ ID NO: 4083964 - RNA, 15 nt, Streptococcus pneumoniae R6
acagaggcuggacaa

SEQ ID NO: 4083965 - RNA, 21 nt, Streptococcus pneumoniae R6
acagaguacuaaauauaagau

SEQ ID NO: 4083966 - RNA, 21 nt, Streptococcus pneumoniae R6
acagaguauuaaauugcgauu

SEQ ID NO: 4083967 - RNA, 11 nt, Streptococcus pneumoniae R6
acagauaagag

SEQ ID NO: 4083968 - RNA, 21 nt, Streptococcus pneumoniae R6
acagauaagagcaacaaauau

SEQ ID NO: 4083969 - RNA, 19 nt, Streptococcus pneumoniae R6
acagaugagcgaauaguau

SEQ ID NO: 4083970 - RNA, 22 nt, Streptococcus pneumoniae R6
acagauucaucacgaucaaagu

SEQ ID NO: 4083971 - RNA, 21 nt, Streptococcus pneumoniae R6
acagauucaucagggcaaagg

SEQ ID NO: 4083972 - RNA, 14 nt, Streptococcus pneumoniae R6
acagauuucuuaga

SEQ ID NO: 4083973 - RNA, 17 nt, Streptococcus pneumoniae R6
acagauuugaaaacuga

SEQ ID NO: 4083974 - RNA, 13 nt, Streptococcus pneumoniae R6
acagcaccaacuc

SEQ ID NO: 4083975 - RNA, 18 nt, Streptococcus pneumoniae R6
acagcauagaaguuuccu

SEQ ID NO: 4083976 - RNA, 18 nt, Streptococcus pneumoniae R6
acagcauuggaggcaaac

SEQ ID NO: 4083977 - RNA, 16 nt, Streptococcus pneumoniae R6
acagccaaaaguccaa

SEQ ID NO: 4083978 - RNA, 19 nt, Streptococcus pneumoniae R6
acagccaaaaguccaaaga

SEQ ID NO: 4083979 - RNA, 12 nt, Streptococcus pneumoniae R6
acagccaucaga

SEQ ID NO: 4083980 - RNA, 15 nt, Streptococcus pneumoniae R6
acagccaucagagag

SEQ ID NO: 4083981 - RNA, 13 nt, Streptococcus pneumoniae R6
acagccauggugu

SEQ ID NO: 4083982 - RNA, 14 nt, Streptococcus pneumoniae R6
acagccuugacucc

SEQ ID NO: 4083983 - RNA, 21 nt, Streptococcus pneumoniae R6
acagcgcuggucacgaccaga

SEQ ID NO: 4083984 - RNA, 14 nt, Streptococcus pneumoniae R6
acagcuccauaaca

SEQ ID NO: 4083985 - RNA, 15 nt, Streptococcus pneumoniae R6
acagcuccugaaaua

SEQ ID NO: 4083986 - RNA, 18 nt, Streptococcus pneumoniae R6
acagcugucgcaccugac

SEQ ID NO: 4083987 - RNA, 23 nt, Streptococcus pneumoniae R6
acagcugucgcaccugacuccau

SEQ ID NO: 4083988 - RNA, 22 nt, Streptococcus pneumoniae R6
acagcuugcauagacuucaaca

SEQ ID NO: 4083989 - RNA, 12 nt, Streptococcus pneumoniae R6
acaggaaaacca

SEQ ID NO: 4083990 - RNA, 20 nt, Streptococcus pneumoniae R6
acaggauguguaaaaaagua

SEQ ID NO: 4083991 - RNA, 17 nt, Streptococcus pneumoniae R6
acaggccaauacagaua

SEQ ID NO: 4083992 - RNA, 16 nt, Streptococcus pneumoniae R6
acaggcuauugaagaa

SEQ ID NO: 4083993 - RNA, 14 nt, Streptococcus pneumoniae R6
acaggcuuucuccc

SEQ ID NO: 4083994 - RNA, 21 nt, Streptococcus pneumoniae R6
acagggccuuuugcauaauga

SEQ ID NO: 4083995 - RNA, 16 nt, Streptococcus pneumoniae R6
acaggucaauggcaaa

SEQ ID NO: 4083996 - RNA, 14 nt, Streptococcus pneumoniae R6
acaguaaaaaauca

SEQ ID NO: 4083997 - RNA, 15 nt, Streptococcus pneumoniae R6
acaguaacccauacc

SEQ ID NO: 4083998 - RNA, 20 nt, Streptococcus pneumoniae R6
acaguaacguucuuuucaag

SEQ ID NO: 4083999 - RNA, 22 nt, Streptococcus pneumoniae R6
acaguaaguaccugacgaaaga

SEQ ID NO: 4084000 - RNA, 13 nt, Streptococcus pneumoniae R6
acaguaccgaaug

SEQ ID NO: 4084001 - RNA, 21 nt, Streptococcus pneumoniae R6
acagucaaaucgauuucuaac

SEQ ID NO: 4084002 - RNA, 20 nt, Streptococcus pneumoniae R6
acaguccucccuuguuuuua

SEQ ID NO: 4084003 - RNA, 16 nt, Streptococcus pneumoniae R6
acaguccuuguuucca

SEQ ID NO: 4084004 - RNA, 17 nt, Streptococcus pneumoniae R6
acagucugaaaaagagg

SEQ ID NO: 4084005 - RNA, 14 nt, Streptococcus pneumoniae R6
acagucugaaaaau

SEQ ID NO: 4084006 - RNA, 16 nt, Streptococcus pneumoniae R6
acagugauuaaaacug

SEQ ID NO: 4084007 - RNA, 22 nt, Streptococcus pneumoniae R6
acagugggcuauuccauauuca

SEQ ID NO: 4084008 - RNA, 19 nt, Streptococcus pneumoniae R6
acaguguuuuaagcugacu

SEQ ID NO: 4084009 - RNA, 21 nt, Streptococcus pneumoniae R6
acaguguuuugagcaaccugc

SEQ ID NO: 4084010 - RNA, 17 nt, Streptococcus pneumoniae R6
acaguguuuugagcuga

SEQ ID NO: 4084011 - RNA, 19 nt, Streptococcus pneumoniae R6
acaguguuuugagcugacu

SEQ ID NO: 4084012 - RNA, 18 nt, Streptococcus pneumoniae R6
acaguguuuugaggcugc

SEQ ID NO: 4084013 - RNA, 16 nt, Streptococcus pneumoniae R6
acaguuagacaauuaa

SEQ ID NO: 4084014 - RNA, 13 nt, Streptococcus pneumoniae R6
acaguugacaaag

SEQ ID NO: 4084015 - RNA, 14 nt, Streptococcus pneumoniae R6
acaguugacaaaga

SEQ ID NO: 4084016 - RNA, 23 nt, Streptococcus pneumoniae R6
acaguugcaucuuaguuaaaaua

SEQ ID NO: 4084017 - RNA, 16 nt, Streptococcus pneumoniae R6
acaguugggaaauucu

SEQ ID NO: 4084018 - RNA, 14 nt, Streptococcus pneumoniae R6
acaguuucggcugu

SEQ ID NO: 4084019 - RNA, 17 nt, Streptococcus pneumoniae R6
acaguuugcucagcauu

SEQ ID NO: 4084020 - RNA, 17 nt, Streptococcus pneumoniae R6
acaguuuguguuucuuu

SEQ ID NO: 4084021 - RNA, 13 nt, Streptococcus pneumoniae R6
acaguuuugaggu

SEQ ID NO: 4084022 - RNA, 22 nt, Streptococcus pneumoniae R6
acaguuuugagguuguggauag

SEQ ID NO: 4084023 - RNA, 16 nt, Streptococcus pneumoniae R6
acauaaaguauuauaa

SEQ ID NO: 4084024 - RNA, 21 nt, Streptococcus pneumoniae R6
acauaaccagauauaggcaua

SEQ ID NO: 4084025 - RNA, 15 nt, Streptococcus pneumoniae R6
acauaauaaaacgca

SEQ ID NO: 4084026 - RNA, 16 nt, Streptococcus pneumoniae R6
acauaaucaagaugaa

SEQ ID NO: 4084027 - RNA, 15 nt, Streptococcus pneumoniae R6
acauaauuuaaaaua

SEQ ID NO: 4084028 - RNA, 15 nt, Streptococcus pneumoniae R6
acauaauuuuagugc

SEQ ID NO: 4084029 - RNA, 16 nt, Streptococcus pneumoniae R6
acauacaacuuaaaaa

SEQ ID NO: 4084030 - RNA, 17 nt, Streptococcus pneumoniae R6
acauacccaugcuuuuc

SEQ ID NO: 4084031 - RNA, 22 nt, Streptococcus pneumoniae R6
acauacgcauacuaauagcacc

SEQ ID NO: 4084032 - RNA, 17 nt, Streptococcus pneumoniae R6
acauacugaacucaacu

SEQ ID NO: 4084033 - RNA, 15 nt, Streptococcus pneumoniae R6
acauacugugccagc

SEQ ID NO: 4084034 - RNA, 21 nt, Streptococcus pneumoniae R6
acauacuguuuuccuuucaau

SEQ ID NO: 4084035 - RNA, 15 nt, Streptococcus pneumoniae R6
acauacuuuaucuuc

SEQ ID NO: 4084036 - RNA, 19 nt, Streptococcus pneumoniae R6
acauagacuccauagggca

SEQ ID NO: 4084037 - RNA, 24 nt, Streptococcus pneumoniae R6
acauagacuccauagggcauaagu

SEQ ID NO: 4084038 - RNA, 14 nt, Streptococcus pneumoniae R6
acauagacuuccca

SEQ ID NO: 4084039 - RNA, 15 nt, Streptococcus pneumoniae R6
acauagacuucccag

SEQ ID NO: 4084040 - RNA, 15 nt, Streptococcus pneumoniae R6
acauagagagacagc

SEQ ID NO: 4084041 - RNA, 23 nt, Streptococcus pneumoniae R6
acauagagagacagcaguuauga

SEQ ID NO: 4084042 - RNA, 22 nt, Streptococcus pneumoniae R6
acauaggcuaaugagucuauuc

SEQ ID NO: 4084043 - RNA, 14 nt, Streptococcus pneumoniae R6
acauagucaaagag

SEQ ID NO: 4084044 - RNA, 16 nt, Streptococcus pneumoniae R6
acauagucaagcucuu

SEQ ID NO: 4084045 - RNA, 20 nt, Streptococcus pneumoniae R6
acauauacacuuaaauucau

SEQ ID NO: 4084046 - RNA, 23 nt, Streptococcus pneumoniae R6
acauauacacuuaaauucauaua

SEQ ID NO: 4084047 - RNA, 20 nt, Streptococcus pneumoniae R6
acauauauaauccaagauga

SEQ ID NO: 4084048 - RNA, 14 nt, Streptococcus pneumoniae R6
acauaucuuuagug

SEQ ID NO: 4084049 - RNA, 17 nt, Streptococcus pneumoniae R6
acauaugauugucuccu

SEQ ID NO: 4084050 - RNA, 16 nt, Streptococcus pneumoniae R6
acauauguaagaagau

SEQ ID NO: 4084051 - RNA, 17 nt, Streptococcus pneumoniae R6
acauauucccacaauaa

SEQ ID NO: 4084052 - RNA, 16 nt, Streptococcus pneumoniae R6
acauauugauauuuau

SEQ ID NO: 4084053 - RNA, 17 nt, Streptococcus pneumoniae R6
acauauugauauuuaua

SEQ ID NO: 4084054 - RNA, 14 nt, Streptococcus pneumoniae R6
acauauuuucaaaa

SEQ ID NO: 4084055 - RNA, 17 nt, Streptococcus pneumoniae R6
acaucauugucaaacaa

SEQ ID NO: 4084056 - RNA, 17 nt, Streptococcus pneumoniae R6
acaucgaaguuguguuu

SEQ ID NO: 4084057 - RNA, 21 nt, Streptococcus pneumoniae R6
acaucgaaguuguguuugacc

SEQ ID NO: 4084058 - RNA, 23 nt, Streptococcus pneumoniae R6
acaucgaaguuguguuugaccac

SEQ ID NO: 4084059 - RNA, 22 nt, Streptococcus pneumoniae R6
acaucgugguacaaguaucuac

SEQ ID NO: 4084060 - RNA, 13 nt, Streptococcus pneumoniae R6
acaucuaccuauu

SEQ ID NO: 4084061 - RNA, 14 nt, Streptococcus pneumoniae R6
acaucuaccuauuc

SEQ ID NO: 4084062 - RNA, 18 nt, Streptococcus pneumoniae R6
acaucucuuguaacccaa

SEQ ID NO: 4084063 - RNA, 22 nt, Streptococcus pneumoniae R6
acaucucuuguuuaagagcaca

SEQ ID NO: 4084064 - RNA, 18 nt, Streptococcus pneumoniae R6
acaucuggguuaaaaauu

SEQ ID NO: 4084065 - RNA, 13 nt, Streptococcus pneumoniae R6
acaucuugaaguu

SEQ ID NO: 4084066 - RNA, 20 nt, Streptococcus pneumoniae R6
acaucuugaaguugauucau

SEQ ID NO: 4084067 - RNA, 12 nt, Streptococcus pneumoniae R6
acaucuuuucca

SEQ ID NO: 4084068 - RNA, 14 nt, Streptococcus pneumoniae R6
acaucuuuugauag

SEQ ID NO: 4084069 - RNA, 12 nt, Streptococcus pneumoniae R6
acaugaaacugu

SEQ ID NO: 4084070 - RNA, 22 nt, Streptococcus pneumoniae R6
acaugaaacuguggaaaauaga

SEQ ID NO: 4084071 - RNA, 19 nt, Streptococcus pneumoniae R6
acaugaaccucuucauuca

SEQ ID NO: 4084072 - RNA, 21 nt, Streptococcus pneumoniae R6
acaugacaaauucuccacaga

SEQ ID NO: 4084073 - RNA, 15 nt, Streptococcus pneumoniae R6
acaugagaauacaaa

SEQ ID NO: 4084074 - RNA, 22 nt, Streptococcus pneumoniae R6
acaugagaauacaaaaaucuaa

SEQ ID NO: 4084075 - RNA, 16 nt, Streptococcus pneumoniae R6
acaugcgcaaaauaau

SEQ ID NO: 4084076 - RNA, 22 nt, Streptococcus pneumoniae R6
acaugcguuucagcauauuucc

SEQ ID NO: 4084077 - RNA, 23 nt, Streptococcus pneumoniae R6
acaugcguuucagcauauuuccc

SEQ ID NO: 4084078 - RNA, 19 nt, Streptococcus pneumoniae R6
acaugcuguuagaagacuu

SEQ ID NO: 4084079 - RNA, 20 nt, Streptococcus pneumoniae R6
acauggaaauuauaaaacca

SEQ ID NO: 4084080 - RNA, 19 nt, Streptococcus pneumoniae R6
acauggcgccauuuggccc

SEQ ID NO: 4084081 - RNA, 20 nt, Streptococcus pneumoniae R6
acauguccauucaucggaau

SEQ ID NO: 4084082 - RNA, 21 nt, Streptococcus pneumoniae R6
acauguguuaccauaguuccg

SEQ ID NO: 4084083 - RNA, 18 nt, Streptococcus pneumoniae R6
acauguuuugagcugacu

SEQ ID NO: 4084084 - RNA, 17 nt, Streptococcus pneumoniae R6
acauuaacgaucaauca

SEQ ID NO: 4084085 - RNA, 20 nt, Streptococcus pneumoniae R6
acauuacccauagauuuuua

SEQ ID NO: 4084086 - RNA, 17 nt, Streptococcus pneumoniae R6
acauuagggucuuuaau

SEQ ID NO: 4084087 - RNA, 18 nt, Streptococcus pneumoniae R6
acauuauccaugaaaaau

SEQ ID NO: 4084088 - RNA, 19 nt, Streptococcus pneumoniae R6
acauuaugcguuuuuguga

SEQ ID NO: 4084089 - RNA, 18 nt, Streptococcus pneumoniae R6
acauuauugauuccguca

SEQ ID NO: 4084090 - RNA, 19 nt, Streptococcus pneumoniae R6
acauuauugauuccgucau

SEQ ID NO: 4084091 - RNA, 14 nt, Streptococcus pneumoniae R6
acauucccaaacaa

SEQ ID NO: 4084092 - RNA, 15 nt, Streptococcus pneumoniae R6
acauucccaaacaaa

SEQ ID NO: 4084093 - RNA, 18 nt, Streptococcus pneumoniae R6
acauucccaaacaaaaaa

SEQ ID NO: 4084094 - RNA, 15 nt, Streptococcus pneumoniae R6
acauucguuccuuua

SEQ ID NO: 4084095 - RNA, 14 nt, Streptococcus pneumoniae R6
acauucuaaaacgc

SEQ ID NO: 4084096 - RNA, 16 nt, Streptococcus pneumoniae R6
acauucuaaaacgcau

SEQ ID NO: 4084097 - RNA, 20 nt, Streptococcus pneumoniae R6
acauucuuaucaauugauuu

SEQ ID NO: 4084098 - RNA, 19 nt, Streptococcus pneumoniae R6
acauucuuuuuaaggaguu

SEQ ID NO: 4084099 - RNA, 15 nt, Streptococcus pneumoniae R6
acauugaaaauguga

SEQ ID NO: 4084100 - RNA, 19 nt, Streptococcus pneumoniae R6
acauugaaaaugugaaaua

SEQ ID NO: 4084101 - RNA, 22 nt, Streptococcus pneumoniae R6
acauugauaauaggagcuuuug

SEQ ID NO: 4084102 - RNA, 23 nt, Streptococcus pneumoniae R6
acauugguucuuuuuacuuauaa

SEQ ID NO: 4084103 - RNA, 19 nt, Streptococcus pneumoniae R6
acauugucuaaaauuucau

SEQ ID NO: 4084104 - RNA, 14 nt, Streptococcus pneumoniae R6
acauuguuagaaau

SEQ ID NO: 4084105 - RNA, 16 nt, Streptococcus pneumoniae R6
acauuguuuguacuug

SEQ ID NO: 4084106 - RNA, 20 nt, Streptococcus pneumoniae R6
acauuuaagccuuuuugaau

SEQ ID NO: 4084107 - RNA, 23 nt, Streptococcus pneumoniae R6
acauuuacgaaucucuuuccaca

SEQ ID NO: 4084108 - RNA, 16 nt, Streptococcus pneumoniae R6
acauuuauagaaauua

SEQ ID NO: 4084109 - RNA, 17 nt, Streptococcus pneumoniae R6
acauuuccauguaaaau

SEQ ID NO: 4084110 - RNA, 16 nt, Streptococcus pneumoniae R6
acauuuccgauuucag

SEQ ID NO: 4084111 - RNA, 23 nt, Streptococcus pneumoniae R6
acauuucgauaaagggaagcccc

SEQ ID NO: 4084112 - RNA, 17 nt, Streptococcus pneumoniae R6
acauuucuauaaaucaa

SEQ ID NO: 4084113 - RNA, 22 nt, Streptococcus pneumoniae R6
accaaaaaaaauacaguaucca

SEQ ID NO: 4084114 - RNA, 14 nt, Streptococcus pneumoniae R6
accaaaaaguggaa

SEQ ID NO: 4084115 - RNA, 14 nt, Streptococcus pneumoniae R6
accaaaaccaauca

SEQ ID NO: 4084116 - RNA, 17 nt, Streptococcus pneumoniae R6
accaaaaccaaucaauu

SEQ ID NO: 4084117 - RNA, 19 nt, Streptococcus pneumoniae R6
accaaaacgccaucuucca

SEQ ID NO: 4084118 - RNA, 13 nt, Streptococcus pneumoniae R6
accaaaaucauac

SEQ ID NO: 4084119 - RNA, 16 nt, Streptococcus pneumoniae R6
accaaacggauuuugu

SEQ ID NO: 4084120 - RNA, 16 nt, Streptococcus pneumoniae R6
accaaacggauuuuuu

SEQ ID NO: 4084121 - RNA, 14 nt, Streptococcus pneumoniae R6
accaaagaaaaacu

SEQ ID NO: 4084122 - RNA, 18 nt, Streptococcus pneumoniae R6
accaaagcaucaaucaaa

SEQ ID NO: 4084123 - RNA, 15 nt, Streptococcus pneumoniae R6
accaaaggaagcuga

SEQ ID NO: 4084124 - RNA, 18 nt, Streptococcus pneumoniae R6
accaaaggaagcugagcu

SEQ ID NO: 4084125 - RNA, 19 nt, Streptococcus pneumoniae R6
accaaaggcauugcguuug

SEQ ID NO: 4084126 - RNA, 14 nt, Streptococcus pneumoniae R6
accaaaucagauaa

SEQ ID NO: 4084127 - RNA, 12 nt, Streptococcus pneumoniae R6
accaaauuucau

SEQ ID NO: 4084128 - RNA, 20 nt, Streptococcus pneumoniae R6
accaaauuucauauuuucag

SEQ ID NO: 4084129 - RNA, 17 nt, Streptococcus pneumoniae R6
accaacauagauaaaga

SEQ ID NO: 4084130 - RNA, 21 nt, Streptococcus pneumoniae R6
accaacuacuaaaccaauaau

SEQ ID NO: 4084131 - RNA, 19 nt, Streptococcus pneumoniae R6
accaacuccucucuccucc

SEQ ID NO: 4084132 - RNA, 14 nt, Streptococcus pneumoniae R6
accaagaaguccau

SEQ ID NO: 4084133 - RNA, 20 nt, Streptococcus pneumoniae R6
accaagagacgauuccaaac

SEQ ID NO: 4084134 - RNA, 20 nt, Streptococcus pneumoniae R6
accaagaucuugucugcaug

SEQ ID NO: 4084135 - RNA, 20 nt, Streptococcus pneumoniae R6
accaagcgguagaugaagca

SEQ ID NO: 4084136 - RNA, 17 nt, Streptococcus pneumoniae R6
accaagcuaucagagau

SEQ ID NO: 4084137 - RNA, 15 nt, Streptococcus pneumoniae R6
accaaguaaaucuac

SEQ ID NO: 4084138 - RNA, 22 nt, Streptococcus pneumoniae R6
accaagucaucaaaaauagaaa

SEQ ID NO: 4084139 - RNA, 14 nt, Streptococcus pneumoniae R6
accaauaauaaaac

SEQ ID NO: 4084140 - RNA, 19 nt, Streptococcus pneumoniae R6
accaauacaggaaaaccag

SEQ ID NO: 4084141 - RNA, 14 nt, Streptococcus pneumoniae R6
accaaucaaucguc

SEQ ID NO: 4084142 - RNA, 15 nt, Streptococcus pneumoniae R6
accaaucaaucgucc

SEQ ID NO: 4084143 - RNA, 20 nt, Streptococcus pneumoniae R6
accaaucauuuggaaaacaa

SEQ ID NO: 4084144 - RNA, 23 nt, Streptococcus pneumoniae R6
accaaucguaaacugagcaaaac

SEQ ID NO: 4084145 - RNA, 20 nt, Streptococcus pneumoniae R6
accaaucucaaauccuugaa

SEQ ID NO: 4084146 - RNA, 22 nt, Streptococcus pneumoniae R6
accaaucucaaauccuugaaga

SEQ ID NO: 4084147 - RNA, 14 nt, Streptococcus pneumoniae R6
accaaucuuuucca

SEQ ID NO: 4084148 - RNA, 21 nt, Streptococcus pneumoniae R6
accaaugagaaacuuagcgaa

SEQ ID NO: 4084149 - RNA, 18 nt, Streptococcus pneumoniae R6
accaauguucaagacauc

SEQ ID NO: 4084150 - RNA, 14 nt, Streptococcus pneumoniae R6
accaauucaguaac

SEQ ID NO: 4084151 - RNA, 17 nt, Streptococcus pneumoniae R6
accaauuucuuaauagc

SEQ ID NO: 4084152 - RNA, 13 nt, Streptococcus pneumoniae R6
accacaaaagaga

SEQ ID NO: 4084153 - RNA, 15 nt, Streptococcus pneumoniae R6
accacaaaagagaaa

SEQ ID NO: 4084154 - RNA, 17 nt, Streptococcus pneumoniae R6
accacaaacaaggugaa

SEQ ID NO: 4084155 - RNA, 17 nt, Streptococcus pneumoniae R6
accacaccgauaucuga

SEQ ID NO: 4084156 - RNA, 18 nt, Streptococcus pneumoniae R6
accacagcguuucuauau

SEQ ID NO: 4084157 - RNA, 13 nt, Streptococcus pneumoniae R6
accacaggagcug

SEQ ID NO: 4084158 - RNA, 15 nt, Streptococcus pneumoniae R6
accaccuacuguggu

SEQ ID NO: 4084159 - RNA, 14 nt, Streptococcus pneumoniae R6
accaccuuccuugg

SEQ ID NO: 4084160 - RNA, 23 nt, Streptococcus pneumoniae R6
accaccuuuaaauccugcaaaga

SEQ ID NO: 4084161 - RNA, 14 nt, Streptococcus pneumoniae R6
accaccuuugagau

SEQ ID NO: 4084162 - RNA, 17 nt, Streptococcus pneumoniae R6
accacgaaguccuuguu

SEQ ID NO: 4084163 - RNA, 16 nt, Streptococcus pneumoniae R6
accacgguaaaauacu

SEQ ID NO: 4084164 - RNA, 17 nt, Streptococcus pneumoniae R6
accacguauaauucuaa

SEQ ID NO: 4084165 - RNA, 20 nt, Streptococcus pneumoniae R6
accacguucugcaacaacag

SEQ ID NO: 4084166 - RNA, 22 nt, Streptococcus pneumoniae R6
accacuagcagccacuuuuuau

SEQ ID NO: 4084167 - RNA, 18 nt, Streptococcus pneumoniae R6
accacuagugaauuuggu

SEQ ID NO: 4084168 - RNA, 15 nt, Streptococcus pneumoniae R6
accacuuccuaccua

SEQ ID NO: 4084169 - RNA, 18 nt, Streptococcus pneumoniae R6
accagaaaguacccaugu

SEQ ID NO: 4084170 - RNA, 14 nt, Streptococcus pneumoniae R6
accagaaccaugac

SEQ ID NO: 4084171 - RNA, 18 nt, Streptococcus pneumoniae R6
accagaauagcugucaaa

SEQ ID NO: 4084172 - RNA, 12 nt, Streptococcus pneumoniae R6
accagagcgacu

SEQ ID NO: 4084173 - RNA, 22 nt, Streptococcus pneumoniae R6
accagaugagacgagcaguucc

SEQ ID NO: 4084174 - RNA, 17 nt, Streptococcus pneumoniae R6
accagcaguaucaauca

SEQ ID NO: 4084175 - RNA, 20 nt, Streptococcus pneumoniae R6
accagcaguaucaaucauga

SEQ ID NO: 4084176 - RNA, 15 nt, Streptococcus pneumoniae R6
accagccuguuuuca

SEQ ID NO: 4084177 - RNA, 19 nt, Streptococcus pneumoniae R6
accagcgauagcuccaucu

SEQ ID NO: 4084178 - RNA, 13 nt, Streptococcus pneumoniae R6
accagcuaccaga

SEQ ID NO: 4084179 - RNA, 15 nt, Streptococcus pneumoniae R6
accagcuacuguacu

SEQ ID NO: 4084180 - RNA, 14 nt, Streptococcus pneumoniae R6
accagcuauuaaga

SEQ ID NO: 4084181 - RNA, 15 nt, Streptococcus pneumoniae R6
accaggagccaagau

SEQ ID NO: 4084182 - RNA, 17 nt, Streptococcus pneumoniae R6
accagguuuuucaccag

SEQ ID NO: 4084183 - RNA, 16 nt, Streptococcus pneumoniae R6
accaguccuugaaaaa

SEQ ID NO: 4084184 - RNA, 17 nt, Streptococcus pneumoniae R6
accagucgcagaguggu

SEQ ID NO: 4084185 - RNA, 13 nt, Streptococcus pneumoniae R6
accaguuaccauu

SEQ ID NO: 4084186 - RNA, 14 nt, Streptococcus pneumoniae R6
accaguuucuucuu

SEQ ID NO: 4084187 - RNA, 15 nt, Streptococcus pneumoniae R6
accaguuucuucuuu

SEQ ID NO: 4084188 - RNA, 18 nt, Streptococcus pneumoniae R6
accauaaaucuugauguc

SEQ ID NO: 4084189 - RNA, 17 nt, Streptococcus pneumoniae R6
accauacagaaucuuca

SEQ ID NO: 4084190 - RNA, 14 nt, Streptococcus pneumoniae R6
accauacauugauu

SEQ ID NO: 4084191 - RNA, 13 nt, Streptococcus pneumoniae R6
accauagguuuug

SEQ ID NO: 4084192 - RNA, 17 nt, Streptococcus pneumoniae R6
accauaguguuucucug

SEQ ID NO: 4084193 - RNA, 15 nt, Streptococcus pneumoniae R6
accauaguuccaguc

SEQ ID NO: 4084194 - RNA, 16 nt, Streptococcus pneumoniae R6
accaucaaaauagugu

SEQ ID NO: 4084195 - RNA, 13 nt, Streptococcus pneumoniae R6
accaucaaagacc

SEQ ID NO: 4084196 - RNA, 17 nt, Streptococcus pneumoniae R6
accaucaucagcauaau

SEQ ID NO: 4084197 - RNA, 19 nt, Streptococcus pneumoniae R6
accauccugaauagugaag

SEQ ID NO: 4084198 - RNA, 15 nt, Streptococcus pneumoniae R6
accaucuaacucaua

SEQ ID NO: 4084199 - RNA, 21 nt, Streptococcus pneumoniae R6
accaucuagccauuugcagac

SEQ ID NO: 4084200 - RNA, 11 nt, Streptococcus pneumoniae R6
accaucucaca

SEQ ID NO: 4084201 - RNA, 21 nt, Streptococcus pneumoniae R6
accaucuguaccgaccuuguc

SEQ ID NO: 4084202 - RNA, 17 nt, Streptococcus pneumoniae R6
accaugagguaagagaa

SEQ ID NO: 4084203 - RNA, 21 nt, Streptococcus pneumoniae R6
accaugcggaugcaugccauu

SEQ ID NO: 4084204 - RNA, 19 nt, Streptococcus pneumoniae R6
accauggacuaaaguugua

SEQ ID NO: 4084205 - RNA, 17 nt, Streptococcus pneumoniae R6
accaugucagcccuauc

SEQ ID NO: 4084206 - RNA, 17 nt, Streptococcus pneumoniae R6
accauguuuugagcuga

SEQ ID NO: 4084207 - RNA, 19 nt, Streptococcus pneumoniae R6
accauuagauuucaggugu

SEQ ID NO: 4084208 - RNA, 15 nt, Streptococcus pneumoniae R6
accauucaauucugg

SEQ ID NO: 4084209 - RNA, 14 nt, Streptococcus pneumoniae R6
accauugacuugga

SEQ ID NO: 4084210 - RNA, 22 nt, Streptococcus pneumoniae R6
accauugacuuggaaccagccu

SEQ ID NO: 4084211 - RNA, 14 nt, Streptococcus pneumoniae R6
accauuuuccaaga

SEQ ID NO: 4084212 - RNA, 19 nt, Streptococcus pneumoniae R6
acccaaaacacaaaaaguc

SEQ ID NO: 4084213 - RNA, 21 nt, Streptococcus pneumoniae R6
acccaaaagauagaugauuua

SEQ ID NO: 4084214 - RNA, 23 nt, Streptococcus pneumoniae R6
acccaaauggauagaucuuuacu

SEQ ID NO: 4084215 - RNA, 15 nt, Streptococcus pneumoniae R6
acccaagcuuuaugc

SEQ ID NO: 4084216 - RNA, 19 nt, Streptococcus pneumoniae R6
acccaaguaaucugcaccu

SEQ ID NO: 4084217 - RNA, 13 nt, Streptococcus pneumoniae R6
acccacaaagaua

SEQ ID NO: 4084218 - RNA, 16 nt, Streptococcus pneumoniae R6
acccaccaagucauca

SEQ ID NO: 4084219 - RNA, 20 nt, Streptococcus pneumoniae R6
acccacucgccaguugcugc

SEQ ID NO: 4084220 - RNA, 15 nt, Streptococcus pneumoniae R6
acccaggcaaagagu

SEQ ID NO: 4084221 - RNA, 15 nt, Streptococcus pneumoniae R6
acccauaauaucaua

SEQ ID NO: 4084222 - RNA, 13 nt, Streptococcus pneumoniae R6
acccauagauuuu

SEQ ID NO: 4084223 - RNA, 16 nt, Streptococcus pneumoniae R6
acccauagauuuuuau

SEQ ID NO: 4084224 - RNA, 13 nt, Streptococcus pneumoniae R6
acccauauuuuuc

SEQ ID NO: 4084225 - RNA, 20 nt, Streptococcus pneumoniae R6
acccauuuauggaaaaaaug

SEQ ID NO: 4084226 - RNA, 14 nt, Streptococcus pneumoniae R6
accccaagaaacaa

SEQ ID NO: 4084227 - RNA, 20 nt, Streptococcus pneumoniae R6
acccccaagaaugggcuccc

SEQ ID NO: 4084228 - RNA, 20 nt, Streptococcus pneumoniae R6
acccgcgcaauuaagcaggu

SEQ ID NO: 4084229 - RNA, 12 nt, Streptococcus pneumoniae R6
acccuauauuuc

SEQ ID NO: 4084230 - RNA, 18 nt, Streptococcus pneumoniae R6
acccucguuaucauucca

SEQ ID NO: 4084231 - RNA, 20 nt, Streptococcus pneumoniae R6
acccuguccgugauuguuuu

SEQ ID NO: 4084232 - RNA, 21 nt, Streptococcus pneumoniae R6
acccuucuuuuuauaggcucu

SEQ ID NO: 4084233 - RNA, 12 nt, Streptococcus pneumoniae R6
acccuugauuuu

SEQ ID NO: 4084234 - RNA, 20 nt, Streptococcus pneumoniae R6
acccuugauuuuuuccuauu

SEQ ID NO: 4084235 - RNA, 16 nt, Streptococcus pneumoniae R6
acccuugcuuuuucuu

SEQ ID NO: 4084236 - RNA, 19 nt, Streptococcus pneumoniae R6
acccuugcuuuuucuuuuu

SEQ ID NO: 4084237 - RNA, 18 nt, Streptococcus pneumoniae R6
accgaaaaucuccucuac

SEQ ID NO: 4084238 - RNA, 12 nt, Streptococcus pneumoniae R6
accgaauuuuuc

SEQ ID NO: 4084239 - RNA, 14 nt, Streptococcus pneumoniae R6
accgacaacccagu

SEQ ID NO: 4084240 - RNA, 22 nt, Streptococcus pneumoniae R6
accgacagcaaggucaauaaca

SEQ ID NO: 4084241 - RNA, 19 nt, Streptococcus pneumoniae R6
accgaccuugucuccccau

SEQ ID NO: 4084242 - RNA, 21 nt, Streptococcus pneumoniae R6
accgacgauaaggacgguagc

SEQ ID NO: 4084243 - RNA, 14 nt, Streptococcus pneumoniae R6
accgacuucugagc

SEQ ID NO: 4084244 - RNA, 16 nt, Streptococcus pneumoniae R6
accgagggaaguaauu

SEQ ID NO: 4084245 - RNA, 20 nt, Streptococcus pneumoniae R6
accgauacgaugaccaagau

SEQ ID NO: 4084246 - RNA, 15 nt, Streptococcus pneumoniae R6
accgaucucaucuuc

SEQ ID NO: 4084247 - RNA, 21 nt, Streptococcus pneumoniae R6
accgcuucagcgauuucuuca

SEQ ID NO: 4084248 - RNA, 12 nt, Streptococcus pneumoniae R6
accggagaaaga

SEQ ID NO: 4084249 - RNA, 14 nt, Streptococcus pneumoniae R6
accggcaucggaua

SEQ ID NO: 4084250 - RNA, 19 nt, Streptococcus pneumoniae R6
accguaugauucguuugaa

SEQ ID NO: 4084251 - RNA, 22 nt, Streptococcus pneumoniae R6
accguauguaugguuacugacu

SEQ ID NO: 4084252 - RNA, 18 nt, Streptococcus pneumoniae R6
accguauuuuuguuacca

SEQ ID NO: 4084253 - RNA, 23 nt, Streptococcus pneumoniae R6
accguguuugacgagugaagaau

SEQ ID NO: 4084254 - RNA, 21 nt, Streptococcus pneumoniae R6
accguucuaaauuacgauuca

SEQ ID NO: 4084255 - RNA, 17 nt, Streptococcus pneumoniae R6
accuaaaaguacuuuca

SEQ ID NO: 4084256 - RNA, 17 nt, Streptococcus pneumoniae R6
accuaaaauucccuuau

SEQ ID NO: 4084257 - RNA, 21 nt, Streptococcus pneumoniae R6
accuaaaauucccuuauccac

SEQ ID NO: 4084258 - RNA, 16 nt, Streptococcus pneumoniae R6
accuaaaguagagaua

SEQ ID NO: 4084259 - RNA, 12 nt, Streptococcus pneumoniae R6
accuaagauuag

SEQ ID NO: 4084260 - RNA, 13 nt, Streptococcus pneumoniae R6
accuaaucauagu

SEQ ID NO: 4084261 - RNA, 15 nt, Streptococcus pneumoniae R6
accuaccagaggaua

SEQ ID NO: 4084262 - RNA, 20 nt, Streptococcus pneumoniae R6
accuagcgaauaaguuuuaa

SEQ ID NO: 4084263 - RNA, 19 nt, Streptococcus pneumoniae R6
accuaguacaaagaauaaa

SEQ ID NO: 4084264 - RNA, 14 nt, Streptococcus pneumoniae R6
accuauucauauau

SEQ ID NO: 4084265 - RNA, 21 nt, Streptococcus pneumoniae R6
accucaaaacaauguuuugau

SEQ ID NO: 4084266 - RNA, 13 nt, Streptococcus pneumoniae R6
accucaaaacagu

SEQ ID NO: 4084267 - RNA, 22 nt, Streptococcus pneumoniae R6
accucaaaaccauguuuugagc

SEQ ID NO: 4084268 - RNA, 23 nt, Streptococcus pneumoniae R6
accucacggagcgagacaaaaca

SEQ ID NO: 4084269 - RNA, 18 nt, Streptococcus pneumoniae R6
accucauaucucuuguau

SEQ ID NO: 4084270 - RNA, 14 nt, Streptococcus pneumoniae R6
accucauaucuguc

SEQ ID NO: 4084271 - RNA, 20 nt, Streptococcus pneumoniae R6
augacaacugggaacucacu

SEQ ID NO: 4084272 - RNA, 17 nt, Streptococcus pneumoniae R6
augacaaucauuucagu

SEQ ID NO: 4084273 - RNA, 13 nt, Streptococcus pneumoniae R6
augacagccucaa

SEQ ID NO: 4084274 - RNA, 17 nt, Streptococcus pneumoniae R6
augacagccucaaugau

SEQ ID NO: 4084275 - RNA, 17 nt, Streptococcus pneumoniae R6
augacagugauuaaaac

SEQ ID NO: 4084276 - RNA, 20 nt, Streptococcus pneumoniae R6
augacagugauuaaaacugc

SEQ ID NO: 4084277 - RNA, 17 nt, Streptococcus pneumoniae R6
augacauuauuuucuua

SEQ ID NO: 4084278 - RNA, 22 nt, Streptococcus pneumoniae R6
augaccaugucguuuccuucca

SEQ ID NO: 4084279 - RNA, 17 nt, Streptococcus pneumoniae R6
augaccccuaaauauaa

SEQ ID NO: 4084280 - RNA, 21 nt, Streptococcus pneumoniae R6
augacgaaacgaagaaggaag

SEQ ID NO: 4084281 - RNA, 18 nt, Streptococcus pneumoniae R6
augacuaacaauuaauuc

SEQ ID NO: 4084282 - RNA, 14 nt, Streptococcus pneumoniae R6
augacuagugaagc

SEQ ID NO: 4084283 - RNA, 14 nt, Streptococcus pneumoniae R6
augacugagagcua

SEQ ID NO: 4084284 - RNA, 18 nt, Streptococcus pneumoniae R6
augacuggacggugaucu

SEQ ID NO: 4084285 - RNA, 19 nt, Streptococcus pneumoniae R6
augacuuuccacaauuuuc

SEQ ID NO: 4084286 - RNA, 17 nt, Streptococcus pneumoniae R6
augacuuucuaauuauu

SEQ ID NO: 4084287 - RNA, 20 nt, Streptococcus pneumoniae R6
augacuuucuaauuauuuca

SEQ ID NO: 4084288 - RNA, 19 nt, Streptococcus pneumoniae R6
augacuuuuaagaaaucau

SEQ ID NO: 4084289 - RNA, 21 nt, Streptococcus pneumoniae R6
augagaaacagcuccugaaau

SEQ ID NO: 4084290 - RNA, 15 nt, Streptococcus pneumoniae R6
augagaaauuuuugg

SEQ ID NO: 4084291 - RNA, 17 nt, Streptococcus pneumoniae R6
augagacuugcaagaaa

SEQ ID NO: 4084292 - RNA, 23 nt, Streptococcus pneumoniae R6
augagacuugcaagaaaguagag

SEQ ID NO: 4084293 - RNA, 19 nt, Streptococcus pneumoniae R6
augagagauucauucugcu

SEQ ID NO: 4084294 - RNA, 15 nt, Streptococcus pneumoniae R6
augagagcuuauuuu

SEQ ID NO: 4084295 - RNA, 21 nt, Streptococcus pneumoniae R6
augagauaagcgauuuuauag

SEQ ID NO: 4084296 - RNA, 14 nt, Streptococcus pneumoniae R6
augagauaauacaa

SEQ ID NO: 4084297 - RNA, 19 nt, Streptococcus pneumoniae R6
augagauuuuggaagagua

SEQ ID NO: 4084298 - RNA, 21 nt, Streptococcus pneumoniae R6
augagcauagcgugcccaaaa

SEQ ID NO: 4084299 - RNA, 17 nt, Streptococcus pneumoniae R6
augagccacuauuuauu

SEQ ID NO: 4084300 - RNA, 18 nt, Streptococcus pneumoniae R6
augagcgucuuucuuauc

SEQ ID NO: 4084301 - RNA, 18 nt, Streptococcus pneumoniae R6
augagcuagguucaacaa

SEQ ID NO: 4084302 - RNA, 22 nt, Streptococcus pneumoniae R6
augagcuggaagaauuuaaaaa

SEQ ID NO: 4084303 - RNA, 21 nt, Streptococcus pneumoniae R6
augaggaaaaucuucccacaa

SEQ ID NO: 4084304 - RNA, 21 nt, Streptococcus pneumoniae R6
augaggguccgaaccacaaca

SEQ ID NO: 4084305 - RNA, 23 nt, Streptococcus pneumoniae R6
augagguaagagaacuucacguu

SEQ ID NO: 4084306 - RNA, 15 nt, Streptococcus pneumoniae R6
augaguccgaaaaau

SEQ ID NO: 4084307 - RNA, 18 nt, Streptococcus pneumoniae R6
augaguggagccccuuga

SEQ ID NO: 4084308 - RNA, 17 nt, Streptococcus pneumoniae R6
augaguguaaaaagaaa

SEQ ID NO: 4084309 - RNA, 15 nt, Streptococcus pneumoniae R6
augaguuugcuuuug

SEQ ID NO: 4084310 - RNA, 13 nt, Streptococcus pneumoniae R6
augauaagaaucg

SEQ ID NO: 4084311 - RNA, 22 nt, Streptococcus pneumoniae R6
augauaaugguaucacauucaa

SEQ ID NO: 4084312 - RNA, 16 nt, Streptococcus pneumoniae R6
augauaauugauuaag

SEQ ID NO: 4084313 - RNA, 14 nt, Streptococcus pneumoniae R6
augauacgcucagc

SEQ ID NO: 4084314 - RNA, 18 nt, Streptococcus pneumoniae R6
augauacgcucagcugau

SEQ ID NO: 4084315 - RNA, 22 nt, Streptococcus pneumoniae R6
augauagcuagcgcaucaacau

SEQ ID NO: 4084316 - RNA, 11 nt, Streptococcus pneumoniae R6
augauauacac

SEQ ID NO: 4084317 - RNA, 15 nt, Streptococcus pneumoniae R6
augauauauaguaga

SEQ ID NO: 4084318 - RNA, 19 nt, Streptococcus pneumoniae R6
augauauuuucaaaaaaau

SEQ ID NO: 4084319 - RNA, 16 nt, Streptococcus pneumoniae R6
augaucgguucacguu

SEQ ID NO: 4084320 - RNA, 16 nt, Streptococcus pneumoniae R6
augaucuauuccuagu

SEQ ID NO: 4084321 - RNA, 15 nt, Streptococcus pneumoniae R6
augaucuuaaauuuu

SEQ ID NO: 4084322 - RNA, 20 nt, Streptococcus pneumoniae R6
augaugaaucugaaucaaaa

SEQ ID NO: 4084323 - RNA, 19 nt, Streptococcus pneumoniae R6
augaugagcuggaagaauu

SEQ ID NO: 4084324 - RNA, 14 nt, Streptococcus pneumoniae R6
augaugauagacug

SEQ ID NO: 4084325 - RNA, 23 nt, Streptococcus pneumoniae R6
augaugcaaaaggugcacacgaa

SEQ ID NO: 4084326 - RNA, 18 nt, Streptococcus pneumoniae R6
augaugcaagauauucau

SEQ ID NO: 4084327 - RNA, 13 nt, Streptococcus pneumoniae R6
augaugugcuauu

SEQ ID NO: 4084328 - RNA, 23 nt, Streptococcus pneumoniae R6
augauguucggcuuaccaagucc

SEQ ID NO: 4084329 - RNA, 13 nt, Streptococcus pneumoniae R6
augauuaacuaug

SEQ ID NO: 4084330 - RNA, 15 nt, Streptococcus pneumoniae R6
augauuacucaaaac

SEQ ID NO: 4084331 - RNA, 14 nt, Streptococcus pneumoniae R6
augauuagaaauag

SEQ ID NO: 4084332 - RNA, 19 nt, Streptococcus pneumoniae R6
augauucaaggaguugucu

SEQ ID NO: 4084333 - RNA, 18 nt, Streptococcus pneumoniae R6
augauucuccuuuuugau

SEQ ID NO: 4084334 - RNA, 13 nt, Streptococcus pneumoniae R6
augauucugaaau

SEQ ID NO: 4084335 - RNA, 15 nt, Streptococcus pneumoniae R6
augauucuuucuaau

SEQ ID NO: 4084336 - RNA, 16 nt, Streptococcus pneumoniae R6
augauucuuuucaaaa

SEQ ID NO: 4084337 - RNA, 21 nt, Streptococcus pneumoniae R6
augauugagaaaguuaaaaaa

SEQ ID NO: 4084338 - RNA, 21 nt, Streptococcus pneumoniae R6
augauuggaaauucaagaaug

SEQ ID NO: 4084339 - RNA, 21 nt, Streptococcus pneumoniae R6
augauuuaauuagaaaaaaau

SEQ ID NO: 4084340 - RNA, 16 nt, Streptococcus pneumoniae R6
augauuucaagaccau

SEQ ID NO: 4084341 - RNA, 11 nt, Streptococcus pneumoniae R6
augauuucaau

SEQ ID NO: 4084342 - RNA, 16 nt, Streptococcus pneumoniae R6
augauuugcaggcugu

SEQ ID NO: 4084343 - RNA, 15 nt, Streptococcus pneumoniae R6
augauuuuuuacugu

SEQ ID NO: 4084344 - RNA, 18 nt, Streptococcus pneumoniae R6
augcaaagaccaccucau

SEQ ID NO: 4084345 - RNA, 17 nt, Streptococcus pneumoniae R6
augcaaagccaauauua

SEQ ID NO: 4084346 - RNA, 20 nt, Streptococcus pneumoniae R6
augcaacuuguuuuuccuga

SEQ ID NO: 4084347 - RNA, 21 nt, Streptococcus pneumoniae R6
augcaacuuguuuuuccugau

SEQ ID NO: 4084348 - RNA, 18 nt, Streptococcus pneumoniae R6
augcaagguuucacagaa

SEQ ID NO: 4084349 - RNA, 18 nt, Streptococcus pneumoniae R6
augcaaguagaacgcuga

SEQ ID NO: 4084350 - RNA, 22 nt, Streptococcus pneumoniae R6
augcaauuucuuuauauaaaaa

SEQ ID NO: 4084351 - RNA, 12 nt, Streptococcus pneumoniae R6
augcaauuuuuu

SEQ ID NO: 4084352 - RNA, 17 nt, Streptococcus pneumoniae R6
augcacagacauaugaa

SEQ ID NO: 4084353 - RNA, 15 nt, Streptococcus pneumoniae R6
augcauaguugaugg

SEQ ID NO: 4084354 - RNA, 12 nt, Streptococcus pneumoniae R6
augccaaaauuc

SEQ ID NO: 4084355 - RNA, 12 nt, Streptococcus pneumoniae R6
augccaaagaaa

SEQ ID NO: 4084356 - RNA, 14 nt, Streptococcus pneumoniae R6
augccaaagaaauu

SEQ ID NO: 4084357 - RNA, 14 nt, Streptococcus pneumoniae R6
augccaagaaaguu

SEQ ID NO: 4084358 - RNA, 19 nt, Streptococcus pneumoniae R6
augccaaucgacccuggau

SEQ ID NO: 4084359 - RNA, 12 nt, Streptococcus pneumoniae R6
augccagccuua

SEQ ID NO: 4084360 - RNA, 14 nt, Streptococcus pneumoniae R6
augccagucaguuu

SEQ ID NO: 4084361 - RNA, 20 nt, Streptococcus pneumoniae R6
augccaugagcgucuuucuu

SEQ ID NO: 4084362 - RNA, 14 nt, Streptococcus pneumoniae R6
augcccaagagacu

SEQ ID NO: 4084363 - RNA, 19 nt, Streptococcus pneumoniae R6
augccgugauuuccaaucu

SEQ ID NO: 4084364 - RNA, 21 nt, Streptococcus pneumoniae R6
augccugucguaccuaaaaag

SEQ ID NO: 4084365 - RNA, 15 nt, Streptococcus pneumoniae R6
augccuguuccaaca

SEQ ID NO: 4084366 - RNA, 19 nt, Streptococcus pneumoniae R6
augccuguuccaacauugu

SEQ ID NO: 4084367 - RNA, 19 nt, Streptococcus pneumoniae R6
augccuuaucuuuuuucau

SEQ ID NO: 4084368 - RNA, 16 nt, Streptococcus pneumoniae R6
augccuuuuucaauca

SEQ ID NO: 4084369 - RNA, 19 nt, Streptococcus pneumoniae R6
augccuuuuucaaucaaug

SEQ ID NO: 4084370 - RNA, 21 nt, Streptococcus pneumoniae R6
augcgaacuagcuaacugcuu

SEQ ID NO: 4084371 - RNA, 22 nt, Streptococcus pneumoniae R6
augcgaacuagcuaacugcuuc

SEQ ID NO: 4084372 - RNA, 14 nt, Streptococcus pneumoniae R6
augcgguuugaaga

SEQ ID NO: 4084373 - RNA, 15 nt, Streptococcus pneumoniae R6
augcgucuaauguac

SEQ ID NO: 4084374 - RNA, 17 nt, Streptococcus pneumoniae R6
auguguuggguagcaua

SEQ ID NO: 4084375 - RNA, 17 nt, Streptococcus pneumoniae R6
auguuaaaaugagucua

SEQ ID NO: 4084376 - RNA, 17 nt, Streptococcus pneumoniae R6
auguuaaccacaaaaag

SEQ ID NO: 4084377 - RNA, 19 nt, Streptococcus pneumoniae R6
auguuaaccacaaaaagug

SEQ ID NO: 4084378 - RNA, 13 nt, Streptococcus pneumoniae R6
auguuaagugcuu

SEQ ID NO: 4084379 - RNA, 19 nt, Streptococcus pneumoniae R6
auguuagaaaaaguucaau

SEQ ID NO: 4084380 - RNA, 16 nt, Streptococcus pneumoniae R6
auguucaaagauuuua

SEQ ID NO: 4084381 - RNA, 19 nt, Streptococcus pneumoniae R6
auguucaaagcgauaaaaa

SEQ ID NO: 4084382 - RNA, 20 nt, Streptococcus pneumoniae R6
auguucaaagcgauaaaaau

SEQ ID NO: 4084383 - RNA, 19 nt, Streptococcus pneumoniae R6
auguuccaaguccguuuuc

SEQ ID NO: 4084384 - RNA, 15 nt, Streptococcus pneumoniae R6
auguucggcuuacca

SEQ ID NO: 4084385 - RNA, 14 nt, Streptococcus pneumoniae R6
auguucuaagaacu

SEQ ID NO: 4084386 - RNA, 17 nt, Streptococcus pneumoniae R6
auguucugugauaaacu

SEQ ID NO: 4084387 - RNA, 17 nt, Streptococcus pneumoniae R6
auguugacuuaaugaau

SEQ ID NO: 4084388 - RNA, 15 nt, Streptococcus pneumoniae R6
auguugcaaauuuau

SEQ ID NO: 4084389 - RNA, 16 nt, Streptococcus pneumoniae R6
auguuuaaaaucugga

SEQ ID NO: 4084390 - RNA, 22 nt, Streptococcus pneumoniae R6
auguuuagcaaacuaaauaccu

SEQ ID NO: 4084391 - RNA, 18 nt, Streptococcus pneumoniae R6
auguuucaacaugucagc

SEQ ID NO: 4084392 - RNA, 21 nt, Streptococcus pneumoniae R6
auguuucaacaugucagcuga

SEQ ID NO: 4084393 - RNA, 23 nt, Streptococcus pneumoniae R6
auguuucccuugcuagucauaac

SEQ ID NO: 4084394 - RNA, 14 nt, Streptococcus pneumoniae R6
auguuuccugcaaa

SEQ ID NO: 4084395 - RNA, 14 nt, Streptococcus pneumoniae R6
auguuucuuuaaau

SEQ ID NO: 4084396 - RNA, 15 nt, Streptococcus pneumoniae R6
auguuucuuuaaauc

SEQ ID NO: 4084397 - RNA, 21 nt, Streptococcus pneumoniae R6
auguuugcuucauuuuuuccu

SEQ ID NO: 4084398 - RNA, 15 nt, Streptococcus pneumoniae R6
auguuuuaaauaaac

SEQ ID NO: 4084399 - RNA, 14 nt, Streptococcus pneumoniae R6
auguuuuagaaaua

SEQ ID NO: 4084400 - RNA, 16 nt, Streptococcus pneumoniae R6
auguuuucucauagcc

SEQ ID NO: 4084401 - RNA, 13 nt, Streptococcus pneumoniae R6
auguuuuugaggu

SEQ ID NO: 4084402 - RNA, 21 nt, Streptococcus pneumoniae R6
auuaaaacggagaauaaggga

SEQ ID NO: 4084403 - RNA, 14 nt, Streptococcus pneumoniae R6
auuaaaaggcucau

SEQ ID NO: 4084404 - RNA, 23 nt, Streptococcus pneumoniae R6
auuaaaaguuuccccugccaacu

SEQ ID NO: 4084405 - RNA, 21 nt, Streptococcus pneumoniae R6
auuaaaauaacucaauuaaga

SEQ ID NO: 4084406 - RNA, 12 nt, Streptococcus pneumoniae R6
auuaaaaucaua

SEQ ID NO: 4084407 - RNA, 17 nt, Streptococcus pneumoniae R6
auuaaaaugcaagacac

SEQ ID NO: 4084408 - RNA, 12 nt, Streptococcus pneumoniae R6
auuaaaauguuc

SEQ ID NO: 4084409 - RNA, 15 nt, Streptococcus pneumoniae R6
auuaaagaccaaaga

SEQ ID NO: 4084410 - RNA, 14 nt, Streptococcus pneumoniae R6
auuaaagauuuuuu

SEQ ID NO: 4084411 - RNA, 15 nt, Streptococcus pneumoniae R6
auuaaagccuucgua

SEQ ID NO: 4084412 - RNA, 21 nt, Streptococcus pneumoniae R6
auuaaaucauaaacacccaua

SEQ ID NO: 4084413 - RNA, 12 nt, Streptococcus pneumoniae R6
auuaaauggaau

SEQ ID NO: 4084414 - RNA, 20 nt, Streptococcus pneumoniae R6
auuaaauugcgauuuugcca

SEQ ID NO: 4084415 - RNA, 12 nt, Streptococcus pneumoniae R6
auuaacaaaaga

SEQ ID NO: 4084416 - RNA, 13 nt, Streptococcus pneumoniae R6
auuaacagcaaaa

SEQ ID NO: 4084417 - RNA, 22 nt, Streptococcus pneumoniae R6
auuaacgaucaaucaauuuaau

SEQ ID NO: 4084418 - RNA, 18 nt, Streptococcus pneumoniae R6
auuaacgauggacuuuau

SEQ ID NO: 4084419 - RNA, 20 nt, Streptococcus pneumoniae R6
auuaacgauggacuuuauca

SEQ ID NO: 4084420 - RNA, 17 nt, Streptococcus pneumoniae R6
auuaacgauugaaauaa

SEQ ID NO: 4084421 - RNA, 23 nt, Streptococcus pneumoniae R6
auuaacuucaggauuuuuacagu

SEQ ID NO: 4084422 - RNA, 23 nt, Streptococcus pneumoniae R6
auuaagaaauuuucuuuuuccua

SEQ ID NO: 4084423 - RNA, 14 nt, Streptococcus pneumoniae R6
auuaagauaaaacu

SEQ ID NO: 4084424 - RNA, 14 nt, Streptococcus pneumoniae R6
auuaagauuacaga

SEQ ID NO: 4084425 - RNA, 17 nt, Streptococcus pneumoniae R6
auuaagauuacagauca

SEQ ID NO: 4084426 - RNA, 21 nt, Streptococcus pneumoniae R6
auuaaggcgauugcuacaauc

SEQ ID NO: 4084427 - RNA, 16 nt, Streptococcus pneumoniae R6
auuaagguuuuaccuu

SEQ ID NO: 4084428 - RNA, 18 nt, Streptococcus pneumoniae R6
auuaagguuuuaccuuca

SEQ ID NO: 4084429 - RNA, 19 nt, Streptococcus pneumoniae R6
auuaagguuuuaccuucaa

SEQ ID NO: 4084430 - RNA, 11 nt, Streptococcus pneumoniae R6
auuaaguaauc

SEQ ID NO: 4084431 - RNA, 23 nt, Streptococcus pneumoniae R6
auuaaguccuucccaucucguga

SEQ ID NO: 4084432 - RNA, 14 nt, Streptococcus pneumoniae R6
auuaagugauuuaa

SEQ ID NO: 4084433 - RNA, 15 nt, Streptococcus pneumoniae R6
auuaagugauuuaaa

SEQ ID NO: 4084434 - RNA, 18 nt, Streptococcus pneumoniae R6
auuaagugauuuaaaugu

SEQ ID NO: 4084435 - RNA, 14 nt, Streptococcus pneumoniae R6
auuaauaauuuuca

SEQ ID NO: 4084436 - RNA, 13 nt, Streptococcus pneumoniae R6
auuaaucaaauga

SEQ ID NO: 4084437 - RNA, 14 nt, Streptococcus pneumoniae R6
auuaaucaaaugag

SEQ ID NO: 4084438 - RNA, 21 nt, Streptococcus pneumoniae R6
auuaaucaccguccccaaaaa

SEQ ID NO: 4084439 - RNA, 14 nt, Streptococcus pneumoniae R6
auuaaucaccuagu

SEQ ID NO: 4084440 - RNA, 15 nt, Streptococcus pneumoniae R6
auuaauuuauagaaa

SEQ ID NO: 4084441 - RNA, 16 nt, Streptococcus pneumoniae R6
auuaauuuauagaaau

SEQ ID NO: 4084442 - RNA, 22 nt, Streptococcus pneumoniae R6
auuaauuucagaaaucuucucu

SEQ ID NO: 4084443 - RNA, 13 nt, Streptococcus pneumoniae R6
auuaauuucauua

SEQ ID NO: 4084444 - RNA, 15 nt, Streptococcus pneumoniae R6
auuaauuucauuacu

SEQ ID NO: 4084445 - RNA, 17 nt, Streptococcus pneumoniae R6
auuaauuucauuacuaa

SEQ ID NO: 4084446 - RNA, 12 nt, Streptococcus pneumoniae R6
auuaauuucuag

SEQ ID NO: 4084447 - RNA, 18 nt, Streptococcus pneumoniae R6
auuaauuugaauuuucua

SEQ ID NO: 4084448 - RNA, 20 nt, Streptococcus pneumoniae R6
auuaauuugacuuuucuaau

SEQ ID NO: 4084449 - RNA, 20 nt, Streptococcus pneumoniae R6
auuaauuuuacuuuccugau

SEQ ID NO: 4084450 - RNA, 21 nt, Streptococcus pneumoniae R6
auuacaaacacgcauaguauc

SEQ ID NO: 4084451 - RNA, 18 nt, Streptococcus pneumoniae R6
auuacagaacauuuuaau

SEQ ID NO: 4084452 - RNA, 20 nt, Streptococcus pneumoniae R6
auuacaggcaggacaaaaga

SEQ ID NO: 4084453 - RNA, 23 nt, Streptococcus pneumoniae R6
auuacaggcaggacaaaagauaa

SEQ ID NO: 4084454 - RNA, 20 nt, Streptococcus pneumoniae R6
auuacauccaccagcuauua

SEQ ID NO: 4084455 - RNA, 14 nt, Streptococcus pneumoniae R6
auuacaucuaucuc

SEQ ID NO: 4084456 - RNA, 19 nt, Streptococcus pneumoniae R6
auuacaugaugugaagaac

SEQ ID NO: 4084457 - RNA, 13 nt, Streptococcus pneumoniae R6
auuaccaagguug

SEQ ID NO: 4084458 - RNA, 17 nt, Streptococcus pneumoniae R6
auuaccaaguuaaacaa

SEQ ID NO: 4084459 - RNA, 22 nt, Streptococcus pneumoniae R6
auuaccaaguuaaacaaccuug

SEQ ID NO: 4084460 - RNA, 19 nt, Streptococcus pneumoniae R6
auuaccaccacguauaauu

SEQ ID NO: 4084461 - RNA, 21 nt, Streptococcus pneumoniae R6
auuaccucuuuuuauucuuuu

SEQ ID NO: 4084462 - RNA, 23 nt, Streptococcus pneumoniae R6
auuaccucuuuuuauucuuuuuc

SEQ ID NO: 4084463 - RNA, 17 nt, Streptococcus pneumoniae R6
auuaccuuugaaaaaau

SEQ ID NO: 4084464 - RNA, 15 nt, Streptococcus pneumoniae R6
auuacgacguuuuag

SEQ ID NO: 4084465 - RNA, 23 nt, Streptococcus pneumoniae R6
auuacuacuaucccuuuaccauu

SEQ ID NO: 4084466 - RNA, 18 nt, Streptococcus pneumoniae R6
auuacuaucaaaaucaau

SEQ ID NO: 4084467 - RNA, 14 nt, Streptococcus pneumoniae R6
auuacuaucaagaa

SEQ ID NO: 4084468 - RNA, 15 nt, Streptococcus pneumoniae R6
auuacucccauucuu

SEQ ID NO: 4084469 - RNA, 15 nt, Streptococcus pneumoniae R6
auuacuucuaaaaca

SEQ ID NO: 4084470 - RNA, 14 nt, Streptococcus pneumoniae R6
auuagaaaaaaauu

SEQ ID NO: 4084471 - RNA, 18 nt, Streptococcus pneumoniae R6
auuagaaaaaaauuuuua

SEQ ID NO: 4084472 - RNA, 19 nt, Streptococcus pneumoniae R6
auuagaaaaagacuugaaa

SEQ ID NO: 4084473 - RNA, 21 nt, Streptococcus pneumoniae R6
auuagaaaaagacuugaaaua

SEQ ID NO: 4084474 - RNA, 14 nt, Streptococcus pneumoniae R6
auuagaccugccau

SEQ ID NO: 4084475 - RNA, 22 nt, Streptococcus pneumoniae R6
auuagaggcgagacauuuuucg

SEQ ID NO: 4084476 - RNA, 14 nt, Streptococcus pneumoniae R6
auuagagguuugcu

SEQ ID NO: 4084477 - RNA, 13 nt, Streptococcus pneumoniae R6
auucauucugcua

SEQ ID NO: 4084478 - RNA, 19 nt, Streptococcus pneumoniae R6
auucauuuacucuccucca

SEQ ID NO: 4084479 - RNA, 16 nt, Streptococcus pneumoniae R6
auucauuuacugaacg

SEQ ID NO: 4084480 - RNA, 17 nt, Streptococcus pneumoniae R6
auucauuugauuuuccu

SEQ ID NO: 4084481 - RNA, 18 nt, Streptococcus pneumoniae R6
auucauuugauuuuccua

SEQ ID NO: 4084482 - RNA, 16 nt, Streptococcus pneumoniae R6
auuccaaauuagaaaa

SEQ ID NO: 4084483 - RNA, 21 nt, Streptococcus pneumoniae R6
auuccaaguuccucuuucaaa

SEQ ID NO: 4084484 - RNA, 15 nt, Streptococcus pneumoniae R6
auuccaaucaucauc

SEQ ID NO: 4084485 - RNA, 17 nt, Streptococcus pneumoniae R6
auuccacauucauacca

SEQ ID NO: 4084486 - RNA, 15 nt, Streptococcus pneumoniae R6
auuccacgagccaaa

SEQ ID NO: 4084487 - RNA, 12 nt, Streptococcus pneumoniae R6
auuccagacacu

SEQ ID NO: 4084488 - RNA, 17 nt, Streptococcus pneumoniae R6
auuccagacagcuucaa

SEQ ID NO: 4084489 - RNA, 15 nt, Streptococcus pneumoniae R6
auuccagcuucuugg

SEQ ID NO: 4084490 - RNA, 14 nt, Streptococcus pneumoniae R6
auuccauaccuaaa

SEQ ID NO: 4084491 - RNA, 22 nt, Streptococcus pneumoniae R6
auuccauauucaauuauccaua

SEQ ID NO: 4084492 - RNA, 14 nt, Streptococcus pneumoniae R6
auucccacaaggga

SEQ ID NO: 4084493 - RNA, 15 nt, Streptococcus pneumoniae R6
auucccaucaauauc

SEQ ID NO: 4084494 - RNA, 22 nt, Streptococcus pneumoniae R6
auucccauucccuuguagaaaa

SEQ ID NO: 4084495 - RNA, 14 nt, Streptococcus pneumoniae R6
auucccugagccau

SEQ ID NO: 4084496 - RNA, 17 nt, Streptococcus pneumoniae R6
auucccuuguagaaaag

SEQ ID NO: 4084497 - RNA, 21 nt, Streptococcus pneumoniae R6
auucccuuuuugauuuuaaau

SEQ ID NO: 4084498 - RNA, 17 nt, Streptococcus pneumoniae R6
auuccgacucugaaguc

SEQ ID NO: 4084499 - RNA, 14 nt, Streptococcus pneumoniae R6
auuccgucauguuc

SEQ ID NO: 4084500 - RNA, 17 nt, Streptococcus pneumoniae R6
auuccuaaaauaacacu

SEQ ID NO: 4084501 - RNA, 16 nt, Streptococcus pneumoniae R6
auuccuacuucaaauc

SEQ ID NO: 4084502 - RNA, 23 nt, Streptococcus pneumoniae R6
auuccuaugauuaaucaaaugag

SEQ ID NO: 4084503 - RNA, 14 nt, Streptococcus pneumoniae R6
auuccugauaaaag

SEQ ID NO: 4084504 - RNA, 23 nt, Streptococcus pneumoniae R6
auuccuggaaucagaacacuucc

SEQ ID NO: 4084505 - RNA, 14 nt, Streptococcus pneumoniae R6
auuccuguguacug

SEQ ID NO: 4084506 - RNA, 18 nt, Streptococcus pneumoniae R6
auuccuuaaacucuugau

SEQ ID NO: 4084507 - RNA, 21 nt, Streptococcus pneumoniae R6
auuccuucaagggcagacaua

SEQ ID NO: 4084508 - RNA, 17 nt, Streptococcus pneumoniae R6
auuccuugauaaguucu

SEQ ID NO: 4084509 - RNA, 21 nt, Streptococcus pneumoniae R6
auuccuugauaaguucuuuuu

SEQ ID NO: 4084510 - RNA, 23 nt, Streptococcus pneumoniae R6
auuccuugcgcgugguccagaua

SEQ ID NO: 4084511 - RNA, 17 nt, Streptococcus pneumoniae R6
auuccuuuaaaaacaau

SEQ ID NO: 4084512 - RNA, 16 nt, Streptococcus pneumoniae R6
auuccuuuuuucuaug

SEQ ID NO: 4084513 - RNA, 16 nt, Streptococcus pneumoniae R6
auuccuuuuuuuacau

SEQ ID NO: 4084514 - RNA, 20 nt, Streptococcus pneumoniae R6
auucgaaaaucaaagugcaa

SEQ ID NO: 4084515 - RNA, 20 nt, Streptococcus pneumoniae R6
auucgaaugauauuuucaaa

SEQ ID NO: 4084516 - RNA, 19 nt, Streptococcus pneumoniae R6
auucgacugccucucuucu

SEQ ID NO: 4084517 - RNA, 16 nt, Streptococcus pneumoniae R6
auucgaucugauauau

SEQ ID NO: 4084518 - RNA, 20 nt, Streptococcus pneumoniae R6
auucgaucugauauauuuuc

SEQ ID NO: 4084519 - RNA, 15 nt, Streptococcus pneumoniae R6
auucgaugaaucauu

SEQ ID NO: 4084520 - RNA, 17 nt, Streptococcus pneumoniae R6
auucgaugaaucauuuc

SEQ ID NO: 4084521 - RNA, 19 nt, Streptococcus pneumoniae R6
auucgaugguugucccugg

SEQ ID NO: 4084522 - RNA, 16 nt, Streptococcus pneumoniae R6
auucgauuacaaucau

SEQ ID NO: 4084523 - RNA, 21 nt, Streptococcus pneumoniae R6
auucgccacguucaacaugac

SEQ ID NO: 4084524 - RNA, 21 nt, Streptococcus pneumoniae R6
auucgcuuuuuuaaaugcugu

SEQ ID NO: 4084525 - RNA, 20 nt, Streptococcus pneumoniae R6
auucggaaagccaaaucaau

SEQ ID NO: 4084526 - RNA, 14 nt, Streptococcus pneumoniae R6
auucgugguuuuau

SEQ ID NO: 4084527 - RNA, 17 nt, Streptococcus pneumoniae R6
auucguucuugguagua

SEQ ID NO: 4084528 - RNA, 21 nt, Streptococcus pneumoniae R6
auucuaaaggcuuaauauuac

SEQ ID NO: 4084529 - RNA, 15 nt, Streptococcus pneumoniae R6
auucuaacuuauuuu

SEQ ID NO: 4084530 - RNA, 20 nt, Streptococcus pneumoniae R6
auucuaagcgaccaucuuga

SEQ ID NO: 4084531 - RNA, 16 nt, Streptococcus pneumoniae R6
auucuaauuaaauaaa

SEQ ID NO: 4084532 - RNA, 18 nt, Streptococcus pneumoniae R6
auucuacaucauugucaa

SEQ ID NO: 4084533 - RNA, 14 nt, Streptococcus pneumoniae R6
auucuacuuuuuca

SEQ ID NO: 4084534 - RNA, 13 nt, Streptococcus pneumoniae R6
auucuaggcuauc

SEQ ID NO: 4084535 - RNA, 20 nt, Streptococcus pneumoniae R6
auucuaggcuaucgauauca

SEQ ID NO: 4084536 - RNA, 15 nt, Streptococcus pneumoniae R6
auucuaguccaucuc

SEQ ID NO: 4084537 - RNA, 16 nt, Streptococcus pneumoniae R6
auucuaguccaucucc

SEQ ID NO: 4084538 - RNA, 14 nt, Streptococcus pneumoniae R6
auucuaguuucaau

SEQ ID NO: 4084539 - RNA, 16 nt, Streptococcus pneumoniae R6
auucuauuccaucucc

SEQ ID NO: 4084540 - RNA, 14 nt, Streptococcus pneumoniae R6
auucuccacagacc

SEQ ID NO: 4084541 - RNA, 18 nt, Streptococcus pneumoniae R6
auucuccaguagaucacu

SEQ ID NO: 4084542 - RNA, 21 nt, Streptococcus pneumoniae R6
auucuccaguagaucacugaa

SEQ ID NO: 4084543 - RNA, 23 nt, Streptococcus pneumoniae R6
auucuccauaauugcuugagcaa

SEQ ID NO: 4084544 - RNA, 23 nt, Streptococcus pneumoniae R6
auucucccgcccuuuuuucucaa

SEQ ID NO: 4084545 - RNA, 17 nt, Streptococcus pneumoniae R6
auucucgugaaauuuua

SEQ ID NO: 4084546 - RNA, 23 nt, Streptococcus pneumoniae R6
auucucuaaauaagguuuagcaa

SEQ ID NO: 4084547 - RNA, 18 nt, Streptococcus pneumoniae R6
auucucuuuucauacuca

SEQ ID NO: 4084548 - RNA, 13 nt, Streptococcus pneumoniae R6
auucugcaaucaa

SEQ ID NO: 4084549 - RNA, 17 nt, Streptococcus pneumoniae R6
auucugcaaucaagguu

SEQ ID NO: 4084550 - RNA, 18 nt, Streptococcus pneumoniae R6
auucuggaagugaaaaag

SEQ ID NO: 4084551 - RNA, 18 nt, Streptococcus pneumoniae R6
auucuggaagugaaacag

SEQ ID NO: 4084552 - RNA, 13 nt, Streptococcus pneumoniae R6
auucuggauuuuu

SEQ ID NO: 4084553 - RNA, 16 nt, Streptococcus pneumoniae R6
auucuggcauuuguaa

SEQ ID NO: 4084554 - RNA, 21 nt, Streptococcus pneumoniae R6
auucugugguaaugcuuucca

SEQ ID NO: 4084555 - RNA, 18 nt, Streptococcus pneumoniae R6
auucuuaaagccacuaua

SEQ ID NO: 4084556 - RNA, 13 nt, Streptococcus pneumoniae R6
auucuuagaaauc

SEQ ID NO: 4084557 - RNA, 12 nt, Streptococcus pneumoniae R6
auucuuauauua

SEQ ID NO: 4084558 - RNA, 15 nt, Streptococcus pneumoniae R6
auucuuauauuaaaa

SEQ ID NO: 4084559 - RNA, 12 nt, Streptococcus pneumoniae R6
auucuuauuuca

SEQ ID NO: 4084560 - RNA, 16 nt, Streptococcus pneumoniae R6
auucuuauuucauuuu

SEQ ID NO: 4084561 - RNA, 14 nt, Streptococcus pneumoniae R6
auucuucauagagu

SEQ ID NO: 4084562 - RNA, 17 nt, Streptococcus pneumoniae R6
auucuucgugaaagaca

SEQ ID NO: 4084563 - RNA, 16 nt, Streptococcus pneumoniae R6
auucuucucuugaaaa

SEQ ID NO: 4084564 - RNA, 18 nt, Streptococcus pneumoniae R6
auucuucucuugaaaaug

SEQ ID NO: 4084565 - RNA, 13 nt, Streptococcus pneumoniae R6
auucuucugguuu

SEQ ID NO: 4084566 - RNA, 15 nt, Streptococcus pneumoniae R6
auucuucuguuucug

SEQ ID NO: 4084567 - RNA, 20 nt, Streptococcus pneumoniae R6
auucuucuuuuccaaacaua

SEQ ID NO: 4084568 - RNA, 18 nt, Streptococcus pneumoniae R6
auucuugagcgauuuuaa

SEQ ID NO: 4084569 - RNA, 16 nt, Streptococcus pneumoniae R6
auucuugguaaagagg

SEQ ID NO: 4084570 - RNA, 17 nt, Streptococcus pneumoniae R6
auucuugguaaagagga

SEQ ID NO: 4084571 - RNA, 22 nt, Streptococcus pneumoniae R6
auucuuuagcuuucaaguuuug

SEQ ID NO: 4084572 - RNA, 14 nt, Streptococcus pneumoniae R6
auucuuucaagcgc

SEQ ID NO: 4084573 - RNA, 16 nt, Streptococcus pneumoniae R6
auucuuuccgucaaga

SEQ ID NO: 4084574 - RNA, 18 nt, Streptococcus pneumoniae R6
auucuuuccuuuuacagu

SEQ ID NO: 4084575 - RNA, 17 nt, Streptococcus pneumoniae R6
auucuuucuaaugaguu

SEQ ID NO: 4084576 - RNA, 13 nt, Streptococcus pneumoniae R6
auucuuugaaauc

SEQ ID NO: 4084577 - RNA, 22 nt, Streptococcus pneumoniae R6
auucuuugaaaucagaaaaaac

SEQ ID NO: 4084578 - RNA, 13 nt, Streptococcus pneumoniae R6
auucuuuguuaaa

SEQ ID NO: 4084579 - RNA, 20 nt, Streptococcus pneumoniae R6
auucuuuuacacucaauuua

SEQ ID NO: 4084580 - RNA, 16 nt, Streptococcus pneumoniae R6
auugucagagucuuga

SEQ ID NO: 4084581 - RNA, 23 nt, Streptococcus pneumoniae R6
auugucuaaaaauuuaaaagaua

SEQ ID NO: 4084582 - RNA, 20 nt, Streptococcus pneumoniae R6
auugucuacauugauuucca

SEQ ID NO: 4084583 - RNA, 18 nt, Streptococcus pneumoniae R6
auugucucuaaaaauaaa

SEQ ID NO: 4084584 - RNA, 19 nt, Streptococcus pneumoniae R6
auugucucuaaaaauaaaa

SEQ ID NO: 4084585 - RNA, 17 nt, Streptococcus pneumoniae R6
auugucuuacguucauc

SEQ ID NO: 4084586 - RNA, 13 nt, Streptococcus pneumoniae R6
auuguuaaaaauc

SEQ ID NO: 4084587 - RNA, 15 nt, Streptococcus pneumoniae R6
auuguuaaacaauuc

SEQ ID NO: 4084588 - RNA, 16 nt, Streptococcus pneumoniae R6
auuguuaauggucuuc

SEQ ID NO: 4084589 - RNA, 20 nt, Streptococcus pneumoniae R6
auuguuauuaagauuacaga

SEQ ID NO: 4084590 - RNA, 12 nt, Streptococcus pneumoniae R6
auuguucagagg

SEQ ID NO: 4084591 - RNA, 15 nt, Streptococcus pneumoniae R6
auuguucagaggcac

SEQ ID NO: 4084592 - RNA, 19 nt, Streptococcus pneumoniae R6
auuguucagaggcacuuga

SEQ ID NO: 4084593 - RNA, 19 nt, Streptococcus pneumoniae R6
auuguuccauaugauucuu

SEQ ID NO: 4084594 - RNA, 16 nt, Streptococcus pneumoniae R6
auuguuccuaaaacag

SEQ ID NO: 4084595 - RNA, 16 nt, Streptococcus pneumoniae R6
auuguuguaauaauca

SEQ ID NO: 4084596 - RNA, 17 nt, Streptococcus pneumoniae R6
auuguugucccuuuuuc

SEQ ID NO: 4084597 - RNA, 20 nt, Streptococcus pneumoniae R6
auuguugucccuuuuucacu

SEQ ID NO: 4084598 - RNA, 15 nt, Streptococcus pneumoniae R6
auuguuuauaaaaua

SEQ ID NO: 4084599 - RNA, 16 nt, Streptococcus pneumoniae R6
auuguuuuauuuuuau

SEQ ID NO: 4084600 - RNA, 11 nt, Streptococcus pneumoniae R6
auuguuuucaa

SEQ ID NO: 4084601 - RNA, 13 nt, Streptococcus pneumoniae R6
auuguuuuuaaag

SEQ ID NO: 4084602 - RNA, 22 nt, Streptococcus pneumoniae R6
auuguuuuuaaaggaauuuuau

SEQ ID NO: 4084603 - RNA, 22 nt, Streptococcus pneumoniae R6
auuguuuuuuacauagaauaau

SEQ ID NO: 4084604 - RNA, 18 nt, Streptococcus pneumoniae R6
auuuaaaaauagauuuuu

SEQ ID NO: 4084605 - RNA, 19 nt, Streptococcus pneumoniae R6
auuuaaaaauagauuuuua

SEQ ID NO: 4084606 - RNA, 19 nt, Streptococcus pneumoniae R6
auuuaaaacucauuaauaa

SEQ ID NO: 4084607 - RNA, 24 nt, Streptococcus pneumoniae R6
auuuaaaaucguagucuuucacca

SEQ ID NO: 4084608 - RNA, 16 nt, Streptococcus pneumoniae R6
auuuaaacuaguuuuc

SEQ ID NO: 4084609 - RNA, 12 nt, Streptococcus pneumoniae R6
auuuaaauguuu

SEQ ID NO: 4084610 - RNA, 17 nt, Streptococcus pneumoniae R6
auuuaaauguuuucuca

SEQ ID NO: 4084611 - RNA, 12 nt, Streptococcus pneumoniae R6
auuuaacauuaa

SEQ ID NO: 4084612 - RNA, 17 nt, Streptococcus pneumoniae R6
auuuaacucuuuuuugg

SEQ ID NO: 4084613 - RNA, 16 nt, Streptococcus pneumoniae R6
auuuaagucaaagcca

SEQ ID NO: 4084614 - RNA, 20 nt, Streptococcus pneumoniae R6
auuuaauaaugaagacauca

SEQ ID NO: 4084615 - RNA, 18 nt, Streptococcus pneumoniae R6
auuuaauacggcauugag

SEQ ID NO: 4084616 - RNA, 21 nt, Streptococcus pneumoniae R6
auuuaauacggcauugaggac

SEQ ID NO: 4084617 - RNA, 20 nt, Streptococcus pneumoniae R6
auuuaauacucugugaaaau

SEQ ID NO: 4084618 - RNA, 22 nt, Streptococcus pneumoniae R6
auuuaaucauguuuuuaagcua

SEQ ID NO: 4084619 - RNA, 17 nt, Streptococcus pneumoniae R6
auuuaaucauuuaauaa

SEQ ID NO: 4084620 - RNA, 20 nt, Streptococcus pneumoniae R6
auuuaauccaaaguaaaaua

SEQ ID NO: 4084621 - RNA, 19 nt, Streptococcus pneumoniae R6
auuuaauccacuauaauaa

SEQ ID NO: 4084622 - RNA, 20 nt, Streptococcus pneumoniae R6
auuuaaugcaguaaaucaua

SEQ ID NO: 4084623 - RNA, 14 nt, Streptococcus pneumoniae R6
auuuaauuagaaaa

SEQ ID NO: 4084624 - RNA, 17 nt, Streptococcus pneumoniae R6
auuuaauuagaaaaaaa

SEQ ID NO: 4084625 - RNA, 11 nt, Streptococcus pneumoniae R6
auuuaccaaaa

SEQ ID NO: 4084626 - RNA, 15 nt, Streptococcus pneumoniae R6
auuuaccaaggaagc

SEQ ID NO: 4084627 - RNA, 16 nt, Streptococcus pneumoniae R6
auuuacggaugcgauu

SEQ ID NO: 4084628 - RNA, 15 nt, Streptococcus pneumoniae R6
auuuacguccuugga

SEQ ID NO: 4084629 - RNA, 18 nt, Streptococcus pneumoniae R6
auuuacguugaauagcug

SEQ ID NO: 4084630 - RNA, 14 nt, Streptococcus pneumoniae R6
auuuacuaauuaau

SEQ ID NO: 4084631 - RNA, 23 nt, Streptococcus pneumoniae R6
auuuacucuccuccauaaaaaga

SEQ ID NO: 4084632 - RNA, 14 nt, Streptococcus pneumoniae R6
auuuacuguuuuag

SEQ ID NO: 4084633 - RNA, 21 nt, Streptococcus pneumoniae R6
auuuacuuaaaauuguuucau

SEQ ID NO: 4084634 - RNA, 16 nt, Streptococcus pneumoniae R6
auuuacuuccuuuucu

SEQ ID NO: 4084635 - RNA, 13 nt, Streptococcus pneumoniae R6
auuuagauaguac

SEQ ID NO: 4084636 - RNA, 19 nt, Streptococcus pneumoniae R6
auuuagaucaucaaccuca

SEQ ID NO: 4084637 - RNA, 22 nt, Streptococcus pneumoniae R6
auuuaggacuaaauacaaaaac

SEQ ID NO: 4084638 - RNA, 21 nt, Streptococcus pneumoniae R6
auuuaguaaaaacguuuuuca

SEQ ID NO: 4084639 - RNA, 22 nt, Streptococcus pneumoniae R6
auuuaguacucuguaaaacucu

SEQ ID NO: 4084640 - RNA, 19 nt, Streptococcus pneumoniae R6
auuuauaaaucuucuaaau

SEQ ID NO: 4084641 - RNA, 15 nt, Streptococcus pneumoniae R6
auuuauaauuucaac

SEQ ID NO: 4084642 - RNA, 21 nt, Streptococcus pneumoniae R6
auuuauacuaauacauuuugu

SEQ ID NO: 4084643 - RNA, 13 nt, Streptococcus pneumoniae R6
auuuauagaaaua

SEQ ID NO: 4084644 - RNA, 17 nt, Streptococcus pneumoniae R6
auuuauagaaauauuuu

SEQ ID NO: 4084645 - RNA, 13 nt, Streptococcus pneumoniae R6
auuuauagaaauu

SEQ ID NO: 4084646 - RNA, 14 nt, Streptococcus pneumoniae R6
auuuauagaaauua

SEQ ID NO: 4084647 - RNA, 16 nt, Streptococcus pneumoniae R6
auuuauagaaauuaau

SEQ ID NO: 4084648 - RNA, 16 nt, Streptococcus pneumoniae R6
auuuauagaauuuuuu

SEQ ID NO: 4084649 - RNA, 16 nt, Streptococcus pneumoniae R6
auuuauaguaaaauga

SEQ ID NO: 4084650 - RNA, 19 nt, Streptococcus pneumoniae R6
auuuauaguaaaaugaaau

SEQ ID NO: 4084651 - RNA, 20 nt, Streptococcus pneumoniae R6
auuuauaguaaaaugaaaua

SEQ ID NO: 4084652 - RNA, 20 nt, Streptococcus pneumoniae R6
auuuauaguauuaguaauuu

SEQ ID NO: 4084653 - RNA, 15 nt, Streptococcus pneumoniae R6
auuuauaguuuugau

SEQ ID NO: 4084654 - RNA, 19 nt, Streptococcus pneumoniae R6
auuuauauaaaaagaaaug

SEQ ID NO: 4084655 - RNA, 21 nt, Streptococcus pneumoniae R6
auuuaucauccagauuuuucu

SEQ ID NO: 4084656 - RNA, 18 nt, Streptococcus pneumoniae R6
auuuauccauucacaaca

SEQ ID NO: 4084657 - RNA, 19 nt, Streptococcus pneumoniae R6
auuuauccauucacaacau

SEQ ID NO: 4084658 - RNA, 17 nt, Streptococcus pneumoniae R6
auuuauccgaagauuua

SEQ ID NO: 4084659 - RNA, 17 nt, Streptococcus pneumoniae R6
auuuauccgaaggauuu

SEQ ID NO: 4084660 - RNA, 20 nt, Streptococcus pneumoniae R6
auuuaucuagugcuauagua

SEQ ID NO: 4084661 - RNA, 22 nt, Streptococcus pneumoniae R6
auuuauggaaaaaaugaaauua

SEQ ID NO: 4084662 - RNA, 16 nt, Streptococcus pneumoniae R6
auuuauguccuaaaac

SEQ ID NO: 4084663 - RNA, 14 nt, Streptococcus pneumoniae R6
auuuauuaauuuca

SEQ ID NO: 4084664 - RNA, 22 nt, Streptococcus pneumoniae R6
auuuauuacuucaauuucuaau

SEQ ID NO: 4084665 - RNA, 16 nt, Streptococcus pneumoniae R6
auuuauuauaaaauuu

SEQ ID NO: 4084666 - RNA, 17 nt, Streptococcus pneumoniae R6
auuuauuuaauauguau

SEQ ID NO: 4084667 - RNA, 15 nt, Streptococcus pneumoniae R6
auuucaaaaaaugua

SEQ ID NO: 4084668 - RNA, 14 nt, Streptococcus pneumoniae R6
auuucaaagaacau

SEQ ID NO: 4084669 - RNA, 22 nt, Streptococcus pneumoniae R6
auuucaaaggcuuuuucuucuu

SEQ ID NO: 4084670 - RNA, 17 nt, Streptococcus pneumoniae R6
auuucaaccuuguggaa

SEQ ID NO: 4084671 - RNA, 22 nt, Streptococcus pneumoniae R6
auuucaagaaguugucugucuu

SEQ ID NO: 4084672 - RNA, 22 nt, Streptococcus pneumoniae R6
auuucaauagcuccuugugcac

SEQ ID NO: 4084673 - RNA, 16 nt, Streptococcus pneumoniae R6
auuucaauccauuaua

SEQ ID NO: 4084674 - RNA, 24 nt, Streptococcus pneumoniae R6
auuucaauccauuauacaucuucc

SEQ ID NO: 4084675 - RNA, 21 nt, Streptococcus pneumoniae R6
auuucaaucuacuauagaaaa

SEQ ID NO: 4084676 - RNA, 13 nt, Streptococcus pneumoniae R6
auuucaaucugcu

SEQ ID NO: 4084677 - RNA, 18 nt, Streptococcus pneumoniae R6
auuucacaguuaaauuau

SEQ ID NO: 4084678 - RNA, 13 nt, Streptococcus pneumoniae R6
auuucacauuuuc

SEQ ID NO: 4084679 - RNA, 14 nt, Streptococcus pneumoniae R6
auuucacauuuuca

SEQ ID NO: 4084680 - RNA, 23 nt, Streptococcus pneumoniae R6
auuucacgcgcauucguuucuuu

SEQ ID NO: 4084681 - RNA, 17 nt, Streptococcus pneumoniae R6
auuucacuagaaaauga

SEQ ID NO: 4084682 - RNA, 16 nt, Streptococcus pneumoniae R6
auuugcacuuugauuu

SEQ ID NO: 4084683 - RNA, 15 nt, Streptococcus pneumoniae R6
auuugcaucaaucuc

SEQ ID NO: 4084684 - RNA, 15 nt, Streptococcus pneumoniae R6
auuugccagaaaaag

SEQ ID NO: 4084685 - RNA, 19 nt, Streptococcus pneumoniae R6
auuugcgacacuagcauaa

SEQ ID NO: 4084686 - RNA, 14 nt, Streptococcus pneumoniae R6
auuugcgcgcuuga

SEQ ID NO: 4084687 - RNA, 17 nt, Streptococcus pneumoniae R6
auuugcuucaucauuuu

SEQ ID NO: 4084688 - RNA, 19 nt, Streptococcus pneumoniae R6
auuugcuucaucauuuuau

SEQ ID NO: 4084689 - RNA, 21 nt, Streptococcus pneumoniae R6
auuuggacuauucguuugaug

SEQ ID NO: 4084690 - RNA, 23 nt, Streptococcus pneumoniae R6
auuuggacuauucguuugaugua

SEQ ID NO: 4084691 - RNA, 20 nt, Streptococcus pneumoniae R6
auuuggcaccgaauuuuuca

SEQ ID NO: 4084692 - RNA, 18 nt, Streptococcus pneumoniae R6
auuuggcgaugauuuuag

SEQ ID NO: 4084693 - RNA, 21 nt, Streptococcus pneumoniae R6
auuugggcaaucgccaauucu

SEQ ID NO: 4084694 - RNA, 22 nt, Streptococcus pneumoniae R6
auuugguuuuuggcaauuuuug

SEQ ID NO: 4084695 - RNA, 23 nt, Streptococcus pneumoniae R6
auuugguuuuuggcaauuuuuga

SEQ ID NO: 4084696 - RNA, 21 nt, Streptococcus pneumoniae R6
auuuguaaaauugguguugga

SEQ ID NO: 4084697 - RNA, 20 nt, Streptococcus pneumoniae R6
auuuguaucaccaagcauuu

SEQ ID NO: 4084698 - RNA, 22 nt, Streptococcus pneumoniae R6
auuugucaaauugcuuaaaaua

SEQ ID NO: 4084699 - RNA, 22 nt, Streptococcus pneumoniae R6
auuugugauacgugaacaaguc

SEQ ID NO: 4084700 - RNA, 18 nt, Streptococcus pneumoniae R6
auuuguucuguucuuauu

SEQ ID NO: 4084701 - RNA, 20 nt, Streptococcus pneumoniae R6
auuuguuucaagcuugccua

SEQ ID NO: 4084702 - RNA, 12 nt, Streptococcus pneumoniae R6
auuuguuuucaa

SEQ ID NO: 4084703 - RNA, 15 nt, Streptococcus pneumoniae R6
auuuguuuucaagug

SEQ ID NO: 4084704 - RNA, 14 nt, Streptococcus pneumoniae R6
auuuguuuuucaaa

SEQ ID NO: 4084705 - RNA, 12 nt, Streptococcus pneumoniae R6
auuuguuuuugg

SEQ ID NO: 4084706 - RNA, 16 nt, Streptococcus pneumoniae R6
auuuuaaaauauuagc

SEQ ID NO: 4084707 - RNA, 19 nt, Streptococcus pneumoniae R6
auuuuaaaauauuagcaaa

SEQ ID NO: 4084708 - RNA, 22 nt, Streptococcus pneumoniae R6
auuuuaaaaugccaaagaaaga

SEQ ID NO: 4084709 - RNA, 13 nt, Streptococcus pneumoniae R6
auuuuaaagaaau

SEQ ID NO: 4084710 - RNA, 22 nt, Streptococcus pneumoniae R6
auuuuaaagaaauagaaaacaa

SEQ ID NO: 4084711 - RNA, 15 nt, Streptococcus pneumoniae R6
auuuuaaagacuuuu

SEQ ID NO: 4084712 - RNA, 20 nt, Streptococcus pneumoniae R6
auuuuaaagacuuuuuucca

SEQ ID NO: 4084713 - RNA, 17 nt, Streptococcus pneumoniae R6
auuuuaaaggucaauuc

SEQ ID NO: 4084714 - RNA, 21 nt, Streptococcus pneumoniae R6
auuuuaaauuauguaaauaaa

SEQ ID NO: 4084715 - RNA, 14 nt, Streptococcus pneumoniae R6
auuuuaaauuuuuc

SEQ ID NO: 4084716 - RNA, 15 nt, Streptococcus pneumoniae R6
auuuuaaauuuuucu

SEQ ID NO: 4084717 - RNA, 20 nt, Streptococcus pneumoniae R6
auuuuaaauuuuucugcaaa

SEQ ID NO: 4084718 - RNA, 22 nt, Streptococcus pneumoniae R6
auuuuaaauuuuucugcaaaaa

SEQ ID NO: 4084719 - RNA, 24 nt, Streptococcus pneumoniae R6
auuuuaauugggccuuaguaaaua

SEQ ID NO: 4084720 - RNA, 18 nt, Streptococcus pneumoniae R6
auuuuaccuuucaaaccg

SEQ ID NO: 4084721 - RNA, 17 nt, Streptococcus pneumoniae R6
auuuuacuauaaaauaa

SEQ ID NO: 4084722 - RNA, 19 nt, Streptococcus pneumoniae R6
auuuuacuauauaucaugc

SEQ ID NO: 4084723 - RNA, 15 nt, Streptococcus pneumoniae R6
auuuuacuucuuccc

SEQ ID NO: 4084724 - RNA, 18 nt, Streptococcus pneumoniae R6
auuuuacuuuccugauag

SEQ ID NO: 4084725 - RNA, 22 nt, Streptococcus pneumoniae R6
auuuuacuuuccugauagaguu

SEQ ID NO: 4084726 - RNA, 15 nt, Streptococcus pneumoniae R6
auuuuagaagguuuu

SEQ ID NO: 4084727 - RNA, 20 nt, Streptococcus pneumoniae R6
auuuuagaagguuuuugaaa

SEQ ID NO: 4084728 - RNA, 14 nt, Streptococcus pneumoniae R6
auuuuaguagaaaa

SEQ ID NO: 4084729 - RNA, 21 nt, Streptococcus pneumoniae R6
auuuuagugaguccaaaagau

SEQ ID NO: 4084730 - RNA, 14 nt, Streptococcus pneumoniae R6
auuuuauacucauc

SEQ ID NO: 4084731 - RNA, 18 nt, Streptococcus pneumoniae R6
auuuuauauaaaauaauu

SEQ ID NO: 4084732 - RNA, 19 nt, Streptococcus pneumoniae R6
auuuuauccaaucuauuua

SEQ ID NO: 4084733 - RNA, 13 nt, Streptococcus pneumoniae R6
auuuuaucuuuga

SEQ ID NO: 4084734 - RNA, 17 nt, Streptococcus pneumoniae R6
auuuuaucuuugaaaua

SEQ ID NO: 4084735 - RNA, 14 nt, Streptococcus pneumoniae R6
auuuuauucauauc

SEQ ID NO: 4084736 - RNA, 19 nt, Streptococcus pneumoniae R6
auuuuauugucauuuuucu

SEQ ID NO: 4084737 - RNA, 15 nt, Streptococcus pneumoniae R6
auuuuauuuaagcaa

SEQ ID NO: 4084738 - RNA, 19 nt, Streptococcus pneumoniae R6
auuuuauuuaagcaaaaaa

SEQ ID NO: 4084739 - RNA, 13 nt, Streptococcus pneumoniae R6
auuuuauuucauu

SEQ ID NO: 4084740 - RNA, 16 nt, Streptococcus pneumoniae R6
auuuuauuuuuuaagg

SEQ ID NO: 4084741 - RNA, 18 nt, Streptococcus pneumoniae R6
auuuucaaaaaaaucgua

SEQ ID NO: 4084742 - RNA, 15 nt, Streptococcus pneumoniae R6
auuuucaaaaagaag

SEQ ID NO: 4084743 - RNA, 16 nt, Streptococcus pneumoniae R6
auuuucaaaaaucauu

SEQ ID NO: 4084744 - RNA, 15 nt, Streptococcus pneumoniae R6
auuuucaaaacuggu

SEQ ID NO: 4084745 - RNA, 18 nt, Streptococcus pneumoniae R6
auuuucaaaauaggaauc

SEQ ID NO: 4084746 - RNA, 17 nt, Streptococcus pneumoniae R6
auuuucaaaaucagaaa

SEQ ID NO: 4084747 - RNA, 18 nt, Streptococcus pneumoniae R6
auuuucaagaauugcagc

SEQ ID NO: 4084748 - RNA, 11 nt, Streptococcus pneumoniae R6
auuuucaaucc

SEQ ID NO: 4084749 - RNA, 17 nt, Streptococcus pneumoniae R6
auuuucagauaaccauc

SEQ ID NO: 4084750 - RNA, 16 nt, Streptococcus pneumoniae R6
auuuucagcaccugaa

SEQ ID NO: 4084751 - RNA, 18 nt, Streptococcus pneumoniae R6
auuuucagcccagagcuu

SEQ ID NO: 4084752 - RNA, 21 nt, Streptococcus pneumoniae R6
auuuucagccucuauacuuac

SEQ ID NO: 4084753 - RNA, 23 nt, Streptococcus pneumoniae R6
auuuucauacucgugaagaaauc

SEQ ID NO: 4084754 - RNA, 16 nt, Streptococcus pneumoniae R6
auuuucauauaauaaa

SEQ ID NO: 4084755 - RNA, 13 nt, Streptococcus pneumoniae R6
auuuucaucauca

SEQ ID NO: 4084756 - RNA, 15 nt, Streptococcus pneumoniae R6
auuuucaucaucaca

SEQ ID NO: 4084757 - RNA, 19 nt, Streptococcus pneumoniae R6
auuuucauugagcuuuaaa

SEQ ID NO: 4084758 - RNA, 14 nt, Streptococcus pneumoniae R6
auuuucauugagua

SEQ ID NO: 4084759 - RNA, 15 nt, Streptococcus pneumoniae R6
auuuucauugaguau

SEQ ID NO: 4084760 - RNA, 17 nt, Streptococcus pneumoniae R6
auuuucauugaguauaa

SEQ ID NO: 4084761 - RNA, 20 nt, Streptococcus pneumoniae R6
auuuucauugaguaugaaau

SEQ ID NO: 4084762 - RNA, 21 nt, Streptococcus pneumoniae R6
auuuucauugaguaugaaaua

SEQ ID NO: 4084763 - RNA, 19 nt, Streptococcus pneumoniae R6
auuuuccggcucuuuguca

SEQ ID NO: 4084764 - RNA, 16 nt, Streptococcus pneumoniae R6
auuuuccuaaacagaa

SEQ ID NO: 4084765 - RNA, 16 nt, Streptococcus pneumoniae R6
auuuuccuaaucaauu

SEQ ID NO: 4084766 - RNA, 17 nt, Streptococcus pneumoniae R6
auuuuccuuaauccacu

SEQ ID NO: 4084767 - RNA, 11 nt, Streptococcus pneumoniae R6
auuuuccuugg

SEQ ID NO: 4084768 - RNA, 23 nt, Streptococcus pneumoniae R6
auuuucgaagaguauaaaaucaa

SEQ ID NO: 4084769 - RNA, 16 nt, Streptococcus pneumoniae R6
auuuucuaauugauuu

SEQ ID NO: 4084770 - RNA, 17 nt, Streptococcus pneumoniae R6
auuuucuacacuugauu

SEQ ID NO: 4084771 - RNA, 19 nt, Streptococcus pneumoniae R6
auuuucuacacuugauuua

SEQ ID NO: 4084772 - RNA, 21 nt, Streptococcus pneumoniae R6
auuuucuacuaaaauuauguu

SEQ ID NO: 4084773 - RNA, 12 nt, Streptococcus pneumoniae R6
auuuucucauca

SEQ ID NO: 4084774 - RNA, 12 nt, Streptococcus pneumoniae R6
auuuucucuuug

SEQ ID NO: 4084775 - RNA, 23 nt, Streptococcus pneumoniae R6
auuuucucuuuguccuuuagaaa

SEQ ID NO: 4084776 - RNA, 23 nt, Streptococcus pneumoniae R6
auuuucucuuuguucuuuagaaa

SEQ ID NO: 4084777 - RNA, 16 nt, Streptococcus pneumoniae R6
auuuucuguggauacu

SEQ ID NO: 4084778 - RNA, 16 nt, Streptococcus pneumoniae R6
auuuucuuaaaagcuu

SEQ ID NO: 4084779 - RNA, 15 nt, Streptococcus pneumoniae R6
auuuucuuagauaga

SEQ ID NO: 4084780 - RNA, 11 nt, Streptococcus pneumoniae R6
auuuucuuauc

SEQ ID NO: 4084781 - RNA, 13 nt, Streptococcus pneumoniae R6
auuuucuucuuua

SEQ ID NO: 4084782 - RNA, 22 nt, Streptococcus pneumoniae R6
auuuucuucuuuauaauauuua

SEQ ID NO: 4084783 - RNA, 13 nt, Streptococcus pneumoniae R6
auuuucuuuaaaa

SEQ ID NO: 4084784 - RNA, 14 nt, Streptococcus pneumoniae R6
caaaacuaauuuag

SEQ ID NO: 4084785 - RNA, 14 nt, Streptococcus pneumoniae R6
caaaacuauauucu

SEQ ID NO: 4084786 - RNA, 14 nt, Streptococcus pneumoniae R6
caaaacucaagguc

SEQ ID NO: 4084787 - RNA, 22 nt, Streptococcus pneumoniae R6
caaaacugguccagagauagua

SEQ ID NO: 4084788 - RNA, 13 nt, Streptococcus pneumoniae R6
caaaacuuuuuaa

SEQ ID NO: 4084789 - RNA, 19 nt, Streptococcus pneumoniae R6
caaaacuuuuuaaaaaauc

SEQ ID NO: 4084790 - RNA, 18 nt, Streptococcus pneumoniae R6
caaaagaaagcauagaga

SEQ ID NO: 4084791 - RNA, 18 nt, Streptococcus pneumoniae R6
caaaagaagauuggucaa

SEQ ID NO: 4084792 - RNA, 18 nt, Streptococcus pneumoniae R6
caaaagaccguuugaaaa

SEQ ID NO: 4084793 - RNA, 13 nt, Streptococcus pneumoniae R6
caaaagauaagau

SEQ ID NO: 4084794 - RNA, 16 nt, Streptococcus pneumoniae R6
caaaagauagaugauu

SEQ ID NO: 4084795 - RNA, 14 nt, Streptococcus pneumoniae R6
caaaagcacucaau

SEQ ID NO: 4084796 - RNA, 14 nt, Streptococcus pneumoniae R6
caaaagcagaggca

SEQ ID NO: 4084797 - RNA, 17 nt, Streptococcus pneumoniae R6
caaaagccgauaccuau

SEQ ID NO: 4084798 - RNA, 12 nt, Streptococcus pneumoniae R6
caaaagccugag

SEQ ID NO: 4084799 - RNA, 19 nt, Streptococcus pneumoniae R6
caaaagcguguaggaaacc

SEQ ID NO: 4084800 - RNA, 21 nt, Streptococcus pneumoniae R6
caaaagcguguaggaaaccaa

SEQ ID NO: 4084801 - RNA, 22 nt, Streptococcus pneumoniae R6
caaaagcguguaggaaaccaau

SEQ ID NO: 4084802 - RNA, 15 nt, Streptococcus pneumoniae R6
caaaagcuaauagag

SEQ ID NO: 4084803 - RNA, 14 nt, Streptococcus pneumoniae R6
caaaagcuuguuua

SEQ ID NO: 4084804 - RNA, 19 nt, Streptococcus pneumoniae R6
caaaagcuuguuuaaaauc

SEQ ID NO: 4084805 - RNA, 16 nt, Streptococcus pneumoniae R6
caaaagguucuuuuau

SEQ ID NO: 4084806 - RNA, 16 nt, Streptococcus pneumoniae R6
caaaaguccaaagaug

SEQ ID NO: 4084807 - RNA, 17 nt, Streptococcus pneumoniae R6
caaaaguccaaagauga

SEQ ID NO: 4084808 - RNA, 21 nt, Streptococcus pneumoniae R6
caaaagucgaguucauguuuc

SEQ ID NO: 4084809 - RNA, 17 nt, Streptococcus pneumoniae R6
caaaaguuagaaauaaa

SEQ ID NO: 4084810 - RNA, 20 nt, Streptococcus pneumoniae R6
caaaaguuagaaauaaaacu

SEQ ID NO: 4084811 - RNA, 21 nt, Streptococcus pneumoniae R6
caaaaguuagaaauaaaacuc

SEQ ID NO: 4084812 - RNA, 17 nt, Streptococcus pneumoniae R6
caaaaguuagacaaaua

SEQ ID NO: 4084813 - RNA, 20 nt, Streptococcus pneumoniae R6
caaaaguuagacagaaaaaa

SEQ ID NO: 4084814 - RNA, 22 nt, Streptococcus pneumoniae R6
caaaaguuagacagaaaaaauc

SEQ ID NO: 4084815 - RNA, 21 nt, Streptococcus pneumoniae R6
caaaauaaaaacaucuaccua

SEQ ID NO: 4084816 - RNA, 20 nt, Streptococcus pneumoniae R6
caaaauacuagauucuauuu

SEQ ID NO: 4084817 - RNA, 17 nt, Streptococcus pneumoniae R6
caaaauaggaaucaacc

SEQ ID NO: 4084818 - RNA, 18 nt, Streptococcus pneumoniae R6
caaaauagugugaccugc

SEQ ID NO: 4084819 - RNA, 14 nt, Streptococcus pneumoniae R6
caaaauaguucuca

SEQ ID NO: 4084820 - RNA, 15 nt, Streptococcus pneumoniae R6
caaaaucaaugacaa

SEQ ID NO: 4084821 - RNA, 20 nt, Streptococcus pneumoniae R6
caaaaucaggaaaucuucuc

SEQ ID NO: 4084822 - RNA, 17 nt, Streptococcus pneumoniae R6
caaaaucauaaacuauc

SEQ ID NO: 4084823 - RNA, 22 nt, Streptococcus pneumoniae R6
caaaaucauacuuagcuaauuu

SEQ ID NO: 4084824 - RNA, 14 nt, Streptococcus pneumoniae R6
caaaaucauagcau

SEQ ID NO: 4084825 - RNA, 23 nt, Streptococcus pneumoniae R6
caaaaucaugacaaucaagaccc

SEQ ID NO: 4084826 - RNA, 19 nt, Streptococcus pneumoniae R6
caaaauccguuuuuuaaaa

SEQ ID NO: 4084827 - RNA, 15 nt, Streptococcus pneumoniae R6
caaaauccuugacca

SEQ ID NO: 4084828 - RNA, 13 nt, Streptococcus pneumoniae R6
caaaauccuuugu

SEQ ID NO: 4084829 - RNA, 16 nt, Streptococcus pneumoniae R6
caaaauccuuuguuua

SEQ ID NO: 4084830 - RNA, 22 nt, Streptococcus pneumoniae R6
caaaaucgaaacuccauaaaau

SEQ ID NO: 4084831 - RNA, 22 nt, Streptococcus pneumoniae R6
caaaaugaggguccgaaccaca

SEQ ID NO: 4084832 - RNA, 16 nt, Streptococcus pneumoniae R6
caaaauuaaaauguuc

SEQ ID NO: 4084833 - RNA, 20 nt, Streptococcus pneumoniae R6
caaaauuagcucaaaacacu

SEQ ID NO: 4084834 - RNA, 14 nt, Streptococcus pneumoniae R6
caaaauuccuaaaa

SEQ ID NO: 4084835 - RNA, 21 nt, Streptococcus pneumoniae R6
caaaauucugucuuagacuuu

SEQ ID NO: 4084836 - RNA, 24 nt, Streptococcus pneumoniae R6
caaaauucuuccuacugauaucuu

SEQ ID NO: 4084837 - RNA, 20 nt, Streptococcus pneumoniae R6
caaacaaaucagccauugaa

SEQ ID NO: 4084838 - RNA, 14 nt, Streptococcus pneumoniae R6
caaacaacaauacu

SEQ ID NO: 4084839 - RNA, 21 nt, Streptococcus pneumoniae R6
caaacaggauguguaaaaaag

SEQ ID NO: 4084840 - RNA, 20 nt, Streptococcus pneumoniae R6
caaacaguuagacaauuaau

SEQ ID NO: 4084841 - RNA, 19 nt, Streptococcus pneumoniae R6
caaacauaacaggaauuuc

SEQ ID NO: 4084842 - RNA, 21 nt, Streptococcus pneumoniae R6
caaacauaacgggaaucccaa

SEQ ID NO: 4084843 - RNA, 17 nt, Streptococcus pneumoniae R6
caaacaucgugguacaa

SEQ ID NO: 4084844 - RNA, 15 nt, Streptococcus pneumoniae R6
caaacaucuggcuca

SEQ ID NO: 4084845 - RNA, 19 nt, Streptococcus pneumoniae R6
caaacauucccacaauaaa

SEQ ID NO: 4084846 - RNA, 15 nt, Streptococcus pneumoniae R6
caaacauugugagga

SEQ ID NO: 4084847 - RNA, 17 nt, Streptococcus pneumoniae R6
caaaccaaacagucuca

SEQ ID NO: 4084848 - RNA, 16 nt, Streptococcus pneumoniae R6
caaaccaacauagaua

SEQ ID NO: 4084849 - RNA, 15 nt, Streptococcus pneumoniae R6
caaaccaauuucuaa

SEQ ID NO: 4084850 - RNA, 21 nt, Streptococcus pneumoniae R6
caaaccagcaccagacauuuc

SEQ ID NO: 4084851 - RNA, 21 nt, Streptococcus pneumoniae R6
caaaccaugagguaagagaac

SEQ ID NO: 4084852 - RNA, 16 nt, Streptococcus pneumoniae R6
caaaccgcgucagcuu

SEQ ID NO: 4084853 - RNA, 14 nt, Streptococcus pneumoniae R6
caaaccguccucuu

SEQ ID NO: 4084854 - RNA, 19 nt, Streptococcus pneumoniae R6
caaaccguguucugucaug

SEQ ID NO: 4084855 - RNA, 21 nt, Streptococcus pneumoniae R6
caaaccugauaggaugcguuu

SEQ ID NO: 4084856 - RNA, 21 nt, Streptococcus pneumoniae R6
caaacgaacgccuuaaaaaac

SEQ ID NO: 4084857 - RNA, 19 nt, Streptococcus pneumoniae R6
caaacgaauguuguuacua

SEQ ID NO: 4084858 - RNA, 16 nt, Streptococcus pneumoniae R6
caaacgagaaaacgau

SEQ ID NO: 4084859 - RNA, 14 nt, Streptococcus pneumoniae R6
caaacgauuaucua

SEQ ID NO: 4084860 - RNA, 21 nt, Streptococcus pneumoniae R6
caaacgauuuuuuucaaacaa

SEQ ID NO: 4084861 - RNA, 12 nt, Streptococcus pneumoniae R6
caaacggauuuu

SEQ ID NO: 4084862 - RNA, 18 nt, Streptococcus pneumoniae R6
caaacgggugguuuaucc

SEQ ID NO: 4084863 - RNA, 16 nt, Streptococcus pneumoniae R6
caaacuaggaaaccag

SEQ ID NO: 4084864 - RNA, 22 nt, Streptococcus pneumoniae R6
caaacuaggaggcuagccgcac

SEQ ID NO: 4084865 - RNA, 16 nt, Streptococcus pneumoniae R6
caaacuaggauuuucu

SEQ ID NO: 4084866 - RNA, 18 nt, Streptococcus pneumoniae R6
caaacucuucacacaaga

SEQ ID NO: 4084867 - RNA, 14 nt, Streptococcus pneumoniae R6
caaacuugaaauga

SEQ ID NO: 4084868 - RNA, 19 nt, Streptococcus pneumoniae R6
caaacuuuccaauauguuc

SEQ ID NO: 4084869 - RNA, 23 nt, Streptococcus pneumoniae R6
caaacuuuuuaaguuuuuugauu

SEQ ID NO: 4084870 - RNA, 21 nt, Streptococcus pneumoniae R6
caaacuuuuucucucugaaua

SEQ ID NO: 4084871 - RNA, 15 nt, Streptococcus pneumoniae R6
caaagaaaaaacaaa

SEQ ID NO: 4084872 - RNA, 17 nt, Streptococcus pneumoniae R6
caaagaaaaaagcugua

SEQ ID NO: 4084873 - RNA, 23 nt, Streptococcus pneumoniae R6
caaagaacaucuacaauugaaac

SEQ ID NO: 4084874 - RNA, 14 nt, Streptococcus pneumoniae R6
caaagaacaugaaa

SEQ ID NO: 4084875 - RNA, 16 nt, Streptococcus pneumoniae R6
caaagaaccugcaguu

SEQ ID NO: 4084876 - RNA, 13 nt, Streptococcus pneumoniae R6
caaagacaaggga

SEQ ID NO: 4084877 - RNA, 14 nt, Streptococcus pneumoniae R6
caaagacaagggau

SEQ ID NO: 4084878 - RNA, 19 nt, Streptococcus pneumoniae R6
caaagacaagggaugaaac

SEQ ID NO: 4084879 - RNA, 20 nt, Streptococcus pneumoniae R6
caaagaccaccucaucuuga

SEQ ID NO: 4084880 - RNA, 16 nt, Streptococcus pneumoniae R6
caaagaccaugaggaa

SEQ ID NO: 4084881 - RNA, 17 nt, Streptococcus pneumoniae R6
caaagaccaugaggaaa

SEQ ID NO: 4084882 - RNA, 14 nt, Streptococcus pneumoniae R6
caaagacugggugu

SEQ ID NO: 4084883 - RNA, 17 nt, Streptococcus pneumoniae R6
caaagacuggguguuug

SEQ ID NO: 4084884 - RNA, 14 nt, Streptococcus pneumoniae R6
caaagacuuauacu

SEQ ID NO: 4084885 - RNA, 22 nt, Streptococcus pneumoniae R6
caaagacuuauacucuucaaaa

SEQ ID NO: 4084886 - RNA, 14 nt, Streptococcus pneumoniae R6
caaauuuaccaaug

SEQ ID NO: 4084887 - RNA, 15 nt, Streptococcus pneumoniae R6
caaauuuagcaauga

SEQ ID NO: 4084888 - RNA, 19 nt, Streptococcus pneumoniae R6
caaauuuauaaaucuucua

SEQ ID NO: 4084889 - RNA, 16 nt, Streptococcus pneumoniae R6
caaauuuauucagacu

SEQ ID NO: 4084890 - RNA, 18 nt, Streptococcus pneumoniae R6
caaauuucauauuuucag

SEQ ID NO: 4084891 - RNA, 18 nt, Streptococcus pneumoniae R6
caaauuucaugacagauu

SEQ ID NO: 4084892 - RNA, 15 nt, Streptococcus pneumoniae R6
caaauuugaaaaucu

SEQ ID NO: 4084893 - RNA, 14 nt, Streptococcus pneumoniae R6
caaauuugaccauu

SEQ ID NO: 4084894 - RNA, 18 nt, Streptococcus pneumoniae R6
caaauuugacuaaaaacu

SEQ ID NO: 4084895 - RNA, 23 nt, Streptococcus pneumoniae R6
caaauuuucaguuuuauuuuuga

SEQ ID NO: 4084896 - RNA, 13 nt, Streptococcus pneumoniae R6
caaauuuucuuua

SEQ ID NO: 4084897 - RNA, 19 nt, Streptococcus pneumoniae R6
caaauuuucuuuacuauag

SEQ ID NO: 4084898 - RNA, 13 nt, Streptococcus pneumoniae R6
caaauuuuguccu

SEQ ID NO: 4084899 - RNA, 19 nt, Streptococcus pneumoniae R6
caacaaaaucgggagauug

SEQ ID NO: 4084900 - RNA, 18 nt, Streptococcus pneumoniae R6
caacaaaucagaaaagua

SEQ ID NO: 4084901 - RNA, 15 nt, Streptococcus pneumoniae R6
caacaauacuuucca

SEQ ID NO: 4084902 - RNA, 21 nt, Streptococcus pneumoniae R6
caacaaucguaaccaauuucu

SEQ ID NO: 4084903 - RNA, 20 nt, Streptococcus pneumoniae R6
caacaaugagaaauuuuugg

SEQ ID NO: 4084904 - RNA, 18 nt, Streptococcus pneumoniae R6
caacaauucuuggaucuu

SEQ ID NO: 4084905 - RNA, 14 nt, Streptococcus pneumoniae R6
caacacaccuuguc

SEQ ID NO: 4084906 - RNA, 23 nt, Streptococcus pneumoniae R6
caacaccugucaagaccauggcg

SEQ ID NO: 4084907 - RNA, 18 nt, Streptococcus pneumoniae R6
caacagaaauaaccccau

SEQ ID NO: 4084908 - RNA, 12 nt, Streptococcus pneumoniae R6
caacagaagaau

SEQ ID NO: 4084909 - RNA, 13 nt, Streptococcus pneumoniae R6
caacagagaaaau

SEQ ID NO: 4084910 - RNA, 15 nt, Streptococcus pneumoniae R6
caacagagaaaauuc

SEQ ID NO: 4084911 - RNA, 15 nt, Streptococcus pneumoniae R6
caacagcuccauaac

SEQ ID NO: 4084912 - RNA, 16 nt, Streptococcus pneumoniae R6
caacaggaaaagucuu

SEQ ID NO: 4084913 - RNA, 21 nt, Streptococcus pneumoniae R6
caacaggauuuuguucuuuuu

SEQ ID NO: 4084914 - RNA, 11 nt, Streptococcus pneumoniae R6
caacaguaacg

SEQ ID NO: 4084915 - RNA, 23 nt, Streptococcus pneumoniae R6
caacaucucuuguuuaagagcac

SEQ ID NO: 4084916 - RNA, 21 nt, Streptococcus pneumoniae R6
caacaucuucuguaccaauac

SEQ ID NO: 4084917 - RNA, 20 nt, Streptococcus pneumoniae R6
caacaugagaauacaaaaau

SEQ ID NO: 4084918 - RNA, 19 nt, Streptococcus pneumoniae R6
caacauuauccaugaaaaa

SEQ ID NO: 4084919 - RNA, 14 nt, Streptococcus pneumoniae R6
caacauuguuugua

SEQ ID NO: 4084920 - RNA, 23 nt, Streptococcus pneumoniae R6
caacauuguuuguacuuguucua

SEQ ID NO: 4084921 - RNA, 14 nt, Streptococcus pneumoniae R6
caaccaagucugca

SEQ ID NO: 4084922 - RNA, 22 nt, Streptococcus pneumoniae R6
caaccaauuucuuaauagcuga

SEQ ID NO: 4084923 - RNA, 14 nt, Streptococcus pneumoniae R6
caaccaggucaucu

SEQ ID NO: 4084924 - RNA, 14 nt, Streptococcus pneumoniae R6
caaccauuuucuca

SEQ ID NO: 4084925 - RNA, 17 nt, Streptococcus pneumoniae R6
caacccucucuucaaau

SEQ ID NO: 4084926 - RNA, 13 nt, Streptococcus pneumoniae R6
caaccguuuggca

SEQ ID NO: 4084927 - RNA, 17 nt, Streptococcus pneumoniae R6
caaccuacggcuagcuu

SEQ ID NO: 4084928 - RNA, 23 nt, Streptococcus pneumoniae R6
caaccucaaaacacugcuuugag

SEQ ID NO: 4084929 - RNA, 17 nt, Streptococcus pneumoniae R6
caaccugcacauugguu

SEQ ID NO: 4084930 - RNA, 17 nt, Streptococcus pneumoniae R6
caaccugcgacuagcuu

SEQ ID NO: 4084931 - RNA, 12 nt, Streptococcus pneumoniae R6
caaccuuaaaac

SEQ ID NO: 4084932 - RNA, 14 nt, Streptococcus pneumoniae R6
caaccuuaaaacag

SEQ ID NO: 4084933 - RNA, 18 nt, Streptococcus pneumoniae R6
caaccuuguggaauuggu

SEQ ID NO: 4084934 - RNA, 16 nt, Streptococcus pneumoniae R6
caacgaacuauaaaau

SEQ ID NO: 4084935 - RNA, 17 nt, Streptococcus pneumoniae R6
caacgacacgguaugga

SEQ ID NO: 4084936 - RNA, 20 nt, Streptococcus pneumoniae R6
caacgaguguauuguacuuu

SEQ ID NO: 4084937 - RNA, 14 nt, Streptococcus pneumoniae R6
caacgcgugauuug

SEQ ID NO: 4084938 - RNA, 22 nt, Streptococcus pneumoniae R6
caacgguaucuugaauauuuuu

SEQ ID NO: 4084939 - RNA, 18 nt, Streptococcus pneumoniae R6
caacgucuucaauaccaa

SEQ ID NO: 4084940 - RNA, 17 nt, Streptococcus pneumoniae R6
caacuaaccaacuucuu

SEQ ID NO: 4084941 - RNA, 22 nt, Streptococcus pneumoniae R6
caacuaaccaacuucuuuuuuu

SEQ ID NO: 4084942 - RNA, 16 nt, Streptococcus pneumoniae R6
caacuacuaaaccaau

SEQ ID NO: 4084943 - RNA, 21 nt, Streptococcus pneumoniae R6
caacuagauuucugaauaucc

SEQ ID NO: 4084944 - RNA, 18 nt, Streptococcus pneumoniae R6
caacuauagccaucucua

SEQ ID NO: 4084945 - RNA, 14 nt, Streptococcus pneumoniae R6
caacuaucugaaua

SEQ ID NO: 4084946 - RNA, 15 nt, Streptococcus pneumoniae R6
caacuauucuuuuuc

SEQ ID NO: 4084947 - RNA, 21 nt, Streptococcus pneumoniae R6
caacucaauuucagaagaaaa

SEQ ID NO: 4084948 - RNA, 19 nt, Streptococcus pneumoniae R6
caacucagcauuuucuuuu

SEQ ID NO: 4084949 - RNA, 21 nt, Streptococcus pneumoniae R6
caacucagcauuuucuuuuug

SEQ ID NO: 4084950 - RNA, 14 nt, Streptococcus pneumoniae R6
caacucaggaaaga

SEQ ID NO: 4084951 - RNA, 14 nt, Streptococcus pneumoniae R6
caacuccucucucc

SEQ ID NO: 4084952 - RNA, 18 nt, Streptococcus pneumoniae R6
caacuccuuacuuuuuau

SEQ ID NO: 4084953 - RNA, 17 nt, Streptococcus pneumoniae R6
caacuccuugaaucauc

SEQ ID NO: 4084954 - RNA, 16 nt, Streptococcus pneumoniae R6
caacucgggcugaaua

SEQ ID NO: 4084955 - RNA, 22 nt, Streptococcus pneumoniae R6
caacucuauuuuugagcagaac

SEQ ID NO: 4084956 - RNA, 16 nt, Streptococcus pneumoniae R6
caacucuuauacuuuu

SEQ ID NO: 4084957 - RNA, 20 nt, Streptococcus pneumoniae R6
caacugaucccuccauuuca

SEQ ID NO: 4084958 - RNA, 15 nt, Streptococcus pneumoniae R6
caacugaugagagau

SEQ ID NO: 4084959 - RNA, 17 nt, Streptococcus pneumoniae R6
caacugccugguaaaga

SEQ ID NO: 4084960 - RNA, 23 nt, Streptococcus pneumoniae R6
caacuggagacuuucguuccaga

SEQ ID NO: 4084961 - RNA, 16 nt, Streptococcus pneumoniae R6
caacuggcauccccag

SEQ ID NO: 4084962 - RNA, 23 nt, Streptococcus pneumoniae R6
caacuggcauccccagcucaaga

SEQ ID NO: 4084963 - RNA, 21 nt, Streptococcus pneumoniae R6
caacugggaagauuucuuuca

SEQ ID NO: 4084964 - RNA, 19 nt, Streptococcus pneumoniae R6
caacuguaguggguugaaa

SEQ ID NO: 4084965 - RNA, 19 nt, Streptococcus pneumoniae R6
caacuguaguggguugaag

SEQ ID NO: 4084966 - RNA, 21 nt, Streptococcus pneumoniae R6
caacuguaguggguugaaguc

SEQ ID NO: 4084967 - RNA, 16 nt, Streptococcus pneumoniae R6
caacuguuuuuucaac

SEQ ID NO: 4084968 - RNA, 13 nt, Streptococcus pneumoniae R6
caacuuaaaaaga

SEQ ID NO: 4084969 - RNA, 23 nt, Streptococcus pneumoniae R6
caacuuacauuugaguuucucuu

SEQ ID NO: 4084970 - RNA, 15 nt, Streptococcus pneumoniae R6
caacuuauaaaaaac

SEQ ID NO: 4084971 - RNA, 21 nt, Streptococcus pneumoniae R6
caacuuauaaaaaacacaaaa

SEQ ID NO: 4084972 - RNA, 21 nt, Streptococcus pneumoniae R6
caacuuaucuagggcauuaau

SEQ ID NO: 4084973 - RNA, 13 nt, Streptococcus pneumoniae R6
caacuucuuuuug

SEQ ID NO: 4084974 - RNA, 16 nt, Streptococcus pneumoniae R6
caacuucuuuuugauu

SEQ ID NO: 4084975 - RNA, 13 nt, Streptococcus pneumoniae R6
caacuucuuuuuu

SEQ ID NO: 4084976 - RNA, 17 nt, Streptococcus pneumoniae R6
caacuugaaucugauga

SEQ ID NO: 4084977 - RNA, 13 nt, Streptococcus pneumoniae R6
caacuuuuccuug

SEQ ID NO: 4084978 - RNA, 14 nt, Streptococcus pneumoniae R6
caagaaacaacaau

SEQ ID NO: 4084979 - RNA, 15 nt, Streptococcus pneumoniae R6
caagaacuccucuca

SEQ ID NO: 4084980 - RNA, 15 nt, Streptococcus pneumoniae R6
caagaacucuucugg

SEQ ID NO: 4084981 - RNA, 22 nt, Streptococcus pneumoniae R6
caagaacugcuaccaauucagu

SEQ ID NO: 4084982 - RNA, 14 nt, Streptococcus pneumoniae R6
caagaagagcuugg

SEQ ID NO: 4084983 - RNA, 22 nt, Streptococcus pneumoniae R6
caagaagagcuugguaagaguc

SEQ ID NO: 4084984 - RNA, 22 nt, Streptococcus pneumoniae R6
caagaagaucagaguagucuuu

SEQ ID NO: 4084985 - RNA, 22 nt, Streptococcus pneumoniae R6
caagaaguccauaaugucuucu

SEQ ID NO: 4084986 - RNA, 23 nt, Streptococcus pneumoniae R6
caagaaugggcucccacuuucaa

SEQ ID NO: 4084987 - RNA, 16 nt, Streptococcus pneumoniae R6
caagaccaauccuaug

SEQ ID NO: 4084988 - RNA, 22 nt, Streptococcus pneumoniae R6
caauaacacgagaaacaauaaa

SEQ ID NO: 4084989 - RNA, 19 nt, Streptococcus pneumoniae R6
caauaaccaucauuuuuag

SEQ ID NO: 4084990 - RNA, 12 nt, Streptococcus pneumoniae R6
caauaagacuau

SEQ ID NO: 4084991 - RNA, 17 nt, Streptococcus pneumoniae R6
caauaagcgauugagaa

SEQ ID NO: 4084992 - RNA, 20 nt, Streptococcus pneumoniae R6
caauaaguccgaaaaauuuc

SEQ ID NO: 4084993 - RNA, 21 nt, Streptococcus pneumoniae R6
caauaaguccgaaaaauuucu

SEQ ID NO: 4084994 - RNA, 20 nt, Streptococcus pneumoniae R6
caauaauguuaaccacaaaa

SEQ ID NO: 4084995 - RNA, 13 nt, Streptococcus pneumoniae R6
caauaauucaccu

SEQ ID NO: 4084996 - RNA, 14 nt, Streptococcus pneumoniae R6
caauaauucaccua

SEQ ID NO: 4084997 - RNA, 20 nt, Streptococcus pneumoniae R6
caauaauugguacauuuuga

SEQ ID NO: 4084998 - RNA, 21 nt, Streptococcus pneumoniae R6
caauaauugguacauuuugau

SEQ ID NO: 4084999 - RNA, 22 nt, Streptococcus pneumoniae R6
caauaauuucuuuuuguguuaa

SEQ ID NO: 4085000 - RNA, 17 nt, Streptococcus pneumoniae R6
caauacagauaaaaauc

SEQ ID NO: 4085001 - RNA, 20 nt, Streptococcus pneumoniae R6
caauacccccuuaaaaccau

SEQ ID NO: 4085002 - RNA, 18 nt, Streptococcus pneumoniae R6
caauacgaaucaauacag

SEQ ID NO: 4085003 - RNA, 19 nt, Streptococcus pneumoniae R6
caauacuacaauaauuggu

SEQ ID NO: 4085004 - RNA, 13 nt, Streptococcus pneumoniae R6
caauacuucaaca

SEQ ID NO: 4085005 - RNA, 13 nt, Streptococcus pneumoniae R6
caauacuuuuucg

SEQ ID NO: 4085006 - RNA, 13 nt, Streptococcus pneumoniae R6
caauagcaacuac

SEQ ID NO: 4085007 - RNA, 17 nt, Streptococcus pneumoniae R6
caauagcauauuuuuag

SEQ ID NO: 4085008 - RNA, 12 nt, Streptococcus pneumoniae R6
caauagccgcaa

SEQ ID NO: 4085009 - RNA, 16 nt, Streptococcus pneumoniae R6
caauagcuaauagaac

SEQ ID NO: 4085010 - RNA, 18 nt, Streptococcus pneumoniae R6
caauagcuucauccuauc

SEQ ID NO: 4085011 - RNA, 14 nt, Streptococcus pneumoniae R6
caauagcuuguucc

SEQ ID NO: 4085012 - RNA, 16 nt, Streptococcus pneumoniae R6
caauaggcggacaccu

SEQ ID NO: 4085013 - RNA, 18 nt, Streptococcus pneumoniae R6
caauaggcggacaccucu

SEQ ID NO: 4085014 - RNA, 20 nt, Streptococcus pneumoniae R6
caauaggcggacaccucuuu

SEQ ID NO: 4085015 - RNA, 14 nt, Streptococcus pneumoniae R6
caauagucauucca

SEQ ID NO: 4085016 - RNA, 11 nt, Streptococcus pneumoniae R6
caauaguucau

SEQ ID NO: 4085017 - RNA, 23 nt, Streptococcus pneumoniae R6
caauauagccuaagacaaccaaa

SEQ ID NO: 4085018 - RNA, 17 nt, Streptococcus pneumoniae R6
caauaucguaucuuugg

SEQ ID NO: 4085019 - RNA, 22 nt, Streptococcus pneumoniae R6
caauaucuuuaaagcuuuuugu

SEQ ID NO: 4085020 - RNA, 22 nt, Streptococcus pneumoniae R6
caauaucuuuauugaugaaguc

SEQ ID NO: 4085021 - RNA, 23 nt, Streptococcus pneumoniae R6
caauaucuuuauugaugaagucu

SEQ ID NO: 4085022 - RNA, 20 nt, Streptococcus pneumoniae R6
caauauuacguccuguugcu

SEQ ID NO: 4085023 - RNA, 19 nt, Streptococcus pneumoniae R6
caauauuuuagaagcagag

SEQ ID NO: 4085024 - RNA, 12 nt, Streptococcus pneumoniae R6
caauauuuuuga

SEQ ID NO: 4085025 - RNA, 21 nt, Streptococcus pneumoniae R6
caaucaaaaaaucucacuauu

SEQ ID NO: 4085026 - RNA, 22 nt, Streptococcus pneumoniae R6
caaucaaacgagaaucuguauu

SEQ ID NO: 4085027 - RNA, 13 nt, Streptococcus pneumoniae R6
caaucaaacuacu

SEQ ID NO: 4085028 - RNA, 15 nt, Streptococcus pneumoniae R6
caaucaauccaaaga

SEQ ID NO: 4085029 - RNA, 14 nt, Streptococcus pneumoniae R6
caaucaauuuaauc

SEQ ID NO: 4085030 - RNA, 14 nt, Streptococcus pneumoniae R6
caaucacuugacca

SEQ ID NO: 4085031 - RNA, 23 nt, Streptococcus pneumoniae R6
caaucagacuauaauauaauaaa

SEQ ID NO: 4085032 - RNA, 21 nt, Streptococcus pneumoniae R6
caaucaguaauuuaguucuca

SEQ ID NO: 4085033 - RNA, 19 nt, Streptococcus pneumoniae R6
caaucaguuuuuucacaaa

SEQ ID NO: 4085034 - RNA, 19 nt, Streptococcus pneumoniae R6
caaucauaccugcauuguc

SEQ ID NO: 4085035 - RNA, 15 nt, Streptococcus pneumoniae R6
caaucauaucaucaa

SEQ ID NO: 4085036 - RNA, 20 nt, Streptococcus pneumoniae R6
caaucauuucaaagccuucc

SEQ ID NO: 4085037 - RNA, 15 nt, Streptococcus pneumoniae R6
caaucauuuggaaaa

SEQ ID NO: 4085038 - RNA, 13 nt, Streptococcus pneumoniae R6
caauccaucucca

SEQ ID NO: 4085039 - RNA, 16 nt, Streptococcus pneumoniae R6
caaucccaagcccugc

SEQ ID NO: 4085040 - RNA, 19 nt, Streptococcus pneumoniae R6
caaucccuagcuuuuuccu

SEQ ID NO: 4085041 - RNA, 20 nt, Streptococcus pneumoniae R6
caauccguucugagauaggu

SEQ ID NO: 4085042 - RNA, 15 nt, Streptococcus pneumoniae R6
caauccuaaauccuc

SEQ ID NO: 4085043 - RNA, 20 nt, Streptococcus pneumoniae R6
caauccuaugauacccaaaa

SEQ ID NO: 4085044 - RNA, 17 nt, Streptococcus pneumoniae R6
caauccugaagaauggg

SEQ ID NO: 4085045 - RNA, 21 nt, Streptococcus pneumoniae R6
caauccuuguaugacaucuug

SEQ ID NO: 4085046 - RNA, 22 nt, Streptococcus pneumoniae R6
caaucgcuauuaucguuuuccu

SEQ ID NO: 4085047 - RNA, 13 nt, Streptococcus pneumoniae R6
caaucgcuuuuuu

SEQ ID NO: 4085048 - RNA, 15 nt, Streptococcus pneumoniae R6
caaucgggaucugau

SEQ ID NO: 4085049 - RNA, 14 nt, Streptococcus pneumoniae R6
caaucguaaacuga

SEQ ID NO: 4085050 - RNA, 17 nt, Streptococcus pneumoniae R6
caaucguugcaccugaa

SEQ ID NO: 4085051 - RNA, 14 nt, Streptococcus pneumoniae R6
caaucguuucaagu

SEQ ID NO: 4085052 - RNA, 13 nt, Streptococcus pneumoniae R6
caaucuaucuuuu

SEQ ID NO: 4085053 - RNA, 18 nt, Streptococcus pneumoniae R6
caaucuauuuaugaaaaa

SEQ ID NO: 4085054 - RNA, 19 nt, Streptococcus pneumoniae R6
caaucuauuuaugaaaaag

SEQ ID NO: 4085055 - RNA, 14 nt, Streptococcus pneumoniae R6
caaucuuaucaauc

SEQ ID NO: 4085056 - RNA, 14 nt, Streptococcus pneumoniae R6
caaucuucaaaauc

SEQ ID NO: 4085057 - RNA, 13 nt, Streptococcus pneumoniae R6
caaucuucuccag

SEQ ID NO: 4085058 - RNA, 15 nt, Streptococcus pneumoniae R6
caaucuuuuccaacu

SEQ ID NO: 4085059 - RNA, 14 nt, Streptococcus pneumoniae R6
caaugaaaaaaaca

SEQ ID NO: 4085060 - RNA, 13 nt, Streptococcus pneumoniae R6
caaugaaaagaac

SEQ ID NO: 4085061 - RNA, 16 nt, Streptococcus pneumoniae R6
caaugaaaaucaaaga

SEQ ID NO: 4085062 - RNA, 17 nt, Streptococcus pneumoniae R6
caaugaaaaucaaagag

SEQ ID NO: 4085063 - RNA, 19 nt, Streptococcus pneumoniae R6
caaugaaaaucaaagagca

SEQ ID NO: 4085064 - RNA, 20 nt, Streptococcus pneumoniae R6
caaugaaaaucaaagagcaa

SEQ ID NO: 4085065 - RNA, 19 nt, Streptococcus pneumoniae R6
caaugaaaaucaaagugca

SEQ ID NO: 4085066 - RNA, 17 nt, Streptococcus pneumoniae R6
caaugaaaaucauagaa

SEQ ID NO: 4085067 - RNA, 18 nt, Streptococcus pneumoniae R6
caaugaauccgaaaaauu

SEQ ID NO: 4085068 - RNA, 20 nt, Streptococcus pneumoniae R6
caaugaauccgaaaaauuuc

SEQ ID NO: 4085069 - RNA, 15 nt, Streptococcus pneumoniae R6
caaugauaaaagucu

SEQ ID NO: 4085070 - RNA, 20 nt, Streptococcus pneumoniae R6
caaugcccuugauaauaaag

SEQ ID NO: 4085071 - RNA, 21 nt, Streptococcus pneumoniae R6
caaugcccuugauaauaaaga

SEQ ID NO: 4085072 - RNA, 14 nt, Streptococcus pneumoniae R6
caauggaaaugaua

SEQ ID NO: 4085073 - RNA, 15 nt, Streptococcus pneumoniae R6
caauggaaaugauaa

SEQ ID NO: 4085074 - RNA, 16 nt, Streptococcus pneumoniae R6
caauggaguaaaaaaa

SEQ ID NO: 4085075 - RNA, 22 nt, Streptococcus pneumoniae R6
caauggcaaaaaauugagaaag

SEQ ID NO: 4085076 - RNA, 20 nt, Streptococcus pneumoniae R6
caauggcugguauuaagaac

SEQ ID NO: 4085077 - RNA, 17 nt, Streptococcus pneumoniae R6
caauggguucaucucug

SEQ ID NO: 4085078 - RNA, 21 nt, Streptococcus pneumoniae R6
caaugguaacagucuuagcaa

SEQ ID NO: 4085079 - RNA, 16 nt, Streptococcus pneumoniae R6
caauggucaagaguug

SEQ ID NO: 4085080 - RNA, 14 nt, Streptococcus pneumoniae R6
caaugguuuuuagc

SEQ ID NO: 4085081 - RNA, 19 nt, Streptococcus pneumoniae R6
caauguaccugcaaauuua

SEQ ID NO: 4085082 - RNA, 22 nt, Streptococcus pneumoniae R6
caauguagccaucauccaccuu

SEQ ID NO: 4085083 - RNA, 22 nt, Streptococcus pneumoniae R6
caaugugcagggcgcuacaaca

SEQ ID NO: 4085084 - RNA, 21 nt, Streptococcus pneumoniae R6
caaugugcucagaaacaagaa

SEQ ID NO: 4085085 - RNA, 22 nt, Streptococcus pneumoniae R6
caaugugcucagaaacaagaaa

SEQ ID NO: 4085086 - RNA, 22 nt, Streptococcus pneumoniae R6
caauguuuacucaguauuugga

SEQ ID NO: 4085087 - RNA, 16 nt, Streptococcus pneumoniae R6
caauguuuuagaaaua

SEQ ID NO: 4085088 - RNA, 20 nt, Streptococcus pneumoniae R6
caauguuuugaucugacuuc

SEQ ID NO: 4085089 - RNA, 22 nt, Streptococcus pneumoniae R6
caauguuuugaucugacuucgu

SEQ ID NO: 4085090 - RNA, 14 nt, Streptococcus pneumoniae R6
caccaagucaucaa

SEQ ID NO: 4085091 - RNA, 19 nt, Streptococcus pneumoniae R6
caccaagucaucaaaaaua

SEQ ID NO: 4085092 - RNA, 11 nt, Streptococcus pneumoniae R6
caccaauacag

SEQ ID NO: 4085093 - RNA, 14 nt, Streptococcus pneumoniae R6
caccaauacagcuu

SEQ ID NO: 4085094 - RNA, 15 nt, Streptococcus pneumoniae R6
caccaaucauuugga

SEQ ID NO: 4085095 - RNA, 16 nt, Streptococcus pneumoniae R6
caccaauuuuacaaau

SEQ ID NO: 4085096 - RNA, 18 nt, Streptococcus pneumoniae R6
caccaauuuuaccuuuca

SEQ ID NO: 4085097 - RNA, 17 nt, Streptococcus pneumoniae R6
caccaccgauauggccu

SEQ ID NO: 4085098 - RNA, 16 nt, Streptococcus pneumoniae R6
caccaccugcaacaau

SEQ ID NO: 4085099 - RNA, 18 nt, Streptococcus pneumoniae R6
caccaccugccacaacua

SEQ ID NO: 4085100 - RNA, 15 nt, Streptococcus pneumoniae R6
caccacgaaguccuu

SEQ ID NO: 4085101 - RNA, 15 nt, Streptococcus pneumoniae R6
caccacuugcuuagu

SEQ ID NO: 4085102 - RNA, 17 nt, Streptococcus pneumoniae R6
caccagauagaauagca

SEQ ID NO: 4085103 - RNA, 23 nt, Streptococcus pneumoniae R6
caccagcuauuaagaaaaaugau

SEQ ID NO: 4085104 - RNA, 14 nt, Streptococcus pneumoniae R6
caccaggagccaag

SEQ ID NO: 4085105 - RNA, 16 nt, Streptococcus pneumoniae R6
caccaggagccaagau

SEQ ID NO: 4085106 - RNA, 21 nt, Streptococcus pneumoniae R6
caccaggagccaagauaggaa

SEQ ID NO: 4085107 - RNA, 18 nt, Streptococcus pneumoniae R6
caccaggcauuauuucac

SEQ ID NO: 4085108 - RNA, 23 nt, Streptococcus pneumoniae R6
caccaggcauuauuucacuugua

SEQ ID NO: 4085109 - RNA, 16 nt, Streptococcus pneumoniae R6
cacccauaauaucaua

SEQ ID NO: 4085110 - RNA, 14 nt, Streptococcus pneumoniae R6
cacccauguaugga

SEQ ID NO: 4085111 - RNA, 16 nt, Streptococcus pneumoniae R6
cacccugcaugagcug

SEQ ID NO: 4085112 - RNA, 18 nt, Streptococcus pneumoniae R6
caccgaaggcuugcucug

SEQ ID NO: 4085113 - RNA, 15 nt, Streptococcus pneumoniae R6
caccgaauuuuucaa

SEQ ID NO: 4085114 - RNA, 20 nt, Streptococcus pneumoniae R6
caccgacuugguaguugagc

SEQ ID NO: 4085115 - RNA, 23 nt, Streptococcus pneumoniae R6
caccgagaaaggcgacaucaucc

SEQ ID NO: 4085116 - RNA, 12 nt, Streptococcus pneumoniae R6
caccgccugcuc

SEQ ID NO: 4085117 - RNA, 14 nt, Streptococcus pneumoniae R6
caccguuuuuguag

SEQ ID NO: 4085118 - RNA, 20 nt, Streptococcus pneumoniae R6
caccuaaaauucccuuaucc

SEQ ID NO: 4085119 - RNA, 18 nt, Streptococcus pneumoniae R6
caccuagcgccuguucua

SEQ ID NO: 4085120 - RNA, 21 nt, Streptococcus pneumoniae R6
caccuaguccaagacguucaa

SEQ ID NO: 4085121 - RNA, 21 nt, Streptococcus pneumoniae R6
caccuaucugcuauguugcaa

SEQ ID NO: 4085122 - RNA, 12 nt, Streptococcus pneumoniae R6
caccucaucuug

SEQ ID NO: 4085123 - RNA, 17 nt, Streptococcus pneumoniae R6
caccuccgccuccagag

SEQ ID NO: 4085124 - RNA, 18 nt, Streptococcus pneumoniae R6
caccuccgccuccagaga

SEQ ID NO: 4085125 - RNA, 23 nt, Streptococcus pneumoniae R6
caccuccgccuccagagaagcca

SEQ ID NO: 4085126 - RNA, 15 nt, Streptococcus pneumoniae R6
caccuccuucuccaa

SEQ ID NO: 4085127 - RNA, 17 nt, Streptococcus pneumoniae R6
caccuccuucuccaauc

SEQ ID NO: 4085128 - RNA, 15 nt, Streptococcus pneumoniae R6
caccuccuucuccag

SEQ ID NO: 4085129 - RNA, 16 nt, Streptococcus pneumoniae R6
caccuccuucuccagu

SEQ ID NO: 4085130 - RNA, 12 nt, Streptococcus pneumoniae R6
caccugauuuua

SEQ ID NO: 4085131 - RNA, 13 nt, Streptococcus pneumoniae R6
caccugcaauaau

SEQ ID NO: 4085132 - RNA, 17 nt, Streptococcus pneumoniae R6
caccuugaucuuccauu

SEQ ID NO: 4085133 - RNA, 16 nt, Streptococcus pneumoniae R6
caccuuuaucagccaa

SEQ ID NO: 4085134 - RNA, 22 nt, Streptococcus pneumoniae R6
caccuuuguauggaaacucaaa

SEQ ID NO: 4085135 - RNA, 13 nt, Streptococcus pneumoniae R6
caccuuuucucaa

SEQ ID NO: 4085136 - RNA, 17 nt, Streptococcus pneumoniae R6
cacgaagggcuucauca

SEQ ID NO: 4085137 - RNA, 18 nt, Streptococcus pneumoniae R6
cacgaagggcuucaucaa

SEQ ID NO: 4085138 - RNA, 13 nt, Streptococcus pneumoniae R6
cacgaauaaccaa

SEQ ID NO: 4085139 - RNA, 18 nt, Streptococcus pneumoniae R6
cacgaaucaauuucuuca

SEQ ID NO: 4085140 - RNA, 21 nt, Streptococcus pneumoniae R6
cacgaauuucuuguucaacca

SEQ ID NO: 4085141 - RNA, 19 nt, Streptococcus pneumoniae R6
cacgacgcaguucuucaua

SEQ ID NO: 4085142 - RNA, 15 nt, Streptococcus pneumoniae R6
cacgacuuucugaua

SEQ ID NO: 4085143 - RNA, 20 nt, Streptococcus pneumoniae R6
cacgacuuucugauggauuu

SEQ ID NO: 4085144 - RNA, 15 nt, Streptococcus pneumoniae R6
cacgagucacugugg

SEQ ID NO: 4085145 - RNA, 22 nt, Streptococcus pneumoniae R6
cacgaguggacucgaaccaccg

SEQ ID NO: 4085146 - RNA, 15 nt, Streptococcus pneumoniae R6
cacgauuggggucag

SEQ ID NO: 4085147 - RNA, 15 nt, Streptococcus pneumoniae R6
cacgcuccacuuccc

SEQ ID NO: 4085148 - RNA, 13 nt, Streptococcus pneumoniae R6
cacggauuaagag

SEQ ID NO: 4085149 - RNA, 16 nt, Streptococcus pneumoniae R6
cacggauucucucagc

SEQ ID NO: 4085150 - RNA, 13 nt, Streptococcus pneumoniae R6
cacgguaaaauac

SEQ ID NO: 4085151 - RNA, 15 nt, Streptococcus pneumoniae R6
cacgguaauuguuuu

SEQ ID NO: 4085152 - RNA, 20 nt, Streptococcus pneumoniae R6
cacgguuuguauugaacccg

SEQ ID NO: 4085153 - RNA, 16 nt, Streptococcus pneumoniae R6
cacguaacauauuuuc

SEQ ID NO: 4085154 - RNA, 15 nt, Streptococcus pneumoniae R6
cacguacuuuaaaau

SEQ ID NO: 4085155 - RNA, 16 nt, Streptococcus pneumoniae R6
cacguauaauucuaac

SEQ ID NO: 4085156 - RNA, 16 nt, Streptococcus pneumoniae R6
cacgucagcuuuaucu

SEQ ID NO: 4085157 - RNA, 20 nt, Streptococcus pneumoniae R6
cacguccaucgaugauuggu

SEQ ID NO: 4085158 - RNA, 22 nt, Streptococcus pneumoniae R6
cacguccaucgaugauuggugc

SEQ ID NO: 4085159 - RNA, 13 nt, Streptococcus pneumoniae R6
cacguccuagcuc

SEQ ID NO: 4085160 - RNA, 15 nt, Streptococcus pneumoniae R6
cacgugcucaaaaca

SEQ ID NO: 4085161 - RNA, 18 nt, Streptococcus pneumoniae R6
cacguucuuuaaucaaga

SEQ ID NO: 4085162 - RNA, 17 nt, Streptococcus pneumoniae R6
cacguuuuucuucuuuu

SEQ ID NO: 4085163 - RNA, 11 nt, Streptococcus pneumoniae R6
cacuaaaaaua

SEQ ID NO: 4085164 - RNA, 13 nt, Streptococcus pneumoniae R6
cacuaaacuacac

SEQ ID NO: 4085165 - RNA, 22 nt, Streptococcus pneumoniae R6
cacuaauuaucuaucucaacaa

SEQ ID NO: 4085166 - RNA, 17 nt, Streptococcus pneumoniae R6
cacuacacuugacaaag

SEQ ID NO: 4085167 - RNA, 18 nt, Streptococcus pneumoniae R6
cacuacaguugacaaaga

SEQ ID NO: 4085168 - RNA, 23 nt, Streptococcus pneumoniae R6
cacuacgauuggggauuuuuagu

SEQ ID NO: 4085169 - RNA, 17 nt, Streptococcus pneumoniae R6
cacuacuuccaucuaca

SEQ ID NO: 4085170 - RNA, 19 nt, Streptococcus pneumoniae R6
cacuagaugcaucugccag

SEQ ID NO: 4085171 - RNA, 22 nt, Streptococcus pneumoniae R6
cacuagcauaauggcucauuug

SEQ ID NO: 4085172 - RNA, 20 nt, Streptococcus pneumoniae R6
cacuagugaauuugguucca

SEQ ID NO: 4085173 - RNA, 21 nt, Streptococcus pneumoniae R6
cacuaguuuuaggacauaaau

SEQ ID NO: 4085174 - RNA, 17 nt, Streptococcus pneumoniae R6
cacuauaauaaaaugaa

SEQ ID NO: 4085175 - RNA, 18 nt, Streptococcus pneumoniae R6
cacuauaauaaaaugaaa

SEQ ID NO: 4085176 - RNA, 20 nt, Streptococcus pneumoniae R6
cacuauaguccaaacgucca

SEQ ID NO: 4085177 - RNA, 12 nt, Streptococcus pneumoniae R6
cacuaucuaaaa

SEQ ID NO: 4085178 - RNA, 14 nt, Streptococcus pneumoniae R6
cacuaucuaaaaaa

SEQ ID NO: 4085179 - RNA, 18 nt, Streptococcus pneumoniae R6
cacuauguggcuuggcag

SEQ ID NO: 4085180 - RNA, 14 nt, Streptococcus pneumoniae R6
cacuauuagcaucu

SEQ ID NO: 4085181 - RNA, 15 nt, Streptococcus pneumoniae R6
cacuauuagcaucuu

SEQ ID NO: 4085182 - RNA, 12 nt, Streptococcus pneumoniae R6
cacuauucauca

SEQ ID NO: 4085183 - RNA, 21 nt, Streptococcus pneumoniae R6
cacuauugaugaaguaaaugu

SEQ ID NO: 4085184 - RNA, 15 nt, Streptococcus pneumoniae R6
cacuauuguauuuau

SEQ ID NO: 4085185 - RNA, 20 nt, Streptococcus pneumoniae R6
cacucaaaucaaaauauagc

SEQ ID NO: 4085186 - RNA, 14 nt, Streptococcus pneumoniae R6
cacucaaaucauau

SEQ ID NO: 4085187 - RNA, 13 nt, Streptococcus pneumoniae R6
cacucaauauuau

SEQ ID NO: 4085188 - RNA, 23 nt, Streptococcus pneumoniae R6
cacucaauauuaugcguuuuuuc

SEQ ID NO: 4085189 - RNA, 15 nt, Streptococcus pneumoniae R6
cacucaauuuaucua

SEQ ID NO: 4085190 - RNA, 18 nt, Streptococcus pneumoniae R6
cacucaguauuacaucca

SEQ ID NO: 4085191 - RNA, 20 nt, Streptococcus pneumoniae R6
cacucaguauuacauccacc

SEQ ID NO: 4085192 - RNA, 22 nt, Streptococcus pneumoniae R6
cacucaguauuacauccaccag

SEQ ID NO: 4085193 - RNA, 20 nt, Streptococcus pneumoniae R6
cagauaagagcaacaaauau

SEQ ID NO: 4085194 - RNA, 20 nt, Streptococcus pneumoniae R6
cagauaagcaccuaguacaa

SEQ ID NO: 4085195 - RNA, 22 nt, Streptococcus pneumoniae R6
cagauaauaauugacgaagaaa

SEQ ID NO: 4085196 - RNA, 15 nt, Streptococcus pneumoniae R6
cagauaauucucuaa

SEQ ID NO: 4085197 - RNA, 17 nt, Streptococcus pneumoniae R6
cagauagacauuuucug

SEQ ID NO: 4085198 - RNA, 16 nt, Streptococcus pneumoniae R6
cagauaggauugcccu

SEQ ID NO: 4085199 - RNA, 17 nt, Streptococcus pneumoniae R6
cagauauaccaagacau

SEQ ID NO: 4085200 - RNA, 20 nt, Streptococcus pneumoniae R6
cagauauaggcauaucugau

SEQ ID NO: 4085201 - RNA, 15 nt, Streptococcus pneumoniae R6
cagaucuuagaagca

SEQ ID NO: 4085202 - RNA, 15 nt, Streptococcus pneumoniae R6
cagaugacaaaucua

SEQ ID NO: 4085203 - RNA, 16 nt, Streptococcus pneumoniae R6
cagaugacaaaucuaa

SEQ ID NO: 4085204 - RNA, 21 nt, Streptococcus pneumoniae R6
cagaugaguguaaaaagaaag

SEQ ID NO: 4085205 - RNA, 15 nt, Streptococcus pneumoniae R6
cagaugcugcauuuu

SEQ ID NO: 4085206 - RNA, 22 nt, Streptococcus pneumoniae R6
cagauggacugaccaccuguac

SEQ ID NO: 4085207 - RNA, 15 nt, Streptococcus pneumoniae R6
cagauucacuagccc

SEQ ID NO: 4085208 - RNA, 12 nt, Streptococcus pneumoniae R6
cagauucagucu

SEQ ID NO: 4085209 - RNA, 13 nt, Streptococcus pneumoniae R6
cagauucugacaa

SEQ ID NO: 4085210 - RNA, 17 nt, Streptococcus pneumoniae R6
cagauucugacaaucca

SEQ ID NO: 4085211 - RNA, 17 nt, Streptococcus pneumoniae R6
cagauugcucaaaacac

SEQ ID NO: 4085212 - RNA, 20 nt, Streptococcus pneumoniae R6
cagauuguaaaggaugacaa

SEQ ID NO: 4085213 - RNA, 22 nt, Streptococcus pneumoniae R6
cagauugucgguagaacgauaa

SEQ ID NO: 4085214 - RNA, 14 nt, Streptococcus pneumoniae R6
cagauugucuaggg

SEQ ID NO: 4085215 - RNA, 20 nt, Streptococcus pneumoniae R6
cagauuuaacuauaguagau

SEQ ID NO: 4085216 - RNA, 12 nt, Streptococcus pneumoniae R6
cagauuuuaaag

SEQ ID NO: 4085217 - RNA, 14 nt, Streptococcus pneumoniae R6
cagcaaagguacau

SEQ ID NO: 4085218 - RNA, 11 nt, Streptococcus pneumoniae R6
cagcaaucaaa

SEQ ID NO: 4085219 - RNA, 15 nt, Streptococcus pneumoniae R6
cagcaccagacauuu

SEQ ID NO: 4085220 - RNA, 14 nt, Streptococcus pneumoniae R6
cagcaccaguugag

SEQ ID NO: 4085221 - RNA, 16 nt, Streptococcus pneumoniae R6
cagcaccaguugaguu

SEQ ID NO: 4085222 - RNA, 15 nt, Streptococcus pneumoniae R6
cagcacguuuuucuu

SEQ ID NO: 4085223 - RNA, 20 nt, Streptococcus pneumoniae R6
cagcacguuuuucuucuuuu

SEQ ID NO: 4085224 - RNA, 20 nt, Streptococcus pneumoniae R6
cagcacuuggcauucaaaac

SEQ ID NO: 4085225 - RNA, 16 nt, Streptococcus pneumoniae R6
cagcagagaaagaaaa

SEQ ID NO: 4085226 - RNA, 12 nt, Streptococcus pneumoniae R6
cagcagugguuu

SEQ ID NO: 4085227 - RNA, 20 nt, Streptococcus pneumoniae R6
cagcauauuucccauuuuuu

SEQ ID NO: 4085228 - RNA, 22 nt, Streptococcus pneumoniae R6
cagcauggcacggucauuuucu

SEQ ID NO: 4085229 - RNA, 19 nt, Streptococcus pneumoniae R6
cagcauggcccgcuucgcu

SEQ ID NO: 4085230 - RNA, 17 nt, Streptococcus pneumoniae R6
cagcauuuccuagccaa

SEQ ID NO: 4085231 - RNA, 21 nt, Streptococcus pneumoniae R6
cagcauuuucuuuuugaaguu

SEQ ID NO: 4085232 - RNA, 15 nt, Streptococcus pneumoniae R6
cagccaaaaguccaa

SEQ ID NO: 4085233 - RNA, 21 nt, Streptococcus pneumoniae R6
cagccaaacuaggauuuucuu

SEQ ID NO: 4085234 - RNA, 15 nt, Streptococcus pneumoniae R6
cagccaauuucuuua

SEQ ID NO: 4085235 - RNA, 18 nt, Streptococcus pneumoniae R6
cagccacggcacguucca

SEQ ID NO: 4085236 - RNA, 20 nt, Streptococcus pneumoniae R6
cagccacuguacguccaacu

SEQ ID NO: 4085237 - RNA, 15 nt, Streptococcus pneumoniae R6
cagccgacuauacuc

SEQ ID NO: 4085238 - RNA, 14 nt, Streptococcus pneumoniae R6
cagccucuuucuug

SEQ ID NO: 4085239 - RNA, 16 nt, Streptococcus pneumoniae R6
cagccuucauaaaagu

SEQ ID NO: 4085240 - RNA, 15 nt, Streptococcus pneumoniae R6
cagccuuggucacua

SEQ ID NO: 4085241 - RNA, 22 nt, Streptococcus pneumoniae R6
cagcgauagcuccaucuccaac

SEQ ID NO: 4085242 - RNA, 13 nt, Streptococcus pneumoniae R6
cagcuaaaaauaa

SEQ ID NO: 4085243 - RNA, 17 nt, Streptococcus pneumoniae R6
cagcuaaaagcaaagca

SEQ ID NO: 4085244 - RNA, 18 nt, Streptococcus pneumoniae R6
cagcuaaaauguuuuucg

SEQ ID NO: 4085245 - RNA, 20 nt, Streptococcus pneumoniae R6
cagcuaaaauguuuuucguc

SEQ ID NO: 4085246 - RNA, 16 nt, Streptococcus pneumoniae R6
cagcuaacucugcugc

SEQ ID NO: 4085247 - RNA, 18 nt, Streptococcus pneumoniae R6
cagcuaagccuuuuucuu

SEQ ID NO: 4085248 - RNA, 22 nt, Streptococcus pneumoniae R6
cagcuacaaaggcuauagucaa

SEQ ID NO: 4085249 - RNA, 19 nt, Streptococcus pneumoniae R6
cagcuacgacaccugacaa

SEQ ID NO: 4085250 - RNA, 21 nt, Streptococcus pneumoniae R6
cagcuagcuagaguuucaauu

SEQ ID NO: 4085251 - RNA, 14 nt, Streptococcus pneumoniae R6
cagcuauuaagaaa

SEQ ID NO: 4085252 - RNA, 19 nt, Streptococcus pneumoniae R6
cagcuauuaagaaaaauga

SEQ ID NO: 4085253 - RNA, 12 nt, Streptococcus pneumoniae R6
cagcucaaaaca

SEQ ID NO: 4085254 - RNA, 13 nt, Streptococcus pneumoniae R6
cagcucaaaacac

SEQ ID NO: 4085255 - RNA, 17 nt, Streptococcus pneumoniae R6
cagcucaaaacacuguu

SEQ ID NO: 4085256 - RNA, 20 nt, Streptococcus pneumoniae R6
cagcucaaaacacuguuuua

SEQ ID NO: 4085257 - RNA, 17 nt, Streptococcus pneumoniae R6
cagcuccgauguauuug

SEQ ID NO: 4085258 - RNA, 12 nt, Streptococcus pneumoniae R6
cagcuccugaaa

SEQ ID NO: 4085259 - RNA, 23 nt, Streptococcus pneumoniae R6
cagcucucugauuuucagagggc

SEQ ID NO: 4085260 - RNA, 21 nt, Streptococcus pneumoniae R6
cagcugcgauuuuagcacugg

SEQ ID NO: 4085261 - RNA, 18 nt, Streptococcus pneumoniae R6
cagcugucuuuucaaagu

SEQ ID NO: 4085262 - RNA, 19 nt, Streptococcus pneumoniae R6
cagcugucuuuucaaaguu

SEQ ID NO: 4085263 - RNA, 16 nt, Streptococcus pneumoniae R6
cagcuuaucucguacu

SEQ ID NO: 4085264 - RNA, 13 nt, Streptococcus pneumoniae R6
cagcuucuuuuua

SEQ ID NO: 4085265 - RNA, 14 nt, Streptococcus pneumoniae R6
cagcuucuuuuuau

SEQ ID NO: 4085266 - RNA, 21 nt, Streptococcus pneumoniae R6
cagcuucuuuuuauauauaaa

SEQ ID NO: 4085267 - RNA, 18 nt, Streptococcus pneumoniae R6
cagcuugcccuuugucca

SEQ ID NO: 4085268 - RNA, 15 nt, Streptococcus pneumoniae R6
cagcuuguucuucug

SEQ ID NO: 4085269 - RNA, 20 nt, Streptococcus pneumoniae R6
cagcuuguucuucugcuguc

SEQ ID NO: 4085270 - RNA, 20 nt, Streptococcus pneumoniae R6
cagcuuucuagccuguauga

SEQ ID NO: 4085271 - RNA, 17 nt, Streptococcus pneumoniae R6
cagcuuuggcaacugcu

SEQ ID NO: 4085272 - RNA, 11 nt, Streptococcus pneumoniae R6
cagcuuuuucu

SEQ ID NO: 4085273 - RNA, 12 nt, Streptococcus pneumoniae R6
cagcuuuuucuu

SEQ ID NO: 4085274 - RNA, 18 nt, Streptococcus pneumoniae R6
cagcuuuuuugauaguga

SEQ ID NO: 4085275 - RNA, 18 nt, Streptococcus pneumoniae R6
cagcuuuuuuggcagauu

SEQ ID NO: 4085276 - RNA, 16 nt, Streptococcus pneumoniae R6
caggaaaccagcugcg

SEQ ID NO: 4085277 - RNA, 15 nt, Streptococcus pneumoniae R6
caggaaagacuaggg

SEQ ID NO: 4085278 - RNA, 17 nt, Streptococcus pneumoniae R6
caggaaaggcauuccag

SEQ ID NO: 4085279 - RNA, 13 nt, Streptococcus pneumoniae R6
caggaaggaaaua

SEQ ID NO: 4085280 - RNA, 15 nt, Streptococcus pneumoniae R6
caggaagucuauuau

SEQ ID NO: 4085281 - RNA, 21 nt, Streptococcus pneumoniae R6
caggaagucuauuauauauau

SEQ ID NO: 4085282 - RNA, 17 nt, Streptococcus pneumoniae R6
caggaagucuauuauuu

SEQ ID NO: 4085283 - RNA, 14 nt, Streptococcus pneumoniae R6
caggaaguuuuuuc

SEQ ID NO: 4085284 - RNA, 16 nt, Streptococcus pneumoniae R6
caggaauacuaaaaua

SEQ ID NO: 4085285 - RNA, 20 nt, Streptococcus pneumoniae R6
caggaauauccaauauggca

SEQ ID NO: 4085286 - RNA, 20 nt, Streptococcus pneumoniae R6
caggaauauugaguucuuca

SEQ ID NO: 4085287 - RNA, 20 nt, Streptococcus pneumoniae R6
caggaauguccuuagcaugg

SEQ ID NO: 4085288 - RNA, 22 nt, Streptococcus pneumoniae R6
caggaauuucgcuauuuaaacu

SEQ ID NO: 4085289 - RNA, 14 nt, Streptococcus pneumoniae R6
caggacaaaucgau

SEQ ID NO: 4085290 - RNA, 18 nt, Streptococcus pneumoniae R6
caggacagucaaaucgau

SEQ ID NO: 4085291 - RNA, 22 nt, Streptococcus pneumoniae R6
caggacagucaaaucgauuucu

SEQ ID NO: 4085292 - RNA, 17 nt, Streptococcus pneumoniae R6
caggaccgaugauuaca

SEQ ID NO: 4085293 - RNA, 15 nt, Streptococcus pneumoniae R6
caggacgaacgcugg

SEQ ID NO: 4085294 - RNA, 21 nt, Streptococcus pneumoniae R6
caggacuuggauaagagaaga

SEQ ID NO: 4085295 - RNA, 22 nt, Streptococcus pneumoniae R6
caggagaaaaugaaauaauacu

SEQ ID NO: 4085296 - RNA, 17 nt, Streptococcus pneumoniae R6
caguuccuuugucuuua

SEQ ID NO: 4085297 - RNA, 23 nt, Streptococcus pneumoniae R6
caguuccuuugucuuuagucuua

SEQ ID NO: 4085298 - RNA, 13 nt, Streptococcus pneumoniae R6
caguucuauccac

SEQ ID NO: 4085299 - RNA, 14 nt, Streptococcus pneumoniae R6
caguucuauccaca

SEQ ID NO: 4085300 - RNA, 17 nt, Streptococcus pneumoniae R6
caguucuauccacaacc

SEQ ID NO: 4085301 - RNA, 15 nt, Streptococcus pneumoniae R6
caguucuaucugcaa

SEQ ID NO: 4085302 - RNA, 13 nt, Streptococcus pneumoniae R6
caguucuucaugg

SEQ ID NO: 4085303 - RNA, 13 nt, Streptococcus pneumoniae R6
caguugaaaaggc

SEQ ID NO: 4085304 - RNA, 22 nt, Streptococcus pneumoniae R6
caguugacaaagagccaaaaaa

SEQ ID NO: 4085305 - RNA, 23 nt, Streptococcus pneumoniae R6
caguugacaaagagccauaaaaa

SEQ ID NO: 4085306 - RNA, 19 nt, Streptococcus pneumoniae R6
caguugacaaagagccgga

SEQ ID NO: 4085307 - RNA, 13 nt, Streptococcus pneumoniae R6
caguugcaagaag

SEQ ID NO: 4085308 - RNA, 16 nt, Streptococcus pneumoniae R6
caguugccucagauuc

SEQ ID NO: 4085309 - RNA, 13 nt, Streptococcus pneumoniae R6
caguugcgccacu

SEQ ID NO: 4085310 - RNA, 14 nt, Streptococcus pneumoniae R6
caguugguuauaca

SEQ ID NO: 4085311 - RNA, 18 nt, Streptococcus pneumoniae R6
caguuuauaacuugaagu

SEQ ID NO: 4085312 - RNA, 20 nt, Streptococcus pneumoniae R6
caguuucgccuggagcuuca

SEQ ID NO: 4085313 - RNA, 16 nt, Streptococcus pneumoniae R6
caguuucggcuguucu

SEQ ID NO: 4085314 - RNA, 18 nt, Streptococcus pneumoniae R6
caguuuggcguuggaaua

SEQ ID NO: 4085315 - RNA, 22 nt, Streptococcus pneumoniae R6
caguuuguguuucuuuuuggcc

SEQ ID NO: 4085316 - RNA, 14 nt, Streptococcus pneumoniae R6
caguuuucauucua

SEQ ID NO: 4085317 - RNA, 15 nt, Streptococcus pneumoniae R6
caguuuugagguugu

SEQ ID NO: 4085318 - RNA, 16 nt, Streptococcus pneumoniae R6
caguuuugucuguaac

SEQ ID NO: 4085319 - RNA, 18 nt, Streptococcus pneumoniae R6
caguuuuguuuuuuauaa

SEQ ID NO: 4085320 - RNA, 18 nt, Streptococcus pneumoniae R6
caguuuuuaauuuuucuu

SEQ ID NO: 4085321 - RNA, 22 nt, Streptococcus pneumoniae R6
caguuuuugauaccacagaguu

SEQ ID NO: 4085322 - RNA, 19 nt, Streptococcus pneumoniae R6
caguuuuuucacaaauucu

SEQ ID NO: 4085323 - RNA, 18 nt, Streptococcus pneumoniae R6
cauaaaaaaauccuccag

SEQ ID NO: 4085324 - RNA, 20 nt, Streptococcus pneumoniae R6
cauaaaaaaguuuccaauca

SEQ ID NO: 4085325 - RNA, 14 nt, Streptococcus pneumoniae R6
cauaaaaauugaca

SEQ ID NO: 4085326 - RNA, 23 nt, Streptococcus pneumoniae R6
cauaaaacauuuccgauuucaga

SEQ ID NO: 4085327 - RNA, 16 nt, Streptococcus pneumoniae R6
cauaaaacuauaaucu

SEQ ID NO: 4085328 - RNA, 15 nt, Streptococcus pneumoniae R6
cauaaaagucuggcu

SEQ ID NO: 4085329 - RNA, 19 nt, Streptococcus pneumoniae R6
cauaaaauacccucuauca

SEQ ID NO: 4085330 - RNA, 14 nt, Streptococcus pneumoniae R6
cauaaaaucugaau

SEQ ID NO: 4085331 - RNA, 15 nt, Streptococcus pneumoniae R6
cauaaaaucugaauc

SEQ ID NO: 4085332 - RNA, 12 nt, Streptococcus pneumoniae R6
cauaaacaagag

SEQ ID NO: 4085333 - RNA, 18 nt, Streptococcus pneumoniae R6
cauaaacacccauaauau

SEQ ID NO: 4085334 - RNA, 13 nt, Streptococcus pneumoniae R6
cauaaagccuuug

SEQ ID NO: 4085335 - RNA, 22 nt, Streptococcus pneumoniae R6
cauaaaguauuauaauauaauu

SEQ ID NO: 4085336 - RNA, 19 nt, Streptococcus pneumoniae R6
cauaaauacuaucaauaaa

SEQ ID NO: 4085337 - RNA, 23 nt, Streptococcus pneumoniae R6
cauaaauagauuggauaaaaucu

SEQ ID NO: 4085338 - RNA, 20 nt, Streptococcus pneumoniae R6
cauaaaucgaucauauuuau

SEQ ID NO: 4085339 - RNA, 16 nt, Streptococcus pneumoniae R6
cauaacagcauuucca

SEQ ID NO: 4085340 - RNA, 14 nt, Streptococcus pneumoniae R6
cauaacgacagaag

SEQ ID NO: 4085341 - RNA, 18 nt, Streptococcus pneumoniae R6
cauaacgaguaaaagaua

SEQ ID NO: 4085342 - RNA, 23 nt, Streptococcus pneumoniae R6
cauaacgaguaaaagauaaucau

SEQ ID NO: 4085343 - RNA, 16 nt, Streptococcus pneumoniae R6
cauaacgauaauccuu

SEQ ID NO: 4085344 - RNA, 20 nt, Streptococcus pneumoniae R6
cauaacgauaauccuugucg

SEQ ID NO: 4085345 - RNA, 19 nt, Streptococcus pneumoniae R6
cauaacugcugcuuggaag

SEQ ID NO: 4085346 - RNA, 14 nt, Streptococcus pneumoniae R6
cauaacuuuaucca

SEQ ID NO: 4085347 - RNA, 13 nt, Streptococcus pneumoniae R6
cauaagaaacucu

SEQ ID NO: 4085348 - RNA, 19 nt, Streptococcus pneumoniae R6
cauaagaggucugaaacua

SEQ ID NO: 4085349 - RNA, 17 nt, Streptococcus pneumoniae R6
cauaagcuggucuuuuu

SEQ ID NO: 4085350 - RNA, 18 nt, Streptococcus pneumoniae R6
cauaagcuggucuuuuuu

SEQ ID NO: 4085351 - RNA, 22 nt, Streptococcus pneumoniae R6
cauaaguaccaaucccauguca

SEQ ID NO: 4085352 - RNA, 15 nt, Streptococcus pneumoniae R6
cauaagucauaacau

SEQ ID NO: 4085353 - RNA, 16 nt, Streptococcus pneumoniae R6
cauaagucauaacauu

SEQ ID NO: 4085354 - RNA, 19 nt, Streptococcus pneumoniae R6
cauaaguuguaguacugaa

SEQ ID NO: 4085355 - RNA, 23 nt, Streptococcus pneumoniae R6
cauaaguuguaguacugaacaau

SEQ ID NO: 4085356 - RNA, 18 nt, Streptococcus pneumoniae R6
cauaauaaaagugucuua

SEQ ID NO: 4085357 - RNA, 13 nt, Streptococcus pneumoniae R6
cauaauaauaacc

SEQ ID NO: 4085358 - RNA, 19 nt, Streptococcus pneumoniae R6
cauaauacuguggaauaua

SEQ ID NO: 4085359 - RNA, 13 nt, Streptococcus pneumoniae R6
cauaauagucucu

SEQ ID NO: 4085360 - RNA, 14 nt, Streptococcus pneumoniae R6
cauaauagucucuu

SEQ ID NO: 4085361 - RNA, 18 nt, Streptococcus pneumoniae R6
cauaauaucauaaugagc

SEQ ID NO: 4085362 - RNA, 18 nt, Streptococcus pneumoniae R6
cauaaucgcuggcauuuc

SEQ ID NO: 4085363 - RNA, 14 nt, Streptococcus pneumoniae R6
cauaaugagcugua

SEQ ID NO: 4085364 - RNA, 16 nt, Streptococcus pneumoniae R6
cauaaugauuucaaga

SEQ ID NO: 4085365 - RNA, 15 nt, Streptococcus pneumoniae R6
cauaaugucuucugc

SEQ ID NO: 4085366 - RNA, 21 nt, Streptococcus pneumoniae R6
cauaaugucuucugcucgcug

SEQ ID NO: 4085367 - RNA, 16 nt, Streptococcus pneumoniae R6
cauaauuuuaguagaa

SEQ ID NO: 4085368 - RNA, 19 nt, Streptococcus pneumoniae R6
cauaauuuuaguagaaaau

SEQ ID NO: 4085369 - RNA, 13 nt, Streptococcus pneumoniae R6
cauacauacgaua

SEQ ID NO: 4085370 - RNA, 16 nt, Streptococcus pneumoniae R6
cauacauuucgauaaa

SEQ ID NO: 4085371 - RNA, 20 nt, Streptococcus pneumoniae R6
cauacauuucgauaaaggga

SEQ ID NO: 4085372 - RNA, 19 nt, Streptococcus pneumoniae R6
cauacccaugcuuuucuau

SEQ ID NO: 4085373 - RNA, 23 nt, Streptococcus pneumoniae R6
cauaccgccaaucacuugaccaa

SEQ ID NO: 4085374 - RNA, 15 nt, Streptococcus pneumoniae R6
cauaccgccuugucc

SEQ ID NO: 4085375 - RNA, 23 nt, Streptococcus pneumoniae R6
cauaccuacgauaucugaagaua

SEQ ID NO: 4085376 - RNA, 15 nt, Streptococcus pneumoniae R6
cauacgauaaaaauc

SEQ ID NO: 4085377 - RNA, 23 nt, Streptococcus pneumoniae R6
cauacggcgguucaacuaacuuu

SEQ ID NO: 4085378 - RNA, 16 nt, Streptococcus pneumoniae R6
cauacgucggcuagca

SEQ ID NO: 4085379 - RNA, 19 nt, Streptococcus pneumoniae R6
cauacugccaagauagaga

SEQ ID NO: 4085380 - RNA, 11 nt, Streptococcus pneumoniae R6
cauacugcccu

SEQ ID NO: 4085381 - RNA, 17 nt, Streptococcus pneumoniae R6
cauacuuggagaaccua

SEQ ID NO: 4085382 - RNA, 24 nt, Streptococcus pneumoniae R6
cauacuuggagaaccuagaggaau

SEQ ID NO: 4085383 - RNA, 16 nt, Streptococcus pneumoniae R6
cauacuuuaucuucua

SEQ ID NO: 4085384 - RNA, 13 nt, Streptococcus pneumoniae R6
cauacuuucucug

SEQ ID NO: 4085385 - RNA, 18 nt, Streptococcus pneumoniae R6
cauagaaauauuuacuuc

SEQ ID NO: 4085386 - RNA, 15 nt, Streptococcus pneumoniae R6
cauagaaauuuuuac

SEQ ID NO: 4085387 - RNA, 16 nt, Streptococcus pneumoniae R6
cauagacuguuaccac

SEQ ID NO: 4085388 - RNA, 15 nt, Streptococcus pneumoniae R6
cauagacuucccagc

SEQ ID NO: 4085389 - RNA, 16 nt, Streptococcus pneumoniae R6
cauagacuuuacaaca

SEQ ID NO: 4085390 - RNA, 20 nt, Streptococcus pneumoniae R6
cauagagauugauaucugga

SEQ ID NO: 4085391 - RNA, 17 nt, Streptococcus pneumoniae R6
cauagagcggacuaggc

SEQ ID NO: 4085392 - RNA, 21 nt, Streptococcus pneumoniae R6
cauagauucaccaguagacuu

SEQ ID NO: 4085393 - RNA, 16 nt, Streptococcus pneumoniae R6
cauagcaaaauaagcu

SEQ ID NO: 4085394 - RNA, 14 nt, Streptococcus pneumoniae R6
cauagcaagagcac

SEQ ID NO: 4085395 - RNA, 16 nt, Streptococcus pneumoniae R6
cauagcagcaauugau

SEQ ID NO: 4085396 - RNA, 13 nt, Streptococcus pneumoniae R6
cauagccaaauaa

SEQ ID NO: 4085397 - RNA, 14 nt, Streptococcus pneumoniae R6
cauagccaauaaau

SEQ ID NO: 4085398 - RNA, 18 nt, Streptococcus pneumoniae R6
cauagccaauaaauguuu

SEQ ID NO: 4085399 - RNA, 23 nt, Streptococcus pneumoniae R6
caucgcccaauuuauguaaucaa

SEQ ID NO: 4085400 - RNA, 16 nt, Streptococcus pneumoniae R6
caucgcccauggccau

SEQ ID NO: 4085401 - RNA, 16 nt, Streptococcus pneumoniae R6
caucgcuaucaauggu

SEQ ID NO: 4085402 - RNA, 22 nt, Streptococcus pneumoniae R6
caucguuaaucggagacggacu

SEQ ID NO: 4085403 - RNA, 17 nt, Streptococcus pneumoniae R6
caucuaaaacuggugau

SEQ ID NO: 4085404 - RNA, 12 nt, Streptococcus pneumoniae R6
caucuaaauaau

SEQ ID NO: 4085405 - RNA, 22 nt, Streptococcus pneumoniae R6
caucuaaauaauacuuggacua

SEQ ID NO: 4085406 - RNA, 20 nt, Streptococcus pneumoniae R6
caucuaacucauagcagaua

SEQ ID NO: 4085407 - RNA, 22 nt, Streptococcus pneumoniae R6
caucuaagguauauucaaaaua

SEQ ID NO: 4085408 - RNA, 17 nt, Streptococcus pneumoniae R6
caucuacaaccucaaaa

SEQ ID NO: 4085409 - RNA, 19 nt, Streptococcus pneumoniae R6
caucuacaaccucaaaaca

SEQ ID NO: 4085410 - RNA, 20 nt, Streptococcus pneumoniae R6
caucuacaaccucaaaacca

SEQ ID NO: 4085411 - RNA, 12 nt, Streptococcus pneumoniae R6
caucuaccuauu

SEQ ID NO: 4085412 - RNA, 15 nt, Streptococcus pneumoniae R6
caucuauaaucaaua

SEQ ID NO: 4085413 - RNA, 14 nt, Streptococcus pneumoniae R6
caucuaucaaaaga

SEQ ID NO: 4085414 - RNA, 22 nt, Streptococcus pneumoniae R6
caucucaggcuuggucauuaaa

SEQ ID NO: 4085415 - RNA, 14 nt, Streptococcus pneumoniae R6
caucuccugucaau

SEQ ID NO: 4085416 - RNA, 19 nt, Streptococcus pneumoniae R6
caucuccugucaauuccaa

SEQ ID NO: 4085417 - RNA, 16 nt, Streptococcus pneumoniae R6
caucucgugaauagag

SEQ ID NO: 4085418 - RNA, 17 nt, Streptococcus pneumoniae R6
caucucucuauaauaac

SEQ ID NO: 4085419 - RNA, 20 nt, Streptococcus pneumoniae R6
caucucugguguguauggag

SEQ ID NO: 4085420 - RNA, 23 nt, Streptococcus pneumoniae R6
caucucuuacaguuugcucagca

SEQ ID NO: 4085421 - RNA, 12 nt, Streptococcus pneumoniae R6
caucugaaaucc

SEQ ID NO: 4085422 - RNA, 13 nt, Streptococcus pneumoniae R6
caucugcaauaac

SEQ ID NO: 4085423 - RNA, 14 nt, Streptococcus pneumoniae R6
caucugcaucaaga

SEQ ID NO: 4085424 - RNA, 18 nt, Streptococcus pneumoniae R6
caucugcuauaauaguaa

SEQ ID NO: 4085425 - RNA, 21 nt, Streptococcus pneumoniae R6
caucuggaguagcauccccag

SEQ ID NO: 4085426 - RNA, 22 nt, Streptococcus pneumoniae R6
caucuggaguagcauccccagu

SEQ ID NO: 4085427 - RNA, 21 nt, Streptococcus pneumoniae R6
caucuggauuuucagccucua

SEQ ID NO: 4085428 - RNA, 17 nt, Streptococcus pneumoniae R6
caucuggguuaaaaauu

SEQ ID NO: 4085429 - RNA, 20 nt, Streptococcus pneumoniae R6
caucuguaccgaccuugucu

SEQ ID NO: 4085430 - RNA, 14 nt, Streptococcus pneumoniae R6
caucuguuuuaaac

SEQ ID NO: 4085431 - RNA, 15 nt, Streptococcus pneumoniae R6
caucuguuuuaaacg

SEQ ID NO: 4085432 - RNA, 23 nt, Streptococcus pneumoniae R6
caucuguuuuaaacguucaaucc

SEQ ID NO: 4085433 - RNA, 14 nt, Streptococcus pneumoniae R6
caucuguuuucaaa

SEQ ID NO: 4085434 - RNA, 14 nt, Streptococcus pneumoniae R6
caucuuaacauucu

SEQ ID NO: 4085435 - RNA, 12 nt, Streptococcus pneumoniae R6
caucuuauuuca

SEQ ID NO: 4085436 - RNA, 18 nt, Streptococcus pneumoniae R6
caucuuauuucaaucuac

SEQ ID NO: 4085437 - RNA, 20 nt, Streptococcus pneumoniae R6
caucuuauuucaaucuacua

SEQ ID NO: 4085438 - RNA, 21 nt, Streptococcus pneumoniae R6
caucuuauuucaaucugcuau

SEQ ID NO: 4085439 - RNA, 15 nt, Streptococcus pneumoniae R6
caucuucaacuucua

SEQ ID NO: 4085440 - RNA, 16 nt, Streptococcus pneumoniae R6
caucuuccaagaccug

SEQ ID NO: 4085441 - RNA, 22 nt, Streptococcus pneumoniae R6
caucuucguaacgaguuucugg

SEQ ID NO: 4085442 - RNA, 22 nt, Streptococcus pneumoniae R6
caucuuguaaccgauauuuccu

SEQ ID NO: 4085443 - RNA, 13 nt, Streptococcus pneumoniae R6
caucuuucauguu

SEQ ID NO: 4085444 - RNA, 13 nt, Streptococcus pneumoniae R6
caucuuuggucaa

SEQ ID NO: 4085445 - RNA, 17 nt, Streptococcus pneumoniae R6
caucuuuguaaguuucu

SEQ ID NO: 4085446 - RNA, 17 nt, Streptococcus pneumoniae R6
caucuuuugauagauga

SEQ ID NO: 4085447 - RNA, 20 nt, Streptococcus pneumoniae R6
caucuuuugauagaugacuu

SEQ ID NO: 4085448 - RNA, 17 nt, Streptococcus pneumoniae R6
caugaaaaaugcaugag

SEQ ID NO: 4085449 - RNA, 23 nt, Streptococcus pneumoniae R6
caugaaagaugaagcaaucaaug

SEQ ID NO: 4085450 - RNA, 17 nt, Streptococcus pneumoniae R6
caugaauauuccuauga

SEQ ID NO: 4085451 - RNA, 17 nt, Streptococcus pneumoniae R6
caugacaaauucuccac

SEQ ID NO: 4085452 - RNA, 16 nt, Streptococcus pneumoniae R6
caugacaaucaagacc

SEQ ID NO: 4085453 - RNA, 23 nt, Streptococcus pneumoniae R6
caugacagccucaaugauaccau

SEQ ID NO: 4085454 - RNA, 14 nt, Streptococcus pneumoniae R6
caugacaucuucca

SEQ ID NO: 4085455 - RNA, 15 nt, Streptococcus pneumoniae R6
caugacgucguaacc

SEQ ID NO: 4085456 - RNA, 12 nt, Streptococcus pneumoniae R6
caugacuaguga

SEQ ID NO: 4085457 - RNA, 19 nt, Streptococcus pneumoniae R6
caugacuccacucaacauu

SEQ ID NO: 4085458 - RNA, 20 nt, Streptococcus pneumoniae R6
caugacuucgucguaaccuu

SEQ ID NO: 4085459 - RNA, 19 nt, Streptococcus pneumoniae R6
caugagcaugaucauuugc

SEQ ID NO: 4085460 - RNA, 20 nt, Streptococcus pneumoniae R6
caugagcaugaucauuugca

SEQ ID NO: 4085461 - RNA, 16 nt, Streptococcus pneumoniae R6
caugaguuuucaaccu

SEQ ID NO: 4085462 - RNA, 12 nt, Streptococcus pneumoniae R6
caugauagaugg

SEQ ID NO: 4085463 - RNA, 19 nt, Streptococcus pneumoniae R6
caugauaucaaacuuuuua

SEQ ID NO: 4085464 - RNA, 20 nt, Streptococcus pneumoniae R6
caugauaucaaacuuuuuag

SEQ ID NO: 4085465 - RNA, 15 nt, Streptococcus pneumoniae R6
caugauuagaaauag

SEQ ID NO: 4085466 - RNA, 19 nt, Streptococcus pneumoniae R6
caugcaaaaaaaaugaaaa

SEQ ID NO: 4085467 - RNA, 20 nt, Streptococcus pneumoniae R6
caugcaaaaaaaaugaaaaa

SEQ ID NO: 4085468 - RNA, 13 nt, Streptococcus pneumoniae R6
caugccaagaaag

SEQ ID NO: 4085469 - RNA, 21 nt, Streptococcus pneumoniae R6
caugccagauggacugaccac

SEQ ID NO: 4085470 - RNA, 18 nt, Streptococcus pneumoniae R6
caugccuuuuucaaucaa

SEQ ID NO: 4085471 - RNA, 15 nt, Streptococcus pneumoniae R6
caugcgcaaaauaau

SEQ ID NO: 4085472 - RNA, 21 nt, Streptococcus pneumoniae R6
caugcgcucgcuuuucaccug

SEQ ID NO: 4085473 - RNA, 15 nt, Streptococcus pneumoniae R6
caugcguuaaaaguu

SEQ ID NO: 4085474 - RNA, 16 nt, Streptococcus pneumoniae R6
caugcguuggaacgau

SEQ ID NO: 4085475 - RNA, 18 nt, Streptococcus pneumoniae R6
caugcugacaaagagauu

SEQ ID NO: 4085476 - RNA, 19 nt, Streptococcus pneumoniae R6
caugcugaccgcaaaagcu

SEQ ID NO: 4085477 - RNA, 23 nt, Streptococcus pneumoniae R6
caugcugaccgcaaaagcuacuc

SEQ ID NO: 4085478 - RNA, 24 nt, Streptococcus pneumoniae R6
caugcugacgauguugaugauaug

SEQ ID NO: 4085479 - RNA, 19 nt, Streptococcus pneumoniae R6
caugcuggcagaaacuguc

SEQ ID NO: 4085480 - RNA, 22 nt, Streptococcus pneumoniae R6
caugcuugauucaaagucauaa

SEQ ID NO: 4085481 - RNA, 14 nt, Streptococcus pneumoniae R6
caugcuugccugaa

SEQ ID NO: 4085482 - RNA, 21 nt, Streptococcus pneumoniae R6
caugcuuuacuaguucucaaa

SEQ ID NO: 4085483 - RNA, 15 nt, Streptococcus pneumoniae R6
cauggaaccaaaguu

SEQ ID NO: 4085484 - RNA, 18 nt, Streptococcus pneumoniae R6
cauggaaccaaaguuccu

SEQ ID NO: 4085485 - RNA, 14 nt, Streptococcus pneumoniae R6
cauggacuuuuuug

SEQ ID NO: 4085486 - RNA, 13 nt, Streptococcus pneumoniae R6
cauggaucauuuc

SEQ ID NO: 4085487 - RNA, 14 nt, Streptococcus pneumoniae R6
cauggaugcaauuu

SEQ ID NO: 4085488 - RNA, 20 nt, Streptococcus pneumoniae R6
cauggauuuuauugucuuua

SEQ ID NO: 4085489 - RNA, 20 nt, Streptococcus pneumoniae R6
cauggauuuuucuuauuuuc

SEQ ID NO: 4085490 - RNA, 19 nt, Streptococcus pneumoniae R6
cauggcaacguuaaagagu

SEQ ID NO: 4085491 - RNA, 21 nt, Streptococcus pneumoniae R6
cauggcaagcaagucuagacu

SEQ ID NO: 4085492 - RNA, 21 nt, Streptococcus pneumoniae R6
cauggcacggucauuuucuuc

SEQ ID NO: 4085493 - RNA, 16 nt, Streptococcus pneumoniae R6
caugggcuucuguaau

SEQ ID NO: 4085494 - RNA, 16 nt, Streptococcus pneumoniae R6
caugguucgggauaaa

SEQ ID NO: 4085495 - RNA, 12 nt, Streptococcus pneumoniae R6
cauguagauuga

SEQ ID NO: 4085496 - RNA, 19 nt, Streptococcus pneumoniae R6
cauguauggacgaagugcu

SEQ ID NO: 4085497 - RNA, 15 nt, Streptococcus pneumoniae R6
caugucagcccuauc

SEQ ID NO: 4085498 - RNA, 14 nt, Streptococcus pneumoniae R6
caugucuuuuaaau

SEQ ID NO: 4085499 - RNA, 18 nt, Streptococcus pneumoniae R6
caugucuuuuaaauauuu

SEQ ID NO: 4085500 - RNA, 18 nt, Streptococcus pneumoniae R6
caugugcaguuuuggaau

SEQ ID NO: 4085501 - RNA, 13 nt, Streptococcus pneumoniae R6
cauuugaauagaa

SEQ ID NO: 4085502 - RNA, 20 nt, Streptococcus pneumoniae R6
cauuugacgaacaaaaagug

SEQ ID NO: 4085503 - RNA, 17 nt, Streptococcus pneumoniae R6
cauuugagcgaaaucaa

SEQ ID NO: 4085504 - RNA, 12 nt, Streptococcus pneumoniae R6
cauuugaugaga

SEQ ID NO: 4085505 - RNA, 16 nt, Streptococcus pneumoniae R6
cauuugaugagaaaau

SEQ ID NO: 4085506 - RNA, 20 nt, Streptococcus pneumoniae R6
cauuugcagacgaaauacaa

SEQ ID NO: 4085507 - RNA, 19 nt, Streptococcus pneumoniae R6
cauuugcgcgcuugaauga

SEQ ID NO: 4085508 - RNA, 19 nt, Streptococcus pneumoniae R6
cauuuggcaccgaauuuuu

SEQ ID NO: 4085509 - RNA, 22 nt, Streptococcus pneumoniae R6
cauuuggcccuaccugcuccaa

SEQ ID NO: 4085510 - RNA, 16 nt, Streptococcus pneumoniae R6
cauuuggcuauaaaaa

SEQ ID NO: 4085511 - RNA, 20 nt, Streptococcus pneumoniae R6
cauuuggcuauaaaaaacuc

SEQ ID NO: 4085512 - RNA, 19 nt, Streptococcus pneumoniae R6
cauuuggguaggucuuuuu

SEQ ID NO: 4085513 - RNA, 20 nt, Streptococcus pneumoniae R6
cauuuggguaggucuuuuug

SEQ ID NO: 4085514 - RNA, 19 nt, Streptococcus pneumoniae R6
cauuuguaaaucuucagau

SEQ ID NO: 4085515 - RNA, 23 nt, Streptococcus pneumoniae R6
cauuuguuuaguguauaugaaga

SEQ ID NO: 4085516 - RNA, 22 nt, Streptococcus pneumoniae R6
cauuuuaaaggucaauuccuca

SEQ ID NO: 4085517 - RNA, 14 nt, Streptococcus pneumoniae R6
cauuuuaauauaua

SEQ ID NO: 4085518 - RNA, 16 nt, Streptococcus pneumoniae R6
cauuuuaauauauaaa

SEQ ID NO: 4085519 - RNA, 19 nt, Streptococcus pneumoniae R6
cauuuuaauauauaaaaaa

SEQ ID NO: 4085520 - RNA, 20 nt, Streptococcus pneumoniae R6
cauuuuaauauauaaaaaau

SEQ ID NO: 4085521 - RNA, 13 nt, Streptococcus pneumoniae R6
cauuuuauuauua

SEQ ID NO: 4085522 - RNA, 22 nt, Streptococcus pneumoniae R6
cauuuuauuauuaauauauaaa

SEQ ID NO: 4085523 - RNA, 15 nt, Streptococcus pneumoniae R6
cauuuucaaagaaga

SEQ ID NO: 4085524 - RNA, 21 nt, Streptococcus pneumoniae R6
cauuuucaaugugaccaguga

SEQ ID NO: 4085525 - RNA, 15 nt, Streptococcus pneumoniae R6
cauuuucuacuaaaa

SEQ ID NO: 4085526 - RNA, 13 nt, Streptococcus pneumoniae R6
cauuuucuuaaaa

SEQ ID NO: 4085527 - RNA, 17 nt, Streptococcus pneumoniae R6
cauuuucuugauuuguu

SEQ ID NO: 4085528 - RNA, 18 nt, Streptococcus pneumoniae R6
cauuuucuuuacuucuga

SEQ ID NO: 4085529 - RNA, 12 nt, Streptococcus pneumoniae R6
cauuuucuuuua

SEQ ID NO: 4085530 - RNA, 17 nt, Streptococcus pneumoniae R6
cauuuugaccuguugau

SEQ ID NO: 4085531 - RNA, 18 nt, Streptococcus pneumoniae R6
cauuuugcgauauaguga

SEQ ID NO: 4085532 - RNA, 13 nt, Streptococcus pneumoniae R6
cauuuuguaaaaa

SEQ ID NO: 4085533 - RNA, 14 nt, Streptococcus pneumoniae R6
cauuuuguaaaaaa

SEQ ID NO: 4085534 - RNA, 13 nt, Streptococcus pneumoniae R6
cauuuugugaaaa

SEQ ID NO: 4085535 - RNA, 23 nt, Streptococcus pneumoniae R6
cauuuuguuuuugagucaagaua

SEQ ID NO: 4085536 - RNA, 14 nt, Streptococcus pneumoniae R6
cauuuuuagauuga

SEQ ID NO: 4085537 - RNA, 14 nt, Streptococcus pneumoniae R6
cauuuuucaaauca

SEQ ID NO: 4085538 - RNA, 16 nt, Streptococcus pneumoniae R6
cauuuuucaaaucaaa

SEQ ID NO: 4085539 - RNA, 17 nt, Streptococcus pneumoniae R6
cauuuuucgaaauuuau

SEQ ID NO: 4085540 - RNA, 14 nt, Streptococcus pneumoniae R6
cauuuuucugcuau

SEQ ID NO: 4085541 - RNA, 19 nt, Streptococcus pneumoniae R6
cauuuuugccuaaaauuca

SEQ ID NO: 4085542 - RNA, 12 nt, Streptococcus pneumoniae R6
cauuuuuuaaaa

SEQ ID NO: 4085543 - RNA, 18 nt, Streptococcus pneumoniae R6
cauuuuuuauugcaauuu

SEQ ID NO: 4085544 - RNA, 23 nt, Streptococcus pneumoniae R6
cauuuuuuccugaagucgaguuu

SEQ ID NO: 4085545 - RNA, 17 nt, Streptococcus pneumoniae R6
cauuuuuugcaucaacu

SEQ ID NO: 4085546 - RNA, 20 nt, Streptococcus pneumoniae R6
cauuuuuuguuaguuuaaaa

SEQ ID NO: 4085547 - RNA, 18 nt, Streptococcus pneumoniae R6
ccaaaaaaacuccaaacg

SEQ ID NO: 4085548 - RNA, 17 nt, Streptococcus pneumoniae R6
ccaaaaauucuuacuac

SEQ ID NO: 4085549 - RNA, 23 nt, Streptococcus pneumoniae R6
ccaaaacaucugguuuaauccau

SEQ ID NO: 4085550 - RNA, 17 nt, Streptococcus pneumoniae R6
ccaaaaccaaucaauuu

SEQ ID NO: 4085551 - RNA, 17 nt, Streptococcus pneumoniae R6
ccaaaacgccaucuucc

SEQ ID NO: 4085552 - RNA, 18 nt, Streptococcus pneumoniae R6
ccaaaagcagaggcaaug

SEQ ID NO: 4085553 - RNA, 21 nt, Streptococcus pneumoniae R6
ccaaaaguuagauuuuuucug

SEQ ID NO: 4085554 - RNA, 19 nt, Streptococcus pneumoniae R6
ccaaaaucaugacaaucaa

SEQ ID NO: 4085555 - RNA, 13 nt, Streptococcus pneumoniae R6
ccaaaauccuuga

SEQ ID NO: 4085556 - RNA, 16 nt, Streptococcus pneumoniae R6
ccaaaauccuugacca

SEQ ID NO: 4085557 - RNA, 19 nt, Streptococcus pneumoniae R6
ccaaacaacaauacuuucc

SEQ ID NO: 4085558 - RNA, 19 nt, Streptococcus pneumoniae R6
ccaaacacgaaaccagucc

SEQ ID NO: 4085559 - RNA, 18 nt, Streptococcus pneumoniae R6
ccaaaccaaccuucauca

SEQ ID NO: 4085560 - RNA, 16 nt, Streptococcus pneumoniae R6
ccaaacggauuuuuua

SEQ ID NO: 4085561 - RNA, 16 nt, Streptococcus pneumoniae R6
ccaaacucgaucugaa

SEQ ID NO: 4085562 - RNA, 17 nt, Streptococcus pneumoniae R6
ccaaacucgaucugaau

SEQ ID NO: 4085563 - RNA, 18 nt, Streptococcus pneumoniae R6
ccaaacucgaucugaaug

SEQ ID NO: 4085564 - RNA, 19 nt, Streptococcus pneumoniae R6
ccaaacuuaguauccuuga

SEQ ID NO: 4085565 - RNA, 22 nt, Streptococcus pneumoniae R6
ccaaagaagucaccauaaaucu

SEQ ID NO: 4085566 - RNA, 16 nt, Streptococcus pneumoniae R6
ccaaagcaucaaucaa

SEQ ID NO: 4085567 - RNA, 21 nt, Streptococcus pneumoniae R6
ccaaaggaagcugagcucuuu

SEQ ID NO: 4085568 - RNA, 19 nt, Streptococcus pneumoniae R6
ccaaaggauuuaguucugu

SEQ ID NO: 4085569 - RNA, 21 nt, Streptococcus pneumoniae R6
ccaaaguaaaauacaaaccaa

SEQ ID NO: 4085570 - RNA, 17 nt, Streptococcus pneumoniae R6
ccaaaguagcuugcucc

SEQ ID NO: 4085571 - RNA, 21 nt, Streptococcus pneumoniae R6
ccaaaguuacuugauugcaaa

SEQ ID NO: 4085572 - RNA, 21 nt, Streptococcus pneumoniae R6
ccaaaucaaugagucagggaa

SEQ ID NO: 4085573 - RNA, 11 nt, Streptococcus pneumoniae R6
ccaaaucaauu

SEQ ID NO: 4085574 - RNA, 18 nt, Streptococcus pneumoniae R6
ccaaaucagauaagcacc

SEQ ID NO: 4085575 - RNA, 18 nt, Streptococcus pneumoniae R6
ccaaauggauagaucuuu

SEQ ID NO: 4085576 - RNA, 19 nt, Streptococcus pneumoniae R6
ccaaauggauagaucuuua

SEQ ID NO: 4085577 - RNA, 22 nt, Streptococcus pneumoniae R6
ccaaauuccuggcauaagucau

SEQ ID NO: 4085578 - RNA, 17 nt, Streptococcus pneumoniae R6
ccaaauuucauauuuuc

SEQ ID NO: 4085579 - RNA, 13 nt, Streptococcus pneumoniae R6
ccaacagagaaaa

SEQ ID NO: 4085580 - RNA, 23 nt, Streptococcus pneumoniae R6
ccaacagagaaaauucuaaaggc

SEQ ID NO: 4085581 - RNA, 21 nt, Streptococcus pneumoniae R6
ccaacauuaacgaucaaucaa

SEQ ID NO: 4085582 - RNA, 13 nt, Streptococcus pneumoniae R6
ccaacgauuuuau

SEQ ID NO: 4085583 - RNA, 17 nt, Streptococcus pneumoniae R6
ccaacucaggaaagaug

SEQ ID NO: 4085584 - RNA, 13 nt, Streptococcus pneumoniae R6
ccaacucuuggaa

SEQ ID NO: 4085585 - RNA, 17 nt, Streptococcus pneumoniae R6
ccaacugcaaagauacc

SEQ ID NO: 4085586 - RNA, 14 nt, Streptococcus pneumoniae R6
ccaacuuuuccuug

SEQ ID NO: 4085587 - RNA, 15 nt, Streptococcus pneumoniae R6
ccaagaccaauccua

SEQ ID NO: 4085588 - RNA, 19 nt, Streptococcus pneumoniae R6
ccaagagacgauuccaaac

SEQ ID NO: 4085589 - RNA, 21 nt, Streptococcus pneumoniae R6
ccaagagacgauuccaaacaa

SEQ ID NO: 4085590 - RNA, 20 nt, Streptococcus pneumoniae R6
ccaagaguagagagaaagga

SEQ ID NO: 4085591 - RNA, 22 nt, Streptococcus pneumoniae R6
ccaagauagagagcuccaaaga

SEQ ID NO: 4085592 - RNA, 21 nt, Streptococcus pneumoniae R6
ccaagauauugccgauaucac

SEQ ID NO: 4085593 - RNA, 16 nt, Streptococcus pneumoniae R6
ccaagaucuuuuuaua

SEQ ID NO: 4085594 - RNA, 21 nt, Streptococcus pneumoniae R6
ccaagcccucagccaguucag

SEQ ID NO: 4085595 - RNA, 13 nt, Streptococcus pneumoniae R6
ccaagcucugaau

SEQ ID NO: 4085596 - RNA, 18 nt, Streptococcus pneumoniae R6
ccaaggaaaguucuuccc

SEQ ID NO: 4085597 - RNA, 19 nt, Streptococcus pneumoniae R6
ccaaggaaaguucuucccc

SEQ ID NO: 4085598 - RNA, 15 nt, Streptococcus pneumoniae R6
ccaaggauugguaaa

SEQ ID NO: 4085599 - RNA, 14 nt, Streptococcus pneumoniae R6
ccaaggauugucug

SEQ ID NO: 4085600 - RNA, 18 nt, Streptococcus pneumoniae R6
ccaaggucugacaggcua

SEQ ID NO: 4085601 - RNA, 20 nt, Streptococcus pneumoniae R6
ccaagguucauuucuucuau

SEQ ID NO: 4085602 - RNA, 18 nt, Streptococcus pneumoniae R6
ccaaguaaauuagggaua

SEQ ID NO: 4085603 - RNA, 17 nt, Streptococcus pneumoniae R6
ccagaucuuagaagcag

SEQ ID NO: 4085604 - RNA, 13 nt, Streptococcus pneumoniae R6
ccagauuaggaac

SEQ ID NO: 4085605 - RNA, 16 nt, Streptococcus pneumoniae R6
ccagauuaucuuccuu

SEQ ID NO: 4085606 - RNA, 16 nt, Streptococcus pneumoniae R6
ccagauuccugaaaua

SEQ ID NO: 4085607 - RNA, 17 nt, Streptococcus pneumoniae R6
ccagcaaucaaauucau

SEQ ID NO: 4085608 - RNA, 16 nt, Streptococcus pneumoniae R6
ccagcaguaucaauca

SEQ ID NO: 4085609 - RNA, 14 nt, Streptococcus pneumoniae R6
ccagcauggucagg

SEQ ID NO: 4085610 - RNA, 16 nt, Streptococcus pneumoniae R6
ccagccaaucgcuuuu

SEQ ID NO: 4085611 - RNA, 18 nt, Streptococcus pneumoniae R6
ccagcgauagcuccaucu

SEQ ID NO: 4085612 - RNA, 19 nt, Streptococcus pneumoniae R6
ccagcguccagcagcuaag

SEQ ID NO: 4085613 - RNA, 16 nt, Streptococcus pneumoniae R6
ccagcuaggagagcua

SEQ ID NO: 4085614 - RNA, 22 nt, Streptococcus pneumoniae R6
ccagcuguaucgaccucuacca

SEQ ID NO: 4085615 - RNA, 15 nt, Streptococcus pneumoniae R6
ccaggaaaccagcug

SEQ ID NO: 4085616 - RNA, 18 nt, Streptococcus pneumoniae R6
ccaggagccaagauagga

SEQ ID NO: 4085617 - RNA, 16 nt, Streptococcus pneumoniae R6
ccaggcuaauugcaaa

SEQ ID NO: 4085618 - RNA, 20 nt, Streptococcus pneumoniae R6
ccaggcucuuucaguuuauu

SEQ ID NO: 4085619 - RNA, 13 nt, Streptococcus pneumoniae R6
ccaguaccauggg

SEQ ID NO: 4085620 - RNA, 14 nt, Streptococcus pneumoniae R6
ccaguacuuucaac

SEQ ID NO: 4085621 - RNA, 17 nt, Streptococcus pneumoniae R6
ccaguacuuucaacucc

SEQ ID NO: 4085622 - RNA, 20 nt, Streptococcus pneumoniae R6
ccaguacuuucaacuccuua

SEQ ID NO: 4085623 - RNA, 14 nt, Streptococcus pneumoniae R6
ccaguagacuugac

SEQ ID NO: 4085624 - RNA, 15 nt, Streptococcus pneumoniae R6
ccaguagcgcuugau

SEQ ID NO: 4085625 - RNA, 12 nt, Streptococcus pneumoniae R6
ccaguauucuuu

SEQ ID NO: 4085626 - RNA, 15 nt, Streptococcus pneumoniae R6
ccagucaucugauug

SEQ ID NO: 4085627 - RNA, 22 nt, Streptococcus pneumoniae R6
ccaguccuuguaugacaucuug

SEQ ID NO: 4085628 - RNA, 19 nt, Streptococcus pneumoniae R6
ccagucgucaccguuuuug

SEQ ID NO: 4085629 - RNA, 12 nt, Streptococcus pneumoniae R6
ccaguuaucugc

SEQ ID NO: 4085630 - RNA, 13 nt, Streptococcus pneumoniae R6
ccaguuuggacca

SEQ ID NO: 4085631 - RNA, 21 nt, Streptococcus pneumoniae R6
ccaguuuggcgaugauuuccu

SEQ ID NO: 4085632 - RNA, 22 nt, Streptococcus pneumoniae R6
ccaguuuucuucgguuaggaug

SEQ ID NO: 4085633 - RNA, 14 nt, Streptococcus pneumoniae R6
ccaguuuuuuucag

SEQ ID NO: 4085634 - RNA, 15 nt, Streptococcus pneumoniae R6
ccauaaaaauaacuu

SEQ ID NO: 4085635 - RNA, 17 nt, Streptococcus pneumoniae R6
ccauaauaucauaauga

SEQ ID NO: 4085636 - RNA, 22 nt, Streptococcus pneumoniae R6
ccauaauaucauaaugagcucc

SEQ ID NO: 4085637 - RNA, 22 nt, Streptococcus pneumoniae R6
ccauacauugauugcaagcccu

SEQ ID NO: 4085638 - RNA, 21 nt, Streptococcus pneumoniae R6
ccauaccagucuccuagucua

SEQ ID NO: 4085639 - RNA, 13 nt, Streptococcus pneumoniae R6
ccauacgcccucc

SEQ ID NO: 4085640 - RNA, 13 nt, Streptococcus pneumoniae R6
ccauacguuucau

SEQ ID NO: 4085641 - RNA, 17 nt, Streptococcus pneumoniae R6
ccauacuuucucugacu

SEQ ID NO: 4085642 - RNA, 17 nt, Streptococcus pneumoniae R6
ccauagcgucaaagaag

SEQ ID NO: 4085643 - RNA, 20 nt, Streptococcus pneumoniae R6
ccauagcgucaaagaaggcu

SEQ ID NO: 4085644 - RNA, 18 nt, Streptococcus pneumoniae R6
ccauaggccaagucuuuu

SEQ ID NO: 4085645 - RNA, 20 nt, Streptococcus pneumoniae R6
ccauaguaaacuucuucuuc

SEQ ID NO: 4085646 - RNA, 14 nt, Streptococcus pneumoniae R6
ccauaugauucuuu

SEQ ID NO: 4085647 - RNA, 17 nt, Streptococcus pneumoniae R6
ccauauuuguugcucuu

SEQ ID NO: 4085648 - RNA, 17 nt, Streptococcus pneumoniae R6
ccaucaauacccccuua

SEQ ID NO: 4085649 - RNA, 22 nt, Streptococcus pneumoniae R6
ccaucacgauuaucuagucgaa

SEQ ID NO: 4085650 - RNA, 19 nt, Streptococcus pneumoniae R6
ccaucauccaccuugcaaa

SEQ ID NO: 4085651 - RNA, 14 nt, Streptococcus pneumoniae R6
ccauccacaaccuu

SEQ ID NO: 4085652 - RNA, 17 nt, Streptococcus pneumoniae R6
ccaucccauuuauauaa

SEQ ID NO: 4085653 - RNA, 23 nt, Streptococcus pneumoniae R6
ccauccuccaccuguaauuuggu

SEQ ID NO: 4085654 - RNA, 18 nt, Streptococcus pneumoniae R6
ccaucgcgaccaagagca

SEQ ID NO: 4085655 - RNA, 19 nt, Streptococcus pneumoniae R6
ccaucgcgaccaagagcaa

SEQ ID NO: 4085656 - RNA, 18 nt, Streptococcus pneumoniae R6
ccaucguuccguucuuau

SEQ ID NO: 4085657 - RNA, 20 nt, Streptococcus pneumoniae R6
ccaucguuccugucuuauuu

SEQ ID NO: 4085658 - RNA, 20 nt, Streptococcus pneumoniae R6
ccaucuacacccacgucaca

SEQ ID NO: 4085659 - RNA, 23 nt, Streptococcus pneumoniae R6
ccaucuacacccacgucacaaag

SEQ ID NO: 4085660 - RNA, 21 nt, Streptococcus pneumoniae R6
ccaucucacacaaucgggauc

SEQ ID NO: 4085661 - RNA, 15 nt, Streptococcus pneumoniae R6
ccaucuccaaccauc

SEQ ID NO: 4085662 - RNA, 17 nt, Streptococcus pneumoniae R6
ccaucuccgauuaccga

SEQ ID NO: 4085663 - RNA, 14 nt, Streptococcus pneumoniae R6
ccaucugcagccuc

SEQ ID NO: 4085664 - RNA, 17 nt, Streptococcus pneumoniae R6
ccaucugcagccucaaa

SEQ ID NO: 4085665 - RNA, 11 nt, Streptococcus pneumoniae R6
ccaucuguaau

SEQ ID NO: 4085666 - RNA, 21 nt, Streptococcus pneumoniae R6
ccaucuucaacuucuaucacg

SEQ ID NO: 4085667 - RNA, 16 nt, Streptococcus pneumoniae R6
ccaucuuuagcuccac

SEQ ID NO: 4085668 - RNA, 22 nt, Streptococcus pneumoniae R6
ccaucuuuugacagucuucaug

SEQ ID NO: 4085669 - RNA, 16 nt, Streptococcus pneumoniae R6
ccaugacaaucauuuc

SEQ ID NO: 4085670 - RNA, 16 nt, Streptococcus pneumoniae R6
ccaugaccgaaugaag

SEQ ID NO: 4085671 - RNA, 21 nt, Streptococcus pneumoniae R6
ccaugaccgaguugaggggca

SEQ ID NO: 4085672 - RNA, 17 nt, Streptococcus pneumoniae R6
ccaugagaauguccaua

SEQ ID NO: 4085673 - RNA, 19 nt, Streptococcus pneumoniae R6
ccaugcugaccgcaaaagc

SEQ ID NO: 4085674 - RNA, 14 nt, Streptococcus pneumoniae R6
ccaugcugacgaug

SEQ ID NO: 4085675 - RNA, 15 nt, Streptococcus pneumoniae R6
ccaugcugagacuca

SEQ ID NO: 4085676 - RNA, 15 nt, Streptococcus pneumoniae R6
ccaugcuuccagcuu

SEQ ID NO: 4085677 - RNA, 14 nt, Streptococcus pneumoniae R6
ccaugcuugauuca

SEQ ID NO: 4085678 - RNA, 18 nt, Streptococcus pneumoniae R6
ccauggcugacaacaagg

SEQ ID NO: 4085679 - RNA, 19 nt, Streptococcus pneumoniae R6
ccaugguccgggcugacaa

SEQ ID NO: 4085680 - RNA, 23 nt, Streptococcus pneumoniae R6
ccauguauggacgaagugcuucu

SEQ ID NO: 4085681 - RNA, 14 nt, Streptococcus pneumoniae R6
ccauguccuggaua

SEQ ID NO: 4085682 - RNA, 22 nt, Streptococcus pneumoniae R6
ccauguuuuucuccuauuuucu

SEQ ID NO: 4085683 - RNA, 21 nt, Streptococcus pneumoniae R6
ccauuaaucagauaaacaaug

SEQ ID NO: 4085684 - RNA, 15 nt, Streptococcus pneumoniae R6
ccauuaauucgauuu

SEQ ID NO: 4085685 - RNA, 17 nt, Streptococcus pneumoniae R6
ccauuaauucgauuucu

SEQ ID NO: 4085686 - RNA, 20 nt, Streptococcus pneumoniae R6
ccauuauagcauucuucuca

SEQ ID NO: 4085687 - RNA, 13 nt, Streptococcus pneumoniae R6
ccauuaucuagac

SEQ ID NO: 4085688 - RNA, 18 nt, Streptococcus pneumoniae R6
ccauuaugauauauagua

SEQ ID NO: 4085689 - RNA, 12 nt, Streptococcus pneumoniae R6
ccauucacaaca

SEQ ID NO: 4085690 - RNA, 22 nt, Streptococcus pneumoniae R6
ccauucgauuuaucuguuugua

SEQ ID NO: 4085691 - RNA, 17 nt, Streptococcus pneumoniae R6
ccauucuuuuacuuacg

SEQ ID NO: 4085692 - RNA, 15 nt, Streptococcus pneumoniae R6
ccauugagaaaauau

SEQ ID NO: 4085693 - RNA, 16 nt, Streptococcus pneumoniae R6
ccauugagaaaauaug

SEQ ID NO: 4085694 - RNA, 20 nt, Streptococcus pneumoniae R6
ccauugcucuauacacaucc

SEQ ID NO: 4085695 - RNA, 14 nt, Streptococcus pneumoniae R6
ccauuguauccuga

SEQ ID NO: 4085696 - RNA, 21 nt, Streptococcus pneumoniae R6
ccauuguauccugaaaagcca

SEQ ID NO: 4085697 - RNA, 22 nt, Streptococcus pneumoniae R6
ccauugucacaauuacguuuaa

SEQ ID NO: 4085698 - RNA, 16 nt, Streptococcus pneumoniae R6
ccauuucuucaguaua

SEQ ID NO: 4085699 - RNA, 14 nt, Streptococcus pneumoniae R6
ccauuugaaagaac

SEQ ID NO: 4085700 - RNA, 20 nt, Streptococcus pneumoniae R6
ccauuuggcccuaccugcuc

SEQ ID NO: 4085701 - RNA, 14 nt, Streptococcus pneumoniae R6
ccauuuguucccaa

SEQ ID NO: 4085702 - RNA, 20 nt, Streptococcus pneumoniae R6
ccauuuuaaaggucaauucc

SEQ ID NO: 4085703 - RNA, 16 nt, Streptococcus pneumoniae R6
ccauuuuuuaaaaagg

SEQ ID NO: 4085704 - RNA, 18 nt, Streptococcus pneumoniae R6
cccaaaaguuagauuuuu

SEQ ID NO: 4085705 - RNA, 12 nt, Streptococcus pneumoniae R6
cccaaaaugagg

SEQ ID NO: 4085706 - RNA, 13 nt, Streptococcus pneumoniae R6
ccuaaagaaaaag

SEQ ID NO: 4085707 - RNA, 22 nt, Streptococcus pneumoniae R6
ccuaagaauagcgauuuaauca

SEQ ID NO: 4085708 - RNA, 14 nt, Streptococcus pneumoniae R6
ccuaagacaaccaa

SEQ ID NO: 4085709 - RNA, 15 nt, Streptococcus pneumoniae R6
ccuaaggcuguuuca

SEQ ID NO: 4085710 - RNA, 18 nt, Streptococcus pneumoniae R6
ccuaaggcuguuucaaau

SEQ ID NO: 4085711 - RNA, 22 nt, Streptococcus pneumoniae R6
ccuaaggcuguuucaaaugaaa

SEQ ID NO: 4085712 - RNA, 17 nt, Streptococcus pneumoniae R6
ccuaaguauagacgaaa

SEQ ID NO: 4085713 - RNA, 19 nt, Streptococcus pneumoniae R6
ccuaauaauacaaaaaaua

SEQ ID NO: 4085714 - RNA, 19 nt, Streptococcus pneumoniae R6
ccuaaucuggagauuucuu

SEQ ID NO: 4085715 - RNA, 23 nt, Streptococcus pneumoniae R6
ccuaauuauaggacguuuucaga

SEQ ID NO: 4085716 - RNA, 21 nt, Streptococcus pneumoniae R6
ccuacaauuggaaauaacaaa

SEQ ID NO: 4085717 - RNA, 22 nt, Streptococcus pneumoniae R6
ccuacaugcuguuagaagacuu

SEQ ID NO: 4085718 - RNA, 17 nt, Streptococcus pneumoniae R6
ccuacauugacucugcu

SEQ ID NO: 4085719 - RNA, 17 nt, Streptococcus pneumoniae R6
ccuacgaacaagacuac

SEQ ID NO: 4085720 - RNA, 15 nt, Streptococcus pneumoniae R6
ccuacuguuagaaca

SEQ ID NO: 4085721 - RNA, 18 nt, Streptococcus pneumoniae R6
ccuacuucaaauccuuua

SEQ ID NO: 4085722 - RNA, 22 nt, Streptococcus pneumoniae R6
ccuacuucaaauccuuuauuuu

SEQ ID NO: 4085723 - RNA, 17 nt, Streptococcus pneumoniae R6
ccuagaauaugaacauu

SEQ ID NO: 4085724 - RNA, 16 nt, Streptococcus pneumoniae R6
ccuagauuacaaaaaa

SEQ ID NO: 4085725 - RNA, 22 nt, Streptococcus pneumoniae R6
ccuagauuacaaaaaaaacuac

SEQ ID NO: 4085726 - RNA, 16 nt, Streptococcus pneumoniae R6
ccuagccuauuuuuua

SEQ ID NO: 4085727 - RNA, 22 nt, Streptococcus pneumoniae R6
ccuagcuuucuaguuugcuuuu

SEQ ID NO: 4085728 - RNA, 14 nt, Streptococcus pneumoniae R6
ccuagcuuuuuccu

SEQ ID NO: 4085729 - RNA, 20 nt, Streptococcus pneumoniae R6
ccuagggugacaguaaaaaa

SEQ ID NO: 4085730 - RNA, 22 nt, Streptococcus pneumoniae R6
ccuagucagaauagauaacacc

SEQ ID NO: 4085731 - RNA, 11 nt, Streptococcus pneumoniae R6
ccuagucuucu

SEQ ID NO: 4085732 - RNA, 17 nt, Streptococcus pneumoniae R6
ccuaguuugaucuuugc

SEQ ID NO: 4085733 - RNA, 14 nt, Streptococcus pneumoniae R6
ccuauagaaaucug

SEQ ID NO: 4085734 - RNA, 14 nt, Streptococcus pneumoniae R6
ccuauauuucaaga

SEQ ID NO: 4085735 - RNA, 16 nt, Streptococcus pneumoniae R6
ccuaucaacuagauca

SEQ ID NO: 4085736 - RNA, 17 nt, Streptococcus pneumoniae R6
ccuaucaacuagaucaa

SEQ ID NO: 4085737 - RNA, 17 nt, Streptococcus pneumoniae R6
ccuaucaagguuuuuga

SEQ ID NO: 4085738 - RNA, 15 nt, Streptococcus pneumoniae R6
ccuauccgcaaccuc

SEQ ID NO: 4085739 - RNA, 18 nt, Streptococcus pneumoniae R6
ccuaucgauauaauuuuc

SEQ ID NO: 4085740 - RNA, 21 nt, Streptococcus pneumoniae R6
ccuaucugcuauguugcaaau

SEQ ID NO: 4085741 - RNA, 12 nt, Streptococcus pneumoniae R6
ccuaugcuuucc

SEQ ID NO: 4085742 - RNA, 17 nt, Streptococcus pneumoniae R6
ccuauuaacaauaaucu

SEQ ID NO: 4085743 - RNA, 16 nt, Streptococcus pneumoniae R6
ccuauucccugagugu

SEQ ID NO: 4085744 - RNA, 18 nt, Streptococcus pneumoniae R6
ccuauucggacuuuggcu

SEQ ID NO: 4085745 - RNA, 11 nt, Streptococcus pneumoniae R6
ccuauucugaa

SEQ ID NO: 4085746 - RNA, 13 nt, Streptococcus pneumoniae R6
ccuauuuaccaug

SEQ ID NO: 4085747 - RNA, 14 nt, Streptococcus pneumoniae R6
ccuauuuauuacuu

SEQ ID NO: 4085748 - RNA, 17 nt, Streptococcus pneumoniae R6
ccuauuuauuacuucaa

SEQ ID NO: 4085749 - RNA, 20 nt, Streptococcus pneumoniae R6
ccuauuuauuacuucaauuu

SEQ ID NO: 4085750 - RNA, 13 nt, Streptococcus pneumoniae R6
ccuauuuucuucu

SEQ ID NO: 4085751 - RNA, 22 nt, Streptococcus pneumoniae R6
ccuauuuucuucuuuauaauau

SEQ ID NO: 4085752 - RNA, 22 nt, Streptococcus pneumoniae R6
ccuauuuuuucggcucuuuguc

SEQ ID NO: 4085753 - RNA, 16 nt, Streptococcus pneumoniae R6
ccucaaaacaauguuu

SEQ ID NO: 4085754 - RNA, 14 nt, Streptococcus pneumoniae R6
ccucaaaacagugu

SEQ ID NO: 4085755 - RNA, 16 nt, Streptococcus pneumoniae R6
ccucaaaaccauguuu

SEQ ID NO: 4085756 - RNA, 19 nt, Streptococcus pneumoniae R6
ccucaauaucuucugcuug

SEQ ID NO: 4085757 - RNA, 23 nt, Streptococcus pneumoniae R6
ccucaauaugcucacugaugaaa

SEQ ID NO: 4085758 - RNA, 21 nt, Streptococcus pneumoniae R6
ccucacacggaaguauauucu

SEQ ID NO: 4085759 - RNA, 19 nt, Streptococcus pneumoniae R6
ccucacggagcgagacaaa

SEQ ID NO: 4085760 - RNA, 18 nt, Streptococcus pneumoniae R6
ccucagaguaagaaagca

SEQ ID NO: 4085761 - RNA, 23 nt, Streptococcus pneumoniae R6
ccucagaguaagaaagcagcuua

SEQ ID NO: 4085762 - RNA, 18 nt, Streptococcus pneumoniae R6
ccucagcucccgcuucau

SEQ ID NO: 4085763 - RNA, 17 nt, Streptococcus pneumoniae R6
ccucauauucaagaauc

SEQ ID NO: 4085764 - RNA, 23 nt, Streptococcus pneumoniae R6
ccucauauucaagaaucgucacg

SEQ ID NO: 4085765 - RNA, 16 nt, Streptococcus pneumoniae R6
ccucauuccccuucuu

SEQ ID NO: 4085766 - RNA, 17 nt, Streptococcus pneumoniae R6
ccucauuuucuagugaa

SEQ ID NO: 4085767 - RNA, 14 nt, Streptococcus pneumoniae R6
ccuccaguuuuguu

SEQ ID NO: 4085768 - RNA, 24 nt, Streptococcus pneumoniae R6
ccucccauuuugugaaaaacuuag

SEQ ID NO: 4085769 - RNA, 13 nt, Streptococcus pneumoniae R6
ccuccgccuccag

SEQ ID NO: 4085770 - RNA, 17 nt, Streptococcus pneumoniae R6
ccuccuaaggaguaguu

SEQ ID NO: 4085771 - RNA, 21 nt, Streptococcus pneumoniae R6
ccuccuaaggaguaguugcag

SEQ ID NO: 4085772 - RNA, 18 nt, Streptococcus pneumoniae R6
ccuccucgagcaguucca

SEQ ID NO: 4085773 - RNA, 14 nt, Streptococcus pneumoniae R6
ccuccuucuccaau

SEQ ID NO: 4085774 - RNA, 22 nt, Streptococcus pneumoniae R6
ccucgagcaguuccaucaaucu

SEQ ID NO: 4085775 - RNA, 21 nt, Streptococcus pneumoniae R6
ccucgauaccuguuaagccua

SEQ ID NO: 4085776 - RNA, 23 nt, Streptococcus pneumoniae R6
ccucgauggcuccguagauagcu

SEQ ID NO: 4085777 - RNA, 21 nt, Streptococcus pneumoniae R6
ccucggcuguuuuuucuuauc

SEQ ID NO: 4085778 - RNA, 13 nt, Streptococcus pneumoniae R6
ccucuacaauaac

SEQ ID NO: 4085779 - RNA, 18 nt, Streptococcus pneumoniae R6
ccucuacaccauaaauau

SEQ ID NO: 4085780 - RNA, 23 nt, Streptococcus pneumoniae R6
ccucuacaccauaaauauuugcu

SEQ ID NO: 4085781 - RNA, 15 nt, Streptococcus pneumoniae R6
ccucuaccaagcccu

SEQ ID NO: 4085782 - RNA, 23 nt, Streptococcus pneumoniae R6
ccucuaccaagcccucagccagu

SEQ ID NO: 4085783 - RNA, 18 nt, Streptococcus pneumoniae R6
ccucuaccugccuuccaa

SEQ ID NO: 4085784 - RNA, 13 nt, Streptococcus pneumoniae R6
ccucucuccuccc

SEQ ID NO: 4085785 - RNA, 18 nt, Streptococcus pneumoniae R6
ccucugaguauuuagcaa

SEQ ID NO: 4085786 - RNA, 17 nt, Streptococcus pneumoniae R6
ccucuucaauuuguuuu

SEQ ID NO: 4085787 - RNA, 15 nt, Streptococcus pneumoniae R6
ccucuugaguaauuc

SEQ ID NO: 4085788 - RNA, 19 nt, Streptococcus pneumoniae R6
ccucuugaguaauucucca

SEQ ID NO: 4085789 - RNA, 22 nt, Streptococcus pneumoniae R6
ccucuuuacaugcgcaaaauaa

SEQ ID NO: 4085790 - RNA, 23 nt, Streptococcus pneumoniae R6
ccucuuuuuauucuuuuucaaag

SEQ ID NO: 4085791 - RNA, 15 nt, Streptococcus pneumoniae R6
ccucuuuuuccccag

SEQ ID NO: 4085792 - RNA, 13 nt, Streptococcus pneumoniae R6
ccucuuuuuguau

SEQ ID NO: 4085793 - RNA, 13 nt, Streptococcus pneumoniae R6
ccugaaaaaauaa

SEQ ID NO: 4085794 - RNA, 16 nt, Streptococcus pneumoniae R6
ccugaaauaaaaugcu

SEQ ID NO: 4085795 - RNA, 10 nt, Streptococcus pneumoniae R6
ccugaagaau

SEQ ID NO: 4085796 - RNA, 20 nt, Streptococcus pneumoniae R6
ccugaaucuccucaggaacu

SEQ ID NO: 4085797 - RNA, 21 nt, Streptococcus pneumoniae R6
ccugaaucuccucaggaacuu

SEQ ID NO: 4085798 - RNA, 19 nt, Streptococcus pneumoniae R6
ccugaaugauuucuucuug

SEQ ID NO: 4085799 - RNA, 20 nt, Streptococcus pneumoniae R6
ccugaaugauuucuucuugg

SEQ ID NO: 4085800 - RNA, 18 nt, Streptococcus pneumoniae R6
ccugacaauuuaaccaaa

SEQ ID NO: 4085801 - RNA, 23 nt, Streptococcus pneumoniae R6
ccugacaauuuaaccaaaccaac

SEQ ID NO: 4085802 - RNA, 19 nt, Streptococcus pneumoniae R6
ccugagaagacaucuucuc

SEQ ID NO: 4085803 - RNA, 15 nt, Streptococcus pneumoniae R6
ccugagccaucuuga

SEQ ID NO: 4085804 - RNA, 17 nt, Streptococcus pneumoniae R6
ccugauaacgaagagcu

SEQ ID NO: 4085805 - RNA, 20 nt, Streptococcus pneumoniae R6
ccugauaacgaagagcuggc

SEQ ID NO: 4085806 - RNA, 21 nt, Streptococcus pneumoniae R6
ccugauaagauuuuuggaaaa

SEQ ID NO: 4085807 - RNA, 15 nt, Streptococcus pneumoniae R6
ccugauagaguuguu

SEQ ID NO: 4085808 - RNA, 18 nt, Streptococcus pneumoniae R6
ccuuuucuauaggauuua

SEQ ID NO: 4085809 - RNA, 21 nt, Streptococcus pneumoniae R6
ccuuuuuaaauccgauaauau

SEQ ID NO: 4085810 - RNA, 14 nt, Streptococcus pneumoniae R6
ccuuuuucacuaga

SEQ ID NO: 4085811 - RNA, 14 nt, Streptococcus pneumoniae R6
ccuuuuugcagaag

SEQ ID NO: 4085812 - RNA, 18 nt, Streptococcus pneumoniae R6
ccuuuuugcccuuuuuga

SEQ ID NO: 4085813 - RNA, 21 nt, Streptococcus pneumoniae R6
ccuuuuuucuuuacucuuugg

SEQ ID NO: 4085814 - RNA, 13 nt, Streptococcus pneumoniae R6
cgaaaaguauuaa

SEQ ID NO: 4085815 - RNA, 15 nt, Streptococcus pneumoniae R6
cgaaaagucaucuau

SEQ ID NO: 4085816 - RNA, 15 nt, Streptococcus pneumoniae R6
cgaaaaucacuccag

SEQ ID NO: 4085817 - RNA, 21 nt, Streptococcus pneumoniae R6
cgaaacaauugcuaaaacauu

SEQ ID NO: 4085818 - RNA, 18 nt, Streptococcus pneumoniae R6
cgaaacgaagaaggaaga

SEQ ID NO: 4085819 - RNA, 18 nt, Streptococcus pneumoniae R6
cgaaaggagaaaaaauau

SEQ ID NO: 4085820 - RNA, 13 nt, Streptococcus pneumoniae R6
cgaaauucguacu

SEQ ID NO: 4085821 - RNA, 17 nt, Streptococcus pneumoniae R6
cgaaauucguacucucu

SEQ ID NO: 4085822 - RNA, 20 nt, Streptococcus pneumoniae R6
cgaaauuggauauugaguaa

SEQ ID NO: 4085823 - RNA, 20 nt, Streptococcus pneumoniae R6
cgaaauuuauaauauaaacu

SEQ ID NO: 4085824 - RNA, 12 nt, Streptococcus pneumoniae R6
cgaacaaaucaa

SEQ ID NO: 4085825 - RNA, 16 nt, Streptococcus pneumoniae R6
cgaacgccuuaaaaaa

SEQ ID NO: 4085826 - RNA, 20 nt, Streptococcus pneumoniae R6
cgaacgccuuaaaaaaccaa

SEQ ID NO: 4085827 - RNA, 17 nt, Streptococcus pneumoniae R6
cgaacuuuggaagaugu

SEQ ID NO: 4085828 - RNA, 14 nt, Streptococcus pneumoniae R6
cgaagacggggcug

SEQ ID NO: 4085829 - RNA, 12 nt, Streptococcus pneumoniae R6
cgaagagcuggc

SEQ ID NO: 4085830 - RNA, 21 nt, Streptococcus pneumoniae R6
cgaagaguauaaaaacucucu

SEQ ID NO: 4085831 - RNA, 19 nt, Streptococcus pneumoniae R6
cgaagaguauaagucucua

SEQ ID NO: 4085832 - RNA, 19 nt, Streptococcus pneumoniae R6
cgaagaguucaauagcucu

SEQ ID NO: 4085833 - RNA, 22 nt, Streptococcus pneumoniae R6
cgaagauuuaguucuguauugc

SEQ ID NO: 4085834 - RNA, 20 nt, Streptococcus pneumoniae R6
cgaagcguuuacgaugauuu

SEQ ID NO: 4085835 - RNA, 11 nt, Streptococcus pneumoniae R6
cgaagcuucca

SEQ ID NO: 4085836 - RNA, 13 nt, Streptococcus pneumoniae R6
cgaagcuuccaau

SEQ ID NO: 4085837 - RNA, 15 nt, Streptococcus pneumoniae R6
cgaagcuuccaauaa

SEQ ID NO: 4085838 - RNA, 20 nt, Streptococcus pneumoniae R6
cgaagcuugcuuccaaaaau

SEQ ID NO: 4085839 - RNA, 15 nt, Streptococcus pneumoniae R6
cgaaggacaucuucu

SEQ ID NO: 4085840 - RNA, 16 nt, Streptococcus pneumoniae R6
cgaagguuauaccaaa

SEQ ID NO: 4085841 - RNA, 21 nt, Streptococcus pneumoniae R6
cgaagucagcucaaaacaugg

SEQ ID NO: 4085842 - RNA, 18 nt, Streptococcus pneumoniae R6
cgaaguuguguuugacca

SEQ ID NO: 4085843 - RNA, 17 nt, Streptococcus pneumoniae R6
cgaaguuguucuugaag

SEQ ID NO: 4085844 - RNA, 13 nt, Streptococcus pneumoniae R6
cgaauaccauaca

SEQ ID NO: 4085845 - RNA, 16 nt, Streptococcus pneumoniae R6
cgaauagaguucuaaa

SEQ ID NO: 4085846 - RNA, 12 nt, Streptococcus pneumoniae R6
cgaauaguauaa

SEQ ID NO: 4085847 - RNA, 17 nt, Streptococcus pneumoniae R6
cgaaucaauuucuucac

SEQ ID NO: 4085848 - RNA, 14 nt, Streptococcus pneumoniae R6
cgaaucucuuucca

SEQ ID NO: 4085849 - RNA, 15 nt, Streptococcus pneumoniae R6
cgaaucucuuuccac

SEQ ID NO: 4085850 - RNA, 20 nt, Streptococcus pneumoniae R6
cgaaucucuuuccacacuug

SEQ ID NO: 4085851 - RNA, 21 nt, Streptococcus pneumoniae R6
cgaaugauauuuucaaaaaaa

SEQ ID NO: 4085852 - RNA, 22 nt, Streptococcus pneumoniae R6
cgaaugauauuuucaaaaaaau

SEQ ID NO: 4085853 - RNA, 15 nt, Streptococcus pneumoniae R6
cgaauuauuuccuug

SEQ ID NO: 4085854 - RNA, 14 nt, Streptococcus pneumoniae R6
cgaauuucuuguuc

SEQ ID NO: 4085855 - RNA, 23 nt, Streptococcus pneumoniae R6
cgaauuuuuuggcuaaaaagcua

SEQ ID NO: 4085856 - RNA, 16 nt, Streptococcus pneumoniae R6
cgacaaacauugacuu

SEQ ID NO: 4085857 - RNA, 17 nt, Streptococcus pneumoniae R6
cgacaagauacccacaa

SEQ ID NO: 4085858 - RNA, 19 nt, Streptococcus pneumoniae R6
cgacaagauacccacaaaa

SEQ ID NO: 4085859 - RNA, 19 nt, Streptococcus pneumoniae R6
cgacaauacaguagaugau

SEQ ID NO: 4085860 - RNA, 14 nt, Streptococcus pneumoniae R6
cgacaauauguauc

SEQ ID NO: 4085861 - RNA, 19 nt, Streptococcus pneumoniae R6
cgacacuagaugcaucugc

SEQ ID NO: 4085862 - RNA, 23 nt, Streptococcus pneumoniae R6
cgacaucauccguacucaugaca

SEQ ID NO: 4085863 - RNA, 15 nt, Streptococcus pneumoniae R6
cgacauccuauuuau

SEQ ID NO: 4085864 - RNA, 18 nt, Streptococcus pneumoniae R6
cgacauuaccucuuuuua

SEQ ID NO: 4085865 - RNA, 17 nt, Streptococcus pneumoniae R6
cgaccaagagcaaaaac

SEQ ID NO: 4085866 - RNA, 11 nt, Streptococcus pneumoniae R6
cgaccaucuug

SEQ ID NO: 4085867 - RNA, 12 nt, Streptococcus pneumoniae R6
cgaccucagacu

SEQ ID NO: 4085868 - RNA, 20 nt, Streptococcus pneumoniae R6
cgacgauaaggacgguagca

SEQ ID NO: 4085869 - RNA, 13 nt, Streptococcus pneumoniae R6
cgacgaucaugag

SEQ ID NO: 4085870 - RNA, 18 nt, Streptococcus pneumoniae R6
cgacguuuucuccuuuga

SEQ ID NO: 4085871 - RNA, 14 nt, Streptococcus pneumoniae R6
cgacuaauuuggaa

SEQ ID NO: 4085872 - RNA, 14 nt, Streptococcus pneumoniae R6
cgacuacuaaaaca

SEQ ID NO: 4085873 - RNA, 18 nt, Streptococcus pneumoniae R6
cgacucugaagucacuac

SEQ ID NO: 4085874 - RNA, 14 nt, Streptococcus pneumoniae R6
cgacugguaaagaa

SEQ ID NO: 4085875 - RNA, 13 nt, Streptococcus pneumoniae R6
cgacuucaauaaa

SEQ ID NO: 4085876 - RNA, 18 nt, Streptococcus pneumoniae R6
cgacuucugagcuacuau

SEQ ID NO: 4085877 - RNA, 22 nt, Streptococcus pneumoniae R6
cgacuugguaguugagcuggcu

SEQ ID NO: 4085878 - RNA, 18 nt, Streptococcus pneumoniae R6
cgagaaacaauaaaauca

SEQ ID NO: 4085879 - RNA, 16 nt, Streptococcus pneumoniae R6
cgagaaaggacaaauu

SEQ ID NO: 4085880 - RNA, 19 nt, Streptococcus pneumoniae R6
cgagaaaggcgacaucauc

SEQ ID NO: 4085881 - RNA, 20 nt, Streptococcus pneumoniae R6
cgagaaguaccgccaaaccu

SEQ ID NO: 4085882 - RNA, 14 nt, Streptococcus pneumoniae R6
cgagacaaaaaaaa

SEQ ID NO: 4085883 - RNA, 19 nt, Streptococcus pneumoniae R6
cgagacaacgcacaccaga

SEQ ID NO: 4085884 - RNA, 14 nt, Streptococcus pneumoniae R6
cgagagcugauaag

SEQ ID NO: 4085885 - RNA, 22 nt, Streptococcus pneumoniae R6
cgagcaagaauucaauugcagg

SEQ ID NO: 4085886 - RNA, 14 nt, Streptococcus pneumoniae R6
cgagccucuuuuuu

SEQ ID NO: 4085887 - RNA, 15 nt, Streptococcus pneumoniae R6
cgagccucuuuuuug

SEQ ID NO: 4085888 - RNA, 23 nt, Streptococcus pneumoniae R6
cgagcuaauuuuuugagcaauaa

SEQ ID NO: 4085889 - RNA, 13 nt, Streptococcus pneumoniae R6
cgagcucaaauca

SEQ ID NO: 4085890 - RNA, 15 nt, Streptococcus pneumoniae R6
cgagcucaaaucagc

SEQ ID NO: 4085891 - RNA, 23 nt, Streptococcus pneumoniae R6
cgagguauuucuuguuuucuaaa

SEQ ID NO: 4085892 - RNA, 17 nt, Streptococcus pneumoniae R6
cgagucaaaauucuuug

SEQ ID NO: 4085893 - RNA, 14 nt, Streptococcus pneumoniae R6
cgagugacuuuuuc

SEQ ID NO: 4085894 - RNA, 23 nt, Streptococcus pneumoniae R6
cgagugcaagagcgucaucugau

SEQ ID NO: 4085895 - RNA, 22 nt, Streptococcus pneumoniae R6
cgaguguauuguacuuuccaau

SEQ ID NO: 4085896 - RNA, 17 nt, Streptococcus pneumoniae R6
cgaguuauuaacaaaag

SEQ ID NO: 4085897 - RNA, 10 nt, Streptococcus pneumoniae R6
cgaguucaug

SEQ ID NO: 4085898 - RNA, 15 nt, Streptococcus pneumoniae R6
cgaguuucugggucu

SEQ ID NO: 4085899 - RNA, 13 nt, Streptococcus pneumoniae R6
cgauaaaaauccu

SEQ ID NO: 4085900 - RNA, 22 nt, Streptococcus pneumoniae R6
cgauaaacaagggcaaaaaaga

SEQ ID NO: 4085901 - RNA, 17 nt, Streptococcus pneumoniae R6
cgauaaggcgaugcuga

SEQ ID NO: 4085902 - RNA, 16 nt, Streptococcus pneumoniae R6
cgauaccuucagccac

SEQ ID NO: 4085903 - RNA, 17 nt, Streptococcus pneumoniae R6
cgauacuguaguuuuuc

SEQ ID NO: 4085904 - RNA, 18 nt, Streptococcus pneumoniae R6
cgauagcuccaucuccaa

SEQ ID NO: 4085905 - RNA, 18 nt, Streptococcus pneumoniae R6
cgauaucguuauuagcau

SEQ ID NO: 4085906 - RNA, 21 nt, Streptococcus pneumoniae R6
cgauauggccugcuaggcuga

SEQ ID NO: 4085907 - RNA, 16 nt, Streptococcus pneumoniae R6
cgauauucuuuucaaa

SEQ ID NO: 4085908 - RNA, 19 nt, Streptococcus pneumoniae R6
cgaucauccauucuuuuuu

SEQ ID NO: 4085909 - RNA, 13 nt, Streptococcus pneumoniae R6
cgaucucaucuuc

SEQ ID NO: 4085910 - RNA, 15 nt, Streptococcus pneumoniae R6
cgaucugaaauaaag

SEQ ID NO: 4085911 - RNA, 22 nt, Streptococcus pneumoniae R6
cgguaaccgaugacaaaaauag

SEQ ID NO: 4085912 - RNA, 17 nt, Streptococcus pneumoniae R6
cgguauuuaagauaacg

SEQ ID NO: 4085913 - RNA, 12 nt, Streptococcus pneumoniae R6
cgguauuuucau

SEQ ID NO: 4085914 - RNA, 12 nt, Streptococcus pneumoniae R6
cggucaucauca

SEQ ID NO: 4085915 - RNA, 14 nt, Streptococcus pneumoniae R6
cgguuaauuuaaag

SEQ ID NO: 4085916 - RNA, 15 nt, Streptococcus pneumoniae R6
cgguuaauuuaaaga

SEQ ID NO: 4085917 - RNA, 19 nt, Streptococcus pneumoniae R6
cgguuuaucucccauacca

SEQ ID NO: 4085918 - RNA, 16 nt, Streptococcus pneumoniae R6
cgguuuggcguuagaa

SEQ ID NO: 4085919 - RNA, 17 nt, Streptococcus pneumoniae R6
cguaaaacgauaaauuc

SEQ ID NO: 4085920 - RNA, 21 nt, Streptococcus pneumoniae R6
cguaaaccuucaagaccuucu

SEQ ID NO: 4085921 - RNA, 17 nt, Streptococcus pneumoniae R6
cguaacauauuuucaaa

SEQ ID NO: 4085922 - RNA, 18 nt, Streptococcus pneumoniae R6
cguaagaggguaauccuu

SEQ ID NO: 4085923 - RNA, 23 nt, Streptococcus pneumoniae R6
cguaagauagggcugaaggaaug

SEQ ID NO: 4085924 - RNA, 15 nt, Streptococcus pneumoniae R6
cguaaucauaagcaa

SEQ ID NO: 4085925 - RNA, 17 nt, Streptococcus pneumoniae R6
cguacaacagcuacacc

SEQ ID NO: 4085926 - RNA, 16 nt, Streptococcus pneumoniae R6
cguacacucaaaucaa

SEQ ID NO: 4085927 - RNA, 16 nt, Streptococcus pneumoniae R6
cguacaugagaauggc

SEQ ID NO: 4085928 - RNA, 17 nt, Streptococcus pneumoniae R6
cguacgcuccugaauua

SEQ ID NO: 4085929 - RNA, 16 nt, Streptococcus pneumoniae R6
cguacuguuauagauu

SEQ ID NO: 4085930 - RNA, 16 nt, Streptococcus pneumoniae R6
cguacuuaccaaggcu

SEQ ID NO: 4085931 - RNA, 23 nt, Streptococcus pneumoniae R6
cguagauagcugcagcugaggaa

SEQ ID NO: 4085932 - RNA, 14 nt, Streptococcus pneumoniae R6
cguagaucaucugc

SEQ ID NO: 4085933 - RNA, 15 nt, Streptococcus pneumoniae R6
cguagcugagggcua

SEQ ID NO: 4085934 - RNA, 18 nt, Streptococcus pneumoniae R6
cguaguugguuaccucau

SEQ ID NO: 4085935 - RNA, 22 nt, Streptococcus pneumoniae R6
cguaucuuugauacaaagcucu

SEQ ID NO: 4085936 - RNA, 20 nt, Streptococcus pneumoniae R6
cguaugguucuggagaagca

SEQ ID NO: 4085937 - RNA, 13 nt, Streptococcus pneumoniae R6
cgucaaagaaggc

SEQ ID NO: 4085938 - RNA, 18 nt, Streptococcus pneumoniae R6
cgucaaauccauaguaaa

SEQ ID NO: 4085939 - RNA, 21 nt, Streptococcus pneumoniae R6
cgucaagaacuuuaguuugag

SEQ ID NO: 4085940 - RNA, 17 nt, Streptococcus pneumoniae R6
cgucagcuuccaucugc

SEQ ID NO: 4085941 - RNA, 19 nt, Streptococcus pneumoniae R6
cgucagcuuccaucugcag

SEQ ID NO: 4085942 - RNA, 16 nt, Streptococcus pneumoniae R6
cgucagcuuuaucugc

SEQ ID NO: 4085943 - RNA, 22 nt, Streptococcus pneumoniae R6
cgucaguuccaucuacaaccuu

SEQ ID NO: 4085944 - RNA, 20 nt, Streptococcus pneumoniae R6
cgucaguucuaucugcaacc

SEQ ID NO: 4085945 - RNA, 16 nt, Streptococcus pneumoniae R6
cgucaguuucaucuac

SEQ ID NO: 4085946 - RNA, 23 nt, Streptococcus pneumoniae R6
cgucauuuaaagauguccuuuua

SEQ ID NO: 4085947 - RNA, 13 nt, Streptococcus pneumoniae R6
cguccaccacaaa

SEQ ID NO: 4085948 - RNA, 13 nt, Streptococcus pneumoniae R6
cguccagccuugu

SEQ ID NO: 4085949 - RNA, 14 nt, Streptococcus pneumoniae R6
cguccagccuuguc

SEQ ID NO: 4085950 - RNA, 21 nt, Streptococcus pneumoniae R6
cguccgacauagaugaugguu

SEQ ID NO: 4085951 - RNA, 20 nt, Streptococcus pneumoniae R6
cguccuuggaagauuucagu

SEQ ID NO: 4085952 - RNA, 14 nt, Streptococcus pneumoniae R6
cguccuuucuuuuu

SEQ ID NO: 4085953 - RNA, 22 nt, Streptococcus pneumoniae R6
cgucuaaacuguacaagaacaa

SEQ ID NO: 4085954 - RNA, 15 nt, Streptococcus pneumoniae R6
cgucucaaacagugc

SEQ ID NO: 4085955 - RNA, 16 nt, Streptococcus pneumoniae R6
cgucugaaggaacuaa

SEQ ID NO: 4085956 - RNA, 16 nt, Streptococcus pneumoniae R6
cgucugaguuuuuaug

SEQ ID NO: 4085957 - RNA, 19 nt, Streptococcus pneumoniae R6
cgucuggauugaccaagcu

SEQ ID NO: 4085958 - RNA, 21 nt, Streptococcus pneumoniae R6
cgucuuuagagagaugaauag

SEQ ID NO: 4085959 - RNA, 15 nt, Streptococcus pneumoniae R6
cgugaagaaaucauc

SEQ ID NO: 4085960 - RNA, 17 nt, Streptococcus pneumoniae R6
cgugaagaaaucaucca

SEQ ID NO: 4085961 - RNA, 17 nt, Streptococcus pneumoniae R6
cgugaguuccuguuuca

SEQ ID NO: 4085962 - RNA, 15 nt, Streptococcus pneumoniae R6
cgugauuguuuuuaa

SEQ ID NO: 4085963 - RNA, 19 nt, Streptococcus pneumoniae R6
cgugauuuccaaucuucuc

SEQ ID NO: 4085964 - RNA, 23 nt, Streptococcus pneumoniae R6
cgugauuugaauauccccugaau

SEQ ID NO: 4085965 - RNA, 23 nt, Streptococcus pneumoniae R6
cgugcucuaaaaucaucgccaaa

SEQ ID NO: 4085966 - RNA, 13 nt, Streptococcus pneumoniae R6
cgugggucaucaa

SEQ ID NO: 4085967 - RNA, 24 nt, Streptococcus pneumoniae R6
cguggguguagauggaaguaguga

SEQ ID NO: 4085968 - RNA, 16 nt, Streptococcus pneumoniae R6
cgugguuuaaaaagag

SEQ ID NO: 4085969 - RNA, 16 nt, Streptococcus pneumoniae R6
cgugguuugcagagau

SEQ ID NO: 4085970 - RNA, 14 nt, Streptococcus pneumoniae R6
cguguaguucuuua

SEQ ID NO: 4085971 - RNA, 22 nt, Streptococcus pneumoniae R6
cguguaugugcauaguauuugu

SEQ ID NO: 4085972 - RNA, 22 nt, Streptococcus pneumoniae R6
cgugugagacggccuacaugcu

SEQ ID NO: 4085973 - RNA, 14 nt, Streptococcus pneumoniae R6
cgugugauaucaau

SEQ ID NO: 4085974 - RNA, 20 nt, Streptococcus pneumoniae R6
cguguggguucauccagcag

SEQ ID NO: 4085975 - RNA, 15 nt, Streptococcus pneumoniae R6
cguguuuuuucacau

SEQ ID NO: 4085976 - RNA, 17 nt, Streptococcus pneumoniae R6
cguuagcacaccaaaca

SEQ ID NO: 4085977 - RNA, 13 nt, Streptococcus pneumoniae R6
cguuaucauucca

SEQ ID NO: 4085978 - RNA, 20 nt, Streptococcus pneumoniae R6
cguuauuugaaaaauauaca

SEQ ID NO: 4085979 - RNA, 12 nt, Streptococcus pneumoniae R6
cguucaggacag

SEQ ID NO: 4085980 - RNA, 12 nt, Streptococcus pneumoniae R6
cguucauauccg

SEQ ID NO: 4085981 - RNA, 16 nt, Streptococcus pneumoniae R6
cguucauccauaucuu

SEQ ID NO: 4085982 - RNA, 22 nt, Streptococcus pneumoniae R6
cguuccaaagguccagaagccu

SEQ ID NO: 4085983 - RNA, 24 nt, Streptococcus pneumoniae R6
cguuccaaccgaacguacgagaua

SEQ ID NO: 4085984 - RNA, 16 nt, Streptococcus pneumoniae R6
cguuccaagauuggau

SEQ ID NO: 4085985 - RNA, 19 nt, Streptococcus pneumoniae R6
cguuccaaguggcauugcu

SEQ ID NO: 4085986 - RNA, 15 nt, Streptococcus pneumoniae R6
cguucccccuuuuuu

SEQ ID NO: 4085987 - RNA, 22 nt, Streptococcus pneumoniae R6
cguuccugucuuauuucauuug

SEQ ID NO: 4085988 - RNA, 12 nt, Streptococcus pneumoniae R6
cguuccuuuucc

SEQ ID NO: 4085989 - RNA, 17 nt, Streptococcus pneumoniae R6
cguucggcuucaucugg

SEQ ID NO: 4085990 - RNA, 15 nt, Streptococcus pneumoniae R6
cguucucugagaccu

SEQ ID NO: 4085991 - RNA, 12 nt, Streptococcus pneumoniae R6
cguucucuuauu

SEQ ID NO: 4085992 - RNA, 16 nt, Streptococcus pneumoniae R6
cguucugucaaaccau

SEQ ID NO: 4085993 - RNA, 13 nt, Streptococcus pneumoniae R6
cguucuucaacau

SEQ ID NO: 4085994 - RNA, 15 nt, Streptococcus pneumoniae R6
cguucuucugcaguu

SEQ ID NO: 4085995 - RNA, 19 nt, Streptococcus pneumoniae R6
cguugaaaaagugagauau

SEQ ID NO: 4085996 - RNA, 16 nt, Streptococcus pneumoniae R6
cguugaaucuauaaca

SEQ ID NO: 4085997 - RNA, 13 nt, Streptococcus pneumoniae R6
cguugacaaucuu

SEQ ID NO: 4085998 - RNA, 18 nt, Streptococcus pneumoniae R6
cguugacgauuuuuucuu

SEQ ID NO: 4085999 - RNA, 22 nt, Streptococcus pneumoniae R6
cguugacuguuucgucuuccau

SEQ ID NO: 4086000 - RNA, 13 nt, Streptococcus pneumoniae R6
cguugaggacagg

SEQ ID NO: 4086001 - RNA, 14 nt, Streptococcus pneumoniae R6
cguugaguuuuuua

SEQ ID NO: 4086002 - RNA, 10 nt, Streptococcus pneumoniae R6
cguugcuuga

SEQ ID NO: 4086003 - RNA, 19 nt, Streptococcus pneumoniae R6
cguuggaauaaggcagcuu

SEQ ID NO: 4086004 - RNA, 16 nt, Streptococcus pneumoniae R6
cguuggcuaaagauaa

SEQ ID NO: 4086005 - RNA, 17 nt, Streptococcus pneumoniae R6
cguugguaaaagcgcac

SEQ ID NO: 4086006 - RNA, 13 nt, Streptococcus pneumoniae R6
cguugucaaguuu

SEQ ID NO: 4086007 - RNA, 14 nt, Streptococcus pneumoniae R6
cguugucguaccau

SEQ ID NO: 4086008 - RNA, 12 nt, Streptococcus pneumoniae R6
cguuuauauagu

SEQ ID NO: 4086009 - RNA, 13 nt, Streptococcus pneumoniae R6
cguuuaucaauaa

SEQ ID NO: 4086010 - RNA, 19 nt, Streptococcus pneumoniae R6
cguuucagcauauuuccca

SEQ ID NO: 4086011 - RNA, 19 nt, Streptococcus pneumoniae R6
cguuuccuuccaugauaga

SEQ ID NO: 4086012 - RNA, 14 nt, Streptococcus pneumoniae R6
cguuugguuuaucu

SEQ ID NO: 4086013 - RNA, 10 nt, Streptococcus pneumoniae R6
cguuuuauag

SEQ ID NO: 4086014 - RNA, 24 nt, Streptococcus pneumoniae R6
cuaaugaguuguuuugucgcuuuu

SEQ ID NO: 4086015 - RNA, 14 nt, Streptococcus pneumoniae R6
cuaauguaauucuc

SEQ ID NO: 4086016 - RNA, 17 nt, Streptococcus pneumoniae R6
cuaauguacagaagacu

SEQ ID NO: 4086017 - RNA, 21 nt, Streptococcus pneumoniae R6
cuaaugucucugcuauuucua

SEQ ID NO: 4086018 - RNA, 14 nt, Streptococcus pneumoniae R6
cuaauuaauuaacu

SEQ ID NO: 4086019 - RNA, 16 nt, Streptococcus pneumoniae R6
cuaauucccauaaaaa

SEQ ID NO: 4086020 - RNA, 16 nt, Streptococcus pneumoniae R6
cuaauucuuugacaag

SEQ ID NO: 4086021 - RNA, 13 nt, Streptococcus pneumoniae R6
cuaauucuuuucg

SEQ ID NO: 4086022 - RNA, 22 nt, Streptococcus pneumoniae R6
cuaauugaaaacgguaacaaaa

SEQ ID NO: 4086023 - RNA, 16 nt, Streptococcus pneumoniae R6
cuaauuguaaacugug

SEQ ID NO: 4086024 - RNA, 20 nt, Streptococcus pneumoniae R6
cuaauuuagaaauagauucu

SEQ ID NO: 4086025 - RNA, 20 nt, Streptococcus pneumoniae R6
cuaauuucaaaggcuuuuuc

SEQ ID NO: 4086026 - RNA, 13 nt, Streptococcus pneumoniae R6
cuaauuuggaaau

SEQ ID NO: 4086027 - RNA, 13 nt, Streptococcus pneumoniae R6
cuaauuuugccag

SEQ ID NO: 4086028 - RNA, 22 nt, Streptococcus pneumoniae R6
cuaauuuuuugagcaauaauaa

SEQ ID NO: 4086029 - RNA, 14 nt, Streptococcus pneumoniae R6
cuacaaauaagaaa

SEQ ID NO: 4086030 - RNA, 21 nt, Streptococcus pneumoniae R6
cuacaaaucccaugacaauca

SEQ ID NO: 4086031 - RNA, 16 nt, Streptococcus pneumoniae R6
cuacaacauaaguugu

SEQ ID NO: 4086032 - RNA, 20 nt, Streptococcus pneumoniae R6
cuacaacauagacuuuacaa

SEQ ID NO: 4086033 - RNA, 19 nt, Streptococcus pneumoniae R6
cuacaaccucaaaaacaug

SEQ ID NO: 4086034 - RNA, 13 nt, Streptococcus pneumoniae R6
cuacaaccuuaaa

SEQ ID NO: 4086035 - RNA, 17 nt, Streptococcus pneumoniae R6
cuacaaccuuaaaacag

SEQ ID NO: 4086036 - RNA, 18 nt, Streptococcus pneumoniae R6
cuacaacuaacaauuaug

SEQ ID NO: 4086037 - RNA, 21 nt, Streptococcus pneumoniae R6
cuacaauagcuuguuccaauu

SEQ ID NO: 4086038 - RNA, 14 nt, Streptococcus pneumoniae R6
cuacaauuggaaau

SEQ ID NO: 4086039 - RNA, 14 nt, Streptococcus pneumoniae R6
cuacacaaaauagg

SEQ ID NO: 4086040 - RNA, 20 nt, Streptococcus pneumoniae R6
cuacacagcuugguaaugcu

SEQ ID NO: 4086041 - RNA, 13 nt, Streptococcus pneumoniae R6
cuacaccauaaau

SEQ ID NO: 4086042 - RNA, 18 nt, Streptococcus pneumoniae R6
cuacacguggguugaggc

SEQ ID NO: 4086043 - RNA, 14 nt, Streptococcus pneumoniae R6
cuacacuugacaaa

SEQ ID NO: 4086044 - RNA, 14 nt, Streptococcus pneumoniae R6
cuacacuugauuua

SEQ ID NO: 4086045 - RNA, 17 nt, Streptococcus pneumoniae R6
cuacagaugcugcauuu

SEQ ID NO: 4086046 - RNA, 20 nt, Streptococcus pneumoniae R6
cuacagggaucgaaccugug

SEQ ID NO: 4086047 - RNA, 19 nt, Streptococcus pneumoniae R6
cuacaguugacaaagagcc

SEQ ID NO: 4086048 - RNA, 20 nt, Streptococcus pneumoniae R6
cuacaguugacaaagagccc

SEQ ID NO: 4086049 - RNA, 17 nt, Streptococcus pneumoniae R6
cuacaguuggagcaucu

SEQ ID NO: 4086050 - RNA, 22 nt, Streptococcus pneumoniae R6
cuacauauguaagaagauuuuu

SEQ ID NO: 4086051 - RNA, 13 nt, Streptococcus pneumoniae R6
cuacaucuucucc

SEQ ID NO: 4086052 - RNA, 20 nt, Streptococcus pneumoniae R6
cuacaugcuguuagaagacu

SEQ ID NO: 4086053 - RNA, 18 nt, Streptococcus pneumoniae R6
cuacauguguuaccauag

SEQ ID NO: 4086054 - RNA, 20 nt, Streptococcus pneumoniae R6
cuacauucccaaacaaaaaa

SEQ ID NO: 4086055 - RNA, 18 nt, Streptococcus pneumoniae R6
cuacccacuacacuugac

SEQ ID NO: 4086056 - RNA, 16 nt, Streptococcus pneumoniae R6
cuaccguugaaaucaa

SEQ ID NO: 4086057 - RNA, 20 nt, Streptococcus pneumoniae R6
cuaccuacuuuagauacacc

SEQ ID NO: 4086058 - RNA, 14 nt, Streptococcus pneumoniae R6
cuaccugccuucca

SEQ ID NO: 4086059 - RNA, 19 nt, Streptococcus pneumoniae R6
cuacgacaccugacaaugu

SEQ ID NO: 4086060 - RNA, 14 nt, Streptococcus pneumoniae R6
cuacgcuauuuaaa

SEQ ID NO: 4086061 - RNA, 21 nt, Streptococcus pneumoniae R6
cuacggucaccgacaacuuca

SEQ ID NO: 4086062 - RNA, 16 nt, Streptococcus pneumoniae R6
cuacuaaaacauuucu

SEQ ID NO: 4086063 - RNA, 23 nt, Streptococcus pneumoniae R6
cuacuaaaacauuucuauaaauc

SEQ ID NO: 4086064 - RNA, 15 nt, Streptococcus pneumoniae R6
cuacuauauuuuugg

SEQ ID NO: 4086065 - RNA, 22 nt, Streptococcus pneumoniae R6
cuacucgaacuagagaagccaa

SEQ ID NO: 4086066 - RNA, 12 nt, Streptococcus pneumoniae R6
cuacucuaacuu

SEQ ID NO: 4086067 - RNA, 17 nt, Streptococcus pneumoniae R6
cuacucuaacuucaaua

SEQ ID NO: 4086068 - RNA, 18 nt, Streptococcus pneumoniae R6
cuacucuguuuucacccu

SEQ ID NO: 4086069 - RNA, 17 nt, Streptococcus pneumoniae R6
cuacucuuucgaagucu

SEQ ID NO: 4086070 - RNA, 15 nt, Streptococcus pneumoniae R6
cuacugauaucuuua

SEQ ID NO: 4086071 - RNA, 16 nt, Streptococcus pneumoniae R6
cuacugauaucuuuag

SEQ ID NO: 4086072 - RNA, 17 nt, Streptococcus pneumoniae R6
cuacuguauacuuuuuc

SEQ ID NO: 4086073 - RNA, 18 nt, Streptococcus pneumoniae R6
cuacugucaagucuugcu

SEQ ID NO: 4086074 - RNA, 16 nt, Streptococcus pneumoniae R6
cuacuucccacccaua

SEQ ID NO: 4086075 - RNA, 18 nt, Streptococcus pneumoniae R6
cuacuugcuuugcugacu

SEQ ID NO: 4086076 - RNA, 19 nt, Streptococcus pneumoniae R6
cuacuugcuuugcugacuu

SEQ ID NO: 4086077 - RNA, 14 nt, Streptococcus pneumoniae R6
cuacuuguucaggu

SEQ ID NO: 4086078 - RNA, 14 nt, Streptococcus pneumoniae R6
cuacuuuagauaca

SEQ ID NO: 4086079 - RNA, 14 nt, Streptococcus pneumoniae R6
cuacuuugaaauuu

SEQ ID NO: 4086080 - RNA, 19 nt, Streptococcus pneumoniae R6
cuacuuuuuucuaaagcaa

SEQ ID NO: 4086081 - RNA, 21 nt, Streptococcus pneumoniae R6
cuagaaaaagcuucauuuauc

SEQ ID NO: 4086082 - RNA, 16 nt, Streptococcus pneumoniae R6
cuagaaaucucuuuuu

SEQ ID NO: 4086083 - RNA, 18 nt, Streptococcus pneumoniae R6
cuagaaaucucuuuuuuc

SEQ ID NO: 4086084 - RNA, 22 nt, Streptococcus pneumoniae R6
cuagaaaucucuuuuuucucca

SEQ ID NO: 4086085 - RNA, 21 nt, Streptococcus pneumoniae R6
cuagaauagaaacaaaauaua

SEQ ID NO: 4086086 - RNA, 17 nt, Streptococcus pneumoniae R6
cuagaauccuaguucau

SEQ ID NO: 4086087 - RNA, 16 nt, Streptococcus pneumoniae R6
cuagaaugcuuuuuga

SEQ ID NO: 4086088 - RNA, 22 nt, Streptococcus pneumoniae R6
cuagaaugcuuuuugaaagcag

SEQ ID NO: 4086089 - RNA, 20 nt, Streptococcus pneumoniae R6
cuagacgcuuguccugaaug

SEQ ID NO: 4086090 - RNA, 15 nt, Streptococcus pneumoniae R6
cuagacuaacuucuu

SEQ ID NO: 4086091 - RNA, 17 nt, Streptococcus pneumoniae R6
cuagacuaacuucuuau

SEQ ID NO: 4086092 - RNA, 21 nt, Streptococcus pneumoniae R6
cuagacuauaacagagaagaa

SEQ ID NO: 4086093 - RNA, 20 nt, Streptococcus pneumoniae R6
cuagacucuuauuucucaac

SEQ ID NO: 4086094 - RNA, 12 nt, Streptococcus pneumoniae R6
cuagagaagcca

SEQ ID NO: 4086095 - RNA, 17 nt, Streptococcus pneumoniae R6
cuagagacuacggaguu

SEQ ID NO: 4086096 - RNA, 20 nt, Streptococcus pneumoniae R6
cuagaggggugauuuuauau

SEQ ID NO: 4086097 - RNA, 13 nt, Streptococcus pneumoniae R6
cuagaguccaaga

SEQ ID NO: 4086098 - RNA, 15 nt, Streptococcus pneumoniae R6
cuagauaguaccaug

SEQ ID NO: 4086099 - RNA, 13 nt, Streptococcus pneumoniae R6
cuagauauuucca

SEQ ID NO: 4086100 - RNA, 15 nt, Streptococcus pneumoniae R6
cuagauauuuccaau

SEQ ID NO: 4086101 - RNA, 22 nt, Streptococcus pneumoniae R6
cuagauauuuccaauugcggaa

SEQ ID NO: 4086102 - RNA, 13 nt, Streptococcus pneumoniae R6
cuagauauuuuga

SEQ ID NO: 4086103 - RNA, 23 nt, Streptococcus pneumoniae R6
cuagauauuuugaaaggaaagca

SEQ ID NO: 4086104 - RNA, 22 nt, Streptococcus pneumoniae R6
cuagaugaauuacaugaaacug

SEQ ID NO: 4086105 - RNA, 19 nt, Streptococcus pneumoniae R6
cuagauggcuaacuucauu

SEQ ID NO: 4086106 - RNA, 18 nt, Streptococcus pneumoniae R6
cuagcaaaaucauagcau

SEQ ID NO: 4086107 - RNA, 15 nt, Streptococcus pneumoniae R6
cuagcaaaguuuuag

SEQ ID NO: 4086108 - RNA, 17 nt, Streptococcus pneumoniae R6
cuagcaacaaccugcac

SEQ ID NO: 4086109 - RNA, 20 nt, Streptococcus pneumoniae R6
cuagcaacaaccugcacauu

SEQ ID NO: 4086110 - RNA, 12 nt, Streptococcus pneumoniae R6
cuagcaacagau

SEQ ID NO: 4086111 - RNA, 19 nt, Streptococcus pneumoniae R6
cuagcaaugccaaagguaa

SEQ ID NO: 4086112 - RNA, 22 nt, Streptococcus pneumoniae R6
cuagcauaaaagccuccaaucu

SEQ ID NO: 4086113 - RNA, 14 nt, Streptococcus pneumoniae R6
cuagccccagcuag

SEQ ID NO: 4086114 - RNA, 21 nt, Streptococcus pneumoniae R6
cuagccgcagauugcucaaaa

SEQ ID NO: 4086115 - RNA, 18 nt, Streptococcus pneumoniae R6
cuagccgcagguugcuca

SEQ ID NO: 4086116 - RNA, 20 nt, Streptococcus pneumoniae R6
cuaugauuagguuuccuuua

SEQ ID NO: 4086117 - RNA, 13 nt, Streptococcus pneumoniae R6
cuaugauuuucac

SEQ ID NO: 4086118 - RNA, 18 nt, Streptococcus pneumoniae R6
cuaugcaaguucuucucu

SEQ ID NO: 4086119 - RNA, 12 nt, Streptococcus pneumoniae R6
cuauguugcaaa

SEQ ID NO: 4086120 - RNA, 16 nt, Streptococcus pneumoniae R6
cuauguugcaaauuua

SEQ ID NO: 4086121 - RNA, 11 nt, Streptococcus pneumoniae R6
cuauuaaaauu

SEQ ID NO: 4086122 - RNA, 16 nt, Streptococcus pneumoniae R6
cuauuaacaauaaucu

SEQ ID NO: 4086123 - RNA, 17 nt, Streptococcus pneumoniae R6
cuauuacaucguugguu

SEQ ID NO: 4086124 - RNA, 17 nt, Streptococcus pneumoniae R6
cuauuaugcuaaagaaa

SEQ ID NO: 4086125 - RNA, 23 nt, Streptococcus pneumoniae R6
cuauuauuaauguuuagcaaacu

SEQ ID NO: 4086126 - RNA, 22 nt, Streptococcus pneumoniae R6
cuauuauuuaaguguuaugaau

SEQ ID NO: 4086127 - RNA, 22 nt, Streptococcus pneumoniae R6
cuauucacucaaaucauauuca

SEQ ID NO: 4086128 - RNA, 19 nt, Streptococcus pneumoniae R6
cuauucuaguuucaaucua

SEQ ID NO: 4086129 - RNA, 22 nt, Streptococcus pneumoniae R6
cuauucuaguuucaauuugaua

SEQ ID NO: 4086130 - RNA, 14 nt, Streptococcus pneumoniae R6
cuauucuuuuucua

SEQ ID NO: 4086131 - RNA, 12 nt, Streptococcus pneumoniae R6
cuauucuuuuuu

SEQ ID NO: 4086132 - RNA, 20 nt, Streptococcus pneumoniae R6
cuauugaaaggaaaaugauu

SEQ ID NO: 4086133 - RNA, 16 nt, Streptococcus pneumoniae R6
cuauugaaaugaggac

SEQ ID NO: 4086134 - RNA, 21 nt, Streptococcus pneumoniae R6
cuauugacuuuucuuauaguu

SEQ ID NO: 4086135 - RNA, 14 nt, Streptococcus pneumoniae R6
cuauugcuuuuaga

SEQ ID NO: 4086136 - RNA, 18 nt, Streptococcus pneumoniae R6
cuauugucacgaaccaca

SEQ ID NO: 4086137 - RNA, 16 nt, Streptococcus pneumoniae R6
cuauuuaccauggacu

SEQ ID NO: 4086138 - RNA, 21 nt, Streptococcus pneumoniae R6
cuauuuacgacaacgguaucu

SEQ ID NO: 4086139 - RNA, 23 nt, Streptococcus pneumoniae R6
cuauuuauuacuucaauuucuaa

SEQ ID NO: 4086140 - RNA, 13 nt, Streptococcus pneumoniae R6
cuauuucagauuc

SEQ ID NO: 4086141 - RNA, 14 nt, Streptococcus pneumoniae R6
cuauuucagauuca

SEQ ID NO: 4086142 - RNA, 18 nt, Streptococcus pneumoniae R6
cuauuucuagcuagaccu

SEQ ID NO: 4086143 - RNA, 21 nt, Streptococcus pneumoniae R6
cuauuugaguaacggcuuccu

SEQ ID NO: 4086144 - RNA, 17 nt, Streptococcus pneumoniae R6
cuauuuggcuuaucuga

SEQ ID NO: 4086145 - RNA, 16 nt, Streptococcus pneumoniae R6
cuauuuuauugucauu

SEQ ID NO: 4086146 - RNA, 15 nt, Streptococcus pneumoniae R6
cuauuuuauuuuuua

SEQ ID NO: 4086147 - RNA, 22 nt, Streptococcus pneumoniae R6
cuauuuucuucuuuauaauauu

SEQ ID NO: 4086148 - RNA, 13 nt, Streptococcus pneumoniae R6
cuauuuuuugaau

SEQ ID NO: 4086149 - RNA, 16 nt, Streptococcus pneumoniae R6
cucaaaaaaguuaaau

SEQ ID NO: 4086150 - RNA, 14 nt, Streptococcus pneumoniae R6
cucaaaacacaguu

SEQ ID NO: 4086151 - RNA, 12 nt, Streptococcus pneumoniae R6
cucaaaacacug

SEQ ID NO: 4086152 - RNA, 19 nt, Streptococcus pneumoniae R6
cucaaaacacuguuuuaag

SEQ ID NO: 4086153 - RNA, 21 nt, Streptococcus pneumoniae R6
cucaaaacacuguuuugagcu

SEQ ID NO: 4086154 - RNA, 21 nt, Streptococcus pneumoniae R6
cucaaaacacuguuuugaggu

SEQ ID NO: 4086155 - RNA, 14 nt, Streptococcus pneumoniae R6
cucaaaacaguguu

SEQ ID NO: 4086156 - RNA, 21 nt, Streptococcus pneumoniae R6
cucaaaacaguguuuugagca

SEQ ID NO: 4086157 - RNA, 21 nt, Streptococcus pneumoniae R6
cucaaaacaguguuuugagcu

SEQ ID NO: 4086158 - RNA, 21 nt, Streptococcus pneumoniae R6
cucaaaacaugguuuugaggu

SEQ ID NO: 4086159 - RNA, 17 nt, Streptococcus pneumoniae R6
cucaaaaccauguuuug

SEQ ID NO: 4086160 - RNA, 21 nt, Streptococcus pneumoniae R6
cucaaaaccauguuuugagcu

SEQ ID NO: 4086161 - RNA, 21 nt, Streptococcus pneumoniae R6
cucaaaacgguguuuugagcu

SEQ ID NO: 4086162 - RNA, 13 nt, Streptococcus pneumoniae R6
cucaaaauucugu

SEQ ID NO: 4086163 - RNA, 19 nt, Streptococcus pneumoniae R6
cucaaacucaguuaaaauc

SEQ ID NO: 4086164 - RNA, 16 nt, Streptococcus pneumoniae R6
cucaaaguacugccuu

SEQ ID NO: 4086165 - RNA, 17 nt, Streptococcus pneumoniae R6
cucaaaguacugccuug

SEQ ID NO: 4086166 - RNA, 18 nt, Streptococcus pneumoniae R6
cucaacaaaucuuccuag

SEQ ID NO: 4086167 - RNA, 12 nt, Streptococcus pneumoniae R6
cucaacagaaga

SEQ ID NO: 4086168 - RNA, 17 nt, Streptococcus pneumoniae R6
cucaaccacaaaaaagc

SEQ ID NO: 4086169 - RNA, 17 nt, Streptococcus pneumoniae R6
cucaacgcuagaagcau

SEQ ID NO: 4086170 - RNA, 13 nt, Streptococcus pneumoniae R6
cucaacuucuuuu

SEQ ID NO: 4086171 - RNA, 19 nt, Streptococcus pneumoniae R6
cucaagcugugaguucauu

SEQ ID NO: 4086172 - RNA, 21 nt, Streptococcus pneumoniae R6
cucaaggagagcuuuuauuuc

SEQ ID NO: 4086173 - RNA, 22 nt, Streptococcus pneumoniae R6
cucaaggcaguacuuugagcaa

SEQ ID NO: 4086174 - RNA, 16 nt, Streptococcus pneumoniae R6
cucaauaucuucugcu

SEQ ID NO: 4086175 - RNA, 21 nt, Streptococcus pneumoniae R6
cucaauauuaugcguuuuuuc

SEQ ID NO: 4086176 - RNA, 23 nt, Streptococcus pneumoniae R6
cucaauauuaugcguuuuuucug

SEQ ID NO: 4086177 - RNA, 20 nt, Streptococcus pneumoniae R6
cucaaucaagauagcuguga

SEQ ID NO: 4086178 - RNA, 20 nt, Streptococcus pneumoniae R6
cucaaucaauccaaagaaau

SEQ ID NO: 4086179 - RNA, 15 nt, Streptococcus pneumoniae R6
cucaaucaguuuuug

SEQ ID NO: 4086180 - RNA, 18 nt, Streptococcus pneumoniae R6
cucaaucaguuuuuucac

SEQ ID NO: 4086181 - RNA, 20 nt, Streptococcus pneumoniae R6
cucaaucccauauuuuuccu

SEQ ID NO: 4086182 - RNA, 23 nt, Streptococcus pneumoniae R6
cucaaugaaaaucaaagugcaaa

SEQ ID NO: 4086183 - RNA, 16 nt, Streptococcus pneumoniae R6
cucaaugaaaaucaua

SEQ ID NO: 4086184 - RNA, 19 nt, Streptococcus pneumoniae R6
cucaaugauaccaucuuua

SEQ ID NO: 4086185 - RNA, 15 nt, Streptococcus pneumoniae R6
cucaauguuuuauua

SEQ ID NO: 4086186 - RNA, 18 nt, Streptococcus pneumoniae R6
cucaauuguauagugaac

SEQ ID NO: 4086187 - RNA, 21 nt, Streptococcus pneumoniae R6
cucaauuuaucuagugcuaua

SEQ ID NO: 4086188 - RNA, 13 nt, Streptococcus pneumoniae R6
cucaauuucagga

SEQ ID NO: 4086189 - RNA, 16 nt, Streptococcus pneumoniae R6
cucaauuucaggagaa

SEQ ID NO: 4086190 - RNA, 22 nt, Streptococcus pneumoniae R6
cucaccaggcauuauuucacuu

SEQ ID NO: 4086191 - RNA, 21 nt, Streptococcus pneumoniae R6
cucaccaucuuccgcaaucca

SEQ ID NO: 4086192 - RNA, 16 nt, Streptococcus pneumoniae R6
cucaccgaccaauucu

SEQ ID NO: 4086193 - RNA, 13 nt, Streptococcus pneumoniae R6
cucacugaugaaa

SEQ ID NO: 4086194 - RNA, 15 nt, Streptococcus pneumoniae R6
cucagaaacaagaaa

SEQ ID NO: 4086195 - RNA, 19 nt, Streptococcus pneumoniae R6
cucagaacccuuauuuccu

SEQ ID NO: 4086196 - RNA, 20 nt, Streptococcus pneumoniae R6
cucagaacccuuauuuccug

SEQ ID NO: 4086197 - RNA, 23 nt, Streptococcus pneumoniae R6
cucagaacgucgcuguaaaaucu

SEQ ID NO: 4086198 - RNA, 21 nt, Streptococcus pneumoniae R6
cucagauuacaucucuuguaa

SEQ ID NO: 4086199 - RNA, 13 nt, Streptococcus pneumoniae R6
cucagcacuuggc

SEQ ID NO: 4086200 - RNA, 12 nt, Streptococcus pneumoniae R6
cucagcaggagc

SEQ ID NO: 4086201 - RNA, 14 nt, Streptococcus pneumoniae R6
cucagcauuuucuu

SEQ ID NO: 4086202 - RNA, 18 nt, Streptococcus pneumoniae R6
cucagcauuuucuuuuug

SEQ ID NO: 4086203 - RNA, 21 nt, Streptococcus pneumoniae R6
cucagccauaagguuauccuu

SEQ ID NO: 4086204 - RNA, 23 nt, Streptococcus pneumoniae R6
cucagcugagcgguuuuagucua

SEQ ID NO: 4086205 - RNA, 15 nt, Streptococcus pneumoniae R6
cucagggucuuuguu

SEQ ID NO: 4086206 - RNA, 11 nt, Streptococcus pneumoniae R6
cucagucugac

SEQ ID NO: 4086207 - RNA, 20 nt, Streptococcus pneumoniae R6
cucauaaaagguauugcaac

SEQ ID NO: 4086208 - RNA, 13 nt, Streptococcus pneumoniae R6
cucauauagacca

SEQ ID NO: 4086209 - RNA, 21 nt, Streptococcus pneumoniae R6
cucauauucaagaaucgucac

SEQ ID NO: 4086210 - RNA, 16 nt, Streptococcus pneumoniae R6
cucauauucuuuuaca

SEQ ID NO: 4086211 - RNA, 18 nt, Streptococcus pneumoniae R6
cucauauucuuuuacacu

SEQ ID NO: 4086212 - RNA, 15 nt, Streptococcus pneumoniae R6
cucauauuuauuaau

SEQ ID NO: 4086213 - RNA, 18 nt, Streptococcus pneumoniae R6
cucauauuuauuaauuuc

SEQ ID NO: 4086214 - RNA, 12 nt, Streptococcus pneumoniae R6
cucauauuuucu

SEQ ID NO: 4086215 - RNA, 23 nt, Streptococcus pneumoniae R6
cucaucaaaggucucuucuucug

SEQ ID NO: 4086216 - RNA, 14 nt, Streptococcus pneumoniae R6
cucaucaucugaau

SEQ ID NO: 4086217 - RNA, 23 nt, Streptococcus pneumoniae R6
cucauccuuugcauccacaucca

SEQ ID NO: 4086218 - RNA, 12 nt, Streptococcus pneumoniae R6
cucucuaauucc

SEQ ID NO: 4086219 - RNA, 20 nt, Streptococcus pneumoniae R6
cucucuaauucccuuaaagu

SEQ ID NO: 4086220 - RNA, 20 nt, Streptococcus pneumoniae R6
cucucuauaauaacuccgaa

SEQ ID NO: 4086221 - RNA, 14 nt, Streptococcus pneumoniae R6
cucucuucaaauuu

SEQ ID NO: 4086222 - RNA, 20 nt, Streptococcus pneumoniae R6
cucugaaaacaaguucuuuu

SEQ ID NO: 4086223 - RNA, 14 nt, Streptococcus pneumoniae R6
cucugagaccuuua

SEQ ID NO: 4086224 - RNA, 21 nt, Streptococcus pneumoniae R6
cucugaggaaucaaucuucaa

SEQ ID NO: 4086225 - RNA, 22 nt, Streptococcus pneumoniae R6
cucugccagcugagcuaaggag

SEQ ID NO: 4086226 - RNA, 14 nt, Streptococcus pneumoniae R6
cucugccuuccuug

SEQ ID NO: 4086227 - RNA, 14 nt, Streptococcus pneumoniae R6
cucugucacaaaga

SEQ ID NO: 4086228 - RNA, 17 nt, Streptococcus pneumoniae R6
cucugucacaaagaguu

SEQ ID NO: 4086229 - RNA, 17 nt, Streptococcus pneumoniae R6
cucugucccaucauuuc

SEQ ID NO: 4086230 - RNA, 13 nt, Streptococcus pneumoniae R6
cucugugcaauac

SEQ ID NO: 4086231 - RNA, 18 nt, Streptococcus pneumoniae R6
cucuguuaccacaggagc

SEQ ID NO: 4086232 - RNA, 19 nt, Streptococcus pneumoniae R6
cucuuaaaaaaguccaaaa

SEQ ID NO: 4086233 - RNA, 19 nt, Streptococcus pneumoniae R6
cucuuaauaucagccagag

SEQ ID NO: 4086234 - RNA, 23 nt, Streptococcus pneumoniae R6
cucuuaauccgugggucacaggu

SEQ ID NO: 4086235 - RNA, 22 nt, Streptococcus pneumoniae R6
cucuuacaguuugcucagcauu

SEQ ID NO: 4086236 - RNA, 18 nt, Streptococcus pneumoniae R6
cucuuauuguauaguaga

SEQ ID NO: 4086237 - RNA, 21 nt, Streptococcus pneumoniae R6
cucuucaaaccacgucagcgu

SEQ ID NO: 4086238 - RNA, 13 nt, Streptococcus pneumoniae R6
cucuucaaacuac

SEQ ID NO: 4086239 - RNA, 11 nt, Streptococcus pneumoniae R6
cucuucaaucu

SEQ ID NO: 4086240 - RNA, 23 nt, Streptococcus pneumoniae R6
cucuucagcaaaacgcugcucaa

SEQ ID NO: 4086241 - RNA, 15 nt, Streptococcus pneumoniae R6
cucuuccgaggucau

SEQ ID NO: 4086242 - RNA, 20 nt, Streptococcus pneumoniae R6
cucuucgaaaaucucuucaa

SEQ ID NO: 4086243 - RNA, 12 nt, Streptococcus pneumoniae R6
cucuucuaaaaa

SEQ ID NO: 4086244 - RNA, 12 nt, Streptococcus pneumoniae R6
cucuugaaaaug

SEQ ID NO: 4086245 - RNA, 19 nt, Streptococcus pneumoniae R6
cucuugaagacuuuuuaaa

SEQ ID NO: 4086246 - RNA, 21 nt, Streptococcus pneumoniae R6
cucuugauuuuuuuuaaaaaa

SEQ ID NO: 4086247 - RNA, 14 nt, Streptococcus pneumoniae R6
cucuugucuuacuu

SEQ ID NO: 4086248 - RNA, 12 nt, Streptococcus pneumoniae R6
cucuuuaagaga

SEQ ID NO: 4086249 - RNA, 13 nt, Streptococcus pneumoniae R6
cucuuucaaaagg

SEQ ID NO: 4086250 - RNA, 18 nt, Streptococcus pneumoniae R6
cucuuugauuuuuauuga

SEQ ID NO: 4086251 - RNA, 13 nt, Streptococcus pneumoniae R6
cucuuugcauuuc

SEQ ID NO: 4086252 - RNA, 14 nt, Streptococcus pneumoniae R6
cucuuuguccuuua

SEQ ID NO: 4086253 - RNA, 12 nt, Streptococcus pneumoniae R6
cucuuuguucuu

SEQ ID NO: 4086254 - RNA, 22 nt, Streptococcus pneumoniae R6
cucuuuucuuaucuggguucca

SEQ ID NO: 4086255 - RNA, 21 nt, Streptococcus pneumoniae R6
cucuuuuuacaauuguaaaaa

SEQ ID NO: 4086256 - RNA, 23 nt, Streptococcus pneumoniae R6
cucuuuuuauucuuuuucaaagg

SEQ ID NO: 4086257 - RNA, 15 nt, Streptococcus pneumoniae R6
cucuuuuuucaugua

SEQ ID NO: 4086258 - RNA, 12 nt, Streptococcus pneumoniae R6
cucuuuuuucuc

SEQ ID NO: 4086259 - RNA, 21 nt, Streptococcus pneumoniae R6
cucuuuuuugauaucuuccuc

SEQ ID NO: 4086260 - RNA, 22 nt, Streptococcus pneumoniae R6
cucuuuuuugauaucuuccuca

SEQ ID NO: 4086261 - RNA, 22 nt, Streptococcus pneumoniae R6
cugaaaaaauaaauaaaacucu

SEQ ID NO: 4086262 - RNA, 20 nt, Streptococcus pneumoniae R6
cugaaaacaaguucuuuucu

SEQ ID NO: 4086263 - RNA, 24 nt, Streptococcus pneumoniae R6
cugaaaagacguauucagucaucu

SEQ ID NO: 4086264 - RNA, 12 nt, Streptococcus pneumoniae R6
cugaaaaucauc

SEQ ID NO: 4086265 - RNA, 11 nt, Streptococcus pneumoniae R6
cugaaagugaa

SEQ ID NO: 4086266 - RNA, 17 nt, Streptococcus pneumoniae R6
cugaaauauacucauaa

SEQ ID NO: 4086267 - RNA, 21 nt, Streptococcus pneumoniae R6
cugaaauauacucauaaaguc

SEQ ID NO: 4086268 - RNA, 16 nt, Streptococcus pneumoniae R6
cugaaaucagugugac

SEQ ID NO: 4086269 - RNA, 20 nt, Streptococcus pneumoniae R6
cugaaaucccauaguagucu

SEQ ID NO: 4086270 - RNA, 19 nt, Streptococcus pneumoniae R6
cugaaauugagucuuuuuc

SEQ ID NO: 4086271 - RNA, 21 nt, Streptococcus pneumoniae R6
cugaaauuggcucaucugcaa

SEQ ID NO: 4086272 - RNA, 12 nt, Streptococcus pneumoniae R6
cugaacaaauua

SEQ ID NO: 4086273 - RNA, 15 nt, Streptococcus pneumoniae R6
cugaacaaugaaaaa

SEQ ID NO: 4086274 - RNA, 20 nt, Streptococcus pneumoniae R6
cugaaccauguccuggauag

SEQ ID NO: 4086275 - RNA, 20 nt, Streptococcus pneumoniae R6
cugaacccuugucuacauuc

SEQ ID NO: 4086276 - RNA, 18 nt, Streptococcus pneumoniae R6
cugaacggugaacuucuu

SEQ ID NO: 4086277 - RNA, 18 nt, Streptococcus pneumoniae R6
cugaacucaacuuccuua

SEQ ID NO: 4086278 - RNA, 16 nt, Streptococcus pneumoniae R6
cugaagaaagcaauuu

SEQ ID NO: 4086279 - RNA, 21 nt, Streptococcus pneumoniae R6
cugaagcauauuccacauuca

SEQ ID NO: 4086280 - RNA, 21 nt, Streptococcus pneumoniae R6
cugaagucacuacuuccaucu

SEQ ID NO: 4086281 - RNA, 18 nt, Streptococcus pneumoniae R6
cugaaguuccucuuuuuc

SEQ ID NO: 4086282 - RNA, 19 nt, Streptococcus pneumoniae R6
cugaaguuccucuuuuucc

SEQ ID NO: 4086283 - RNA, 22 nt, Streptococcus pneumoniae R6
cugaauaauacagauaaaaccu

SEQ ID NO: 4086284 - RNA, 17 nt, Streptococcus pneumoniae R6
cugaauagugaagauac

SEQ ID NO: 4086285 - RNA, 17 nt, Streptococcus pneumoniae R6
cugaauauauucuccag

SEQ ID NO: 4086286 - RNA, 17 nt, Streptococcus pneumoniae R6
cugaauauccuuauaua

SEQ ID NO: 4086287 - RNA, 20 nt, Streptococcus pneumoniae R6
cugaaucauaggcauaguac

SEQ ID NO: 4086288 - RNA, 16 nt, Streptococcus pneumoniae R6
cugaaucguuggcaaa

SEQ ID NO: 4086289 - RNA, 18 nt, Streptococcus pneumoniae R6
cugaaucugaaauaguac

SEQ ID NO: 4086290 - RNA, 14 nt, Streptococcus pneumoniae R6
cugaaugcuuucca

SEQ ID NO: 4086291 - RNA, 15 nt, Streptococcus pneumoniae R6
cugaaugcuuuccaa

SEQ ID NO: 4086292 - RNA, 20 nt, Streptococcus pneumoniae R6
cugaauggccuccuucauua

SEQ ID NO: 4086293 - RNA, 19 nt, Streptococcus pneumoniae R6
cugaaugucguauucgucu

SEQ ID NO: 4086294 - RNA, 24 nt, Streptococcus pneumoniae R6
cugaauguuucccuugcuagucau

SEQ ID NO: 4086295 - RNA, 20 nt, Streptococcus pneumoniae R6
cugacaauuuaaccaaacca

SEQ ID NO: 4086296 - RNA, 11 nt, Streptococcus pneumoniae R6
cugacaugaug

SEQ ID NO: 4086297 - RNA, 12 nt, Streptococcus pneumoniae R6
cugacauucuuu

SEQ ID NO: 4086298 - RNA, 13 nt, Streptococcus pneumoniae R6
cugacgaagucag

SEQ ID NO: 4086299 - RNA, 21 nt, Streptococcus pneumoniae R6
cugacgugguugaugagauuu

SEQ ID NO: 4086300 - RNA, 15 nt, Streptococcus pneumoniae R6
cugacgugguuugaa

SEQ ID NO: 4086301 - RNA, 23 nt, Streptococcus pneumoniae R6
cugacgugguuugaagagauuuu

SEQ ID NO: 4086302 - RNA, 15 nt, Streptococcus pneumoniae R6
cugacuagcaucuug

SEQ ID NO: 4086303 - RNA, 14 nt, Streptococcus pneumoniae R6
cugacuaucuuguu

SEQ ID NO: 4086304 - RNA, 19 nt, Streptococcus pneumoniae R6
cugacuaucuuguugaaug

SEQ ID NO: 4086305 - RNA, 14 nt, Streptococcus pneumoniae R6
cugacuccauagcc

SEQ ID NO: 4086306 - RNA, 21 nt, Streptococcus pneumoniae R6
cugacuucgucaguuccaucu

SEQ ID NO: 4086307 - RNA, 17 nt, Streptococcus pneumoniae R6
cugacuucgucaguucu

SEQ ID NO: 4086308 - RNA, 20 nt, Streptococcus pneumoniae R6
cugacuucgucaguucuauc

SEQ ID NO: 4086309 - RNA, 19 nt, Streptococcus pneumoniae R6
cugacuucgucaguuucau

SEQ ID NO: 4086310 - RNA, 13 nt, Streptococcus pneumoniae R6
cugacuuuuccac

SEQ ID NO: 4086311 - RNA, 21 nt, Streptococcus pneumoniae R6
cugagaccuuuauuggcugcc

SEQ ID NO: 4086312 - RNA, 15 nt, Streptococcus pneumoniae R6
cugagaucuucuucu

SEQ ID NO: 4086313 - RNA, 19 nt, Streptococcus pneumoniae R6
cugagaucuucuucuagaa

SEQ ID NO: 4086314 - RNA, 16 nt, Streptococcus pneumoniae R6
cugagaugaggcgcuc

SEQ ID NO: 4086315 - RNA, 16 nt, Streptococcus pneumoniae R6
cugaggauuaggguag

SEQ ID NO: 4086316 - RNA, 22 nt, Streptococcus pneumoniae R6
cugaguaaagacuagacuugcc

SEQ ID NO: 4086317 - RNA, 22 nt, Streptococcus pneumoniae R6
cugaguuagugucgcauaugca

SEQ ID NO: 4086318 - RNA, 22 nt, Streptococcus pneumoniae R6
cugauaacgaagagcuggcugc

SEQ ID NO: 4086319 - RNA, 21 nt, Streptococcus pneumoniae R6
cugauaagaugacaucuaaau

SEQ ID NO: 4086320 - RNA, 17 nt, Streptococcus pneumoniae R6
cugcucgguaaaacaua

SEQ ID NO: 4086321 - RNA, 17 nt, Streptococcus pneumoniae R6
cugcucuccaucuuggc

SEQ ID NO: 4086322 - RNA, 15 nt, Streptococcus pneumoniae R6
cugcugcuaaggauu

SEQ ID NO: 4086323 - RNA, 17 nt, Streptococcus pneumoniae R6
cugcuguuuucauguuc

SEQ ID NO: 4086324 - RNA, 20 nt, Streptococcus pneumoniae R6
cugcuucaaauuguuuacga

SEQ ID NO: 4086325 - RNA, 17 nt, Streptococcus pneumoniae R6
cugcuuccauuuccaca

SEQ ID NO: 4086326 - RNA, 21 nt, Streptococcus pneumoniae R6
cugcuuccauuuccacagccu

SEQ ID NO: 4086327 - RNA, 15 nt, Streptococcus pneumoniae R6
cugcuucgauaacaa

SEQ ID NO: 4086328 - RNA, 13 nt, Streptococcus pneumoniae R6
cugcuugcaauuc

SEQ ID NO: 4086329 - RNA, 18 nt, Streptococcus pneumoniae R6
cugcuugcaauucuuuuc

SEQ ID NO: 4086330 - RNA, 21 nt, Streptococcus pneumoniae R6
cugcuugcacggguuuaacua

SEQ ID NO: 4086331 - RNA, 22 nt, Streptococcus pneumoniae R6
cugcuugcacggguuuaacuaa

SEQ ID NO: 4086332 - RNA, 13 nt, Streptococcus pneumoniae R6
cugcuugcauuug

SEQ ID NO: 4086333 - RNA, 18 nt, Streptococcus pneumoniae R6
cugcuuuauaguggguug

SEQ ID NO: 4086334 - RNA, 20 nt, Streptococcus pneumoniae R6
cugcuuugagaucuuuuucg

SEQ ID NO: 4086335 - RNA, 13 nt, Streptococcus pneumoniae R6
cugcuuuuaaaua

SEQ ID NO: 4086336 - RNA, 18 nt, Streptococcus pneumoniae R6
cuggaaagauaacugcua

SEQ ID NO: 4086337 - RNA, 19 nt, Streptococcus pneumoniae R6
cuggaacaaaauaguucuc

SEQ ID NO: 4086338 - RNA, 23 nt, Streptococcus pneumoniae R6
cuggaacgggguccuuaccuguu

SEQ ID NO: 4086339 - RNA, 14 nt, Streptococcus pneumoniae R6
cuggaagugaaaaa

SEQ ID NO: 4086340 - RNA, 20 nt, Streptococcus pneumoniae R6
cuggaaucagaacacuucca

SEQ ID NO: 4086341 - RNA, 19 nt, Streptococcus pneumoniae R6
cuggaauggcaaauucugu

SEQ ID NO: 4086342 - RNA, 20 nt, Streptococcus pneumoniae R6
cuggacaaaaacucaauuuc

SEQ ID NO: 4086343 - RNA, 22 nt, Streptococcus pneumoniae R6
cuggacaaaaacucaauuucag

SEQ ID NO: 4086344 - RNA, 16 nt, Streptococcus pneumoniae R6
cuggacguucuucaag

SEQ ID NO: 4086345 - RNA, 16 nt, Streptococcus pneumoniae R6
cuggagaagcaccagu

SEQ ID NO: 4086346 - RNA, 17 nt, Streptococcus pneumoniae R6
cuggagaaucaucauga

SEQ ID NO: 4086347 - RNA, 20 nt, Streptococcus pneumoniae R6
cuggagcuucaucaguucca

SEQ ID NO: 4086348 - RNA, 19 nt, Streptococcus pneumoniae R6
cuggaguagcauccccagu

SEQ ID NO: 4086349 - RNA, 14 nt, Streptococcus pneumoniae R6
cuggaguucuuuuc

SEQ ID NO: 4086350 - RNA, 23 nt, Streptococcus pneumoniae R6
cuggauaaaguuaugaaaaagau

SEQ ID NO: 4086351 - RNA, 20 nt, Streptococcus pneumoniae R6
cuggauaagcuugugaaagc

SEQ ID NO: 4086352 - RNA, 23 nt, Streptococcus pneumoniae R6
cuggauagguugcaaagaguuuu

SEQ ID NO: 4086353 - RNA, 22 nt, Streptococcus pneumoniae R6
cuggauaguuuacuuaaauuuc

SEQ ID NO: 4086354 - RNA, 17 nt, Streptococcus pneumoniae R6
cuggaucuacuuuuuuc

SEQ ID NO: 4086355 - RNA, 17 nt, Streptococcus pneumoniae R6
cuggaucuagauaguac

SEQ ID NO: 4086356 - RNA, 16 nt, Streptococcus pneumoniae R6
cuggauguucugucug

SEQ ID NO: 4086357 - RNA, 19 nt, Streptococcus pneumoniae R6
cuggauugccaacaaacau

SEQ ID NO: 4086358 - RNA, 17 nt, Streptococcus pneumoniae R6
cuggauuguauagugaa

SEQ ID NO: 4086359 - RNA, 15 nt, Streptococcus pneumoniae R6
cuggauuuucagccu

SEQ ID NO: 4086360 - RNA, 18 nt, Streptococcus pneumoniae R6
cuggauuuucagccucua

SEQ ID NO: 4086361 - RNA, 14 nt, Streptococcus pneumoniae R6
cuggcaaaggcaug

SEQ ID NO: 4086362 - RNA, 19 nt, Streptococcus pneumoniae R6
cuggcaagauuuguucagg

SEQ ID NO: 4086363 - RNA, 21 nt, Streptococcus pneumoniae R6
cuggcaauacuucaacaaaug

SEQ ID NO: 4086364 - RNA, 15 nt, Streptococcus pneumoniae R6
cuggcagauagaugg

SEQ ID NO: 4086365 - RNA, 13 nt, Streptococcus pneumoniae R6
cuggcauccccag

SEQ ID NO: 4086366 - RNA, 22 nt, Streptococcus pneumoniae R6
cuggcauuaaggcuuugaacau

SEQ ID NO: 4086367 - RNA, 15 nt, Streptococcus pneumoniae R6
cuggcauuccugcuc

SEQ ID NO: 4086368 - RNA, 20 nt, Streptococcus pneumoniae R6
cuggcauuucccauugcaau

SEQ ID NO: 4086369 - RNA, 16 nt, Streptococcus pneumoniae R6
cuggcguaguaaauca

SEQ ID NO: 4086370 - RNA, 23 nt, Streptococcus pneumoniae R6
cuggcguaguaaaucaguccagu

SEQ ID NO: 4086371 - RNA, 17 nt, Streptococcus pneumoniae R6
cuggcuaauaauuccag

SEQ ID NO: 4086372 - RNA, 22 nt, Streptococcus pneumoniae R6
cuggcuaauaauuccagauugu

SEQ ID NO: 4086373 - RNA, 21 nt, Streptococcus pneumoniae R6
cuggcuacagaugcugcauuu

SEQ ID NO: 4086374 - RNA, 14 nt, Streptococcus pneumoniae R6
cuggcuauuuuuau

SEQ ID NO: 4086375 - RNA, 18 nt, Streptococcus pneumoniae R6
cuggcucauaucuggcau

SEQ ID NO: 4086376 - RNA, 17 nt, Streptococcus pneumoniae R6
cuggcuccuucuuuuuu

SEQ ID NO: 4086377 - RNA, 13 nt, Streptococcus pneumoniae R6
cuggcucuuuguc

SEQ ID NO: 4086378 - RNA, 12 nt, Streptococcus pneumoniae R6
cugggaaaaauu

SEQ ID NO: 4086379 - RNA, 22 nt, Streptococcus pneumoniae R6
cugggaagacugucaaguucuu

SEQ ID NO: 4086380 - RNA, 19 nt, Streptococcus pneumoniae R6
cugggaagaugaagacauu

SEQ ID NO: 4086381 - RNA, 17 nt, Streptococcus pneumoniae R6
cugggauggucacagaa

SEQ ID NO: 4086382 - RNA, 14 nt, Streptococcus pneumoniae R6
cugguaaaagagca

SEQ ID NO: 4086383 - RNA, 13 nt, Streptococcus pneumoniae R6
cugguaaagacuc

SEQ ID NO: 4086384 - RNA, 16 nt, Streptococcus pneumoniae R6
cugguaaagacucuug

SEQ ID NO: 4086385 - RNA, 20 nt, Streptococcus pneumoniae R6
cugguaagaaguaaccaguu

SEQ ID NO: 4086386 - RNA, 23 nt, Streptococcus pneumoniae R6
cugguaggcauaaacaggcucgg

SEQ ID NO: 4086387 - RNA, 15 nt, Streptococcus pneumoniae R6
cugguauuuuuucaa

SEQ ID NO: 4086388 - RNA, 20 nt, Streptococcus pneumoniae R6
cuggucaugaggcauagaac

SEQ ID NO: 4086389 - RNA, 21 nt, Streptococcus pneumoniae R6
cuggucuuauuucauuucacu

SEQ ID NO: 4086390 - RNA, 12 nt, Streptococcus pneumoniae R6
cuggucuuuuug

SEQ ID NO: 4086391 - RNA, 18 nt, Streptococcus pneumoniae R6
cuggugcuagggcaagga

SEQ ID NO: 4086392 - RNA, 19 nt, Streptococcus pneumoniae R6
cuggugucguugaaugaaa

SEQ ID NO: 4086393 - RNA, 15 nt, Streptococcus pneumoniae R6
cuggugugauuuucc

SEQ ID NO: 4086394 - RNA, 16 nt, Streptococcus pneumoniae R6
cuggugugauuuuccu

SEQ ID NO: 4086395 - RNA, 17 nt, Streptococcus pneumoniae R6
cuggugugauuuuccug

SEQ ID NO: 4086396 - RNA, 18 nt, Streptococcus pneumoniae R6
cugguguguauggaggaa

SEQ ID NO: 4086397 - RNA, 12 nt, Streptococcus pneumoniae R6
cugguuacgacg

SEQ ID NO: 4086398 - RNA, 23 nt, Streptococcus pneumoniae R6
cugguucagcagagaagcacaug

SEQ ID NO: 4086399 - RNA, 14 nt, Streptococcus pneumoniae R6
cugguugaaaaccu

SEQ ID NO: 4086400 - RNA, 21 nt, Streptococcus pneumoniae R6
cuguaaaaagugaaaggaaga

SEQ ID NO: 4086401 - RNA, 18 nt, Streptococcus pneumoniae R6
cuguaagaacuuuuuaaa

SEQ ID NO: 4086402 - RNA, 21 nt, Streptococcus pneumoniae R6
cuguaagaacuuuuuaaagua

SEQ ID NO: 4086403 - RNA, 19 nt, Streptococcus pneumoniae R6
cuguaagucauuuucuuuu

SEQ ID NO: 4086404 - RNA, 22 nt, Streptococcus pneumoniae R6
cuguaauaugaacaaaaccugg

SEQ ID NO: 4086405 - RNA, 14 nt, Streptococcus pneumoniae R6
cuguaaucaugaug

SEQ ID NO: 4086406 - RNA, 23 nt, Streptococcus pneumoniae R6
cuguaaucccaaucauggcuggg

SEQ ID NO: 4086407 - RNA, 16 nt, Streptococcus pneumoniae R6
cuguaaugaaauacug

SEQ ID NO: 4086408 - RNA, 19 nt, Streptococcus pneumoniae R6
cuguaaugaaauacugaug

SEQ ID NO: 4086409 - RNA, 14 nt, Streptococcus pneumoniae R6
cuguacaaauccca

SEQ ID NO: 4086410 - RNA, 20 nt, Streptococcus pneumoniae R6
cuguacccaaguaaucugca

SEQ ID NO: 4086411 - RNA, 20 nt, Streptococcus pneumoniae R6
cuguaccguccccuuuugga

SEQ ID NO: 4086412 - RNA, 14 nt, Streptococcus pneumoniae R6
cuguacgguaauca

SEQ ID NO: 4086413 - RNA, 15 nt, Streptococcus pneumoniae R6
cuguacgucaucaga

SEQ ID NO: 4086414 - RNA, 15 nt, Streptococcus pneumoniae R6
cuguacuuagccaag

SEQ ID NO: 4086415 - RNA, 19 nt, Streptococcus pneumoniae R6
cuguagaguuuugguugau

SEQ ID NO: 4086416 - RNA, 18 nt, Streptococcus pneumoniae R6
cuguagggggcauauaaa

SEQ ID NO: 4086417 - RNA, 13 nt, Streptococcus pneumoniae R6
cuguaguggguug

SEQ ID NO: 4086418 - RNA, 21 nt, Streptococcus pneumoniae R6
cuguaguggguugaaaaaaag

SEQ ID NO: 4086419 - RNA, 12 nt, Streptococcus pneumoniae R6
cuguauacuuuu

SEQ ID NO: 4086420 - RNA, 14 nt, Streptococcus pneumoniae R6
cuguauacuuuuuc

SEQ ID NO: 4086421 - RNA, 15 nt, Streptococcus pneumoniae R6
cuguauacuuuuuca

SEQ ID NO: 4086422 - RNA, 21 nt, Streptococcus pneumoniae R6
cuucaaucucgcuguuuauuu

SEQ ID NO: 4086423 - RNA, 14 nt, Streptococcus pneumoniae R6
cuucaaucucugcu

SEQ ID NO: 4086424 - RNA, 13 nt, Streptococcus pneumoniae R6
cuucaaucuuguc

SEQ ID NO: 4086425 - RNA, 18 nt, Streptococcus pneumoniae R6
cuucaauggaguaaaaaa

SEQ ID NO: 4086426 - RNA, 19 nt, Streptococcus pneumoniae R6
cuucaauggaguaaaaaaa

SEQ ID NO: 4086427 - RNA, 20 nt, Streptococcus pneumoniae R6
cuucaauggaguaaaaaaag

SEQ ID NO: 4086428 - RNA, 13 nt, Streptococcus pneumoniae R6
cuucaauuccuuc

SEQ ID NO: 4086429 - RNA, 21 nt, Streptococcus pneumoniae R6
cuucaauuuguuuugggucug

SEQ ID NO: 4086430 - RNA, 21 nt, Streptococcus pneumoniae R6
cuucacaucacuuucugcaau

SEQ ID NO: 4086431 - RNA, 18 nt, Streptococcus pneumoniae R6
cuucaccaaucaaaucaa

SEQ ID NO: 4086432 - RNA, 16 nt, Streptococcus pneumoniae R6
cuucacgguuuguauu

SEQ ID NO: 4086433 - RNA, 15 nt, Streptococcus pneumoniae R6
cuucacguucuucca

SEQ ID NO: 4086434 - RNA, 15 nt, Streptococcus pneumoniae R6
cuucacucuucaaau

SEQ ID NO: 4086435 - RNA, 23 nt, Streptococcus pneumoniae R6
cuucacuuucccuuuccaagaau

SEQ ID NO: 4086436 - RNA, 23 nt, Streptococcus pneumoniae R6
cuucagauuaguaauucaauuaa

SEQ ID NO: 4086437 - RNA, 21 nt, Streptococcus pneumoniae R6
cuucagauucagcuaaaaugu

SEQ ID NO: 4086438 - RNA, 20 nt, Streptococcus pneumoniae R6
cuucagcccaaccagcugua

SEQ ID NO: 4086439 - RNA, 15 nt, Streptococcus pneumoniae R6
cuucagccuuauauu

SEQ ID NO: 4086440 - RNA, 19 nt, Streptococcus pneumoniae R6
cuucaggauugauaaaauu

SEQ ID NO: 4086441 - RNA, 16 nt, Streptococcus pneumoniae R6
cuucaucaaagcuagu

SEQ ID NO: 4086442 - RNA, 16 nt, Streptococcus pneumoniae R6
cuucaucaguuccagc

SEQ ID NO: 4086443 - RNA, 21 nt, Streptococcus pneumoniae R6
cuucaucauuuuauucauauc

SEQ ID NO: 4086444 - RNA, 17 nt, Streptococcus pneumoniae R6
cuucaucuugucuucaa

SEQ ID NO: 4086445 - RNA, 17 nt, Streptococcus pneumoniae R6
cuucaugaaauuauuuc

SEQ ID NO: 4086446 - RNA, 13 nt, Streptococcus pneumoniae R6
cuucaugcuggca

SEQ ID NO: 4086447 - RNA, 21 nt, Streptococcus pneumoniae R6
cuucauggacuuuuuugcgaa

SEQ ID NO: 4086448 - RNA, 19 nt, Streptococcus pneumoniae R6
cuucauggaucauuucuuc

SEQ ID NO: 4086449 - RNA, 22 nt, Streptococcus pneumoniae R6
cuucauggaucauuucuucugg

SEQ ID NO: 4086450 - RNA, 16 nt, Streptococcus pneumoniae R6
cuucauguuucauauc

SEQ ID NO: 4086451 - RNA, 19 nt, Streptococcus pneumoniae R6
cuucauuaagucauagcca

SEQ ID NO: 4086452 - RNA, 17 nt, Streptococcus pneumoniae R6
cuucauucggucaugga

SEQ ID NO: 4086453 - RNA, 21 nt, Streptococcus pneumoniae R6
cuucauugacagaaccuugga

SEQ ID NO: 4086454 - RNA, 17 nt, Streptococcus pneumoniae R6
cuucauuuagaacacca

SEQ ID NO: 4086455 - RNA, 15 nt, Streptococcus pneumoniae R6
cuucauuuaucuucu

SEQ ID NO: 4086456 - RNA, 16 nt, Streptococcus pneumoniae R6
cuucauuuaucuucuu

SEQ ID NO: 4086457 - RNA, 18 nt, Streptococcus pneumoniae R6
cuucauuuccaaugauga

SEQ ID NO: 4086458 - RNA, 21 nt, Streptococcus pneumoniae R6
cuucauuuugguaauuuucaa

SEQ ID NO: 4086459 - RNA, 19 nt, Streptococcus pneumoniae R6
cuucauuuuugccuaaaau

SEQ ID NO: 4086460 - RNA, 11 nt, Streptococcus pneumoniae R6
cuucauuuuuu

SEQ ID NO: 4086461 - RNA, 14 nt, Streptococcus pneumoniae R6
cuucauuuuuuccu

SEQ ID NO: 4086462 - RNA, 24 nt, Streptococcus pneumoniae R6
cuuccaaaaauucuuacuaccuac

SEQ ID NO: 4086463 - RNA, 13 nt, Streptococcus pneumoniae R6
cuuccaagaccug

SEQ ID NO: 4086464 - RNA, 23 nt, Streptococcus pneumoniae R6
cuuccaauaauagaaaacagaca

SEQ ID NO: 4086465 - RNA, 20 nt, Streptococcus pneumoniae R6
cuuccaauuucuuuucauuc

SEQ ID NO: 4086466 - RNA, 15 nt, Streptococcus pneumoniae R6
cuuccacuuccagaa

SEQ ID NO: 4086467 - RNA, 20 nt, Streptococcus pneumoniae R6
cuuccauauagucuuucaaa

SEQ ID NO: 4086468 - RNA, 20 nt, Streptococcus pneumoniae R6
cuuccauguuguagucugcu

SEQ ID NO: 4086469 - RNA, 21 nt, Streptococcus pneumoniae R6
cuucccaaguaguaguuucag

SEQ ID NO: 4086470 - RNA, 17 nt, Streptococcus pneumoniae R6
cuucccaccauccucca

SEQ ID NO: 4086471 - RNA, 18 nt, Streptococcus pneumoniae R6
cuucccaccauccuccac

SEQ ID NO: 4086472 - RNA, 19 nt, Streptococcus pneumoniae R6
cuucccacccauauuuuuc

SEQ ID NO: 4086473 - RNA, 13 nt, Streptococcus pneumoniae R6
cuucccacuugug

SEQ ID NO: 4086474 - RNA, 17 nt, Streptococcus pneumoniae R6
cuuccgccaucuuguuu

SEQ ID NO: 4086475 - RNA, 19 nt, Streptococcus pneumoniae R6
cuuccuaauuugcacuuug

SEQ ID NO: 4086476 - RNA, 20 nt, Streptococcus pneumoniae R6
cuuccuacugauaucuuuag

SEQ ID NO: 4086477 - RNA, 23 nt, Streptococcus pneumoniae R6
cuuccuagaauaugaacauuuuc

SEQ ID NO: 4086478 - RNA, 23 nt, Streptococcus pneumoniae R6
cuuccugcaaaucuacuggcaaa

SEQ ID NO: 4086479 - RNA, 23 nt, Streptococcus pneumoniae R6
cuuccuguaagaacuuuuuaaag

SEQ ID NO: 4086480 - RNA, 17 nt, Streptococcus pneumoniae R6
cuuccuuaacaucuuug

SEQ ID NO: 4086481 - RNA, 23 nt, Streptococcus pneumoniae R6
cuucgaaaaucucugcaaaccac

SEQ ID NO: 4086482 - RNA, 18 nt, Streptococcus pneumoniae R6
cuucgaaaaucucuucaa

SEQ ID NO: 4086483 - RNA, 18 nt, Streptococcus pneumoniae R6
cuucgacuauuugaguaa

SEQ ID NO: 4086484 - RNA, 15 nt, Streptococcus pneumoniae R6
cuucgcuuccaaucu

SEQ ID NO: 4086485 - RNA, 18 nt, Streptococcus pneumoniae R6
cuucgcuuccaaucucac

SEQ ID NO: 4086486 - RNA, 19 nt, Streptococcus pneumoniae R6
cuucggaauagcucaaaag

SEQ ID NO: 4086487 - RNA, 14 nt, Streptococcus pneumoniae R6
cuucggauaaaauc

SEQ ID NO: 4086488 - RNA, 21 nt, Streptococcus pneumoniae R6
cuucguaaauaagcucuguuu

SEQ ID NO: 4086489 - RNA, 17 nt, Streptococcus pneumoniae R6
cuucguaacgaguuucu

SEQ ID NO: 4086490 - RNA, 19 nt, Streptococcus pneumoniae R6
cuucguaagauucuucugg

SEQ ID NO: 4086491 - RNA, 15 nt, Streptococcus pneumoniae R6
cuucgucagucuuau

SEQ ID NO: 4086492 - RNA, 16 nt, Streptococcus pneumoniae R6
cuucgucagucuuauc

SEQ ID NO: 4086493 - RNA, 14 nt, Streptococcus pneumoniae R6
cuucgucaguucca

SEQ ID NO: 4086494 - RNA, 15 nt, Streptococcus pneumoniae R6
cuucgucaguucuau

SEQ ID NO: 4086495 - RNA, 22 nt, Streptococcus pneumoniae R6
cuucgucaguucuauccacaac

SEQ ID NO: 4086496 - RNA, 18 nt, Streptococcus pneumoniae R6
cuucgucaguucuaucua

SEQ ID NO: 4086497 - RNA, 16 nt, Streptococcus pneumoniae R6
cuucgucaguuucauc

SEQ ID NO: 4086498 - RNA, 21 nt, Streptococcus pneumoniae R6
cuucgucaguuucaucuacaa

SEQ ID NO: 4086499 - RNA, 17 nt, Streptococcus pneumoniae R6
cuucgucguaaccuucu

SEQ ID NO: 4086500 - RNA, 19 nt, Streptococcus pneumoniae R6
cuucgugaaagacaaaggu

SEQ ID NO: 4086501 - RNA, 20 nt, Streptococcus pneumoniae R6
cuucguuuuuacuacaaaga

SEQ ID NO: 4086502 - RNA, 21 nt, Streptococcus pneumoniae R6
cuucuaaaaaggcguucaucc

SEQ ID NO: 4086503 - RNA, 14 nt, Streptococcus pneumoniae R6
cuucuaaaacauug

SEQ ID NO: 4086504 - RNA, 15 nt, Streptococcus pneumoniae R6
cuucuaaaacauugu

SEQ ID NO: 4086505 - RNA, 19 nt, Streptococcus pneumoniae R6
cuucuaaaacauuguuaga

SEQ ID NO: 4086506 - RNA, 22 nt, Streptococcus pneumoniae R6
cuucuaaaacauuguuagaaau

SEQ ID NO: 4086507 - RNA, 15 nt, Streptococcus pneumoniae R6
cuucuaaauuaacua

SEQ ID NO: 4086508 - RNA, 14 nt, Streptococcus pneumoniae R6
cuucuaacagcaug

SEQ ID NO: 4086509 - RNA, 14 nt, Streptococcus pneumoniae R6
cuucuaacauauca

SEQ ID NO: 4086510 - RNA, 19 nt, Streptococcus pneumoniae R6
cuucuaagcucuuaaaagc

SEQ ID NO: 4086511 - RNA, 20 nt, Streptococcus pneumoniae R6
cuucuacaacgucuuuugcc

SEQ ID NO: 4086512 - RNA, 18 nt, Streptococcus pneumoniae R6
cuucuacagcuagcuaga

SEQ ID NO: 4086513 - RNA, 19 nt, Streptococcus pneumoniae R6
cuucuacuccgugaaguga

SEQ ID NO: 4086514 - RNA, 15 nt, Streptococcus pneumoniae R6
cuucuacuuccugcu

SEQ ID NO: 4086515 - RNA, 12 nt, Streptococcus pneumoniae R6
cuucuacuucua

SEQ ID NO: 4086516 - RNA, 21 nt, Streptococcus pneumoniae R6
cuucuagcuaucuccucauau

SEQ ID NO: 4086517 - RNA, 13 nt, Streptococcus pneumoniae R6
cuucuaucuucuu

SEQ ID NO: 4086518 - RNA, 16 nt, Streptococcus pneumoniae R6
cuucucaggcuuuuuc

SEQ ID NO: 4086519 - RNA, 16 nt, Streptococcus pneumoniae R6
cuucuccaguuuuaau

SEQ ID NO: 4086520 - RNA, 14 nt, Streptococcus pneumoniae R6
cuucuccaucuuag

SEQ ID NO: 4086521 - RNA, 17 nt, Streptococcus pneumoniae R6
cuucuccaucuuaggaa

SEQ ID NO: 4086522 - RNA, 19 nt, Streptococcus pneumoniae R6
cuucucgauucccugauuu

SEQ ID NO: 4086523 - RNA, 19 nt, Streptococcus pneumoniae R6
cuucucggacuuuuuccaa

SEQ ID NO: 4086524 - RNA, 23 nt, Streptococcus pneumoniae R6
cuugcguugagcgaaaucugucu

SEQ ID NO: 4086525 - RNA, 16 nt, Streptococcus pneumoniae R6
cuugcguuucuucuuc

SEQ ID NO: 4086526 - RNA, 16 nt, Streptococcus pneumoniae R6
cuugcuagauauuguu

SEQ ID NO: 4086527 - RNA, 22 nt, Streptococcus pneumoniae R6
cuugcuagucauaacugcuuug

SEQ ID NO: 4086528 - RNA, 20 nt, Streptococcus pneumoniae R6
cuugcucaaaguacagauuu

SEQ ID NO: 4086529 - RNA, 21 nt, Streptococcus pneumoniae R6
cuugcucaaaguacagauuug

SEQ ID NO: 4086530 - RNA, 21 nt, Streptococcus pneumoniae R6
cuugcucagaggagaugaauu

SEQ ID NO: 4086531 - RNA, 17 nt, Streptococcus pneumoniae R6
cuugcuccauucuuuua

SEQ ID NO: 4086532 - RNA, 14 nt, Streptococcus pneumoniae R6
cuugcucucccccu

SEQ ID NO: 4086533 - RNA, 14 nt, Streptococcus pneumoniae R6
cuugcucugucacu

SEQ ID NO: 4086534 - RNA, 14 nt, Streptococcus pneumoniae R6
cuugcuucccauuu

SEQ ID NO: 4086535 - RNA, 13 nt, Streptococcus pneumoniae R6
cuugcuugccaug

SEQ ID NO: 4086536 - RNA, 19 nt, Streptococcus pneumoniae R6
cuugcuuuugauggguucu

SEQ ID NO: 4086537 - RNA, 11 nt, Streptococcus pneumoniae R6
cuuggaaaaau

SEQ ID NO: 4086538 - RNA, 16 nt, Streptococcus pneumoniae R6
cuuggaaaucuucugu

SEQ ID NO: 4086539 - RNA, 13 nt, Streptococcus pneumoniae R6
cuuggaccaggau

SEQ ID NO: 4086540 - RNA, 16 nt, Streptococcus pneumoniae R6
cuuggagaaacuccuu

SEQ ID NO: 4086541 - RNA, 15 nt, Streptococcus pneumoniae R6
cuuggagaaccuaga

SEQ ID NO: 4086542 - RNA, 14 nt, Streptococcus pneumoniae R6
cuuggauaccuuua

SEQ ID NO: 4086543 - RNA, 17 nt, Streptococcus pneumoniae R6
cuuggauauucaauucu

SEQ ID NO: 4086544 - RNA, 12 nt, Streptococcus pneumoniae R6
cuuggcaaaauc

SEQ ID NO: 4086545 - RNA, 19 nt, Streptococcus pneumoniae R6
cuuggcagagcuaaaaacu

SEQ ID NO: 4086546 - RNA, 14 nt, Streptococcus pneumoniae R6
cuuggccacuuccc

SEQ ID NO: 4086547 - RNA, 20 nt, Streptococcus pneumoniae R6
cuuggcuaauuucaagaagu

SEQ ID NO: 4086548 - RNA, 16 nt, Streptococcus pneumoniae R6
cuuggcuguuuccuuu

SEQ ID NO: 4086549 - RNA, 14 nt, Streptococcus pneumoniae R6
cuugggaaugauga

SEQ ID NO: 4086550 - RNA, 22 nt, Streptococcus pneumoniae R6
cuugggucguaaaccuucaaga

SEQ ID NO: 4086551 - RNA, 19 nt, Streptococcus pneumoniae R6
cuugguaguugagcuggcu

SEQ ID NO: 4086552 - RNA, 20 nt, Streptococcus pneumoniae R6
cuugguaguugagcuggcuc

SEQ ID NO: 4086553 - RNA, 17 nt, Streptococcus pneumoniae R6
cuuggucauuugagaua

SEQ ID NO: 4086554 - RNA, 14 nt, Streptococcus pneumoniae R6
cuuggugagaaagu

SEQ ID NO: 4086555 - RNA, 13 nt, Streptococcus pneumoniae R6
cuugguuacauca

SEQ ID NO: 4086556 - RNA, 17 nt, Streptococcus pneumoniae R6
cuugguuugucaucguu

SEQ ID NO: 4086557 - RNA, 16 nt, Streptococcus pneumoniae R6
cuugguuuuugccaug

SEQ ID NO: 4086558 - RNA, 19 nt, Streptococcus pneumoniae R6
cuugguuuuuuaggacaau

SEQ ID NO: 4086559 - RNA, 18 nt, Streptococcus pneumoniae R6
cuuguaaccgauauuucc

SEQ ID NO: 4086560 - RNA, 19 nt, Streptococcus pneumoniae R6
cuuguaaccgauauuuccu

SEQ ID NO: 4086561 - RNA, 21 nt, Streptococcus pneumoniae R6
cuuguaagucaagucuucuug

SEQ ID NO: 4086562 - RNA, 23 nt, Streptococcus pneumoniae R6
cuuguaauaagcuuguuaccuga

SEQ ID NO: 4086563 - RNA, 21 nt, Streptococcus pneumoniae R6
cuuguaauagcaguugguugu

SEQ ID NO: 4086564 - RNA, 20 nt, Streptococcus pneumoniae R6
cuuguaaugacaauuauaua

SEQ ID NO: 4086565 - RNA, 12 nt, Streptococcus pneumoniae R6
cuuguagaugaa

SEQ ID NO: 4086566 - RNA, 21 nt, Streptococcus pneumoniae R6
cuuguagaugaaaaauaaucg

SEQ ID NO: 4086567 - RNA, 15 nt, Streptococcus pneumoniae R6
cuuguaguucucaau

SEQ ID NO: 4086568 - RNA, 17 nt, Streptococcus pneumoniae R6
cuuguaguucucaauca

SEQ ID NO: 4086569 - RNA, 15 nt, Streptococcus pneumoniae R6
cuugucaaagaguug

SEQ ID NO: 4086570 - RNA, 14 nt, Streptococcus pneumoniae R6
cuugucaucuucca

SEQ ID NO: 4086571 - RNA, 19 nt, Streptococcus pneumoniae R6
cuugucaugccagauggac

SEQ ID NO: 4086572 - RNA, 14 nt, Streptococcus pneumoniae R6
cuuguccugaauga

SEQ ID NO: 4086573 - RNA, 14 nt, Streptococcus pneumoniae R6
cuugucguugaaaa

SEQ ID NO: 4086574 - RNA, 16 nt, Streptococcus pneumoniae R6
cuugucguugaaaaag

SEQ ID NO: 4086575 - RNA, 21 nt, Streptococcus pneumoniae R6
cuugucguugaaaaagugaga

SEQ ID NO: 4086576 - RNA, 13 nt, Streptococcus pneumoniae R6
cuugucugcaugg

SEQ ID NO: 4086577 - RNA, 13 nt, Streptococcus pneumoniae R6
cuugucuuuuuca

SEQ ID NO: 4086578 - RNA, 15 nt, Streptococcus pneumoniae R6
cuugucuuuuucauc

SEQ ID NO: 4086579 - RNA, 18 nt, Streptococcus pneumoniae R6
cuugugaaagcucuucua

SEQ ID NO: 4086580 - RNA, 21 nt, Streptococcus pneumoniae R6
cuugugaaagcucuucuaaaa

SEQ ID NO: 4086581 - RNA, 15 nt, Streptococcus pneumoniae R6
cuugugaauagcuca

SEQ ID NO: 4086582 - RNA, 20 nt, Streptococcus pneumoniae R6
cuugugauuuaguagcauca

SEQ ID NO: 4086583 - RNA, 18 nt, Streptococcus pneumoniae R6
cuugugcacacucagaac

SEQ ID NO: 4086584 - RNA, 19 nt, Streptococcus pneumoniae R6
cuugugcacacucagaacc

SEQ ID NO: 4086585 - RNA, 19 nt, Streptococcus pneumoniae R6
cuuguggagacagcaccaa

SEQ ID NO: 4086586 - RNA, 23 nt, Streptococcus pneumoniae R6
cuuguggggccagaauaauuaaa

SEQ ID NO: 4086587 - RNA, 15 nt, Streptococcus pneumoniae R6
cuuguguuuuuccuu

SEQ ID NO: 4086588 - RNA, 16 nt, Streptococcus pneumoniae R6
cuuguguuuuuccuuu

SEQ ID NO: 4086589 - RNA, 19 nt, Streptococcus pneumoniae R6
cuuguuagcugauuuuuua

SEQ ID NO: 4086590 - RNA, 13 nt, Streptococcus pneumoniae R6
cuuguucacuuuu

SEQ ID NO: 4086591 - RNA, 15 nt, Streptococcus pneumoniae R6
cuuguuccaauugau

SEQ ID NO: 4086592 - RNA, 23 nt, Streptococcus pneumoniae R6
cuuguucuuggagaaacuccuug

SEQ ID NO: 4086593 - RNA, 21 nt, Streptococcus pneumoniae R6
cuuguugaaugagcuuccagu

SEQ ID NO: 4086594 - RNA, 22 nt, Streptococcus pneumoniae R6
cuuguugaaugagcuuccagua

SEQ ID NO: 4086595 - RNA, 22 nt, Streptococcus pneumoniae R6
cuuguugauguagauugagagc

SEQ ID NO: 4086596 - RNA, 18 nt, Streptococcus pneumoniae R6
cuuguuguugugauaaag

SEQ ID NO: 4086597 - RNA, 18 nt, Streptococcus pneumoniae R6
cuuguuuacguuuuaaaa

SEQ ID NO: 4086598 - RNA, 21 nt, Streptococcus pneumoniae R6
cuuguuuaguaaacaaaggau

SEQ ID NO: 4086599 - RNA, 16 nt, Streptococcus pneumoniae R6
cuuguuucaauugacu

SEQ ID NO: 4086600 - RNA, 18 nt, Streptococcus pneumoniae R6
cuuguuucaauugacuau

SEQ ID NO: 4086601 - RNA, 17 nt, Streptococcus pneumoniae R6
cuuguuugagcucuuug

SEQ ID NO: 4086602 - RNA, 23 nt, Streptococcus pneumoniae R6
cuuguuuuaaaauguugggcaga

SEQ ID NO: 4086603 - RNA, 22 nt, Streptococcus pneumoniae R6
cuuguuuuuauaugauuucaau

SEQ ID NO: 4086604 - RNA, 13 nt, Streptococcus pneumoniae R6
cuuuaaaaaauuu

SEQ ID NO: 4086605 - RNA, 13 nt, Streptococcus pneumoniae R6
cuuuaaaaacaau

SEQ ID NO: 4086606 - RNA, 13 nt, Streptococcus pneumoniae R6
cuuuaaaaauuuu

SEQ ID NO: 4086607 - RNA, 16 nt, Streptococcus pneumoniae R6
cuuuaaaaauuuuuuu

SEQ ID NO: 4086608 - RNA, 19 nt, Streptococcus pneumoniae R6
cuuuaaaaauuuuuuucua

SEQ ID NO: 4086609 - RNA, 13 nt, Streptococcus pneumoniae R6
cuuuaaaauccuc

SEQ ID NO: 4086610 - RNA, 21 nt, Streptococcus pneumoniae R6
cuuuaaauccugcaaagauag

SEQ ID NO: 4086611 - RNA, 20 nt, Streptococcus pneumoniae R6
cuuuaaaucgcuauaaauaa

SEQ ID NO: 4086612 - RNA, 13 nt, Streptococcus pneumoniae R6
cuuuaacaaagaa

SEQ ID NO: 4086613 - RNA, 23 nt, Streptococcus pneumoniae R6
cuuuaacuugaacuucuugacca

SEQ ID NO: 4086614 - RNA, 17 nt, Streptococcus pneumoniae R6
cuuuaagagcuucuuuu

SEQ ID NO: 4086615 - RNA, 16 nt, Streptococcus pneumoniae R6
cuuuaaucuugacuau

SEQ ID NO: 4086616 - RNA, 19 nt, Streptococcus pneumoniae R6
cuuuacaugcgcaaaauaa

SEQ ID NO: 4086617 - RNA, 20 nt, Streptococcus pneumoniae R6
cuuuacaugcgcaaaauaau

SEQ ID NO: 4086618 - RNA, 18 nt, Streptococcus pneumoniae R6
cuuuaccaaaaaugugaa

SEQ ID NO: 4086619 - RNA, 17 nt, Streptococcus pneumoniae R6
cuuuaccaaaaccuucu

SEQ ID NO: 4086620 - RNA, 20 nt, Streptococcus pneumoniae R6
cuuuaccaaaaccuucuuug

SEQ ID NO: 4086621 - RNA, 24 nt, Streptococcus pneumoniae R6
cuuuaccauucgauuuaucuguuu

SEQ ID NO: 4086622 - RNA, 22 nt, Streptococcus pneumoniae R6
cuuuacuucugagguuaaaauc

SEQ ID NO: 4086623 - RNA, 23 nt, Streptococcus pneumoniae R6
cuuuacuucugagguuaaaaucu

SEQ ID NO: 4086624 - RNA, 15 nt, Streptococcus pneumoniae R6
cuuuacuuguuuuag

SEQ ID NO: 4086625 - RNA, 16 nt, Streptococcus pneumoniae R6
cuuuagaaacuaugau

SEQ ID NO: 4086626 - RNA, 13 nt, Streptococcus pneumoniae R6
cuuuuaagaguua

SEQ ID NO: 4086627 - RNA, 17 nt, Streptococcus pneumoniae R6
cuuuuacaauguuguca

SEQ ID NO: 4086628 - RNA, 15 nt, Streptococcus pneumoniae R6
cuuuuacacucaauu

SEQ ID NO: 4086629 - RNA, 21 nt, Streptococcus pneumoniae R6
cuuuuaccugaaauauacuca

SEQ ID NO: 4086630 - RNA, 21 nt, Streptococcus pneumoniae R6
cuuuuacucuaguuuuuauaa

SEQ ID NO: 4086631 - RNA, 14 nt, Streptococcus pneumoniae R6
cuuuuacucucauu

SEQ ID NO: 4086632 - RNA, 18 nt, Streptococcus pneumoniae R6
cuuuuauaauagaaagau

SEQ ID NO: 4086633 - RNA, 15 nt, Streptococcus pneumoniae R6
cuuuuauccaccuau

SEQ ID NO: 4086634 - RNA, 20 nt, Streptococcus pneumoniae R6
cuuuuaugaggugcuuuuug

SEQ ID NO: 4086635 - RNA, 13 nt, Streptococcus pneumoniae R6
cuuuuauuucuug

SEQ ID NO: 4086636 - RNA, 18 nt, Streptococcus pneumoniae R6
cuuuuauuuuuauaacaa

SEQ ID NO: 4086637 - RNA, 19 nt, Streptococcus pneumoniae R6
cuuuucaaaguaauuugag

SEQ ID NO: 4086638 - RNA, 22 nt, Streptococcus pneumoniae R6
cuuuucaaaguuaacuuuucca

SEQ ID NO: 4086639 - RNA, 16 nt, Streptococcus pneumoniae R6
cuuuucaagaacugcu

SEQ ID NO: 4086640 - RNA, 21 nt, Streptococcus pneumoniae R6
cuuuucaagaacugcuaccaa

SEQ ID NO: 4086641 - RNA, 20 nt, Streptococcus pneumoniae R6
cuuuucaauacggucaauca

SEQ ID NO: 4086642 - RNA, 15 nt, Streptococcus pneumoniae R6
cuuuucaccugcuuu

SEQ ID NO: 4086643 - RNA, 13 nt, Streptococcus pneumoniae R6
cuuuucauuauag

SEQ ID NO: 4086644 - RNA, 15 nt, Streptococcus pneumoniae R6
cuuuuccaaacauac

SEQ ID NO: 4086645 - RNA, 14 nt, Streptococcus pneumoniae R6
cuuuuccaagaccu

SEQ ID NO: 4086646 - RNA, 17 nt, Streptococcus pneumoniae R6
cuuuuccaauagauaau

SEQ ID NO: 4086647 - RNA, 21 nt, Streptococcus pneumoniae R6
cuuuuccaauagauaauuuaa

SEQ ID NO: 4086648 - RNA, 12 nt, Streptococcus pneumoniae R6
cuuuuccauugu

SEQ ID NO: 4086649 - RNA, 19 nt, Streptococcus pneumoniae R6
cuuuuccgauaaugcuuug

SEQ ID NO: 4086650 - RNA, 22 nt, Streptococcus pneumoniae R6
cuuuuccuuaacaaucuuacca

SEQ ID NO: 4086651 - RNA, 17 nt, Streptococcus pneumoniae R6
cuuuuccuucauuucca

SEQ ID NO: 4086652 - RNA, 17 nt, Streptococcus pneumoniae R6
cuuuuccuugaccuuau

SEQ ID NO: 4086653 - RNA, 18 nt, Streptococcus pneumoniae R6
cuuuucgaaacucuuuuu

SEQ ID NO: 4086654 - RNA, 22 nt, Streptococcus pneumoniae R6
cuuuucgccuacccacuacacu

SEQ ID NO: 4086655 - RNA, 15 nt, Streptococcus pneumoniae R6
cuuuucuacugaaau

SEQ ID NO: 4086656 - RNA, 13 nt, Streptococcus pneumoniae R6
cuuuucugaggau

SEQ ID NO: 4086657 - RNA, 20 nt, Streptococcus pneumoniae R6
cuuuucuguugauauuucca

SEQ ID NO: 4086658 - RNA, 17 nt, Streptococcus pneumoniae R6
cuuuucuuauucuuggc

SEQ ID NO: 4086659 - RNA, 15 nt, Streptococcus pneumoniae R6
cuuuucuuuaucuuu

SEQ ID NO: 4086660 - RNA, 13 nt, Streptococcus pneumoniae R6
cuuuugaggucac

SEQ ID NO: 4086661 - RNA, 16 nt, Streptococcus pneumoniae R6
cuuuugauagaugacu

SEQ ID NO: 4086662 - RNA, 15 nt, Streptococcus pneumoniae R6
cuuuugcauaaugag

SEQ ID NO: 4086663 - RNA, 19 nt, Streptococcus pneumoniae R6
cuuuugcgucuucuacaac

SEQ ID NO: 4086664 - RNA, 23 nt, Streptococcus pneumoniae R6
cuuuuggacucacuaaaauucua

SEQ ID NO: 4086665 - RNA, 14 nt, Streptococcus pneumoniae R6
cuuuugggacagaa

SEQ ID NO: 4086666 - RNA, 20 nt, Streptococcus pneumoniae R6
cuuuuggggggcaguucaua

SEQ ID NO: 4086667 - RNA, 22 nt, Streptococcus pneumoniae R6
cuuuuggucagaggggugcuga

SEQ ID NO: 4086668 - RNA, 15 nt, Streptococcus pneumoniae R6
cuuuuguauuuugaa

SEQ ID NO: 4086669 - RNA, 21 nt, Streptococcus pneumoniae R6
cuuuuguccuauucuuguuuc

SEQ ID NO: 4086670 - RNA, 20 nt, Streptococcus pneumoniae R6
cuuuugugauuuuaaauuua

SEQ ID NO: 4086671 - RNA, 21 nt, Streptococcus pneumoniae R6
cuuuugugauuuuaaauuuac

SEQ ID NO: 4086672 - RNA, 16 nt, Streptococcus pneumoniae R6
cuuuuguucaucauua

SEQ ID NO: 4086673 - RNA, 13 nt, Streptococcus pneumoniae R6
cuuuuuaaaaaau

SEQ ID NO: 4086674 - RNA, 17 nt, Streptococcus pneumoniae R6
cuuuuuaaaaaaucuuu

SEQ ID NO: 4086675 - RNA, 14 nt, Streptococcus pneumoniae R6
cuuuuuaaauaaau

SEQ ID NO: 4086676 - RNA, 13 nt, Streptococcus pneumoniae R6
cuuuuuacuuaua

SEQ ID NO: 4086677 - RNA, 15 nt, Streptococcus pneumoniae R6
cuuuuuauacucaau

SEQ ID NO: 4086678 - RNA, 20 nt, Streptococcus pneumoniae R6
cuuuuuauacucaaugaaaa

SEQ ID NO: 4086679 - RNA, 15 nt, Streptococcus pneumoniae R6
cuuuuuauauauaaa

SEQ ID NO: 4086680 - RNA, 21 nt, Streptococcus pneumoniae R6
cuuuuuauauauaaaauuuua

SEQ ID NO: 4086681 - RNA, 15 nt, Streptococcus pneumoniae R6
cuuuuuauucuuuuu

SEQ ID NO: 4086682 - RNA, 22 nt, Streptococcus pneumoniae R6
cuuuuucaaauguauuugaaag

SEQ ID NO: 4086683 - RNA, 14 nt, Streptococcus pneumoniae R6
cuuuuucagaacuu

SEQ ID NO: 4086684 - RNA, 18 nt, Streptococcus pneumoniae R6
cuuuuuccaaaucuuugg

SEQ ID NO: 4086685 - RNA, 18 nt, Streptococcus pneumoniae R6
cuuuuucgcuuggauuuu

SEQ ID NO: 4086686 - RNA, 12 nt, Streptococcus pneumoniae R6
cuuuuucuucuu

SEQ ID NO: 4086687 - RNA, 15 nt, Streptococcus pneumoniae R6
cuuuuucuucuuauc

SEQ ID NO: 4086688 - RNA, 15 nt, Streptococcus pneumoniae R6
cuuuuugaaaaacua

SEQ ID NO: 4086689 - RNA, 18 nt, Streptococcus pneumoniae R6
cuuuuugaaaaacuagaa

SEQ ID NO: 4086690 - RNA, 20 nt, Streptococcus pneumoniae R6
cuuuuugguaugaaauagcc

SEQ ID NO: 4086691 - RNA, 14 nt, Streptococcus pneumoniae R6
cuuuuuguaucaau

SEQ ID NO: 4086692 - RNA, 17 nt, Streptococcus pneumoniae R6
cuuuuuguccuucuucu

SEQ ID NO: 4086693 - RNA, 15 nt, Streptococcus pneumoniae R6
cuuuuugugaauaca

SEQ ID NO: 4086694 - RNA, 18 nt, Streptococcus pneumoniae R6
cuuuuugugaauacaaaa

SEQ ID NO: 4086695 - RNA, 14 nt, Streptococcus pneumoniae R6
cuuuuuguguuaaa

SEQ ID NO: 4086696 - RNA, 13 nt, Streptococcus pneumoniae R6
cuuuuuguuuaau

SEQ ID NO: 4086697 - RNA, 13 nt, Streptococcus pneumoniae R6
cuuuuuguuucca

SEQ ID NO: 4086698 - RNA, 17 nt, Streptococcus pneumoniae R6
cuuuuuuaauucuuuuu

SEQ ID NO: 4086699 - RNA, 12 nt, Streptococcus pneumoniae R6
cuuuuuuaccug

SEQ ID NO: 4086700 - RNA, 15 nt, Streptococcus pneumoniae R6
cuuuuuuauaagcaa

SEQ ID NO: 4086701 - RNA, 19 nt, Streptococcus pneumoniae R6
cuuuuuuauacuuuuaaua

SEQ ID NO: 4086702 - RNA, 14 nt, Streptococcus pneumoniae R6
cuuuuuuauagaau

SEQ ID NO: 4086703 - RNA, 17 nt, Streptococcus pneumoniae R6
cuuuuuuauccucaaaa

SEQ ID NO: 4086704 - RNA, 20 nt, Streptococcus pneumoniae R6
cuuuuuuaucuuuccuucgc

SEQ ID NO: 4086705 - RNA, 13 nt, Streptococcus pneumoniae R6
cuuuuuuccagcc

SEQ ID NO: 4086706 - RNA, 17 nt, Streptococcus pneumoniae R6
cuuuuuuccgaauaaau

SEQ ID NO: 4086707 - RNA, 14 nt, Streptococcus pneumoniae R6
cuuuuuucuaaagc

SEQ ID NO: 4086708 - RNA, 19 nt, Streptococcus pneumoniae R6
cuuuuuugauaucuuccuc

SEQ ID NO: 4086709 - RNA, 20 nt, Streptococcus pneumoniae R6
cuuuuuugauaucuuccuca

SEQ ID NO: 4086710 - RNA, 16 nt, Streptococcus pneumoniae R6
cuuuuuugauguucaa

SEQ ID NO: 4086711 - RNA, 19 nt, Streptococcus pneumoniae R6
cuuuuuugauguucagagc

SEQ ID NO: 4086712 - RNA, 16 nt, Streptococcus pneumoniae R6
cuuuuuuggcagauuu

SEQ ID NO: 4086713 - RNA, 19 nt, Streptococcus pneumoniae R6
cuuuuuuguauucacaaaa

SEQ ID NO: 4086714 - RNA, 13 nt, Streptococcus pneumoniae R6
cuuuuuuguuuca

SEQ ID NO: 4086715 - RNA, 14 nt, Streptococcus pneumoniae R6
cuuuuuuguuucuu

SEQ ID NO: 4086716 - RNA, 19 nt, Streptococcus pneumoniae R6
cuuuuuuuaauauaagaau

SEQ ID NO: 4086717 - RNA, 22 nt, Streptococcus pneumoniae R6
cuuuuuuugaaguuuucaaagu

SEQ ID NO: 4086718 - RNA, 12 nt, Streptococcus pneumoniae R6
gaaaaaaacugg

SEQ ID NO: 4086719 - RNA, 16 nt, Streptococcus pneumoniae R6
gaaaaaaaguaaaucu

SEQ ID NO: 4086720 - RNA, 16 nt, Streptococcus pneumoniae R6
gaaaaaagucuuuaaa

SEQ ID NO: 4086721 - RNA, 23 nt, Streptococcus pneumoniae R6
gaaaaaagucuuuaaaaucugaa

SEQ ID NO: 4086722 - RNA, 22 nt, Streptococcus pneumoniae R6
gaaaaaauaggcagaacaagag

SEQ ID NO: 4086723 - RNA, 22 nt, Streptococcus pneumoniae R6
gaaaaacuagaauagaaacaaa

SEQ ID NO: 4086724 - RNA, 18 nt, Streptococcus pneumoniae R6
gaaaaagaaggauugaga

SEQ ID NO: 4086725 - RNA, 23 nt, Streptococcus pneumoniae R6
gaaaaagaaggauugagaagcca

SEQ ID NO: 4086726 - RNA, 16 nt, Streptococcus pneumoniae R6
gaaaaagacuugaaau

SEQ ID NO: 4086727 - RNA, 22 nt, Streptococcus pneumoniae R6
gaaaaagaggugcgagccucuu

SEQ ID NO: 4086728 - RNA, 19 nt, Streptococcus pneumoniae R6
gaaaaagauuuuuuaaaaa

SEQ ID NO: 4086729 - RNA, 22 nt, Streptococcus pneumoniae R6
gaaaguaaaauuaauuucuaua

SEQ ID NO: 4086730 - RNA, 20 nt, Streptococcus pneumoniae R6
gaaagucauauuucuucaau

SEQ ID NO: 4086731 - RNA, 17 nt, Streptococcus pneumoniae R6
gaaagucggaaggcaug

SEQ ID NO: 4086732 - RNA, 12 nt, Streptococcus pneumoniae R6
gaaagugggcug

SEQ ID NO: 4086733 - RNA, 22 nt, Streptococcus pneumoniae R6
gaaaguuuuccaaaggaaccaa

SEQ ID NO: 4086734 - RNA, 22 nt, Streptococcus pneumoniae R6
gaaauaaaaguaacaccucuuc

SEQ ID NO: 4086735 - RNA, 22 nt, Streptococcus pneumoniae R6
gaaauaaaauuugaacaaauua

SEQ ID NO: 4086736 - RNA, 19 nt, Streptococcus pneumoniae R6
gaaauaacucauaauaguc

SEQ ID NO: 4086737 - RNA, 22 nt, Streptococcus pneumoniae R6
gaaauaacucauaauagucucu

SEQ ID NO: 4086738 - RNA, 17 nt, Streptococcus pneumoniae R6
gaaauaagauaugaaca

SEQ ID NO: 4086739 - RNA, 18 nt, Streptococcus pneumoniae R6
gaaauaagauaugaacaa

SEQ ID NO: 4086740 - RNA, 19 nt, Streptococcus pneumoniae R6
gaaauaagauaugaacaaa

SEQ ID NO: 4086741 - RNA, 16 nt, Streptococcus pneumoniae R6
gaaauaagaugugaac

SEQ ID NO: 4086742 - RNA, 22 nt, Streptococcus pneumoniae R6
gaaauaauagacccuuguuucu

SEQ ID NO: 4086743 - RNA, 15 nt, Streptococcus pneumoniae R6
gaaauaaucaaaaua

SEQ ID NO: 4086744 - RNA, 15 nt, Streptococcus pneumoniae R6
gaaauaaucuuucac

SEQ ID NO: 4086745 - RNA, 20 nt, Streptococcus pneumoniae R6
gaaauacuaaaaaaaaaaag

SEQ ID NO: 4086746 - RNA, 22 nt, Streptococcus pneumoniae R6
gaaauacuaaaaaaaaaaagua

SEQ ID NO: 4086747 - RNA, 21 nt, Streptococcus pneumoniae R6
gaaauagagguguacuauucu

SEQ ID NO: 4086748 - RNA, 20 nt, Streptococcus pneumoniae R6
gaaauagcuaaaccuuauuu

SEQ ID NO: 4086749 - RNA, 21 nt, Streptococcus pneumoniae R6
gaaauaguuuagauaaaacua

SEQ ID NO: 4086750 - RNA, 19 nt, Streptococcus pneumoniae R6
gaaauauagaguauuucuc

SEQ ID NO: 4086751 - RNA, 16 nt, Streptococcus pneumoniae R6
gaaauaucgaugcccu

SEQ ID NO: 4086752 - RNA, 13 nt, Streptococcus pneumoniae R6
gaaauauuuuagc

SEQ ID NO: 4086753 - RNA, 12 nt, Streptococcus pneumoniae R6
gaaauauuuuuu

SEQ ID NO: 4086754 - RNA, 23 nt, Streptococcus pneumoniae R6
gaaaucaacugcuguuuucaugu

SEQ ID NO: 4086755 - RNA, 21 nt, Streptococcus pneumoniae R6
gaaaucaaggcagugaauuua

SEQ ID NO: 4086756 - RNA, 23 nt, Streptococcus pneumoniae R6
gaaaucacagugggcuauuccau

SEQ ID NO: 4086757 - RNA, 16 nt, Streptococcus pneumoniae R6
gaaaucacgcuuuucu

SEQ ID NO: 4086758 - RNA, 13 nt, Streptococcus pneumoniae R6
gaaaucagaaaaa

SEQ ID NO: 4086759 - RNA, 14 nt, Streptococcus pneumoniae R6
gaaaucagaaaaaa

SEQ ID NO: 4086760 - RNA, 23 nt, Streptococcus pneumoniae R6
gaaaucagugugacccaagauag

SEQ ID NO: 4086761 - RNA, 21 nt, Streptococcus pneumoniae R6
gaaaucauacugccaagauag

SEQ ID NO: 4086762 - RNA, 14 nt, Streptococcus pneumoniae R6
gaaaucauuugaau

SEQ ID NO: 4086763 - RNA, 16 nt, Streptococcus pneumoniae R6
gaaaucccuacaagga

SEQ ID NO: 4086764 - RNA, 16 nt, Streptococcus pneumoniae R6
gaaauccucuacauga

SEQ ID NO: 4086765 - RNA, 14 nt, Streptococcus pneumoniae R6
gaaaucugaaaaau

SEQ ID NO: 4086766 - RNA, 14 nt, Streptococcus pneumoniae R6
gaaaucuuugauuu

SEQ ID NO: 4086767 - RNA, 18 nt, Streptococcus pneumoniae R6
gaaaugaccugcauacgu

SEQ ID NO: 4086768 - RNA, 17 nt, Streptococcus pneumoniae R6
gaaaugaggacuuucuu

SEQ ID NO: 4086769 - RNA, 18 nt, Streptococcus pneumoniae R6
gaaaugauaauugauuaa

SEQ ID NO: 4086770 - RNA, 20 nt, Streptococcus pneumoniae R6
gaaaugauaauugauuaaga

SEQ ID NO: 4086771 - RNA, 17 nt, Streptococcus pneumoniae R6
gaaaugaucagaccagu

SEQ ID NO: 4086772 - RNA, 18 nt, Streptococcus pneumoniae R6
gaaaugccgauucccaaa

SEQ ID NO: 4086773 - RNA, 20 nt, Streptococcus pneumoniae R6
gaaaugcgccaccaacugca

SEQ ID NO: 4086774 - RNA, 18 nt, Streptococcus pneumoniae R6
gaaauggcuccacggagu

SEQ ID NO: 4086775 - RNA, 14 nt, Streptococcus pneumoniae R6
gaaauuaaauauga

SEQ ID NO: 4086776 - RNA, 14 nt, Streptococcus pneumoniae R6
gaaauuaauuugac

SEQ ID NO: 4086777 - RNA, 22 nt, Streptococcus pneumoniae R6
gaaauuaauuuuacuuuccuga

SEQ ID NO: 4086778 - RNA, 12 nt, Streptococcus pneumoniae R6
gaaauuauuuau

SEQ ID NO: 4086779 - RNA, 21 nt, Streptococcus pneumoniae R6
gaaauucaaaugaauuucuac

SEQ ID NO: 4086780 - RNA, 15 nt, Streptococcus pneumoniae R6
gaaauucaagaauga

SEQ ID NO: 4086781 - RNA, 22 nt, Streptococcus pneumoniae R6
gaaauucgcuuuuuuaaaugcu

SEQ ID NO: 4086782 - RNA, 19 nt, Streptococcus pneumoniae R6
gaaauuggcucaucugcaa

SEQ ID NO: 4086783 - RNA, 20 nt, Streptococcus pneumoniae R6
gaaauugucugagcauucuu

SEQ ID NO: 4086784 - RNA, 13 nt, Streptococcus pneumoniae R6
gaaauuucaacaa

SEQ ID NO: 4086785 - RNA, 15 nt, Streptococcus pneumoniae R6
gaaauuuucuuuuuc

SEQ ID NO: 4086786 - RNA, 18 nt, Streptococcus pneumoniae R6
gaaauuuucuuuuuccua

SEQ ID NO: 4086787 - RNA, 18 nt, Streptococcus pneumoniae R6
gaaauuuuucugcuucuu

SEQ ID NO: 4086788 - RNA, 16 nt, Streptococcus pneumoniae R6
gaacaaaauaguucuc

SEQ ID NO: 4086789 - RNA, 16 nt, Streptococcus pneumoniae R6
gaacaagacuaccgcu

SEQ ID NO: 4086790 - RNA, 19 nt, Streptococcus pneumoniae R6
gaacaagucagcucaaagc

SEQ ID NO: 4086791 - RNA, 22 nt, Streptococcus pneumoniae R6
gaacaauaaaacgcauaauauc

SEQ ID NO: 4086792 - RNA, 15 nt, Streptococcus pneumoniae R6
gaacaauuucacaac

SEQ ID NO: 4086793 - RNA, 12 nt, Streptococcus pneumoniae R6
gaacaccugauu

SEQ ID NO: 4086794 - RNA, 14 nt, Streptococcus pneumoniae R6
gaacagcuugagau

SEQ ID NO: 4086795 - RNA, 21 nt, Streptococcus pneumoniae R6
gaacagugauagcacuugaau

SEQ ID NO: 4086796 - RNA, 20 nt, Streptococcus pneumoniae R6
gaacaguuucggcuguucuu

SEQ ID NO: 4086797 - RNA, 21 nt, Streptococcus pneumoniae R6
gaacaguuucggcuguucuuu

SEQ ID NO: 4086798 - RNA, 17 nt, Streptococcus pneumoniae R6
gaacaucuccaacugca

SEQ ID NO: 4086799 - RNA, 22 nt, Streptococcus pneumoniae R6
gaacauuugaaacgauaauauc

SEQ ID NO: 4086800 - RNA, 19 nt, Streptococcus pneumoniae R6
gaaccaaaccaaacagucu

SEQ ID NO: 4086801 - RNA, 14 nt, Streptococcus pneumoniae R6
gaaccaaugugcag

SEQ ID NO: 4086802 - RNA, 16 nt, Streptococcus pneumoniae R6
gaaccaguacuuucaa

SEQ ID NO: 4086803 - RNA, 15 nt, Streptococcus pneumoniae R6
gaaccaucuucauuu

SEQ ID NO: 4086804 - RNA, 15 nt, Streptococcus pneumoniae R6
gaacccccaugacuu

SEQ ID NO: 4086805 - RNA, 18 nt, Streptococcus pneumoniae R6
gaacccccaugacuucgu

SEQ ID NO: 4086806 - RNA, 17 nt, Streptococcus pneumoniae R6
gaacccuuauuuccugc

SEQ ID NO: 4086807 - RNA, 23 nt, Streptococcus pneumoniae R6
gaaccucuguauaaauagcuaca

SEQ ID NO: 4086808 - RNA, 14 nt, Streptococcus pneumoniae R6
gaaccugugaccca

SEQ ID NO: 4086809 - RNA, 15 nt, Streptococcus pneumoniae R6
gaaccuuaaaaugaa

SEQ ID NO: 4086810 - RNA, 18 nt, Streptococcus pneumoniae R6
gaacgacaugcguuaaaa

SEQ ID NO: 4086811 - RNA, 15 nt, Streptococcus pneumoniae R6
gaacgacucacuuua

SEQ ID NO: 4086812 - RNA, 14 nt, Streptococcus pneumoniae R6
gaacgauaaacaag

SEQ ID NO: 4086813 - RNA, 16 nt, Streptococcus pneumoniae R6
gaacgauguuugcagc

SEQ ID NO: 4086814 - RNA, 20 nt, Streptococcus pneumoniae R6
gaacgauguuugcagcacca

SEQ ID NO: 4086815 - RNA, 18 nt, Streptococcus pneumoniae R6
gaacgccuuaaaaaacca

SEQ ID NO: 4086816 - RNA, 16 nt, Streptococcus pneumoniae R6
gaacggguucuuccaa

SEQ ID NO: 4086817 - RNA, 23 nt, Streptococcus pneumoniae R6
gaacgucuaaacuguacaagaac

SEQ ID NO: 4086818 - RNA, 20 nt, Streptococcus pneumoniae R6
gaacguguucaauagcaccu

SEQ ID NO: 4086819 - RNA, 17 nt, Streptococcus pneumoniae R6
gaacguuuuuaaaucca

SEQ ID NO: 4086820 - RNA, 19 nt, Streptococcus pneumoniae R6
gaacuagagaagccaagag

SEQ ID NO: 4086821 - RNA, 22 nt, Streptococcus pneumoniae R6
gaacuagagaagccaagaguag

SEQ ID NO: 4086822 - RNA, 21 nt, Streptococcus pneumoniae R6
gaacuagcuaacugcuucacu

SEQ ID NO: 4086823 - RNA, 15 nt, Streptococcus pneumoniae R6
gaacuaguaaauugu

SEQ ID NO: 4086824 - RNA, 17 nt, Streptococcus pneumoniae R6
gaacuauaaaaucugaa

SEQ ID NO: 4086825 - RNA, 20 nt, Streptococcus pneumoniae R6
gaacuauaaaaucugaagaa

SEQ ID NO: 4086826 - RNA, 21 nt, Streptococcus pneumoniae R6
gaacuaugggagcuaacucaa

SEQ ID NO: 4086827 - RNA, 20 nt, Streptococcus pneumoniae R6
gaacucacuucccugagacu

SEQ ID NO: 4086828 - RNA, 19 nt, Streptococcus pneumoniae R6
gaacuccagauuaucuucc

SEQ ID NO: 4086829 - RNA, 14 nt, Streptococcus pneumoniae R6
gaacuccagugaaa

SEQ ID NO: 4086830 - RNA, 22 nt, Streptococcus pneumoniae R6
gaacuccuuaaauuuuauacaa

SEQ ID NO: 4086831 - RNA, 20 nt, Streptococcus pneumoniae R6
gaauagaaaguauagucaau

SEQ ID NO: 4086832 - RNA, 13 nt, Streptococcus pneumoniae R6
gaauagaguucua

SEQ ID NO: 4086833 - RNA, 14 nt, Streptococcus pneumoniae R6
gaauagauacaaaa

SEQ ID NO: 4086834 - RNA, 19 nt, Streptococcus pneumoniae R6
gaauagcccacugugauuu

SEQ ID NO: 4086835 - RNA, 13 nt, Streptococcus pneumoniae R6
gaauagcucaaaa

SEQ ID NO: 4086836 - RNA, 16 nt, Streptococcus pneumoniae R6
gaauagcucaaaagcu

SEQ ID NO: 4086837 - RNA, 19 nt, Streptococcus pneumoniae R6
gaauaggcauccgugauuu

SEQ ID NO: 4086838 - RNA, 13 nt, Streptococcus pneumoniae R6
gaauaguaucuga

SEQ ID NO: 4086839 - RNA, 21 nt, Streptococcus pneumoniae R6
gaauaguggaccgaaucugaa

SEQ ID NO: 4086840 - RNA, 14 nt, Streptococcus pneumoniae R6
gaauaguguaguug

SEQ ID NO: 4086841 - RNA, 15 nt, Streptococcus pneumoniae R6
gaauauagacaaaau

SEQ ID NO: 4086842 - RNA, 19 nt, Streptococcus pneumoniae R6
gaauauagaggauauuucc

SEQ ID NO: 4086843 - RNA, 13 nt, Streptococcus pneumoniae R6
gaauauauuucuc

SEQ ID NO: 4086844 - RNA, 18 nt, Streptococcus pneumoniae R6
gaauauccuuauauaucc

SEQ ID NO: 4086845 - RNA, 17 nt, Streptococcus pneumoniae R6
gaauaugaacaaauuga

SEQ ID NO: 4086846 - RNA, 22 nt, Streptococcus pneumoniae R6
gaauauguauuucauuuucuac

SEQ ID NO: 4086847 - RNA, 22 nt, Streptococcus pneumoniae R6
gaauauuaguaaauagaaguuc

SEQ ID NO: 4086848 - RNA, 23 nt, Streptococcus pneumoniae R6
gaauauuuacuaauuaauuaacu

SEQ ID NO: 4086849 - RNA, 15 nt, Streptococcus pneumoniae R6
gaaucaacauaucca

SEQ ID NO: 4086850 - RNA, 21 nt, Streptococcus pneumoniae R6
gaaucaacaugagaauacaaa

SEQ ID NO: 4086851 - RNA, 11 nt, Streptococcus pneumoniae R6
gaaucaauaga

SEQ ID NO: 4086852 - RNA, 15 nt, Streptococcus pneumoniae R6
gaaucaauuucuuca

SEQ ID NO: 4086853 - RNA, 19 nt, Streptococcus pneumoniae R6
gaaucacgaaccuaauuau

SEQ ID NO: 4086854 - RNA, 22 nt, Streptococcus pneumoniae R6
gaaucauaggcauaguaccagu

SEQ ID NO: 4086855 - RNA, 14 nt, Streptococcus pneumoniae R6
gaaucauuuccuuc

SEQ ID NO: 4086856 - RNA, 18 nt, Streptococcus pneumoniae R6
gaaucauuuuguuuuuga

SEQ ID NO: 4086857 - RNA, 12 nt, Streptococcus pneumoniae R6
gaaucccaaaga

SEQ ID NO: 4086858 - RNA, 12 nt, Streptococcus pneumoniae R6
gaaucccaagau

SEQ ID NO: 4086859 - RNA, 22 nt, Streptococcus pneumoniae R6
gaaucccagauaaagcugauuu

SEQ ID NO: 4086860 - RNA, 24 nt, Streptococcus pneumoniae R6
gaaucccuggaggauagcacauga

SEQ ID NO: 4086861 - RNA, 21 nt, Streptococcus pneumoniae R6
gaauccgcacugucguuccuu

SEQ ID NO: 4086862 - RNA, 20 nt, Streptococcus pneumoniae R6
gaaucgacgcuuucuaagga

SEQ ID NO: 4086863 - RNA, 17 nt, Streptococcus pneumoniae R6
gaaucugaugaaccuuc

SEQ ID NO: 4086864 - RNA, 11 nt, Streptococcus pneumoniae R6
gaaucuggcuu

SEQ ID NO: 4086865 - RNA, 21 nt, Streptococcus pneumoniae R6
gaaucuucccguagguuuucu

SEQ ID NO: 4086866 - RNA, 19 nt, Streptococcus pneumoniae R6
gaaugacagcaucgacaaa

SEQ ID NO: 4086867 - RNA, 22 nt, Streptococcus pneumoniae R6
gaaugacuaacccuucuuuuua

SEQ ID NO: 4086868 - RNA, 16 nt, Streptococcus pneumoniae R6
gaaugaguucaaagcu

SEQ ID NO: 4086869 - RNA, 13 nt, Streptococcus pneumoniae R6
gaaugauuucucu

SEQ ID NO: 4086870 - RNA, 14 nt, Streptococcus pneumoniae R6
gaaugauuucucuu

SEQ ID NO: 4086871 - RNA, 20 nt, Streptococcus pneumoniae R6
gaaugauuucucuugcaaua

SEQ ID NO: 4086872 - RNA, 15 nt, Streptococcus pneumoniae R6
gaaugccaaaauucc

SEQ ID NO: 4086873 - RNA, 14 nt, Streptococcus pneumoniae R6
gaaugccaaagaca

SEQ ID NO: 4086874 - RNA, 23 nt, Streptococcus pneumoniae R6
gaaugccuccaagaaagagaaua

SEQ ID NO: 4086875 - RNA, 14 nt, Streptococcus pneumoniae R6
gaaugcuuacuuca

SEQ ID NO: 4086876 - RNA, 16 nt, Streptococcus pneumoniae R6
gaaugcuuacuucacu

SEQ ID NO: 4086877 - RNA, 15 nt, Streptococcus pneumoniae R6
gaaugcuuuuugaaa

SEQ ID NO: 4086878 - RNA, 21 nt, Streptococcus pneumoniae R6
gaaugcuuuuugaaagcagau

SEQ ID NO: 4086879 - RNA, 18 nt, Streptococcus pneumoniae R6
gaauggauuuaucaguau

SEQ ID NO: 4086880 - RNA, 21 nt, Streptococcus pneumoniae R6
gaauggauuuaucaguauauu

SEQ ID NO: 4086881 - RNA, 15 nt, Streptococcus pneumoniae R6
gaauggauuugucau

SEQ ID NO: 4086882 - RNA, 18 nt, Streptococcus pneumoniae R6
gaauggcaaauucuguca

SEQ ID NO: 4086883 - RNA, 14 nt, Streptococcus pneumoniae R6
gaauggccgcagca

SEQ ID NO: 4086884 - RNA, 18 nt, Streptococcus pneumoniae R6
gaauggccuccuucauua

SEQ ID NO: 4086885 - RNA, 22 nt, Streptococcus pneumoniae R6
gaauggcuagaaccacaccucc

SEQ ID NO: 4086886 - RNA, 21 nt, Streptococcus pneumoniae R6
gaauggguuaaaauuuuaucu

SEQ ID NO: 4086887 - RNA, 11 nt, Streptococcus pneumoniae R6
gaauguaguua

SEQ ID NO: 4086888 - RNA, 19 nt, Streptococcus pneumoniae R6
gaauuaagauaaaacuaaa

SEQ ID NO: 4086889 - RNA, 18 nt, Streptococcus pneumoniae R6
gaauuaauggcagugcuu

SEQ ID NO: 4086890 - RNA, 16 nt, Streptococcus pneumoniae R6
gaauuacaugaaacug

SEQ ID NO: 4086891 - RNA, 17 nt, Streptococcus pneumoniae R6
gaauuaggaaaacauga

SEQ ID NO: 4086892 - RNA, 14 nt, Streptococcus pneumoniae R6
gaauuaggcucuuu

SEQ ID NO: 4086893 - RNA, 19 nt, Streptococcus pneumoniae R6
gaauuaggcucuuugucaa

SEQ ID NO: 4086894 - RNA, 16 nt, Streptococcus pneumoniae R6
gaauuagguugaccau

SEQ ID NO: 4086895 - RNA, 22 nt, Streptococcus pneumoniae R6
gaauuagguugaccauuucaau

SEQ ID NO: 4086896 - RNA, 12 nt, Streptococcus pneumoniae R6
gaauuagugaag

SEQ ID NO: 4086897 - RNA, 15 nt, Streptococcus pneumoniae R6
gaauuauaguagagu

SEQ ID NO: 4086898 - RNA, 17 nt, Streptococcus pneumoniae R6
gaauuaucauaguacaa

SEQ ID NO: 4086899 - RNA, 14 nt, Streptococcus pneumoniae R6
gaauuauuuccuug

SEQ ID NO: 4086900 - RNA, 18 nt, Streptococcus pneumoniae R6
gaauucaagcaaaacaaa

SEQ ID NO: 4086901 - RNA, 14 nt, Streptococcus pneumoniae R6
gaauucaauugcag

SEQ ID NO: 4086902 - RNA, 21 nt, Streptococcus pneumoniae R6
gaauucaauugcaggagaaaa

SEQ ID NO: 4086903 - RNA, 22 nt, Streptococcus pneumoniae R6
gaauucaauugcaggagaaaau

SEQ ID NO: 4086904 - RNA, 20 nt, Streptococcus pneumoniae R6
gaauucauuuucuuaaaagc

SEQ ID NO: 4086905 - RNA, 22 nt, Streptococcus pneumoniae R6
gaauucauuuucuuaaaagcuu

SEQ ID NO: 4086906 - RNA, 19 nt, Streptococcus pneumoniae R6
gaauucuaaacauuugauu

SEQ ID NO: 4086907 - RNA, 20 nt, Streptococcus pneumoniae R6
gaauucuccaaucaaauugu

SEQ ID NO: 4086908 - RNA, 15 nt, Streptococcus pneumoniae R6
gaauugaaauaagau

SEQ ID NO: 4086909 - RNA, 19 nt, Streptococcus pneumoniae R6
gaauugauuuaccuuccuc

SEQ ID NO: 4086910 - RNA, 19 nt, Streptococcus pneumoniae R6
gaauuguaggacuuccuuu

SEQ ID NO: 4086911 - RNA, 18 nt, Streptococcus pneumoniae R6
gaauuuaaaaaucuauuu

SEQ ID NO: 4086912 - RNA, 19 nt, Streptococcus pneumoniae R6
gaauuucuuuauuagucaa

SEQ ID NO: 4086913 - RNA, 19 nt, Streptococcus pneumoniae R6
gaauuugaaacaaugaaaa

SEQ ID NO: 4086914 - RNA, 20 nt, Streptococcus pneumoniae R6
gaauuugaaacaaugaaaau

SEQ ID NO: 4086915 - RNA, 18 nt, Streptococcus pneumoniae R6
gaauuuuagugaguccaa

SEQ ID NO: 4086916 - RNA, 20 nt, Streptococcus pneumoniae R6
gaauuuuucgacugugauuu

SEQ ID NO: 4086917 - RNA, 12 nt, Streptococcus pneumoniae R6
gacaaaaacuca

SEQ ID NO: 4086918 - RNA, 16 nt, Streptococcus pneumoniae R6
gacaaaacuaacccua

SEQ ID NO: 4086919 - RNA, 13 nt, Streptococcus pneumoniae R6
gacaaaacuuuuu

SEQ ID NO: 4086920 - RNA, 20 nt, Streptococcus pneumoniae R6
gacaaaagagccucauaaaa

SEQ ID NO: 4086921 - RNA, 15 nt, Streptococcus pneumoniae R6
gacaaacauugacuu

SEQ ID NO: 4086922 - RNA, 13 nt, Streptococcus pneumoniae R6
gacaaagaaaaaa

SEQ ID NO: 4086923 - RNA, 17 nt, Streptococcus pneumoniae R6
gacaaagaaaaaacaaa

SEQ ID NO: 4086924 - RNA, 19 nt, Streptococcus pneumoniae R6
gacaaagagccaaaaaaga

SEQ ID NO: 4086925 - RNA, 21 nt, Streptococcus pneumoniae R6
gacaaagagccauaaaaauaa

SEQ ID NO: 4086926 - RNA, 21 nt, Streptococcus pneumoniae R6
gacaaagagccgaaaaaauag

SEQ ID NO: 4086927 - RNA, 19 nt, Streptococcus pneumoniae R6
gacaaagcgcuggaacuug

SEQ ID NO: 4086928 - RNA, 15 nt, Streptococcus pneumoniae R6
gacaaaguuugaaaa

SEQ ID NO: 4086929 - RNA, 16 nt, Streptococcus pneumoniae R6
gacaaaguuugaaaag

SEQ ID NO: 4086930 - RNA, 23 nt, Streptococcus pneumoniae R6
gacaaauaauuuauccaaaggau

SEQ ID NO: 4086931 - RNA, 21 nt, Streptococcus pneumoniae R6
gacaaauccauucuuuaccag

SEQ ID NO: 4086932 - RNA, 23 nt, Streptococcus pneumoniae R6
gacaaaucguucaggacagucaa

SEQ ID NO: 4086933 - RNA, 16 nt, Streptococcus pneumoniae R6
gacaaaucguuccagc

SEQ ID NO: 4086934 - RNA, 19 nt, Streptococcus pneumoniae R6
gacaaaucuaagucaaaua

SEQ ID NO: 4086935 - RNA, 21 nt, Streptococcus pneumoniae R6
gacaacgcacaccagagauug

SEQ ID NO: 4086936 - RNA, 14 nt, Streptococcus pneumoniae R6
gacaagauacccac

SEQ ID NO: 4086937 - RNA, 14 nt, Streptococcus pneumoniae R6
gacaagcaaucucu

SEQ ID NO: 4086938 - RNA, 18 nt, Streptococcus pneumoniae R6
gacaaggcugcggcuaca

SEQ ID NO: 4086939 - RNA, 21 nt, Streptococcus pneumoniae R6
gacaagggaugaaaccccaag

SEQ ID NO: 4086940 - RNA, 16 nt, Streptococcus pneumoniae R6
gacaaguaaguagcau

SEQ ID NO: 4086941 - RNA, 15 nt, Streptococcus pneumoniae R6
gacaagugaaagugg

SEQ ID NO: 4086942 - RNA, 22 nt, Streptococcus pneumoniae R6
gacaaugcgcaagguuguuaga

SEQ ID NO: 4086943 - RNA, 21 nt, Streptococcus pneumoniae R6
gacaauguaccugcaaauuua

SEQ ID NO: 4086944 - RNA, 19 nt, Streptococcus pneumoniae R6
gacaauuauauaaaccaaa

SEQ ID NO: 4086945 - RNA, 19 nt, Streptococcus pneumoniae R6
gacacaccacuauuagcau

SEQ ID NO: 4086946 - RNA, 17 nt, Streptococcus pneumoniae R6
gacacauucguuccuuu

SEQ ID NO: 4086947 - RNA, 18 nt, Streptococcus pneumoniae R6
gacacauucguuccuuua

SEQ ID NO: 4086948 - RNA, 14 nt, Streptococcus pneumoniae R6
gacaccaaaaagug

SEQ ID NO: 4086949 - RNA, 23 nt, Streptococcus pneumoniae R6
gacacggcaagacgaagcugaca

SEQ ID NO: 4086950 - RNA, 20 nt, Streptococcus pneumoniae R6
gacacuagaugcaucugcca

SEQ ID NO: 4086951 - RNA, 21 nt, Streptococcus pneumoniae R6
gacacuagaugcaucugccag

SEQ ID NO: 4086952 - RNA, 14 nt, Streptococcus pneumoniae R6
gacacuauuuacaa

SEQ ID NO: 4086953 - RNA, 23 nt, Streptococcus pneumoniae R6
gacacuugccuaaacacuucacu

SEQ ID NO: 4086954 - RNA, 22 nt, Streptococcus pneumoniae R6
gacagaauuuugaggauaaaaa

SEQ ID NO: 4086955 - RNA, 23 nt, Streptococcus pneumoniae R6
gacagagacuuuaaacauacuga

SEQ ID NO: 4086956 - RNA, 14 nt, Streptococcus pneumoniae R6
gacagauaagagca

SEQ ID NO: 4086957 - RNA, 12 nt, Streptococcus pneumoniae R6
gacagcaccaac

SEQ ID NO: 4086958 - RNA, 13 nt, Streptococcus pneumoniae R6
gacagcaccaacu

SEQ ID NO: 4086959 - RNA, 18 nt, Streptococcus pneumoniae R6
gacagcaguuaugauaua

SEQ ID NO: 4086960 - RNA, 21 nt, Streptococcus pneumoniae R6
gacagccucaaugauaccauc

SEQ ID NO: 4086961 - RNA, 22 nt, Streptococcus pneumoniae R6
gacagggccuuagcagacuucu

SEQ ID NO: 4086962 - RNA, 23 nt, Streptococcus pneumoniae R6
gacagggccuuagcagacuucuu

SEQ ID NO: 4086963 - RNA, 15 nt, Streptococcus pneumoniae R6
gacagucgcaaagag

SEQ ID NO: 4086964 - RNA, 20 nt, Streptococcus pneumoniae R6
gacagucgcaaagaggaaga

SEQ ID NO: 4086965 - RNA, 20 nt, Streptococcus pneumoniae R6
gacagucugaaaaagaggau

SEQ ID NO: 4086966 - RNA, 16 nt, Streptococcus pneumoniae R6
gacagucugaaaaaua

SEQ ID NO: 4086967 - RNA, 21 nt, Streptococcus pneumoniae R6
gacagugaaaucauacugcca

SEQ ID NO: 4086968 - RNA, 14 nt, Streptococcus pneumoniae R6
gacaguugcauugu

SEQ ID NO: 4086969 - RNA, 15 nt, Streptococcus pneumoniae R6
gacauaaucaagaug

SEQ ID NO: 4086970 - RNA, 18 nt, Streptococcus pneumoniae R6
gacauaaucgcuggcauu

SEQ ID NO: 4086971 - RNA, 15 nt, Streptococcus pneumoniae R6
gacauaccaccaagu

SEQ ID NO: 4086972 - RNA, 15 nt, Streptococcus pneumoniae R6
gacauagucaagcuc

SEQ ID NO: 4086973 - RNA, 23 nt, Streptococcus pneumoniae R6
gacaucagaaccaaaccaaacag

SEQ ID NO: 4086974 - RNA, 19 nt, Streptococcus pneumoniae R6
gacaucauccguacucaug

SEQ ID NO: 4086975 - RNA, 21 nt, Streptococcus pneumoniae R6
gacauccuauuuauuacuuca

SEQ ID NO: 4086976 - RNA, 14 nt, Streptococcus pneumoniae R6
gacaucgucaccau

SEQ ID NO: 4086977 - RNA, 13 nt, Streptococcus pneumoniae R6
gacaucuucuacu

SEQ ID NO: 4086978 - RNA, 17 nt, Streptococcus pneumoniae R6
gacaucuucucaggcuu

SEQ ID NO: 4086979 - RNA, 15 nt, Streptococcus pneumoniae R6
gacaugcguuaaaag

SEQ ID NO: 4086980 - RNA, 18 nt, Streptococcus pneumoniae R6
gacauggaaauuauaaaa

SEQ ID NO: 4086981 - RNA, 13 nt, Streptococcus pneumoniae R6
gacauguauauua

SEQ ID NO: 4086982 - RNA, 14 nt, Streptococcus pneumoniae R6
gacauuaccucuuu

SEQ ID NO: 4086983 - RNA, 15 nt, Streptococcus pneumoniae R6
gaccaaagcaucaau

SEQ ID NO: 4086984 - RNA, 15 nt, Streptococcus pneumoniae R6
gaccaaauccccauc

SEQ ID NO: 4086985 - RNA, 19 nt, Streptococcus pneumoniae R6
gaccaagagacgauuccaa

SEQ ID NO: 4086986 - RNA, 16 nt, Streptococcus pneumoniae R6
gaccaagagcaaaaac

SEQ ID NO: 4086987 - RNA, 21 nt, Streptococcus pneumoniae R6
gaccaagccugagaugauucu

SEQ ID NO: 4086988 - RNA, 14 nt, Streptococcus pneumoniae R6
gaccaaguccucaa

SEQ ID NO: 4086989 - RNA, 22 nt, Streptococcus pneumoniae R6
gaccaaguucuuuucauaaaga

SEQ ID NO: 4086990 - RNA, 16 nt, Streptococcus pneumoniae R6
gaccaaguuuaaggau

SEQ ID NO: 4086991 - RNA, 16 nt, Streptococcus pneumoniae R6
gaccaauccuaugaua

SEQ ID NO: 4086992 - RNA, 21 nt, Streptococcus pneumoniae R6
gaccaauccuaugauacccaa

SEQ ID NO: 4086993 - RNA, 16 nt, Streptococcus pneumoniae R6
gaccaaucuuuuccaa

SEQ ID NO: 4086994 - RNA, 16 nt, Streptococcus pneumoniae R6
gaccaauucuucucuu

SEQ ID NO: 4086995 - RNA, 14 nt, Streptococcus pneumoniae R6
gaccacgaugauga

SEQ ID NO: 4086996 - RNA, 22 nt, Streptococcus pneumoniae R6
gaccacguucugcaacaacagc

SEQ ID NO: 4086997 - RNA, 20 nt, Streptococcus pneumoniae R6
gaccaguucaucaugauaga

SEQ ID NO: 4086998 - RNA, 14 nt, Streptococcus pneumoniae R6
gaccauacauugau

SEQ ID NO: 4086999 - RNA, 18 nt, Streptococcus pneumoniae R6
gaccauacauugauugca

SEQ ID NO: 4087000 - RNA, 21 nt, Streptococcus pneumoniae R6
gaccaugcggaugcaugccau

SEQ ID NO: 4087001 - RNA, 13 nt, Streptococcus pneumoniae R6
gacccaagauagg

SEQ ID NO: 4087002 - RNA, 19 nt, Streptococcus pneumoniae R6
gacccaggcaaagaguccc

SEQ ID NO: 4087003 - RNA, 22 nt, Streptococcus pneumoniae R6
gacccuauauuucaagaauuaa

SEQ ID NO: 4087004 - RNA, 19 nt, Streptococcus pneumoniae R6
gaccgacaaacauugacuu

SEQ ID NO: 4087005 - RNA, 21 nt, Streptococcus pneumoniae R6
gaccgagaguucuuguuucuc

SEQ ID NO: 4087006 - RNA, 18 nt, Streptococcus pneumoniae R6
gaccgauagcuuuugcag

SEQ ID NO: 4087007 - RNA, 23 nt, Streptococcus pneumoniae R6
gaccgauagcuuuugcagcacca

SEQ ID NO: 4087008 - RNA, 15 nt, Streptococcus pneumoniae R6
gaccggauugcuccg

SEQ ID NO: 4087009 - RNA, 13 nt, Streptococcus pneumoniae R6
gaccguauuuuug

SEQ ID NO: 4087010 - RNA, 18 nt, Streptococcus pneumoniae R6
gaccguggaguacuucuu

SEQ ID NO: 4087011 - RNA, 14 nt, Streptococcus pneumoniae R6
gaccguuugaaaaa

SEQ ID NO: 4087012 - RNA, 13 nt, Streptococcus pneumoniae R6
gaccuaaaucacu

SEQ ID NO: 4087013 - RNA, 14 nt, Streptococcus pneumoniae R6
gaccuaaaucacuu

SEQ ID NO: 4087014 - RNA, 22 nt, Streptococcus pneumoniae R6
gaccucagcucccgcuucauuu

SEQ ID NO: 4087015 - RNA, 22 nt, Streptococcus pneumoniae R6
gaccucuaccaagcccucagcc

SEQ ID NO: 4087016 - RNA, 19 nt, Streptococcus pneumoniae R6
gaccugcauacguucaaau

SEQ ID NO: 4087017 - RNA, 15 nt, Streptococcus pneumoniae R6
gaccugccaugcuga

SEQ ID NO: 4087018 - RNA, 20 nt, Streptococcus pneumoniae R6
gaccuguauucauugaaaaa

SEQ ID NO: 4087019 - RNA, 23 nt, Streptococcus pneumoniae R6
gaccuguauucauugaaaaaaua

SEQ ID NO: 4087020 - RNA, 20 nt, Streptococcus pneumoniae R6
gaccuguuuggucagacugg

SEQ ID NO: 4087021 - RNA, 13 nt, Streptococcus pneumoniae R6
gaccuguuuucac

SEQ ID NO: 4087022 - RNA, 14 nt, Streptococcus pneumoniae R6
gaccuugguggcua

SEQ ID NO: 4087023 - RNA, 16 nt, Streptococcus pneumoniae R6
gaccuuuauuggcugc

SEQ ID NO: 4087024 - RNA, 16 nt, Streptococcus pneumoniae R6
gaccuuucagaacuaa

SEQ ID NO: 4087025 - RNA, 20 nt, Streptococcus pneumoniae R6
gaccuuucauaaaguuuucu

SEQ ID NO: 4087026 - RNA, 21 nt, Streptococcus pneumoniae R6
gaccuuugaaaacugaacaag

SEQ ID NO: 4087027 - RNA, 15 nt, Streptococcus pneumoniae R6
gacgaaacgaagaag

SEQ ID NO: 4087028 - RNA, 17 nt, Streptococcus pneumoniae R6
gacgaacccccaugacu

SEQ ID NO: 4087029 - RNA, 14 nt, Streptococcus pneumoniae R6
gacgaagaaaccaa

SEQ ID NO: 4087030 - RNA, 14 nt, Streptococcus pneumoniae R6
gacgaagugcuucu

SEQ ID NO: 4087031 - RNA, 15 nt, Streptococcus pneumoniae R6
gacgaauaaagaaac

SEQ ID NO: 4087032 - RNA, 19 nt, Streptococcus pneumoniae R6
gacgaaucggucugaguuu

SEQ ID NO: 4087033 - RNA, 14 nt, Streptococcus pneumoniae R6
gacgaaugauaauc

SEQ ID NO: 4087034 - RNA, 20 nt, Streptococcus pneumoniae R6
gacgaauuuuuuggcuaaaa

SEQ ID NO: 4087035 - RNA, 22 nt, Streptococcus pneumoniae R6
gagaagccaagaguagagagaa

SEQ ID NO: 4087036 - RNA, 15 nt, Streptococcus pneumoniae R6
gagaagcccauaucu

SEQ ID NO: 4087037 - RNA, 11 nt, Streptococcus pneumoniae R6
gagaauauuua

SEQ ID NO: 4087038 - RNA, 23 nt, Streptococcus pneumoniae R6
gagaaucaacaugagaauacaaa

SEQ ID NO: 4087039 - RNA, 13 nt, Streptococcus pneumoniae R6
gagaaucaucaug

SEQ ID NO: 4087040 - RNA, 21 nt, Streptococcus pneumoniae R6
gagaaucuucccguagguuuu

SEQ ID NO: 4087041 - RNA, 16 nt, Streptococcus pneumoniae R6
gagaaugaaauauaga

SEQ ID NO: 4087042 - RNA, 23 nt, Streptococcus pneumoniae R6
gagaaugcuugcgacaaaaagag

SEQ ID NO: 4087043 - RNA, 12 nt, Streptococcus pneumoniae R6
gagaauuucugg

SEQ ID NO: 4087044 - RNA, 13 nt, Streptococcus pneumoniae R6
gagacaaaaaaaa

SEQ ID NO: 4087045 - RNA, 14 nt, Streptococcus pneumoniae R6
gagacaaaggagcu

SEQ ID NO: 4087046 - RNA, 21 nt, Streptococcus pneumoniae R6
gagacaacgcacaccagagau

SEQ ID NO: 4087047 - RNA, 20 nt, Streptococcus pneumoniae R6
gagacagaaacgaaccuugg

SEQ ID NO: 4087048 - RNA, 14 nt, Streptococcus pneumoniae R6
gagacagaagauag

SEQ ID NO: 4087049 - RNA, 15 nt, Streptococcus pneumoniae R6
gagacagcaccaacu

SEQ ID NO: 4087050 - RNA, 13 nt, Streptococcus pneumoniae R6
gagacagcaguua

SEQ ID NO: 4087051 - RNA, 13 nt, Streptococcus pneumoniae R6
gagacuaaggaga

SEQ ID NO: 4087052 - RNA, 14 nt, Streptococcus pneumoniae R6
gagacuuuaaacau

SEQ ID NO: 4087053 - RNA, 19 nt, Streptococcus pneumoniae R6
gagacuuugguauuacuua

SEQ ID NO: 4087054 - RNA, 15 nt, Streptococcus pneumoniae R6
gagagacagcaguua

SEQ ID NO: 4087055 - RNA, 19 nt, Streptococcus pneumoniae R6
gagagauaaauaucggcag

SEQ ID NO: 4087056 - RNA, 16 nt, Streptococcus pneumoniae R6
gagagauucauucugc

SEQ ID NO: 4087057 - RNA, 15 nt, Streptococcus pneumoniae R6
gagagggucucccag

SEQ ID NO: 4087058 - RNA, 20 nt, Streptococcus pneumoniae R6
gagaguggaacguagaucau

SEQ ID NO: 4087059 - RNA, 21 nt, Streptococcus pneumoniae R6
gagaguuacggguuuuaaacu

SEQ ID NO: 4087060 - RNA, 13 nt, Streptococcus pneumoniae R6
gagaguucugaaa

SEQ ID NO: 4087061 - RNA, 17 nt, Streptococcus pneumoniae R6
gagauaauacaauugcu

SEQ ID NO: 4087062 - RNA, 17 nt, Streptococcus pneumoniae R6
gagauacuuuuuucuua

SEQ ID NO: 4087063 - RNA, 19 nt, Streptococcus pneumoniae R6
gagauagcgcugggcuguc

SEQ ID NO: 4087064 - RNA, 20 nt, Streptococcus pneumoniae R6
gagauaggucacagcccccu

SEQ ID NO: 4087065 - RNA, 14 nt, Streptococcus pneumoniae R6
gagaugaggcgcuc

SEQ ID NO: 4087066 - RNA, 18 nt, Streptococcus pneumoniae R6
gagauuacugauaaaacu

SEQ ID NO: 4087067 - RNA, 20 nt, Streptococcus pneumoniae R6
gagauuacugauaaaacuga

SEQ ID NO: 4087068 - RNA, 20 nt, Streptococcus pneumoniae R6
gagauuauagugguguuuca

SEQ ID NO: 4087069 - RNA, 18 nt, Streptococcus pneumoniae R6
gagauuggauuuucugaa

SEQ ID NO: 4087070 - RNA, 20 nt, Streptococcus pneumoniae R6
gagauuucuccauagauuuc

SEQ ID NO: 4087071 - RNA, 17 nt, Streptococcus pneumoniae R6
gagauuuucauaaacaa

SEQ ID NO: 4087072 - RNA, 14 nt, Streptococcus pneumoniae R6
gagauuuuggaaga

SEQ ID NO: 4087073 - RNA, 16 nt, Streptococcus pneumoniae R6
gagauuuuggaagagu

SEQ ID NO: 4087074 - RNA, 13 nt, Streptococcus pneumoniae R6
gagcaacaaauau

SEQ ID NO: 4087075 - RNA, 21 nt, Streptococcus pneumoniae R6
gagcaaccuacggcuagcuuc

SEQ ID NO: 4087076 - RNA, 13 nt, Streptococcus pneumoniae R6
gagcaaugauaga

SEQ ID NO: 4087077 - RNA, 20 nt, Streptococcus pneumoniae R6
gagcacugcuagcaucaucg

SEQ ID NO: 4087078 - RNA, 15 nt, Streptococcus pneumoniae R6
gagcaguugauggag

SEQ ID NO: 4087079 - RNA, 18 nt, Streptococcus pneumoniae R6
gagcauaggaaguugagc

SEQ ID NO: 4087080 - RNA, 13 nt, Streptococcus pneumoniae R6
gagcauucuuuug

SEQ ID NO: 4087081 - RNA, 22 nt, Streptococcus pneumoniae R6
gagccaauacugcucgguaaaa

SEQ ID NO: 4087082 - RNA, 24 nt, Streptococcus pneumoniae R6
gagccaguuuucguagcauaucca

SEQ ID NO: 4087083 - RNA, 15 nt, Streptococcus pneumoniae R6
gagcccauguuuucu

SEQ ID NO: 4087084 - RNA, 19 nt, Streptococcus pneumoniae R6
gagcccauguuuucucaau

SEQ ID NO: 4087085 - RNA, 16 nt, Streptococcus pneumoniae R6
gagccggaaauugucu

SEQ ID NO: 4087086 - RNA, 20 nt, Streptococcus pneumoniae R6
gagccggggggcucuuuuua

SEQ ID NO: 4087087 - RNA, 13 nt, Streptococcus pneumoniae R6
gagccuucuucca

SEQ ID NO: 4087088 - RNA, 17 nt, Streptococcus pneumoniae R6
gagccuuuuuaaagaua

SEQ ID NO: 4087089 - RNA, 22 nt, Streptococcus pneumoniae R6
gagcgaauaccaccaaucauuu

SEQ ID NO: 4087090 - RNA, 17 nt, Streptococcus pneumoniae R6
gagcgauaaaaauccuu

SEQ ID NO: 4087091 - RNA, 18 nt, Streptococcus pneumoniae R6
gagcgcaggaagaaagag

SEQ ID NO: 4087092 - RNA, 21 nt, Streptococcus pneumoniae R6
gagcuacguucugucaaacca

SEQ ID NO: 4087093 - RNA, 23 nt, Streptococcus pneumoniae R6
gagcuauuagaugguauugacug

SEQ ID NO: 4087094 - RNA, 12 nt, Streptococcus pneumoniae R6
gagcuccaaaga

SEQ ID NO: 4087095 - RNA, 20 nt, Streptococcus pneumoniae R6
gagcuccaaagaagauaauc

SEQ ID NO: 4087096 - RNA, 11 nt, Streptococcus pneumoniae R6
gagcugacuuc

SEQ ID NO: 4087097 - RNA, 21 nt, Streptococcus pneumoniae R6
gagcugacuucgucaguucua

SEQ ID NO: 4087098 - RNA, 19 nt, Streptococcus pneumoniae R6
gagcuggaucuugaggaag

SEQ ID NO: 4087099 - RNA, 19 nt, Streptococcus pneumoniae R6
gagcuggccgacaucagaa

SEQ ID NO: 4087100 - RNA, 12 nt, Streptococcus pneumoniae R6
gagcuggcucau

SEQ ID NO: 4087101 - RNA, 16 nt, Streptococcus pneumoniae R6
gagcuggggcuacugg

SEQ ID NO: 4087102 - RNA, 18 nt, Streptococcus pneumoniae R6
gagcuuagcuuuucuuca

SEQ ID NO: 4087103 - RNA, 19 nt, Streptococcus pneumoniae R6
gagcuuagcuuuucuucaa

SEQ ID NO: 4087104 - RNA, 20 nt, Streptococcus pneumoniae R6
gagcuuccaguagcgcuuga

SEQ ID NO: 4087105 - RNA, 16 nt, Streptococcus pneumoniae R6
gagcuucuuuuggauu

SEQ ID NO: 4087106 - RNA, 18 nt, Streptococcus pneumoniae R6
gagcuuuuauuucuugaa

SEQ ID NO: 4087107 - RNA, 20 nt, Streptococcus pneumoniae R6
gaggaagguuuuaaacaaag

SEQ ID NO: 4087108 - RNA, 19 nt, Streptococcus pneumoniae R6
gaggaauaaaugcaaagcc

SEQ ID NO: 4087109 - RNA, 19 nt, Streptococcus pneumoniae R6
gaggacaguuauagggauu

SEQ ID NO: 4087110 - RNA, 18 nt, Streptococcus pneumoniae R6
gaggagaauuuuugagau

SEQ ID NO: 4087111 - RNA, 21 nt, Streptococcus pneumoniae R6
gaggaguaggaguaguaaaac

SEQ ID NO: 4087112 - RNA, 14 nt, Streptococcus pneumoniae R6
gaggagugauaaug

SEQ ID NO: 4087113 - RNA, 18 nt, Streptococcus pneumoniae R6
gaggauaaaaaagaagga

SEQ ID NO: 4087114 - RNA, 16 nt, Streptococcus pneumoniae R6
gaggauggcuuucuuu

SEQ ID NO: 4087115 - RNA, 15 nt, Streptococcus pneumoniae R6
gaggauuucacgcac

SEQ ID NO: 4087116 - RNA, 22 nt, Streptococcus pneumoniae R6
gaggcaaugacaacaccgacag

SEQ ID NO: 4087117 - RNA, 20 nt, Streptococcus pneumoniae R6
gagggcugagaaggcugguu

SEQ ID NO: 4087118 - RNA, 21 nt, Streptococcus pneumoniae R6
gagggcugcguugaggacagg

SEQ ID NO: 4087119 - RNA, 23 nt, Streptococcus pneumoniae R6
gaggggugauuuuauauaaaaua

SEQ ID NO: 4087120 - RNA, 23 nt, Streptococcus pneumoniae R6
gaggguccgaaccacaacaaaaa

SEQ ID NO: 4087121 - RNA, 17 nt, Streptococcus pneumoniae R6
gagguaaaucccaagua

SEQ ID NO: 4087122 - RNA, 20 nt, Streptococcus pneumoniae R6
gagguaaaucccaaguaaau

SEQ ID NO: 4087123 - RNA, 18 nt, Streptococcus pneumoniae R6
gaggucgcugugauaaug

SEQ ID NO: 4087124 - RNA, 14 nt, Streptococcus pneumoniae R6
gaggucugaaacua

SEQ ID NO: 4087125 - RNA, 15 nt, Streptococcus pneumoniae R6
gagguguaaguccuc

SEQ ID NO: 4087126 - RNA, 16 nt, Streptococcus pneumoniae R6
gagguuaacuccuuug

SEQ ID NO: 4087127 - RNA, 14 nt, Streptococcus pneumoniae R6
gaguaaaaaaagag

SEQ ID NO: 4087128 - RNA, 18 nt, Streptococcus pneumoniae R6
gaguaaaagauaaucauc

SEQ ID NO: 4087129 - RNA, 13 nt, Streptococcus pneumoniae R6
gaguaaacuagaa

SEQ ID NO: 4087130 - RNA, 18 nt, Streptococcus pneumoniae R6
gaguaacaucaauaacca

SEQ ID NO: 4087131 - RNA, 20 nt, Streptococcus pneumoniae R6
gaguaacaucaauaaccauc

SEQ ID NO: 4087132 - RNA, 19 nt, Streptococcus pneumoniae R6
gaguaaugggcgcauuuuc

SEQ ID NO: 4087133 - RNA, 21 nt, Streptococcus pneumoniae R6
gaguaaugggcgcauuuuccu

SEQ ID NO: 4087134 - RNA, 19 nt, Streptococcus pneumoniae R6
gaguacggaugcaaaacca

SEQ ID NO: 4087135 - RNA, 15 nt, Streptococcus pneumoniae R6
gaguagcauccccag

SEQ ID NO: 4087136 - RNA, 15 nt, Streptococcus pneumoniae R6
gaguauaaaaucaaa

SEQ ID NO: 4087137 - RNA, 11 nt, Streptococcus pneumoniae R6
gauagccaacu

SEQ ID NO: 4087138 - RNA, 22 nt, Streptococcus pneumoniae R6
gauagccaacucauacuuucua

SEQ ID NO: 4087139 - RNA, 22 nt, Streptococcus pneumoniae R6
gauagcuccaucuccaacugcu

SEQ ID NO: 4087140 - RNA, 17 nt, Streptococcus pneumoniae R6
gauagcugcagcugagg

SEQ ID NO: 4087141 - RNA, 14 nt, Streptococcus pneumoniae R6
gauagcuuuugcag

SEQ ID NO: 4087142 - RNA, 14 nt, Streptococcus pneumoniae R6
gauaggugcugguu

SEQ ID NO: 4087143 - RNA, 16 nt, Streptococcus pneumoniae R6
gauaguaucaaaugac

SEQ ID NO: 4087144 - RNA, 18 nt, Streptococcus pneumoniae R6
gauagugguguuucaagu

SEQ ID NO: 4087145 - RNA, 11 nt, Streptococcus pneumoniae R6
gauaguuuuuc

SEQ ID NO: 4087146 - RNA, 13 nt, Streptococcus pneumoniae R6
gauaguuuuuccc

SEQ ID NO: 4087147 - RNA, 19 nt, Streptococcus pneumoniae R6
gauauaauaaaaagagaag

SEQ ID NO: 4087148 - RNA, 18 nt, Streptococcus pneumoniae R6
gauauaaugguuauaucu

SEQ ID NO: 4087149 - RNA, 15 nt, Streptococcus pneumoniae R6
gauauacguuuucuu

SEQ ID NO: 4087150 - RNA, 18 nt, Streptococcus pneumoniae R6
gauauagauaccugguuc

SEQ ID NO: 4087151 - RNA, 21 nt, Streptococcus pneumoniae R6
gauauagccuguaaaaaguga

SEQ ID NO: 4087152 - RNA, 12 nt, Streptococcus pneumoniae R6
gauauaggaggg

SEQ ID NO: 4087153 - RNA, 18 nt, Streptococcus pneumoniae R6
gauauaguuaaaaaagau

SEQ ID NO: 4087154 - RNA, 15 nt, Streptococcus pneumoniae R6
gauauauaaaugaaa

SEQ ID NO: 4087155 - RNA, 22 nt, Streptococcus pneumoniae R6
gauauauugacuuuugaaaaaa

SEQ ID NO: 4087156 - RNA, 23 nt, Streptococcus pneumoniae R6
gauaucaaacuuuuuaguuuuug

SEQ ID NO: 4087157 - RNA, 20 nt, Streptococcus pneumoniae R6
gauaucaauuccacgagcca

SEQ ID NO: 4087158 - RNA, 18 nt, Streptococcus pneumoniae R6
gauaucaccaucaaggac

SEQ ID NO: 4087159 - RNA, 14 nt, Streptococcus pneumoniae R6
gauaucucuuugaa

SEQ ID NO: 4087160 - RNA, 17 nt, Streptococcus pneumoniae R6
gauaucuggauuuucaa

SEQ ID NO: 4087161 - RNA, 13 nt, Streptococcus pneumoniae R6
gauaucugguugc

SEQ ID NO: 4087162 - RNA, 20 nt, Streptococcus pneumoniae R6
gauaucuuccaguuuauaac

SEQ ID NO: 4087163 - RNA, 12 nt, Streptococcus pneumoniae R6
gauaucuugaag

SEQ ID NO: 4087164 - RNA, 12 nt, Streptococcus pneumoniae R6
gauaugaacaaa

SEQ ID NO: 4087165 - RNA, 20 nt, Streptococcus pneumoniae R6
gauaugagcccauguuuucu

SEQ ID NO: 4087166 - RNA, 19 nt, Streptococcus pneumoniae R6
gauaugaggagaaagaaga

SEQ ID NO: 4087167 - RNA, 18 nt, Streptococcus pneumoniae R6
gauauuaagaaucuuuuc

SEQ ID NO: 4087168 - RNA, 17 nt, Streptococcus pneumoniae R6
gauauuauuucaaagaa

SEQ ID NO: 4087169 - RNA, 12 nt, Streptococcus pneumoniae R6
gauauucagagc

SEQ ID NO: 4087170 - RNA, 21 nt, Streptococcus pneumoniae R6
gauauucagagcgauaaaaau

SEQ ID NO: 4087171 - RNA, 14 nt, Streptococcus pneumoniae R6
gauauucuuuucaa

SEQ ID NO: 4087172 - RNA, 20 nt, Streptococcus pneumoniae R6
gauauuguucuaguuuuuug

SEQ ID NO: 4087173 - RNA, 17 nt, Streptococcus pneumoniae R6
gauauuuucaaaaaaau

SEQ ID NO: 4087174 - RNA, 13 nt, Streptococcus pneumoniae R6
gaucaaccaguug

SEQ ID NO: 4087175 - RNA, 22 nt, Streptococcus pneumoniae R6
gaucaaccgauuuaagauaagu

SEQ ID NO: 4087176 - RNA, 22 nt, Streptococcus pneumoniae R6
gaucaagcguuuuucuucugua

SEQ ID NO: 4087177 - RNA, 15 nt, Streptococcus pneumoniae R6
gaucagaccaguuuc

SEQ ID NO: 4087178 - RNA, 18 nt, Streptococcus pneumoniae R6
gaucagaguagucuuuuu

SEQ ID NO: 4087179 - RNA, 23 nt, Streptococcus pneumoniae R6
gaucaugagugggcucauguaaa

SEQ ID NO: 4087180 - RNA, 21 nt, Streptococcus pneumoniae R6
gaucauggauuuuucuuauuu

SEQ ID NO: 4087181 - RNA, 13 nt, Streptococcus pneumoniae R6
gaucauuucuucu

SEQ ID NO: 4087182 - RNA, 23 nt, Streptococcus pneumoniae R6
gaucccaacuccuccuucauauu

SEQ ID NO: 4087183 - RNA, 14 nt, Streptococcus pneumoniae R6
gaucccauggugca

SEQ ID NO: 4087184 - RNA, 19 nt, Streptococcus pneumoniae R6
gaucccauggugcaaguac

SEQ ID NO: 4087185 - RNA, 18 nt, Streptococcus pneumoniae R6
gauccuucaaauccugca

SEQ ID NO: 4087186 - RNA, 23 nt, Streptococcus pneumoniae R6
gaucuagcugagacagggaauug

SEQ ID NO: 4087187 - RNA, 22 nt, Streptococcus pneumoniae R6
gaucugacuucgucaguucuau

SEQ ID NO: 4087188 - RNA, 14 nt, Streptococcus pneumoniae R6
gaucuggcaggcug

SEQ ID NO: 4087189 - RNA, 14 nt, Streptococcus pneumoniae R6
gaucuuaaauuuuc

SEQ ID NO: 4087190 - RNA, 18 nt, Streptococcus pneumoniae R6
gaucuuauuagucaagag

SEQ ID NO: 4087191 - RNA, 19 nt, Streptococcus pneumoniae R6
gaucuuggauauucaauuc

SEQ ID NO: 4087192 - RNA, 15 nt, Streptococcus pneumoniae R6
gaucuugucugcaug

SEQ ID NO: 4087193 - RNA, 16 nt, Streptococcus pneumoniae R6
gaucuugucugcaugg

SEQ ID NO: 4087194 - RNA, 22 nt, Streptococcus pneumoniae R6
gaucuuuuuauacucaaugaaa

SEQ ID NO: 4087195 - RNA, 14 nt, Streptococcus pneumoniae R6
gaugaaaaaaaguu

SEQ ID NO: 4087196 - RNA, 11 nt, Streptococcus pneumoniae R6
gaugaaacccc

SEQ ID NO: 4087197 - RNA, 13 nt, Streptococcus pneumoniae R6
gaugaaaccccaa

SEQ ID NO: 4087198 - RNA, 20 nt, Streptococcus pneumoniae R6
gaugaaaccccaagaaacaa

SEQ ID NO: 4087199 - RNA, 21 nt, Streptococcus pneumoniae R6
gaugaaaccccaagaaacaac

SEQ ID NO: 4087200 - RNA, 21 nt, Streptococcus pneumoniae R6
gaugaaccugcuuuagauugu

SEQ ID NO: 4087201 - RNA, 20 nt, Streptococcus pneumoniae R6
gaugaaccuucaucaaauga

SEQ ID NO: 4087202 - RNA, 14 nt, Streptococcus pneumoniae R6
gaugaagauugaua

SEQ ID NO: 4087203 - RNA, 21 nt, Streptococcus pneumoniae R6
gaugaaguaaaugugagcuuu

SEQ ID NO: 4087204 - RNA, 22 nt, Streptococcus pneumoniae R6
gaugaaucugaaucaaaauuau

SEQ ID NO: 4087205 - RNA, 19 nt, Streptococcus pneumoniae R6
gaugaauuacaugaaacug

SEQ ID NO: 4087206 - RNA, 14 nt, Streptococcus pneumoniae R6
gaugacaaaaauag

SEQ ID NO: 4087207 - RNA, 19 nt, Streptococcus pneumoniae R6
gaugacaaaacguucccaa

SEQ ID NO: 4087208 - RNA, 20 nt, Streptococcus pneumoniae R6
gaugacaauagcuaauagaa

SEQ ID NO: 4087209 - RNA, 22 nt, Streptococcus pneumoniae R6
gaugacccaagcuuuaugcuug

SEQ ID NO: 4087210 - RNA, 13 nt, Streptococcus pneumoniae R6
gaugacuucagcu

SEQ ID NO: 4087211 - RNA, 14 nt, Streptococcus pneumoniae R6
gaugacuucagcuc

SEQ ID NO: 4087212 - RNA, 18 nt, Streptococcus pneumoniae R6
gaugacuucuuaaucaau

SEQ ID NO: 4087213 - RNA, 20 nt, Streptococcus pneumoniae R6
gaugacuuuuaagaaaucau

SEQ ID NO: 4087214 - RNA, 16 nt, Streptococcus pneumoniae R6
gaugagacgagcaguu

SEQ ID NO: 4087215 - RNA, 17 nt, Streptococcus pneumoniae R6
gaugagggucaacuugu

SEQ ID NO: 4087216 - RNA, 17 nt, Streptococcus pneumoniae R6
gaugaguaaguuuuugu

SEQ ID NO: 4087217 - RNA, 20 nt, Streptococcus pneumoniae R6
gaugauauugcaguauaucu

SEQ ID NO: 4087218 - RNA, 14 nt, Streptococcus pneumoniae R6
gaugauguucauaa

SEQ ID NO: 4087219 - RNA, 14 nt, Streptococcus pneumoniae R6
gaugauguuuaaaa

SEQ ID NO: 4087220 - RNA, 19 nt, Streptococcus pneumoniae R6
gaugauucucagguuuuuc

SEQ ID NO: 4087221 - RNA, 20 nt, Streptococcus pneumoniae R6
gaugauuuaauuagaaaaaa

SEQ ID NO: 4087222 - RNA, 19 nt, Streptococcus pneumoniae R6
gaugccuuuuauaauagaa

SEQ ID NO: 4087223 - RNA, 16 nt, Streptococcus pneumoniae R6
gaugcuacuauauucu

SEQ ID NO: 4087224 - RNA, 21 nt, Streptococcus pneumoniae R6
gaugcugacaagucauccaug

SEQ ID NO: 4087225 - RNA, 22 nt, Streptococcus pneumoniae R6
gaugcuggcuuuucagcuucua

SEQ ID NO: 4087226 - RNA, 19 nt, Streptococcus pneumoniae R6
gauggaaauauaggccaag

SEQ ID NO: 4087227 - RNA, 13 nt, Streptococcus pneumoniae R6
gauggaacugacg

SEQ ID NO: 4087228 - RNA, 15 nt, Streptococcus pneumoniae R6
gauggaacugacgaa

SEQ ID NO: 4087229 - RNA, 16 nt, Streptococcus pneumoniae R6
gauggacaacaaugag

SEQ ID NO: 4087230 - RNA, 21 nt, Streptococcus pneumoniae R6
gauggacuguuauagauucaa

SEQ ID NO: 4087231 - RNA, 20 nt, Streptococcus pneumoniae R6
gauggacuuuaucaccuccu

SEQ ID NO: 4087232 - RNA, 16 nt, Streptococcus pneumoniae R6
gauggaguuccuccau

SEQ ID NO: 4087233 - RNA, 14 nt, Streptococcus pneumoniae R6
gauggaguuuucaa

SEQ ID NO: 4087234 - RNA, 19 nt, Streptococcus pneumoniae R6
gauggauacuuaacuuugu

SEQ ID NO: 4087235 - RNA, 19 nt, Streptococcus pneumoniae R6
gaugggcucuuuuuuuguc

SEQ ID NO: 4087236 - RNA, 17 nt, Streptococcus pneumoniae R6
gaugguaguuuacccca

SEQ ID NO: 4087237 - RNA, 23 nt, Streptococcus pneumoniae R6
gauggugacgaugucuugguaua

SEQ ID NO: 4087238 - RNA, 18 nt, Streptococcus pneumoniae R6
gaugucaccaaacaaauc

SEQ ID NO: 4087239 - RNA, 15 nt, Streptococcus pneumoniae R6
gauuuguucucuuug

SEQ ID NO: 4087240 - RNA, 22 nt, Streptococcus pneumoniae R6
gauuuuaauaauuuuguuaaga

SEQ ID NO: 4087241 - RNA, 21 nt, Streptococcus pneumoniae R6
gauuuuagauuuuuuaacaua

SEQ ID NO: 4087242 - RNA, 12 nt, Streptococcus pneumoniae R6
gauuuuauccaa

SEQ ID NO: 4087243 - RNA, 18 nt, Streptococcus pneumoniae R6
gauuuuauugucuuuauu

SEQ ID NO: 4087244 - RNA, 22 nt, Streptococcus pneumoniae R6
gauuuucauugacucuaacugu

SEQ ID NO: 4087245 - RNA, 16 nt, Streptococcus pneumoniae R6
gauuuuccuaaucaau

SEQ ID NO: 4087246 - RNA, 17 nt, Streptococcus pneumoniae R6
gauuuucgaaaauucuu

SEQ ID NO: 4087247 - RNA, 19 nt, Streptococcus pneumoniae R6
gauuuucgaagaguauaaa

SEQ ID NO: 4087248 - RNA, 21 nt, Streptococcus pneumoniae R6
gauuuucuggcagauuuugaa

SEQ ID NO: 4087249 - RNA, 12 nt, Streptococcus pneumoniae R6
gauuuugaaaau

SEQ ID NO: 4087250 - RNA, 22 nt, Streptococcus pneumoniae R6
gauuuugccaaguuucuuuauu

SEQ ID NO: 4087251 - RNA, 16 nt, Streptococcus pneumoniae R6
gauuuuguaaaaauag

SEQ ID NO: 4087252 - RNA, 18 nt, Streptococcus pneumoniae R6
gauuuuuaaauucuucca

SEQ ID NO: 4087253 - RNA, 23 nt, Streptococcus pneumoniae R6
gauuuuucaaggugaaguucacg

SEQ ID NO: 4087254 - RNA, 17 nt, Streptococcus pneumoniae R6
gauuuuucuguuuucuu

SEQ ID NO: 4087255 - RNA, 19 nt, Streptococcus pneumoniae R6
gauuuuuggaaaaaauaaa

SEQ ID NO: 4087256 - RNA, 19 nt, Streptococcus pneumoniae R6
gauuuuuguguuuuuucuu

SEQ ID NO: 4087257 - RNA, 16 nt, Streptococcus pneumoniae R6
gauuuuuuagcuucuu

SEQ ID NO: 4087258 - RNA, 20 nt, Streptococcus pneumoniae R6
gauuuuuucaccaaaaccaa

SEQ ID NO: 4087259 - RNA, 13 nt, Streptococcus pneumoniae R6
gauuuuuuccuug

SEQ ID NO: 4087260 - RNA, 19 nt, Streptococcus pneumoniae R6
gauuuuuucugucuaacuu

SEQ ID NO: 4087261 - RNA, 17 nt, Streptococcus pneumoniae R6
gauuuuuuucaaacaau

SEQ ID NO: 4087262 - RNA, 16 nt, Streptococcus pneumoniae R6
gauuuuuuugauuucu

SEQ ID NO: 4087263 - RNA, 10 nt, Streptococcus pneumoniae R6
gcaaaaaaag

SEQ ID NO: 4087264 - RNA, 14 nt, Streptococcus pneumoniae R6
gcaaaaacaauugc

SEQ ID NO: 4087265 - RNA, 21 nt, Streptococcus pneumoniae R6
gcaaaaacaauugcccaaagc

SEQ ID NO: 4087266 - RNA, 22 nt, Streptococcus pneumoniae R6
gcaaaagcagcgacauugacug

SEQ ID NO: 4087267 - RNA, 22 nt, Streptococcus pneumoniae R6
gcaaaagccgauaccuaucgag

SEQ ID NO: 4087268 - RNA, 21 nt, Streptococcus pneumoniae R6
gcaaaaucgcaauuuaauacu

SEQ ID NO: 4087269 - RNA, 21 nt, Streptococcus pneumoniae R6
gcaaacuucuaaggaaaaagg

SEQ ID NO: 4087270 - RNA, 15 nt, Streptococcus pneumoniae R6
gcaaacuuggucgcu

SEQ ID NO: 4087271 - RNA, 22 nt, Streptococcus pneumoniae R6
gcaaacuuuccaauauguucua

SEQ ID NO: 4087272 - RNA, 14 nt, Streptococcus pneumoniae R6
gcaaagaaaaggaa

SEQ ID NO: 4087273 - RNA, 18 nt, Streptococcus pneumoniae R6
gcaaagaggaagaggaca

SEQ ID NO: 4087274 - RNA, 19 nt, Streptococcus pneumoniae R6
gcaaagauguucucaaccu

SEQ ID NO: 4087275 - RNA, 12 nt, Streptococcus pneumoniae R6
gcaaagcaaucu

SEQ ID NO: 4087276 - RNA, 18 nt, Streptococcus pneumoniae R6
gcaaagcagaugcaaaag

SEQ ID NO: 4087277 - RNA, 15 nt, Streptococcus pneumoniae R6
gcaaagcuaaauccu

SEQ ID NO: 4087278 - RNA, 14 nt, Streptococcus pneumoniae R6
gcaaaggcaugggc

SEQ ID NO: 4087279 - RNA, 22 nt, Streptococcus pneumoniae R6
gcaaauaaaaagcuuuaagaca

SEQ ID NO: 4087280 - RNA, 20 nt, Streptococcus pneumoniae R6
gcaaauagcccauaaagaga

SEQ ID NO: 4087281 - RNA, 21 nt, Streptococcus pneumoniae R6
gcaaauagcccauaaagagag

SEQ ID NO: 4087282 - RNA, 14 nt, Streptococcus pneumoniae R6
gcaaaucaaagcua

SEQ ID NO: 4087283 - RNA, 18 nt, Streptococcus pneumoniae R6
gcaaaucaaagcuagcaa

SEQ ID NO: 4087284 - RNA, 21 nt, Streptococcus pneumoniae R6
gcaaaucaacuggcaucccca

SEQ ID NO: 4087285 - RNA, 22 nt, Streptococcus pneumoniae R6
gcaaaucaacuggcauccccag

SEQ ID NO: 4087286 - RNA, 16 nt, Streptococcus pneumoniae R6
gcaaauccgaaaauca

SEQ ID NO: 4087287 - RNA, 22 nt, Streptococcus pneumoniae R6
gcaaauuaaccuuauuucucaa

SEQ ID NO: 4087288 - RNA, 18 nt, Streptococcus pneumoniae R6
gcaaauuguuuucaaggu

SEQ ID NO: 4087289 - RNA, 21 nt, Streptococcus pneumoniae R6
gcaaauuuauaaaucuucuaa

SEQ ID NO: 4087290 - RNA, 22 nt, Streptococcus pneumoniae R6
gcaaauuuauaaaucuucuaaa

SEQ ID NO: 4087291 - RNA, 20 nt, Streptococcus pneumoniae R6
gcaacaaaaacgauaaaagc

SEQ ID NO: 4087292 - RNA, 21 nt, Streptococcus pneumoniae R6
gcaacaaaaacgauaaaagcu

SEQ ID NO: 4087293 - RNA, 18 nt, Streptococcus pneumoniae R6
gcaacaaaguaaccaucu

SEQ ID NO: 4087294 - RNA, 22 nt, Streptococcus pneumoniae R6
gcaacaaaguaaccaucuguac

SEQ ID NO: 4087295 - RNA, 17 nt, Streptococcus pneumoniae R6
gcaaccaagucugcaug

SEQ ID NO: 4087296 - RNA, 16 nt, Streptococcus pneumoniae R6
gcaacgccgucuucuu

SEQ ID NO: 4087297 - RNA, 22 nt, Streptococcus pneumoniae R6
gcaacuaaaaaggaaccagguu

SEQ ID NO: 4087298 - RNA, 13 nt, Streptococcus pneumoniae R6
gcaacuaaaauca

SEQ ID NO: 4087299 - RNA, 18 nt, Streptococcus pneumoniae R6
gcaacuaggacaagaaga

SEQ ID NO: 4087300 - RNA, 15 nt, Streptococcus pneumoniae R6
gcaacugucuuaucc

SEQ ID NO: 4087301 - RNA, 16 nt, Streptococcus pneumoniae R6
gcaacuguuuuuucaa

SEQ ID NO: 4087302 - RNA, 18 nt, Streptococcus pneumoniae R6
gcaacuguuuuuucaaca

SEQ ID NO: 4087303 - RNA, 18 nt, Streptococcus pneumoniae R6
gcaacuuuuccaauagau

SEQ ID NO: 4087304 - RNA, 19 nt, Streptococcus pneumoniae R6
gcaagacgaagcugacaug

SEQ ID NO: 4087305 - RNA, 11 nt, Streptococcus pneumoniae R6
gcaagagaaau

SEQ ID NO: 4087306 - RNA, 20 nt, Streptococcus pneumoniae R6
gcaagagcaucugccgcaug

SEQ ID NO: 4087307 - RNA, 21 nt, Streptococcus pneumoniae R6
gcaagagccuuuuuaaagaua

SEQ ID NO: 4087308 - RNA, 21 nt, Streptococcus pneumoniae R6
gcaagaggucauaaaccucga

SEQ ID NO: 4087309 - RNA, 15 nt, Streptococcus pneumoniae R6
gcaagcagcuaaaag

SEQ ID NO: 4087310 - RNA, 16 nt, Streptococcus pneumoniae R6
gcaagcuugaaacaaa

SEQ ID NO: 4087311 - RNA, 18 nt, Streptococcus pneumoniae R6
gcaaggaugccagccuua

SEQ ID NO: 4087312 - RNA, 23 nt, Streptococcus pneumoniae R6
gcaaggcuugaguauauggguga

SEQ ID NO: 4087313 - RNA, 15 nt, Streptococcus pneumoniae R6
gcaaguagaacgcug

SEQ ID NO: 4087314 - RNA, 13 nt, Streptococcus pneumoniae R6
gcaaguucuucuc

SEQ ID NO: 4087315 - RNA, 19 nt, Streptococcus pneumoniae R6
gcaaguuuuagaugagaaa

SEQ ID NO: 4087316 - RNA, 13 nt, Streptococcus pneumoniae R6
gcaauaauaaugg

SEQ ID NO: 4087317 - RNA, 15 nt, Streptococcus pneumoniae R6
gcaauaauaaugguu

SEQ ID NO: 4087318 - RNA, 16 nt, Streptococcus pneumoniae R6
gcaauacagaacuaaa

SEQ ID NO: 4087319 - RNA, 13 nt, Streptococcus pneumoniae R6
gcaauacuucaac

SEQ ID NO: 4087320 - RNA, 18 nt, Streptococcus pneumoniae R6
gcaaucauuucaaagccu

SEQ ID NO: 4087321 - RNA, 17 nt, Streptococcus pneumoniae R6
gcaaugagccaaggaag

SEQ ID NO: 4087322 - RNA, 18 nt, Streptococcus pneumoniae R6
gcaaugagccaaggaagu

SEQ ID NO: 4087323 - RNA, 23 nt, Streptococcus pneumoniae R6
gcaauuguuucguacuauuucag

SEQ ID NO: 4087324 - RNA, 18 nt, Streptococcus pneumoniae R6
gcaauuuaucuccuacuu

SEQ ID NO: 4087325 - RNA, 16 nt, Streptococcus pneumoniae R6
gcaauuucuaauacaa

SEQ ID NO: 4087326 - RNA, 19 nt, Streptococcus pneumoniae R6
gcaauuuuacuucuucccc

SEQ ID NO: 4087327 - RNA, 11 nt, Streptococcus pneumoniae R6
gcaauuuuuga

SEQ ID NO: 4087328 - RNA, 16 nt, Streptococcus pneumoniae R6
gcaauuuuugaaagga

SEQ ID NO: 4087329 - RNA, 21 nt, Streptococcus pneumoniae R6
gcacaaaaggcucauaguuua

SEQ ID NO: 4087330 - RNA, 23 nt, Streptococcus pneumoniae R6
gcacaaaauccgcuugggaaacc

SEQ ID NO: 4087331 - RNA, 17 nt, Streptococcus pneumoniae R6
gcacaaaaucuuaaaaa

SEQ ID NO: 4087332 - RNA, 16 nt, Streptococcus pneumoniae R6
gcacaaacuucauccc

SEQ ID NO: 4087333 - RNA, 12 nt, Streptococcus pneumoniae R6
gcacaaagaacc

SEQ ID NO: 4087334 - RNA, 23 nt, Streptococcus pneumoniae R6
gcacaauauagccuaagacaacc

SEQ ID NO: 4087335 - RNA, 16 nt, Streptococcus pneumoniae R6
gcacacaaaucuucug

SEQ ID NO: 4087336 - RNA, 14 nt, Streptococcus pneumoniae R6
gcacaccugauauu

SEQ ID NO: 4087337 - RNA, 15 nt, Streptococcus pneumoniae R6
gcacacgaaucugau

SEQ ID NO: 4087338 - RNA, 19 nt, Streptococcus pneumoniae R6
gcacaguagauuccuucuu

SEQ ID NO: 4087339 - RNA, 14 nt, Streptococcus pneumoniae R6
gcacaugacaaauu

SEQ ID NO: 4087340 - RNA, 16 nt, Streptococcus pneumoniae R6
gcacaugccuucuucg

SEQ ID NO: 4087341 - RNA, 14 nt, Streptococcus pneumoniae R6
gcauucguuucuuu

SEQ ID NO: 4087342 - RNA, 18 nt, Streptococcus pneumoniae R6
gcauucuauuccaucucc

SEQ ID NO: 4087343 - RNA, 16 nt, Streptococcus pneumoniae R6
gcauucuucucagcua

SEQ ID NO: 4087344 - RNA, 19 nt, Streptococcus pneumoniae R6
gcauucuucucuugaaaau

SEQ ID NO: 4087345 - RNA, 19 nt, Streptococcus pneumoniae R6
gcauugcgcuugauaaguu

SEQ ID NO: 4087346 - RNA, 19 nt, Streptococcus pneumoniae R6
gcauugcguuugauaaguu

SEQ ID NO: 4087347 - RNA, 15 nt, Streptococcus pneumoniae R6
gcauuggauauaagg

SEQ ID NO: 4087348 - RNA, 22 nt, Streptococcus pneumoniae R6
gcauuguccauaacgaguaaaa

SEQ ID NO: 4087349 - RNA, 19 nt, Streptococcus pneumoniae R6
gcauugugcuugauaaguu

SEQ ID NO: 4087350 - RNA, 19 nt, Streptococcus pneumoniae R6
gcauuguuggcaaccaagu

SEQ ID NO: 4087351 - RNA, 17 nt, Streptococcus pneumoniae R6
gcauuucaucuucuacu

SEQ ID NO: 4087352 - RNA, 22 nt, Streptococcus pneumoniae R6
gcauuucccauugcaaucccaa

SEQ ID NO: 4087353 - RNA, 19 nt, Streptococcus pneumoniae R6
gcauuugagcgaaaucaac

SEQ ID NO: 4087354 - RNA, 16 nt, Streptococcus pneumoniae R6
gcauuuuaauuucaau

SEQ ID NO: 4087355 - RNA, 18 nt, Streptococcus pneumoniae R6
gcauuuucauaaggaagu

SEQ ID NO: 4087356 - RNA, 12 nt, Streptococcus pneumoniae R6
gcauuuuccuug

SEQ ID NO: 4087357 - RNA, 13 nt, Streptococcus pneumoniae R6
gcauuuucuuuuu

SEQ ID NO: 4087358 - RNA, 18 nt, Streptococcus pneumoniae R6
gcauuuuucgaaauuuau

SEQ ID NO: 4087359 - RNA, 19 nt, Streptococcus pneumoniae R6
gccaaaaaagaaaggacga

SEQ ID NO: 4087360 - RNA, 21 nt, Streptococcus pneumoniae R6
gccaaaaaggaagcccuuuau

SEQ ID NO: 4087361 - RNA, 22 nt, Streptococcus pneumoniae R6
gccaaagaaauuauucuuaucu

SEQ ID NO: 4087362 - RNA, 17 nt, Streptococcus pneumoniae R6
gccaaaucaucauaaaa

SEQ ID NO: 4087363 - RNA, 20 nt, Streptococcus pneumoniae R6
gccaaaucaucauaaaaaua

SEQ ID NO: 4087364 - RNA, 21 nt, Streptococcus pneumoniae R6
gccaaaucaucauaaaaauaa

SEQ ID NO: 4087365 - RNA, 14 nt, Streptococcus pneumoniae R6
gccaacuaaccaac

SEQ ID NO: 4087366 - RNA, 19 nt, Streptococcus pneumoniae R6
gccaacuuaucagcuagcu

SEQ ID NO: 4087367 - RNA, 17 nt, Streptococcus pneumoniae R6
gccaagcgaaucuugua

SEQ ID NO: 4087368 - RNA, 16 nt, Streptococcus pneumoniae R6
gccaaguccagaggac

SEQ ID NO: 4087369 - RNA, 14 nt, Streptococcus pneumoniae R6
gccaagugaguaau

SEQ ID NO: 4087370 - RNA, 18 nt, Streptococcus pneumoniae R6
gccaaguuaaauucuucu

SEQ ID NO: 4087371 - RNA, 13 nt, Streptococcus pneumoniae R6
gccaauacagaua

SEQ ID NO: 4087372 - RNA, 14 nt, Streptococcus pneumoniae R6
gccaauacagauaa

SEQ ID NO: 4087373 - RNA, 16 nt, Streptococcus pneumoniae R6
gccaauugcucaacuu

SEQ ID NO: 4087374 - RNA, 16 nt, Streptococcus pneumoniae R6
gccacaaaugcuucuu

SEQ ID NO: 4087375 - RNA, 17 nt, Streptococcus pneumoniae R6
gccaccuccgccuccag

SEQ ID NO: 4087376 - RNA, 23 nt, Streptococcus pneumoniae R6
gccaccuccgccuccagagaagc

SEQ ID NO: 4087377 - RNA, 19 nt, Streptococcus pneumoniae R6
gccacuauuuuaucuuacu

SEQ ID NO: 4087378 - RNA, 21 nt, Streptococcus pneumoniae R6
gccacucuuuauuccauggua

SEQ ID NO: 4087379 - RNA, 20 nt, Streptococcus pneumoniae R6
gccagaacuuccacuuccag

SEQ ID NO: 4087380 - RNA, 15 nt, Streptococcus pneumoniae R6
gccagacugggcagu

SEQ ID NO: 4087381 - RNA, 15 nt, Streptococcus pneumoniae R6
gccagagcaccaacc

SEQ ID NO: 4087382 - RNA, 21 nt, Streptococcus pneumoniae R6
gccagauggacugaccaccug

SEQ ID NO: 4087383 - RNA, 19 nt, Streptococcus pneumoniae R6
gccagauguuccacggaga

SEQ ID NO: 4087384 - RNA, 23 nt, Streptococcus pneumoniae R6
gccagccauaagcuacauagaga

SEQ ID NO: 4087385 - RNA, 19 nt, Streptococcus pneumoniae R6
gccagcgccuaaagacgcu

SEQ ID NO: 4087386 - RNA, 17 nt, Streptococcus pneumoniae R6
gccagugagaagaaggg

SEQ ID NO: 4087387 - RNA, 22 nt, Streptococcus pneumoniae R6
gccaguucagcauaagacaauu

SEQ ID NO: 4087388 - RNA, 23 nt, Streptococcus pneumoniae R6
gccaguugcugcguuaaauccua

SEQ ID NO: 4087389 - RNA, 20 nt, Streptococcus pneumoniae R6
gccaguugcuguaaucacau

SEQ ID NO: 4087390 - RNA, 19 nt, Streptococcus pneumoniae R6
gccauaaaaauaacuucag

SEQ ID NO: 4087391 - RNA, 18 nt, Streptococcus pneumoniae R6
gccauagcaagagcaccg

SEQ ID NO: 4087392 - RNA, 19 nt, Streptococcus pneumoniae R6
gccauauagcauuguccau

SEQ ID NO: 4087393 - RNA, 14 nt, Streptococcus pneumoniae R6
gccaucauccaccu

SEQ ID NO: 4087394 - RNA, 16 nt, Streptococcus pneumoniae R6
gccaucucuacuccuu

SEQ ID NO: 4087395 - RNA, 21 nt, Streptococcus pneumoniae R6
gccaucuugagcgaggucgcu

SEQ ID NO: 4087396 - RNA, 13 nt, Streptococcus pneumoniae R6
gccaucuuguaac

SEQ ID NO: 4087397 - RNA, 19 nt, Streptococcus pneumoniae R6
gccaucuuuugacagucuu

SEQ ID NO: 4087398 - RNA, 19 nt, Streptococcus pneumoniae R6
gccaugacaccguaagaua

SEQ ID NO: 4087399 - RNA, 17 nt, Streptococcus pneumoniae R6
gccauggccauaucugg

SEQ ID NO: 4087400 - RNA, 20 nt, Streptococcus pneumoniae R6
gccauggccauaucugguuu

SEQ ID NO: 4087401 - RNA, 19 nt, Streptococcus pneumoniae R6
gccauuuggcccuaccugc

SEQ ID NO: 4087402 - RNA, 22 nt, Streptococcus pneumoniae R6
gcccaaaaauuaccgagaaucu

SEQ ID NO: 4087403 - RNA, 12 nt, Streptococcus pneumoniae R6
gcccaaccagcu

SEQ ID NO: 4087404 - RNA, 15 nt, Streptococcus pneumoniae R6
gcccaauauucucua

SEQ ID NO: 4087405 - RNA, 16 nt, Streptococcus pneumoniae R6
gcccaauauucucuag

SEQ ID NO: 4087406 - RNA, 15 nt, Streptococcus pneumoniae R6
gcccacuaaaaauau

SEQ ID NO: 4087407 - RNA, 16 nt, Streptococcus pneumoniae R6
gcccaucccaaagaau

SEQ ID NO: 4087408 - RNA, 19 nt, Streptococcus pneumoniae R6
gcccauggccauaaucucu

SEQ ID NO: 4087409 - RNA, 14 nt, Streptococcus pneumoniae R6
gcccauguuuucuc

SEQ ID NO: 4087410 - RNA, 21 nt, Streptococcus pneumoniae R6
gccccugauaguuaucgucac

SEQ ID NO: 4087411 - RNA, 16 nt, Streptococcus pneumoniae R6
gcccgagcucaaauca

SEQ ID NO: 4087412 - RNA, 17 nt, Streptococcus pneumoniae R6
gcccgauguuauugaaa

SEQ ID NO: 4087413 - RNA, 15 nt, Streptococcus pneumoniae R6
gcccgcuucgcuucc

SEQ ID NO: 4087414 - RNA, 13 nt, Streptococcus pneumoniae R6
gcccucagccagu

SEQ ID NO: 4087415 - RNA, 20 nt, Streptococcus pneumoniae R6
gcccugcaaucauugcaaag

SEQ ID NO: 4087416 - RNA, 11 nt, Streptococcus pneumoniae R6
gcccugucuuu

SEQ ID NO: 4087417 - RNA, 14 nt, Streptococcus pneumoniae R6
gcccuucauaaagg

SEQ ID NO: 4087418 - RNA, 20 nt, Streptococcus pneumoniae R6
gcccuuugcugcuuuccuuc

SEQ ID NO: 4087419 - RNA, 15 nt, Streptococcus pneumoniae R6
gcccuuuuuucucaa

SEQ ID NO: 4087420 - RNA, 21 nt, Streptococcus pneumoniae R6
gccgcacgugcucaaaacacu

SEQ ID NO: 4087421 - RNA, 21 nt, Streptococcus pneumoniae R6
gccgcuggaaugguaucugcu

SEQ ID NO: 4087422 - RNA, 22 nt, Streptococcus pneumoniae R6
gccggauuuauagcgcuagaga

SEQ ID NO: 4087423 - RNA, 22 nt, Streptococcus pneumoniae R6
gccuaaaauucaauguuuacuc

SEQ ID NO: 4087424 - RNA, 16 nt, Streptococcus pneumoniae R6
gccuacaauuggaaau

SEQ ID NO: 4087425 - RNA, 12 nt, Streptococcus pneumoniae R6
gccuacaugugu

SEQ ID NO: 4087426 - RNA, 16 nt, Streptococcus pneumoniae R6
gccuaucuuaagacua

SEQ ID NO: 4087427 - RNA, 19 nt, Streptococcus pneumoniae R6
gccuaucuuaagacuaagu

SEQ ID NO: 4087428 - RNA, 14 nt, Streptococcus pneumoniae R6
gccuaugaaaugag

SEQ ID NO: 4087429 - RNA, 20 nt, Streptococcus pneumoniae R6
gccuauuuuuuauuucaaau

SEQ ID NO: 4087430 - RNA, 19 nt, Streptococcus pneumoniae R6
gccucagauucugacaauc

SEQ ID NO: 4087431 - RNA, 20 nt, Streptococcus pneumoniae R6
gccuccagagaagccaccgc

SEQ ID NO: 4087432 - RNA, 16 nt, Streptococcus pneumoniae R6
gccucucuaaaguaag

SEQ ID NO: 4087433 - RNA, 17 nt, Streptococcus pneumoniae R6
gccucucuaaaguaagu

SEQ ID NO: 4087434 - RNA, 20 nt, Streptococcus pneumoniae R6
gccucucuucuguucauucu

SEQ ID NO: 4087435 - RNA, 11 nt, Streptococcus pneumoniae R6
gccucuuucau

SEQ ID NO: 4087436 - RNA, 21 nt, Streptococcus pneumoniae R6
gccugagaagacaucuucuca

SEQ ID NO: 4087437 - RNA, 18 nt, Streptococcus pneumoniae R6
gccugauaacgaagagcu

SEQ ID NO: 4087438 - RNA, 20 nt, Streptococcus pneumoniae R6
gccugcagcuaguuuccuag

SEQ ID NO: 4087439 - RNA, 22 nt, Streptococcus pneumoniae R6
gccugcuaggcugauuccugga

SEQ ID NO: 4087440 - RNA, 20 nt, Streptococcus pneumoniae R6
gccugcucaccaucuuccgc

SEQ ID NO: 4087441 - RNA, 21 nt, Streptococcus pneumoniae R6
gccuggauagguugcaaagag

SEQ ID NO: 4087442 - RNA, 16 nt, Streptococcus pneumoniae R6
gccuguaaaaagugaa

SEQ ID NO: 4087443 - RNA, 18 nt, Streptococcus pneumoniae R6
gcuauccagauagacauu

SEQ ID NO: 4087444 - RNA, 22 nt, Streptococcus pneumoniae R6
gcuauccuggcguaguaaauca

SEQ ID NO: 4087445 - RNA, 21 nt, Streptococcus pneumoniae R6
gcuauuaaaauucguuucauu

SEQ ID NO: 4087446 - RNA, 14 nt, Streptococcus pneumoniae R6
gcuauuagauggua

SEQ ID NO: 4087447 - RNA, 21 nt, Streptococcus pneumoniae R6
gcuauuagaugguauugacug

SEQ ID NO: 4087448 - RNA, 13 nt, Streptococcus pneumoniae R6
gcuauuccagcuu

SEQ ID NO: 4087449 - RNA, 19 nt, Streptococcus pneumoniae R6
gcuauugaaaggaaaauga

SEQ ID NO: 4087450 - RNA, 20 nt, Streptococcus pneumoniae R6
gcuauugaaaggaaaaugau

SEQ ID NO: 4087451 - RNA, 14 nt, Streptococcus pneumoniae R6
gcuauuuaaaccaa

SEQ ID NO: 4087452 - RNA, 13 nt, Streptococcus pneumoniae R6
gcuauuucuugcu

SEQ ID NO: 4087453 - RNA, 22 nt, Streptococcus pneumoniae R6
gcuauuuuauugucauuuuucu

SEQ ID NO: 4087454 - RNA, 13 nt, Streptococcus pneumoniae R6
gcucaaaacacug

SEQ ID NO: 4087455 - RNA, 15 nt, Streptococcus pneumoniae R6
gcucaaaacacuguu

SEQ ID NO: 4087456 - RNA, 16 nt, Streptococcus pneumoniae R6
gcucaaaacacuguuu

SEQ ID NO: 4087457 - RNA, 19 nt, Streptococcus pneumoniae R6
gcucaaaacauguuuuuga

SEQ ID NO: 4087458 - RNA, 20 nt, Streptococcus pneumoniae R6
gcucaaaagcuuguuuaaaa

SEQ ID NO: 4087459 - RNA, 18 nt, Streptococcus pneumoniae R6
gcucaaaucagcucucug

SEQ ID NO: 4087460 - RNA, 18 nt, Streptococcus pneumoniae R6
gcucaaucaaguaagcca

SEQ ID NO: 4087461 - RNA, 19 nt, Streptococcus pneumoniae R6
gcucaaucaaguaagccau

SEQ ID NO: 4087462 - RNA, 14 nt, Streptococcus pneumoniae R6
gcucaaucuuauca

SEQ ID NO: 4087463 - RNA, 17 nt, Streptococcus pneumoniae R6
gcucaaucuuaucaauc

SEQ ID NO: 4087464 - RNA, 18 nt, Streptococcus pneumoniae R6
gcucacugaugaaacuaa

SEQ ID NO: 4087465 - RNA, 16 nt, Streptococcus pneumoniae R6
gcucagaaacaagaaa

SEQ ID NO: 4087466 - RNA, 18 nt, Streptococcus pneumoniae R6
gcucagaaacaagaaauc

SEQ ID NO: 4087467 - RNA, 13 nt, Streptococcus pneumoniae R6
gcucagcauuuuu

SEQ ID NO: 4087468 - RNA, 15 nt, Streptococcus pneumoniae R6
gcucagcugaugagu

SEQ ID NO: 4087469 - RNA, 19 nt, Streptococcus pneumoniae R6
gcucagcuggcagagcagc

SEQ ID NO: 4087470 - RNA, 17 nt, Streptococcus pneumoniae R6
gcucaucaucugaauga

SEQ ID NO: 4087471 - RNA, 17 nt, Streptococcus pneumoniae R6
gcucaucugcaauaaca

SEQ ID NO: 4087472 - RNA, 18 nt, Streptococcus pneumoniae R6
gcucauuugcgcgcuuga

SEQ ID NO: 4087473 - RNA, 21 nt, Streptococcus pneumoniae R6
gcuccaaauggcaugaggaga

SEQ ID NO: 4087474 - RNA, 18 nt, Streptococcus pneumoniae R6
gcuccacccauguaugga

SEQ ID NO: 4087475 - RNA, 16 nt, Streptococcus pneumoniae R6
gcuccacuuccccagc

SEQ ID NO: 4087476 - RNA, 19 nt, Streptococcus pneumoniae R6
gcuccacuuccccagcgau

SEQ ID NO: 4087477 - RNA, 15 nt, Streptococcus pneumoniae R6
gcuccauuuuuuaaa

SEQ ID NO: 4087478 - RNA, 16 nt, Streptococcus pneumoniae R6
gcuccauuuuuuaaaa

SEQ ID NO: 4087479 - RNA, 22 nt, Streptococcus pneumoniae R6
gcucccauuuuuggaucauaac

SEQ ID NO: 4087480 - RNA, 19 nt, Streptococcus pneumoniae R6
gcuccgauacugccgccac

SEQ ID NO: 4087481 - RNA, 14 nt, Streptococcus pneumoniae R6
gcuccuaaaucaac

SEQ ID NO: 4087482 - RNA, 21 nt, Streptococcus pneumoniae R6
gcuccuguacccaaguaaucu

SEQ ID NO: 4087483 - RNA, 16 nt, Streptococcus pneumoniae R6
gcucggcuuuuuguuu

SEQ ID NO: 4087484 - RNA, 19 nt, Streptococcus pneumoniae R6
gcucguacuuugggugcaa

SEQ ID NO: 4087485 - RNA, 14 nt, Streptococcus pneumoniae R6
gcucguccagcacu

SEQ ID NO: 4087486 - RNA, 20 nt, Streptococcus pneumoniae R6
gcucgugauguuaaaaugag

SEQ ID NO: 4087487 - RNA, 18 nt, Streptococcus pneumoniae R6
gcucuaacugaagcuguu

SEQ ID NO: 4087488 - RNA, 21 nt, Streptococcus pneumoniae R6
gcucuaacugaagcuguuucc

SEQ ID NO: 4087489 - RNA, 22 nt, Streptococcus pneumoniae R6
gcucuacgaacaggaacgugau

SEQ ID NO: 4087490 - RNA, 14 nt, Streptococcus pneumoniae R6
gcucuaugauuuuc

SEQ ID NO: 4087491 - RNA, 14 nt, Streptococcus pneumoniae R6
gcucugaaccaaca

SEQ ID NO: 4087492 - RNA, 21 nt, Streptococcus pneumoniae R6
gcucugaauggccuccuucau

SEQ ID NO: 4087493 - RNA, 14 nt, Streptococcus pneumoniae R6
gcucugguauaagg

SEQ ID NO: 4087494 - RNA, 18 nt, Streptococcus pneumoniae R6
gcucugucacuugaccug

SEQ ID NO: 4087495 - RNA, 17 nt, Streptococcus pneumoniae R6
gcucugugcaauacaga

SEQ ID NO: 4087496 - RNA, 13 nt, Streptococcus pneumoniae R6
gcucuguucuggu

SEQ ID NO: 4087497 - RNA, 14 nt, Streptococcus pneumoniae R6
gcucuuugauuuuc

SEQ ID NO: 4087498 - RNA, 16 nt, Streptococcus pneumoniae R6
gcucuuugauuuucau

SEQ ID NO: 4087499 - RNA, 14 nt, Streptococcus pneumoniae R6
gcucuuugucaagu

SEQ ID NO: 4087500 - RNA, 12 nt, Streptococcus pneumoniae R6
gcucuuuuggga

SEQ ID NO: 4087501 - RNA, 23 nt, Streptococcus pneumoniae R6
gcucuuuuuugauaucuuccuca

SEQ ID NO: 4087502 - RNA, 18 nt, Streptococcus pneumoniae R6
gcugaaggaaugccaaag

SEQ ID NO: 4087503 - RNA, 15 nt, Streptococcus pneumoniae R6
gcugacaaccacaua

SEQ ID NO: 4087504 - RNA, 18 nt, Streptococcus pneumoniae R6
gcugacaauaaagauaag

SEQ ID NO: 4087505 - RNA, 16 nt, Streptococcus pneumoniae R6
gcugacgauguugaug

SEQ ID NO: 4087506 - RNA, 19 nt, Streptococcus pneumoniae R6
gcugacgggcaaauuucau

SEQ ID NO: 4087507 - RNA, 17 nt, Streptococcus pneumoniae R6
gcugacgugguuugcag

SEQ ID NO: 4087508 - RNA, 13 nt, Streptococcus pneumoniae R6
gcugacugauuua

SEQ ID NO: 4087509 - RNA, 15 nt, Streptococcus pneumoniae R6
gcugacuucgucagu

SEQ ID NO: 4087510 - RNA, 20 nt, Streptococcus pneumoniae R6
gcugacuucgucaguuucau

SEQ ID NO: 4087511 - RNA, 21 nt, Streptococcus pneumoniae R6
gcugacuucgucaguuucauc

SEQ ID NO: 4087512 - RNA, 15 nt, Streptococcus pneumoniae R6
gcugagacuaucugc

SEQ ID NO: 4087513 - RNA, 17 nt, Streptococcus pneumoniae R6
gcugagacuaucugcua

SEQ ID NO: 4087514 - RNA, 18 nt, Streptococcus pneumoniae R6
gcugagucauucaaucca

SEQ ID NO: 4087515 - RNA, 22 nt, Streptococcus pneumoniae R6
gcugagucauucaauccaucuc

SEQ ID NO: 4087516 - RNA, 13 nt, Streptococcus pneumoniae R6
gcugauagagauu

SEQ ID NO: 4087517 - RNA, 13 nt, Streptococcus pneumoniae R6
gcugauuuuuuca

SEQ ID NO: 4087518 - RNA, 22 nt, Streptococcus pneumoniae R6
gcugcaauaaucuaacccuaag

SEQ ID NO: 4087519 - RNA, 22 nt, Streptococcus pneumoniae R6
gcugcauuucuggauaacugaa

SEQ ID NO: 4087520 - RNA, 21 nt, Streptococcus pneumoniae R6
gcugccauuugacgaacaaaa

SEQ ID NO: 4087521 - RNA, 20 nt, Streptococcus pneumoniae R6
gcugccuaguuugaucuuug

SEQ ID NO: 4087522 - RNA, 18 nt, Streptococcus pneumoniae R6
gcugcgggcugcucaaaa

SEQ ID NO: 4087523 - RNA, 21 nt, Streptococcus pneumoniae R6
gcugcguaguagauuggcagg

SEQ ID NO: 4087524 - RNA, 13 nt, Streptococcus pneumoniae R6
gcugcucaaaaca

SEQ ID NO: 4087525 - RNA, 21 nt, Streptococcus pneumoniae R6
gcuggaaaaaagucuuuaaaa

SEQ ID NO: 4087526 - RNA, 13 nt, Streptococcus pneumoniae R6
gcuggagaaucau

SEQ ID NO: 4087527 - RNA, 19 nt, Streptococcus pneumoniae R6
gcuggauaguuuacuuaaa

SEQ ID NO: 4087528 - RNA, 14 nt, Streptococcus pneumoniae R6
gcuggcauuuccca

SEQ ID NO: 4087529 - RNA, 23 nt, Streptococcus pneumoniae R6
gcuggcuggaucagcuuuuucag

SEQ ID NO: 4087530 - RNA, 22 nt, Streptococcus pneumoniae R6
gcuggcuuuucagcuucuauuu

SEQ ID NO: 4087531 - RNA, 15 nt, Streptococcus pneumoniae R6
gcugguauuuuuuca

SEQ ID NO: 4087532 - RNA, 14 nt, Streptococcus pneumoniae R6
gcuguacuauuguc

SEQ ID NO: 4087533 - RNA, 23 nt, Streptococcus pneumoniae R6
gcugucaagaaauuacaguuauu

SEQ ID NO: 4087534 - RNA, 14 nt, Streptococcus pneumoniae R6
gcugucagcaauuc

SEQ ID NO: 4087535 - RNA, 18 nt, Streptococcus pneumoniae R6
gcuguccucaaaaugaaa

SEQ ID NO: 4087536 - RNA, 16 nt, Streptococcus pneumoniae R6
gcugucgcaccugacu

SEQ ID NO: 4087537 - RNA, 17 nt, Streptococcus pneumoniae R6
gcugucguagucuagga

SEQ ID NO: 4087538 - RNA, 22 nt, Streptococcus pneumoniae R6
gcugucuuuaguagucuaaaaa

SEQ ID NO: 4087539 - RNA, 17 nt, Streptococcus pneumoniae R6
gcugucuuuucaaaguu

SEQ ID NO: 4087540 - RNA, 20 nt, Streptococcus pneumoniae R6
gcugugcuuugagcaaccua

SEQ ID NO: 4087541 - RNA, 21 nt, Streptococcus pneumoniae R6
gcuguggguggcuacaagaac

SEQ ID NO: 4087542 - RNA, 17 nt, Streptococcus pneumoniae R6
gcuguguuccucuuuuu

SEQ ID NO: 4087543 - RNA, 21 nt, Streptococcus pneumoniae R6
gcuguuaaagccaucuaaaac

SEQ ID NO: 4087544 - RNA, 18 nt, Streptococcus pneumoniae R6
gcuguuccaccaccugca

SEQ ID NO: 4087545 - RNA, 21 nt, Streptococcus pneumoniae R6
ggaauaaugcccaugaaaaga

SEQ ID NO: 4087546 - RNA, 13 nt, Streptococcus pneumoniae R6
ggaauacuaaaau

SEQ ID NO: 4087547 - RNA, 18 nt, Streptococcus pneumoniae R6
ggaauagcccacugugau

SEQ ID NO: 4087548 - RNA, 22 nt, Streptococcus pneumoniae R6
ggaauagcucaaaaguuuaucu

SEQ ID NO: 4087549 - RNA, 21 nt, Streptococcus pneumoniae R6
ggaauaguaucugaugcugac

SEQ ID NO: 4087550 - RNA, 21 nt, Streptococcus pneumoniae R6
ggaauauugaguucuucacga

SEQ ID NO: 4087551 - RNA, 16 nt, Streptococcus pneumoniae R6
ggaauauuuacuaauu

SEQ ID NO: 4087552 - RNA, 15 nt, Streptococcus pneumoniae R6
ggaaugccaaagaca

SEQ ID NO: 4087553 - RNA, 17 nt, Streptococcus pneumoniae R6
ggaaugcuugcaaauca

SEQ ID NO: 4087554 - RNA, 18 nt, Streptococcus pneumoniae R6
ggaauuaauggcagugcu

SEQ ID NO: 4087555 - RNA, 20 nt, Streptococcus pneumoniae R6
ggaauuagagaguuuuuaua

SEQ ID NO: 4087556 - RNA, 22 nt, Streptococcus pneumoniae R6
ggaauuagagaguuuuuauacu

SEQ ID NO: 4087557 - RNA, 12 nt, Streptococcus pneumoniae R6
ggaauuuuauuu

SEQ ID NO: 4087558 - RNA, 22 nt, Streptococcus pneumoniae R6
ggacaauagcgaguaggcugga

SEQ ID NO: 4087559 - RNA, 18 nt, Streptococcus pneumoniae R6
ggacaccucuuucuuucu

SEQ ID NO: 4087560 - RNA, 20 nt, Streptococcus pneumoniae R6
ggacagucaaaucgauuucu

SEQ ID NO: 4087561 - RNA, 15 nt, Streptococcus pneumoniae R6
ggacauaaauaugau

SEQ ID NO: 4087562 - RNA, 13 nt, Streptococcus pneumoniae R6
ggacaugaguccu

SEQ ID NO: 4087563 - RNA, 14 nt, Streptococcus pneumoniae R6
ggacaugaguccug

SEQ ID NO: 4087564 - RNA, 12 nt, Streptococcus pneumoniae R6
ggacuaaauaca

SEQ ID NO: 4087565 - RNA, 23 nt, Streptococcus pneumoniae R6
ggacuagaaugcuuuuugaaagc

SEQ ID NO: 4087566 - RNA, 22 nt, Streptococcus pneumoniae R6
ggacucgaaccaccgaccucac

SEQ ID NO: 4087567 - RNA, 20 nt, Streptococcus pneumoniae R6
ggacuguuucauggcaaauu

SEQ ID NO: 4087568 - RNA, 14 nt, Streptococcus pneumoniae R6
ggagaaaaagaagu

SEQ ID NO: 4087569 - RNA, 19 nt, Streptococcus pneumoniae R6
ggagaagauuucagaaaua

SEQ ID NO: 4087570 - RNA, 21 nt, Streptococcus pneumoniae R6
ggagccaaguuaaauucuucu

SEQ ID NO: 4087571 - RNA, 20 nt, Streptococcus pneumoniae R6
ggagcgaauuugaugcugca

SEQ ID NO: 4087572 - RNA, 15 nt, Streptococcus pneumoniae R6
ggagcuuucagagcu

SEQ ID NO: 4087573 - RNA, 22 nt, Streptococcus pneumoniae R6
ggaggaauaaagguaaaaccaa

SEQ ID NO: 4087574 - RNA, 14 nt, Streptococcus pneumoniae R6
ggaggcaaagaaaa

SEQ ID NO: 4087575 - RNA, 17 nt, Streptococcus pneumoniae R6
ggaggcaaagaaaaaag

SEQ ID NO: 4087576 - RNA, 17 nt, Streptococcus pneumoniae R6
ggagggucuuuuguccu

SEQ ID NO: 4087577 - RNA, 12 nt, Streptococcus pneumoniae R6
ggaguaaaaaaa

SEQ ID NO: 4087578 - RNA, 15 nt, Streptococcus pneumoniae R6
ggaguaaaaaaagag

SEQ ID NO: 4087579 - RNA, 19 nt, Streptococcus pneumoniae R6
ggaguacccucggcuguuu

SEQ ID NO: 4087580 - RNA, 13 nt, Streptococcus pneumoniae R6
ggagugauagaaa

SEQ ID NO: 4087581 - RNA, 15 nt, Streptococcus pneumoniae R6
ggagugauagaaaag

SEQ ID NO: 4087582 - RNA, 18 nt, Streptococcus pneumoniae R6
ggagugauagaaaagccc

SEQ ID NO: 4087583 - RNA, 18 nt, Streptococcus pneumoniae R6
ggaguuacuccgacagca

SEQ ID NO: 4087584 - RNA, 13 nt, Streptococcus pneumoniae R6
ggaguucuuuuca

SEQ ID NO: 4087585 - RNA, 18 nt, Streptococcus pneumoniae R6
ggaguugagccugaaagu

SEQ ID NO: 4087586 - RNA, 22 nt, Streptococcus pneumoniae R6
ggaguugagccugaaagugaga

SEQ ID NO: 4087587 - RNA, 14 nt, Streptococcus pneumoniae R6
ggauaaaaagucca

SEQ ID NO: 4087588 - RNA, 18 nt, Streptococcus pneumoniae R6
ggauaaaaccaaaaagug

SEQ ID NO: 4087589 - RNA, 15 nt, Streptococcus pneumoniae R6
ggauaaaagagaaua

SEQ ID NO: 4087590 - RNA, 17 nt, Streptococcus pneumoniae R6
ggauaacagucaguuca

SEQ ID NO: 4087591 - RNA, 21 nt, Streptococcus pneumoniae R6
ggauaauagcaaggaugaggg

SEQ ID NO: 4087592 - RNA, 15 nt, Streptococcus pneumoniae R6
ggauaauuucuuuaa

SEQ ID NO: 4087593 - RNA, 18 nt, Streptococcus pneumoniae R6
ggauaccuauccuaccca

SEQ ID NO: 4087594 - RNA, 16 nt, Streptococcus pneumoniae R6
ggauacuccauaaaaa

SEQ ID NO: 4087595 - RNA, 13 nt, Streptococcus pneumoniae R6
ggauacuugcaaa

SEQ ID NO: 4087596 - RNA, 18 nt, Streptococcus pneumoniae R6
ggauaugaggagaaagaa

SEQ ID NO: 4087597 - RNA, 23 nt, Streptococcus pneumoniae R6
ggaucaugagccacaacuuuuaa

SEQ ID NO: 4087598 - RNA, 17 nt, Streptococcus pneumoniae R6
ggaucauuucuucugga

SEQ ID NO: 4087599 - RNA, 21 nt, Streptococcus pneumoniae R6
ggauccauugcuggagcuggg

SEQ ID NO: 4087600 - RNA, 20 nt, Streptococcus pneumoniae R6
ggauccucauauucuuuuac

SEQ ID NO: 4087601 - RNA, 19 nt, Streptococcus pneumoniae R6
ggaucuccaguuuggacca

SEQ ID NO: 4087602 - RNA, 14 nt, Streptococcus pneumoniae R6
ggaugaaacugacg

SEQ ID NO: 4087603 - RNA, 19 nt, Streptococcus pneumoniae R6
ggaugauguuaucaaaucg

SEQ ID NO: 4087604 - RNA, 23 nt, Streptococcus pneumoniae R6
ggaugauuuaauuagaaaaaaau

SEQ ID NO: 4087605 - RNA, 14 nt, Streptococcus pneumoniae R6
ggauggcgugggca

SEQ ID NO: 4087606 - RNA, 17 nt, Streptococcus pneumoniae R6
ggauguguauagagcaa

SEQ ID NO: 4087607 - RNA, 13 nt, Streptococcus pneumoniae R6
ggauuacauagac

SEQ ID NO: 4087608 - RNA, 19 nt, Streptococcus pneumoniae R6
ggauuaccuuugaaaaaau

SEQ ID NO: 4087609 - RNA, 19 nt, Streptococcus pneumoniae R6
ggauuccuuuuugcagaag

SEQ ID NO: 4087610 - RNA, 15 nt, Streptococcus pneumoniae R6
ggauuguuaaacaau

SEQ ID NO: 4087611 - RNA, 23 nt, Streptococcus pneumoniae R6
ggauuucuaguuuugguuuuucu

SEQ ID NO: 4087612 - RNA, 12 nt, Streptococcus pneumoniae R6
ggauuuuauccg

SEQ ID NO: 4087613 - RNA, 22 nt, Streptococcus pneumoniae R6
ggauuuucuuacacguuuuugu

SEQ ID NO: 4087614 - RNA, 16 nt, Streptococcus pneumoniae R6
ggauuuuguucuuuuu

SEQ ID NO: 4087615 - RNA, 17 nt, Streptococcus pneumoniae R6
ggauuuuuccaugcuuc

SEQ ID NO: 4087616 - RNA, 23 nt, Streptococcus pneumoniae R6
ggauuuuucuucuuuucuuuuau

SEQ ID NO: 4087617 - RNA, 14 nt, Streptococcus pneumoniae R6
ggauuuuuuggcua

SEQ ID NO: 4087618 - RNA, 13 nt, Streptococcus pneumoniae R6
ggcaaaggcaugg

SEQ ID NO: 4087619 - RNA, 11 nt, Streptococcus pneumoniae R6
ggcaaauagcc

SEQ ID NO: 4087620 - RNA, 20 nt, Streptococcus pneumoniae R6
ggcaaauagcccauaaagag

SEQ ID NO: 4087621 - RNA, 22 nt, Streptococcus pneumoniae R6
ggcaaauucugucacaucugug

SEQ ID NO: 4087622 - RNA, 20 nt, Streptococcus pneumoniae R6
ggcaacgaagcuagaaaugg

SEQ ID NO: 4087623 - RNA, 10 nt, Streptococcus pneumoniae R6
ggcaacugcu

SEQ ID NO: 4087624 - RNA, 16 nt, Streptococcus pneumoniae R6
ggcaauuuaucccaau

SEQ ID NO: 4087625 - RNA, 13 nt, Streptococcus pneumoniae R6
ggcaauuuaucuc

SEQ ID NO: 4087626 - RNA, 17 nt, Streptococcus pneumoniae R6
ggcaccauuuucagccc

SEQ ID NO: 4087627 - RNA, 11 nt, Streptococcus pneumoniae R6
ggcaccuucua

SEQ ID NO: 4087628 - RNA, 21 nt, Streptococcus pneumoniae R6
ggcacuagcuccaaacauaac

SEQ ID NO: 4087629 - RNA, 14 nt, Streptococcus pneumoniae R6
ggcagacauaucca

SEQ ID NO: 4087630 - RNA, 12 nt, Streptococcus pneumoniae R6
ggcagagaaucg

SEQ ID NO: 4087631 - RNA, 17 nt, Streptococcus pneumoniae R6
ggcagauuucaaaccug

SEQ ID NO: 4087632 - RNA, 16 nt, Streptococcus pneumoniae R6
ggcagauuuugaagau

SEQ ID NO: 4087633 - RNA, 16 nt, Streptococcus pneumoniae R6
ggcagccucuuucuug

SEQ ID NO: 4087634 - RNA, 18 nt, Streptococcus pneumoniae R6
ggcaggaaaggcauucca

SEQ ID NO: 4087635 - RNA, 11 nt, Streptococcus pneumoniae R6
ggcaggcuggu

SEQ ID NO: 4087636 - RNA, 17 nt, Streptococcus pneumoniae R6
ggcaguaauuagacauc

SEQ ID NO: 4087637 - RNA, 14 nt, Streptococcus pneumoniae R6
ggcauaaacuugca

SEQ ID NO: 4087638 - RNA, 16 nt, Streptococcus pneumoniae R6
ggcauaaaucaaaucg

SEQ ID NO: 4087639 - RNA, 19 nt, Streptococcus pneumoniae R6
ggcauaagcaaucauaccu

SEQ ID NO: 4087640 - RNA, 16 nt, Streptococcus pneumoniae R6
ggcauaguaccaguua

SEQ ID NO: 4087641 - RNA, 17 nt, Streptococcus pneumoniae R6
ggcaucaacagcuccau

SEQ ID NO: 4087642 - RNA, 17 nt, Streptococcus pneumoniae R6
ggcaucuugucaaagag

SEQ ID NO: 4087643 - RNA, 19 nt, Streptococcus pneumoniae R6
ggcauugauaugguaaugu

SEQ ID NO: 4087644 - RNA, 21 nt, Streptococcus pneumoniae R6
ggccaaaucaucauaaaaaua

SEQ ID NO: 4087645 - RNA, 22 nt, Streptococcus pneumoniae R6
ggccaaaucaucauaaaaauaa

SEQ ID NO: 4087646 - RNA, 17 nt, Streptococcus pneumoniae R6
ggccaauucuucuucug

SEQ ID NO: 4087647 - RNA, 10 nt, Streptococcus pneumoniae R6
ggccacugag

SEQ ID NO: 4087648 - RNA, 18 nt, Streptococcus pneumoniae R6
ggucacgacggugaacaa

SEQ ID NO: 4087649 - RNA, 15 nt, Streptococcus pneumoniae R6
ggucagcuucuugca

SEQ ID NO: 4087650 - RNA, 14 nt, Streptococcus pneumoniae R6
ggucaguugcaaga

SEQ ID NO: 4087651 - RNA, 14 nt, Streptococcus pneumoniae R6
ggucauaugggacu

SEQ ID NO: 4087652 - RNA, 23 nt, Streptococcus pneumoniae R6
ggucauaugggacuuuuuuucua

SEQ ID NO: 4087653 - RNA, 19 nt, Streptococcus pneumoniae R6
ggucaucaagcuuucacua

SEQ ID NO: 4087654 - RNA, 16 nt, Streptococcus pneumoniae R6
ggucauguagauugac

SEQ ID NO: 4087655 - RNA, 14 nt, Streptococcus pneumoniae R6
ggucauuuucuucg

SEQ ID NO: 4087656 - RNA, 19 nt, Streptococcus pneumoniae R6
gguccgaaccacaacaaaa

SEQ ID NO: 4087657 - RNA, 20 nt, Streptococcus pneumoniae R6
gguccgaaccacaacaaaaa

SEQ ID NO: 4087658 - RNA, 23 nt, Streptococcus pneumoniae R6
gguccgaaccacaacaaaaaagg

SEQ ID NO: 4087659 - RNA, 16 nt, Streptococcus pneumoniae R6
ggucgcuugaaccuuu

SEQ ID NO: 4087660 - RNA, 20 nt, Streptococcus pneumoniae R6
ggucuuucaagcgaacaucu

SEQ ID NO: 4087661 - RNA, 13 nt, Streptococcus pneumoniae R6
ggucuuuguucug

SEQ ID NO: 4087662 - RNA, 16 nt, Streptococcus pneumoniae R6
ggugacaguaaaaaau

SEQ ID NO: 4087663 - RNA, 20 nt, Streptococcus pneumoniae R6
ggugacuucauuauuaugaa

SEQ ID NO: 4087664 - RNA, 19 nt, Streptococcus pneumoniae R6
ggugcaauuuuuuauggau

SEQ ID NO: 4087665 - RNA, 18 nt, Streptococcus pneumoniae R6
ggugcgagacaaaaaaaa

SEQ ID NO: 4087666 - RNA, 20 nt, Streptococcus pneumoniae R6
ggugcguuuuuugauuaagu

SEQ ID NO: 4087667 - RNA, 18 nt, Streptococcus pneumoniae R6
ggugcuugucccauaaac

SEQ ID NO: 4087668 - RNA, 14 nt, Streptococcus pneumoniae R6
gguggaaaagcaag

SEQ ID NO: 4087669 - RNA, 13 nt, Streptococcus pneumoniae R6
gguggauaaaagu

SEQ ID NO: 4087670 - RNA, 19 nt, Streptococcus pneumoniae R6
gguguaaacuuuauauccu

SEQ ID NO: 4087671 - RNA, 15 nt, Streptococcus pneumoniae R6
gguguaagggaaggu

SEQ ID NO: 4087672 - RNA, 12 nt, Streptococcus pneumoniae R6
ggugugauuuuc

SEQ ID NO: 4087673 - RNA, 23 nt, Streptococcus pneumoniae R6
gguguucacgaaagcaacuuacu

SEQ ID NO: 4087674 - RNA, 16 nt, Streptococcus pneumoniae R6
gguuaaaaucuuuuac

SEQ ID NO: 4087675 - RNA, 22 nt, Streptococcus pneumoniae R6
gguuagcuccagaagggagaac

SEQ ID NO: 4087676 - RNA, 16 nt, Streptococcus pneumoniae R6
gguuagcugcaccaca

SEQ ID NO: 4087677 - RNA, 16 nt, Streptococcus pneumoniae R6
gguuagucaaaaagaa

SEQ ID NO: 4087678 - RNA, 16 nt, Streptococcus pneumoniae R6
gguuauaccaaaaaaa

SEQ ID NO: 4087679 - RNA, 21 nt, Streptococcus pneumoniae R6
gguucaaaaaaugccuuaucu

SEQ ID NO: 4087680 - RNA, 20 nt, Streptococcus pneumoniae R6
gguucauccagcaggagaaa

SEQ ID NO: 4087681 - RNA, 15 nt, Streptococcus pneumoniae R6
gguucaucucuggug

SEQ ID NO: 4087682 - RNA, 21 nt, Streptococcus pneumoniae R6
gguuccuucugcaucguggau

SEQ ID NO: 4087683 - RNA, 22 nt, Streptococcus pneumoniae R6
gguucgauuccugcagggggca

SEQ ID NO: 4087684 - RNA, 17 nt, Streptococcus pneumoniae R6
gguucgcccaaacauag

SEQ ID NO: 4087685 - RNA, 16 nt, Streptococcus pneumoniae R6
gguugaaaaaaagcua

SEQ ID NO: 4087686 - RNA, 13 nt, Streptococcus pneumoniae R6
gguugaccaguau

SEQ ID NO: 4087687 - RNA, 18 nt, Streptococcus pneumoniae R6
gguugcucaaaguacugc

SEQ ID NO: 4087688 - RNA, 21 nt, Streptococcus pneumoniae R6
gguugcuccgcggugcaauuu

SEQ ID NO: 4087689 - RNA, 14 nt, Streptococcus pneumoniae R6
gguuguagauagaa

SEQ ID NO: 4087690 - RNA, 21 nt, Streptococcus pneumoniae R6
gguuguagauagaacugacga

SEQ ID NO: 4087691 - RNA, 20 nt, Streptococcus pneumoniae R6
gguuguagaugaaacugacg

SEQ ID NO: 4087692 - RNA, 21 nt, Streptococcus pneumoniae R6
gguuguagaugaaacugacga

SEQ ID NO: 4087693 - RNA, 14 nt, Streptococcus pneumoniae R6
gguuguggauagaa

SEQ ID NO: 4087694 - RNA, 23 nt, Streptococcus pneumoniae R6
gguuuauuggcuacgacugcuuc

SEQ ID NO: 4087695 - RNA, 15 nt, Streptococcus pneumoniae R6
gguuucguagcagaa

SEQ ID NO: 4087696 - RNA, 20 nt, Streptococcus pneumoniae R6
gguuuggaaaugaucagacc

SEQ ID NO: 4087697 - RNA, 18 nt, Streptococcus pneumoniae R6
gguuuuucuucagcaaua

SEQ ID NO: 4087698 - RNA, 20 nt, Streptococcus pneumoniae R6
guaaaaccuuuauaccaagc

SEQ ID NO: 4087699 - RNA, 14 nt, Streptococcus pneumoniae R6
guaaaagacacaug

SEQ ID NO: 4087700 - RNA, 11 nt, Streptococcus pneumoniae R6
guaaaauacuc

SEQ ID NO: 4087701 - RNA, 18 nt, Streptococcus pneumoniae R6
guaaaauagauaaauacu

SEQ ID NO: 4087702 - RNA, 19 nt, Streptococcus pneumoniae R6
guaaaaugcaccaaaacag

SEQ ID NO: 4087703 - RNA, 18 nt, Streptococcus pneumoniae R6
guaaacaaagagguuuua

SEQ ID NO: 4087704 - RNA, 19 nt, Streptococcus pneumoniae R6
guaaacaaguugcuugaaa

SEQ ID NO: 4087705 - RNA, 22 nt, Streptococcus pneumoniae R6
guaaacaucaucugcauuacau

SEQ ID NO: 4087706 - RNA, 18 nt, Streptococcus pneumoniae R6
guaaacguggauuuaaga

SEQ ID NO: 4087707 - RNA, 17 nt, Streptococcus pneumoniae R6
guaaacuucuucuucca

SEQ ID NO: 4087708 - RNA, 18 nt, Streptococcus pneumoniae R6
guaaacuucuucuuccau

SEQ ID NO: 4087709 - RNA, 17 nt, Streptococcus pneumoniae R6
guaaagacauuauaauc

SEQ ID NO: 4087710 - RNA, 14 nt, Streptococcus pneumoniae R6
guaaagacuagacu

SEQ ID NO: 4087711 - RNA, 17 nt, Streptococcus pneumoniae R6
guaaaguguagcagauu

SEQ ID NO: 4087712 - RNA, 17 nt, Streptococcus pneumoniae R6
guaaaguuaauugaauu

SEQ ID NO: 4087713 - RNA, 15 nt, Streptococcus pneumoniae R6
guaaauaaauaucaa

SEQ ID NO: 4087714 - RNA, 21 nt, Streptococcus pneumoniae R6
guaaauauuucuaugauaaaa

SEQ ID NO: 4087715 - RNA, 17 nt, Streptococcus pneumoniae R6
guaaaucuucagauuca

SEQ ID NO: 4087716 - RNA, 15 nt, Streptococcus pneumoniae R6
guaaauuauacucuu

SEQ ID NO: 4087717 - RNA, 20 nt, Streptococcus pneumoniae R6
guaaauucuucauacucaau

SEQ ID NO: 4087718 - RNA, 13 nt, Streptococcus pneumoniae R6
guaacaaaaauac

SEQ ID NO: 4087719 - RNA, 23 nt, Streptococcus pneumoniae R6
guaacaacaccgcagucuucaau

SEQ ID NO: 4087720 - RNA, 16 nt, Streptococcus pneumoniae R6
guaaccaaaucagaua

SEQ ID NO: 4087721 - RNA, 17 nt, Streptococcus pneumoniae R6
guaaccaauuucucaaa

SEQ ID NO: 4087722 - RNA, 23 nt, Streptococcus pneumoniae R6
guaaccaauuucucaaaaaaguu

SEQ ID NO: 4087723 - RNA, 16 nt, Streptococcus pneumoniae R6
guaacggcuuucaguu

SEQ ID NO: 4087724 - RNA, 20 nt, Streptococcus pneumoniae R6
guaacggcuuucaguuucau

SEQ ID NO: 4087725 - RNA, 15 nt, Streptococcus pneumoniae R6
guaacuggaccaagu

SEQ ID NO: 4087726 - RNA, 13 nt, Streptococcus pneumoniae R6
guaacuucugucu

SEQ ID NO: 4087727 - RNA, 21 nt, Streptococcus pneumoniae R6
guaacuugccugcuuuuucaa

SEQ ID NO: 4087728 - RNA, 20 nt, Streptococcus pneumoniae R6
guaagaaagcagcuuaucuc

SEQ ID NO: 4087729 - RNA, 15 nt, Streptococcus pneumoniae R6
guaagaaauuuugga

SEQ ID NO: 4087730 - RNA, 15 nt, Streptococcus pneumoniae R6
guaagaacuuuuuaa

SEQ ID NO: 4087731 - RNA, 18 nt, Streptococcus pneumoniae R6
guaagaauguugcuuugg

SEQ ID NO: 4087732 - RNA, 22 nt, Streptococcus pneumoniae R6
guaagagaaauuucugaaacua

SEQ ID NO: 4087733 - RNA, 19 nt, Streptococcus pneumoniae R6
guaagagaacuucacguuc

SEQ ID NO: 4087734 - RNA, 18 nt, Streptococcus pneumoniae R6
guaagaguggauuuucac

SEQ ID NO: 4087735 - RNA, 16 nt, Streptococcus pneumoniae R6
guaaggacuuugcuua

SEQ ID NO: 4087736 - RNA, 21 nt, Streptococcus pneumoniae R6
guaaguaccugacgaaagacu

SEQ ID NO: 4087737 - RNA, 11 nt, Streptococcus pneumoniae R6
guaagucugcu

SEQ ID NO: 4087738 - RNA, 20 nt, Streptococcus pneumoniae R6
guaaguggguggguaaagga

SEQ ID NO: 4087739 - RNA, 20 nt, Streptococcus pneumoniae R6
guaauaaacuggguugaaga

SEQ ID NO: 4087740 - RNA, 14 nt, Streptococcus pneumoniae R6
guaaucaaaaggac

SEQ ID NO: 4087741 - RNA, 15 nt, Streptococcus pneumoniae R6
guaaucacugcagca

SEQ ID NO: 4087742 - RNA, 22 nt, Streptococcus pneumoniae R6
guaaucacugcagcaaagguac

SEQ ID NO: 4087743 - RNA, 12 nt, Streptococcus pneumoniae R6
guaaucaucuca

SEQ ID NO: 4087744 - RNA, 13 nt, Streptococcus pneumoniae R6
guaaucaucucau

SEQ ID NO: 4087745 - RNA, 23 nt, Streptococcus pneumoniae R6
guaaucucguucuugaaaccagu

SEQ ID NO: 4087746 - RNA, 18 nt, Streptococcus pneumoniae R6
guaaucucugauaauauu

SEQ ID NO: 4087747 - RNA, 14 nt, Streptococcus pneumoniae R6
guaaucuuaaaguu

SEQ ID NO: 4087748 - RNA, 19 nt, Streptococcus pneumoniae R6
guaaucuuagcaaagauau

SEQ ID NO: 4087749 - RNA, 14 nt, Streptococcus pneumoniae R6
guaaugacaauuau

SEQ ID NO: 4087750 - RNA, 19 nt, Streptococcus pneumoniae R6
guaaugacaauuauauaaa

SEQ ID NO: 4087751 - RNA, 20 nt, Streptococcus pneumoniae R6
guaaugacuuguguuuuucc

SEQ ID NO: 4087752 - RNA, 18 nt, Streptococcus pneumoniae R6
guaaugggcgcauuuucc

SEQ ID NO: 4087753 - RNA, 20 nt, Streptococcus pneumoniae R6
guaauuuaguucucaggaau

SEQ ID NO: 4087754 - RNA, 22 nt, Streptococcus pneumoniae R6
guaauuucuacuguauacuuuu

SEQ ID NO: 4087755 - RNA, 19 nt, Streptococcus pneumoniae R6
guaauuuucaagaauugca

SEQ ID NO: 4087756 - RNA, 17 nt, Streptococcus pneumoniae R6
guacaaagaauaaaaua

SEQ ID NO: 4087757 - RNA, 18 nt, Streptococcus pneumoniae R6
guacaaagaauaaaauag

SEQ ID NO: 4087758 - RNA, 16 nt, Streptococcus pneumoniae R6
guacacaacugcuucu

SEQ ID NO: 4087759 - RNA, 17 nt, Streptococcus pneumoniae R6
guacacaucuacuucua

SEQ ID NO: 4087760 - RNA, 17 nt, Streptococcus pneumoniae R6
guacacuucuacuucua

SEQ ID NO: 4087761 - RNA, 20 nt, Streptococcus pneumoniae R6
guacagaaaaaccuugauac

SEQ ID NO: 4087762 - RNA, 17 nt, Streptococcus pneumoniae R6
guacagauuugaaaacu

SEQ ID NO: 4087763 - RNA, 19 nt, Streptococcus pneumoniae R6
guacagcuugcauagacuu

SEQ ID NO: 4087764 - RNA, 13 nt, Streptococcus pneumoniae R6
guacauucaacac

SEQ ID NO: 4087765 - RNA, 16 nt, Streptococcus pneumoniae R6
guacauugaaauuaaa

SEQ ID NO: 4087766 - RNA, 21 nt, Streptococcus pneumoniae R6
guaccacggcagacagagaaa

SEQ ID NO: 4087767 - RNA, 22 nt, Streptococcus pneumoniae R6
guaccacggcagacagagaaaa

SEQ ID NO: 4087768 - RNA, 13 nt, Streptococcus pneumoniae R6
guaccagcucguu

SEQ ID NO: 4087769 - RNA, 13 nt, Streptococcus pneumoniae R6
guaccaugauaca

SEQ ID NO: 4087770 - RNA, 19 nt, Streptococcus pneumoniae R6
guaccgaauguggauacug

SEQ ID NO: 4087771 - RNA, 15 nt, Streptococcus pneumoniae R6
guaccgccaaaccuu

SEQ ID NO: 4087772 - RNA, 21 nt, Streptococcus pneumoniae R6
guaccguucauauccguucca

SEQ ID NO: 4087773 - RNA, 20 nt, Streptococcus pneumoniae R6
guaccuaaaaaggaaccagu

SEQ ID NO: 4087774 - RNA, 15 nt, Streptococcus pneumoniae R6
guacuaagcaugaua

SEQ ID NO: 4087775 - RNA, 21 nt, Streptococcus pneumoniae R6
guacuagggcauuuugaccug

SEQ ID NO: 4087776 - RNA, 23 nt, Streptococcus pneumoniae R6
guacuauucuaguuucaaucuau

SEQ ID NO: 4087777 - RNA, 19 nt, Streptococcus pneumoniae R6
guacucaaugaaaaucaaa

SEQ ID NO: 4087778 - RNA, 14 nt, Streptococcus pneumoniae R6
guacucacuuacau

SEQ ID NO: 4087779 - RNA, 19 nt, Streptococcus pneumoniae R6
guacugccccccaaaaaag

SEQ ID NO: 4087780 - RNA, 13 nt, Streptococcus pneumoniae R6
guacuggauaaag

SEQ ID NO: 4087781 - RNA, 12 nt, Streptococcus pneumoniae R6
guacuguauacu

SEQ ID NO: 4087782 - RNA, 21 nt, Streptococcus pneumoniae R6
guacuguuauagauucaacga

SEQ ID NO: 4087783 - RNA, 22 nt, Streptococcus pneumoniae R6
guacuuucagaacauuacccau

SEQ ID NO: 4087784 - RNA, 12 nt, Streptococcus pneumoniae R6
guacuuuccaau

SEQ ID NO: 4087785 - RNA, 16 nt, Streptococcus pneumoniae R6
guagaaaaugaaauuu

SEQ ID NO: 4087786 - RNA, 19 nt, Streptococcus pneumoniae R6
guagaaagucuuuaacauc

SEQ ID NO: 4087787 - RNA, 16 nt, Streptococcus pneumoniae R6
guagaacgauaaacaa

SEQ ID NO: 4087788 - RNA, 22 nt, Streptococcus pneumoniae R6
guagaaguguauuauucuaguu

SEQ ID NO: 4087789 - RNA, 16 nt, Streptococcus pneumoniae R6
guagaggaggauagaa

SEQ ID NO: 4087790 - RNA, 14 nt, Streptococcus pneumoniae R6
guagagucuguucu

SEQ ID NO: 4087791 - RNA, 12 nt, Streptococcus pneumoniae R6
guagaguuugua

SEQ ID NO: 4087792 - RNA, 22 nt, Streptococcus pneumoniae R6
guagaguuuugguugaugaaga

SEQ ID NO: 4087793 - RNA, 14 nt, Streptococcus pneumoniae R6
guagaugaaaaaua

SEQ ID NO: 4087794 - RNA, 15 nt, Streptococcus pneumoniae R6
guagaugaaacugac

SEQ ID NO: 4087795 - RNA, 15 nt, Streptococcus pneumoniae R6
guagauggaacugac

SEQ ID NO: 4087796 - RNA, 22 nt, Streptococcus pneumoniae R6
guagauuauaugcuaaaaugua

SEQ ID NO: 4087797 - RNA, 13 nt, Streptococcus pneumoniae R6
guagcaaaacacu

SEQ ID NO: 4087798 - RNA, 15 nt, Streptococcus pneumoniae R6
guagcaacagcugga

SEQ ID NO: 4087799 - RNA, 16 nt, Streptococcus pneumoniae R6
guagccaaaauccuug

SEQ ID NO: 4087800 - RNA, 22 nt, Streptococcus pneumoniae R6
guagccacucuggcaauuuauc

SEQ ID NO: 4087801 - RNA, 18 nt, Streptococcus pneumoniae R6
guagcccuucauaaagga

SEQ ID NO: 4087802 - RNA, 16 nt, Streptococcus pneumoniae R6
guagccugugauuuuc

SEQ ID NO: 4087803 - RNA, 14 nt, Streptococcus pneumoniae R6
guagcggauuuuca

SEQ ID NO: 4087804 - RNA, 15 nt, Streptococcus pneumoniae R6
guagcggauuuucaa

SEQ ID NO: 4087805 - RNA, 13 nt, Streptococcus pneumoniae R6
guagcuauuaaag

SEQ ID NO: 4087806 - RNA, 15 nt, Streptococcus pneumoniae R6
guagcuauuaaagau

SEQ ID NO: 4087807 - RNA, 18 nt, Streptococcus pneumoniae R6
guagcugagaagcccaua

SEQ ID NO: 4087808 - RNA, 18 nt, Streptococcus pneumoniae R6
guaggaagauuuuuugga

SEQ ID NO: 4087809 - RNA, 17 nt, Streptococcus pneumoniae R6
guaggacgauaaaaacg

SEQ ID NO: 4087810 - RNA, 13 nt, Streptococcus pneumoniae R6
guaggaugacaac

SEQ ID NO: 4087811 - RNA, 14 nt, Streptococcus pneumoniae R6
guaggauuucuccu

SEQ ID NO: 4087812 - RNA, 22 nt, Streptococcus pneumoniae R6
guaggcauaaaucaaaucgaua

SEQ ID NO: 4087813 - RNA, 19 nt, Streptococcus pneumoniae R6
guaggcuuuaucaagcaaa

SEQ ID NO: 4087814 - RNA, 13 nt, Streptococcus pneumoniae R6
guaggugcuuauu

SEQ ID NO: 4087815 - RNA, 19 nt, Streptococcus pneumoniae R6
guaggugcuuauuucacau

SEQ ID NO: 4087816 - RNA, 14 nt, Streptococcus pneumoniae R6
guagguugcucaaa

SEQ ID NO: 4087817 - RNA, 17 nt, Streptococcus pneumoniae R6
guagguugcucaaagca

SEQ ID NO: 4087818 - RNA, 17 nt, Streptococcus pneumoniae R6
guagguugggugaagug

SEQ ID NO: 4087819 - RNA, 15 nt, Streptococcus pneumoniae R6
guaguaaccaccuac

SEQ ID NO: 4087820 - RNA, 22 nt, Streptococcus pneumoniae R6
guaguacacaacugcuucuaag

SEQ ID NO: 4087821 - RNA, 20 nt, Streptococcus pneumoniae R6
guaguacugaacaaugaaaa

SEQ ID NO: 4087822 - RNA, 21 nt, Streptococcus pneumoniae R6
guaguacugaacaaugaaaaa

SEQ ID NO: 4087823 - RNA, 16 nt, Streptococcus pneumoniae R6
guaguagucagugauu

SEQ ID NO: 4087824 - RNA, 14 nt, Streptococcus pneumoniae R6
guagucuaggauau

SEQ ID NO: 4087825 - RNA, 18 nt, Streptococcus pneumoniae R6
guagucuccguaaaagac

SEQ ID NO: 4087826 - RNA, 14 nt, Streptococcus pneumoniae R6
guagucuuuuaaac

SEQ ID NO: 4087827 - RNA, 15 nt, Streptococcus pneumoniae R6
guaguugagcuggcu

SEQ ID NO: 4087828 - RNA, 20 nt, Streptococcus pneumoniae R6
guaguuuaccccaaauuccu

SEQ ID NO: 4087829 - RNA, 22 nt, Streptococcus pneumoniae R6
guaguuuuaccacuaaacuaca

SEQ ID NO: 4087830 - RNA, 19 nt, Streptococcus pneumoniae R6
guauaaaaaagucugggaa

SEQ ID NO: 4087831 - RNA, 15 nt, Streptococcus pneumoniae R6
guauaaaacuuauga

SEQ ID NO: 4087832 - RNA, 12 nt, Streptococcus pneumoniae R6
guauaaaccacg

SEQ ID NO: 4087833 - RNA, 23 nt, Streptococcus pneumoniae R6
guauaaucccauugagaaaauau

SEQ ID NO: 4087834 - RNA, 21 nt, Streptococcus pneumoniae R6
guauaauggauugaaauaaga

SEQ ID NO: 4087835 - RNA, 18 nt, Streptococcus pneumoniae R6
guauaccagucguuucaa

SEQ ID NO: 4087836 - RNA, 19 nt, Streptococcus pneumoniae R6
guauacuuuuucaguuuua

SEQ ID NO: 4087837 - RNA, 17 nt, Streptococcus pneumoniae R6
guauaggucuggcuauu

SEQ ID NO: 4087838 - RNA, 15 nt, Streptococcus pneumoniae R6
guauaguagaagugu

SEQ ID NO: 4087839 - RNA, 12 nt, Streptococcus pneumoniae R6
guauauucaaaa

SEQ ID NO: 4087840 - RNA, 21 nt, Streptococcus pneumoniae R6
guauauucugaaugcuuucca

SEQ ID NO: 4087841 - RNA, 13 nt, Streptococcus pneumoniae R6
guauauucugugu

SEQ ID NO: 4087842 - RNA, 17 nt, Streptococcus pneumoniae R6
guauauugaaaugaaau

SEQ ID NO: 4087843 - RNA, 21 nt, Streptococcus pneumoniae R6
guaucaagguuuuucuguacu

SEQ ID NO: 4087844 - RNA, 13 nt, Streptococcus pneumoniae R6
guaucaaguguau

SEQ ID NO: 4087845 - RNA, 18 nt, Streptococcus pneumoniae R6
guaucaauguaguaauca

SEQ ID NO: 4087846 - RNA, 14 nt, Streptococcus pneumoniae R6
guaucauauaaaua

SEQ ID NO: 4087847 - RNA, 22 nt, Streptococcus pneumoniae R6
guaucauauaaauauagaaacg

SEQ ID NO: 4087848 - RNA, 14 nt, Streptococcus pneumoniae R6
guaucauucuuauu

SEQ ID NO: 4087849 - RNA, 14 nt, Streptococcus pneumoniae R6
guauccuauuucac

SEQ ID NO: 4087850 - RNA, 19 nt, Streptococcus pneumoniae R6
guaucggaaauauuuugcu

SEQ ID NO: 4087851 - RNA, 19 nt, Streptococcus pneumoniae R6
guaucugaugcugacaagu

SEQ ID NO: 4087852 - RNA, 16 nt, Streptococcus pneumoniae R6
guaucugcuaaaacaa

SEQ ID NO: 4087853 - RNA, 15 nt, Streptococcus pneumoniae R6
gucaucguuccaguu

SEQ ID NO: 4087854 - RNA, 12 nt, Streptococcus pneumoniae R6
gucaucuaucaa

SEQ ID NO: 4087855 - RNA, 20 nt, Streptococcus pneumoniae R6
gucaugaaguggggcaccau

SEQ ID NO: 4087856 - RNA, 19 nt, Streptococcus pneumoniae R6
gucaugaccccuaaauaua

SEQ ID NO: 4087857 - RNA, 13 nt, Streptococcus pneumoniae R6
gucauggccucua

SEQ ID NO: 4087858 - RNA, 16 nt, Streptococcus pneumoniae R6
gucauguuagaaaaau

SEQ ID NO: 4087859 - RNA, 14 nt, Streptococcus pneumoniae R6
gucauucaauccau

SEQ ID NO: 4087860 - RNA, 13 nt, Streptococcus pneumoniae R6
gucauuccaauuc

SEQ ID NO: 4087861 - RNA, 12 nt, Streptococcus pneumoniae R6
gucauucccugu

SEQ ID NO: 4087862 - RNA, 15 nt, Streptococcus pneumoniae R6
gucauuuuucugcua

SEQ ID NO: 4087863 - RNA, 14 nt, Streptococcus pneumoniae R6
guccaacagacuca

SEQ ID NO: 4087864 - RNA, 12 nt, Streptococcus pneumoniae R6
guccaaggcuga

SEQ ID NO: 4087865 - RNA, 18 nt, Streptococcus pneumoniae R6
guccaauuuugucucuga

SEQ ID NO: 4087866 - RNA, 19 nt, Streptococcus pneumoniae R6
guccacugcaauuucuaaa

SEQ ID NO: 4087867 - RNA, 20 nt, Streptococcus pneumoniae R6
guccagcacuaaaacguugu

SEQ ID NO: 4087868 - RNA, 14 nt, Streptococcus pneumoniae R6
guccauaacugcug

SEQ ID NO: 4087869 - RNA, 22 nt, Streptococcus pneumoniae R6
guccauccaagcgucugaggca

SEQ ID NO: 4087870 - RNA, 16 nt, Streptococcus pneumoniae R6
guccauuugaaagaac

SEQ ID NO: 4087871 - RNA, 13 nt, Streptococcus pneumoniae R6
gucccagcuucuu

SEQ ID NO: 4087872 - RNA, 14 nt, Streptococcus pneumoniae R6
gucccaguuuucuu

SEQ ID NO: 4087873 - RNA, 16 nt, Streptococcus pneumoniae R6
gucccaguuuucuucg

SEQ ID NO: 4087874 - RNA, 13 nt, Streptococcus pneumoniae R6
gucccauuuucag

SEQ ID NO: 4087875 - RNA, 16 nt, Streptococcus pneumoniae R6
guccgaaaaauuucuc

SEQ ID NO: 4087876 - RNA, 16 nt, Streptococcus pneumoniae R6
guccgagcaggaaggu

SEQ ID NO: 4087877 - RNA, 23 nt, Streptococcus pneumoniae R6
guccgcugcucugccagcugagc

SEQ ID NO: 4087878 - RNA, 18 nt, Streptococcus pneumoniae R6
guccgugauuguuuuuaa

SEQ ID NO: 4087879 - RNA, 17 nt, Streptococcus pneumoniae R6
guccuaaaacuagugaa

SEQ ID NO: 4087880 - RNA, 20 nt, Streptococcus pneumoniae R6
guccuaaauagaagauaaag

SEQ ID NO: 4087881 - RNA, 13 nt, Streptococcus pneumoniae R6
guccuaauaaacu

SEQ ID NO: 4087882 - RNA, 14 nt, Streptococcus pneumoniae R6
guccucaauuugaa

SEQ ID NO: 4087883 - RNA, 19 nt, Streptococcus pneumoniae R6
guccucgcaagagacuauu

SEQ ID NO: 4087884 - RNA, 21 nt, Streptococcus pneumoniae R6
guccucggugggcaccuacua

SEQ ID NO: 4087885 - RNA, 16 nt, Streptococcus pneumoniae R6
guccugaaaaucaucu

SEQ ID NO: 4087886 - RNA, 18 nt, Streptococcus pneumoniae R6
guccugaaaaucaucugc

SEQ ID NO: 4087887 - RNA, 18 nt, Streptococcus pneumoniae R6
guccuuaugacgaaugau

SEQ ID NO: 4087888 - RNA, 14 nt, Streptococcus pneumoniae R6
guccuuguaugaca

SEQ ID NO: 4087889 - RNA, 17 nt, Streptococcus pneumoniae R6
guccuuguaugacaucu

SEQ ID NO: 4087890 - RNA, 16 nt, Streptococcus pneumoniae R6
guccuuucuuuuuuga

SEQ ID NO: 4087891 - RNA, 19 nt, Streptococcus pneumoniae R6
guccuuucuuuuuugauau

SEQ ID NO: 4087892 - RNA, 23 nt, Streptococcus pneumoniae R6
gucgaaccaagagcacgauuauu

SEQ ID NO: 4087893 - RNA, 19 nt, Streptococcus pneumoniae R6
gucgaaccuuccugauacc

SEQ ID NO: 4087894 - RNA, 15 nt, Streptococcus pneumoniae R6
gucgaagcuuccaau

SEQ ID NO: 4087895 - RNA, 19 nt, Streptococcus pneumoniae R6
gucgaagcuuccaauaaua

SEQ ID NO: 4087896 - RNA, 18 nt, Streptococcus pneumoniae R6
gucgauuggcagccucuu

SEQ ID NO: 4087897 - RNA, 17 nt, Streptococcus pneumoniae R6
gucgcuugaaccuuucu

SEQ ID NO: 4087898 - RNA, 19 nt, Streptococcus pneumoniae R6
gucggaacaucuuuuccau

SEQ ID NO: 4087899 - RNA, 18 nt, Streptococcus pneumoniae R6
gucggauggaaauaaucu

SEQ ID NO: 4087900 - RNA, 13 nt, Streptococcus pneumoniae R6
gucggcaggcugg

SEQ ID NO: 4087901 - RNA, 21 nt, Streptococcus pneumoniae R6
gucgguuuuauuaaguagaau

SEQ ID NO: 4087902 - RNA, 20 nt, Streptococcus pneumoniae R6
gucguaccuaaaaaggaacc

SEQ ID NO: 4087903 - RNA, 15 nt, Streptococcus pneumoniae R6
gucgucauaccaguu

SEQ ID NO: 4087904 - RNA, 18 nt, Streptococcus pneumoniae R6
gucguuaaaagcaaaaac

SEQ ID NO: 4087905 - RNA, 15 nt, Streptococcus pneumoniae R6
gucguuagcacacca

SEQ ID NO: 4087906 - RNA, 16 nt, Streptococcus pneumoniae R6
gucuaaaaauuuaaaa

SEQ ID NO: 4087907 - RNA, 20 nt, Streptococcus pneumoniae R6
gucuaaacuguacaagaaca

SEQ ID NO: 4087908 - RNA, 16 nt, Streptococcus pneumoniae R6
gucuacaaauucaaac

SEQ ID NO: 4087909 - RNA, 19 nt, Streptococcus pneumoniae R6
gucuacaauagcuuguucc

SEQ ID NO: 4087910 - RNA, 23 nt, Streptococcus pneumoniae R6
gucuacaauagcuuguuccaauu

SEQ ID NO: 4087911 - RNA, 22 nt, Streptococcus pneumoniae R6
gucuacauucuuuuuaaggagu

SEQ ID NO: 4087912 - RNA, 17 nt, Streptococcus pneumoniae R6
gucuagacuauaacaga

SEQ ID NO: 4087913 - RNA, 19 nt, Streptococcus pneumoniae R6
gucuauagaacuaguaaau

SEQ ID NO: 4087914 - RNA, 16 nt, Streptococcus pneumoniae R6
gucuaucaaacaggau

SEQ ID NO: 4087915 - RNA, 21 nt, Streptococcus pneumoniae R6
gucuauccagccuucauaaaa

SEQ ID NO: 4087916 - RNA, 21 nt, Streptococcus pneumoniae R6
gucuauguuguaggugcuuau

SEQ ID NO: 4087917 - RNA, 16 nt, Streptococcus pneumoniae R6
gucuauuauacaccau

SEQ ID NO: 4087918 - RNA, 16 nt, Streptococcus pneumoniae R6
gucuauucuuuccuuu

SEQ ID NO: 4087919 - RNA, 11 nt, Streptococcus pneumoniae R6
gucuauuuucu

SEQ ID NO: 4087920 - RNA, 20 nt, Streptococcus pneumoniae R6
gucucaaaaucaaagacuua

SEQ ID NO: 4087921 - RNA, 13 nt, Streptococcus pneumoniae R6
gucucaugaaagg

SEQ ID NO: 4087922 - RNA, 21 nt, Streptococcus pneumoniae R6
gucuccaguaacuuuaccaaa

SEQ ID NO: 4087923 - RNA, 14 nt, Streptococcus pneumoniae R6
gucuccugugcucc

SEQ ID NO: 4087924 - RNA, 21 nt, Streptococcus pneumoniae R6
gucucgacugguaaagaaugg

SEQ ID NO: 4087925 - RNA, 22 nt, Streptococcus pneumoniae R6
gucucuaaaaauaaaaaagaga

SEQ ID NO: 4087926 - RNA, 12 nt, Streptococcus pneumoniae R6
gucucuaaauaa

SEQ ID NO: 4087927 - RNA, 20 nt, Streptococcus pneumoniae R6
gucucuccagcgagcaaacg

SEQ ID NO: 4087928 - RNA, 22 nt, Streptococcus pneumoniae R6
gucucugucccaucauuucuuc

SEQ ID NO: 4087929 - RNA, 22 nt, Streptococcus pneumoniae R6
gucucuuaauaucagccagagc

SEQ ID NO: 4087930 - RNA, 17 nt, Streptococcus pneumoniae R6
gucucuugcgaggacag

SEQ ID NO: 4087931 - RNA, 19 nt, Streptococcus pneumoniae R6
gucucuuuuguucuaugag

SEQ ID NO: 4087932 - RNA, 15 nt, Streptococcus pneumoniae R6
gucugaaggaacuaa

SEQ ID NO: 4087933 - RNA, 15 nt, Streptococcus pneumoniae R6
gucugaauauauaau

SEQ ID NO: 4087934 - RNA, 17 nt, Streptococcus pneumoniae R6
gucugaauauauaauua

SEQ ID NO: 4087935 - RNA, 23 nt, Streptococcus pneumoniae R6
gucugacgcuggaaauaagaauc

SEQ ID NO: 4087936 - RNA, 20 nt, Streptococcus pneumoniae R6
gucugagcauucuuuuaucu

SEQ ID NO: 4087937 - RNA, 17 nt, Streptococcus pneumoniae R6
gucuggauguucugucu

SEQ ID NO: 4087938 - RNA, 20 nt, Streptococcus pneumoniae R6
gucuggcucguggcagacca

SEQ ID NO: 4087939 - RNA, 17 nt, Streptococcus pneumoniae R6
gucugggaaaaauuuuc

SEQ ID NO: 4087940 - RNA, 23 nt, Streptococcus pneumoniae R6
gucugggaaaaauuuucaaaauc

SEQ ID NO: 4087941 - RNA, 13 nt, Streptococcus pneumoniae R6
gucugggugcuga

SEQ ID NO: 4087942 - RNA, 13 nt, Streptococcus pneumoniae R6
gucugguucccag

SEQ ID NO: 4087943 - RNA, 17 nt, Streptococcus pneumoniae R6
gucugguucccagcaug

SEQ ID NO: 4087944 - RNA, 19 nt, Streptococcus pneumoniae R6
gucugucaaagcuucgcag

SEQ ID NO: 4087945 - RNA, 21 nt, Streptococcus pneumoniae R6
gucugucaccuuaucacgaau

SEQ ID NO: 4087946 - RNA, 22 nt, Streptococcus pneumoniae R6
gucugucaccuuaucacgaauu

SEQ ID NO: 4087947 - RNA, 18 nt, Streptococcus pneumoniae R6
gucuuacguucauccaua

SEQ ID NO: 4087948 - RNA, 13 nt, Streptococcus pneumoniae R6
gucuuauccuugu

SEQ ID NO: 4087949 - RNA, 12 nt, Streptococcus pneumoniae R6
gucuuauuucau

SEQ ID NO: 4087950 - RNA, 14 nt, Streptococcus pneumoniae R6
gucuucaauaccaa

SEQ ID NO: 4087951 - RNA, 16 nt, Streptococcus pneumoniae R6
gucuuccauuucuuug

SEQ ID NO: 4087952 - RNA, 21 nt, Streptococcus pneumoniae R6
gucuucuugaguaguuccagu

SEQ ID NO: 4087953 - RNA, 20 nt, Streptococcus pneumoniae R6
gucuugauggacaacaauga

SEQ ID NO: 4087954 - RNA, 14 nt, Streptococcus pneumoniae R6
gucuuggaaaaugg

SEQ ID NO: 4087955 - RNA, 15 nt, Streptococcus pneumoniae R6
gucuuggcuguuucc

SEQ ID NO: 4087956 - RNA, 19 nt, Streptococcus pneumoniae R6
guuacugauuucgucaguu

SEQ ID NO: 4087957 - RNA, 22 nt, Streptococcus pneumoniae R6
guuagaaaaaguucaauuucac

SEQ ID NO: 4087958 - RNA, 21 nt, Streptococcus pneumoniae R6
guuagaauaaggaaaacauua

SEQ ID NO: 4087959 - RNA, 14 nt, Streptococcus pneumoniae R6
guuagacagaaaaa

SEQ ID NO: 4087960 - RNA, 18 nt, Streptococcus pneumoniae R6
guuagauaguucaaucau

SEQ ID NO: 4087961 - RNA, 22 nt, Streptococcus pneumoniae R6
guuagauuuauaauuucaacua

SEQ ID NO: 4087962 - RNA, 15 nt, Streptococcus pneumoniae R6
guuagccucucuaaa

SEQ ID NO: 4087963 - RNA, 22 nt, Streptococcus pneumoniae R6
guuaggaacgauguuugcagca

SEQ ID NO: 4087964 - RNA, 19 nt, Streptococcus pneumoniae R6
guuaggauguaggauuguu

SEQ ID NO: 4087965 - RNA, 15 nt, Streptococcus pneumoniae R6
guuaggcauauaaug

SEQ ID NO: 4087966 - RNA, 18 nt, Streptococcus pneumoniae R6
guuaggugaauuagugaa

SEQ ID NO: 4087967 - RNA, 14 nt, Streptococcus pneumoniae R6
guuagucaaaaaga

SEQ ID NO: 4087968 - RNA, 13 nt, Streptococcus pneumoniae R6
guuagucuuagua

SEQ ID NO: 4087969 - RNA, 14 nt, Streptococcus pneumoniae R6
guuaguguauaagg

SEQ ID NO: 4087970 - RNA, 18 nt, Streptococcus pneumoniae R6
guuauacauagcuaaaau

SEQ ID NO: 4087971 - RNA, 16 nt, Streptococcus pneumoniae R6
guuauaccaaaaaaac

SEQ ID NO: 4087972 - RNA, 17 nt, Streptococcus pneumoniae R6
guuauagaguguuaucu

SEQ ID NO: 4087973 - RNA, 18 nt, Streptococcus pneumoniae R6
guuauagauucaauauau

SEQ ID NO: 4087974 - RNA, 19 nt, Streptococcus pneumoniae R6
guuauagauucaauauauu

SEQ ID NO: 4087975 - RNA, 19 nt, Streptococcus pneumoniae R6
guuauaucugcuacagaua

SEQ ID NO: 4087976 - RNA, 12 nt, Streptococcus pneumoniae R6
guuaucuuauca

SEQ ID NO: 4087977 - RNA, 20 nt, Streptococcus pneumoniae R6
guuaugcaacuuuuuuaaaa

SEQ ID NO: 4087978 - RNA, 19 nt, Streptococcus pneumoniae R6
guuauggaaaaugauaugg

SEQ ID NO: 4087979 - RNA, 18 nt, Streptococcus pneumoniae R6
guuauuaacaaaagagcu

SEQ ID NO: 4087980 - RNA, 11 nt, Streptococcus pneumoniae R6
guuauucaaaa

SEQ ID NO: 4087981 - RNA, 22 nt, Streptococcus pneumoniae R6
guuauugaaacagcuaaagaca

SEQ ID NO: 4087982 - RNA, 16 nt, Streptococcus pneumoniae R6
guuauugcuuucaauu

SEQ ID NO: 4087983 - RNA, 15 nt, Streptococcus pneumoniae R6
guuauuggaacuaaa

SEQ ID NO: 4087984 - RNA, 19 nt, Streptococcus pneumoniae R6
guuauuucuccuaaagaaa

SEQ ID NO: 4087985 - RNA, 16 nt, Streptococcus pneumoniae R6
guucaaagauaucauc

SEQ ID NO: 4087986 - RNA, 20 nt, Streptococcus pneumoniae R6
guucaacaaaucagaaaagu

SEQ ID NO: 4087987 - RNA, 15 nt, Streptococcus pneumoniae R6
guucaagacuugggc

SEQ ID NO: 4087988 - RNA, 14 nt, Streptococcus pneumoniae R6
guucaagguaugaa

SEQ ID NO: 4087989 - RNA, 20 nt, Streptococcus pneumoniae R6
guucaaucagcuaaaaauaa

SEQ ID NO: 4087990 - RNA, 18 nt, Streptococcus pneumoniae R6
guucaaugggguucaucu

SEQ ID NO: 4087991 - RNA, 21 nt, Streptococcus pneumoniae R6
guucaccaauguucaagacau

SEQ ID NO: 4087992 - RNA, 20 nt, Streptococcus pneumoniae R6
guucaccaggagccaagaua

SEQ ID NO: 4087993 - RNA, 21 nt, Streptococcus pneumoniae R6
guucacguucgguauuuucau

SEQ ID NO: 4087994 - RNA, 20 nt, Streptococcus pneumoniae R6
guucacuugagcaaacugaa

SEQ ID NO: 4087995 - RNA, 18 nt, Streptococcus pneumoniae R6
guucagaauuuucuuacu

SEQ ID NO: 4087996 - RNA, 18 nt, Streptococcus pneumoniae R6
guucagggguaacgucuu

SEQ ID NO: 4087997 - RNA, 15 nt, Streptococcus pneumoniae R6
guucauaacuucacu

SEQ ID NO: 4087998 - RNA, 19 nt, Streptococcus pneumoniae R6
guucauaucuuauuucaau

SEQ ID NO: 4087999 - RNA, 14 nt, Streptococcus pneumoniae R6
guucaucauuaaca

SEQ ID NO: 4088000 - RNA, 18 nt, Streptococcus pneumoniae R6
guucauccagcaggagaa

SEQ ID NO: 4088001 - RNA, 20 nt, Streptococcus pneumoniae R6
guucauccagcaggagaaag

SEQ ID NO: 4088002 - RNA, 15 nt, Streptococcus pneumoniae R6
guucaucuucuuucu

SEQ ID NO: 4088003 - RNA, 15 nt, Streptococcus pneumoniae R6
guucauguucgaucu

SEQ ID NO: 4088004 - RNA, 22 nt, Streptococcus pneumoniae R6
guucauuaacgacauagucaaa

SEQ ID NO: 4088005 - RNA, 13 nt, Streptococcus pneumoniae R6
guucauuacucaa

SEQ ID NO: 4088006 - RNA, 18 nt, Streptococcus pneumoniae R6
guucauucuugguaaaga

SEQ ID NO: 4088007 - RNA, 21 nt, Streptococcus pneumoniae R6
guuccaaacuuaguauccuug

SEQ ID NO: 4088008 - RNA, 21 nt, Streptococcus pneumoniae R6
guuccaauagucauuccaugg

SEQ ID NO: 4088009 - RNA, 18 nt, Streptococcus pneumoniae R6
guuccagcgguaucaauc

SEQ ID NO: 4088010 - RNA, 23 nt, Streptococcus pneumoniae R6
guuccagucccaaguuccaaacu

SEQ ID NO: 4088011 - RNA, 12 nt, Streptococcus pneumoniae R6
guuccaguuugg

SEQ ID NO: 4088012 - RNA, 23 nt, Streptococcus pneumoniae R6
guuccaguuuggcaaauagaaga

SEQ ID NO: 4088013 - RNA, 20 nt, Streptococcus pneumoniae R6
guuccauaccaucaaagacc

SEQ ID NO: 4088014 - RNA, 21 nt, Streptococcus pneumoniae R6
guuccauaccaucaaagacca

SEQ ID NO: 4088015 - RNA, 20 nt, Streptococcus pneumoniae R6
guuccauaugauucuuucua

SEQ ID NO: 4088016 - RNA, 20 nt, Streptococcus pneumoniae R6
guuccauccacaaccuuaaa

SEQ ID NO: 4088017 - RNA, 22 nt, Streptococcus pneumoniae R6
guuccauccacaaccuuaaaac

SEQ ID NO: 4088018 - RNA, 17 nt, Streptococcus pneumoniae R6
guuccaucuacaaccuu

SEQ ID NO: 4088019 - RNA, 14 nt, Streptococcus pneumoniae R6
guuccauuuaacaa

SEQ ID NO: 4088020 - RNA, 19 nt, Streptococcus pneumoniae R6
guuccgcuaacguuuuugu

SEQ ID NO: 4088021 - RNA, 14 nt, Streptococcus pneumoniae R6
guuccuaauuguua

SEQ ID NO: 4088022 - RNA, 12 nt, Streptococcus pneumoniae R6
guuccuccauug

SEQ ID NO: 4088023 - RNA, 17 nt, Streptococcus pneumoniae R6
guuccuuauucugaaag

SEQ ID NO: 4088024 - RNA, 17 nt, Streptococcus pneumoniae R6
guucgcaucuuauuuca

SEQ ID NO: 4088025 - RNA, 22 nt, Streptococcus pneumoniae R6
guucgggcacuucuuuuuguuc

SEQ ID NO: 4088026 - RNA, 16 nt, Streptococcus pneumoniae R6
guucgugccaaucuca

SEQ ID NO: 4088027 - RNA, 16 nt, Streptococcus pneumoniae R6
guucuaaaacuccuau

SEQ ID NO: 4088028 - RNA, 18 nt, Streptococcus pneumoniae R6
guucuaaaacuccuauuc

SEQ ID NO: 4088029 - RNA, 12 nt, Streptococcus pneumoniae R6
guucuaaauuca

SEQ ID NO: 4088030 - RNA, 18 nt, Streptococcus pneumoniae R6
guucuaagguuucaaaac

SEQ ID NO: 4088031 - RNA, 17 nt, Streptococcus pneumoniae R6
guucuauaaaauauagu

SEQ ID NO: 4088032 - RNA, 16 nt, Streptococcus pneumoniae R6
guucuauagcagccuc

SEQ ID NO: 4088033 - RNA, 21 nt, Streptococcus pneumoniae R6
guucuauccacaaccucaaaa

SEQ ID NO: 4088034 - RNA, 16 nt, Streptococcus pneumoniae R6
guucuaucugcaaccu

SEQ ID NO: 4088035 - RNA, 19 nt, Streptococcus pneumoniae R6
guucuaucugcaaccucaa

SEQ ID NO: 4088036 - RNA, 21 nt, Streptococcus pneumoniae R6
guucuaucugccaccucaaaa

SEQ ID NO: 4088037 - RNA, 21 nt, Streptococcus pneumoniae R6
guucucaucuuauuucaaucu

SEQ ID NO: 4088038 - RNA, 13 nt, Streptococcus pneumoniae R6
guucucucuuuuu

SEQ ID NO: 4088039 - RNA, 12 nt, Streptococcus pneumoniae R6
guucucuuugca

SEQ ID NO: 4088040 - RNA, 14 nt, Streptococcus pneumoniae R6
guucugcaacaaca

SEQ ID NO: 4088041 - RNA, 13 nt, Streptococcus pneumoniae R6
guucugcuagacg

SEQ ID NO: 4088042 - RNA, 17 nt, Streptococcus pneumoniae R6
guucugcuccauaggca

SEQ ID NO: 4088043 - RNA, 17 nt, Streptococcus pneumoniae R6
guucugggcuuucaucc

SEQ ID NO: 4088044 - RNA, 23 nt, Streptococcus pneumoniae R6
guucuguaaugaaauacugaugu

SEQ ID NO: 4088045 - RNA, 18 nt, Streptococcus pneumoniae R6
guucuguuuagccuccau

SEQ ID NO: 4088046 - RNA, 13 nt, Streptococcus pneumoniae R6
guucuuauuucau

SEQ ID NO: 4088047 - RNA, 16 nt, Streptococcus pneumoniae R6
guucuuauuucauuuu

SEQ ID NO: 4088048 - RNA, 21 nt, Streptococcus pneumoniae R6
guucuucacuauugaugaagu

SEQ ID NO: 4088049 - RNA, 24 nt, Streptococcus pneumoniae R6
guucuuccacucaaaucauuucuu

SEQ ID NO: 4088050 - RNA, 23 nt, Streptococcus pneumoniae R6
guucuugaaaccaguuccuuugu

SEQ ID NO: 4088051 - RNA, 13 nt, Streptococcus pneumoniae R6
guucuuguuucaa

SEQ ID NO: 4088052 - RNA, 17 nt, Streptococcus pneumoniae R6
guucuuguuuugacauu

SEQ ID NO: 4088053 - RNA, 15 nt, Streptococcus pneumoniae R6
guucuuuuucaaaag

SEQ ID NO: 4088054 - RNA, 16 nt, Streptococcus pneumoniae R6
guucuuuuucaaaagc

SEQ ID NO: 4088055 - RNA, 12 nt, Streptococcus pneumoniae R6
guucuuuuugcu

SEQ ID NO: 4088056 - RNA, 17 nt, Streptococcus pneumoniae R6
guucuuuuuuguuucuu

SEQ ID NO: 4088057 - RNA, 16 nt, Streptococcus pneumoniae R6
guugaaaaaaagcuaa

SEQ ID NO: 4088058 - RNA, 13 nt, Streptococcus pneumoniae R6
guuuuagaauauc

SEQ ID NO: 4088059 - RNA, 15 nt, Streptococcus pneumoniae R6
guuuuagaauaucug

SEQ ID NO: 4088060 - RNA, 19 nt, Streptococcus pneumoniae R6
guuuuagaugauuggaaau

SEQ ID NO: 4088061 - RNA, 21 nt, Streptococcus pneumoniae R6
guuuuaguauaguaaacugaa

SEQ ID NO: 4088062 - RNA, 18 nt, Streptococcus pneumoniae R6
guuuuauacucuuagaaa

SEQ ID NO: 4088063 - RNA, 18 nt, Streptococcus pneumoniae R6
guuuuauauccuaaaaaa

SEQ ID NO: 4088064 - RNA, 21 nt, Streptococcus pneumoniae R6
guuuuaucaguaaucucaaaa

SEQ ID NO: 4088065 - RNA, 19 nt, Streptococcus pneumoniae R6
guuuuauuguuccuaaaac

SEQ ID NO: 4088066 - RNA, 21 nt, Streptococcus pneumoniae R6
guuuuauuguuccuaaaacag

SEQ ID NO: 4088067 - RNA, 18 nt, Streptococcus pneumoniae R6
guuuucaaucaagacaga

SEQ ID NO: 4088068 - RNA, 23 nt, Streptococcus pneumoniae R6
guuuucaaucaagacagauuuga

SEQ ID NO: 4088069 - RNA, 21 nt, Streptococcus pneumoniae R6
guuuucacaauuucauuucuu

SEQ ID NO: 4088070 - RNA, 16 nt, Streptococcus pneumoniae R6
guuuucacccuugauu

SEQ ID NO: 4088071 - RNA, 19 nt, Streptococcus pneumoniae R6
guuuucacuggaguucuuu

SEQ ID NO: 4088072 - RNA, 13 nt, Streptococcus pneumoniae R6
guuuucuaauugu

SEQ ID NO: 4088073 - RNA, 21 nt, Streptococcus pneumoniae R6
guuuucucauagccauaaaac

SEQ ID NO: 4088074 - RNA, 16 nt, Streptococcus pneumoniae R6
guuuucugaugcacua

SEQ ID NO: 4088075 - RNA, 15 nt, Streptococcus pneumoniae R6
guuuugagaauccaa

SEQ ID NO: 4088076 - RNA, 17 nt, Streptococcus pneumoniae R6
guuuugagaauccaaaa

SEQ ID NO: 4088077 - RNA, 14 nt, Streptococcus pneumoniae R6
guuuugagcaaccu

SEQ ID NO: 4088078 - RNA, 13 nt, Streptococcus pneumoniae R6
guuuugagguugc

SEQ ID NO: 4088079 - RNA, 13 nt, Streptococcus pneumoniae R6
guuuugagguugu

SEQ ID NO: 4088080 - RNA, 19 nt, Streptococcus pneumoniae R6
guuuuggauaauauccaca

SEQ ID NO: 4088081 - RNA, 22 nt, Streptococcus pneumoniae R6
guuuuggcuaguaaauaucauu

SEQ ID NO: 4088082 - RNA, 21 nt, Streptococcus pneumoniae R6
guuuuggguucgccauagaau

SEQ ID NO: 4088083 - RNA, 16 nt, Streptococcus pneumoniae R6
guuuugguuuuucuuc

SEQ ID NO: 4088084 - RNA, 16 nt, Streptococcus pneumoniae R6
guuuuguuucuuaucc

SEQ ID NO: 4088085 - RNA, 17 nt, Streptococcus pneumoniae R6
guuuuguuucuuaucca

SEQ ID NO: 4088086 - RNA, 14 nt, Streptococcus pneumoniae R6
guuuuguuugucag

SEQ ID NO: 4088087 - RNA, 17 nt, Streptococcus pneumoniae R6
guuuuuaaaggaauuuu

SEQ ID NO: 4088088 - RNA, 16 nt, Streptococcus pneumoniae R6
guuuuuaauuuuucuu

SEQ ID NO: 4088089 - RNA, 16 nt, Streptococcus pneumoniae R6
guuuuuacuacuuuug

SEQ ID NO: 4088090 - RNA, 20 nt, Streptococcus pneumoniae R6
guuuuuacuacuuuugucag

SEQ ID NO: 4088091 - RNA, 15 nt, Streptococcus pneumoniae R6
guuuuuaggcaauaa

SEQ ID NO: 4088092 - RNA, 20 nt, Streptococcus pneumoniae R6
guuuuuaggcaauaaaauau

SEQ ID NO: 4088093 - RNA, 14 nt, Streptococcus pneumoniae R6
guuuuuaucauuuu

SEQ ID NO: 4088094 - RNA, 15 nt, Streptococcus pneumoniae R6
guuuuucaaaccuuc

SEQ ID NO: 4088095 - RNA, 17 nt, Streptococcus pneumoniae R6
guuuuucccagccuuca

SEQ ID NO: 4088096 - RNA, 19 nt, Streptococcus pneumoniae R6
guuuuucgucaccaaauuu

SEQ ID NO: 4088097 - RNA, 11 nt, Streptococcus pneumoniae R6
guuuuucuucu

SEQ ID NO: 4088098 - RNA, 15 nt, Streptococcus pneumoniae R6
guuuuugaaaaaccu

SEQ ID NO: 4088099 - RNA, 15 nt, Streptococcus pneumoniae R6
guuuuugaauaaccu

SEQ ID NO: 4088100 - RNA, 19 nt, Streptococcus pneumoniae R6
guuuuuuaacaaaaauuug

SEQ ID NO: 4088101 - RNA, 15 nt, Streptococcus pneumoniae R6
guuuuuuacauagaa

SEQ ID NO: 4088102 - RNA, 19 nt, Streptococcus pneumoniae R6
guuuuuuaggacaauuucu

SEQ ID NO: 4088103 - RNA, 12 nt, Streptococcus pneumoniae R6
guuuuuuccuau

SEQ ID NO: 4088104 - RNA, 13 nt, Streptococcus pneumoniae R6
guuuuuucuuucu

SEQ ID NO: 4088105 - RNA, 18 nt, Streptococcus pneumoniae R6
guuuuuugaaguuuucaa

SEQ ID NO: 4088106 - RNA, 15 nt, Streptococcus pneumoniae R6
uaaaaaaaaaaagua

SEQ ID NO: 4088107 - RNA, 12 nt, Streptococcus pneumoniae R6
uaaaaaaacuau

SEQ ID NO: 4088108 - RNA, 19 nt, Streptococcus pneumoniae R6
uaaaaaaacugguagaaag

SEQ ID NO: 4088109 - RNA, 20 nt, Streptococcus pneumoniae R6
uaaaaaaacuuaaaaaucuu

SEQ ID NO: 4088110 - RNA, 16 nt, Streptococcus pneumoniae R6
uaaaaaaauuuggaaa

SEQ ID NO: 4088111 - RNA, 20 nt, Streptococcus pneumoniae R6
uaaaaaaauuuggaaaauag

SEQ ID NO: 4088112 - RNA, 19 nt, Streptococcus pneumoniae R6
uaaaaaagucugggaaaaa

SEQ ID NO: 4088113 - RNA, 14 nt, Streptococcus pneumoniae R6
uaaaaaagugaaca

SEQ ID NO: 4088114 - RNA, 14 nt, Streptococcus pneumoniae R6
uaaaaaaguugaag

SEQ ID NO: 4088115 - RNA, 20 nt, Streptococcus pneumoniae R6
uaaaaaaguuuccaaucaga

SEQ ID NO: 4088116 - RNA, 18 nt, Streptococcus pneumoniae R6
uaaaaaaucuuuuucaua

SEQ ID NO: 4088117 - RNA, 22 nt, Streptococcus pneumoniae R6
uaaaaaaucuuuuucauaacuu

SEQ ID NO: 4088118 - RNA, 16 nt, Streptococcus pneumoniae R6
uaaaaacaaucacgga

SEQ ID NO: 4088119 - RNA, 17 nt, Streptococcus pneumoniae R6
uaaaaacacauuuugaa

SEQ ID NO: 4088120 - RNA, 21 nt, Streptococcus pneumoniae R6
uaaaaacagaggcuggacaaa

SEQ ID NO: 4088121 - RNA, 22 nt, Streptococcus pneumoniae R6
uaaaaacaucuaccuauucaua

SEQ ID NO: 4088122 - RNA, 15 nt, Streptococcus pneumoniae R6
uaaaaaccuaucaua

SEQ ID NO: 4088123 - RNA, 16 nt, Streptococcus pneumoniae R6
uaaaaaccuaucauau

SEQ ID NO: 4088124 - RNA, 17 nt, Streptococcus pneumoniae R6
uaaaaaccuaucauauc

SEQ ID NO: 4088125 - RNA, 17 nt, Streptococcus pneumoniae R6
uaaaaacugaacaaauu

SEQ ID NO: 4088126 - RNA, 20 nt, Streptococcus pneumoniae R6
uaaaaacugaacaaauuaau

SEQ ID NO: 4088127 - RNA, 21 nt, Streptococcus pneumoniae R6
uaaaaacugaacaaauuaauu

SEQ ID NO: 4088128 - RNA, 14 nt, Streptococcus pneumoniae R6
uaaaaagaaagucc

SEQ ID NO: 4088129 - RNA, 22 nt, Streptococcus pneumoniae R6
uaaaaagaaaguccucauuuca

SEQ ID NO: 4088130 - RNA, 12 nt, Streptococcus pneumoniae R6
uaaaaagaaaua

SEQ ID NO: 4088131 - RNA, 14 nt, Streptococcus pneumoniae R6
uaaaaagaaauguc

SEQ ID NO: 4088132 - RNA, 20 nt, Streptococcus pneumoniae R6
uaaaaagaccggauugcucc

SEQ ID NO: 4088133 - RNA, 21 nt, Streptococcus pneumoniae R6
uaaaaagauaagguucaaaaa

SEQ ID NO: 4088134 - RNA, 21 nt, Streptococcus pneumoniae R6
uaaaaagcuacuauaaaagag

SEQ ID NO: 4088135 - RNA, 18 nt, Streptococcus pneumoniae R6
uaaaaagggauaaguuga

SEQ ID NO: 4088136 - RNA, 21 nt, Streptococcus pneumoniae R6
uaaaaaggguagccaauuccu

SEQ ID NO: 4088137 - RNA, 14 nt, Streptococcus pneumoniae R6
uaaaaauaaaaaag

SEQ ID NO: 4088138 - RNA, 16 nt, Streptococcus pneumoniae R6
uaaaaauaaaaaagag

SEQ ID NO: 4088139 - RNA, 22 nt, Streptococcus pneumoniae R6
uaaaaauagauuuuuaaauucu

SEQ ID NO: 4088140 - RNA, 23 nt, Streptococcus pneumoniae R6
uaaaaauagauuuuuaaauucuu

SEQ ID NO: 4088141 - RNA, 20 nt, Streptococcus pneumoniae R6
uaaaaauccguuuuuugaag

SEQ ID NO: 4088142 - RNA, 21 nt, Streptococcus pneumoniae R6
uaaaaauccguuuuuugaagu

SEQ ID NO: 4088143 - RNA, 22 nt, Streptococcus pneumoniae R6
uaaaaauccuaagauuacuguc

SEQ ID NO: 4088144 - RNA, 20 nt, Streptococcus pneumoniae R6
uaaaaauccugauuucaagu

SEQ ID NO: 4088145 - RNA, 21 nt, Streptococcus pneumoniae R6
uaaaaauccugauuucaagua

SEQ ID NO: 4088146 - RNA, 21 nt, Streptococcus pneumoniae R6
uaaaaauccuuuuuuugaagu

SEQ ID NO: 4088147 - RNA, 21 nt, Streptococcus pneumoniae R6
uaaaaaucuauuuuuaaauuu

SEQ ID NO: 4088148 - RNA, 19 nt, Streptococcus pneumoniae R6
uaaaaaucuucaaaaaagu

SEQ ID NO: 4088149 - RNA, 13 nt, Streptococcus pneumoniae R6
uaaaaauguuuua

SEQ ID NO: 4088150 - RNA, 15 nt, Streptococcus pneumoniae R6
uaaaaauuacaaaca

SEQ ID NO: 4088151 - RNA, 17 nt, Streptococcus pneumoniae R6
uaaaaauuauuuaaagc

SEQ ID NO: 4088152 - RNA, 20 nt, Streptococcus pneumoniae R6
uaaaaauuuuuuucuaauua

SEQ ID NO: 4088153 - RNA, 14 nt, Streptococcus pneumoniae R6
uaaaacaaagaaaa

SEQ ID NO: 4088154 - RNA, 21 nt, Streptococcus pneumoniae R6
uaaaacaaagaaaaagaagga

SEQ ID NO: 4088155 - RNA, 19 nt, Streptococcus pneumoniae R6
uaaaacaguguuuugagca

SEQ ID NO: 4088156 - RNA, 19 nt, Streptococcus pneumoniae R6
uaaaacaguguuuugagcu

SEQ ID NO: 4088157 - RNA, 23 nt, Streptococcus pneumoniae R6
uaaaacauacugugccagccaua

SEQ ID NO: 4088158 - RNA, 17 nt, Streptococcus pneumoniae R6
uaaaacauucuuacaaa

SEQ ID NO: 4088159 - RNA, 23 nt, Streptococcus pneumoniae R6
uaaaacauucuuagaaaucgauu

SEQ ID NO: 4088160 - RNA, 19 nt, Streptococcus pneumoniae R6
agcucaaaacacuguuuua

SEQ ID NO: 4088161 - RNA, 23 nt, Streptococcus pneumoniae R6
agcucaaaacacuguuuuaaggu

SEQ ID NO: 4088162 - RNA, 17 nt, Streptococcus pneumoniae R6
agcucaaaaguuuaucu

SEQ ID NO: 4088163 - RNA, 21 nt, Streptococcus pneumoniae R6
agcucaaugaaaaucaaagag

SEQ ID NO: 4088164 - RNA, 13 nt, Streptococcus pneumoniae R6
agcucagcauuuu

SEQ ID NO: 4088165 - RNA, 17 nt, Streptococcus pneumoniae R6
agcucaucuaauguuuu

SEQ ID NO: 4088166 - RNA, 20 nt, Streptococcus pneumoniae R6
agcucaucuaauguuuuuau

SEQ ID NO: 4088167 - RNA, 14 nt, Streptococcus pneumoniae R6
agcuccaaagaaga

SEQ ID NO: 4088168 - RNA, 20 nt, Streptococcus pneumoniae R6
agcuccaaauggcaugagga

SEQ ID NO: 4088169 - RNA, 22 nt, Streptococcus pneumoniae R6
agcuccaaauggcaugaggaga

SEQ ID NO: 4088170 - RNA, 21 nt, Streptococcus pneumoniae R6
agcuccaauuuauuuguuuau

SEQ ID NO: 4088171 - RNA, 17 nt, Streptococcus pneumoniae R6
agcuccauaacaauagc

SEQ ID NO: 4088172 - RNA, 19 nt, Streptococcus pneumoniae R6
agcuccauacacuggaugu

SEQ ID NO: 4088173 - RNA, 13 nt, Streptococcus pneumoniae R6
agcuccaucucca

SEQ ID NO: 4088174 - RNA, 14 nt, Streptococcus pneumoniae R6
agcuccaucuccaa

SEQ ID NO: 4088175 - RNA, 23 nt, Streptococcus pneumoniae R6
agcucccgcuucauuuagaacac

SEQ ID NO: 4088176 - RNA, 21 nt, Streptococcus pneumoniae R6
agcuccuuuagugauaucuug

SEQ ID NO: 4088177 - RNA, 15 nt, Streptococcus pneumoniae R6
agcucgagaaaggac

SEQ ID NO: 4088178 - RNA, 21 nt, Streptococcus pneumoniae R6
agcucgagaaaggggcucuuu

SEQ ID NO: 4088179 - RNA, 15 nt, Streptococcus pneumoniae R6
agcucgauaaaggac

SEQ ID NO: 4088180 - RNA, 21 nt, Streptococcus pneumoniae R6
agcucguucuauggcuuguuc

SEQ ID NO: 4088181 - RNA, 14 nt, Streptococcus pneumoniae R6
agcucucugauuuu

SEQ ID NO: 4088182 - RNA, 21 nt, Streptococcus pneumoniae R6
agcucugugcaauacagaacu

SEQ ID NO: 4088183 - RNA, 19 nt, Streptococcus pneumoniae R6
agcucuguuuuuggauuuu

SEQ ID NO: 4088184 - RNA, 23 nt, Streptococcus pneumoniae R6
agcucuguuuuuggauuuuguuu

SEQ ID NO: 4088185 - RNA, 11 nt, Streptococcus pneumoniae R6
agcucuuaaaa

SEQ ID NO: 4088186 - RNA, 14 nt, Streptococcus pneumoniae R6
agcucuucagcaaa

SEQ ID NO: 4088187 - RNA, 14 nt, Streptococcus pneumoniae R6
agcucuucuaaaaa

SEQ ID NO: 4088188 - RNA, 20 nt, Streptococcus pneumoniae R6
agcucuuuagucccagcuuc

SEQ ID NO: 4088189 - RNA, 15 nt, Streptococcus pneumoniae R6
agcucuuugacagaa

SEQ ID NO: 4088190 - RNA, 18 nt, Streptococcus pneumoniae R6
agcucuuuugggacagaa

SEQ ID NO: 4088191 - RNA, 23 nt, Streptococcus pneumoniae R6
agcucuuuuguuaauaacucgau

SEQ ID NO: 4088192 - RNA, 16 nt, Streptococcus pneumoniae R6
agcucuuuuuggaauu

SEQ ID NO: 4088193 - RNA, 20 nt, Streptococcus pneumoniae R6
agcucuuuuuggaauuuuuu

SEQ ID NO: 4088194 - RNA, 21 nt, Streptococcus pneumoniae R6
agcucuuuuuggaauuuuuug

SEQ ID NO: 4088195 - RNA, 13 nt, Streptococcus pneumoniae R6
agcugaauaggua

SEQ ID NO: 4088196 - RNA, 19 nt, Streptococcus pneumoniae R6
agcugacgggcaaauuuca

SEQ ID NO: 4088197 - RNA, 21 nt, Streptococcus pneumoniae R6
agcugacuucgucaguuccau

SEQ ID NO: 4088198 - RNA, 20 nt, Streptococcus pneumoniae R6
agcugacuucgucaguucua

SEQ ID NO: 4088199 - RNA, 21 nt, Streptococcus pneumoniae R6
agcugacuucgucaguucuau

SEQ ID NO: 4088200 - RNA, 12 nt, Streptococcus pneumoniae R6
agcugagauacc

SEQ ID NO: 4088201 - RNA, 19 nt, Streptococcus pneumoniae R6
agcugauagagauuauagu

SEQ ID NO: 4088202 - RNA, 14 nt, Streptococcus pneumoniae R6
agcugaucaauauu

SEQ ID NO: 4088203 - RNA, 15 nt, Streptococcus pneumoniae R6
agcugcagcugagga

SEQ ID NO: 4088204 - RNA, 21 nt, Streptococcus pneumoniae R6
agcugcaggcugcucaaaaca

SEQ ID NO: 4088205 - RNA, 16 nt, Streptococcus pneumoniae R6
agcugcggcuuucuuc

SEQ ID NO: 4088206 - RNA, 21 nt, Streptococcus pneumoniae R6
agcugcggcuuucuucacauc

SEQ ID NO: 4088207 - RNA, 20 nt, Streptococcus pneumoniae R6
agcugcggcuuuuucuuuca

SEQ ID NO: 4088208 - RNA, 14 nt, Streptococcus pneumoniae R6
agcugcugcuucca

SEQ ID NO: 4088209 - RNA, 21 nt, Streptococcus pneumoniae R6
agcugcugcuuccauuuccac

SEQ ID NO: 4088210 - RNA, 14 nt, Streptococcus pneumoniae R6
agcuggaagaauuu

SEQ ID NO: 4088211 - RNA, 14 nt, Streptococcus pneumoniae R6
agcuggcucaucug

SEQ ID NO: 4088212 - RNA, 14 nt, Streptococcus pneumoniae R6
agcuggcuccuucu

SEQ ID NO: 4088213 - RNA, 16 nt, Streptococcus pneumoniae R6
agcuggcuccuucuuu

SEQ ID NO: 4088214 - RNA, 18 nt, Streptococcus pneumoniae R6
agcuggcuccuucuuuuu

SEQ ID NO: 4088215 - RNA, 16 nt, Streptococcus pneumoniae R6
agcuguaaaucuagga

SEQ ID NO: 4088216 - RNA, 17 nt, Streptococcus pneumoniae R6
agcuguaucaauugcug

SEQ ID NO: 4088217 - RNA, 19 nt, Streptococcus pneumoniae R6
agcugucaaaucauccgaa

SEQ ID NO: 4088218 - RNA, 18 nt, Streptococcus pneumoniae R6
agcugucaagaaauuaca

SEQ ID NO: 4088219 - RNA, 20 nt, Streptococcus pneumoniae R6
agcugucaagaaauuacagu

SEQ ID NO: 4088220 - RNA, 21 nt, Streptococcus pneumoniae R6
agcugugcuuugagcaaccua

SEQ ID NO: 4088221 - RNA, 14 nt, Streptococcus pneumoniae R6
agcuguuuggccaa

SEQ ID NO: 4088222 - RNA, 15 nt, Streptococcus pneumoniae R6
agcuuagcuuuucuu

SEQ ID NO: 4088223 - RNA, 19 nt, Streptococcus pneumoniae R6
agcuuauauacccaaaaca

SEQ ID NO: 4088224 - RNA, 21 nt, Streptococcus pneumoniae R6
agcuuauauacccaaaacaca

SEQ ID NO: 4088225 - RNA, 23 nt, Streptococcus pneumoniae R6
agcuuauuauucuagugaaaaau

SEQ ID NO: 4088226 - RNA, 21 nt, Streptococcus pneumoniae R6
agcuucaucaguuccagcaaa

SEQ ID NO: 4088227 - RNA, 18 nt, Streptococcus pneumoniae R6
agcuucauuuaucuucuu

SEQ ID NO: 4088228 - RNA, 20 nt, Streptococcus pneumoniae R6
agcuuccaguagcgcuugau

SEQ ID NO: 4088229 - RNA, 18 nt, Streptococcus pneumoniae R6
agcuuccaucugcagccu

SEQ ID NO: 4088230 - RNA, 19 nt, Streptococcus pneumoniae R6
agcuuccgcaagagcaucu

SEQ ID NO: 4088231 - RNA, 23 nt, Streptococcus pneumoniae R6
agcuucuuggaauucuggauuuu

SEQ ID NO: 4088232 - RNA, 22 nt, Streptococcus pneumoniae R6
agcuucuuuuuauauauaaaau

SEQ ID NO: 4088233 - RNA, 21 nt, Streptococcus pneumoniae R6
agcuugaaacaaauaaaucau

SEQ ID NO: 4088234 - RNA, 22 nt, Streptococcus pneumoniae R6
agcuugaaacaaauaaaucauu

SEQ ID NO: 4088235 - RNA, 15 nt, Streptococcus pneumoniae R6
agcuugcaauucuuu

SEQ ID NO: 4088236 - RNA, 16 nt, Streptococcus pneumoniae R6
agcuugcaauucuuua

SEQ ID NO: 4088237 - RNA, 22 nt, Streptococcus pneumoniae R6
agcuugcaauucuuuagcagau

SEQ ID NO: 4088238 - RNA, 16 nt, Streptococcus pneumoniae R6
agcuugcgaaauggcu

SEQ ID NO: 4088239 - RNA, 20 nt, Streptococcus pneumoniae R6
agcuugcgauaaagcuaaag

SEQ ID NO: 4088240 - RNA, 22 nt, Streptococcus pneumoniae R6
agcuugcucaaaguacagauuu

SEQ ID NO: 4088241 - RNA, 14 nt, Streptococcus pneumoniae R6
agcuugcuuccaaa

SEQ ID NO: 4088242 - RNA, 24 nt, Streptococcus pneumoniae R6
agcuugcuuccaaaaauucuuacu

SEQ ID NO: 4088243 - RNA, 18 nt, Streptococcus pneumoniae R6
agcuugguaagagucacu

SEQ ID NO: 4088244 - RNA, 17 nt, Streptococcus pneumoniae R6
agcuugguaaugcucca

SEQ ID NO: 4088245 - RNA, 17 nt, Streptococcus pneumoniae R6
agcuuguuguugugaua

SEQ ID NO: 4088246 - RNA, 15 nt, Streptococcus pneumoniae R6
agcuuuaccauccug

SEQ ID NO: 4088247 - RNA, 18 nt, Streptococcus pneumoniae R6
agcuuuauuaagcccuac

SEQ ID NO: 4088248 - RNA, 11 nt, Streptococcus pneumoniae R6
agcuuucagag

SEQ ID NO: 4088249 - RNA, 15 nt, Streptococcus pneumoniae R6
agcuuucagagcugc

SEQ ID NO: 4088250 - RNA, 16 nt, Streptococcus pneumoniae R6
agcuuucagagcugca

SEQ ID NO: 4088251 - RNA, 23 nt, Streptococcus pneumoniae R6
agcuuucuagccuguaugauggg

SEQ ID NO: 4088252 - RNA, 18 nt, Streptococcus pneumoniae R6
agcuuucuaguuugcucu

SEQ ID NO: 4088253 - RNA, 15 nt, Streptococcus pneumoniae R6
agcuuugcuuuccuc

SEQ ID NO: 4088254 - RNA, 12 nt, Streptococcus pneumoniae R6
agcuuuucuuca

SEQ ID NO: 4088255 - RNA, 15 nt, Streptococcus pneumoniae R6
agcuuuucuucaacc

SEQ ID NO: 4088256 - RNA, 16 nt, Streptococcus pneumoniae R6
agcuuuugcagcacca

SEQ ID NO: 4088257 - RNA, 17 nt, Streptococcus pneumoniae R6
agcuuuugugauaaagg

SEQ ID NO: 4088258 - RNA, 13 nt, Streptococcus pneumoniae R6
agcuuuuuccuca

SEQ ID NO: 4088259 - RNA, 14 nt, Streptococcus pneumoniae R6
agcuuuuucuuguu

SEQ ID NO: 4088260 - RNA, 15 nt, Streptococcus pneumoniae R6
agcuuuuucuuguug

SEQ ID NO: 4088261 - RNA, 12 nt, Streptococcus pneumoniae R6
agcuuuuuucuu

SEQ ID NO: 4088262 - RNA, 14 nt, Streptococcus pneumoniae R6
agcuuuuuucuuug

SEQ ID NO: 4088263 - RNA, 20 nt, Streptococcus pneumoniae R6
aggaaaaaaugaagcaaaca

SEQ ID NO: 4088264 - RNA, 21 nt, Streptococcus pneumoniae R6
aggaaaaucuucccacaauaa

SEQ ID NO: 4088265 - RNA, 11 nt, Streptococcus pneumoniae R6
aggaaaaugau

SEQ ID NO: 4088266 - RNA, 18 nt, Streptococcus pneumoniae R6
aggaaaaugauuuuuuac

SEQ ID NO: 4088267 - RNA, 22 nt, Streptococcus pneumoniae R6
aggaaaauugauuuauagaaau

SEQ ID NO: 4088268 - RNA, 16 nt, Streptococcus pneumoniae R6
aggaaaccaaucucaa

SEQ ID NO: 4088269 - RNA, 22 nt, Streptococcus pneumoniae R6
aggaaacgcucgguuucaacug

SEQ ID NO: 4088270 - RNA, 19 nt, Streptococcus pneumoniae R6
aggaaagaagguguuuuua

SEQ ID NO: 4088271 - RNA, 17 nt, Streptococcus pneumoniae R6
aggaaagcauaggggcu

SEQ ID NO: 4088272 - RNA, 18 nt, Streptococcus pneumoniae R6
aggaaagucaaacaaugu

SEQ ID NO: 4088273 - RNA, 17 nt, Streptococcus pneumoniae R6
aggaaagucaaauuaau

SEQ ID NO: 4088274 - RNA, 18 nt, Streptococcus pneumoniae R6
aggaaagucaaauuaauu

SEQ ID NO: 4088275 - RNA, 21 nt, Streptococcus pneumoniae R6
aggaaagucggaaggcaugaa

SEQ ID NO: 4088276 - RNA, 22 nt, Streptococcus pneumoniae R6
aggaaauaagucagcucacaaa

SEQ ID NO: 4088277 - RNA, 18 nt, Streptococcus pneumoniae R6
aggaacacguaaauuaua

SEQ ID NO: 4088278 - RNA, 23 nt, Streptococcus pneumoniae R6
aggaacacguaaauuauacucuu

SEQ ID NO: 4088279 - RNA, 22 nt, Streptococcus pneumoniae R6
aggaacgauguuugcagcacca

SEQ ID NO: 4088280 - RNA, 15 nt, Streptococcus pneumoniae R6
aggaacuauccguga

SEQ ID NO: 4088281 - RNA, 12 nt, Streptococcus pneumoniae R6
aggaagaaagag

SEQ ID NO: 4088282 - RNA, 12 nt, Streptococcus pneumoniae R6
aggaagauguaa

SEQ ID NO: 4088283 - RNA, 15 nt, Streptococcus pneumoniae R6
aggaagauuuauacu

SEQ ID NO: 4088284 - RNA, 22 nt, Streptococcus pneumoniae R6
aggaagccuucuuuuccaccaa

SEQ ID NO: 4088285 - RNA, 17 nt, Streptococcus pneumoniae R6
aggaagcuagccgcagg

SEQ ID NO: 4088286 - RNA, 22 nt, Streptococcus pneumoniae R6
aggaaggaaauagcuguuucaa

SEQ ID NO: 4088287 - RNA, 23 nt, Streptococcus pneumoniae R6
aggaagguaacucccauaguuaa

SEQ ID NO: 4088288 - RNA, 17 nt, Streptococcus pneumoniae R6
aggaagguuauuuggau

SEQ ID NO: 4088289 - RNA, 20 nt, Streptococcus pneumoniae R6
aggaaguaccaaggaagaag

SEQ ID NO: 4088290 - RNA, 18 nt, Streptococcus pneumoniae R6
aggaaguuuagauuaaaa

SEQ ID NO: 4088291 - RNA, 20 nt, Streptococcus pneumoniae R6
aggaauaaauccagcugaga

SEQ ID NO: 4088292 - RNA, 13 nt, Streptococcus pneumoniae R6
aggaauacuaaaa

SEQ ID NO: 4088293 - RNA, 15 nt, Streptococcus pneumoniae R6
aggaauacuaaaaua

SEQ ID NO: 4088294 - RNA, 16 nt, Streptococcus pneumoniae R6
aggaauacuaaaauau

SEQ ID NO: 4088295 - RNA, 23 nt, Streptococcus pneumoniae R6
aggaauauugaguucuucacgaa

SEQ ID NO: 4088296 - RNA, 23 nt, Streptococcus pneumoniae R6
aggaaucuugcugguuugugaag

SEQ ID NO: 4088297 - RNA, 17 nt, Streptococcus pneumoniae R6
aggaauucaagcaaaac

SEQ ID NO: 4088298 - RNA, 17 nt, Streptococcus pneumoniae R6
aggaauucauuuacuga

SEQ ID NO: 4088299 - RNA, 14 nt, Streptococcus pneumoniae R6
aggaauuuuagaag

SEQ ID NO: 4088300 - RNA, 18 nt, Streptococcus pneumoniae R6
aggacaaaauucguccuu

SEQ ID NO: 4088301 - RNA, 13 nt, Streptococcus pneumoniae R6
aggacaaauuucg

SEQ ID NO: 4088302 - RNA, 23 nt, Streptococcus pneumoniae R6
aggacaaauuucguccuuucuuu

SEQ ID NO: 4088303 - RNA, 13 nt, Streptococcus pneumoniae R6
aggacaggugcuu

SEQ ID NO: 4088304 - RNA, 14 nt, Streptococcus pneumoniae R6
aggacauaaaucga

SEQ ID NO: 4088305 - RNA, 22 nt, Streptococcus pneumoniae R6
aggacauaaaucgaucauauuu

SEQ ID NO: 4088306 - RNA, 22 nt, Streptococcus pneumoniae R6
aggacauagaaaaugguuccaa

SEQ ID NO: 4088307 - RNA, 14 nt, Streptococcus pneumoniae R6
aggacauugacuuu

SEQ ID NO: 4088308 - RNA, 13 nt, Streptococcus pneumoniae R6
aggaccaaauaua

SEQ ID NO: 4088309 - RNA, 15 nt, Streptococcus pneumoniae R6
aggaccagguuuuuc

SEQ ID NO: 4088310 - RNA, 17 nt, Streptococcus pneumoniae R6
aggaccagguuuuucac

SEQ ID NO: 4088311 - RNA, 23 nt, Streptococcus pneumoniae R6
aggaccugaguucauuacucaag

SEQ ID NO: 4088312 - RNA, 17 nt, Streptococcus pneumoniae R6
aggacuaaauacaaaaa

SEQ ID NO: 4088313 - RNA, 19 nt, Streptococcus pneumoniae R6
aggacugagccaauuaaau

SEQ ID NO: 4088314 - RNA, 16 nt, Streptococcus pneumoniae R6
aggacuuugcuuacag

SEQ ID NO: 4088315 - RNA, 13 nt, Streptococcus pneumoniae R6
aggacuuuuuuac

SEQ ID NO: 4088316 - RNA, 13 nt, Streptococcus pneumoniae R6
aggagaaaaagaa

SEQ ID NO: 4088317 - RNA, 20 nt, Streptococcus pneumoniae R6
aggagaaaaagaaguaaauc

SEQ ID NO: 4088318 - RNA, 13 nt, Streptococcus pneumoniae R6
aggagaaccagga

SEQ ID NO: 4088319 - RNA, 13 nt, Streptococcus pneumoniae R6
aggagaaucaaca

SEQ ID NO: 4088320 - RNA, 17 nt, Streptococcus pneumoniae R6
aggagaauuuuugagau

SEQ ID NO: 4088321 - RNA, 17 nt, Streptococcus pneumoniae R6
aggagaccagcuacaaa

SEQ ID NO: 4088322 - RNA, 22 nt, Streptococcus pneumoniae R6
aggagaguaugauuacuuauuu

SEQ ID NO: 4088323 - RNA, 17 nt, Streptococcus pneumoniae R6
aggagaugaauugugua

SEQ ID NO: 4088324 - RNA, 22 nt, Streptococcus pneumoniae R6
aggagcacuugaugaaaaaaag

SEQ ID NO: 4088325 - RNA, 20 nt, Streptococcus pneumoniae R6
aggagcaguugauggagcug

SEQ ID NO: 4088326 - RNA, 20 nt, Streptococcus pneumoniae R6
aggagcuggaucuugaggaa

SEQ ID NO: 4088327 - RNA, 14 nt, Streptococcus pneumoniae R6
aggagcuuuuggga

SEQ ID NO: 4088328 - RNA, 14 nt, Streptococcus pneumoniae R6
aggaggagaaaaag

SEQ ID NO: 4088329 - RNA, 20 nt, Streptococcus pneumoniae R6
aggaggcaaagaaaaaagcu

SEQ ID NO: 4088330 - RNA, 21 nt, Streptococcus pneumoniae R6
aggaggcaaagaaaaaagcug

SEQ ID NO: 4088331 - RNA, 21 nt, Streptococcus pneumoniae R6
aggagguaaaucccaaguaaa

SEQ ID NO: 4088332 - RNA, 15 nt, Streptococcus pneumoniae R6
aggaguccucuguau

SEQ ID NO: 4088333 - RNA, 17 nt, Streptococcus pneumoniae R6
aggaguuugagacaauc

SEQ ID NO: 4088334 - RNA, 16 nt, Streptococcus pneumoniae R6
aggauaauagcaagga

SEQ ID NO: 4088335 - RNA, 17 nt, Streptococcus pneumoniae R6
aggauaauagugauugg

SEQ ID NO: 4088336 - RNA, 18 nt, Streptococcus pneumoniae R6
aggauagaaguagagagu

SEQ ID NO: 4088337 - RNA, 14 nt, Streptococcus pneumoniae R6
aggauagauaccuu

SEQ ID NO: 4088338 - RNA, 14 nt, Streptococcus pneumoniae R6
aggauagcgaggau

SEQ ID NO: 4088339 - RNA, 22 nt, Streptococcus pneumoniae R6
aggauagcuccuccaaguccaa

SEQ ID NO: 4088340 - RNA, 13 nt, Streptococcus pneumoniae R6
aggauaugaggag

SEQ ID NO: 4088341 - RNA, 15 nt, Streptococcus pneumoniae R6
aggauaugaggagaa

SEQ ID NO: 4088342 - RNA, 20 nt, Streptococcus pneumoniae R6
aggauaugaggagaaagaag

SEQ ID NO: 4088343 - RNA, 20 nt, Streptococcus pneumoniae R6
aggauauuucuccaaagccu

SEQ ID NO: 4088344 - RNA, 17 nt, Streptococcus pneumoniae R6
aggaugccuuuuuauga

SEQ ID NO: 4088345 - RNA, 21 nt, Streptococcus pneumoniae R6
aggauuaccuuugaaaaaaug

SEQ ID NO: 4088346 - RNA, 14 nt, Streptococcus pneumoniae R6
aggauugauaaaau

SEQ ID NO: 4088347 - RNA, 19 nt, Streptococcus pneumoniae R6
aggauugguaaauucuuca

SEQ ID NO: 4088348 - RNA, 13 nt, Streptococcus pneumoniae R6
aggauuguucaga

SEQ ID NO: 4088349 - RNA, 17 nt, Streptococcus pneumoniae R6
aggauuuauuuuucuuu

SEQ ID NO: 4088350 - RNA, 15 nt, Streptococcus pneumoniae R6
aggauuuccuaguag

SEQ ID NO: 4088351 - RNA, 19 nt, Streptococcus pneumoniae R6
aggauuuuguucuuuuuca

SEQ ID NO: 4088352 - RNA, 18 nt, Streptococcus pneumoniae R6
aggauuuuugcuucugau

SEQ ID NO: 4088353 - RNA, 13 nt, Streptococcus pneumoniae R6
aggcaaagaaaaa

SEQ ID NO: 4088354 - RNA, 14 nt, Streptococcus pneumoniae R6
aggcaaagaaaaaa

SEQ ID NO: 4088355 - RNA, 18 nt, Streptococcus pneumoniae R6
aggcaaagagucccuuag

SEQ ID NO: 4088356 - RNA, 22 nt, Streptococcus pneumoniae R6
aggcaaagcugacgugguuuga

SEQ ID NO: 4088357 - RNA, 21 nt, Streptococcus pneumoniae R6
aggcaacaaaguaaccaucug

SEQ ID NO: 4088358 - RNA, 16 nt, Streptococcus pneumoniae R6
aggcaaccaaaaucau

SEQ ID NO: 4088359 - RNA, 14 nt, Streptococcus pneumoniae R6
aggcaauuaaaagg

SEQ ID NO: 4088360 - RNA, 15 nt, Streptococcus pneumoniae R6
aggcaauuaaaaggc

SEQ ID NO: 4088361 - RNA, 23 nt, Streptococcus pneumoniae R6
aggcacuuuuguccuauucuugu

SEQ ID NO: 4088362 - RNA, 18 nt, Streptococcus pneumoniae R6
aggcagauucucuaucuc

SEQ ID NO: 4088363 - RNA, 18 nt, Streptococcus pneumoniae R6
aggcagcuuaagugcguu

SEQ ID NO: 4088364 - RNA, 17 nt, Streptococcus pneumoniae R6
aggcauaaaucaaaucg

SEQ ID NO: 4088365 - RNA, 14 nt, Streptococcus pneumoniae R6
aggcauaauacugu

SEQ ID NO: 4088366 - RNA, 22 nt, Streptococcus pneumoniae R6
aggcauaguaccaguuaccauu

SEQ ID NO: 4088367 - RNA, 14 nt, Streptococcus pneumoniae R6
aggcaucaucugaa

SEQ ID NO: 4088368 - RNA, 19 nt, Streptococcus pneumoniae R6
aggcaucuugucaaagagu

SEQ ID NO: 4088369 - RNA, 17 nt, Streptococcus pneumoniae R6
aggcaugggccccagcu

SEQ ID NO: 4088370 - RNA, 21 nt, Streptococcus pneumoniae R6
aggcauugcgcuugauaaguu

SEQ ID NO: 4088371 - RNA, 16 nt, Streptococcus pneumoniae R6
aggcauugugcuugau

SEQ ID NO: 4088372 - RNA, 16 nt, Streptococcus pneumoniae R6
aggccaaacuugaaau

SEQ ID NO: 4088373 - RNA, 19 nt, Streptococcus pneumoniae R6
aggccaaacuugaaaugau

SEQ ID NO: 4088374 - RNA, 16 nt, Streptococcus pneumoniae R6
aggccaagucuuuucg

SEQ ID NO: 4088375 - RNA, 19 nt, Streptococcus pneumoniae R6
aggccacaaaugcuucuuu

SEQ ID NO: 4088376 - RNA, 22 nt, Streptococcus pneumoniae R6
aggcccccuuguaguucucaau

SEQ ID NO: 4088377 - RNA, 17 nt, Streptococcus pneumoniae R6
aggccgagucaaaauuc

SEQ ID NO: 4088378 - RNA, 21 nt, Streptococcus pneumoniae R6
aggccuaaggcuguuucaaau

SEQ ID NO: 4088379 - RNA, 19 nt, Streptococcus pneumoniae R6
aggccuauuuaccauggac

SEQ ID NO: 4088380 - RNA, 16 nt, Streptococcus pneumoniae R6
aggccucuucaaagaa

SEQ ID NO: 4088381 - RNA, 12 nt, Streptococcus pneumoniae R6
aggccuuggccu

SEQ ID NO: 4088382 - RNA, 18 nt, Streptococcus pneumoniae R6
aggccuuguggaagaagu

SEQ ID NO: 4088383 - RNA, 17 nt, Streptococcus pneumoniae R6
aggcuaagagagaagcc

SEQ ID NO: 4088384 - RNA, 14 nt, Streptococcus pneumoniae R6
aggcuaaugagucu

SEQ ID NO: 4088385 - RNA, 17 nt, Streptococcus pneumoniae R6
aggcuaaugagucuauu

SEQ ID NO: 4088386 - RNA, 17 nt, Streptococcus pneumoniae R6
aggcuaauugcaaauuu

SEQ ID NO: 4088387 - RNA, 21 nt, Streptococcus pneumoniae R6
aggcuaauugcaaauuuagca

SEQ ID NO: 4088388 - RNA, 16 nt, Streptococcus pneumoniae R6
aggcuauugaagaaga

SEQ ID NO: 4088389 - RNA, 16 nt, Streptococcus pneumoniae R6
aggcugacaauaaaga

SEQ ID NO: 4088390 - RNA, 22 nt, Streptococcus pneumoniae R6
aggcugacgcgaucuggcaggc

SEQ ID NO: 4088391 - RNA, 14 nt, Streptococcus pneumoniae R6
aggcugauuccugg

SEQ ID NO: 4088392 - RNA, 15 nt, Streptococcus pneumoniae R6
aggcugcucaaaaca

SEQ ID NO: 4088393 - RNA, 18 nt, Streptococcus pneumoniae R6
aggcugcucaaaacacug

SEQ ID NO: 4088394 - RNA, 22 nt, Streptococcus pneumoniae R6
aggcuggacaaaaacucaauuu

SEQ ID NO: 4088395 - RNA, 16 nt, Streptococcus pneumoniae R6
aggcugguugaaaacc

SEQ ID NO: 4088396 - RNA, 21 nt, Streptococcus pneumoniae R6
aggcuguaaugccaaagaaau

SEQ ID NO: 4088397 - RNA, 15 nt, Streptococcus pneumoniae R6
aggcuguaguuuuac

SEQ ID NO: 4088398 - RNA, 17 nt, Streptococcus pneumoniae R6
aggcugucggcaugcug

SEQ ID NO: 4088399 - RNA, 17 nt, Streptococcus pneumoniae R6
aggcuuaauauuaccac

SEQ ID NO: 4088400 - RNA, 23 nt, Streptococcus pneumoniae R6
aggcuugcucugucacuugaccu

SEQ ID NO: 4088401 - RNA, 19 nt, Streptococcus pneumoniae R6
aggcuuggauuuaaaaacg

SEQ ID NO: 4088402 - RNA, 14 nt, Streptococcus pneumoniae R6
aggcuugugugcca

SEQ ID NO: 4088403 - RNA, 15 nt, Streptococcus pneumoniae R6
aggcuuguucacuuu

SEQ ID NO: 4088404 - RNA, 15 nt, Streptococcus pneumoniae R6
aggcuuuaccaaaaa

SEQ ID NO: 4088405 - RNA, 21 nt, Streptococcus pneumoniae R6
aggcuuuaucaagcaaaucaa

SEQ ID NO: 4088406 - RNA, 12 nt, Streptococcus pneumoniae R6
aggcuuucaacu

SEQ ID NO: 4088407 - RNA, 21 nt, Streptococcus pneumoniae R6
aggcuuucaacugcuuuuuca

SEQ ID NO: 4088408 - RNA, 19 nt, Streptococcus pneumoniae R6
aggcuuuguggucuugcuu

SEQ ID NO: 4088409 - RNA, 14 nt, Streptococcus pneumoniae R6
aggcuuuuucucau

SEQ ID NO: 4088410 - RNA, 18 nt, Streptococcus pneumoniae R6
agggaaaaguggucugga

SEQ ID NO: 4088411 - RNA, 14 nt, Streptococcus pneumoniae R6
agggaaacaaaagu

SEQ ID NO: 4088412 - RNA, 23 nt, Streptococcus pneumoniae R6
agggaaacaccaccgauagagug

SEQ ID NO: 4088413 - RNA, 16 nt, Streptococcus pneumoniae R6
agggaaaccacuagca

SEQ ID NO: 4088414 - RNA, 16 nt, Streptococcus pneumoniae R6
agggagccugugguga

SEQ ID NO: 4088415 - RNA, 16 nt, Streptococcus pneumoniae R6
agggaguuuagaagag

SEQ ID NO: 4088416 - RNA, 18 nt, Streptococcus pneumoniae R6
agggauucuuauauuaaa

SEQ ID NO: 4088417 - RNA, 22 nt, Streptococcus pneumoniae R6
agggcaaaaaagggacaaaacu

SEQ ID NO: 4088418 - RNA, 16 nt, Streptococcus pneumoniae R6
agggcaaauaaaaagc

SEQ ID NO: 4088419 - RNA, 17 nt, Streptococcus pneumoniae R6
agggcaaauaaaaagcu

SEQ ID NO: 4088420 - RNA, 21 nt, Streptococcus pneumoniae R6
agggcauuaaucauucccugg

SEQ ID NO: 4088421 - RNA, 15 nt, Streptococcus pneumoniae R6
agggcauuuugaccu

SEQ ID NO: 4088422 - RNA, 18 nt, Streptococcus pneumoniae R6
agggcguuaccuccaccu

SEQ ID NO: 4088423 - RNA, 19 nt, Streptococcus pneumoniae R6
agggcuaggcuaacacuug

SEQ ID NO: 4088424 - RNA, 19 nt, Streptococcus pneumoniae R6
agggcugaacgacucacuu

SEQ ID NO: 4088425 - RNA, 14 nt, Streptococcus pneumoniae R6
agggcugaaggaau

SEQ ID NO: 4088426 - RNA, 16 nt, Streptococcus pneumoniae R6
agggcugcaaaauuuu

SEQ ID NO: 4088427 - RNA, 17 nt, Streptococcus pneumoniae R6
agggcuucaaucucugc

SEQ ID NO: 4088428 - RNA, 16 nt, Streptococcus pneumoniae R6
agggcuuuuuuugcuu

SEQ ID NO: 4088429 - RNA, 21 nt, Streptococcus pneumoniae R6
aggggucaugacuagugaagc

SEQ ID NO: 4088430 - RNA, 22 nt, Streptococcus pneumoniae R6
aggggugauuuuauauaaaaua

SEQ ID NO: 4088431 - RNA, 21 nt, Streptococcus pneumoniae R6
aggguagcgugucaagaguug

SEQ ID NO: 4088432 - RNA, 22 nt, Streptococcus pneumoniae R6
aggguauaaaacuuaugagcua

SEQ ID NO: 4088433 - RNA, 22 nt, Streptococcus pneumoniae R6
aggguccaaaccaacauagaua

SEQ ID NO: 4088434 - RNA, 20 nt, Streptococcus pneumoniae R6
agggucuuuguucugaaagu

SEQ ID NO: 4088435 - RNA, 18 nt, Streptococcus pneumoniae R6
agggugacaguaaaaaau

SEQ ID NO: 4088436 - RNA, 19 nt, Streptococcus pneumoniae R6
aggguggguuuuuugauuu

SEQ ID NO: 4088437 - RNA, 14 nt, Streptococcus pneumoniae R6
aggguguuuucaau

SEQ ID NO: 4088438 - RNA, 24 nt, Streptococcus pneumoniae R6
aggguguuuucaaucaagacagau

SEQ ID NO: 4088439 - RNA, 18 nt, Streptococcus pneumoniae R6
aggguuagauuauugcag

SEQ ID NO: 4088440 - RNA, 19 nt, Streptococcus pneumoniae R6
agguaaaucccaaguaaau

SEQ ID NO: 4088441 - RNA, 16 nt, Streptococcus pneumoniae R6
agguaauccagaaaug

SEQ ID NO: 4088442 - RNA, 15 nt, Streptococcus pneumoniae R6
agguaauuaugaaau

SEQ ID NO: 4088443 - RNA, 21 nt, Streptococcus pneumoniae R6
agguacuaagaccccaacgug

SEQ ID NO: 4088444 - RNA, 15 nt, Streptococcus pneumoniae R6
agguacuugauuuau

SEQ ID NO: 4088445 - RNA, 22 nt, Streptococcus pneumoniae R6
agguacuugauuuaugccauau

SEQ ID NO: 4088446 - RNA, 14 nt, Streptococcus pneumoniae R6
agguaggagugaaa

SEQ ID NO: 4088447 - RNA, 15 nt, Streptococcus pneumoniae R6
agguaguauuuagau

SEQ ID NO: 4088448 - RNA, 22 nt, Streptococcus pneumoniae R6
agguaucuguagaguuuugguu

SEQ ID NO: 4088449 - RNA, 20 nt, Streptococcus pneumoniae R6
agguauuucuuguuuucuaa

SEQ ID NO: 4088450 - RNA, 15 nt, Streptococcus pneumoniae R6
aggucaaaauuccua

SEQ ID NO: 4088451 - RNA, 20 nt, Streptococcus pneumoniae R6
aggucaaaauuccuaaaaua

SEQ ID NO: 4088452 - RNA, 19 nt, Streptococcus pneumoniae R6
aggucaaacuuuuucucuc

SEQ ID NO: 4088453 - RNA, 14 nt, Streptococcus pneumoniae R6
aggucaagagaaaa

SEQ ID NO: 4088454 - RNA, 17 nt, Streptococcus pneumoniae R6
aggucaauggcaaaaaa

SEQ ID NO: 4088455 - RNA, 22 nt, Streptococcus pneumoniae R6
aggucacgaggaggagaaaaag

SEQ ID NO: 4088456 - RNA, 16 nt, Streptococcus pneumoniae R6
aggucaucagcagaga

SEQ ID NO: 4088457 - RNA, 17 nt, Streptococcus pneumoniae R6
aggucaucagcagagaa

SEQ ID NO: 4088458 - RNA, 13 nt, Streptococcus pneumoniae R6
aggucauguagau

SEQ ID NO: 4088459 - RNA, 16 nt, Streptococcus pneumoniae R6
aggucauuugaaucau

SEQ ID NO: 4088460 - RNA, 13 nt, Streptococcus pneumoniae R6
agguccaaccaga

SEQ ID NO: 4088461 - RNA, 20 nt, Streptococcus pneumoniae R6
agguccaaguuugcaaaguu

SEQ ID NO: 4088462 - RNA, 22 nt, Streptococcus pneumoniae R6
aggucuuuuugugaauacaaaa

SEQ ID NO: 4088463 - RNA, 16 nt, Streptococcus pneumoniae R6
aggugaauuagugaag

SEQ ID NO: 4088464 - RNA, 17 nt, Streptococcus pneumoniae R6
aggugagcaucaggaaa

SEQ ID NO: 4088465 - RNA, 23 nt, Streptococcus pneumoniae R6
aggugagggcugagaaggcuggu

SEQ ID NO: 4088466 - RNA, 18 nt, Streptococcus pneumoniae R6
aggugaguaggaaggaag

SEQ ID NO: 4088467 - RNA, 17 nt, Streptococcus pneumoniae R6
aggugauaaaguccauc

SEQ ID NO: 4088468 - RNA, 20 nt, Streptococcus pneumoniae R6
aggugauaucugguugccaa

SEQ ID NO: 4088469 - RNA, 17 nt, Streptococcus pneumoniae R6
aggugauuuaccauagu

SEQ ID NO: 4088470 - RNA, 19 nt, Streptococcus pneumoniae R6
aggugcagagagauaaaua

SEQ ID NO: 4088471 - RNA, 22 nt, Streptococcus pneumoniae R6
aggugcgagacaaaaaaaacac

SEQ ID NO: 4088472 - RNA, 13 nt, Streptococcus pneumoniae R6
agguggaaaagca

SEQ ID NO: 4088473 - RNA, 16 nt, Streptococcus pneumoniae R6
agguggggcaaaaaca

SEQ ID NO: 4088474 - RNA, 14 nt, Streptococcus pneumoniae R6
agguguacuauucu

SEQ ID NO: 4088475 - RNA, 17 nt, Streptococcus pneumoniae R6
agguguucuaucacauu

SEQ ID NO: 4088476 - RNA, 14 nt, Streptococcus pneumoniae R6
agguguuucugguc

SEQ ID NO: 4088477 - RNA, 15 nt, Streptococcus pneumoniae R6
agguuaaaaucuuuu

SEQ ID NO: 4088478 - RNA, 17 nt, Streptococcus pneumoniae R6
agguuagucaaaaagaa

SEQ ID NO: 4088479 - RNA, 19 nt, Streptococcus pneumoniae R6
agguuaucguaacggcuuu

SEQ ID NO: 4088480 - RNA, 19 nt, Streptococcus pneumoniae R6
agguuauucaaaaacauaa

SEQ ID NO: 4088481 - RNA, 22 nt, Streptococcus pneumoniae R6
agguucaauccccaagggacca

SEQ ID NO: 4088482 - RNA, 11 nt, Streptococcus pneumoniae R6
agguucauuag

SEQ ID NO: 4088483 - RNA, 16 nt, Streptococcus pneumoniae R6
agguucauuucuucua

SEQ ID NO: 4088484 - RNA, 16 nt, Streptococcus pneumoniae R6
agguuccgagauaaaa

SEQ ID NO: 4088485 - RNA, 14 nt, Streptococcus pneumoniae R6
agguuccuucugca

SEQ ID NO: 4088486 - RNA, 21 nt, Streptococcus pneumoniae R6
agguucuuuuauccuguucuu

SEQ ID NO: 4088487 - RNA, 16 nt, Streptococcus pneumoniae R6
agguugaccauuucaa

SEQ ID NO: 4088488 - RNA, 20 nt, Streptococcus pneumoniae R6
agguugcagauaaagcugac

SEQ ID NO: 4088489 - RNA, 18 nt, Streptococcus pneumoniae R6
agguugcauagaccaaga

SEQ ID NO: 4088490 - RNA, 18 nt, Streptococcus pneumoniae R6
agguugcucaaaacacug

SEQ ID NO: 4088491 - RNA, 23 nt, Streptococcus pneumoniae R6
agguugcucaaagcacugauuug

SEQ ID NO: 4088492 - RNA, 15 nt, Streptococcus pneumoniae R6
agguugcucaaagua

SEQ ID NO: 4088493 - RNA, 18 nt, Streptococcus pneumoniae R6
agguugcucaaaguacug

SEQ ID NO: 4088494 - RNA, 19 nt, Streptococcus pneumoniae R6
agguuguagauagaacuga

SEQ ID NO: 4088495 - RNA, 14 nt, Streptococcus pneumoniae R6
agguuguagaugaa

SEQ ID NO: 4088496 - RNA, 17 nt, Streptococcus pneumoniae R6
agguuguagaugaaacu

SEQ ID NO: 4088497 - RNA, 19 nt, Streptococcus pneumoniae R6
agguuguagauggaacuga

SEQ ID NO: 4088498 - RNA, 18 nt, Streptococcus pneumoniae R6
agguuguggauagaacug

SEQ ID NO: 4088499 - RNA, 22 nt, Streptococcus pneumoniae R6
agguuguuagauuauguaagau

SEQ ID NO: 4088500 - RNA, 16 nt, Streptococcus pneumoniae R6
agguuuccaaaccaac

SEQ ID NO: 4088501 - RNA, 22 nt, Streptococcus pneumoniae R6
agguuuccuuuaaccugaugaa

SEQ ID NO: 4088502 - RNA, 18 nt, Streptococcus pneumoniae R6
agguuugauuaguccauu

SEQ ID NO: 4088503 - RNA, 20 nt, Streptococcus pneumoniae R6
agguuugcuauuguccaacu

SEQ ID NO: 4088504 - RNA, 13 nt, Streptococcus pneumoniae R6
agguuuuaaacaa

SEQ ID NO: 4088505 - RNA, 15 nt, Streptococcus pneumoniae R6
agguuuuaaacaaag

SEQ ID NO: 4088506 - RNA, 13 nt, Streptococcus pneumoniae R6
agguuuucaagcc

SEQ ID NO: 4088507 - RNA, 19 nt, Streptococcus pneumoniae R6
agguuuuucuguacugccc

SEQ ID NO: 4088508 - RNA, 14 nt, Streptococcus pneumoniae R6
agguuuuugaaaaa

SEQ ID NO: 4088509 - RNA, 21 nt, Streptococcus pneumoniae R6
aguaaaaaaaacauauauuca

SEQ ID NO: 4088510 - RNA, 11 nt, Streptococcus pneumoniae R6
aguaaaaaaag

SEQ ID NO: 4088511 - RNA, 15 nt, Streptococcus pneumoniae R6
aguaaaaaaagaagc

SEQ ID NO: 4088512 - RNA, 16 nt, Streptococcus pneumoniae R6
aguaaaaaaagaguug

SEQ ID NO: 4088513 - RNA, 14 nt, Streptococcus pneumoniae R6
aguaaaaauugcuu

SEQ ID NO: 4088514 - RNA, 17 nt, Streptococcus pneumoniae R6
aguaaaauacaaaccaa

SEQ ID NO: 4088515 - RNA, 21 nt, Streptococcus pneumoniae R6
aguaaaaucaggauuuuuuca

SEQ ID NO: 4088516 - RNA, 13 nt, Streptococcus pneumoniae R6
aguaaaaugaaac

SEQ ID NO: 4088517 - RNA, 15 nt, Streptococcus pneumoniae R6
aguaaaccuucccac

SEQ ID NO: 4088518 - RNA, 20 nt, Streptococcus pneumoniae R6
aguaaagcuagauuuaaaac

SEQ ID NO: 4088519 - RNA, 14 nt, Streptococcus pneumoniae R6
aguaaaggacuuua

SEQ ID NO: 4088520 - RNA, 16 nt, Streptococcus pneumoniae R6
aguaaaggacuuuaaa

SEQ ID NO: 4088521 - RNA, 15 nt, Streptococcus pneumoniae R6
aguaaauaaaacaaa

SEQ ID NO: 4088522 - RNA, 20 nt, Streptococcus pneumoniae R6
aguaaauaucauuuccaaca

SEQ ID NO: 4088523 - RNA, 22 nt, Streptococcus pneumoniae R6
aguaaauauuucuaugauaaaa

SEQ ID NO: 4088524 - RNA, 11 nt, Streptococcus pneumoniae R6
aguaaaucuuc

SEQ ID NO: 4088525 - RNA, 13 nt, Streptococcus pneumoniae R6
aguaaaucuuccc

SEQ ID NO: 4088526 - RNA, 14 nt, Streptococcus pneumoniae R6
aguaaaucuuccca

SEQ ID NO: 4088527 - RNA, 20 nt, Streptococcus pneumoniae R6
aguaaaucuucccacaauaa

SEQ ID NO: 4088528 - RNA, 15 nt, Streptococcus pneumoniae R6
aguaaauuagggaua

SEQ ID NO: 4088529 - RNA, 18 nt, Streptococcus pneumoniae R6
aguaaauugucuaaaaau

SEQ ID NO: 4088530 - RNA, 21 nt, Streptococcus pneumoniae R6
aguaacaucaauaaccaucau

SEQ ID NO: 4088531 - RNA, 16 nt, Streptococcus pneumoniae R6
aguaacgagucaaaaa

SEQ ID NO: 4088532 - RNA, 20 nt, Streptococcus pneumoniae R6
aguaacguucuuuucaagaa

SEQ ID NO: 4088533 - RNA, 13 nt, Streptococcus pneumoniae R6
aguaacuaugaau

SEQ ID NO: 4088534 - RNA, 13 nt, Streptococcus pneumoniae R6
aguaacuauuuuu

SEQ ID NO: 4088535 - RNA, 16 nt, Streptococcus pneumoniae R6
aguaacuauuuuugau

SEQ ID NO: 4088536 - RNA, 20 nt, Streptococcus pneumoniae R6
aguaacucuuguucaaagug

SEQ ID NO: 4088537 - RNA, 17 nt, Streptococcus pneumoniae R6
aguaagaauguugcuuu

SEQ ID NO: 4088538 - RNA, 16 nt, Streptococcus pneumoniae R6
aguaagauacagacug

SEQ ID NO: 4088539 - RNA, 19 nt, Streptococcus pneumoniae R6
aguaagaugaguuugcuuu

SEQ ID NO: 4088540 - RNA, 16 nt, Streptococcus pneumoniae R6
aguaaggacuuugcuu

SEQ ID NO: 4088541 - RNA, 12 nt, Streptococcus pneumoniae R6
aguaagugggug

SEQ ID NO: 4088542 - RNA, 19 nt, Streptococcus pneumoniae R6
aguaauauaggagauucug

SEQ ID NO: 4088543 - RNA, 23 nt, Streptococcus pneumoniae R6
aguaauaucuccagauagagcua

SEQ ID NO: 4088544 - RNA, 20 nt, Streptococcus pneumoniae R6
aguaaucacugcagcaaagg

SEQ ID NO: 4088545 - RNA, 22 nt, Streptococcus pneumoniae R6
aguaaucacugcagcaaaggua

SEQ ID NO: 4088546 - RNA, 21 nt, Streptococcus pneumoniae R6
aguaauuccacacagaaagca

SEQ ID NO: 4088547 - RNA, 20 nt, Streptococcus pneumoniae R6
aguaauuucccauuuguaaa

SEQ ID NO: 4088548 - RNA, 19 nt, Streptococcus pneumoniae R6
aguacaaaagcacucaaua

SEQ ID NO: 4088549 - RNA, 15 nt, Streptococcus pneumoniae R6
aguacaagguuugua

SEQ ID NO: 4088550 - RNA, 16 nt, Streptococcus pneumoniae R6
aguacacaacugcuuc

SEQ ID NO: 4088551 - RNA, 20 nt, Streptococcus pneumoniae R6
aguacacaucuacuucuaaa

SEQ ID NO: 4088552 - RNA, 14 nt, Streptococcus pneumoniae R6
aguacaugcaaagu

SEQ ID NO: 4088553 - RNA, 16 nt, Streptococcus pneumoniae R6
aguacauucuuugaca

SEQ ID NO: 4088554 - RNA, 19 nt, Streptococcus pneumoniae R6
aguacauugaaauuaaaau

SEQ ID NO: 4088555 - RNA, 16 nt, Streptococcus pneumoniae R6
aguaccaguuaccauu

SEQ ID NO: 4088556 - RNA, 21 nt, Streptococcus pneumoniae R6
aguacccucggcuguuuuuuc

SEQ ID NO: 4088557 - RNA, 18 nt, Streptococcus pneumoniae R6
aguaccgaauguggauac

SEQ ID NO: 4088558 - RNA, 22 nt, Streptococcus pneumoniae R6
aguaccguucauauccguucca

SEQ ID NO: 4088559 - RNA, 13 nt, Streptococcus pneumoniae R6
aguacgaaacaau

SEQ ID NO: 4088560 - RNA, 19 nt, Streptococcus pneumoniae R6
aguacgaaacaauugcuaa

SEQ ID NO: 4088561 - RNA, 17 nt, Streptococcus pneumoniae R6
aguacuaaauauaagau

SEQ ID NO: 4088562 - RNA, 13 nt, Streptococcus pneumoniae R6
aguacuucuuugu

SEQ ID NO: 4088563 - RNA, 16 nt, Streptococcus pneumoniae R6
aguacuuucaacuccu

SEQ ID NO: 4088564 - RNA, 22 nt, Streptococcus pneumoniae R6
aguacuuuuaauauacuugaua

SEQ ID NO: 4088565 - RNA, 15 nt, Streptococcus pneumoniae R6
aguagaaaaugaaau

SEQ ID NO: 4088566 - RNA, 20 nt, Streptococcus pneumoniae R6
aguagaaaguuaaucucucc

SEQ ID NO: 4088567 - RNA, 19 nt, Streptococcus pneumoniae R6
aguagacuugaccgcagau

SEQ ID NO: 4088568 - RNA, 14 nt, Streptococcus pneumoniae R6
aguagagagaaagg

SEQ ID NO: 4088569 - RNA, 16 nt, Streptococcus pneumoniae R6
aguagagagaaaggag

SEQ ID NO: 4088570 - RNA, 16 nt, Streptococcus pneumoniae R6
aguagagaguucugaa

SEQ ID NO: 4088571 - RNA, 18 nt, Streptococcus pneumoniae R6
aguagagauaaguggcaa

SEQ ID NO: 4088572 - RNA, 17 nt, Streptococcus pneumoniae R6
aguagauaauauacccu

SEQ ID NO: 4088573 - RNA, 22 nt, Streptococcus pneumoniae R6
aguagauaauauacccuuguag

SEQ ID NO: 4088574 - RNA, 13 nt, Streptococcus pneumoniae R6
aguagauugaaac

SEQ ID NO: 4088575 - RNA, 19 nt, Streptococcus pneumoniae R6
aguagauugaaacuagaau

SEQ ID NO: 4088576 - RNA, 14 nt, Streptococcus pneumoniae R6
aguagauugaaaua

SEQ ID NO: 4088577 - RNA, 16 nt, Streptococcus pneumoniae R6
aguagauugaaauaag

SEQ ID NO: 4088578 - RNA, 17 nt, Streptococcus pneumoniae R6
aguagauugaaauaaga

SEQ ID NO: 4088579 - RNA, 22 nt, Streptococcus pneumoniae R6
aguagcaaaacacuaccaagca

SEQ ID NO: 4088580 - RNA, 17 nt, Streptococcus pneumoniae R6
aguagcaccaagaauaa

SEQ ID NO: 4088581 - RNA, 15 nt, Streptococcus pneumoniae R6
aguagccaaaauccu

SEQ ID NO: 4088582 - RNA, 22 nt, Streptococcus pneumoniae R6
aguagccuuugucguuccaagu

SEQ ID NO: 4088583 - RNA, 17 nt, Streptococcus pneumoniae R6
aguaggacgauaaaaac

SEQ ID NO: 4088584 - RNA, 20 nt, Streptococcus pneumoniae R6
aguaggccaaacuugaaaug

SEQ ID NO: 4088585 - RNA, 19 nt, Streptococcus pneumoniae R6
aguagggaaaccacuagca

SEQ ID NO: 4088586 - RNA, 21 nt, Streptococcus pneumoniae R6
aguagucuguucuauaaaaua

SEQ ID NO: 4088587 - RNA, 13 nt, Streptococcus pneumoniae R6
aguaguuggcuug

SEQ ID NO: 4088588 - RNA, 19 nt, Streptococcus pneumoniae R6
aguaguuggcuugucuuuu

SEQ ID NO: 4088589 - RNA, 23 nt, Streptococcus pneumoniae R6
aguaguuucagcgauuuccuuga

SEQ ID NO: 4088590 - RNA, 18 nt, Streptococcus pneumoniae R6
aguauaaaaccuugaaga

SEQ ID NO: 4088591 - RNA, 22 nt, Streptococcus pneumoniae R6
aguauaaaaccuugaagaguug

SEQ ID NO: 4088592 - RNA, 14 nt, Streptococcus pneumoniae R6
aguauaaaaucaaa

SEQ ID NO: 4088593 - RNA, 16 nt, Streptococcus pneumoniae R6
aguauaaaauuuugac

SEQ ID NO: 4088594 - RNA, 19 nt, Streptococcus pneumoniae R6
aguauaagguaauuuucug

SEQ ID NO: 4088595 - RNA, 22 nt, Streptococcus pneumoniae R6
aguauaagguaauuuucuggca

SEQ ID NO: 4088596 - RNA, 22 nt, Streptococcus pneumoniae R6
aguauaagucuuugauuuugag

SEQ ID NO: 4088597 - RNA, 22 nt, Streptococcus pneumoniae R6
aguauaaucccauugagaaaau

SEQ ID NO: 4088598 - RNA, 22 nt, Streptococcus pneumoniae R6
aguauagcauaguauaucacuu

SEQ ID NO: 4088599 - RNA, 17 nt, Streptococcus pneumoniae R6
aguauaguaaacugaau

SEQ ID NO: 4088600 - RNA, 14 nt, Streptococcus pneumoniae R6
aguauauugaaaug

SEQ ID NO: 4088601 - RNA, 15 nt, Streptococcus pneumoniae R6
aguauauugaaauga

SEQ ID NO: 4088602 - RNA, 18 nt, Streptococcus pneumoniae R6
aguauauugaaaugaaau

SEQ ID NO: 4088603 - RNA, 19 nt, Streptococcus pneumoniae R6
aguauauugaaaugaaaua

SEQ ID NO: 4088604 - RNA, 13 nt, Streptococcus pneumoniae R6
aguaucaaaugac

SEQ ID NO: 4088605 - RNA, 22 nt, Streptococcus pneumoniae R6
aguaucagguguugaaacaccu

SEQ ID NO: 4088606 - RNA, 17 nt, Streptococcus pneumoniae R6
aguaucagguguugaau

SEQ ID NO: 4088607 - RNA, 12 nt, Streptococcus pneumoniae R6
aguaucuacuuu

SEQ ID NO: 4088608 - RNA, 15 nt, Streptococcus pneumoniae R6
aguaucugaugcuga

SEQ ID NO: 4088609 - RNA, 14 nt, Streptococcus pneumoniae R6
aguaugaaaagaga

SEQ ID NO: 4088610 - RNA, 21 nt, Streptococcus pneumoniae R6
aguaugaguuaccuaaauuau

SEQ ID NO: 4088611 - RNA, 20 nt, Streptococcus pneumoniae R6
aguaugcucgugauguuaaa

SEQ ID NO: 4088612 - RNA, 16 nt, Streptococcus pneumoniae R6
aguauguuuaaagucu

SEQ ID NO: 4088613 - RNA, 13 nt, Streptococcus pneumoniae R6
aguauuaaaauaa

SEQ ID NO: 4088614 - RNA, 16 nt, Streptococcus pneumoniae R6
aguauuaaaauaaguu

SEQ ID NO: 4088615 - RNA, 21 nt, Streptococcus pneumoniae R6
aguauuaaaauaaguucaaca

SEQ ID NO: 4088616 - RNA, 23 nt, Streptococcus pneumoniae R6
aguauuaaauugcgauuuugcca

SEQ ID NO: 4088617 - RNA, 16 nt, Streptococcus pneumoniae R6
aguauuacauccacca

SEQ ID NO: 4088618 - RNA, 14 nt, Streptococcus pneumoniae R6
aguauuauucuuca

SEQ ID NO: 4088619 - RNA, 14 nt, Streptococcus pneumoniae R6
aguauuauuucauu

SEQ ID NO: 4088620 - RNA, 21 nt, Streptococcus pneumoniae R6
aguauucguucugucugcuga

SEQ ID NO: 4088621 - RNA, 17 nt, Streptococcus pneumoniae R6
aguauuguaagaauuug

SEQ ID NO: 4088622 - RNA, 13 nt, Streptococcus pneumoniae R6
aguauuuauaaac

SEQ ID NO: 4088623 - RNA, 19 nt, Streptococcus pneumoniae R6
aguauuucauuacagaaca

SEQ ID NO: 4088624 - RNA, 13 nt, Streptococcus pneumoniae R6
aguauuuuaaaac

SEQ ID NO: 4088625 - RNA, 21 nt, Streptococcus pneumoniae R6
aguauuuuaaaacgaaaggau

SEQ ID NO: 4088626 - RNA, 15 nt, Streptococcus pneumoniae R6
agucaaaaaaggagu

SEQ ID NO: 4088627 - RNA, 13 nt, Streptococcus pneumoniae R6
agucaaaaagaag

SEQ ID NO: 4088628 - RNA, 23 nt, Streptococcus pneumoniae R6
agucaaaauucuuugaaaucaga

SEQ ID NO: 4088629 - RNA, 16 nt, Streptococcus pneumoniae R6
agucaaaucgauuucu

SEQ ID NO: 4088630 - RNA, 19 nt, Streptococcus pneumoniae R6
agucaaaucgauuucuaaa

SEQ ID NO: 4088631 - RNA, 20 nt, Streptococcus pneumoniae R6
agucaaauuaauuuauagaa

SEQ ID NO: 4088632 - RNA, 15 nt, Streptococcus pneumoniae R6
agucaacagaguuuc

SEQ ID NO: 4088633 - RNA, 15 nt, Streptococcus pneumoniae R6
agucaagaagagggc

SEQ ID NO: 4088634 - RNA, 21 nt, Streptococcus pneumoniae R6
agucaagaguugggcagaagu

SEQ ID NO: 4088635 - RNA, 15 nt, Streptococcus pneumoniae R6
agucaagcucuugga

SEQ ID NO: 4088636 - RNA, 17 nt, Streptococcus pneumoniae R6
agucaauaccagguaau

SEQ ID NO: 4088637 - RNA, 19 nt, Streptococcus pneumoniae R6
agucaauuucucuacaaau

SEQ ID NO: 4088638 - RNA, 22 nt, Streptococcus pneumoniae R6
agucacaaaggucauuuuccac

SEQ ID NO: 4088639 - RNA, 16 nt, Streptococcus pneumoniae R6
agucacugucuugcca

SEQ ID NO: 4088640 - RNA, 17 nt, Streptococcus pneumoniae R6
agucagcuaagcucgau

SEQ ID NO: 4088641 - RNA, 17 nt, Streptococcus pneumoniae R6
agucagcucaaaacacu

SEQ ID NO: 4088642 - RNA, 13 nt, Streptococcus pneumoniae R6
agucagcucaaag

SEQ ID NO: 4088643 - RNA, 19 nt, Streptococcus pneumoniae R6
agucagcucgacacuagau

SEQ ID NO: 4088644 - RNA, 14 nt, Streptococcus pneumoniae R6
agucagcucuuuuu

SEQ ID NO: 4088645 - RNA, 15 nt, Streptococcus pneumoniae R6
agucagcugucuuuu

SEQ ID NO: 4088646 - RNA, 15 nt, Streptococcus pneumoniae R6
agucagggucaaagu

SEQ ID NO: 4088647 - RNA, 21 nt, Streptococcus pneumoniae R6
agucaguaaccauacauacga

SEQ ID NO: 4088648 - RNA, 20 nt, Streptococcus pneumoniae R6
agucagugguucacuggcau

SEQ ID NO: 4088649 - RNA, 17 nt, Streptococcus pneumoniae R6
agucauaaacaucuguc

SEQ ID NO: 4088650 - RNA, 18 nt, Streptococcus pneumoniae R6
agucauaaacaucugucg

SEQ ID NO: 4088651 - RNA, 14 nt, Streptococcus pneumoniae R6
agucauaacauucu

SEQ ID NO: 4088652 - RNA, 15 nt, Streptococcus pneumoniae R6
agucauacuuucucg

SEQ ID NO: 4088653 - RNA, 18 nt, Streptococcus pneumoniae R6
agucauccaugauaaugg

SEQ ID NO: 4088654 - RNA, 18 nt, Streptococcus pneumoniae R6
agucaucuauaaucaaua

SEQ ID NO: 4088655 - RNA, 19 nt, Streptococcus pneumoniae R6
agucaucuauaaucaauau

SEQ ID NO: 4088656 - RNA, 22 nt, Streptococcus pneumoniae R6
agucaugcaaaaaaaaugaaaa

SEQ ID NO: 4088657 - RNA, 16 nt, Streptococcus pneumoniae R6
agucaugggcgaugaa

SEQ ID NO: 4088658 - RNA, 21 nt, Streptococcus pneumoniae R6
agucauuaccaguggcaauca

SEQ ID NO: 4088659 - RNA, 18 nt, Streptococcus pneumoniae R6
agucauuagauauagaau

SEQ ID NO: 4088660 - RNA, 15 nt, Streptococcus pneumoniae R6
agucauucaauccau

SEQ ID NO: 4088661 - RNA, 22 nt, Streptococcus pneumoniae R6
agucauuccauggcugacaaca

SEQ ID NO: 4088662 - RNA, 11 nt, Streptococcus pneumoniae R6
agucauuuucu

SEQ ID NO: 4088663 - RNA, 15 nt, Streptococcus pneumoniae R6
agucauuuuguucuc

SEQ ID NO: 4088664 - RNA, 19 nt, Streptococcus pneumoniae R6
aguccaacuguaaagacau

SEQ ID NO: 4088665 - RNA, 20 nt, Streptococcus pneumoniae R6
aguccaagacguucaaagau

SEQ ID NO: 4088666 - RNA, 16 nt, Streptococcus pneumoniae R6
aguccaagauucaaca

SEQ ID NO: 4088667 - RNA, 22 nt, Streptococcus pneumoniae R6
aguccaagcccaguugacugug

SEQ ID NO: 4088668 - RNA, 13 nt, Streptococcus pneumoniae R6
aguccacugcaau

SEQ ID NO: 4088669 - RNA, 13 nt, Streptococcus pneumoniae R6
aguccauaggcug

SEQ ID NO: 4088670 - RNA, 17 nt, Streptococcus pneumoniae R6
agucccagcuucuuuuu

SEQ ID NO: 4088671 - RNA, 15 nt, Streptococcus pneumoniae R6
agucccauaaaacua

SEQ ID NO: 4088672 - RNA, 22 nt, Streptococcus pneumoniae R6
agucccauuuucagaaagaagg

SEQ ID NO: 4088673 - RNA, 19 nt, Streptococcus pneumoniae R6
agucccugguaaaagagca

SEQ ID NO: 4088674 - RNA, 14 nt, Streptococcus pneumoniae R6
agucccuuagaaaa

SEQ ID NO: 4088675 - RNA, 22 nt, Streptococcus pneumoniae R6
aguccguuuucaccaaaacuau

SEQ ID NO: 4088676 - RNA, 15 nt, Streptococcus pneumoniae R6
aguccugaaaaucau

SEQ ID NO: 4088677 - RNA, 16 nt, Streptococcus pneumoniae R6
aguccugaaaaucauc

SEQ ID NO: 4088678 - RNA, 21 nt, Streptococcus pneumoniae R6
aguccuuacucaaauaaaaga

SEQ ID NO: 4088679 - RNA, 14 nt, Streptococcus pneumoniae R6
aguccuuguuucca

SEQ ID NO: 4088680 - RNA, 20 nt, Streptococcus pneumoniae R6
aguccuuuuaguuuuaccuu

SEQ ID NO: 4088681 - RNA, 21 nt, Streptococcus pneumoniae R6
aguccuuuugauuacauaaau

SEQ ID NO: 4088682 - RNA, 20 nt, Streptococcus pneumoniae R6
agucgaagcuuccaauaaua

SEQ ID NO: 4088683 - RNA, 13 nt, Streptococcus pneumoniae R6
agucgaguuuuuu

SEQ ID NO: 4088684 - RNA, 17 nt, Streptococcus pneumoniae R6
agucgcaaagaggaaga

SEQ ID NO: 4088685 - RNA, 21 nt, Streptococcus pneumoniae R6
agucgcagguugcucaaagua

SEQ ID NO: 4088686 - RNA, 22 nt, Streptococcus pneumoniae R6
agucgcagguugcucaaaguac

SEQ ID NO: 4088687 - RNA, 20 nt, Streptococcus pneumoniae R6
agucgcuacaggcaugggca

SEQ ID NO: 4088688 - RNA, 15 nt, Streptococcus pneumoniae R6
agucggcaggcuggu

SEQ ID NO: 4088689 - RNA, 14 nt, Streptococcus pneumoniae R6
agucguuaaaagca

SEQ ID NO: 4088690 - RNA, 20 nt, Streptococcus pneumoniae R6
agucguuucaagauaaggaa

SEQ ID NO: 4088691 - RNA, 20 nt, Streptococcus pneumoniae R6
agucuagcauaaaagccucc

SEQ ID NO: 4088692 - RNA, 22 nt, Streptococcus pneumoniae R6
agucucagcagucguuccuuuu

SEQ ID NO: 4088693 - RNA, 19 nt, Streptococcus pneumoniae R6
agucucagugggcuauucc

SEQ ID NO: 4088694 - RNA, 22 nt, Streptococcus pneumoniae R6
agucucauagucguguugacuu

SEQ ID NO: 4088695 - RNA, 16 nt, Streptococcus pneumoniae R6
agucuccucaaaaaca

SEQ ID NO: 4088696 - RNA, 17 nt, Streptococcus pneumoniae R6
agucuccucaaaaacag

SEQ ID NO: 4088697 - RNA, 20 nt, Streptococcus pneumoniae R6
agucugaaaaagaggaugaa

SEQ ID NO: 4088698 - RNA, 18 nt, Streptococcus pneumoniae R6
agucugaaaaauaggaug

SEQ ID NO: 4088699 - RNA, 21 nt, Streptococcus pneumoniae R6
agucugacgcuggaaauaaga

SEQ ID NO: 4088700 - RNA, 22 nt, Streptococcus pneumoniae R6
agucugacgcuggaaauaagaa

SEQ ID NO: 4088701 - RNA, 19 nt, Streptococcus pneumoniae R6
agucugcugccaauugcuc

SEQ ID NO: 4088702 - RNA, 17 nt, Streptococcus pneumoniae R6
agucugcuuuauagugg

SEQ ID NO: 4088703 - RNA, 20 nt, Streptococcus pneumoniae R6
agucugggaaaaauuuucaa

SEQ ID NO: 4088704 - RNA, 23 nt, Streptococcus pneumoniae R6
agucugguucccagcauggucag

SEQ ID NO: 4088705 - RNA, 21 nt, Streptococcus pneumoniae R6
agucuguuauuucuugagaac

SEQ ID NO: 4088706 - RNA, 14 nt, Streptococcus pneumoniae R6
agucuguucuaugc

SEQ ID NO: 4088707 - RNA, 15 nt, Streptococcus pneumoniae R6
agucuuaaaaucaca

SEQ ID NO: 4088708 - RNA, 16 nt, Streptococcus pneumoniae R6
agucuucggaauagcu

SEQ ID NO: 4088709 - RNA, 18 nt, Streptococcus pneumoniae R6
agucuucggaauagcuca

SEQ ID NO: 4088710 - RNA, 24 nt, Streptococcus pneumoniae R6
agucuucggaauagcucaaaaguu

SEQ ID NO: 4088711 - RNA, 15 nt, Streptococcus pneumoniae R6
agucuucuuuucuuu

SEQ ID NO: 4088712 - RNA, 22 nt, Streptococcus pneumoniae R6
agucuugauggacaacaaugag

SEQ ID NO: 4088713 - RNA, 23 nt, Streptococcus pneumoniae R6
agucuugauggacaacaaugaga

SEQ ID NO: 4088714 - RNA, 15 nt, Streptococcus pneumoniae R6
agucuugcucuucau

SEQ ID NO: 4088715 - RNA, 13 nt, Streptococcus pneumoniae R6
agucuuggaaaau

SEQ ID NO: 4088716 - RNA, 22 nt, Streptococcus pneumoniae R6
agucuuuaucgauucuugcaaa

SEQ ID NO: 4088717 - RNA, 22 nt, Streptococcus pneumoniae R6
agucuuucuucguuuuuacuac

SEQ ID NO: 4088718 - RNA, 16 nt, Streptococcus pneumoniae R6
agugaacaagccuagu

SEQ ID NO: 4088719 - RNA, 18 nt, Streptococcus pneumoniae R6
agugaacuauuuuauccc

SEQ ID NO: 4088720 - RNA, 17 nt, Streptococcus pneumoniae R6
agugaaggcuuuaaaug

SEQ ID NO: 4088721 - RNA, 14 nt, Streptococcus pneumoniae R6
agugaauugaaaua

SEQ ID NO: 4088722 - RNA, 16 nt, Streptococcus pneumoniae R6
agugaauugaaauaag

SEQ ID NO: 4088723 - RNA, 16 nt, Streptococcus pneumoniae R6
agugagaagcccagua

SEQ ID NO: 4088724 - RNA, 23 nt, Streptococcus pneumoniae R6
agugagauuuuuugauuggcuuu

SEQ ID NO: 4088725 - RNA, 10 nt, Streptococcus pneumoniae R6
agugagucca

SEQ ID NO: 4088726 - RNA, 20 nt, Streptococcus pneumoniae R6
agugaguuuuacaauguaau

SEQ ID NO: 4088727 - RNA, 14 nt, Streptococcus pneumoniae R6
agugauaacauaac

SEQ ID NO: 4088728 - RNA, 22 nt, Streptococcus pneumoniae R6
agugauaacauaaccuuccuug

SEQ ID NO: 4088729 - RNA, 22 nt, Streptococcus pneumoniae R6
agugauuuaaauguuuucucau

SEQ ID NO: 4088730 - RNA, 22 nt, Streptococcus pneumoniae R6
agugcagcuuguuguuaaacaa

SEQ ID NO: 4088731 - RNA, 23 nt, Streptococcus pneumoniae R6
agugcggacggucuuuggaaaua

SEQ ID NO: 4088732 - RNA, 13 nt, Streptococcus pneumoniae R6
agugcucacagag

SEQ ID NO: 4088733 - RNA, 20 nt, Streptococcus pneumoniae R6
aguggauuggcucaaucaau

SEQ ID NO: 4088734 - RNA, 22 nt, Streptococcus pneumoniae R6
aguggauuuuucuucuuuucuu

SEQ ID NO: 4088735 - RNA, 17 nt, Streptococcus pneumoniae R6
aguggcaggaauaucca

SEQ ID NO: 4088736 - RNA, 19 nt, Streptococcus pneumoniae R6
aguggcuuuugauuugauu

SEQ ID NO: 4088737 - RNA, 18 nt, Streptococcus pneumoniae R6
agugggaacuagagaguu

SEQ ID NO: 4088738 - RNA, 21 nt, Streptococcus pneumoniae R6
agugggcucauguaaaucauu

SEQ ID NO: 4088739 - RNA, 16 nt, Streptococcus pneumoniae R6
aguggguugaaaaaaa

SEQ ID NO: 4088740 - RNA, 17 nt, Streptococcus pneumoniae R6
aguggguugaaaaaaag

SEQ ID NO: 4088741 - RNA, 14 nt, Streptococcus pneumoniae R6
aguggguugaagaa

SEQ ID NO: 4088742 - RNA, 14 nt, Streptococcus pneumoniae R6
aguggguugaaguu

SEQ ID NO: 4088743 - RNA, 13 nt, Streptococcus pneumoniae R6
aguguaaaaagaa

SEQ ID NO: 4088744 - RNA, 15 nt, Streptococcus pneumoniae R6
aguguaaaaagaaag

SEQ ID NO: 4088745 - RNA, 19 nt, Streptococcus pneumoniae R6
aguguaaaaagaaaguccu

SEQ ID NO: 4088746 - RNA, 15 nt, Streptococcus pneumoniae R6
aguguacauacuuua

SEQ ID NO: 4088747 - RNA, 18 nt, Streptococcus pneumoniae R6
aguguauaagguucauua

SEQ ID NO: 4088748 - RNA, 23 nt, Streptococcus pneumoniae R6
aguguauaagguucauuagaaca

SEQ ID NO: 4088749 - RNA, 22 nt, Streptococcus pneumoniae R6
aguguauaugaagauucuguau

SEQ ID NO: 4088750 - RNA, 20 nt, Streptococcus pneumoniae R6
agugugaccugcuuucugca

SEQ ID NO: 4088751 - RNA, 16 nt, Streptococcus pneumoniae R6
agugugggacuccuac

SEQ ID NO: 4088752 - RNA, 13 nt, Streptococcus pneumoniae R6
aguguucugucuu

SEQ ID NO: 4088753 - RNA, 14 nt, Streptococcus pneumoniae R6
aguguugaaaaccc

SEQ ID NO: 4088754 - RNA, 15 nt, Streptococcus pneumoniae R6
aguguugaaaacccu

SEQ ID NO: 4088755 - RNA, 18 nt, Streptococcus pneumoniae R6
aguguugacaagugaaag

SEQ ID NO: 4088756 - RNA, 15 nt, Streptococcus pneumoniae R6
aguguugucaaguuc

SEQ ID NO: 4088757 - RNA, 19 nt, Streptococcus pneumoniae R6
aguguuuuaagcugacuuc

SEQ ID NO: 4088758 - RNA, 14 nt, Streptococcus pneumoniae R6
aguguuuugagcac

SEQ ID NO: 4088759 - RNA, 19 nt, Streptococcus pneumoniae R6
aguguuuugaucugacuuc

SEQ ID NO: 4088760 - RNA, 16 nt, Streptococcus pneumoniae R6
aguuaaaaaaagggcu

SEQ ID NO: 4088761 - RNA, 13 nt, Streptococcus pneumoniae R6
aguuaaaaaagau

SEQ ID NO: 4088762 - RNA, 14 nt, Streptococcus pneumoniae R6
aguuaaaacaaaga

SEQ ID NO: 4088763 - RNA, 20 nt, Streptococcus pneumoniae R6
aguuaaaacaaagaaaaaga

SEQ ID NO: 4088764 - RNA, 22 nt, Streptococcus pneumoniae R6
aguuaaaacaaagaaaaagaag

SEQ ID NO: 4088765 - RNA, 13 nt, Streptococcus pneumoniae R6
aguuaaaauaagu

SEQ ID NO: 4088766 - RNA, 21 nt, Streptococcus pneumoniae R6
aguuaaacucuccaauaucau

SEQ ID NO: 4088767 - RNA, 14 nt, Streptococcus pneumoniae R6
aguuaaauuauaaa

SEQ ID NO: 4088768 - RNA, 16 nt, Streptococcus pneumoniae R6
aguuaaauuauaaauu

SEQ ID NO: 4088769 - RNA, 14 nt, Streptococcus pneumoniae R6
aguuaaguuuuuug

SEQ ID NO: 4088770 - RNA, 18 nt, Streptococcus pneumoniae R6
aguuaauggccaccuuca

SEQ ID NO: 4088771 - RNA, 19 nt, Streptococcus pneumoniae R6
aguuacaucaguauuucau

SEQ ID NO: 4088772 - RNA, 16 nt, Streptococcus pneumoniae R6
aguuacggguuuuaaa

SEQ ID NO: 4088773 - RNA, 15 nt, Streptococcus pneumoniae R6
aguuagacaauuaau

SEQ ID NO: 4088774 - RNA, 16 nt, Streptococcus pneumoniae R6
aguuagacagaaaaaa

SEQ ID NO: 4088775 - RNA, 12 nt, Streptococcus pneumoniae R6
aguuagauuuuu

SEQ ID NO: 4088776 - RNA, 20 nt, Streptococcus pneumoniae R6
aguuauauugacagaagauu

SEQ ID NO: 4088777 - RNA, 22 nt, Streptococcus pneumoniae R6
aguuaucguaauuaaaguuaau

SEQ ID NO: 4088778 - RNA, 14 nt, Streptococcus pneumoniae R6
aguuaucugcaaaa

SEQ ID NO: 4088779 - RNA, 23 nt, Streptococcus pneumoniae R6
aguuaugaaaaagauuuuuuaaa

SEQ ID NO: 4088780 - RNA, 14 nt, Streptococcus pneumoniae R6
aguuaugauauauu

SEQ ID NO: 4088781 - RNA, 23 nt, Streptococcus pneumoniae R6
aguuauuucuccuaaagaaaaag

SEQ ID NO: 4088782 - RNA, 14 nt, Streptococcus pneumoniae R6
aguucaauagcucu

SEQ ID NO: 4088783 - RNA, 15 nt, Streptococcus pneumoniae R6
aguucaaucagcuaa

SEQ ID NO: 4088784 - RNA, 15 nt, Streptococcus pneumoniae R6
aguucacaaaugaga

SEQ ID NO: 4088785 - RNA, 18 nt, Streptococcus pneumoniae R6
aguucacaaaugagauaa

SEQ ID NO: 4088786 - RNA, 14 nt, Streptococcus pneumoniae R6
aguucacugaacua

SEQ ID NO: 4088787 - RNA, 15 nt, Streptococcus pneumoniae R6
aguucagaauuuucu

SEQ ID NO: 4088788 - RNA, 17 nt, Streptococcus pneumoniae R6
aguucagaauuuucuua

SEQ ID NO: 4088789 - RNA, 22 nt, Streptococcus pneumoniae R6
aguucaguagauuaaaggcaua

SEQ ID NO: 4088790 - RNA, 20 nt, Streptococcus pneumoniae R6
aguucaucuucaaaaucaaa

SEQ ID NO: 4088791 - RNA, 20 nt, Streptococcus pneumoniae R6
aguucauguuucggaucaua

SEQ ID NO: 4088792 - RNA, 13 nt, Streptococcus pneumoniae R6
aguucauuaugau

SEQ ID NO: 4088793 - RNA, 12 nt, Streptococcus pneumoniae R6
aguucauuuucu

SEQ ID NO: 4088794 - RNA, 23 nt, Streptococcus pneumoniae R6
aguucauuuucuuuacuucugag

SEQ ID NO: 4088795 - RNA, 15 nt, Streptococcus pneumoniae R6
aguucauuuuuccuu

SEQ ID NO: 4088796 - RNA, 16 nt, Streptococcus pneumoniae R6
aguucauuuuuuaugg

SEQ ID NO: 4088797 - RNA, 23 nt, Streptococcus pneumoniae R6
aguucauuuuuuaugguguuuua

SEQ ID NO: 4088798 - RNA, 14 nt, Streptococcus pneumoniae R6
aguuccaaacuuag

SEQ ID NO: 4088799 - RNA, 16 nt, Streptococcus pneumoniae R6
aguuccacccauggca

SEQ ID NO: 4088800 - RNA, 16 nt, Streptococcus pneumoniae R6
aguuccacgauauugu

SEQ ID NO: 4088801 - RNA, 13 nt, Streptococcus pneumoniae R6
aguuccagcaaac

SEQ ID NO: 4088802 - RNA, 19 nt, Streptococcus pneumoniae R6
aguuccagcaaacauagau

SEQ ID NO: 4088803 - RNA, 14 nt, Streptococcus pneumoniae R6
aguuccaucaaucu

SEQ ID NO: 4088804 - RNA, 20 nt, Streptococcus pneumoniae R6
aguuccauccacaaccuuaa

SEQ ID NO: 4088805 - RNA, 20 nt, Streptococcus pneumoniae R6
aguuccaucuacaaccuuaa

SEQ ID NO: 4088806 - RNA, 12 nt, Streptococcus pneumoniae R6
aguuccuaauug

SEQ ID NO: 4088807 - RNA, 13 nt, Streptococcus pneumoniae R6
aguuccuccauug

SEQ ID NO: 4088808 - RNA, 17 nt, Streptococcus pneumoniae R6
aguuccucuuucaaaag

SEQ ID NO: 4088809 - RNA, 15 nt, Streptococcus pneumoniae R6
aguuccuuugucuuu

SEQ ID NO: 4088810 - RNA, 22 nt, Streptococcus pneumoniae R6
aguucgaaaggcuuuauucuua

SEQ ID NO: 4088811 - RNA, 19 nt, Streptococcus pneumoniae R6
aguucgaagauaucucuuu

SEQ ID NO: 4088812 - RNA, 19 nt, Streptococcus pneumoniae R6
aguucgcauauaagcggcu

SEQ ID NO: 4088813 - RNA, 13 nt, Streptococcus pneumoniae R6
aguucguaguaaa

SEQ ID NO: 4088814 - RNA, 17 nt, Streptococcus pneumoniae R6
aguucuaaaacuccuau

SEQ ID NO: 4088815 - RNA, 22 nt, Streptococcus pneumoniae R6
aguucuagcuuccccauucuau

SEQ ID NO: 4088816 - RNA, 12 nt, Streptococcus pneumoniae R6
aguucuaucuac

SEQ ID NO: 4088817 - RNA, 13 nt, Streptococcus pneumoniae R6
aguucuaucugca

SEQ ID NO: 4088818 - RNA, 21 nt, Streptococcus pneumoniae R6
aguucuaucugcaaccucaaa

SEQ ID NO: 4088819 - RNA, 22 nt, Streptococcus pneumoniae R6
aguucuaucugcaaccucaaaa

SEQ ID NO: 4088820 - RNA, 20 nt, Streptococcus pneumoniae R6
aguucuaucuugagcaaguc

SEQ ID NO: 4088821 - RNA, 19 nt, Streptococcus pneumoniae R6
aguucucuagucuggagau

SEQ ID NO: 4088822 - RNA, 18 nt, Streptococcus pneumoniae R6
aguucucuuucuaaaaua

SEQ ID NO: 4088823 - RNA, 20 nt, Streptococcus pneumoniae R6
aguucucuuucuaaaauagu

SEQ ID NO: 4088824 - RNA, 15 nt, Streptococcus pneumoniae R6
aguucuggaugccau

SEQ ID NO: 4088825 - RNA, 20 nt, Streptococcus pneumoniae R6
aguucuggucuacauccuca

SEQ ID NO: 4088826 - RNA, 14 nt, Streptococcus pneumoniae R6
aguucuguacugca

SEQ ID NO: 4088827 - RNA, 16 nt, Streptococcus pneumoniae R6
aguucuguacugcaca

SEQ ID NO: 4088828 - RNA, 17 nt, Streptococcus pneumoniae R6
aguucuuccaauuucuu

SEQ ID NO: 4088829 - RNA, 12 nt, Streptococcus pneumoniae R6
aguucuucccac

SEQ ID NO: 4088830 - RNA, 11 nt, Streptococcus pneumoniae R6
aguucuucccc

SEQ ID NO: 4088831 - RNA, 13 nt, Streptococcus pneumoniae R6
aguucuugaaaug

SEQ ID NO: 4088832 - RNA, 19 nt, Streptococcus pneumoniae R6
aguucuugaaaugaaguua

SEQ ID NO: 4088833 - RNA, 17 nt, Streptococcus pneumoniae R6
aguucuugcucaaucaa

SEQ ID NO: 4088834 - RNA, 12 nt, Streptococcus pneumoniae R6
aguucuuuaaag

SEQ ID NO: 4088835 - RNA, 17 nt, Streptococcus pneumoniae R6
aguucuuuaacaaagaa

SEQ ID NO: 4088836 - RNA, 21 nt, Streptococcus pneumoniae R6
aguucuuuaagguuagcugca

SEQ ID NO: 4088837 - RNA, 18 nt, Streptococcus pneumoniae R6
aguucuuuucauaaagag

SEQ ID NO: 4088838 - RNA, 12 nt, Streptococcus pneumoniae R6
aguugaaaucaa

SEQ ID NO: 4088839 - RNA, 13 nt, Streptococcus pneumoniae R6
aguugaaaucaag

SEQ ID NO: 4088840 - RNA, 23 nt, Streptococcus pneumoniae R6
aguugaagggcguugacaaucuu

SEQ ID NO: 4088841 - RNA, 13 nt, Streptococcus pneumoniae R6
aguugacaaagag

SEQ ID NO: 4088842 - RNA, 22 nt, Streptococcus pneumoniae R6
aguugaccuugaccagccaaga

SEQ ID NO: 4088843 - RNA, 12 nt, Streptococcus pneumoniae R6
aguugagcuggc

SEQ ID NO: 4088844 - RNA, 13 nt, Streptococcus pneumoniae R6
aguugauagaguu

SEQ ID NO: 4088845 - RNA, 20 nt, Streptococcus pneumoniae R6
aguugauaugagagauuucu

SEQ ID NO: 4088846 - RNA, 16 nt, Streptococcus pneumoniae R6
aguugcagggcuauuu

SEQ ID NO: 4088847 - RNA, 17 nt, Streptococcus pneumoniae R6
aguugcagguucgauuc

SEQ ID NO: 4088848 - RNA, 20 nt, Streptococcus pneumoniae R6
aguugcauagcgaagaacaa

SEQ ID NO: 4088849 - RNA, 21 nt, Streptococcus pneumoniae R6
aguugcaucuuaguuaaaaua

SEQ ID NO: 4088850 - RNA, 14 nt, Streptococcus pneumoniae R6
aguugcauuaaaau

SEQ ID NO: 4088851 - RNA, 15 nt, Streptococcus pneumoniae R6
aguugccucagauuc

SEQ ID NO: 4088852 - RNA, 19 nt, Streptococcus pneumoniae R6
aguugccucagauucugac

SEQ ID NO: 4088853 - RNA, 17 nt, Streptococcus pneumoniae R6
aguugcuguaaucacau

SEQ ID NO: 4088854 - RNA, 23 nt, Streptococcus pneumoniae R6
aguugcuugauuacaugauguga

SEQ ID NO: 4088855 - RNA, 16 nt, Streptococcus pneumoniae R6
aguugcuugucaucuu

SEQ ID NO: 4088856 - RNA, 18 nt, Streptococcus pneumoniae R6
aguuggacaaaaugauug

SEQ ID NO: 4088857 - RNA, 21 nt, Streptococcus pneumoniae R6
aguuggcuugguucuucacua

SEQ ID NO: 4088858 - RNA, 16 nt, Streptococcus pneumoniae R6
aguuggcuuugagaua

SEQ ID NO: 4088859 - RNA, 22 nt, Streptococcus pneumoniae R6
aguuggucacgacggugaacaa

SEQ ID NO: 4088860 - RNA, 22 nt, Streptococcus pneumoniae R6
aguugguccguguaaaaccuuu

SEQ ID NO: 4088861 - RNA, 21 nt, Streptococcus pneumoniae R6
aguugguuuauugaguuuuuu

SEQ ID NO: 4088862 - RNA, 20 nt, Streptococcus pneumoniae R6
aguuguaaucuuagcaaaga

SEQ ID NO: 4088863 - RNA, 19 nt, Streptococcus pneumoniae R6
aguuguacaagaaaagugc

SEQ ID NO: 4088864 - RNA, 15 nt, Streptococcus pneumoniae R6
aguugugaaugccac

SEQ ID NO: 4088865 - RNA, 15 nt, Streptococcus pneumoniae R6
aguuguuauuuagga

SEQ ID NO: 4088866 - RNA, 16 nt, Streptococcus pneumoniae R6
aguuguuauuuaggac

SEQ ID NO: 4088867 - RNA, 12 nt, Streptococcus pneumoniae R6
aguuguuuucua

SEQ ID NO: 4088868 - RNA, 21 nt, Streptococcus pneumoniae R6
aguuuaaucaaaauaaagcaa

SEQ ID NO: 4088869 - RNA, 14 nt, Streptococcus pneumoniae R6
aguuuacgacacau

SEQ ID NO: 4088870 - RNA, 15 nt, Streptococcus pneumoniae R6
aguuuacuauccuca

SEQ ID NO: 4088871 - RNA, 15 nt, Streptococcus pneumoniae R6
aguuuagaagaggua

SEQ ID NO: 4088872 - RNA, 18 nt, Streptococcus pneumoniae R6
aguuuaucuagaauuucu

SEQ ID NO: 4088873 - RNA, 18 nt, Streptococcus pneumoniae R6
aguuuaucucacacaaag

SEQ ID NO: 4088874 - RNA, 16 nt, Streptococcus pneumoniae R6
aguuucaauuguagau

SEQ ID NO: 4088875 - RNA, 17 nt, Streptococcus pneumoniae R6
aguuucaauuugauaua

SEQ ID NO: 4088876 - RNA, 21 nt, Streptococcus pneumoniae R6
aguuucagcgaccaucauuuu

SEQ ID NO: 4088877 - RNA, 17 nt, Streptococcus pneumoniae R6
aguuucaucuacaaccu

SEQ ID NO: 4088878 - RNA, 21 nt, Streptococcus pneumoniae R6
aguuucaucuacaaccucaaa

SEQ ID NO: 4088879 - RNA, 15 nt, Streptococcus pneumoniae R6
aguuuccgcaagauu

SEQ ID NO: 4088880 - RNA, 16 nt, Streptococcus pneumoniae R6
aguuucgaaaaccaaa

SEQ ID NO: 4088881 - RNA, 20 nt, Streptococcus pneumoniae R6
aguuucggcaccaauacagc

SEQ ID NO: 4088882 - RNA, 21 nt, Streptococcus pneumoniae R6
aguuucggcaccaauacagcu

SEQ ID NO: 4088883 - RNA, 20 nt, Streptococcus pneumoniae R6
aguuucucuacuaacucaaa

SEQ ID NO: 4088884 - RNA, 19 nt, Streptococcus pneumoniae R6
aguuucugggucucagucu

SEQ ID NO: 4088885 - RNA, 18 nt, Streptococcus pneumoniae R6
aguuugaucaauugucug

SEQ ID NO: 4088886 - RNA, 16 nt, Streptococcus pneumoniae R6
aguuugaucuuugcuu

SEQ ID NO: 4088887 - RNA, 17 nt, Streptococcus pneumoniae R6
aguuugaugagauuauu

SEQ ID NO: 4088888 - RNA, 16 nt, Streptococcus pneumoniae R6
aguuugauuucuggau

SEQ ID NO: 4088889 - RNA, 16 nt, Streptococcus pneumoniae R6
aguuugcaaauuauuu

SEQ ID NO: 4088890 - RNA, 17 nt, Streptococcus pneumoniae R6
aguuugcaaauuauuua

SEQ ID NO: 4088891 - RNA, 14 nt, Streptococcus pneumoniae R6
aguuugcucuuuga

SEQ ID NO: 4088892 - RNA, 21 nt, Streptococcus pneumoniae R6
aguuugcucuuugauuuucau

SEQ ID NO: 4088893 - RNA, 16 nt, Streptococcus pneumoniae R6
aguuuggcgaugauuu

SEQ ID NO: 4088894 - RNA, 20 nt, Streptococcus pneumoniae R6
aguuuggcgaugauuuccuu

SEQ ID NO: 4088895 - RNA, 17 nt, Streptococcus pneumoniae R6
aguuugucuuucauuuc

SEQ ID NO: 4088896 - RNA, 19 nt, Streptococcus pneumoniae R6
aguuuguguuucuuuuugg

SEQ ID NO: 4088897 - RNA, 14 nt, Streptococcus pneumoniae R6
aguuuuaaucucaa

SEQ ID NO: 4088898 - RNA, 20 nt, Streptococcus pneumoniae R6
aguuuuacggaucugaagcu

SEQ ID NO: 4088899 - RNA, 14 nt, Streptococcus pneumoniae R6
aguuuuagaugaga

SEQ ID NO: 4088900 - RNA, 23 nt, Streptococcus pneumoniae R6
aguuuuaggacauaaauaugauc

SEQ ID NO: 4088901 - RNA, 21 nt, Streptococcus pneumoniae R6
aguuuuaucaguaaucucaaa

SEQ ID NO: 4088902 - RNA, 16 nt, Streptococcus pneumoniae R6
aguuuucaaugauaaa

SEQ ID NO: 4088903 - RNA, 12 nt, Streptococcus pneumoniae R6
aguuuucauucu

SEQ ID NO: 4088904 - RNA, 14 nt, Streptococcus pneumoniae R6
aguuuuccguucuc

SEQ ID NO: 4088905 - RNA, 14 nt, Streptococcus pneumoniae R6
aguuuucuaaagaa

SEQ ID NO: 4088906 - RNA, 15 nt, Streptococcus pneumoniae R6
aguuuucuaaagaau

SEQ ID NO: 4088907 - RNA, 13 nt, Streptococcus pneumoniae R6
aguuuucuaguuu

SEQ ID NO: 4088908 - RNA, 13 nt, Streptococcus pneumoniae R6
aguuuugagaauc

SEQ ID NO: 4088909 - RNA, 22 nt, Streptococcus pneumoniae R6
aguuuugauagcguucguucau

SEQ ID NO: 4088910 - RNA, 10 nt, Streptococcus pneumoniae R6
aguuuugcua

SEQ ID NO: 4088911 - RNA, 20 nt, Streptococcus pneumoniae R6
aguuuuggaauggaguagua

SEQ ID NO: 4088912 - RNA, 15 nt, Streptococcus pneumoniae R6
aguuuuuaauuuuuc

SEQ ID NO: 4088913 - RNA, 16 nt, Streptococcus pneumoniae R6
aguuuuuaauuuuucu

SEQ ID NO: 4088914 - RNA, 19 nt, Streptococcus pneumoniae R6
aguuuuuaauuuuucuuug

SEQ ID NO: 4088915 - RNA, 14 nt, Streptococcus pneumoniae R6
aguuuuuagaagcu

SEQ ID NO: 4088916 - RNA, 20 nt, Streptococcus pneumoniae R6
aguuuuuagaagcuucuugg

SEQ ID NO: 4088917 - RNA, 21 nt, Streptococcus pneumoniae R6
aguuuuuagaagcuucuugga

SEQ ID NO: 4088918 - RNA, 20 nt, Streptococcus pneumoniae R6
aguuuuugguaauuuucuuu

SEQ ID NO: 4088919 - RNA, 16 nt, Streptococcus pneumoniae R6
aguuuuuuaucuuugg

SEQ ID NO: 4088920 - RNA, 17 nt, Streptococcus pneumoniae R6
aguuuuuugacuucaau

SEQ ID NO: 4088921 - RNA, 15 nt, Streptococcus pneumoniae R6
auaaaaaacacaaaa

SEQ ID NO: 4088922 - RNA, 20 nt, Streptococcus pneumoniae R6
auaaaaaacucuccugggaa

SEQ ID NO: 4088923 - RNA, 13 nt, Streptococcus pneumoniae R6
auaaaaaagaagg

SEQ ID NO: 4088924 - RNA, 20 nt, Streptococcus pneumoniae R6
auaaaaagagaagaaauaug

SEQ ID NO: 4088925 - RNA, 17 nt, Streptococcus pneumoniae R6
auaaaaagcauaguauc

SEQ ID NO: 4088926 - RNA, 18 nt, Streptococcus pneumoniae R6
auaaaaauaacuucagau

SEQ ID NO: 4088927 - RNA, 21 nt, Streptococcus pneumoniae R6
auaaaaauccguuuuuugaag

SEQ ID NO: 4088928 - RNA, 13 nt, Streptococcus pneumoniae R6
auaaaacaaaaaa

SEQ ID NO: 4088929 - RNA, 17 nt, Streptococcus pneumoniae R6
auaaaaccaaaaagugg

SEQ ID NO: 4088930 - RNA, 23 nt, Streptococcus pneumoniae R6
auaaaacuauaaucuguuaucuu

SEQ ID NO: 4088931 - RNA, 16 nt, Streptococcus pneumoniae R6
auaaaacuauugacuu

SEQ ID NO: 4088932 - RNA, 22 nt, Streptococcus pneumoniae R6
auaaaacugacgugguuuaaaa

SEQ ID NO: 4088933 - RNA, 12 nt, Streptococcus pneumoniae R6
auaaaagauaga

SEQ ID NO: 4088934 - RNA, 18 nt, Streptococcus pneumoniae R6
auaaaaggcauccuauca

SEQ ID NO: 4088935 - RNA, 14 nt, Streptococcus pneumoniae R6
auaaaaggcuuagc

SEQ ID NO: 4088936 - RNA, 16 nt, Streptococcus pneumoniae R6
auaaaagguauugcaa

SEQ ID NO: 4088937 - RNA, 16 nt, Streptococcus pneumoniae R6
auaaaagucuggcucg

SEQ ID NO: 4088938 - RNA, 15 nt, Streptococcus pneumoniae R6
auaaaauaacggaga

SEQ ID NO: 4088939 - RNA, 15 nt, Streptococcus pneumoniae R6
auaaaauauaguaga

SEQ ID NO: 4088940 - RNA, 16 nt, Streptococcus pneumoniae R6
auaaaauauaguagau

SEQ ID NO: 4088941 - RNA, 15 nt, Streptococcus pneumoniae R6
auaaaaucaaacaaa

SEQ ID NO: 4088942 - RNA, 13 nt, Streptococcus pneumoniae R6
auaaaaucaaauu

SEQ ID NO: 4088943 - RNA, 18 nt, Streptococcus pneumoniae R6
auaaaaucagguguucaa

SEQ ID NO: 4088944 - RNA, 18 nt, Streptococcus pneumoniae R6
auaaaauccgaggggcua

SEQ ID NO: 4088945 - RNA, 20 nt, Streptococcus pneumoniae R6
auaaaaucugaagaaagcaa

SEQ ID NO: 4088946 - RNA, 14 nt, Streptococcus pneumoniae R6
auaaaaugaaauaa

SEQ ID NO: 4088947 - RNA, 17 nt, Streptococcus pneumoniae R6
auaaaauuccuuuaaaa

SEQ ID NO: 4088948 - RNA, 21 nt, Streptococcus pneumoniae R6
auaaaauuccuuuaaaaacaa

SEQ ID NO: 4088949 - RNA, 19 nt, Streptococcus pneumoniae R6
auaaaauugaauugcuuau

SEQ ID NO: 4088950 - RNA, 19 nt, Streptococcus pneumoniae R6
auaaaauuuaaaaauagau

SEQ ID NO: 4088951 - RNA, 21 nt, Streptococcus pneumoniae R6
auaaaauuuaaaaauagauuu

SEQ ID NO: 4088952 - RNA, 20 nt, Streptococcus pneumoniae R6
auaaaauuucuugacauaca

SEQ ID NO: 4088953 - RNA, 18 nt, Streptococcus pneumoniae R6
auaaacaagggcaaaaaa

SEQ ID NO: 4088954 - RNA, 17 nt, Streptococcus pneumoniae R6
auaaacagcgagcuuca

SEQ ID NO: 4088955 - RNA, 17 nt, Streptococcus pneumoniae R6
auaaaccacgaggguaa

SEQ ID NO: 4088956 - RNA, 21 nt, Streptococcus pneumoniae R6
auaaacgcaagcaacaaaaac

SEQ ID NO: 4088957 - RNA, 19 nt, Streptococcus pneumoniae R6
auaaacuauccagagcauu

SEQ ID NO: 4088958 - RNA, 14 nt, Streptococcus pneumoniae R6
auaaacuugcagga

SEQ ID NO: 4088959 - RNA, 20 nt, Streptococcus pneumoniae R6
auaaacuugcaggaaauuuu

SEQ ID NO: 4088960 - RNA, 18 nt, Streptococcus pneumoniae R6
auaaacuuguaggcuucu

SEQ ID NO: 4088961 - RNA, 19 nt, Streptococcus pneumoniae R6
auaaacuuugguuauaaaa

SEQ ID NO: 4088962 - RNA, 23 nt, Streptococcus pneumoniae R6
auaaacuuugguuauaaaaaaca

SEQ ID NO: 4088963 - RNA, 21 nt, Streptococcus pneumoniae R6
auaaacuuuuucauaaauaga

SEQ ID NO: 4088964 - RNA, 22 nt, Streptococcus pneumoniae R6
auaaacuuuuucauaaauagau

SEQ ID NO: 4088965 - RNA, 11 nt, Streptococcus pneumoniae R6
auaaagagaag

SEQ ID NO: 4088966 - RNA, 22 nt, Streptococcus pneumoniae R6
auaaagagcacugcuagcauca

SEQ ID NO: 4088967 - RNA, 21 nt, Streptococcus pneumoniae R6
auaaagagucuggaacaaaau

SEQ ID NO: 4088968 - RNA, 14 nt, Streptococcus pneumoniae R6
auaaagauacgaug

SEQ ID NO: 4088969 - RNA, 19 nt, Streptococcus pneumoniae R6
auaaagccuuucgaacuuu

SEQ ID NO: 4088970 - RNA, 13 nt, Streptococcus pneumoniae R6
auaaagcugauuu

SEQ ID NO: 4088971 - RNA, 22 nt, Streptococcus pneumoniae R6
auaaagcuugaccugauaguuu

SEQ ID NO: 4088972 - RNA, 17 nt, Streptococcus pneumoniae R6
auaaaggcagauuucaa

SEQ ID NO: 4088973 - RNA, 14 nt, Streptococcus pneumoniae R6
auaaagguguucaa

SEQ ID NO: 4088974 - RNA, 13 nt, Streptococcus pneumoniae R6
auaaaguauuaua

SEQ ID NO: 4088975 - RNA, 18 nt, Streptococcus pneumoniae R6
auaaaguauuauaauaua

SEQ ID NO: 4088976 - RNA, 18 nt, Streptococcus pneumoniae R6
auaaagugauauacuaug

SEQ ID NO: 4088977 - RNA, 14 nt, Streptococcus pneumoniae R6
auaaaguggucuuu

SEQ ID NO: 4088978 - RNA, 18 nt, Streptococcus pneumoniae R6
auaaagugucucccuuuu

SEQ ID NO: 4088979 - RNA, 21 nt, Streptococcus pneumoniae R6
auaaaguuccuuuaggugaaa

SEQ ID NO: 4088980 - RNA, 14 nt, Streptococcus pneumoniae R6
auaaaguuucugua

SEQ ID NO: 4088981 - RNA, 21 nt, Streptococcus pneumoniae R6
auaaauaauuauagaaaugag

SEQ ID NO: 4088982 - RNA, 15 nt, Streptococcus pneumoniae R6
auaaauacuaucaau

SEQ ID NO: 4088983 - RNA, 20 nt, Streptococcus pneumoniae R6
auaaauacuaucaauaaaau

SEQ ID NO: 4088984 - RNA, 22 nt, Streptococcus pneumoniae R6
auaaauagauuggauaaaaucu

SEQ ID NO: 4088985 - RNA, 14 nt, Streptococcus pneumoniae R6
auaaauaguuauag

SEQ ID NO: 4088986 - RNA, 13 nt, Streptococcus pneumoniae R6
auaaauauagaaa

SEQ ID NO: 4088987 - RNA, 17 nt, Streptococcus pneumoniae R6
auaaauaucaaaaaaag

SEQ ID NO: 4088988 - RNA, 19 nt, Streptococcus pneumoniae R6
auaaauaucaaaaaaagaa

SEQ ID NO: 4088989 - RNA, 15 nt, Streptococcus pneumoniae R6
auaaauccagcugag

SEQ ID NO: 4088990 - RNA, 16 nt, Streptococcus pneumoniae R6
auaaauccagcugaga

SEQ ID NO: 4088991 - RNA, 16 nt, Streptococcus pneumoniae R6
auaaaucgaucauauu

SEQ ID NO: 4088992 - RNA, 21 nt, Streptococcus pneumoniae R6
auaaaucgcuuuuguaaaucu

SEQ ID NO: 4088993 - RNA, 16 nt, Streptococcus pneumoniae R6
auaaaucuucuaaauu

SEQ ID NO: 4088994 - RNA, 14 nt, Streptococcus pneumoniae R6
auaaaugacaugcu

SEQ ID NO: 4088995 - RNA, 16 nt, Streptococcus pneumoniae R6
auaaaugcaaagccaa

SEQ ID NO: 4088996 - RNA, 22 nt, Streptococcus pneumoniae R6
auaaaugucgaaccaagagcac

SEQ ID NO: 4088997 - RNA, 16 nt, Streptococcus pneumoniae R6
auaaauguuuuagcaa

SEQ ID NO: 4088998 - RNA, 16 nt, Streptococcus pneumoniae R6
auaaauuaauugucua

SEQ ID NO: 4088999 - RNA, 14 nt, Streptococcus pneumoniae R6
auaaauucauuuga

SEQ ID NO: 4089000 - RNA, 14 nt, Streptococcus pneumoniae R6
auaaauugagcauu

SEQ ID NO: 4089001 - RNA, 17 nt, Streptococcus pneumoniae R6
auaaauugcuggagaau

SEQ ID NO: 4089002 - RNA, 19 nt, Streptococcus pneumoniae R6
auaaauugggcgaugaaga

SEQ ID NO: 4089003 - RNA, 21 nt, Streptococcus pneumoniae R6
auaaauuucaaaguagauacu

SEQ ID NO: 4089004 - RNA, 13 nt, Streptococcus pneumoniae R6
auaacaaaccaag

SEQ ID NO: 4089005 - RNA, 17 nt, Streptococcus pneumoniae R6
auaacaaaccaagaaua

SEQ ID NO: 4089006 - RNA, 21 nt, Streptococcus pneumoniae R6
auaacaacucccuccuaagga

SEQ ID NO: 4089007 - RNA, 17 nt, Streptococcus pneumoniae R6
auaacacgagaaacaau

SEQ ID NO: 4089008 - RNA, 13 nt, Streptococcus pneumoniae R6
auaacacuauuaa

SEQ ID NO: 4089009 - RNA, 13 nt, Streptococcus pneumoniae R6
auaacagagaaga

SEQ ID NO: 4089010 - RNA, 17 nt, Streptococcus pneumoniae R6
auaacagagaagaaauu

SEQ ID NO: 4089011 - RNA, 19 nt, Streptococcus pneumoniae R6
auaacagcauuuccaccug

SEQ ID NO: 4089012 - RNA, 23 nt, Streptococcus pneumoniae R6
auaacaguauacuggagaauuga

SEQ ID NO: 4089013 - RNA, 21 nt, Streptococcus pneumoniae R6
auaacaguuuuuaauuuuucu

SEQ ID NO: 4089014 - RNA, 23 nt, Streptococcus pneumoniae R6
auaacaguuuuuaauuuuucuuu

SEQ ID NO: 4089015 - RNA, 23 nt, Streptococcus pneumoniae R6
auaacaucugcuauaauaguaag

SEQ ID NO: 4089016 - RNA, 20 nt, Streptococcus pneumoniae R6
auaacauuuccucgaagcaa

SEQ ID NO: 4089017 - RNA, 13 nt, Streptococcus pneumoniae R6
auaaccuuaauca

SEQ ID NO: 4089018 - RNA, 18 nt, Streptococcus pneumoniae R6
auaacgaagagcuggcug

SEQ ID NO: 4089019 - RNA, 18 nt, Streptococcus pneumoniae R6
auaacgaauccaacucuu

SEQ ID NO: 4089020 - RNA, 19 nt, Streptococcus pneumoniae R6
auaacgaauccaacucuug

SEQ ID NO: 4089021 - RNA, 12 nt, Streptococcus pneumoniae R6
auaacgcaauuc

SEQ ID NO: 4089022 - RNA, 16 nt, Streptococcus pneumoniae R6
auaacugcuaaaagau

SEQ ID NO: 4089023 - RNA, 14 nt, Streptococcus pneumoniae R6
auaacugcuagaaa

SEQ ID NO: 4089024 - RNA, 19 nt, Streptococcus pneumoniae R6
auaacuucaauaucuuuaa

SEQ ID NO: 4089025 - RNA, 16 nt, Streptococcus pneumoniae R6
auaacuucagauuagu

SEQ ID NO: 4089026 - RNA, 18 nt, Streptococcus pneumoniae R6
auaacuugaaguaaagac

SEQ ID NO: 4089027 - RNA, 22 nt, Streptococcus pneumoniae R6
auaacuuguuuacguuuuaaaa

SEQ ID NO: 4089028 - RNA, 20 nt, Streptococcus pneumoniae R6
auaagaaaaaacagccgagg

SEQ ID NO: 4089029 - RNA, 15 nt, Streptococcus pneumoniae R6
auaagaauaucaaga

SEQ ID NO: 4089030 - RNA, 16 nt, Streptococcus pneumoniae R6
auaagaauaucaagau

SEQ ID NO: 4089031 - RNA, 19 nt, Streptococcus pneumoniae R6
auaagaauaucaagauaag

SEQ ID NO: 4089032 - RNA, 22 nt, Streptococcus pneumoniae R6
auaagaauaucugagauaguau

SEQ ID NO: 4089033 - RNA, 22 nt, Streptococcus pneumoniae R6
auaagaaucccucuuuuuacaa

SEQ ID NO: 4089034 - RNA, 21 nt, Streptococcus pneumoniae R6
auaagacuuuuccuguuguau

SEQ ID NO: 4089035 - RNA, 19 nt, Streptococcus pneumoniae R6
auaagagaagagagcauua

SEQ ID NO: 4089036 - RNA, 20 nt, Streptococcus pneumoniae R6
auaagagcaacaaauauggu

SEQ ID NO: 4089037 - RNA, 17 nt, Streptococcus pneumoniae R6
auaagaggauuuuaaag

SEQ ID NO: 4089038 - RNA, 21 nt, Streptococcus pneumoniae R6
auaagaggauuuuaaaguaau

SEQ ID NO: 4089039 - RNA, 16 nt, Streptococcus pneumoniae R6
auaagaggucugaaac

SEQ ID NO: 4089040 - RNA, 20 nt, Streptococcus pneumoniae R6
auaagaggucugaaacuacu

SEQ ID NO: 4089041 - RNA, 15 nt, Streptococcus pneumoniae R6
auaagauaaggcauc

SEQ ID NO: 4089042 - RNA, 19 nt, Streptococcus pneumoniae R6
auaagauaaggcaucuuaa

SEQ ID NO: 4089043 - RNA, 17 nt, Streptococcus pneumoniae R6
auaagauaauaaauagu

SEQ ID NO: 4089044 - RNA, 20 nt, Streptococcus pneumoniae R6
auaagauuaauuucagaaau

SEQ ID NO: 4089045 - RNA, 24 nt, Streptococcus pneumoniae R6
auaagcaauucaauuuuauacuca

SEQ ID NO: 4089046 - RNA, 22 nt, Streptococcus pneumoniae R6
auaagcaccuacaacauagacu

SEQ ID NO: 4089047 - RNA, 19 nt, Streptococcus pneumoniae R6
auaagcccgaaaaauuucu

SEQ ID NO: 4089048 - RNA, 22 nt, Streptococcus pneumoniae R6
auaagcccgaaaaauuucucug

SEQ ID NO: 4089049 - RNA, 21 nt, Streptococcus pneumoniae R6
auaagccgaagccaaucaaac

SEQ ID NO: 4089050 - RNA, 19 nt, Streptococcus pneumoniae R6
auaagccggcuugucuuug

SEQ ID NO: 4089051 - RNA, 19 nt, Streptococcus pneumoniae R6
auaagcggcuagcgucuaa

SEQ ID NO: 4089052 - RNA, 19 nt, Streptococcus pneumoniae R6
auaagcuugugaaagcucu

SEQ ID NO: 4089053 - RNA, 13 nt, Streptococcus pneumoniae R6
auaagcuuugaaa

SEQ ID NO: 4089054 - RNA, 14 nt, Streptococcus pneumoniae R6
auaagcuuugaaaa

SEQ ID NO: 4089055 - RNA, 16 nt, Streptococcus pneumoniae R6
auaaggaauuuuagaa

SEQ ID NO: 4089056 - RNA, 19 nt, Streptococcus pneumoniae R6
auaaggacugcgauugggg

SEQ ID NO: 4089057 - RNA, 23 nt, Streptococcus pneumoniae R6
auaaggacuuccgccaucuuguu

SEQ ID NO: 4089058 - RNA, 17 nt, Streptococcus pneumoniae R6
auaaggcaucuuaacau

SEQ ID NO: 4089059 - RNA, 19 nt, Streptococcus pneumoniae R6
auaaggccuauauagcgga

SEQ ID NO: 4089060 - RNA, 15 nt, Streptococcus pneumoniae R6
auaaggcgaugcuga

SEQ ID NO: 4089061 - RNA, 20 nt, Streptococcus pneumoniae R6
auaagggcaaagaaaaggaa

SEQ ID NO: 4089062 - RNA, 21 nt, Streptococcus pneumoniae R6
auaagguuauccuuauuuugc

SEQ ID NO: 4089063 - RNA, 19 nt, Streptococcus pneumoniae R6
auaagguuuagcaaaagca

SEQ ID NO: 4089064 - RNA, 19 nt, Streptococcus pneumoniae R6
auaaguccgaaaaauuucu

SEQ ID NO: 4089065 - RNA, 14 nt, Streptococcus pneumoniae R6
auaagucuuugauu

SEQ ID NO: 4089066 - RNA, 17 nt, Streptococcus pneumoniae R6
auaagucuuugauuuug

SEQ ID NO: 4089067 - RNA, 20 nt, Streptococcus pneumoniae R6
auaagucuuugauuuugaga

SEQ ID NO: 4089068 - RNA, 11 nt, Streptococcus pneumoniae R6
auaaguggcaa

SEQ ID NO: 4089069 - RNA, 19 nt, Streptococcus pneumoniae R6
auaaguuccaucugggucg

SEQ ID NO: 4089070 - RNA, 18 nt, Streptococcus pneumoniae R6
auaaguuguaguacugaa

SEQ ID NO: 4089071 - RNA, 21 nt, Streptococcus pneumoniae R6
auaaguuguaguacugaacaa

SEQ ID NO: 4089072 - RNA, 22 nt, Streptococcus pneumoniae R6
auaaguuguaguacugaacaau

SEQ ID NO: 4089073 - RNA, 12 nt, Streptococcus pneumoniae R6
auaaguuugaug

SEQ ID NO: 4089074 - RNA, 13 nt, Streptococcus pneumoniae R6
auaaguuugguuu

SEQ ID NO: 4089075 - RNA, 22 nt, Streptococcus pneumoniae R6
auaaguuuuguuugucaguuau

SEQ ID NO: 4089076 - RNA, 12 nt, Streptococcus pneumoniae R6
auaauaaaacuu

SEQ ID NO: 4089077 - RNA, 20 nt, Streptococcus pneumoniae R6
auaauaaaagugucuuaaca

SEQ ID NO: 4089078 - RNA, 20 nt, Streptococcus pneumoniae R6
auaauaaaaugaaauaauaa

SEQ ID NO: 4089079 - RNA, 13 nt, Streptococcus pneumoniae R6
auaauaaauaguu

SEQ ID NO: 4089080 - RNA, 15 nt, Streptococcus pneumoniae R6
auaauaauuuauaaa

SEQ ID NO: 4089081 - RNA, 14 nt, Streptococcus pneumoniae R6
auaauacaaaaaau

SEQ ID NO: 4089082 - RNA, 17 nt, Streptococcus pneumoniae R6
auaauacaaaaaauagu

SEQ ID NO: 4089083 - RNA, 24 nt, Streptococcus pneumoniae R6
auaauaccagcaaucaaauucauu

SEQ ID NO: 4089084 - RNA, 22 nt, Streptococcus pneumoniae R6
auaauacgaccaaucuuuucca

SEQ ID NO: 4089085 - RNA, 21 nt, Streptococcus pneumoniae R6
auaauacucaaugaaaaucaa

SEQ ID NO: 4089086 - RNA, 18 nt, Streptococcus pneumoniae R6
auaauagaaaacagacaa

SEQ ID NO: 4089087 - RNA, 19 nt, Streptococcus pneumoniae R6
auaauagaaaacagacaaa

SEQ ID NO: 4089088 - RNA, 21 nt, Streptococcus pneumoniae R6
auaauagaaaacagacaaaac

SEQ ID NO: 4089089 - RNA, 18 nt, Streptococcus pneumoniae R6
auaauagaaauuuugaaa

SEQ ID NO: 4089090 - RNA, 14 nt, Streptococcus pneumoniae R6
auaauagacuuccu

SEQ ID NO: 4089091 - RNA, 17 nt, Streptococcus pneumoniae R6
auaauagauugaaacua

SEQ ID NO: 4089092 - RNA, 17 nt, Streptococcus pneumoniae R6
auaauagcacuuaaaaa

SEQ ID NO: 4089093 - RNA, 19 nt, Streptococcus pneumoniae R6
auaauagcgaugaagagag

SEQ ID NO: 4089094 - RNA, 23 nt, Streptococcus pneumoniae R6
auaauagcuugcaauucuuuagc

SEQ ID NO: 4089095 - RNA, 13 nt, Streptococcus pneumoniae R6
auaauaguaagag

SEQ ID NO: 4089096 - RNA, 20 nt, Streptococcus pneumoniae R6
auaauagugauuggagauac

SEQ ID NO: 4089097 - RNA, 20 nt, Streptococcus pneumoniae R6
auaauauauagguuuugcua

SEQ ID NO: 4089098 - RNA, 20 nt, Streptococcus pneumoniae R6
auaauaucagauauucuaaa

SEQ ID NO: 4089099 - RNA, 23 nt, Streptococcus pneumoniae R6
auaauaucagauauucuaaaacc

SEQ ID NO: 4089100 - RNA, 15 nt, Streptococcus pneumoniae R6
auaauauguauuuau

SEQ ID NO: 4089101 - RNA, 16 nt, Streptococcus pneumoniae R6
auaauauguauuuaua

SEQ ID NO: 4089102 - RNA, 20 nt, Streptococcus pneumoniae R6
auaauauuacuucuaaaaca

SEQ ID NO: 4089103 - RNA, 14 nt, Streptococcus pneumoniae R6
auaauauuauucua

SEQ ID NO: 4089104 - RNA, 16 nt, Streptococcus pneumoniae R6
auaauauuuucuuuau

SEQ ID NO: 4089105 - RNA, 13 nt, Streptococcus pneumoniae R6
auaaucaaacuag

SEQ ID NO: 4089106 - RNA, 12 nt, Streptococcus pneumoniae R6
auaaucaagaug

SEQ ID NO: 4089107 - RNA, 14 nt, Streptococcus pneumoniae R6
auaaucaauauaga

SEQ ID NO: 4089108 - RNA, 18 nt, Streptococcus pneumoniae R6
auaaucaauauagaagua

SEQ ID NO: 4089109 - RNA, 14 nt, Streptococcus pneumoniae R6
auaaucaauauagu

SEQ ID NO: 4089110 - RNA, 20 nt, Streptococcus pneumoniae R6
auaaucaauauagucuauaa

SEQ ID NO: 4089111 - RNA, 22 nt, Streptococcus pneumoniae R6
auaaucaucgcuaucaaugguu

SEQ ID NO: 4089112 - RNA, 14 nt, Streptococcus pneumoniae R6
auaaucaucuggau

SEQ ID NO: 4089113 - RNA, 15 nt, Streptococcus pneumoniae R6
auaauccaacaccaa

SEQ ID NO: 4089114 - RNA, 18 nt, Streptococcus pneumoniae R6
auaauccaacaccaauuu

SEQ ID NO: 4089115 - RNA, 21 nt, Streptococcus pneumoniae R6
auaauccuugucgucauacca

SEQ ID NO: 4089116 - RNA, 17 nt, Streptococcus pneumoniae R6
auaaucgccauacaucu

SEQ ID NO: 4089117 - RNA, 17 nt, Streptococcus pneumoniae R6
auaaucguuuaaaacac

SEQ ID NO: 4089118 - RNA, 19 nt, Streptococcus pneumoniae R6
auaaucuuaucucuaucuc

SEQ ID NO: 4089119 - RNA, 17 nt, Streptococcus pneumoniae R6
auaaugaagacaucaua

SEQ ID NO: 4089120 - RNA, 15 nt, Streptococcus pneumoniae R6
auaaugauuucaaga

SEQ ID NO: 4089121 - RNA, 15 nt, Streptococcus pneumoniae R6
auaaugcuuugaaca

SEQ ID NO: 4089122 - RNA, 15 nt, Streptococcus pneumoniae R6
auaaugguuauaucu

SEQ ID NO: 4089123 - RNA, 20 nt, Streptococcus pneumoniae R6
auaaugguuauaucugcuac

SEQ ID NO: 4089124 - RNA, 23 nt, Streptococcus pneumoniae R6
auaauguaaggugcaaaaaccuu

SEQ ID NO: 4089125 - RNA, 15 nt, Streptococcus pneumoniae R6
auaaugucuucugcu

SEQ ID NO: 4089126 - RNA, 16 nt, Streptococcus pneumoniae R6
auaauuaaaucauaaa

SEQ ID NO: 4089127 - RNA, 19 nt, Streptococcus pneumoniae R6
auaauuaaaucauaaacac

SEQ ID NO: 4089128 - RNA, 19 nt, Streptococcus pneumoniae R6
auaauuagguaguuaaucu

SEQ ID NO: 4089129 - RNA, 16 nt, Streptococcus pneumoniae R6
auaauuauauauaaaa

SEQ ID NO: 4089130 - RNA, 14 nt, Streptococcus pneumoniae R6
auaauuccagauug

SEQ ID NO: 4089131 - RNA, 18 nt, Streptococcus pneumoniae R6
auaauugaauauggaaua

SEQ ID NO: 4089132 - RNA, 14 nt, Streptococcus pneumoniae R6
auaauuguaaacaa

SEQ ID NO: 4089133 - RNA, 15 nt, Streptococcus pneumoniae R6
auaauuguaggaaag

SEQ ID NO: 4089134 - RNA, 13 nt, Streptococcus pneumoniae R6
auaauuuaaaaua

SEQ ID NO: 4089135 - RNA, 20 nt, Streptococcus pneumoniae R6
auaauuuccauaccaaagua

SEQ ID NO: 4089136 - RNA, 18 nt, Streptococcus pneumoniae R6
auaauuuccaugucaauu

SEQ ID NO: 4089137 - RNA, 22 nt, Streptococcus pneumoniae R6
auaauuuccaugucaauuuuua

SEQ ID NO: 4089138 - RNA, 16 nt, Streptococcus pneumoniae R6
auaauuucuuuaaucu

SEQ ID NO: 4089139 - RNA, 13 nt, Streptococcus pneumoniae R6
auaauuuuaaaga

SEQ ID NO: 4089140 - RNA, 17 nt, Streptococcus pneumoniae R6
auaauuuuaguagaaaa

SEQ ID NO: 4089141 - RNA, 15 nt, Streptococcus pneumoniae R6
auaauuuuguuaaga

SEQ ID NO: 4089142 - RNA, 17 nt, Streptococcus pneumoniae R6
auacaaaaacaaagaga

SEQ ID NO: 4089143 - RNA, 20 nt, Streptococcus pneumoniae R6
auacaaaaaucuaagauaaa

SEQ ID NO: 4089144 - RNA, 13 nt, Streptococcus pneumoniae R6
auacaaaaccaaa

SEQ ID NO: 4089145 - RNA, 22 nt, Streptococcus pneumoniae R6
auacaaauuuauacuaauacau

SEQ ID NO: 4089146 - RNA, 16 nt, Streptococcus pneumoniae R6
auacaacuuaaaaaga

SEQ ID NO: 4089147 - RNA, 17 nt, Streptococcus pneumoniae R6
auacaacuuaaaaagag

SEQ ID NO: 4089148 - RNA, 23 nt, Streptococcus pneumoniae R6
auacaaggacuggagaaggagau

SEQ ID NO: 4089149 - RNA, 19 nt, Streptococcus pneumoniae R6
auacaagucuugccuucaa

SEQ ID NO: 4089150 - RNA, 15 nt, Streptococcus pneumoniae R6
auacaaguucaucuu

SEQ ID NO: 4089151 - RNA, 16 nt, Streptococcus pneumoniae R6
auacaaguucaucuuc

SEQ ID NO: 4089152 - RNA, 14 nt, Streptococcus pneumoniae R6
auacaauugcucuu

SEQ ID NO: 4089153 - RNA, 19 nt, Streptococcus pneumoniae R6
auacaauugcucuucugaa

SEQ ID NO: 4089154 - RNA, 13 nt, Streptococcus pneumoniae R6
auacacacuuaaa

SEQ ID NO: 4089155 - RNA, 15 nt, Streptococcus pneumoniae R6
auacacacuuaaauu

SEQ ID NO: 4089156 - RNA, 12 nt, Streptococcus pneumoniae R6
auacacauccag

SEQ ID NO: 4089157 - RNA, 22 nt, Streptococcus pneumoniae R6
auacaccuaauccacucagaca

SEQ ID NO: 4089158 - RNA, 24 nt, Streptococcus pneumoniae R6
auacacuucuacuauacgacaugc

SEQ ID NO: 4089159 - RNA, 22 nt, Streptococcus pneumoniae R6
auacagacugcaaggcaagacu

SEQ ID NO: 4089160 - RNA, 15 nt, Streptococcus pneumoniae R6
auacagauaaaaauc

SEQ ID NO: 4089161 - RNA, 17 nt, Streptococcus pneumoniae R6
auacagcuuuuuucuuu

SEQ ID NO: 4089162 - RNA, 16 nt, Streptococcus pneumoniae R6
auacaguauccacauu

SEQ ID NO: 4089163 - RNA, 21 nt, Streptococcus pneumoniae R6
auacaguccucccuuguuuuu

SEQ ID NO: 4089164 - RNA, 19 nt, Streptococcus pneumoniae R6
auacagugaaggcuuuaaa

SEQ ID NO: 4089165 - RNA, 20 nt, Streptococcus pneumoniae R6
auacauccguuuuucuccuc

SEQ ID NO: 4089166 - RNA, 13 nt, Streptococcus pneumoniae R6
auacaucuaugau

SEQ ID NO: 4089167 - RNA, 18 nt, Streptococcus pneumoniae R6
auacaucuggguuaaaaa

SEQ ID NO: 4089168 - RNA, 22 nt, Streptococcus pneumoniae R6
auaccaaagaagucaccauaaa

SEQ ID NO: 4089169 - RNA, 16 nt, Streptococcus pneumoniae R6
auaccaaggauugucu

SEQ ID NO: 4089170 - RNA, 17 nt, Streptococcus pneumoniae R6
auaccacucuugcauuu

SEQ ID NO: 4089171 - RNA, 22 nt, Streptococcus pneumoniae R6
auaccagguaauccagaaaugg

SEQ ID NO: 4089172 - RNA, 14 nt, Streptococcus pneumoniae R6
auaccaguuuuuga

SEQ ID NO: 4089173 - RNA, 15 nt, Streptococcus pneumoniae R6
auaccaguuuuugau

SEQ ID NO: 4089174 - RNA, 15 nt, Streptococcus pneumoniae R6
auaccauaauaaaag

SEQ ID NO: 4089175 - RNA, 15 nt, Streptococcus pneumoniae R6
auaccauagagcgga

SEQ ID NO: 4089176 - RNA, 16 nt, Streptococcus pneumoniae R6
auacccaugcuuuucu

SEQ ID NO: 4089177 - RNA, 17 nt, Streptococcus pneumoniae R6
auaccuaaucuuucugc

SEQ ID NO: 4089178 - RNA, 14 nt, Streptococcus pneumoniae R6
auaccugaaaccau

SEQ ID NO: 4089179 - RNA, 20 nt, Streptococcus pneumoniae R6
auaccugcucgccccauuuc

SEQ ID NO: 4089180 - RNA, 13 nt, Streptococcus pneumoniae R6
auaccugggaaga

SEQ ID NO: 4089181 - RNA, 22 nt, Streptococcus pneumoniae R6
auaccuguuaagccuauucccu

SEQ ID NO: 4089182 - RNA, 13 nt, Streptococcus pneumoniae R6
auaccuuuuccuu

SEQ ID NO: 4089183 - RNA, 18 nt, Streptococcus pneumoniae R6
auaccuuuuccuucauuu

SEQ ID NO: 4089184 - RNA, 21 nt, Streptococcus pneumoniae R6
auaccuuuuccuucauuucca

SEQ ID NO: 4089185 - RNA, 22 nt, Streptococcus pneumoniae R6
auaccuuuuccuucauuuccaa

SEQ ID NO: 4089186 - RNA, 13 nt, Streptococcus pneumoniae R6
auacgaaucuggu

SEQ ID NO: 4089187 - RNA, 15 nt, Streptococcus pneumoniae R6
auagaucuuuacuug

SEQ ID NO: 4089188 - RNA, 22 nt, Streptococcus pneumoniae R6
auagaugacaaaguacuugaga

SEQ ID NO: 4089189 - RNA, 19 nt, Streptococcus pneumoniae R6
auagaugaucgagcagauu

SEQ ID NO: 4089190 - RNA, 15 nt, Streptococcus pneumoniae R6
auagaugcuugaauu

SEQ ID NO: 4089191 - RNA, 17 nt, Streptococcus pneumoniae R6
auagauguuuucaaaaa

SEQ ID NO: 4089192 - RNA, 22 nt, Streptococcus pneumoniae R6
auagauucaacgaacuauaaaa

SEQ ID NO: 4089193 - RNA, 15 nt, Streptococcus pneumoniae R6
auagcagaaaaauga

SEQ ID NO: 4089194 - RNA, 18 nt, Streptococcus pneumoniae R6
auagcagagacauuagaa

SEQ ID NO: 4089195 - RNA, 21 nt, Streptococcus pneumoniae R6
auagcagagacauuagaaauu

SEQ ID NO: 4089196 - RNA, 22 nt, Streptococcus pneumoniae R6
auagcaguaguuggcuugucuu

SEQ ID NO: 4089197 - RNA, 23 nt, Streptococcus pneumoniae R6
auagcaguaguuggcuugucuuu

SEQ ID NO: 4089198 - RNA, 16 nt, Streptococcus pneumoniae R6
auagcauagaugacaa

SEQ ID NO: 4089199 - RNA, 14 nt, Streptococcus pneumoniae R6
auagcauauuuuua

SEQ ID NO: 4089200 - RNA, 18 nt, Streptococcus pneumoniae R6
auagcauauuuuuagugg

SEQ ID NO: 4089201 - RNA, 16 nt, Streptococcus pneumoniae R6
auagcauucuucucag

SEQ ID NO: 4089202 - RNA, 15 nt, Streptococcus pneumoniae R6
auagcauuuggaaga

SEQ ID NO: 4089203 - RNA, 20 nt, Streptococcus pneumoniae R6
auagccaaaaaggaagcccu

SEQ ID NO: 4089204 - RNA, 14 nt, Streptococcus pneumoniae R6
auagccaucucuac

SEQ ID NO: 4089205 - RNA, 22 nt, Streptococcus pneumoniae R6
auagcccguuggcuaaagauaa

SEQ ID NO: 4089206 - RNA, 14 nt, Streptococcus pneumoniae R6
auagcgauagaugu

SEQ ID NO: 4089207 - RNA, 22 nt, Streptococcus pneumoniae R6
auagcggcuuguccguuuucau

SEQ ID NO: 4089208 - RNA, 19 nt, Streptococcus pneumoniae R6
auagcgugcccaaaaauua

SEQ ID NO: 4089209 - RNA, 14 nt, Streptococcus pneumoniae R6
auagcguuuugaaa

SEQ ID NO: 4089210 - RNA, 21 nt, Streptococcus pneumoniae R6
auagcuaaaccuuauuuuuua

SEQ ID NO: 4089211 - RNA, 14 nt, Streptococcus pneumoniae R6
auagcuacagucau

SEQ ID NO: 4089212 - RNA, 22 nt, Streptococcus pneumoniae R6
auagcuacagucauuguucuug

SEQ ID NO: 4089213 - RNA, 14 nt, Streptococcus pneumoniae R6
auagcucaaaagcu

SEQ ID NO: 4089214 - RNA, 23 nt, Streptococcus pneumoniae R6
auagcucaaaaguuuaucuagaa

SEQ ID NO: 4089215 - RNA, 21 nt, Streptococcus pneumoniae R6
auagcuccaucuccaacugcu

SEQ ID NO: 4089216 - RNA, 22 nt, Streptococcus pneumoniae R6
auagcuccaucuccaacugcug

SEQ ID NO: 4089217 - RNA, 22 nt, Streptococcus pneumoniae R6
auagcucgggggauuaauuuuc

SEQ ID NO: 4089218 - RNA, 15 nt, Streptococcus pneumoniae R6
auagcugcagcugag

SEQ ID NO: 4089219 - RNA, 22 nt, Streptococcus pneumoniae R6
auagcugcggcuuucuucacau

SEQ ID NO: 4089220 - RNA, 20 nt, Streptococcus pneumoniae R6
auagcuuuugcagcaccagu

SEQ ID NO: 4089221 - RNA, 21 nt, Streptococcus pneumoniae R6
auagcuuuugugauaaaggcc

SEQ ID NO: 4089222 - RNA, 14 nt, Streptococcus pneumoniae R6
auagcuuuuuauau

SEQ ID NO: 4089223 - RNA, 15 nt, Streptococcus pneumoniae R6
auaggauauugacaa

SEQ ID NO: 4089224 - RNA, 20 nt, Streptococcus pneumoniae R6
auaggaugccuuuuuaugau

SEQ ID NO: 4089225 - RNA, 16 nt, Streptococcus pneumoniae R6
auaggauuuauuuuuc

SEQ ID NO: 4089226 - RNA, 23 nt, Streptococcus pneumoniae R6
auaggauuuauuuuucuuuuuca

SEQ ID NO: 4089227 - RNA, 17 nt, Streptococcus pneumoniae R6
auaggcagcuuguucuu

SEQ ID NO: 4089228 - RNA, 22 nt, Streptococcus pneumoniae R6
auaggcucuuugucaacuguag

SEQ ID NO: 4089229 - RNA, 13 nt, Streptococcus pneumoniae R6
auagggcuuuuuu

SEQ ID NO: 4089230 - RNA, 23 nt, Streptococcus pneumoniae R6
auagguaaaaucuuaaaaaggga

SEQ ID NO: 4089231 - RNA, 15 nt, Streptococcus pneumoniae R6
auaggugggugggua

SEQ ID NO: 4089232 - RNA, 21 nt, Streptococcus pneumoniae R6
auagguggguggguauaaaag

SEQ ID NO: 4089233 - RNA, 12 nt, Streptococcus pneumoniae R6
auagguugcaaa

SEQ ID NO: 4089234 - RNA, 22 nt, Streptococcus pneumoniae R6
auagguuguugaaaauauuuua

SEQ ID NO: 4089235 - RNA, 13 nt, Streptococcus pneumoniae R6
auagguuuugcua

SEQ ID NO: 4089236 - RNA, 14 nt, Streptococcus pneumoniae R6
auaguaaacuucuu

SEQ ID NO: 4089237 - RNA, 15 nt, Streptococcus pneumoniae R6
auaguaaacuucuuc

SEQ ID NO: 4089238 - RNA, 21 nt, Streptococcus pneumoniae R6
auaguaaacuucuucuuccau

SEQ ID NO: 4089239 - RNA, 17 nt, Streptococcus pneumoniae R6
auaguaaaggacaccag

SEQ ID NO: 4089240 - RNA, 23 nt, Streptococcus pneumoniae R6
auaguaacgagucaaaaaaggag

SEQ ID NO: 4089241 - RNA, 15 nt, Streptococcus pneumoniae R6
auaguacaauaccuu

SEQ ID NO: 4089242 - RNA, 16 nt, Streptococcus pneumoniae R6
auaguacacaucuacu

SEQ ID NO: 4089243 - RNA, 14 nt, Streptococcus pneumoniae R6
auaguacacuucua

SEQ ID NO: 4089244 - RNA, 16 nt, Streptococcus pneumoniae R6
auaguagauugaaaua

SEQ ID NO: 4089245 - RNA, 13 nt, Streptococcus pneumoniae R6
auaguagccuuga

SEQ ID NO: 4089246 - RNA, 16 nt, Streptococcus pneumoniae R6
auaguagccuugacca

SEQ ID NO: 4089247 - RNA, 23 nt, Streptococcus pneumoniae R6
auaguagguugcaguugaaauaa

SEQ ID NO: 4089248 - RNA, 19 nt, Streptococcus pneumoniae R6
auaguauaagguaauuuuc

SEQ ID NO: 4089249 - RNA, 14 nt, Streptococcus pneumoniae R6
auaguaucaaauga

SEQ ID NO: 4089250 - RNA, 16 nt, Streptococcus pneumoniae R6
auaguaucaaaugacu

SEQ ID NO: 4089251 - RNA, 15 nt, Streptococcus pneumoniae R6
auaguaucagguguu

SEQ ID NO: 4089252 - RNA, 18 nt, Streptococcus pneumoniae R6
auaguaucccauucuuca

SEQ ID NO: 4089253 - RNA, 20 nt, Streptococcus pneumoniae R6
auaguaucugaugcugacaa

SEQ ID NO: 4089254 - RNA, 17 nt, Streptococcus pneumoniae R6
auagucaauugaaacaa

SEQ ID NO: 4089255 - RNA, 20 nt, Streptococcus pneumoniae R6
auaguccagauaguggguuu

SEQ ID NO: 4089256 - RNA, 15 nt, Streptococcus pneumoniae R6
auagucccuuuauaa

SEQ ID NO: 4089257 - RNA, 19 nt, Streptococcus pneumoniae R6
auagucuacaauuucucgu

SEQ ID NO: 4089258 - RNA, 15 nt, Streptococcus pneumoniae R6
auagucuauaauggc

SEQ ID NO: 4089259 - RNA, 13 nt, Streptococcus pneumoniae R6
auagucuuuucac

SEQ ID NO: 4089260 - RNA, 16 nt, Streptococcus pneumoniae R6
auagugaauugaaaua

SEQ ID NO: 4089261 - RNA, 15 nt, Streptococcus pneumoniae R6
auagugacuuuaugu

SEQ ID NO: 4089262 - RNA, 14 nt, Streptococcus pneumoniae R6
auagugagauuuuu

SEQ ID NO: 4089263 - RNA, 18 nt, Streptococcus pneumoniae R6
auagugagauuuuuugau

SEQ ID NO: 4089264 - RNA, 21 nt, Streptococcus pneumoniae R6
auagugauuggagauacuuuu

SEQ ID NO: 4089265 - RNA, 18 nt, Streptococcus pneumoniae R6
auagugugggacuccuac

SEQ ID NO: 4089266 - RNA, 13 nt, Streptococcus pneumoniae R6
auaguuaaaaaag

SEQ ID NO: 4089267 - RNA, 22 nt, Streptococcus pneumoniae R6
auaguuaaaaaagauuugaaac

SEQ ID NO: 4089268 - RNA, 20 nt, Streptococcus pneumoniae R6
auaguuaggcauauaauggu

SEQ ID NO: 4089269 - RNA, 16 nt, Streptococcus pneumoniae R6
auaguuauagaguguu

SEQ ID NO: 4089270 - RNA, 13 nt, Streptococcus pneumoniae R6
auaguucuuccaa

SEQ ID NO: 4089271 - RNA, 20 nt, Streptococcus pneumoniae R6
auaguucuuccaauuucuuu

SEQ ID NO: 4089272 - RNA, 15 nt, Streptococcus pneumoniae R6
auaguugaaaucaag

SEQ ID NO: 4089273 - RNA, 15 nt, Streptococcus pneumoniae R6
auaguugcauuaaaa

SEQ ID NO: 4089274 - RNA, 16 nt, Streptococcus pneumoniae R6
auaguugcauuaaaau

SEQ ID NO: 4089275 - RNA, 14 nt, Streptococcus pneumoniae R6
auaguuuaaaacau

SEQ ID NO: 4089276 - RNA, 22 nt, Streptococcus pneumoniae R6
auaguuuaaguaguaaccaccu

SEQ ID NO: 4089277 - RNA, 14 nt, Streptococcus pneumoniae R6
auaguuucauaacu

SEQ ID NO: 4089278 - RNA, 19 nt, Streptococcus pneumoniae R6
auaguuucauaacuacagu

SEQ ID NO: 4089279 - RNA, 20 nt, Streptococcus pneumoniae R6
auaguuucauaacuacagua

SEQ ID NO: 4089280 - RNA, 15 nt, Streptococcus pneumoniae R6
auaguuugucuuuca

SEQ ID NO: 4089281 - RNA, 13 nt, Streptococcus pneumoniae R6
auaguuuucacua

SEQ ID NO: 4089282 - RNA, 23 nt, Streptococcus pneumoniae R6
auaguuuucacuauugaugaacu

SEQ ID NO: 4089283 - RNA, 23 nt, Streptococcus pneumoniae R6
auaguuuugauuauuuuuuaaca

SEQ ID NO: 4089284 - RNA, 13 nt, Streptococcus pneumoniae R6
auaguuuuucccg

SEQ ID NO: 4089285 - RNA, 12 nt, Streptococcus pneumoniae R6
auauaaaaagac

SEQ ID NO: 4089286 - RNA, 13 nt, Streptococcus pneumoniae R6
auauaaaaagacc

SEQ ID NO: 4089287 - RNA, 16 nt, Streptococcus pneumoniae R6
auauaagaagcauaga

SEQ ID NO: 4089288 - RNA, 20 nt, Streptococcus pneumoniae R6
auauaagauuuaacuuuuuu

SEQ ID NO: 4089289 - RNA, 23 nt, Streptococcus pneumoniae R6
auaugucuagccaguauuuuuag

SEQ ID NO: 4089290 - RNA, 19 nt, Streptococcus pneumoniae R6
auauuaagaaucuuuucua

SEQ ID NO: 4089291 - RNA, 21 nt, Streptococcus pneumoniae R6
auauuaagaaucuuuucuauu

SEQ ID NO: 4089292 - RNA, 19 nt, Streptococcus pneumoniae R6
auauuaccaaguuaaacaa

SEQ ID NO: 4089293 - RNA, 18 nt, Streptococcus pneumoniae R6
auauuagaugauuuuucu

SEQ ID NO: 4089294 - RNA, 16 nt, Streptococcus pneumoniae R6
auauuagggcaaauaa

SEQ ID NO: 4089295 - RNA, 20 nt, Streptococcus pneumoniae R6
auauuagggcaaauaaaaag

SEQ ID NO: 4089296 - RNA, 17 nt, Streptococcus pneumoniae R6
auauuaugcguuuuuca

SEQ ID NO: 4089297 - RNA, 20 nt, Streptococcus pneumoniae R6
auauuaugcguuuuucagau

SEQ ID NO: 4089298 - RNA, 21 nt, Streptococcus pneumoniae R6
auauuaugcguuuuuucugau

SEQ ID NO: 4089299 - RNA, 23 nt, Streptococcus pneumoniae R6
auauuaugcguuuuuucugauuu

SEQ ID NO: 4089300 - RNA, 19 nt, Streptococcus pneumoniae R6
auauucaacgaaaauaauu

SEQ ID NO: 4089301 - RNA, 22 nt, Streptococcus pneumoniae R6
auauucaaucgcuauuaucguu

SEQ ID NO: 4089302 - RNA, 22 nt, Streptococcus pneumoniae R6
auauucaccacaugacauuauu

SEQ ID NO: 4089303 - RNA, 18 nt, Streptococcus pneumoniae R6
auauucagagcgauaaaa

SEQ ID NO: 4089304 - RNA, 19 nt, Streptococcus pneumoniae R6
auauucagagcgauaaaaa

SEQ ID NO: 4089305 - RNA, 20 nt, Streptococcus pneumoniae R6
auauucuaacuuauuuuaac

SEQ ID NO: 4089306 - RNA, 22 nt, Streptococcus pneumoniae R6
auauucucuagaaaucucuuuu

SEQ ID NO: 4089307 - RNA, 19 nt, Streptococcus pneumoniae R6
auauucuuaucaaaucccu

SEQ ID NO: 4089308 - RNA, 14 nt, Streptococcus pneumoniae R6
auauugaaaauuuc

SEQ ID NO: 4089309 - RNA, 19 nt, Streptococcus pneumoniae R6
auauugaaacuagaauaau

SEQ ID NO: 4089310 - RNA, 15 nt, Streptococcus pneumoniae R6
auauugaaaugaaau

SEQ ID NO: 4089311 - RNA, 17 nt, Streptococcus pneumoniae R6
auauugaaaugaaauaa

SEQ ID NO: 4089312 - RNA, 22 nt, Streptococcus pneumoniae R6
auauugaaaugaaauaaaauuu

SEQ ID NO: 4089313 - RNA, 16 nt, Streptococcus pneumoniae R6
auauugaguaauuccc

SEQ ID NO: 4089314 - RNA, 15 nt, Streptococcus pneumoniae R6
auauugauauuuaua

SEQ ID NO: 4089315 - RNA, 14 nt, Streptococcus pneumoniae R6
auauugcaagagaa

SEQ ID NO: 4089316 - RNA, 15 nt, Streptococcus pneumoniae R6
auauugcaagagaaa

SEQ ID NO: 4089317 - RNA, 12 nt, Streptococcus pneumoniae R6
auauuguuuuaa

SEQ ID NO: 4089318 - RNA, 18 nt, Streptococcus pneumoniae R6
auauuuacgaauuauuuc

SEQ ID NO: 4089319 - RNA, 20 nt, Streptococcus pneumoniae R6
auauuuacgaauuauuuccu

SEQ ID NO: 4089320 - RNA, 12 nt, Streptococcus pneumoniae R6
auauuuacuaau

SEQ ID NO: 4089321 - RNA, 22 nt, Streptococcus pneumoniae R6
auauuuaggggucaugacuagu

SEQ ID NO: 4089322 - RNA, 19 nt, Streptococcus pneumoniae R6
auauuuaguacucuguaaa

SEQ ID NO: 4089323 - RNA, 15 nt, Streptococcus pneumoniae R6
auauuuauagaauuu

SEQ ID NO: 4089324 - RNA, 21 nt, Streptococcus pneumoniae R6
auauuuauuaauuucauuacu

SEQ ID NO: 4089325 - RNA, 14 nt, Streptococcus pneumoniae R6
auauuuauuauaaa

SEQ ID NO: 4089326 - RNA, 16 nt, Streptococcus pneumoniae R6
auauuucaagaauuaa

SEQ ID NO: 4089327 - RNA, 15 nt, Streptococcus pneumoniae R6
auauuucccauuuuu

SEQ ID NO: 4089328 - RNA, 17 nt, Streptococcus pneumoniae R6
auauuucuaugauaaaa

SEQ ID NO: 4089329 - RNA, 11 nt, Streptococcus pneumoniae R6
auauuucucca

SEQ ID NO: 4089330 - RNA, 20 nt, Streptococcus pneumoniae R6
auauuucuuaauuguagcuu

SEQ ID NO: 4089331 - RNA, 15 nt, Streptococcus pneumoniae R6
auauuucuucuuuuc

SEQ ID NO: 4089332 - RNA, 18 nt, Streptococcus pneumoniae R6
auauuuggcauauuuuua

SEQ ID NO: 4089333 - RNA, 14 nt, Streptococcus pneumoniae R6
auauuuuagaagca

SEQ ID NO: 4089334 - RNA, 14 nt, Streptococcus pneumoniae R6
auauuuuagcaguc

SEQ ID NO: 4089335 - RNA, 15 nt, Streptococcus pneumoniae R6
auauuuucaaaaaaa

SEQ ID NO: 4089336 - RNA, 16 nt, Streptococcus pneumoniae R6
auauuuucaaaaaaau

SEQ ID NO: 4089337 - RNA, 23 nt, Streptococcus pneumoniae R6
auauuuucaaaacugguccagag

SEQ ID NO: 4089338 - RNA, 16 nt, Streptococcus pneumoniae R6
auauuuucugggaaga

SEQ ID NO: 4089339 - RNA, 23 nt, Streptococcus pneumoniae R6
auauuuucugggaagacugucaa

SEQ ID NO: 4089340 - RNA, 19 nt, Streptococcus pneumoniae R6
auauuuuuccuucaucaaa

SEQ ID NO: 4089341 - RNA, 16 nt, Streptococcus pneumoniae R6
auauuuuuuacuuuug

SEQ ID NO: 4089342 - RNA, 22 nt, Streptococcus pneumoniae R6
auauuuuuucguaguugguuac

SEQ ID NO: 4089343 - RNA, 15 nt, Streptococcus pneumoniae R6
aucaaaaaaagaagu

SEQ ID NO: 4089344 - RNA, 16 nt, Streptococcus pneumoniae R6
aucaaaaaaucucacu

SEQ ID NO: 4089345 - RNA, 21 nt, Streptococcus pneumoniae R6
aucaaaaaccgcucagcugag

SEQ ID NO: 4089346 - RNA, 16 nt, Streptococcus pneumoniae R6
aucaaaaauagaaaua

SEQ ID NO: 4089347 - RNA, 22 nt, Streptococcus pneumoniae R6
aucaaaaccaguccuugaaaaa

SEQ ID NO: 4089348 - RNA, 18 nt, Streptococcus pneumoniae R6
aucaaaacuauaaaugau

SEQ ID NO: 4089349 - RNA, 12 nt, Streptococcus pneumoniae R6
aucaaaagaugu

SEQ ID NO: 4089350 - RNA, 17 nt, Streptococcus pneumoniae R6
aucaaaagauguuagaa

SEQ ID NO: 4089351 - RNA, 23 nt, Streptococcus pneumoniae R6
aucaaaagauguuagaaaaaguu

SEQ ID NO: 4089352 - RNA, 14 nt, Streptococcus pneumoniae R6
aucaaaauaaagca

SEQ ID NO: 4089353 - RNA, 15 nt, Streptococcus pneumoniae R6
aucaaaauauagcaa

SEQ ID NO: 4089354 - RNA, 18 nt, Streptococcus pneumoniae R6
aucaaaauauagcaauaa

SEQ ID NO: 4089355 - RNA, 14 nt, Streptococcus pneumoniae R6
aucaaaaucaauga

SEQ ID NO: 4089356 - RNA, 18 nt, Streptococcus pneumoniae R6
aucaaaaucgauagccaa

SEQ ID NO: 4089357 - RNA, 17 nt, Streptococcus pneumoniae R6
aucaaagccaccauccu

SEQ ID NO: 4089358 - RNA, 17 nt, Streptococcus pneumoniae R6
aucaaaggucucuucuu

SEQ ID NO: 4089359 - RNA, 18 nt, Streptococcus pneumoniae R6
aucaaaguagcucuuuug

SEQ ID NO: 4089360 - RNA, 17 nt, Streptococcus pneumoniae R6
aucaaagugcaaacuag

SEQ ID NO: 4089361 - RNA, 23 nt, Streptococcus pneumoniae R6
aucaaaguuuacgacacauucua

SEQ ID NO: 4089362 - RNA, 12 nt, Streptococcus pneumoniae R6
aucaaaucaaua

SEQ ID NO: 4089363 - RNA, 19 nt, Streptococcus pneumoniae R6
aucaaaucgauaaagaaga

SEQ ID NO: 4089364 - RNA, 22 nt, Streptococcus pneumoniae R6
aucaaaucgaucuguucuucua

SEQ ID NO: 4089365 - RNA, 22 nt, Streptococcus pneumoniae R6
aucaaaugacuaagcccaaaga

SEQ ID NO: 4089366 - RNA, 23 nt, Streptococcus pneumoniae R6
aucaaaugucuuggcagaaaggu

SEQ ID NO: 4089367 - RNA, 14 nt, Streptococcus pneumoniae R6
aucaaauugaaaua

SEQ ID NO: 4089368 - RNA, 15 nt, Streptococcus pneumoniae R6
aucaaauugaaauaa

SEQ ID NO: 4089369 - RNA, 20 nt, Streptococcus pneumoniae R6
aucaaauuuuauccaacuga

SEQ ID NO: 4089370 - RNA, 21 nt, Streptococcus pneumoniae R6
aucaacagcuccauaacaaua

SEQ ID NO: 4089371 - RNA, 15 nt, Streptococcus pneumoniae R6
aucaaccgugcaguc

SEQ ID NO: 4089372 - RNA, 14 nt, Streptococcus pneumoniae R6
aucaaccucacuua

SEQ ID NO: 4089373 - RNA, 14 nt, Streptococcus pneumoniae R6
aucaaccuuucuca

SEQ ID NO: 4089374 - RNA, 23 nt, Streptococcus pneumoniae R6
aucaaccuuucucagauaauaau

SEQ ID NO: 4089375 - RNA, 23 nt, Streptococcus pneumoniae R6
aucaacgcuacgacguuuaucaa

SEQ ID NO: 4089376 - RNA, 16 nt, Streptococcus pneumoniae R6
aucaacugcuguuuuc

SEQ ID NO: 4089377 - RNA, 19 nt, Streptococcus pneumoniae R6
aucaacugcuguuuucaug

SEQ ID NO: 4089378 - RNA, 21 nt, Streptococcus pneumoniae R6
aucaacugcuguuuucauguu

SEQ ID NO: 4089379 - RNA, 18 nt, Streptococcus pneumoniae R6
aucaagaacaauuucaca

SEQ ID NO: 4089380 - RNA, 20 nt, Streptococcus pneumoniae R6
aucaagagucuccucaaaaa

SEQ ID NO: 4089381 - RNA, 14 nt, Streptococcus pneumoniae R6
aucaagauagcugu

SEQ ID NO: 4089382 - RNA, 19 nt, Streptococcus pneumoniae R6
aucaagaugagacuugcaa

SEQ ID NO: 4089383 - RNA, 21 nt, Streptococcus pneumoniae R6
aucaagcguuuuucuucugua

SEQ ID NO: 4089384 - RNA, 18 nt, Streptococcus pneumoniae R6
aucaagcucaucuaaugu

SEQ ID NO: 4089385 - RNA, 21 nt, Streptococcus pneumoniae R6
aucaagcuggcuacagaugcu

SEQ ID NO: 4089386 - RNA, 14 nt, Streptococcus pneumoniae R6
aucaagcuuucacu

SEQ ID NO: 4089387 - RNA, 15 nt, Streptococcus pneumoniae R6
aucaagcuuucacua

SEQ ID NO: 4089388 - RNA, 21 nt, Streptococcus pneumoniae R6
aucaaggauuuuuugaacugc

SEQ ID NO: 4089389 - RNA, 15 nt, Streptococcus pneumoniae R6
aucaagguuuuagaa

SEQ ID NO: 4089390 - RNA, 17 nt, Streptococcus pneumoniae R6
aucaagguuuuucugua

SEQ ID NO: 4089391 - RNA, 17 nt, Streptococcus pneumoniae R6
accucauuggaaaagau

SEQ ID NO: 4089392 - RNA, 20 nt, Streptococcus pneumoniae R6
accuccaccuugaucuucca

SEQ ID NO: 4089393 - RNA, 16 nt, Streptococcus pneumoniae R6
accucuacaauaacac

SEQ ID NO: 4089394 - RNA, 16 nt, Streptococcus pneumoniae R6
accucuuucuuucuca

SEQ ID NO: 4089395 - RNA, 20 nt, Streptococcus pneumoniae R6
accucuuucuuucucacuua

SEQ ID NO: 4089396 - RNA, 13 nt, Streptococcus pneumoniae R6
accugaaaccauu

SEQ ID NO: 4089397 - RNA, 15 nt, Streptococcus pneumoniae R6
accugaaucuccuca

SEQ ID NO: 4089398 - RNA, 14 nt, Streptococcus pneumoniae R6
accugcaacaauac

SEQ ID NO: 4089399 - RNA, 19 nt, Streptococcus pneumoniae R6
accugcacauugguucuuu

SEQ ID NO: 4089400 - RNA, 15 nt, Streptococcus pneumoniae R6
accugcaguucccac

SEQ ID NO: 4089401 - RNA, 19 nt, Streptococcus pneumoniae R6
accugccuuccaagauaau

SEQ ID NO: 4089402 - RNA, 16 nt, Streptococcus pneumoniae R6
accugcggauaaaaga

SEQ ID NO: 4089403 - RNA, 21 nt, Streptococcus pneumoniae R6
accugcuaccguugaaaucaa

SEQ ID NO: 4089404 - RNA, 15 nt, Streptococcus pneumoniae R6
accuguaauuugguu

SEQ ID NO: 4089405 - RNA, 17 nt, Streptococcus pneumoniae R6
accuguaccuaauuuuu

SEQ ID NO: 4089406 - RNA, 14 nt, Streptococcus pneumoniae R6
accuguccaacaga

SEQ ID NO: 4089407 - RNA, 22 nt, Streptococcus pneumoniae R6
accuuaaaacaguguuuugagc

SEQ ID NO: 4089408 - RNA, 23 nt, Streptococcus pneumoniae R6
accuuaaaaugaaauuccucuag

SEQ ID NO: 4089409 - RNA, 22 nt, Streptococcus pneumoniae R6
accuuaaacuuguaagucaagu

SEQ ID NO: 4089410 - RNA, 21 nt, Streptococcus pneumoniae R6
accuuaaucuuggcaaaacgu

SEQ ID NO: 4089411 - RNA, 21 nt, Streptococcus pneumoniae R6
accuuacucuacagauuucag

SEQ ID NO: 4089412 - RNA, 22 nt, Streptococcus pneumoniae R6
accuuaucacgaauuucuuguu

SEQ ID NO: 4089413 - RNA, 18 nt, Streptococcus pneumoniae R6
accuuauccaauucuuca

SEQ ID NO: 4089414 - RNA, 19 nt, Streptococcus pneumoniae R6
accuucaauuccuucugga

SEQ ID NO: 4089415 - RNA, 17 nt, Streptococcus pneumoniae R6
accuucaggagauaaaa

SEQ ID NO: 4089416 - RNA, 14 nt, Streptococcus pneumoniae R6
accuugaauuuugu

SEQ ID NO: 4089417 - RNA, 14 nt, Streptococcus pneumoniae R6
accuugaucaauca

SEQ ID NO: 4089418 - RNA, 17 nt, Streptococcus pneumoniae R6
accuugaucaaucaugu

SEQ ID NO: 4089419 - RNA, 22 nt, Streptococcus pneumoniae R6
accuugaucggaagcuacagag

SEQ ID NO: 4089420 - RNA, 14 nt, Streptococcus pneumoniae R6
accuugaucuucca

SEQ ID NO: 4089421 - RNA, 21 nt, Streptococcus pneumoniae R6
accuugaucuuccauuucuuu

SEQ ID NO: 4089422 - RNA, 17 nt, Streptococcus pneumoniae R6
accuuggcauccaguaa

SEQ ID NO: 4089423 - RNA, 23 nt, Streptococcus pneumoniae R6
accuugguaguggagaguucacg

SEQ ID NO: 4089424 - RNA, 14 nt, Streptococcus pneumoniae R6
accuugguggcuac

SEQ ID NO: 4089425 - RNA, 20 nt, Streptococcus pneumoniae R6
accuuguccgcauagccaaa

SEQ ID NO: 4089426 - RNA, 15 nt, Streptococcus pneumoniae R6
accuuuauuauuaau

SEQ ID NO: 4089427 - RNA, 13 nt, Streptococcus pneumoniae R6
accuuucucagau

SEQ ID NO: 4089428 - RNA, 16 nt, Streptococcus pneumoniae R6
accuuucucagauaau

SEQ ID NO: 4089429 - RNA, 20 nt, Streptococcus pneumoniae R6
accuuugaaaacugaacaag

SEQ ID NO: 4089430 - RNA, 21 nt, Streptococcus pneumoniae R6
accuuuguauggaaacucaaa

SEQ ID NO: 4089431 - RNA, 17 nt, Streptococcus pneumoniae R6
accuuuuccuucauuuc

SEQ ID NO: 4089432 - RNA, 16 nt, Streptococcus pneumoniae R6
accuuuucucaauacu

SEQ ID NO: 4089433 - RNA, 21 nt, Streptococcus pneumoniae R6
accuuuuugcgcaauuugacg

SEQ ID NO: 4089434 - RNA, 22 nt, Streptococcus pneumoniae R6
acgaaaaguagggcgauaaaau

SEQ ID NO: 4089435 - RNA, 15 nt, Streptococcus pneumoniae R6
acgaaacaauugcua

SEQ ID NO: 4089436 - RNA, 12 nt, Streptococcus pneumoniae R6
acgaaaccaguc

SEQ ID NO: 4089437 - RNA, 19 nt, Streptococcus pneumoniae R6
acgaaacgaagaaggaaga

SEQ ID NO: 4089438 - RNA, 23 nt, Streptococcus pneumoniae R6
acgaaacgaagaaggaagaguca

SEQ ID NO: 4089439 - RNA, 12 nt, Streptococcus pneumoniae R6
acgaaaggauua

SEQ ID NO: 4089440 - RNA, 19 nt, Streptococcus pneumoniae R6
acgaaaggauuauaaaagc

SEQ ID NO: 4089441 - RNA, 11 nt, Streptococcus pneumoniae R6
acgaacaaaaa

SEQ ID NO: 4089442 - RNA, 16 nt, Streptococcus pneumoniae R6
acgaacaaaaagugau

SEQ ID NO: 4089443 - RNA, 21 nt, Streptococcus pneumoniae R6
acgaacgccuuaaaaaaccaa

SEQ ID NO: 4089444 - RNA, 22 nt, Streptococcus pneumoniae R6
acgaacugcgacguuuucuccu

SEQ ID NO: 4089445 - RNA, 23 nt, Streptococcus pneumoniae R6
acgaacugcgacguuuucuccuu

SEQ ID NO: 4089446 - RNA, 18 nt, Streptococcus pneumoniae R6
acgaagaaggaagaguca

SEQ ID NO: 4089447 - RNA, 15 nt, Streptococcus pneumoniae R6
acgaagcugacauga

SEQ ID NO: 4089448 - RNA, 13 nt, Streptococcus pneumoniae R6
acgaaggacaucu

SEQ ID NO: 4089449 - RNA, 23 nt, Streptococcus pneumoniae R6
acgaaguccuuguuugagcucuu

SEQ ID NO: 4089450 - RNA, 16 nt, Streptococcus pneumoniae R6
acgaaucucuuuccac

SEQ ID NO: 4089451 - RNA, 18 nt, Streptococcus pneumoniae R6
acgaauuagguugaccau

SEQ ID NO: 4089452 - RNA, 15 nt, Streptococcus pneumoniae R6
acgacagaagaagug

SEQ ID NO: 4089453 - RNA, 19 nt, Streptococcus pneumoniae R6
acgacauagucaaagaguu

SEQ ID NO: 4089454 - RNA, 18 nt, Streptococcus pneumoniae R6
acgacaugcguuaaaagu

SEQ ID NO: 4089455 - RNA, 20 nt, Streptococcus pneumoniae R6
acgaccaaucuuuuccaacu

SEQ ID NO: 4089456 - RNA, 12 nt, Streptococcus pneumoniae R6
acgacgauuccg

SEQ ID NO: 4089457 - RNA, 18 nt, Streptococcus pneumoniae R6
acgacgggcuaauugaca

SEQ ID NO: 4089458 - RNA, 15 nt, Streptococcus pneumoniae R6
acgacuaauuucaaa

SEQ ID NO: 4089459 - RNA, 23 nt, Streptococcus pneumoniae R6
acgacuuucugauggauuuauag

SEQ ID NO: 4089460 - RNA, 17 nt, Streptococcus pneumoniae R6
acgagaaacaauaaaau

SEQ ID NO: 4089461 - RNA, 17 nt, Streptococcus pneumoniae R6
acgagucaagucaacuu

SEQ ID NO: 4089462 - RNA, 14 nt, Streptococcus pneumoniae R6
acgagugaagaauu

SEQ ID NO: 4089463 - RNA, 15 nt, Streptococcus pneumoniae R6
acgagugaagaauug

SEQ ID NO: 4089464 - RNA, 13 nt, Streptococcus pneumoniae R6
acgaguuaaaaca

SEQ ID NO: 4089465 - RNA, 15 nt, Streptococcus pneumoniae R6
acgaguuaaaacaaa

SEQ ID NO: 4089466 - RNA, 19 nt, Streptococcus pneumoniae R6
acgaguuaaaacaaagaaa

SEQ ID NO: 4089467 - RNA, 20 nt, Streptococcus pneumoniae R6
acgaguuaaaacaaagaaaa

SEQ ID NO: 4089468 - RNA, 13 nt, Streptococcus pneumoniae R6
acgauaaauuccc

SEQ ID NO: 4089469 - RNA, 15 nt, Streptococcus pneumoniae R6
acgauagauccuuca

SEQ ID NO: 4089470 - RNA, 15 nt, Streptococcus pneumoniae R6
acgauaucugaagau

SEQ ID NO: 4089471 - RNA, 22 nt, Streptococcus pneumoniae R6
acgaugacaagguguguugcuu

SEQ ID NO: 4089472 - RNA, 22 nt, Streptococcus pneumoniae R6
acgaugaccguugacuuccuua

SEQ ID NO: 4089473 - RNA, 16 nt, Streptococcus pneumoniae R6
acgauguuugcagcac

SEQ ID NO: 4089474 - RNA, 20 nt, Streptococcus pneumoniae R6
acgauuaaaaguaagagaaa

SEQ ID NO: 4089475 - RNA, 21 nt, Streptococcus pneumoniae R6
acgauuaaaaguaagagaaac

SEQ ID NO: 4089476 - RNA, 17 nt, Streptococcus pneumoniae R6
acgauucaucaagagac

SEQ ID NO: 4089477 - RNA, 15 nt, Streptococcus pneumoniae R6
acgauuccaaacaac

SEQ ID NO: 4089478 - RNA, 18 nt, Streptococcus pneumoniae R6
acgauuccguuugagaag

SEQ ID NO: 4089479 - RNA, 22 nt, Streptococcus pneumoniae R6
acgauuuucucuuuguccuuua

SEQ ID NO: 4089480 - RNA, 14 nt, Streptococcus pneumoniae R6
acgauuuuuucuuu

SEQ ID NO: 4089481 - RNA, 19 nt, Streptococcus pneumoniae R6
acgauuuuuuucaaacaau

SEQ ID NO: 4089482 - RNA, 22 nt, Streptococcus pneumoniae R6
acgcagagguggaaugauaaca

SEQ ID NO: 4089483 - RNA, 19 nt, Streptococcus pneumoniae R6
acgcauaagcaauuuuuua

SEQ ID NO: 4089484 - RNA, 22 nt, Streptococcus pneumoniae R6
acgcauaguaucagguauugaa

SEQ ID NO: 4089485 - RNA, 20 nt, Streptococcus pneumoniae R6
acgcauaguugcauuaaaau

SEQ ID NO: 4089486 - RNA, 19 nt, Streptococcus pneumoniae R6
acgcaucauaucaagguuu

SEQ ID NO: 4089487 - RNA, 18 nt, Streptococcus pneumoniae R6
acgcaugucguucaaggu

SEQ ID NO: 4089488 - RNA, 17 nt, Streptococcus pneumoniae R6
acgccuuaaaaaaccaa

SEQ ID NO: 4089489 - RNA, 21 nt, Streptococcus pneumoniae R6
acgcgauacaauaaagguguu

SEQ ID NO: 4089490 - RNA, 17 nt, Streptococcus pneumoniae R6
acgcgcccaaguuaaaa

SEQ ID NO: 4089491 - RNA, 15 nt, Streptococcus pneumoniae R6
acgcggauugaagag

SEQ ID NO: 4089492 - RNA, 15 nt, Streptococcus pneumoniae R6
acgcgguuugaagag

SEQ ID NO: 4089493 - RNA, 23 nt, Streptococcus pneumoniae R6
acgcuacgacguuuaucaauaau

SEQ ID NO: 4089494 - RNA, 19 nt, Streptococcus pneumoniae R6
acgcucgguuucaacugau

SEQ ID NO: 4089495 - RNA, 15 nt, Streptococcus pneumoniae R6
acgcugacgugguuu

SEQ ID NO: 4089496 - RNA, 23 nt, Streptococcus pneumoniae R6
acgcugacgugguuugcagagau

SEQ ID NO: 4089497 - RNA, 17 nt, Streptococcus pneumoniae R6
acgcuggaaauaagaau

SEQ ID NO: 4089498 - RNA, 16 nt, Streptococcus pneumoniae R6
acgcuucccucucaga

SEQ ID NO: 4089499 - RNA, 18 nt, Streptococcus pneumoniae R6
acgcuuuaaaaauccacu

SEQ ID NO: 4089500 - RNA, 22 nt, Streptococcus pneumoniae R6
acggagaacaauauuacguccu

SEQ ID NO: 4089501 - RNA, 20 nt, Streptococcus pneumoniae R6
acggagaggacaaguuaaau

SEQ ID NO: 4089502 - RNA, 12 nt, Streptococcus pneumoniae R6
acggaucugaag

SEQ ID NO: 4089503 - RNA, 14 nt, Streptococcus pneumoniae R6
acggaucuugaacu

SEQ ID NO: 4089504 - RNA, 18 nt, Streptococcus pneumoniae R6
acggcaagacgaagcuga

SEQ ID NO: 4089505 - RNA, 15 nt, Streptococcus pneumoniae R6
acggcaaggcaaagc

SEQ ID NO: 4089506 - RNA, 17 nt, Streptococcus pneumoniae R6
acggcaccuucuacagc

SEQ ID NO: 4089507 - RNA, 13 nt, Streptococcus pneumoniae R6
acggcauaaaauc

SEQ ID NO: 4089508 - RNA, 17 nt, Streptococcus pneumoniae R6
acggcggaaaggcuagg

SEQ ID NO: 4089509 - RNA, 14 nt, Streptococcus pneumoniae R6
acggcuaauaccag

SEQ ID NO: 4089510 - RNA, 18 nt, Streptococcus pneumoniae R6
acggcuuuuaguaaaaau

SEQ ID NO: 4089511 - RNA, 13 nt, Streptococcus pneumoniae R6
acgggagaaaagu

SEQ ID NO: 4089512 - RNA, 15 nt, Streptococcus pneumoniae R6
acgggcaaauuucau

SEQ ID NO: 4089513 - RNA, 22 nt, Streptococcus pneumoniae R6
acggggcuguuuuguugacuug

SEQ ID NO: 4089514 - RNA, 14 nt, Streptococcus pneumoniae R6
acgguaaucaagug

SEQ ID NO: 4089515 - RNA, 15 nt, Streptococcus pneumoniae R6
acggucaccgacaac

SEQ ID NO: 4089516 - RNA, 16 nt, Streptococcus pneumoniae R6
acggugaacuucuuca

SEQ ID NO: 4089517 - RNA, 14 nt, Streptococcus pneumoniae R6
acggugaucuucgc

SEQ ID NO: 4089518 - RNA, 12 nt, Streptococcus pneumoniae R6
acggugguguga

SEQ ID NO: 4089519 - RNA, 17 nt, Streptococcus pneumoniae R6
acgguguuuugagcuga

SEQ ID NO: 4089520 - RNA, 19 nt, Streptococcus pneumoniae R6
acgguguuuugagcugacu

SEQ ID NO: 4089521 - RNA, 21 nt, Streptococcus pneumoniae R6
acgguguuuugagcugacuuc

SEQ ID NO: 4089522 - RNA, 23 nt, Streptococcus pneumoniae R6
acgguugagcauguagucaauca

SEQ ID NO: 4089523 - RNA, 19 nt, Streptococcus pneumoniae R6
acgguuuaccaauuuuucc

SEQ ID NO: 4089524 - RNA, 20 nt, Streptococcus pneumoniae R6
acgguuuaccaauuuuuccu

SEQ ID NO: 4089525 - RNA, 18 nt, Streptococcus pneumoniae R6
acguacaguaucaagguu

SEQ ID NO: 4089526 - RNA, 21 nt, Streptococcus pneumoniae R6
acguaguuuuuuuuguaaucu

SEQ ID NO: 4089527 - RNA, 14 nt, Streptococcus pneumoniae R6
acguaucggaaaua

SEQ ID NO: 4089528 - RNA, 13 nt, Streptococcus pneumoniae R6
acgucaagaacuu

SEQ ID NO: 4089529 - RNA, 21 nt, Streptococcus pneumoniae R6
acgucaagaacuuuaguuuga

SEQ ID NO: 4089530 - RNA, 23 nt, Streptococcus pneumoniae R6
acgucaagaacuuuaguuugagu

SEQ ID NO: 4089531 - RNA, 16 nt, Streptococcus pneumoniae R6
acgucacaaagaacau

SEQ ID NO: 4089532 - RNA, 21 nt, Streptococcus pneumoniae R6
acgucauggccucuaaaucga

SEQ ID NO: 4089533 - RNA, 18 nt, Streptococcus pneumoniae R6
acguccaaggcugaaauu

SEQ ID NO: 4089534 - RNA, 14 nt, Streptococcus pneumoniae R6
acguccaccacaaa

SEQ ID NO: 4089535 - RNA, 15 nt, Streptococcus pneumoniae R6
acguccaccacaaaa

SEQ ID NO: 4089536 - RNA, 19 nt, Streptococcus pneumoniae R6
acguccaccacaaaagaga

SEQ ID NO: 4089537 - RNA, 16 nt, Streptococcus pneumoniae R6
acguccagccuugucu

SEQ ID NO: 4089538 - RNA, 17 nt, Streptococcus pneumoniae R6
acguccgucaagaagag

SEQ ID NO: 4089539 - RNA, 14 nt, Streptococcus pneumoniae R6
acguccuguugcuu

SEQ ID NO: 4089540 - RNA, 14 nt, Streptococcus pneumoniae R6
acgucguaaccaga

SEQ ID NO: 4089541 - RNA, 20 nt, Streptococcus pneumoniae R6
acgucguaaucuuaaaguua

SEQ ID NO: 4089542 - RNA, 20 nt, Streptococcus pneumoniae R6
acgucuucaauaccaaagaa

SEQ ID NO: 4089543 - RNA, 12 nt, Streptococcus pneumoniae R6
acgucuucacgg

SEQ ID NO: 4089544 - RNA, 15 nt, Streptococcus pneumoniae R6
acgucuuuucgucca

SEQ ID NO: 4089545 - RNA, 18 nt, Streptococcus pneumoniae R6
acgucuuuugccuuagca

SEQ ID NO: 4089546 - RNA, 20 nt, Streptococcus pneumoniae R6
acgucuuuugccuuagcaac

SEQ ID NO: 4089547 - RNA, 18 nt, Streptococcus pneumoniae R6
acgugaguagucauacca

SEQ ID NO: 4089548 - RNA, 17 nt, Streptococcus pneumoniae R6
acgugauaaaguuucug

SEQ ID NO: 4089549 - RNA, 18 nt, Streptococcus pneumoniae R6
acgugauaauaaggccua

SEQ ID NO: 4089550 - RNA, 15 nt, Streptococcus pneumoniae R6
acgugcucaaaacac

SEQ ID NO: 4089551 - RNA, 16 nt, Streptococcus pneumoniae R6
acgugcucaaaacacu

SEQ ID NO: 4089552 - RNA, 17 nt, Streptococcus pneumoniae R6
acgugcucaaaacacug

SEQ ID NO: 4089553 - RNA, 22 nt, Streptococcus pneumoniae R6
acgugggaaggugguuugaaaa

SEQ ID NO: 4089554 - RNA, 23 nt, Streptococcus pneumoniae R6
acgugggaaggugguuugaaaau

SEQ ID NO: 4089555 - RNA, 20 nt, Streptococcus pneumoniae R6
acgugguuugaagagauuuu

SEQ ID NO: 4089556 - RNA, 15 nt, Streptococcus pneumoniae R6
acguguaauggcugu

SEQ ID NO: 4089557 - RNA, 15 nt, Streptococcus pneumoniae R6
acguuagcaaagacu

SEQ ID NO: 4089558 - RNA, 22 nt, Streptococcus pneumoniae R6
acguucaaaggcaucaucugaa

SEQ ID NO: 4089559 - RNA, 18 nt, Streptococcus pneumoniae R6
acguucugcaacaacagc

SEQ ID NO: 4089560 - RNA, 17 nt, Streptococcus pneumoniae R6
acguucugucaaaccau

SEQ ID NO: 4089561 - RNA, 22 nt, Streptococcus pneumoniae R6
acguucuucaagagcuuuaaua

SEQ ID NO: 4089562 - RNA, 13 nt, Streptococcus pneumoniae R6
acguugaauagcu

SEQ ID NO: 4089563 - RNA, 21 nt, Streptococcus pneumoniae R6
acguugacgcggauugaagag

SEQ ID NO: 4089564 - RNA, 18 nt, Streptococcus pneumoniae R6
acguugacgcgguuugaa

SEQ ID NO: 4089565 - RNA, 21 nt, Streptococcus pneumoniae R6
acguugauauuggucagauug

SEQ ID NO: 4089566 - RNA, 16 nt, Streptococcus pneumoniae R6
acguuguuaaaucaac

SEQ ID NO: 4089567 - RNA, 19 nt, Streptococcus pneumoniae R6
acguuguucaagccuuauu

SEQ ID NO: 4089568 - RNA, 13 nt, Streptococcus pneumoniae R6
acguuguuuucca

SEQ ID NO: 4089569 - RNA, 17 nt, Streptococcus pneumoniae R6
acguuuuaaaaaagagc

SEQ ID NO: 4089570 - RNA, 17 nt, Streptococcus pneumoniae R6
acguuuuuacuuuggca

SEQ ID NO: 4089571 - RNA, 15 nt, Streptococcus pneumoniae R6
acguuuuuugauuuu

SEQ ID NO: 4089572 - RNA, 17 nt, Streptococcus pneumoniae R6
acuaaaaacucuucuuu

SEQ ID NO: 4089573 - RNA, 16 nt, Streptococcus pneumoniae R6
acuaaaaccuucuaau

SEQ ID NO: 4089574 - RNA, 21 nt, Streptococcus pneumoniae R6
acuaaacaagggauuuuucug

SEQ ID NO: 4089575 - RNA, 15 nt, Streptococcus pneumoniae R6
acuaaaccaauaaua

SEQ ID NO: 4089576 - RNA, 17 nt, Streptococcus pneumoniae R6
acuaaaccaauaauaaa

SEQ ID NO: 4089577 - RNA, 14 nt, Streptococcus pneumoniae R6
acuaaagcuuuuuu

SEQ ID NO: 4089578 - RNA, 18 nt, Streptococcus pneumoniae R6
acuaaaguguaaugcuau

SEQ ID NO: 4089579 - RNA, 18 nt, Streptococcus pneumoniae R6
acuaaauacaaaaacaaa

SEQ ID NO: 4089580 - RNA, 19 nt, Streptococcus pneumoniae R6
acuaaauaccuuauccaau

SEQ ID NO: 4089581 - RNA, 16 nt, Streptococcus pneumoniae R6
acuaaauauaagauuu

SEQ ID NO: 4089582 - RNA, 22 nt, Streptococcus pneumoniae R6
acuaaaucuucggauaaauuaa

SEQ ID NO: 4089583 - RNA, 23 nt, Streptococcus pneumoniae R6
acuaaauuccaaauuagaaaaag

SEQ ID NO: 4089584 - RNA, 16 nt, Streptococcus pneumoniae R6
acuaacaauuaugcuu

SEQ ID NO: 4089585 - RNA, 18 nt, Streptococcus pneumoniae R6
acuaaccaacuucuuuuu

SEQ ID NO: 4089586 - RNA, 17 nt, Streptococcus pneumoniae R6
acuaacccuagaaaacc

SEQ ID NO: 4089587 - RNA, 20 nt, Streptococcus pneumoniae R6
acuaagauagagguuauuca

SEQ ID NO: 4089588 - RNA, 20 nt, Streptococcus pneumoniae R6
acuaagauuuguuuuucaaa

SEQ ID NO: 4089589 - RNA, 16 nt, Streptococcus pneumoniae R6
acuaagccuacacaga

SEQ ID NO: 4089590 - RNA, 21 nt, Streptococcus pneumoniae R6
acuaaguuccuguuguaauuu

SEQ ID NO: 4089591 - RNA, 17 nt, Streptococcus pneumoniae R6
acuaaugcccuuuuuug

SEQ ID NO: 4089592 - RNA, 15 nt, Streptococcus pneumoniae R6
acuaauguaaaaaag

SEQ ID NO: 4089593 - RNA, 13 nt, Streptococcus pneumoniae R6
acuaauuaauuaa

SEQ ID NO: 4089594 - RNA, 17 nt, Streptococcus pneumoniae R6
acuaauuuggaaauaag

SEQ ID NO: 4089595 - RNA, 13 nt, Streptococcus pneumoniae R6
acuacaaagagag

SEQ ID NO: 4089596 - RNA, 22 nt, Streptococcus pneumoniae R6
acuacaauaauugguacauuuu

SEQ ID NO: 4089597 - RNA, 13 nt, Streptococcus pneumoniae R6
acuacaguugaca

SEQ ID NO: 4089598 - RNA, 18 nt, Streptococcus pneumoniae R6
acuacaguugacaaagag

SEQ ID NO: 4089599 - RNA, 21 nt, Streptococcus pneumoniae R6
acuacaguugacaaagagcca

SEQ ID NO: 4089600 - RNA, 23 nt, Streptococcus pneumoniae R6
acuacaguugacaaagagccaua

SEQ ID NO: 4089601 - RNA, 18 nt, Streptococcus pneumoniae R6
acuacauuuuuugaaaua

SEQ ID NO: 4089602 - RNA, 21 nt, Streptococcus pneumoniae R6
acuacauuuuuugaaauaaga

SEQ ID NO: 4089603 - RNA, 22 nt, Streptococcus pneumoniae R6
acuaccgcuucagcgauuucuu

SEQ ID NO: 4089604 - RNA, 16 nt, Streptococcus pneumoniae R6
acuacuaaaacauuuc

SEQ ID NO: 4089605 - RNA, 22 nt, Streptococcus pneumoniae R6
acuacuaagauagagguuauuc

SEQ ID NO: 4089606 - RNA, 20 nt, Streptococcus pneumoniae R6
acuacuggaauggcaaccgu

SEQ ID NO: 4089607 - RNA, 21 nt, Streptococcus pneumoniae R6
acuacuggaauggcaaccguu

SEQ ID NO: 4089608 - RNA, 16 nt, Streptococcus pneumoniae R6
acuacuuuugucagua

SEQ ID NO: 4089609 - RNA, 18 nt, Streptococcus pneumoniae R6
acuacuuuugucaguaaa

SEQ ID NO: 4089610 - RNA, 18 nt, Streptococcus pneumoniae R6
acuagaauccuaguucau

SEQ ID NO: 4089611 - RNA, 17 nt, Streptococcus pneumoniae R6
acuagaaugcuuuguga

SEQ ID NO: 4089612 - RNA, 18 nt, Streptococcus pneumoniae R6
acuagaaugcuuugugaa

SEQ ID NO: 4089613 - RNA, 13 nt, Streptococcus pneumoniae R6
acuagagaagcca

SEQ ID NO: 4089614 - RNA, 21 nt, Streptococcus pneumoniae R6
acuagagaagccaagaguaga

SEQ ID NO: 4089615 - RNA, 16 nt, Streptococcus pneumoniae R6
acuagagaggggagga

SEQ ID NO: 4089616 - RNA, 19 nt, Streptococcus pneumoniae R6
acuagauucuauuuuuuau

SEQ ID NO: 4089617 - RNA, 16 nt, Streptococcus pneumoniae R6
acuagcugcaggcugc

SEQ ID NO: 4089618 - RNA, 18 nt, Streptococcus pneumoniae R6
acuaggaaacuagcugca

SEQ ID NO: 4089619 - RNA, 17 nt, Streptococcus pneumoniae R6
acuaggaauauugaaaa

SEQ ID NO: 4089620 - RNA, 14 nt, Streptococcus pneumoniae R6
acuaggauuuucuu

SEQ ID NO: 4089621 - RNA, 14 nt, Streptococcus pneumoniae R6
acuaggcuagcaaa

SEQ ID NO: 4089622 - RNA, 14 nt, Streptococcus pneumoniae R6
acuagggaaacacc

SEQ ID NO: 4089623 - RNA, 15 nt, Streptococcus pneumoniae R6
acuagggaaacacca

SEQ ID NO: 4089624 - RNA, 19 nt, Streptococcus pneumoniae R6
acuagggaaagaagguauu

SEQ ID NO: 4089625 - RNA, 22 nt, Streptococcus pneumoniae R6
acuaggugagcaucaggaaaga

SEQ ID NO: 4089626 - RNA, 20 nt, Streptococcus pneumoniae R6
acuagguuagucaaaaagaa

SEQ ID NO: 4089627 - RNA, 17 nt, Streptococcus pneumoniae R6
acuaguaaauugucuaa

SEQ ID NO: 4089628 - RNA, 12 nt, Streptococcus pneumoniae R6
acuaguauucau

SEQ ID NO: 4089629 - RNA, 20 nt, Streptococcus pneumoniae R6
acuagucuaacuucuccauc

SEQ ID NO: 4089630 - RNA, 22 nt, Streptococcus pneumoniae R6
acuagugaagcgccuagccaaa

SEQ ID NO: 4089631 - RNA, 19 nt, Streptococcus pneumoniae R6
acuagugccauaguuaagg

SEQ ID NO: 4089632 - RNA, 14 nt, Streptococcus pneumoniae R6
acuaguucugcaga

SEQ ID NO: 4089633 - RNA, 19 nt, Streptococcus pneumoniae R6
acuaguuuucuaaagaauu

SEQ ID NO: 4089634 - RNA, 12 nt, Streptococcus pneumoniae R6
acuauaaaaaag

SEQ ID NO: 4089635 - RNA, 15 nt, Streptococcus pneumoniae R6
acuauaaaaaaguga

SEQ ID NO: 4089636 - RNA, 19 nt, Streptococcus pneumoniae R6
acuauaaaaaagugaacaa

SEQ ID NO: 4089637 - RNA, 14 nt, Streptococcus pneumoniae R6
acuauaaaacauuc

SEQ ID NO: 4089638 - RNA, 14 nt, Streptococcus pneumoniae R6
acuauaaaagagga

SEQ ID NO: 4089639 - RNA, 16 nt, Streptococcus pneumoniae R6
acuauaacagagaaga

SEQ ID NO: 4089640 - RNA, 17 nt, Streptococcus pneumoniae R6
acuauaacagagaagaa

SEQ ID NO: 4089641 - RNA, 13 nt, Streptococcus pneumoniae R6
acuauaauaaaau

SEQ ID NO: 4089642 - RNA, 14 nt, Streptococcus pneumoniae R6
acuauaauaaaaug

SEQ ID NO: 4089643 - RNA, 16 nt, Streptococcus pneumoniae R6
acuauaauaaaaugaa

SEQ ID NO: 4089644 - RNA, 20 nt, Streptococcus pneumoniae R6
acuauacuuuuuuaauuuaa

SEQ ID NO: 4089645 - RNA, 22 nt, Streptococcus pneumoniae R6
acuauagacaacuccuugaauc

SEQ ID NO: 4089646 - RNA, 21 nt, Streptococcus pneumoniae R6
acuauaguagcucagaagucg

SEQ ID NO: 4089647 - RNA, 13 nt, Streptococcus pneumoniae R6
acuauaucauaua

SEQ ID NO: 4089648 - RNA, 21 nt, Streptococcus pneumoniae R6
acuauaucauauagauaaaaa

SEQ ID NO: 4089649 - RNA, 18 nt, Streptococcus pneumoniae R6
acuauauugcaagagaaa

SEQ ID NO: 4089650 - RNA, 20 nt, Streptococcus pneumoniae R6
acuauauugcaagagaaauc

SEQ ID NO: 4089651 - RNA, 20 nt, Streptococcus pneumoniae R6
acuauauuucuauacuuuuu

SEQ ID NO: 4089652 - RNA, 23 nt, Streptococcus pneumoniae R6
acuauauuucuauacuuuuucuu

SEQ ID NO: 4089653 - RNA, 21 nt, Streptococcus pneumoniae R6
acuaucaaaaucaaugacaau

SEQ ID NO: 4089654 - RNA, 15 nt, Streptococcus pneumoniae R6
acuaucaaugauuua

SEQ ID NO: 4089655 - RNA, 16 nt, Streptococcus pneumoniae R6
acuaucaaugauuuau

SEQ ID NO: 4089656 - RNA, 21 nt, Streptococcus pneumoniae R6
acuauccagagcauucuuuug

SEQ ID NO: 4089657 - RNA, 16 nt, Streptococcus pneumoniae R6
acuaucccuuuaccau

SEQ ID NO: 4089658 - RNA, 18 nt, Streptococcus pneumoniae R6
acuaucccuuuaccauuc

SEQ ID NO: 4089659 - RNA, 15 nt, Streptococcus pneumoniae R6
acuaucgaaaaauau

SEQ ID NO: 4089660 - RNA, 14 nt, Streptococcus pneumoniae R6
acuaucuaaaaaaa

SEQ ID NO: 4089661 - RNA, 15 nt, Streptococcus pneumoniae R6
acuaucuaaaaaaau

SEQ ID NO: 4089662 - RNA, 17 nt, Streptococcus pneumoniae R6
acuaucuaaaaaaauga

SEQ ID NO: 4089663 - RNA, 21 nt, Streptococcus pneumoniae R6
acuaucuccuuugauucagau

SEQ ID NO: 4089664 - RNA, 18 nt, Streptococcus pneumoniae R6
acuaucucuacauuccca

SEQ ID NO: 4089665 - RNA, 21 nt, Streptococcus pneumoniae R6
acuaucugcuaacugcuggau

SEQ ID NO: 4089666 - RNA, 21 nt, Streptococcus pneumoniae R6
acuaugauuagguuuccuuua

SEQ ID NO: 4089667 - RNA, 23 nt, Streptococcus pneumoniae R6
acuaugauuagguuuccuuuaac

SEQ ID NO: 4089668 - RNA, 16 nt, Streptococcus pneumoniae R6
acuaugcguuuuauug

SEQ ID NO: 4089669 - RNA, 22 nt, Streptococcus pneumoniae R6
acuaugcguuuugcuuuauccu

SEQ ID NO: 4089670 - RNA, 22 nt, Streptococcus pneumoniae R6
acuaugggagcuaacucaaguu

SEQ ID NO: 4089671 - RNA, 17 nt, Streptococcus pneumoniae R6
acuaugguauguugcgu

SEQ ID NO: 4089672 - RNA, 18 nt, Streptococcus pneumoniae R6
acuauguucugugauaaa

SEQ ID NO: 4089673 - RNA, 16 nt, Streptococcus pneumoniae R6
acuauugaugaacugc

SEQ ID NO: 4089674 - RNA, 17 nt, Streptococcus pneumoniae R6
acuauugaugaacugcu

SEQ ID NO: 4089675 - RNA, 18 nt, Streptococcus pneumoniae R6
acuauuguuauuuuucuu

SEQ ID NO: 4089676 - RNA, 12 nt, Streptococcus pneumoniae R6
acuauuucagau

SEQ ID NO: 4089677 - RNA, 12 nt, Streptococcus pneumoniae R6
acuauuugagua

SEQ ID NO: 4089678 - RNA, 18 nt, Streptococcus pneumoniae R6
acuauuuuauuuuuuaag

SEQ ID NO: 4089679 - RNA, 13 nt, Streptococcus pneumoniae R6
acuauuuuuguca

SEQ ID NO: 4089680 - RNA, 15 nt, Streptococcus pneumoniae R6
acuauuuuugucauc

SEQ ID NO: 4089681 - RNA, 20 nt, Streptococcus pneumoniae R6
acucaaaagcuuguuuaaaa

SEQ ID NO: 4089682 - RNA, 21 nt, Streptococcus pneumoniae R6
acucaaaagcuuguuuaaaau

SEQ ID NO: 4089683 - RNA, 16 nt, Streptococcus pneumoniae R6
acucaaaucaaaauau

SEQ ID NO: 4089684 - RNA, 18 nt, Streptococcus pneumoniae R6
acucaaauguaaguuggg

SEQ ID NO: 4089685 - RNA, 18 nt, Streptococcus pneumoniae R6
acucaaauuuaccaaugc

SEQ ID NO: 4089686 - RNA, 18 nt, Streptococcus pneumoniae R6
acucaacauuauccauga

SEQ ID NO: 4089687 - RNA, 18 nt, Streptococcus pneumoniae R6
acucaagacauagucaag

SEQ ID NO: 4089688 - RNA, 17 nt, Streptococcus pneumoniae R6
acucaaugaaaaucaaa

SEQ ID NO: 4089689 - RNA, 22 nt, Streptococcus pneumoniae R6
acucaaugaaaaucaaagagca

SEQ ID NO: 4089690 - RNA, 23 nt, Streptococcus pneumoniae R6
acucaaugaaaaucaaagagcaa

SEQ ID NO: 4089691 - RNA, 21 nt, Streptococcus pneumoniae R6
acucaaugaaaaucaaagugc

SEQ ID NO: 4089692 - RNA, 22 nt, Streptococcus pneumoniae R6
acucaauuaagaaauuuucuuu

SEQ ID NO: 4089693 - RNA, 12 nt, Streptococcus pneumoniae R6
acucaauuguau

SEQ ID NO: 4089694 - RNA, 22 nt, Streptococcus pneumoniae R6
acucaauugugcauaagaaacu

SEQ ID NO: 4089695 - RNA, 16 nt, Streptococcus pneumoniae R6
acucagcauuuucuuu

SEQ ID NO: 4089696 - RNA, 17 nt, Streptococcus pneumoniae R6
acucagcauuuucuuuu

SEQ ID NO: 4089697 - RNA, 16 nt, Streptococcus pneumoniae R6
acucaggaaagaugau

SEQ ID NO: 4089698 - RNA, 18 nt, Streptococcus pneumoniae R6
acucagguccuuucuuuu

SEQ ID NO: 4089699 - RNA, 14 nt, Streptococcus pneumoniae R6
acucaguauuacau

SEQ ID NO: 4089700 - RNA, 15 nt, Streptococcus pneumoniae R6
acucaguauuuggau

SEQ ID NO: 4089701 - RNA, 15 nt, Streptococcus pneumoniae R6
acucaguuaaaauca

SEQ ID NO: 4089702 - RNA, 16 nt, Streptococcus pneumoniae R6
acucauaauagucucu

SEQ ID NO: 4089703 - RNA, 19 nt, Streptococcus pneumoniae R6
acucauacaagcugccaaa

SEQ ID NO: 4089704 - RNA, 20 nt, Streptococcus pneumoniae R6
acucaucugcuuucaaaaag

SEQ ID NO: 4089705 - RNA, 21 nt, Streptococcus pneumoniae R6
acucaucugcuuucaaaaagc

SEQ ID NO: 4089706 - RNA, 20 nt, Streptococcus pneumoniae R6
acucaucuguuuucaaaaag

SEQ ID NO: 4089707 - RNA, 21 nt, Streptococcus pneumoniae R6
acucaucuguuuucaaaaagc

SEQ ID NO: 4089708 - RNA, 18 nt, Streptococcus pneumoniae R6
acucaugugucuugcauu

SEQ ID NO: 4089709 - RNA, 20 nt, Streptococcus pneumoniae R6
acucaugugucuugcauuuu

SEQ ID NO: 4089710 - RNA, 12 nt, Streptococcus pneumoniae R6
acucauuaauaa

SEQ ID NO: 4089711 - RNA, 18 nt, Streptococcus pneumoniae R6
acucauugauuuggacua

SEQ ID NO: 4089712 - RNA, 16 nt, Streptococcus pneumoniae R6
acuccaacuggucuug

SEQ ID NO: 4089713 - RNA, 21 nt, Streptococcus pneumoniae R6
acuccaagcaagcgaagggcu

SEQ ID NO: 4089714 - RNA, 21 nt, Streptococcus pneumoniae R6
acuccaccauaguguuucucu

SEQ ID NO: 4089715 - RNA, 22 nt, Streptococcus pneumoniae R6
acucccaucgcgaccaagagca

SEQ ID NO: 4089716 - RNA, 15 nt, Streptococcus pneumoniae R6
acucccuguuccaaa

SEQ ID NO: 4089717 - RNA, 21 nt, Streptococcus pneumoniae R6
acucccuguuccaaagaagua

SEQ ID NO: 4089718 - RNA, 13 nt, Streptococcus pneumoniae R6
acuccuacaaagc

SEQ ID NO: 4089719 - RNA, 14 nt, Streptococcus pneumoniae R6
acuccucucuccuc

SEQ ID NO: 4089720 - RNA, 16 nt, Streptococcus pneumoniae R6
acuccuuacuuuuuau

SEQ ID NO: 4089721 - RNA, 20 nt, Streptococcus pneumoniae R6
acuccuuaguguacagcaaa

SEQ ID NO: 4089722 - RNA, 16 nt, Streptococcus pneumoniae R6
acuccuugaaucauca

SEQ ID NO: 4089723 - RNA, 12 nt, Streptococcus pneumoniae R6
acuccuuuucua

SEQ ID NO: 4089724 - RNA, 12 nt, Streptococcus pneumoniae R6
acuccuuuuuug

SEQ ID NO: 4089725 - RNA, 23 nt, Streptococcus pneumoniae R6
acucgaaccaccgaccucacgcu

SEQ ID NO: 4089726 - RNA, 17 nt, Streptococcus pneumoniae R6
acucgauuuuaaaucac

SEQ ID NO: 4089727 - RNA, 15 nt, Streptococcus pneumoniae R6
acucgcgacaacagc

SEQ ID NO: 4089728 - RNA, 18 nt, Streptococcus pneumoniae R6
acucgugaagaaaucauc

SEQ ID NO: 4089729 - RNA, 22 nt, Streptococcus pneumoniae R6
acucguuuuaguauaguaaacu

SEQ ID NO: 4089730 - RNA, 22 nt, Streptococcus pneumoniae R6
acucuaaauugaauaaagucaa

SEQ ID NO: 4089731 - RNA, 22 nt, Streptococcus pneumoniae R6
acucuaaccauuauagcauucu

SEQ ID NO: 4089732 - RNA, 16 nt, Streptococcus pneumoniae R6
acucuaacuucugcua

SEQ ID NO: 4089733 - RNA, 14 nt, Streptococcus pneumoniae R6
acucuacagauuuc

SEQ ID NO: 4089734 - RNA, 23 nt, Streptococcus pneumoniae R6
acucuaguuuuuauaauguauug

SEQ ID NO: 4089735 - RNA, 22 nt, Streptococcus pneumoniae R6
acucuauuuuugagcagaacaa

SEQ ID NO: 4089736 - RNA, 23 nt, Streptococcus pneumoniae R6
acucucauuaaaacggagaauaa

SEQ ID NO: 4089737 - RNA, 18 nt, Streptococcus pneumoniae R6
acucuccuccauaaaaag

SEQ ID NO: 4089738 - RNA, 20 nt, Streptococcus pneumoniae R6
acucuccuccauaaaaagac

SEQ ID NO: 4089739 - RNA, 22 nt, Streptococcus pneumoniae R6
acucuccuccauaaaaagaccg

SEQ ID NO: 4089740 - RNA, 17 nt, Streptococcus pneumoniae R6
acucucggucuuguuuu

SEQ ID NO: 4089741 - RNA, 21 nt, Streptococcus pneumoniae R6
acucucggucuuguuuuuuau

SEQ ID NO: 4089742 - RNA, 23 nt, Streptococcus pneumoniae R6
acucucuaauucccuuaaagugg

SEQ ID NO: 4089743 - RNA, 15 nt, Streptococcus pneumoniae R6
acucucuuuuuugau

SEQ ID NO: 4089744 - RNA, 16 nt, Streptococcus pneumoniae R6
acucugccuuccuugu

SEQ ID NO: 4089745 - RNA, 15 nt, Streptococcus pneumoniae R6
acucuggguguuucu

SEQ ID NO: 4089746 - RNA, 18 nt, Streptococcus pneumoniae R6
acucuuacaaaaaaucaa

SEQ ID NO: 4089747 - RNA, 15 nt, Streptococcus pneumoniae R6
acucuuagaaaaucu

SEQ ID NO: 4089748 - RNA, 16 nt, Streptococcus pneumoniae R6
acucuuagucuuuauu

SEQ ID NO: 4089749 - RNA, 18 nt, Streptococcus pneumoniae R6
acucuuagucuuuauuuu

SEQ ID NO: 4089750 - RNA, 15 nt, Streptococcus pneumoniae R6
acucuuauacuuuuc

SEQ ID NO: 4089751 - RNA, 20 nt, Streptococcus pneumoniae R6
acucuuauacuuuucucuua

SEQ ID NO: 4089752 - RNA, 21 nt, Streptococcus pneumoniae R6
acucuuauuauucucuauaua

SEQ ID NO: 4089753 - RNA, 17 nt, Streptococcus pneumoniae R6
acucuucaagguuuuau

SEQ ID NO: 4089754 - RNA, 19 nt, Streptococcus pneumoniae R6
acucuucgaaaaucucugc

SEQ ID NO: 4089755 - RNA, 23 nt, Streptococcus pneumoniae R6
acucuucgaaaaucucugcaaac

SEQ ID NO: 4089756 - RNA, 19 nt, Streptococcus pneumoniae R6
acucuucgaaaaucucuuc

SEQ ID NO: 4089757 - RNA, 12 nt, Streptococcus pneumoniae R6
acucuucugguu

SEQ ID NO: 4089758 - RNA, 13 nt, Streptococcus pneumoniae R6
acucuucugguuu

SEQ ID NO: 4089759 - RNA, 12 nt, Streptococcus pneumoniae R6
acucuucuuuug

SEQ ID NO: 4089760 - RNA, 16 nt, Streptococcus pneumoniae R6
acucuucuuuuggcaa

SEQ ID NO: 4089761 - RNA, 17 nt, Streptococcus pneumoniae R6
acucuugauuuucauug

SEQ ID NO: 4089762 - RNA, 15 nt, Streptococcus pneumoniae R6
acucuugcccuuggc

SEQ ID NO: 4089763 - RNA, 16 nt, Streptococcus pneumoniae R6
acucuuguucugccua

SEQ ID NO: 4089764 - RNA, 13 nt, Streptococcus pneumoniae R6
acucuuuaagaga

SEQ ID NO: 4089765 - RNA, 22 nt, Streptococcus pneumoniae R6
acucuuuagaaaucaaaaagca

SEQ ID NO: 4089766 - RNA, 18 nt, Streptococcus pneumoniae R6
acucuuucgaagucugau

SEQ ID NO: 4089767 - RNA, 15 nt, Streptococcus pneumoniae R6
acucuuugauuuuca

SEQ ID NO: 4089768 - RNA, 16 nt, Streptococcus pneumoniae R6
acucuuugauuuucau

SEQ ID NO: 4089769 - RNA, 16 nt, Streptococcus pneumoniae R6
acugaacaaauuaauu

SEQ ID NO: 4089770 - RNA, 15 nt, Streptococcus pneumoniae R6
acugaacaaugaaaa

SEQ ID NO: 4089771 - RNA, 17 nt, Streptococcus pneumoniae R6
acugaacaaugaaaaaa

SEQ ID NO: 4089772 - RNA, 20 nt, Streptococcus pneumoniae R6
acugaacggugaacuucuuc

SEQ ID NO: 4089773 - RNA, 13 nt, Streptococcus pneumoniae R6
acugaacucaacu

SEQ ID NO: 4089774 - RNA, 17 nt, Streptococcus pneumoniae R6
acugaaucguuggcaaa

SEQ ID NO: 4089775 - RNA, 15 nt, Streptococcus pneumoniae R6
acugaaucuaaaaua

SEQ ID NO: 4089776 - RNA, 18 nt, Streptococcus pneumoniae R6
acugaaucuagacuagca

SEQ ID NO: 4089777 - RNA, 15 nt, Streptococcus pneumoniae R6
acugacgaagucagc

SEQ ID NO: 4089778 - RNA, 18 nt, Streptococcus pneumoniae R6
acugacgaagucagcuca

SEQ ID NO: 4089779 - RNA, 20 nt, Streptococcus pneumoniae R6
acugacgaagucagcucaaa

SEQ ID NO: 4089780 - RNA, 15 nt, Streptococcus pneumoniae R6
acugacgaagucagu

SEQ ID NO: 4089781 - RNA, 23 nt, Streptococcus pneumoniae R6
acugacuaaaacuugugauuuag

SEQ ID NO: 4089782 - RNA, 23 nt, Streptococcus pneumoniae R6
acugacuucgucaguuucaucua

SEQ ID NO: 4089783 - RNA, 23 nt, Streptococcus pneumoniae R6
acugagagcuacacguggguuga

SEQ ID NO: 4089784 - RNA, 10 nt, Streptococcus pneumoniae R6
acugauaaaa

SEQ ID NO: 4089785 - RNA, 14 nt, Streptococcus pneumoniae R6
acugauaaaacuga

SEQ ID NO: 4089786 - RNA, 17 nt, Streptococcus pneumoniae R6
acugaucaaaaaauuuc

SEQ ID NO: 4089787 - RNA, 22 nt, Streptococcus pneumoniae R6
acugaucaaaaaauuucauuuc

SEQ ID NO: 4089788 - RNA, 14 nt, Streptococcus pneumoniae R6
acugaucccuccau

SEQ ID NO: 4089789 - RNA, 19 nt, Streptococcus pneumoniae R6
acugaucccuccauuucau

SEQ ID NO: 4089790 - RNA, 13 nt, Streptococcus pneumoniae R6
acugaugagagau

SEQ ID NO: 4089791 - RNA, 14 nt, Streptococcus pneumoniae R6
acugauucuacuuu

SEQ ID NO: 4089792 - RNA, 19 nt, Streptococcus pneumoniae R6
acugauuggugucaaaaag

SEQ ID NO: 4089793 - RNA, 23 nt, Streptococcus pneumoniae R6
acugauuuacaaauauucaccac

SEQ ID NO: 4089794 - RNA, 21 nt, Streptococcus pneumoniae R6
acugauuucaaggcauuuuuu

SEQ ID NO: 4089795 - RNA, 20 nt, Streptococcus pneumoniae R6
acugcagucuucauguggcu

SEQ ID NO: 4089796 - RNA, 15 nt, Streptococcus pneumoniae R6
acugcaucugguucu

SEQ ID NO: 4089797 - RNA, 17 nt, Streptococcus pneumoniae R6
acugcaucugguucuag

SEQ ID NO: 4089798 - RNA, 16 nt, Streptococcus pneumoniae R6
acugccaagauagaga

SEQ ID NO: 4089799 - RNA, 22 nt, Streptococcus pneumoniae R6
acugccccccaaaaguuagaca

SEQ ID NO: 4089800 - RNA, 12 nt, Streptococcus pneumoniae R6
acugccuugagg

SEQ ID NO: 4089801 - RNA, 17 nt, Streptococcus pneumoniae R6
acugcgaagaaaucauu

SEQ ID NO: 4089802 - RNA, 23 nt, Streptococcus pneumoniae R6
acugcgauuggggauugauuuuc

SEQ ID NO: 4089803 - RNA, 14 nt, Streptococcus pneumoniae R6
acugcgguugcgua

SEQ ID NO: 4089804 - RNA, 13 nt, Streptococcus pneumoniae R6
acugcuagaaaug

SEQ ID NO: 4089805 - RNA, 13 nt, Streptococcus pneumoniae R6
acugcugccacug

SEQ ID NO: 4089806 - RNA, 16 nt, Streptococcus pneumoniae R6
acugcugccacuggga

SEQ ID NO: 4089807 - RNA, 23 nt, Streptococcus pneumoniae R6
acugcuggauagaguagucuggg

SEQ ID NO: 4089808 - RNA, 16 nt, Streptococcus pneumoniae R6
acugcugggucaaacg

SEQ ID NO: 4089809 - RNA, 19 nt, Streptococcus pneumoniae R6
acugcuuagaaccgaaaau

SEQ ID NO: 4089810 - RNA, 15 nt, Streptococcus pneumoniae R6
acugcuugagcugcu

SEQ ID NO: 4089811 - RNA, 20 nt, Streptococcus pneumoniae R6
acugcuuugagaucuuuuuc

SEQ ID NO: 4089812 - RNA, 16 nt, Streptococcus pneumoniae R6
acugcuuuuucaauca

SEQ ID NO: 4089813 - RNA, 23 nt, Streptococcus pneumoniae R6
acuggaccaaguuuaaggauagc

SEQ ID NO: 4089814 - RNA, 23 nt, Streptococcus pneumoniae R6
acuggaccagaaccaugaccgag

SEQ ID NO: 4089815 - RNA, 16 nt, Streptococcus pneumoniae R6
acuggagaguugugaa

SEQ ID NO: 4089816 - RNA, 20 nt, Streptococcus pneumoniae R6
acuggauguguauagagcaa

SEQ ID NO: 4089817 - RNA, 20 nt, Streptococcus pneumoniae R6
acuggauuguauagugaauu

SEQ ID NO: 4089818 - RNA, 12 nt, Streptococcus pneumoniae R6
acuggauuuuaa

SEQ ID NO: 4089819 - RNA, 11 nt, Streptococcus pneumoniae R6
acuggcaaaau

SEQ ID NO: 4089820 - RNA, 16 nt, Streptococcus pneumoniae R6
acuggccucugcacua

SEQ ID NO: 4089821 - RNA, 21 nt, Streptococcus pneumoniae R6
acuggcgauuuuaggauacug

SEQ ID NO: 4089822 - RNA, 14 nt, Streptococcus pneumoniae R6
acuggcugccauug

SEQ ID NO: 4089823 - RNA, 20 nt, Streptococcus pneumoniae R6
acuggcugccauugguguuu

SEQ ID NO: 4089824 - RNA, 17 nt, Streptococcus pneumoniae R6
acuggguguuugccauc

SEQ ID NO: 4089825 - RNA, 18 nt, Streptococcus pneumoniae R6
acuggguguuugccaucu

SEQ ID NO: 4089826 - RNA, 17 nt, Streptococcus pneumoniae R6
acuggucacauugaaaa

SEQ ID NO: 4089827 - RNA, 18 nt, Streptococcus pneumoniae R6
acuggucacauugaaaau

SEQ ID NO: 4089828 - RNA, 21 nt, Streptococcus pneumoniae R6
acuggucuugccagccugccu

SEQ ID NO: 4089829 - RNA, 18 nt, Streptococcus pneumoniae R6
acuggugagauaaaacgu

SEQ ID NO: 4089830 - RNA, 23 nt, Streptococcus pneumoniae R6
acugguuccauuuaacaaaccac

SEQ ID NO: 4089831 - RNA, 22 nt, Streptococcus pneumoniae R6
acugguucucucuuuuugauuu

SEQ ID NO: 4089832 - RNA, 15 nt, Streptococcus pneumoniae R6
acugguuuuccugua

SEQ ID NO: 4089833 - RNA, 17 nt, Streptococcus pneumoniae R6
acuguaaaguagcaaaa

SEQ ID NO: 4089834 - RNA, 15 nt, Streptococcus pneumoniae R6
acuguaguggguuga

SEQ ID NO: 4089835 - RNA, 20 nt, Streptococcus pneumoniae R6
acuguaguggguugaaaaaa

SEQ ID NO: 4089836 - RNA, 14 nt, Streptococcus pneumoniae R6
acuguauacuuuuu

SEQ ID NO: 4089837 - RNA, 14 nt, Streptococcus pneumoniae R6
acuguaugagaaac

SEQ ID NO: 4089838 - RNA, 15 nt, Streptococcus pneumoniae R6
acuguaugagaaaca

SEQ ID NO: 4089839 - RNA, 18 nt, Streptococcus pneumoniae R6
acuguauucuaggaaaac

SEQ ID NO: 4089840 - RNA, 20 nt, Streptococcus pneumoniae R6
acuguauucuaggaaaacga

SEQ ID NO: 4089841 - RNA, 19 nt, Streptococcus pneumoniae R6
acuguauugaccaaagcau

SEQ ID NO: 4089842 - RNA, 16 nt, Streptococcus pneumoniae R6
acuguccacaaagaua

SEQ ID NO: 4089843 - RNA, 17 nt, Streptococcus pneumoniae R6
acuguccugaucgauuu

SEQ ID NO: 4089844 - RNA, 18 nt, Streptococcus pneumoniae R6
acugucucaggucuagca

SEQ ID NO: 4089845 - RNA, 22 nt, Streptococcus pneumoniae R6
acugucuuauccaaacuagaua

SEQ ID NO: 4089846 - RNA, 14 nt, Streptococcus pneumoniae R6
acugucuugccaac

SEQ ID NO: 4089847 - RNA, 20 nt, Streptococcus pneumoniae R6
acugucuugccaaccagguu

SEQ ID NO: 4089848 - RNA, 15 nt, Streptococcus pneumoniae R6
acugugacuagcaau

SEQ ID NO: 4089849 - RNA, 17 nt, Streptococcus pneumoniae R6
acugugacuagcaauca

SEQ ID NO: 4089850 - RNA, 20 nt, Streptococcus pneumoniae R6
acugugauuucuaaaacauu

SEQ ID NO: 4089851 - RNA, 21 nt, Streptococcus pneumoniae R6
acugugcuuugugucaucagc

SEQ ID NO: 4089852 - RNA, 20 nt, Streptococcus pneumoniae R6
acuguuauagauucaauaua

SEQ ID NO: 4089853 - RNA, 22 nt, Streptococcus pneumoniae R6
acuguuauagauucaauauauu

SEQ ID NO: 4089854 - RNA, 14 nt, Streptococcus pneumoniae R6
acuguuuuagcguu

SEQ ID NO: 4089855 - RNA, 16 nt, Streptococcus pneumoniae R6
acuguuuuccuuucaa

SEQ ID NO: 4089856 - RNA, 23 nt, Streptococcus pneumoniae R6
acuguuuugagauuacugauaaa

SEQ ID NO: 4089857 - RNA, 13 nt, Streptococcus pneumoniae R6
acuguuuuucuug

SEQ ID NO: 4089858 - RNA, 21 nt, Streptococcus pneumoniae R6
acuuaaauugguguuguuuau

SEQ ID NO: 4089859 - RNA, 14 nt, Streptococcus pneumoniae R6
acuuaacccauuca

SEQ ID NO: 4089860 - RNA, 14 nt, Streptococcus pneumoniae R6
acuuaccaaggcuu

SEQ ID NO: 4089861 - RNA, 21 nt, Streptococcus pneumoniae R6
acuuaccaaggcuuugagggc

SEQ ID NO: 4089862 - RNA, 19 nt, Streptococcus pneumoniae R6
acuuacgacauccuauuua

SEQ ID NO: 4089863 - RNA, 23 nt, Streptococcus pneumoniae R6
acuuacuauucacucaaaucaua

SEQ ID NO: 4089864 - RNA, 13 nt, Streptococcus pneumoniae R6
acuuacucuuauu

SEQ ID NO: 4089865 - RNA, 17 nt, Streptococcus pneumoniae R6
acuuagacgguuuacca

SEQ ID NO: 4089866 - RNA, 11 nt, Streptococcus pneumoniae R6
acuuagccaag

SEQ ID NO: 4089867 - RNA, 20 nt, Streptococcus pneumoniae R6
acuuaggguuagauuauugc

SEQ ID NO: 4089868 - RNA, 20 nt, Streptococcus pneumoniae R6
acuuauagaggagauuuaaa

SEQ ID NO: 4089869 - RNA, 22 nt, Streptococcus pneumoniae R6
acuuauaguacuaaucuuugcc

SEQ ID NO: 4089870 - RNA, 21 nt, Streptococcus pneumoniae R6
acuuauccuuuuuuacuucau

SEQ ID NO: 4089871 - RNA, 20 nt, Streptococcus pneumoniae R6
acuuaucuagggcauuaauc

SEQ ID NO: 4089872 - RNA, 14 nt, Streptococcus pneumoniae R6
acuuaugaagaaau

SEQ ID NO: 4089873 - RNA, 21 nt, Streptococcus pneumoniae R6
acuucaaauccuuuauuuuca

SEQ ID NO: 4089874 - RNA, 21 nt, Streptococcus pneumoniae R6
acuucaacccacuacaguuga

SEQ ID NO: 4089875 - RNA, 17 nt, Streptococcus pneumoniae R6
acuucaaccuuaccacu

SEQ ID NO: 4089876 - RNA, 17 nt, Streptococcus pneumoniae R6
acuucaagaacuuuaac

SEQ ID NO: 4089877 - RNA, 19 nt, Streptococcus pneumoniae R6
acuucaagaacuuuaacuu

SEQ ID NO: 4089878 - RNA, 16 nt, Streptococcus pneumoniae R6
acuucaauaaaauaua

SEQ ID NO: 4089879 - RNA, 14 nt, Streptococcus pneumoniae R6
acuucaaucauauc

SEQ ID NO: 4089880 - RNA, 23 nt, Streptococcus pneumoniae R6
acuucaauuucuaaugucucugc

SEQ ID NO: 4089881 - RNA, 15 nt, Streptococcus pneumoniae R6
acuucacgagccaag

SEQ ID NO: 4089882 - RNA, 17 nt, Streptococcus pneumoniae R6
acuucacguucuuccaa

SEQ ID NO: 4089883 - RNA, 14 nt, Streptococcus pneumoniae R6
acuucagauucacu

SEQ ID NO: 4089884 - RNA, 15 nt, Streptococcus pneumoniae R6
acuucaggaaaaaau

SEQ ID NO: 4089885 - RNA, 16 nt, Streptococcus pneumoniae R6
acuucaggauuuuuac

SEQ ID NO: 4089886 - RNA, 16 nt, Streptococcus pneumoniae R6
acuuccaagcgaugau

SEQ ID NO: 4089887 - RNA, 19 nt, Streptococcus pneumoniae R6
acuuccacuuccagaagau

SEQ ID NO: 4089888 - RNA, 24 nt, Streptococcus pneumoniae R6
acuucccgauggguuaagugcauu

SEQ ID NO: 4089889 - RNA, 23 nt, Streptococcus pneumoniae R6
acuuccugcaaaacuagaauccu

SEQ ID NO: 4089890 - RNA, 16 nt, Streptococcus pneumoniae R6
acuuccugcaaaucua

SEQ ID NO: 4089891 - RNA, 17 nt, Streptococcus pneumoniae R6
acuuccuguaagaacuu

SEQ ID NO: 4089892 - RNA, 14 nt, Streptococcus pneumoniae R6
acuuccuuaccauc

SEQ ID NO: 4089893 - RNA, 13 nt, Streptococcus pneumoniae R6
acuuccuuuucuu

SEQ ID NO: 4089894 - RNA, 14 nt, Streptococcus pneumoniae R6
acuuccuuuuuaaa

SEQ ID NO: 4089895 - RNA, 18 nt, Streptococcus pneumoniae R6
acuucgauguuacagaca

SEQ ID NO: 4089896 - RNA, 20 nt, Streptococcus pneumoniae R6
acuucgauguuacagacaaa

SEQ ID NO: 4089897 - RNA, 15 nt, Streptococcus pneumoniae R6
acuucgucacauucc

SEQ ID NO: 4089898 - RNA, 20 nt, Streptococcus pneumoniae R6
acuucgucagucuuaucugc

SEQ ID NO: 4089899 - RNA, 16 nt, Streptococcus pneumoniae R6
acuucgucaguuccau

SEQ ID NO: 4089900 - RNA, 16 nt, Streptococcus pneumoniae R6
acuucgucaguucuau

SEQ ID NO: 4089901 - RNA, 13 nt, Streptococcus pneumoniae R6
acuucgucaguuu

SEQ ID NO: 4089902 - RNA, 16 nt, Streptococcus pneumoniae R6
acuucgucaguuucau

SEQ ID NO: 4089903 - RNA, 17 nt, Streptococcus pneumoniae R6
acuucgucaguuucauc

SEQ ID NO: 4089904 - RNA, 21 nt, Streptococcus pneumoniae R6
acuucguucacccuugcuuuu

SEQ ID NO: 4089905 - RNA, 17 nt, Streptococcus pneumoniae R6
acuucuaaaacauuguu

SEQ ID NO: 4089906 - RNA, 22 nt, Streptococcus pneumoniae R6
acuucugaaucugccucaagaa

SEQ ID NO: 4089907 - RNA, 22 nt, Streptococcus pneumoniae R6
acuucugagguuaaaaucuuuu

SEQ ID NO: 4089908 - RNA, 13 nt, Streptococcus pneumoniae R6
acuucugcaauua

SEQ ID NO: 4089909 - RNA, 17 nt, Streptococcus pneumoniae R6
acuucugcuucuaaaac

SEQ ID NO: 4089910 - RNA, 19 nt, Streptococcus pneumoniae R6
acuucugcuucuaaaacau

SEQ ID NO: 4089911 - RNA, 17 nt, Streptococcus pneumoniae R6
acuucugcuugauuaag

SEQ ID NO: 4089912 - RNA, 11 nt, Streptococcus pneumoniae R6
acuucuguaag

SEQ ID NO: 4089913 - RNA, 22 nt, Streptococcus pneumoniae R6
acuucuguaagucauuuucuuu

SEQ ID NO: 4089914 - RNA, 16 nt, Streptococcus pneumoniae R6
acuucuuauuagcaac

SEQ ID NO: 4089915 - RNA, 22 nt, Streptococcus pneumoniae R6
acuucuucauggaucauuucuu

SEQ ID NO: 4089916 - RNA, 13 nt, Streptococcus pneumoniae R6
acuucuuccccag

SEQ ID NO: 4089917 - RNA, 19 nt, Streptococcus pneumoniae R6
acuucuugaccaacuuuaa

SEQ ID NO: 4089918 - RNA, 19 nt, Streptococcus pneumoniae R6
acuucuuuuucuccuaaaa

SEQ ID NO: 4089919 - RNA, 15 nt, Streptococcus pneumoniae R6
acuucuuuuugauuu

SEQ ID NO: 4089920 - RNA, 20 nt, Streptococcus pneumoniae R6
acuucuuuuugauuuaucca

SEQ ID NO: 4089921 - RNA, 22 nt, Streptococcus pneumoniae R6
acuucuuuuuguauuucuucuu

SEQ ID NO: 4089922 - RNA, 12 nt, Streptococcus pneumoniae R6
acuucuuuuuug

SEQ ID NO: 4089923 - RNA, 17 nt, Streptococcus pneumoniae R6
acuucuuuuuugagaug

SEQ ID NO: 4089924 - RNA, 20 nt, Streptococcus pneumoniae R6
acuucuuuuuuugauauuua

SEQ ID NO: 4089925 - RNA, 21 nt, Streptococcus pneumoniae R6
acuugaaaauaccaaguucau

SEQ ID NO: 4089926 - RNA, 12 nt, Streptococcus pneumoniae R6
acuugaaaugau

SEQ ID NO: 4089927 - RNA, 20 nt, Streptococcus pneumoniae R6
acuugaaucuggcuuucaau

SEQ ID NO: 4089928 - RNA, 23 nt, Streptococcus pneumoniae R6
acuugaccuaaaucacuuaguug

SEQ ID NO: 4089929 - RNA, 14 nt, Streptococcus pneumoniae R6
acuugagacuguuu

SEQ ID NO: 4089930 - RNA, 15 nt, Streptococcus pneumoniae R6
acuugagcaaacuga

SEQ ID NO: 4089931 - RNA, 22 nt, Streptococcus pneumoniae R6
acuugagcaaacugaauccgca

SEQ ID NO: 4089932 - RNA, 19 nt, Streptococcus pneumoniae R6
acuugaguaaugaacucag

SEQ ID NO: 4089933 - RNA, 16 nt, Streptococcus pneumoniae R6
acuugauaaaaguuau

SEQ ID NO: 4089934 - RNA, 18 nt, Streptococcus pneumoniae R6
acuugauauuaugcguuu

SEQ ID NO: 4089935 - RNA, 19 nt, Streptococcus pneumoniae R6
acuugaugaaaaaaaguuu

SEQ ID NO: 4089936 - RNA, 18 nt, Streptococcus pneumoniae R6
acuugauuaggauuuuuu

SEQ ID NO: 4089937 - RNA, 22 nt, Streptococcus pneumoniae R6
acuugauuuaugccauauagca

SEQ ID NO: 4089938 - RNA, 17 nt, Streptococcus pneumoniae R6
acuugauuuuugccaua

SEQ ID NO: 4089939 - RNA, 17 nt, Streptococcus pneumoniae R6
acuugcaaaaagacuua

SEQ ID NO: 4089940 - RNA, 22 nt, Streptococcus pneumoniae R6
acuugcaaaaagacuuagcaaa

SEQ ID NO: 4089941 - RNA, 14 nt, Streptococcus pneumoniae R6
acuugcaagaaagu

SEQ ID NO: 4089942 - RNA, 18 nt, Streptococcus pneumoniae R6
acuugcaggaaauuuuuu

SEQ ID NO: 4089943 - RNA, 17 nt, Streptococcus pneumoniae R6
acuugcgaguugugaau

SEQ ID NO: 4089944 - RNA, 20 nt, Streptococcus pneumoniae R6
acuugcuccaaaggagaaga

SEQ ID NO: 4089945 - RNA, 17 nt, Streptococcus pneumoniae R6
acuugggucguaaaccu

SEQ ID NO: 4089946 - RNA, 19 nt, Streptococcus pneumoniae R6
acuugggucguaaaccuuc

SEQ ID NO: 4089947 - RNA, 20 nt, Streptococcus pneumoniae R6
acuuggucgcugaguaaaga

SEQ ID NO: 4089948 - RNA, 14 nt, Streptococcus pneumoniae R6
acuuggugcuauuu

SEQ ID NO: 4089949 - RNA, 21 nt, Streptococcus pneumoniae R6
acuugguguugagaaagcacu

SEQ ID NO: 4089950 - RNA, 22 nt, Streptococcus pneumoniae R6
acuugguguugagaaagcacuu

SEQ ID NO: 4089951 - RNA, 23 nt, Streptococcus pneumoniae R6
acuugguguugagaaagcacuug

SEQ ID NO: 4089952 - RNA, 15 nt, Streptococcus pneumoniae R6
acuugguuacaucaa

SEQ ID NO: 4089953 - RNA, 23 nt, Streptococcus pneumoniae R6
acuuguaaacaucaucugcauua

SEQ ID NO: 4089954 - RNA, 20 nt, Streptococcus pneumoniae R6
acuuguaaagcgaaaggaga

SEQ ID NO: 4089955 - RNA, 14 nt, Streptococcus pneumoniae R6
acuuguauccuccu

SEQ ID NO: 4089956 - RNA, 19 nt, Streptococcus pneumoniae R6
acuugugauuuaguagcau

SEQ ID NO: 4089957 - RNA, 17 nt, Streptococcus pneumoniae R6
acuuguggcaaggagua

SEQ ID NO: 4089958 - RNA, 22 nt, Streptococcus pneumoniae R6
acuuuaaaaauuuuuuucuaau

SEQ ID NO: 4089959 - RNA, 17 nt, Streptococcus pneumoniae R6
acuuuaagauuacgacg

SEQ ID NO: 4089960 - RNA, 14 nt, Streptococcus pneumoniae R6
acuuuacaacacuu

SEQ ID NO: 4089961 - RNA, 14 nt, Streptococcus pneumoniae R6
acuuuaguuccaau

SEQ ID NO: 4089962 - RNA, 20 nt, Streptococcus pneumoniae R6
acuuuaucaccuccuucucc

SEQ ID NO: 4089963 - RNA, 22 nt, Streptococcus pneumoniae R6
acuuuaucaccuccuucuccaa

SEQ ID NO: 4089964 - RNA, 21 nt, Streptococcus pneumoniae R6
acuuuauuuucucaucaaaug

SEQ ID NO: 4089965 - RNA, 15 nt, Streptococcus pneumoniae R6
acuuucauugauggu

SEQ ID NO: 4089966 - RNA, 14 nt, Streptococcus pneumoniae R6
acuuuccugauaga

SEQ ID NO: 4089967 - RNA, 17 nt, Streptococcus pneumoniae R6
acuuucuaauuauuuca

SEQ ID NO: 4089968 - RNA, 18 nt, Streptococcus pneumoniae R6
acuuucuaauuauuucaa

SEQ ID NO: 4089969 - RNA, 22 nt, Streptococcus pneumoniae R6
acuuucuaauuauuucaauuag

SEQ ID NO: 4089970 - RNA, 20 nt, Streptococcus pneumoniae R6
acuuucuagggcacuauggg

SEQ ID NO: 4089971 - RNA, 20 nt, Streptococcus pneumoniae R6
acuuucucacgaauaaccaa

SEQ ID NO: 4089972 - RNA, 18 nt, Streptococcus pneumoniae R6
acuuucucugacuuuucc

SEQ ID NO: 4089973 - RNA, 21 nt, Streptococcus pneumoniae R6
acuuucuucgaaauuccauac

SEQ ID NO: 4089974 - RNA, 21 nt, Streptococcus pneumoniae R6
acuuugauuuuaaagaaauag

SEQ ID NO: 4089975 - RNA, 20 nt, Streptococcus pneumoniae R6
acuuugguuauaaaaaacaa

SEQ ID NO: 4089976 - RNA, 21 nt, Streptococcus pneumoniae R6
acuuugguuauaaaaaacaaa

SEQ ID NO: 4089977 - RNA, 16 nt, Streptococcus pneumoniae R6
acuuuuaagaaaucau

SEQ ID NO: 4089978 - RNA, 13 nt, Streptococcus pneumoniae R6
acuuuuaaugaga

SEQ ID NO: 4089979 - RNA, 20 nt, Streptococcus pneumoniae R6
acuuuuccaauagauaauuu

SEQ ID NO: 4089980 - RNA, 19 nt, Streptococcus pneumoniae R6
acuuuuccaguaauuuccc

SEQ ID NO: 4089981 - RNA, 16 nt, Streptococcus pneumoniae R6
acuuuuccauuguuuu

SEQ ID NO: 4089982 - RNA, 22 nt, Streptococcus pneumoniae R6
acuuuuccuguuguauuuauau

SEQ ID NO: 4089983 - RNA, 18 nt, Streptococcus pneumoniae R6
acuuuucuaagaugauuu

SEQ ID NO: 4089984 - RNA, 22 nt, Streptococcus pneumoniae R6
acuuuucuaagaugauuuuucu

SEQ ID NO: 4089985 - RNA, 12 nt, Streptococcus pneumoniae R6
acuuuugaaaaa

SEQ ID NO: 4089986 - RNA, 13 nt, Streptococcus pneumoniae R6
acuuuugaaaaaa

SEQ ID NO: 4089987 - RNA, 19 nt, Streptococcus pneumoniae R6
acuuuugaaaaaaauguca

SEQ ID NO: 4089988 - RNA, 19 nt, Streptococcus pneumoniae R6
acuuuuguccuauucuugu

SEQ ID NO: 4089989 - RNA, 13 nt, Streptococcus pneumoniae R6
acuuuuuaaaaaa

SEQ ID NO: 4089990 - RNA, 12 nt, Streptococcus pneumoniae R6
acuuuuuaaagu

SEQ ID NO: 4089991 - RNA, 23 nt, Streptococcus pneumoniae R6
acuuuuuaaguuuuuugauuucu

SEQ ID NO: 4089992 - RNA, 18 nt, Streptococcus pneumoniae R6
acuuuuuauuacaucuau

SEQ ID NO: 4089993 - RNA, 15 nt, Streptococcus pneumoniae R6
acuuuuucaaaguuu

SEQ ID NO: 4089994 - RNA, 16 nt, Streptococcus pneumoniae R6
acuuuuuccaaaucuu

SEQ ID NO: 4089995 - RNA, 18 nt, Streptococcus pneumoniae R6
acuuuuucuuccuuucuc

SEQ ID NO: 4089996 - RNA, 22 nt, Streptococcus pneumoniae R6
acuuuuucuuccuuucucugug

SEQ ID NO: 4089997 - RNA, 16 nt, Streptococcus pneumoniae R6
acuuuuuuaccuguac

SEQ ID NO: 4089998 - RNA, 20 nt, Streptococcus pneumoniae R6
acuuuuuuaugauuaacuau

SEQ ID NO: 4089999 - RNA, 13 nt, Streptococcus pneumoniae R6
acuuuuuuucuuc

SEQ ID NO: 4090000 - RNA, 13 nt, Streptococcus pneumoniae R6
agaaaaaaauuuu

SEQ ID NO: 4090001 - RNA, 17 nt, Streptococcus pneumoniae R6
agaaaaacucuuguccu

SEQ ID NO: 4090002 - RNA, 12 nt, Streptococcus pneumoniae R6
agaaaaagaagg

SEQ ID NO: 4090003 - RNA, 14 nt, Streptococcus pneumoniae R6
agaaaaagccucca

SEQ ID NO: 4090004 - RNA, 18 nt, Streptococcus pneumoniae R6
agaaaaagucaauaauau

SEQ ID NO: 4090005 - RNA, 13 nt, Streptococcus pneumoniae R6
agaaaaaguucaa

SEQ ID NO: 4090006 - RNA, 17 nt, Streptococcus pneumoniae R6
agaaaaaguucucuuuc

SEQ ID NO: 4090007 - RNA, 13 nt, Streptococcus pneumoniae R6
agaaaaaugcaaa

SEQ ID NO: 4090008 - RNA, 13 nt, Streptococcus pneumoniae R6
agaaaaauuucau

SEQ ID NO: 4090009 - RNA, 12 nt, Streptococcus pneumoniae R6
agaaaacaacuu

SEQ ID NO: 4090010 - RNA, 14 nt, Streptococcus pneumoniae R6
agaaaacaacuuau

SEQ ID NO: 4090011 - RNA, 14 nt, Streptococcus pneumoniae R6
agaaaacagaaaaa

SEQ ID NO: 4090012 - RNA, 15 nt, Streptococcus pneumoniae R6
agaaaacagaaaaau

SEQ ID NO: 4090013 - RNA, 13 nt, Streptococcus pneumoniae R6
agaaaaccaaaac

SEQ ID NO: 4090014 - RNA, 16 nt, Streptococcus pneumoniae R6
agaaaaccaaaacuca

SEQ ID NO: 4090015 - RNA, 16 nt, Streptococcus pneumoniae R6
agaaaacuaguuuaaa

SEQ ID NO: 4090016 - RNA, 19 nt, Streptococcus pneumoniae R6
agaaaacuaguuuaaauca

SEQ ID NO: 4090017 - RNA, 14 nt, Streptococcus pneumoniae R6
agaaaagagcauau

SEQ ID NO: 4090018 - RNA, 21 nt, Streptococcus pneumoniae R6
agaaaagcccuucauaagcua

SEQ ID NO: 4090019 - RNA, 19 nt, Streptococcus pneumoniae R6
agaaaagggugacuucgca

SEQ ID NO: 4090020 - RNA, 17 nt, Streptococcus pneumoniae R6
agaaaagucacuggaaa

SEQ ID NO: 4090021 - RNA, 18 nt, Streptococcus pneumoniae R6
agaaaagugcaaauaaga

SEQ ID NO: 4090022 - RNA, 21 nt, Streptococcus pneumoniae R6
agaaaagugcaaauaagaaau

SEQ ID NO: 4090023 - RNA, 14 nt, Streptococcus pneumoniae R6
agaaaauaaaauuc

SEQ ID NO: 4090024 - RNA, 16 nt, Streptococcus pneumoniae R6
agaaaauaaaauuccu

SEQ ID NO: 4090025 - RNA, 15 nt, Streptococcus pneumoniae R6
agaaaauaaaguaaa

SEQ ID NO: 4090026 - RNA, 18 nt, Streptococcus pneumoniae R6
agaaaauaaaguaaaaau

SEQ ID NO: 4090027 - RNA, 13 nt, Streptococcus pneumoniae R6
agaaaaucaagua

SEQ ID NO: 4090028 - RNA, 14 nt, Streptococcus pneumoniae R6
agaaaaucucuuca

SEQ ID NO: 4090029 - RNA, 21 nt, Streptococcus pneumoniae R6
agaaaaucucuucaaaccaug

SEQ ID NO: 4090030 - RNA, 13 nt, Streptococcus pneumoniae R6
agaaaaugaaaua

SEQ ID NO: 4090031 - RNA, 16 nt, Streptococcus pneumoniae R6
agaaaaugaggaaaau

SEQ ID NO: 4090032 - RNA, 18 nt, Streptococcus pneumoniae R6
agaaaauucaaauuaauu

SEQ ID NO: 4090033 - RNA, 15 nt, Streptococcus pneumoniae R6
agaaacaacaaugga

SEQ ID NO: 4090034 - RNA, 17 nt, Streptococcus pneumoniae R6
agaaacaacaauggaaa

SEQ ID NO: 4090035 - RNA, 21 nt, Streptococcus pneumoniae R6
agaaacaacaauggaaaugau

SEQ ID NO: 4090036 - RNA, 17 nt, Streptococcus pneumoniae R6
agaaacaauaaaaucaa

SEQ ID NO: 4090037 - RNA, 18 nt, Streptococcus pneumoniae R6
agaaacaauaaaaucaaa

SEQ ID NO: 4090038 - RNA, 18 nt, Streptococcus pneumoniae R6
agaaacacauuuuuagaa

SEQ ID NO: 4090039 - RNA, 14 nt, Streptococcus pneumoniae R6
agaaacagcuccug

SEQ ID NO: 4090040 - RNA, 19 nt, Streptococcus pneumoniae R6
agaaacaucuuauuaucaa

SEQ ID NO: 4090041 - RNA, 17 nt, Streptococcus pneumoniae R6
agaaaccaaucagacua

SEQ ID NO: 4090042 - RNA, 17 nt, Streptococcus pneumoniae R6
agaaaccgucaucagca

SEQ ID NO: 4090043 - RNA, 16 nt, Streptococcus pneumoniae R6
agaaacgacggucaug

SEQ ID NO: 4090044 - RNA, 18 nt, Streptococcus pneumoniae R6
agaaacgacggucaugcg

SEQ ID NO: 4090045 - RNA, 21 nt, Streptococcus pneumoniae R6
agaaacgacggucaugcgaaa

SEQ ID NO: 4090046 - RNA, 22 nt, Streptococcus pneumoniae R6
agaaacgccuuguagaugaaaa

SEQ ID NO: 4090047 - RNA, 21 nt, Streptococcus pneumoniae R6
agaaacguccaaggcugaaau

SEQ ID NO: 4090048 - RNA, 18 nt, Streptococcus pneumoniae R6
agaaacguuguuaaauca

SEQ ID NO: 4090049 - RNA, 19 nt, Streptococcus pneumoniae R6
agaaacguuguuaaaucaa

SEQ ID NO: 4090050 - RNA, 16 nt, Streptococcus pneumoniae R6
agaaacuagaaguggu

SEQ ID NO: 4090051 - RNA, 15 nt, Streptococcus pneumoniae R6
agaaacucuaaacaa

SEQ ID NO: 4090052 - RNA, 13 nt, Streptococcus pneumoniae R6
agaaacucuaaau

SEQ ID NO: 4090053 - RNA, 13 nt, Streptococcus pneumoniae R6
agaaacucuucua

SEQ ID NO: 4090054 - RNA, 20 nt, Streptococcus pneumoniae R6
agaaacuuagcgaaauucca

SEQ ID NO: 4090055 - RNA, 13 nt, Streptococcus pneumoniae R6
agaaagaaaaacu

SEQ ID NO: 4090056 - RNA, 15 nt, Streptococcus pneumoniae R6
agaaagaacaaaaaa

SEQ ID NO: 4090057 - RNA, 24 nt, Streptococcus pneumoniae R6
agaaagacuugaccggagaaagaa

SEQ ID NO: 4090058 - RNA, 18 nt, Streptococcus pneumoniae R6
agaaagcaaggcuuugug

SEQ ID NO: 4090059 - RNA, 16 nt, Streptococcus pneumoniae R6
agaaagcgaagaucua

SEQ ID NO: 4090060 - RNA, 14 nt, Streptococcus pneumoniae R6
agaaagcuagucgc

SEQ ID NO: 4090061 - RNA, 20 nt, Streptococcus pneumoniae R6
agaaagcugauagaggaguu

SEQ ID NO: 4090062 - RNA, 14 nt, Streptococcus pneumoniae R6
agaaaggacaaauu

SEQ ID NO: 4090063 - RNA, 23 nt, Streptococcus pneumoniae R6
agaaaggagcacaguagauuccu

SEQ ID NO: 4090064 - RNA, 16 nt, Streptococcus pneumoniae R6
agaaaggcgacaucau

SEQ ID NO: 4090065 - RNA, 16 nt, Streptococcus pneumoniae R6
agaaagguaacuccuu

SEQ ID NO: 4090066 - RNA, 14 nt, Streptococcus pneumoniae R6
agaaagguuuuaaa

SEQ ID NO: 4090067 - RNA, 15 nt, Streptococcus pneumoniae R6
agaaagguuuuaaag

SEQ ID NO: 4090068 - RNA, 17 nt, Streptococcus pneumoniae R6
agaaagguuuuaaagac

SEQ ID NO: 4090069 - RNA, 19 nt, Streptococcus pneumoniae R6
agaaaguagaguccaaaga

SEQ ID NO: 4090070 - RNA, 23 nt, Streptococcus pneumoniae R6
agaaaguagaguccaaagaccau

SEQ ID NO: 4090071 - RNA, 21 nt, Streptococcus pneumoniae R6
agaaaguggucguuuuucaug

SEQ ID NO: 4090072 - RNA, 21 nt, Streptococcus pneumoniae R6
agaaauaauauccgauagcau

SEQ ID NO: 4090073 - RNA, 22 nt, Streptococcus pneumoniae R6
agaaauagcagagacauuagaa

SEQ ID NO: 4090074 - RNA, 20 nt, Streptococcus pneumoniae R6
agaaauaguuuagauaaaac

SEQ ID NO: 4090075 - RNA, 11 nt, Streptococcus pneumoniae R6
agaaauauuua

SEQ ID NO: 4090076 - RNA, 16 nt, Streptococcus pneumoniae R6
agaaauauuuacuuca

SEQ ID NO: 4090077 - RNA, 14 nt, Streptococcus pneumoniae R6
agaaaucaaaaagc

SEQ ID NO: 4090078 - RNA, 16 nt, Streptococcus pneumoniae R6
agaaaucaauuugacu

SEQ ID NO: 4090079 - RNA, 22 nt, Streptococcus pneumoniae R6
agaaaucaauuugacuguccuu

SEQ ID NO: 4090080 - RNA, 17 nt, Streptococcus pneumoniae R6
agaaaucacaauuccua

SEQ ID NO: 4090081 - RNA, 23 nt, Streptococcus pneumoniae R6
agaaaucacaauuccuaagauau

SEQ ID NO: 4090082 - RNA, 15 nt, Streptococcus pneumoniae R6
agaaaucauacaccu

SEQ ID NO: 4090083 - RNA, 22 nt, Streptococcus pneumoniae R6
agaaaucauuggauacaaggag

SEQ ID NO: 4090084 - RNA, 19 nt, Streptococcus pneumoniae R6
agaaaucgauuugacuguc

SEQ ID NO: 4090085 - RNA, 13 nt, Streptococcus pneumoniae R6
agaaaucucuuuu

SEQ ID NO: 4090086 - RNA, 18 nt, Streptococcus pneumoniae R6
agaaaucucuuuuuucuc

SEQ ID NO: 4090087 - RNA, 15 nt, Streptococcus pneumoniae R6
agaaaugaguaagaa

SEQ ID NO: 4090088 - RNA, 22 nt, Streptococcus pneumoniae R6
agaaaugccgauucccaaacuu

SEQ ID NO: 4090089 - RNA, 22 nt, Streptococcus pneumoniae R6
agaaaugcgccaccaacugcac

SEQ ID NO: 4090090 - RNA, 19 nt, Streptococcus pneumoniae R6
agaaauggaaguuucaaaa

SEQ ID NO: 4090091 - RNA, 21 nt, Streptococcus pneumoniae R6
agaaauggucggcauucuucu

SEQ ID NO: 4090092 - RNA, 23 nt, Streptococcus pneumoniae R6
agaaauuaauuugaauuuucuaa

SEQ ID NO: 4090093 - RNA, 23 nt, Streptococcus pneumoniae R6
agaaauuaauuugacuuuucuaa

SEQ ID NO: 4090094 - RNA, 10 nt, Streptococcus pneumoniae R6
agaaauuccu

SEQ ID NO: 4090095 - RNA, 14 nt, Streptococcus pneumoniae R6
agaaauugacugga

SEQ ID NO: 4090096 - RNA, 19 nt, Streptococcus pneumoniae R6
agaaauuuaugcuauauau

SEQ ID NO: 4090097 - RNA, 14 nt, Streptococcus pneumoniae R6
agaaauuucugaaa

SEQ ID NO: 4090098 - RNA, 14 nt, Streptococcus pneumoniae R6
agaaauuuucuuuu

SEQ ID NO: 4090099 - RNA, 21 nt, Streptococcus pneumoniae R6
agaacaaguaaagagucaaga

SEQ ID NO: 4090100 - RNA, 23 nt, Streptococcus pneumoniae R6
agaacaaugacucccauaaaaau

SEQ ID NO: 4090101 - RNA, 22 nt, Streptococcus pneumoniae R6
agaacaccuagcgccuguucua

SEQ ID NO: 4090102 - RNA, 15 nt, Streptococcus pneumoniae R6
agaacacuuccaaua

SEQ ID NO: 4090103 - RNA, 17 nt, Streptococcus pneumoniae R6
agaacagucaggauagu

SEQ ID NO: 4090104 - RNA, 18 nt, Streptococcus pneumoniae R6
agaacaucuacaauugaa

SEQ ID NO: 4090105 - RNA, 20 nt, Streptococcus pneumoniae R6
agaacaucuacaauugaaac

SEQ ID NO: 4090106 - RNA, 20 nt, Streptococcus pneumoniae R6
agaacauuacccauagauuu

SEQ ID NO: 4090107 - RNA, 23 nt, Streptococcus pneumoniae R6
agaacauuacccauagauuuuua

SEQ ID NO: 4090108 - RNA, 18 nt, Streptococcus pneumoniae R6
agaaccaagaucuugucu

SEQ ID NO: 4090109 - RNA, 14 nt, Streptococcus pneumoniae R6
agaaccaauaugua

SEQ ID NO: 4090110 - RNA, 18 nt, Streptococcus pneumoniae R6
agaaccccgauaacagcc

SEQ ID NO: 4090111 - RNA, 22 nt, Streptococcus pneumoniae R6
agaaccgauacgaugaccaaga

SEQ ID NO: 4090112 - RNA, 22 nt, Streptococcus pneumoniae R6
agaaccucuguauaaauagcua

SEQ ID NO: 4090113 - RNA, 13 nt, Streptococcus pneumoniae R6
agaaccugcaguu

SEQ ID NO: 4090114 - RNA, 19 nt, Streptococcus pneumoniae R6
agaaccugguuccuuuuua

SEQ ID NO: 4090115 - RNA, 22 nt, Streptococcus pneumoniae R6
agaaccuuggaaauaacggucg

SEQ ID NO: 4090116 - RNA, 15 nt, Streptococcus pneumoniae R6
agaaccuuugagaaa

SEQ ID NO: 4090117 - RNA, 17 nt, Streptococcus pneumoniae R6
agaacgauaaacaaggg

SEQ ID NO: 4090118 - RNA, 15 nt, Streptococcus pneumoniae R6
agaacgauuuuagau

SEQ ID NO: 4090119 - RNA, 15 nt, Streptococcus pneumoniae R6
agaacgguaucuguu

SEQ ID NO: 4090120 - RNA, 14 nt, Streptococcus pneumoniae R6
agaacuaguaaauu

SEQ ID NO: 4090121 - RNA, 17 nt, Streptococcus pneumoniae R6
agaacuccagauuaucu

SEQ ID NO: 4090122 - RNA, 21 nt, Streptococcus pneumoniae R6
agaacuccagauuaucuuccu

SEQ ID NO: 4090123 - RNA, 22 nt, Streptococcus pneumoniae R6
agaacucccuguuccaaagaag

SEQ ID NO: 4090124 - RNA, 17 nt, Streptococcus pneumoniae R6
agaacugacgaagucag

SEQ ID NO: 4090125 - RNA, 22 nt, Streptococcus pneumoniae R6
agaacuuuaguuugaguugcgu

SEQ ID NO: 4090126 - RNA, 20 nt, Streptococcus pneumoniae R6
agaacuuucuuuuuuuccau

SEQ ID NO: 4090127 - RNA, 13 nt, Streptococcus pneumoniae R6
agaacuuuuuaaa

SEQ ID NO: 4090128 - RNA, 14 nt, Streptococcus pneumoniae R6
agaagaagugacag

SEQ ID NO: 4090129 - RNA, 19 nt, Streptococcus pneumoniae R6
agaagacgccuaguacauu

SEQ ID NO: 4090130 - RNA, 21 nt, Streptococcus pneumoniae R6
agaagaggcugugguccuugu

SEQ ID NO: 4090131 - RNA, 23 nt, Streptococcus pneumoniae R6
agaagaggcugugguccuuguag

SEQ ID NO: 4090132 - RNA, 20 nt, Streptococcus pneumoniae R6
agaagagucagcucuuuuuu

SEQ ID NO: 4090133 - RNA, 23 nt, Streptococcus pneumoniae R6
agaagaucaauagugagacaagc

SEQ ID NO: 4090134 - RNA, 21 nt, Streptococcus pneumoniae R6
agaagauuggucaaucuuauc

SEQ ID NO: 4090135 - RNA, 15 nt, Streptococcus pneumoniae R6
agaagcaagugacaa

SEQ ID NO: 4090136 - RNA, 23 nt, Streptococcus pneumoniae R6
agaagcaccaguugcagucgcau

SEQ ID NO: 4090137 - RNA, 17 nt, Streptococcus pneumoniae R6
agaagcagaaaaauuuc

SEQ ID NO: 4090138 - RNA, 22 nt, Streptococcus pneumoniae R6
agaagcaggguuaguugguuau

SEQ ID NO: 4090139 - RNA, 15 nt, Streptococcus pneumoniae R6
agaagcauagaggga

SEQ ID NO: 4090140 - RNA, 13 nt, Streptococcus pneumoniae R6
agaagccaaaauc

SEQ ID NO: 4090141 - RNA, 18 nt, Streptococcus pneumoniae R6
agaagccugauggaaaca

SEQ ID NO: 4090142 - RNA, 19 nt, Streptococcus pneumoniae R6
agaagcuuuaccauccuga

SEQ ID NO: 4090143 - RNA, 21 nt, Streptococcus pneumoniae R6
agaaggacuugauauaaauga

SEQ ID NO: 4090144 - RNA, 16 nt, Streptococcus pneumoniae R6
agaaggauugagaagc

SEQ ID NO: 4090145 - RNA, 20 nt, Streptococcus pneumoniae R6
agaaggcugguugaaaaccu

SEQ ID NO: 4090146 - RNA, 20 nt, Streptococcus pneumoniae R6
agaaguagauacgcucagca

SEQ ID NO: 4090147 - RNA, 19 nt, Streptococcus pneumoniae R6
agaagucaccauaaaucuu

SEQ ID NO: 4090148 - RNA, 23 nt, Streptococcus pneumoniae R6
agaaguccauagcgucaaagaag

SEQ ID NO: 4090149 - RNA, 20 nt, Streptococcus pneumoniae R6
agaagucgguacuuaaacgu

SEQ ID NO: 4090150 - RNA, 17 nt, Streptococcus pneumoniae R6
agaagugacagucgcaa

SEQ ID NO: 4090151 - RNA, 21 nt, Streptococcus pneumoniae R6
agaagugacagucgcaaagag

SEQ ID NO: 4090152 - RNA, 19 nt, Streptococcus pneumoniae R6
agaagugguuuaaagucua

SEQ ID NO: 4090153 - RNA, 16 nt, Streptococcus pneumoniae R6
agaaguugucugucuu

SEQ ID NO: 4090154 - RNA, 21 nt, Streptococcus pneumoniae R6
agaauaagggauucgaacccu

SEQ ID NO: 4090155 - RNA, 13 nt, Streptococcus pneumoniae R6
agaauaauuaaau

SEQ ID NO: 4090156 - RNA, 20 nt, Streptococcus pneumoniae R6
agaauagagggauucuccau

SEQ ID NO: 4090157 - RNA, 16 nt, Streptococcus pneumoniae R6
agaauaguacacuucu

SEQ ID NO: 4090158 - RNA, 17 nt, Streptococcus pneumoniae R6
agaauaguacacuucua

SEQ ID NO: 4090159 - RNA, 20 nt, Streptococcus pneumoniae R6
agaauaguacacuucugcuu

SEQ ID NO: 4090160 - RNA, 13 nt, Streptococcus pneumoniae R6
agaauaucaagau

SEQ ID NO: 4090161 - RNA, 15 nt, Streptococcus pneumoniae R6
agaauaucaagauaa

SEQ ID NO: 4090162 - RNA, 17 nt, Streptococcus pneumoniae R6
agaauauccauaccugc

SEQ ID NO: 4090163 - RNA, 22 nt, Streptococcus pneumoniae R6
agaauauuuacuucauuuuugc

SEQ ID NO: 4090164 - RNA, 18 nt, Streptococcus pneumoniae R6
agaaucaauagaagugga

SEQ ID NO: 4090165 - RNA, 16 nt, Streptococcus pneumoniae R6
agaaucccaaagaagg

SEQ ID NO: 4090166 - RNA, 16 nt, Streptococcus pneumoniae R6
agaauccuaguucaug

SEQ ID NO: 4090167 - RNA, 17 nt, Streptococcus pneumoniae R6
agaauccugccaauggu

SEQ ID NO: 4090168 - RNA, 18 nt, Streptococcus pneumoniae R6
agaaucgugaguuccugu

SEQ ID NO: 4090169 - RNA, 12 nt, Streptococcus pneumoniae R6
agaaugaacauc

SEQ ID NO: 4090170 - RNA, 13 nt, Streptococcus pneumoniae R6
agaaugaacaugu

SEQ ID NO: 4090171 - RNA, 21 nt, Streptococcus pneumoniae R6
agaaugauaugggauuuucau

SEQ ID NO: 4090172 - RNA, 22 nt, Streptococcus pneumoniae R6
agaaugcuugcgacaaaaagag

SEQ ID NO: 4090173 - RNA, 20 nt, Streptococcus pneumoniae R6
agaauggcggcauucaagag

SEQ ID NO: 4090174 - RNA, 17 nt, Streptococcus pneumoniae R6
agaaugggcucccacuu

SEQ ID NO: 4090175 - RNA, 18 nt, Streptococcus pneumoniae R6
agaauggguuaaaauuuu

SEQ ID NO: 4090176 - RNA, 14 nt, Streptococcus pneumoniae R6
agaauguccauaac

SEQ ID NO: 4090177 - RNA, 14 nt, Streptococcus pneumoniae R6
agaaugucuuccaa

SEQ ID NO: 4090178 - RNA, 16 nt, Streptococcus pneumoniae R6
agaauuaagauaaaac

SEQ ID NO: 4090179 - RNA, 21 nt, Streptococcus pneumoniae R6
agaauucagcuuuguucacuu

SEQ ID NO: 4090180 - RNA, 14 nt, Streptococcus pneumoniae R6
agaauugaaagucu

SEQ ID NO: 4090181 - RNA, 18 nt, Streptococcus pneumoniae R6
agaauugcuuuaaucugc

SEQ ID NO: 4090182 - RNA, 20 nt, Streptococcus pneumoniae R6
agaauugcuuuaaucugcuu

SEQ ID NO: 4090183 - RNA, 22 nt, Streptococcus pneumoniae R6
agaauuggcuaaagaguugggu

SEQ ID NO: 4090184 - RNA, 14 nt, Streptococcus pneumoniae R6
agaauuuaacucuu

SEQ ID NO: 4090185 - RNA, 16 nt, Streptococcus pneumoniae R6
agaauuuaacucuuuu

SEQ ID NO: 4090186 - RNA, 21 nt, Streptococcus pneumoniae R6
agaauuuuccggcucuuuguc

SEQ ID NO: 4090187 - RNA, 20 nt, Streptococcus pneumoniae R6
agaauuuucuuacuuccuuu

SEQ ID NO: 4090188 - RNA, 14 nt, Streptococcus pneumoniae R6
agacaaaaaaaaca

SEQ ID NO: 4090189 - RNA, 15 nt, Streptococcus pneumoniae R6
agacaaaaaaaacac

SEQ ID NO: 4090190 - RNA, 12 nt, Streptococcus pneumoniae R6
agacaaaucauu

SEQ ID NO: 4090191 - RNA, 19 nt, Streptococcus pneumoniae R6
agacaacuccuugaaucau

SEQ ID NO: 4090192 - RNA, 16 nt, Streptococcus pneumoniae R6
agacaauuuucaucca

SEQ ID NO: 4090193 - RNA, 15 nt, Streptococcus pneumoniae R6
agacacuaagaagac

SEQ ID NO: 4090194 - RNA, 19 nt, Streptococcus pneumoniae R6
agacacucaacaagcugua

SEQ ID NO: 4090195 - RNA, 21 nt, Streptococcus pneumoniae R6
agacacuugacuagcaaugua

SEQ ID NO: 4090196 - RNA, 21 nt, Streptococcus pneumoniae R6
agacagauuugacguuuccuu

SEQ ID NO: 4090197 - RNA, 12 nt, Streptococcus pneumoniae R6
agacagcaccaa

SEQ ID NO: 4090198 - RNA, 14 nt, Streptococcus pneumoniae R6
agacagcaccaacu

SEQ ID NO: 4090199 - RNA, 17 nt, Streptococcus pneumoniae R6
agacagcuuguugcuuu

SEQ ID NO: 4090200 - RNA, 21 nt, Streptococcus pneumoniae R6
agacagcuuguugcuuuucuu

SEQ ID NO: 4090201 - RNA, 16 nt, Streptococcus pneumoniae R6
agacagggccuuagca

SEQ ID NO: 4090202 - RNA, 21 nt, Streptococcus pneumoniae R6
agacaggucaauggcaaaaaa

SEQ ID NO: 4090203 - RNA, 15 nt, Streptococcus pneumoniae R6
agacagguuucacau

SEQ ID NO: 4090204 - RNA, 17 nt, Streptococcus pneumoniae R6
agacagucugaaaaaua

SEQ ID NO: 4090205 - RNA, 16 nt, Streptococcus pneumoniae R6
agacagugaaaucaua

SEQ ID NO: 4090206 - RNA, 20 nt, Streptococcus pneumoniae R6
agacagugaaaucauacugc

SEQ ID NO: 4090207 - RNA, 15 nt, Streptococcus pneumoniae R6
agacauaaucaagau

SEQ ID NO: 4090208 - RNA, 12 nt, Streptococcus pneumoniae R6
agacauaucuuu

SEQ ID NO: 4090209 - RNA, 23 nt, Streptococcus pneumoniae R6
agacaucagaugacaaaacguuc

SEQ ID NO: 4090210 - RNA, 16 nt, Streptococcus pneumoniae R6
agacaucauauaaaua

SEQ ID NO: 4090211 - RNA, 19 nt, Streptococcus pneumoniae R6
agacaucgauagauuuuuc

SEQ ID NO: 4090212 - RNA, 19 nt, Streptococcus pneumoniae R6
agacauuucacgcgcauuc

SEQ ID NO: 4090213 - RNA, 12 nt, Streptococcus pneumoniae R6
agaccaaagaaa

SEQ ID NO: 4090214 - RNA, 13 nt, Streptococcus pneumoniae R6
agaccaagaacuc

SEQ ID NO: 4090215 - RNA, 23 nt, Streptococcus pneumoniae R6
agaccaaguucuuuucauaaaga

SEQ ID NO: 4090216 - RNA, 15 nt, Streptococcus pneumoniae R6
agaccaguuucuucu

SEQ ID NO: 4090217 - RNA, 22 nt, Streptococcus pneumoniae R6
agaccauggcgugggucaucaa

SEQ ID NO: 4090218 - RNA, 18 nt, Streptococcus pneumoniae R6
agacccuauauuucaaga

SEQ ID NO: 4090219 - RNA, 16 nt, Streptococcus pneumoniae R6
agaccgagaaacaaga

SEQ ID NO: 4090220 - RNA, 20 nt, Streptococcus pneumoniae R6
agaccguagguauaaaccac

SEQ ID NO: 4090221 - RNA, 19 nt, Streptococcus pneumoniae R6
agaccucaauaugcucacu

SEQ ID NO: 4090222 - RNA, 15 nt, Streptococcus pneumoniae R6
agaccugccaugcug

SEQ ID NO: 4090223 - RNA, 15 nt, Streptococcus pneumoniae R6
agaccuguauucauu

SEQ ID NO: 4090224 - RNA, 18 nt, Streptococcus pneumoniae R6
agaccuuucauaaaguuu

SEQ ID NO: 4090225 - RNA, 23 nt, Streptococcus pneumoniae R6
agaccuuucauaaaguuuucuga

SEQ ID NO: 4090226 - RNA, 21 nt, Streptococcus pneumoniae R6
agacgaaucggucugaguuuu

SEQ ID NO: 4090227 - RNA, 20 nt, Streptococcus pneumoniae R6
agacgacgggcuaauugaca

SEQ ID NO: 4090228 - RNA, 22 nt, Streptococcus pneumoniae R6
agacgauuaaauaguucuucca

SEQ ID NO: 4090229 - RNA, 13 nt, Streptococcus pneumoniae R6
agacuaacuucuu

SEQ ID NO: 4090230 - RNA, 21 nt, Streptococcus pneumoniae R6
agacuaacuucuuauuagcaa

SEQ ID NO: 4090231 - RNA, 18 nt, Streptococcus pneumoniae R6
agacuaaguuagaauaag

SEQ ID NO: 4090232 - RNA, 22 nt, Streptococcus pneumoniae R6
agacuacuuccguaaucuuguu

SEQ ID NO: 4090233 - RNA, 16 nt, Streptococcus pneumoniae R6
agacuagcacaaugcu

SEQ ID NO: 4090234 - RNA, 19 nt, Streptococcus pneumoniae R6
agacuaggcuuguucacuu

SEQ ID NO: 4090235 - RNA, 17 nt, Streptococcus pneumoniae R6
agacuaggugagcauca

SEQ ID NO: 4090236 - RNA, 23 nt, Streptococcus pneumoniae R6
agacuagguuagucaaaaagaag

SEQ ID NO: 4090237 - RNA, 22 nt, Streptococcus pneumoniae R6
agacuauauugauuauuacaac

SEQ ID NO: 4090238 - RNA, 23 nt, Streptococcus pneumoniae R6
agacuauauugauuauuacaaca

SEQ ID NO: 4090239 - RNA, 17 nt, Streptococcus pneumoniae R6
agacuauucuguagaau

SEQ ID NO: 4090240 - RNA, 19 nt, Streptococcus pneumoniae R6
agacucauuuaaaauuaaa

SEQ ID NO: 4090241 - RNA, 16 nt, Streptococcus pneumoniae R6
agacugaaucugaaau

SEQ ID NO: 4090242 - RNA, 21 nt, Streptococcus pneumoniae R6
agacugacgaagucagcucaa

SEQ ID NO: 4090243 - RNA, 21 nt, Streptococcus pneumoniae R6
agacugacuagaugauuacuc

SEQ ID NO: 4090244 - RNA, 19 nt, Streptococcus pneumoniae R6
agacuggguaacaauucca

SEQ ID NO: 4090245 - RNA, 17 nt, Streptococcus pneumoniae R6
agacuggugugauuuuc

SEQ ID NO: 4090246 - RNA, 18 nt, Streptococcus pneumoniae R6
agacugguucucucuuuu

SEQ ID NO: 4090247 - RNA, 15 nt, Streptococcus pneumoniae R6
agacuguuaccacuu

SEQ ID NO: 4090248 - RNA, 20 nt, Streptococcus pneumoniae R6
agacuuagucuucuuuucuu

SEQ ID NO: 4090249 - RNA, 21 nt, Streptococcus pneumoniae R6
agacuuagucuucuuuucuuu

SEQ ID NO: 4090250 - RNA, 23 nt, Streptococcus pneumoniae R6
agacuugcccaucacgaccaaug

SEQ ID NO: 4090251 - RNA, 21 nt, Streptococcus pneumoniae R6
agacuuggaacaguccuuguu

SEQ ID NO: 4090252 - RNA, 21 nt, Streptococcus pneumoniae R6
agacuuucucacgaauaacca

SEQ ID NO: 4090253 - RNA, 20 nt, Streptococcus pneumoniae R6
agacuuugguauuacuuacc

SEQ ID NO: 4090254 - RNA, 14 nt, Streptococcus pneumoniae R6
agacuuuuuuccag

SEQ ID NO: 4090255 - RNA, 13 nt, Streptococcus pneumoniae R6
agacuuuuuucua

SEQ ID NO: 4090256 - RNA, 14 nt, Streptococcus pneumoniae R6
agagaaaaccaaaa

SEQ ID NO: 4090257 - RNA, 13 nt, Streptococcus pneumoniae R6
agagaaagaaaaa

SEQ ID NO: 4090258 - RNA, 14 nt, Streptococcus pneumoniae R6
agagaaagaaaaac

SEQ ID NO: 4090259 - RNA, 15 nt, Streptococcus pneumoniae R6
agagaaagaaaacaa

SEQ ID NO: 4090260 - RNA, 21 nt, Streptococcus pneumoniae R6
agagaaagucagcugggcuaa

SEQ ID NO: 4090261 - RNA, 14 nt, Streptococcus pneumoniae R6
agagaagaaauaug

SEQ ID NO: 4090262 - RNA, 17 nt, Streptococcus pneumoniae R6
agagaagagagcauuaa

SEQ ID NO: 4090263 - RNA, 16 nt, Streptococcus pneumoniae R6
agagaagccaagagua

SEQ ID NO: 4090264 - RNA, 21 nt, Streptococcus pneumoniae R6
agagaagccaccgccagaacu

SEQ ID NO: 4090265 - RNA, 21 nt, Streptococcus pneumoniae R6
agagaaggauugacauaccac

SEQ ID NO: 4090266 - RNA, 17 nt, Streptococcus pneumoniae R6
agagaaugaaauauaga

SEQ ID NO: 4090267 - RNA, 13 nt, Streptococcus pneumoniae R6
agagacagaagau

SEQ ID NO: 4090268 - RNA, 14 nt, Streptococcus pneumoniae R6
agagacagcaguua

SEQ ID NO: 4090269 - RNA, 22 nt, Streptococcus pneumoniae R6
agagacuacuuccguaaucuug

SEQ ID NO: 4090270 - RNA, 13 nt, Streptococcus pneumoniae R6
agagagaaaggag

SEQ ID NO: 4090271 - RNA, 13 nt, Streptococcus pneumoniae R6
agagagacagcag

SEQ ID NO: 4090272 - RNA, 18 nt, Streptococcus pneumoniae R6
agagagcagauagggcua

SEQ ID NO: 4090273 - RNA, 20 nt, Streptococcus pneumoniae R6
agagagcuccaaagaagaua

SEQ ID NO: 4090274 - RNA, 14 nt, Streptococcus pneumoniae R6
agagagcuccaaau

SEQ ID NO: 4090275 - RNA, 18 nt, Streptococcus pneumoniae R6
agagagcuccaaauggca

SEQ ID NO: 4090276 - RNA, 24 nt, Streptococcus pneumoniae R6
agagagcuccaaauggcaugagga

SEQ ID NO: 4090277 - RNA, 21 nt, Streptococcus pneumoniae R6
agagaggggaggauagaccug

SEQ ID NO: 4090278 - RNA, 15 nt, Streptococcus pneumoniae R6
agagauaaguggcaa

SEQ ID NO: 4090279 - RNA, 17 nt, Streptococcus pneumoniae R6
agagauaccuuuuccuu

SEQ ID NO: 4090280 - RNA, 18 nt, Streptococcus pneumoniae R6
agagauagaaggucaaga

SEQ ID NO: 4090281 - RNA, 18 nt, Streptococcus pneumoniae R6
agagaucuagauuuggaa

SEQ ID NO: 4090282 - RNA, 19 nt, Streptococcus pneumoniae R6
agagaucuagauuuggaaa

SEQ ID NO: 4090283 - RNA, 19 nt, Streptococcus pneumoniae R6
agagaugagagauaaauau

SEQ ID NO: 4090284 - RNA, 16 nt, Streptococcus pneumoniae R6
agagauuuucaaagag

SEQ ID NO: 4090285 - RNA, 15 nt, Streptococcus pneumoniae R6
agagauuuucgaaga

SEQ ID NO: 4090286 - RNA, 11 nt, Streptococcus pneumoniae R6
agagcaaggaa

SEQ ID NO: 4090287 - RNA, 13 nt, Streptococcus pneumoniae R6
agagcacugcuag

SEQ ID NO: 4090288 - RNA, 22 nt, Streptococcus pneumoniae R6
agagcagauagggcuaggcuaa

SEQ ID NO: 4090289 - RNA, 21 nt, Streptococcus pneumoniae R6
agagcaucugccgcaugacaa

SEQ ID NO: 4090290 - RNA, 22 nt, Streptococcus pneumoniae R6
agagcauuaaccuuaggaauga

SEQ ID NO: 4090291 - RNA, 18 nt, Streptococcus pneumoniae R6
agagcauucuuuuguuca

SEQ ID NO: 4090292 - RNA, 15 nt, Streptococcus pneumoniae R6
agagcauuugaaaaa

SEQ ID NO: 4090293 - RNA, 15 nt, Streptococcus pneumoniae R6
agagcauuuuucgaa

SEQ ID NO: 4090294 - RNA, 21 nt, Streptococcus pneumoniae R6
agagcccaauauucucuagaa

SEQ ID NO: 4090295 - RNA, 22 nt, Streptococcus pneumoniae R6
agagccuugaguggauuuuuaa

SEQ ID NO: 4090296 - RNA, 20 nt, Streptococcus pneumoniae R6
agagccuuuuuaaagauaua

SEQ ID NO: 4090297 - RNA, 18 nt, Streptococcus pneumoniae R6
agagcgacuuuuucugau

SEQ ID NO: 4090298 - RNA, 17 nt, Streptococcus pneumoniae R6
agagcggacuaggcggc

SEQ ID NO: 4090299 - RNA, 14 nt, Streptococcus pneumoniae R6
agagcuccaaaugg

SEQ ID NO: 4090300 - RNA, 22 nt, Streptococcus pneumoniae R6
agagcugaggaaauuucgguga

SEQ ID NO: 4090301 - RNA, 14 nt, Streptococcus pneumoniae R6
agagcugauaguga

SEQ ID NO: 4090302 - RNA, 23 nt, Streptococcus pneumoniae R6
agagcugcugcuuccauuuccac

SEQ ID NO: 4090303 - RNA, 23 nt, Streptococcus pneumoniae R6
agagcuuuaauagaaagugacac

SEQ ID NO: 4090304 - RNA, 17 nt, Streptococcus pneumoniae R6
agagcuuugacauccuu

SEQ ID NO: 4090305 - RNA, 22 nt, Streptococcus pneumoniae R6
agagcuuugcuuuccucagcag

SEQ ID NO: 4090306 - RNA, 15 nt, Streptococcus pneumoniae R6
agaggaagaggacau

SEQ ID NO: 4090307 - RNA, 14 nt, Streptococcus pneumoniae R6
agaggacauagaaa

SEQ ID NO: 4090308 - RNA, 18 nt, Streptococcus pneumoniae R6
agaggacuuuuuguguuu

SEQ ID NO: 4090309 - RNA, 18 nt, Streptococcus pneumoniae R6
agaggagaauuuuugaga

SEQ ID NO: 4090310 - RNA, 20 nt, Streptococcus pneumoniae R6
agaggagaauuuuugagaug

SEQ ID NO: 4090311 - RNA, 13 nt, Streptococcus pneumoniae R6
agaggaggauaga

SEQ ID NO: 4090312 - RNA, 20 nt, Streptococcus pneumoniae R6
agaggaggauagaaguagag

SEQ ID NO: 4090313 - RNA, 22 nt, Streptococcus pneumoniae R6
agaggagguaaaucccaaguaa

SEQ ID NO: 4090314 - RNA, 17 nt, Streptococcus pneumoniae R6
agaggccuauuuaccau

SEQ ID NO: 4090315 - RNA, 18 nt, Streptococcus pneumoniae R6
agaggccuauuuaccaug

SEQ ID NO: 4090316 - RNA, 19 nt, Streptococcus pneumoniae R6
agaggcguuauuugaaaaa

SEQ ID NO: 4090317 - RNA, 17 nt, Streptococcus pneumoniae R6
agaggcucgcaccucuu

SEQ ID NO: 4090318 - RNA, 23 nt, Streptococcus pneumoniae R6
agagggcugcguugaggacaggu

SEQ ID NO: 4090319 - RNA, 14 nt, Streptococcus pneumoniae R6
agagggcuguguca

SEQ ID NO: 4090320 - RNA, 15 nt, Streptococcus pneumoniae R6
agaggggugcugaga

SEQ ID NO: 4090321 - RNA, 22 nt, Streptococcus pneumoniae R6
agaggguggaaagacuggugag

SEQ ID NO: 4090322 - RNA, 17 nt, Streptococcus pneumoniae R6
agagguccaaccagaug

SEQ ID NO: 4090323 - RNA, 17 nt, Streptococcus pneumoniae R6
agaggugccaguacaau

SEQ ID NO: 4090324 - RNA, 16 nt, Streptococcus pneumoniae R6
agagguuauucaaaaa

SEQ ID NO: 4090325 - RNA, 15 nt, Streptococcus pneumoniae R6
agagguugcuacagg

SEQ ID NO: 4090326 - RNA, 16 nt, Streptococcus pneumoniae R6
agaguagagagaaagg

SEQ ID NO: 4090327 - RNA, 16 nt, Streptococcus pneumoniae R6
agaguagucuguucua

SEQ ID NO: 4090328 - RNA, 22 nt, Streptococcus pneumoniae R6
agaguagucuguucuauaaaau

SEQ ID NO: 4090329 - RNA, 22 nt, Streptococcus pneumoniae R6
agaguauuaaacaaaaagaaaa

SEQ ID NO: 4090330 - RNA, 21 nt, Streptococcus pneumoniae R6
agagucaagacaaggauaaaa

SEQ ID NO: 4090331 - RNA, 21 nt, Streptococcus pneumoniae R6
agagucacaaaggucauuuuc

SEQ ID NO: 4090332 - RNA, 18 nt, Streptococcus pneumoniae R6
agagucagggucaaagua

SEQ ID NO: 4090333 - RNA, 21 nt, Streptococcus pneumoniae R6
agaguccaaagaccaugagga

SEQ ID NO: 4090334 - RNA, 17 nt, Streptococcus pneumoniae R6
agagucccuuagaaaaa

SEQ ID NO: 4090335 - RNA, 16 nt, Streptococcus pneumoniae R6
agaguuacaaacucuc

SEQ ID NO: 4090336 - RNA, 19 nt, Streptococcus pneumoniae R6
agaguuacaaacucucauu

SEQ ID NO: 4090337 - RNA, 15 nt, Streptococcus pneumoniae R6
agaguucguaguaaa

SEQ ID NO: 4090338 - RNA, 23 nt, Streptococcus pneumoniae R6
agaguucuccggcuuucacaaau

SEQ ID NO: 4090339 - RNA, 15 nt, Streptococcus pneumoniae R6
agaguugaggcaaga

SEQ ID NO: 4090340 - RNA, 17 nt, Streptococcus pneumoniae R6
agaguugccuaaaacuc

SEQ ID NO: 4090341 - RNA, 22 nt, Streptococcus pneumoniae R6
agaguugggguuuggaaaugau

SEQ ID NO: 4090342 - RNA, 19 nt, Streptococcus pneumoniae R6
agaguuucaauuguagaug

SEQ ID NO: 4090343 - RNA, 20 nt, Streptococcus pneumoniae R6
agaguuucgcccaaccacuu

SEQ ID NO: 4090344 - RNA, 13 nt, Streptococcus pneumoniae R6
agaguuuucugau

SEQ ID NO: 4090345 - RNA, 15 nt, Streptococcus pneumoniae R6
agaguuuuuuaucuu

SEQ ID NO: 4090346 - RNA, 20 nt, Streptococcus pneumoniae R6
agaguuuuuuaucuuuggga

SEQ ID NO: 4090347 - RNA, 14 nt, Streptococcus pneumoniae R6
agauaaaaaacaac

SEQ ID NO: 4090348 - RNA, 18 nt, Streptococcus pneumoniae R6
agauaaaagaaugcucag

SEQ ID NO: 4090349 - RNA, 15 nt, Streptococcus pneumoniae R6
agauaaaauugauaa

SEQ ID NO: 4090350 - RNA, 18 nt, Streptococcus pneumoniae R6
agauaacaccguucuaaa

SEQ ID NO: 4090351 - RNA, 21 nt, Streptococcus pneumoniae R6
agauaacaguuuuuaauuuuu

SEQ ID NO: 4090352 - RNA, 16 nt, Streptococcus pneumoniae R6
agauaacguucaccgu

SEQ ID NO: 4090353 - RNA, 17 nt, Streptococcus pneumoniae R6
agauaacuuuucugcua

SEQ ID NO: 4090354 - RNA, 22 nt, Streptococcus pneumoniae R6
agauaagcaccuaguacaaaga

SEQ ID NO: 4090355 - RNA, 18 nt, Streptococcus pneumoniae R6
agauaagcgcuagcaaaa

SEQ ID NO: 4090356 - RNA, 19 nt, Streptococcus pneumoniae R6
agauaaggccugauaagau

SEQ ID NO: 4090357 - RNA, 20 nt, Streptococcus pneumoniae R6
agauaaggccugauaagaug

SEQ ID NO: 4090358 - RNA, 18 nt, Streptococcus pneumoniae R6
agauaagguucaaaaaau

SEQ ID NO: 4090359 - RNA, 19 nt, Streptococcus pneumoniae R6
agauaaguggcaaaaauau

SEQ ID NO: 4090360 - RNA, 21 nt, Streptococcus pneumoniae R6
agauaaguggcaaaaauauca

SEQ ID NO: 4090361 - RNA, 16 nt, Streptococcus pneumoniae R6
agauaaguuccaucug

SEQ ID NO: 4090362 - RNA, 12 nt, Streptococcus pneumoniae R6
agauaauaaaua

SEQ ID NO: 4090363 - RNA, 14 nt, Streptococcus pneumoniae R6
agauaauaaauagu

SEQ ID NO: 4090364 - RNA, 20 nt, Streptococcus pneumoniae R6
agauaauaauugacgaagaa

SEQ ID NO: 4090365 - RNA, 21 nt, Streptococcus pneumoniae R6
agauaauaauugacgaagaaa

SEQ ID NO: 4090366 - RNA, 12 nt, Streptococcus pneumoniae R6
agauaauacaau

SEQ ID NO: 4090367 - RNA, 16 nt, Streptococcus pneumoniae R6
agauaauagcgaugaa

SEQ ID NO: 4090368 - RNA, 14 nt, Streptococcus pneumoniae R6
agauaauauacccu

SEQ ID NO: 4090369 - RNA, 14 nt, Streptococcus pneumoniae R6
agauaaucaucugg

SEQ ID NO: 4090370 - RNA, 22 nt, Streptococcus pneumoniae R6
agauaauuuaaaacucauuaau

SEQ ID NO: 4090371 - RNA, 15 nt, Streptococcus pneumoniae R6
agauacaaaaccaaa

SEQ ID NO: 4090372 - RNA, 16 nt, Streptococcus pneumoniae R6
agauacaaaaccaaac

SEQ ID NO: 4090373 - RNA, 14 nt, Streptococcus pneumoniae R6
agauacauuuuuuc

SEQ ID NO: 4090374 - RNA, 15 nt, Streptococcus pneumoniae R6
agauacuccaaaaca

SEQ ID NO: 4090375 - RNA, 20 nt, Streptococcus pneumoniae R6
agauacugaaucaaaaagac

SEQ ID NO: 4090376 - RNA, 13 nt, Streptococcus pneumoniae R6
agauagaacugac

SEQ ID NO: 4090377 - RNA, 23 nt, Streptococcus pneumoniae R6
agauagaacugacgaagucagcu

SEQ ID NO: 4090378 - RNA, 19 nt, Streptococcus pneumoniae R6
agauagaaggucaagagaa

SEQ ID NO: 4090379 - RNA, 20 nt, Streptococcus pneumoniae R6
agauagaaggucaagagaaa

SEQ ID NO: 4090380 - RNA, 16 nt, Streptococcus pneumoniae R6
agauagaauagcagau

SEQ ID NO: 4090381 - RNA, 20 nt, Streptococcus pneumoniae R6
agauagagacauaaucaaga

SEQ ID NO: 4090382 - RNA, 16 nt, Streptococcus pneumoniae R6
agauagauaaaggcca

SEQ ID NO: 4090383 - RNA, 15 nt, Streptococcus pneumoniae R6
agauagcgcugggcu

SEQ ID NO: 4090384 - RNA, 22 nt, Streptococcus pneumoniae R6
agauagcgcugggcugucucua

SEQ ID NO: 4090385 - RNA, 12 nt, Streptococcus pneumoniae R6
agauagcugcag

SEQ ID NO: 4090386 - RNA, 15 nt, Streptococcus pneumoniae R6
agauagcugugaagc

SEQ ID NO: 4090387 - RNA, 17 nt, Streptococcus pneumoniae R6
agauaggagaccagcua

SEQ ID NO: 4090388 - RNA, 23 nt, Streptococcus pneumoniae R6
agauaggauggcuccagaaauaa

SEQ ID NO: 4090389 - RNA, 14 nt, Streptococcus pneumoniae R6
agauaggauugccc

SEQ ID NO: 4090390 - RNA, 16 nt, Streptococcus pneumoniae R6
agauaggcgcaaaucc

SEQ ID NO: 4090391 - RNA, 16 nt, Streptococcus pneumoniae R6
agauagggaagguaug

SEQ ID NO: 4090392 - RNA, 16 nt, Streptococcus pneumoniae R6
agauagggcugaagga

SEQ ID NO: 4090393 - RNA, 14 nt, Streptococcus pneumoniae R6
agauaggucacagc

SEQ ID NO: 4090394 - RNA, 23 nt, Streptococcus pneumoniae R6
agauagguuuugcaugauugaga

SEQ ID NO: 4090395 - RNA, 15 nt, Streptococcus pneumoniae R6
agauaguaucaaaug

SEQ ID NO: 4090396 - RNA, 17 nt, Streptococcus pneumoniae R6
agauaguaucaaaugac

SEQ ID NO: 4090397 - RNA, 20 nt, Streptococcus pneumoniae R6
agauaguauuuuaaaacgaa

SEQ ID NO: 4090398 - RNA, 17 nt, Streptococcus pneumoniae R6
agauagucgauaaaaag

SEQ ID NO: 4090399 - RNA, 18 nt, Streptococcus pneumoniae R6
agauagucgauaaaaagg

SEQ ID NO: 4090400 - RNA, 19 nt, Streptococcus pneumoniae R6
agauagucgauaaaaaggu

SEQ ID NO: 4090401 - RNA, 16 nt, Streptococcus pneumoniae R6
agauaguucaaucaua

SEQ ID NO: 4090402 - RNA, 18 nt, Streptococcus pneumoniae R6
agauauagccuguaaaaa

SEQ ID NO: 4090403 - RNA, 22 nt, Streptococcus pneumoniae R6
agauauagccuguaaaaaguga

SEQ ID NO: 4090404 - RNA, 15 nt, Streptococcus pneumoniae R6
agauauauugacuuu

SEQ ID NO: 4090405 - RNA, 14 nt, Streptococcus pneumoniae R6
agauaucacucauc

SEQ ID NO: 4090406 - RNA, 23 nt, Streptococcus pneumoniae R6
agauaucgccugcggcugcagcu

SEQ ID NO: 4090407 - RNA, 24 nt, Streptococcus pneumoniae R6
agauaucgccugcggcugcagcug

SEQ ID NO: 4090408 - RNA, 14 nt, Streptococcus pneumoniae R6
agauauuauuucaa

SEQ ID NO: 4090409 - RNA, 20 nt, Streptococcus pneumoniae R6
agauauuauuucaaagaaca

SEQ ID NO: 4090410 - RNA, 20 nt, Streptococcus pneumoniae R6
agauauuguucuaguuuuuu

SEQ ID NO: 4090411 - RNA, 16 nt, Streptococcus pneumoniae R6
agaucaaguucaagau

SEQ ID NO: 4090412 - RNA, 18 nt, Streptococcus pneumoniae R6
agaucaaguucaagauga

SEQ ID NO: 4090413 - RNA, 20 nt, Streptococcus pneumoniae R6
agaucaguucauuuuuccuu

SEQ ID NO: 4090414 - RNA, 15 nt, Streptococcus pneumoniae R6
agaucuagaaaggac

SEQ ID NO: 4090415 - RNA, 15 nt, Streptococcus pneumoniae R6
agaucugcuugcucu

SEQ ID NO: 4090416 - RNA, 16 nt, Streptococcus pneumoniae R6
agaucugguuaaaauu

SEQ ID NO: 4090417 - RNA, 15 nt, Streptococcus pneumoniae R6
agaucuugucugcau

SEQ ID NO: 4090418 - RNA, 16 nt, Streptococcus pneumoniae R6
agaucuugucugcaug

SEQ ID NO: 4090419 - RNA, 16 nt, Streptococcus pneumoniae R6
agaucuuuuuauacuc

SEQ ID NO: 4090420 - RNA, 18 nt, Streptococcus pneumoniae R6
agaucuuuuuauacucaa

SEQ ID NO: 4090421 - RNA, 13 nt, Streptococcus pneumoniae R6
agaugaagcaauc

SEQ ID NO: 4090422 - RNA, 23 nt, Streptococcus pneumoniae R6
agaugacaaaucuaagucaaaua

SEQ ID NO: 4090423 - RNA, 16 nt, Streptococcus pneumoniae R6
agaugacaucuaaaua

SEQ ID NO: 4090424 - RNA, 19 nt, Streptococcus pneumoniae R6
agaugacuucuuaaucaau

SEQ ID NO: 4090425 - RNA, 19 nt, Streptococcus pneumoniae R6
agaugagacuugcaagaaa

SEQ ID NO: 4090426 - RNA, 22 nt, Streptococcus pneumoniae R6
agaugagacuugcaagaaagua

SEQ ID NO: 4090427 - RNA, 13 nt, Streptococcus pneumoniae R6
agaugagaggaga

SEQ ID NO: 4090428 - RNA, 18 nt, Streptococcus pneumoniae R6
agaugaguguaaaaagaa

SEQ ID NO: 4090429 - RNA, 20 nt, Streptococcus pneumoniae R6
agaugaguguaaaaagaaag

SEQ ID NO: 4090430 - RNA, 15 nt, Streptococcus pneumoniae R6
agaugaguuugcuuu

SEQ ID NO: 4090431 - RNA, 22 nt, Streptococcus pneumoniae R6
agaugaucgagcagauuucuuu

SEQ ID NO: 4090432 - RNA, 14 nt, Streptococcus pneumoniae R6
agaugauuacucaa

SEQ ID NO: 4090433 - RNA, 20 nt, Streptococcus pneumoniae R6
agaugauucucagguuuuuc

SEQ ID NO: 4090434 - RNA, 13 nt, Streptococcus pneumoniae R6
agaugauuuuucu

SEQ ID NO: 4090435 - RNA, 14 nt, Streptococcus pneumoniae R6
agaugcuugaauuc

SEQ ID NO: 4090436 - RNA, 22 nt, Streptococcus pneumoniae R6
agaugcuugcauuuuuugaguu

SEQ ID NO: 4090437 - RNA, 18 nt, Streptococcus pneumoniae R6
agauggaagcugacguag

SEQ ID NO: 4090438 - RNA, 18 nt, Streptococcus pneumoniae R6
agauggaguguucuaaaa

SEQ ID NO: 4090439 - RNA, 23 nt, Streptococcus pneumoniae R6
agauggaguguucuaaaauaagu

SEQ ID NO: 4090440 - RNA, 19 nt, Streptococcus pneumoniae R6
agauggaguuccuccauug

SEQ ID NO: 4090441 - RNA, 14 nt, Streptococcus pneumoniae R6
agaugggacuaaag

SEQ ID NO: 4090442 - RNA, 23 nt, Streptococcus pneumoniae R6
agaugggacuaaagauugagaaa

SEQ ID NO: 4090443 - RNA, 18 nt, Streptococcus pneumoniae R6
agauggucaaaauauuug

SEQ ID NO: 4090444 - RNA, 16 nt, Streptococcus pneumoniae R6
agauguuagaaaaagu

SEQ ID NO: 4090445 - RNA, 17 nt, Streptococcus pneumoniae R6
agauguucuuugaaaua

SEQ ID NO: 4090446 - RNA, 17 nt, Streptococcus pneumoniae R6
agauuacugauaaaacu

SEQ ID NO: 4090447 - RNA, 23 nt, Streptococcus pneumoniae R6
agauuacuguuguugagaccgac

SEQ ID NO: 4090448 - RNA, 19 nt, Streptococcus pneumoniae R6
agauuaggaauuagaguuu

SEQ ID NO: 4090449 - RNA, 22 nt, Streptococcus pneumoniae R6
agauuaggaauuagaguuucau

SEQ ID NO: 4090450 - RNA, 15 nt, Streptococcus pneumoniae R6
agauuaucgacagga

SEQ ID NO: 4090451 - RNA, 13 nt, Streptococcus pneumoniae R6
agauuaucuuccu

SEQ ID NO: 4090452 - RNA, 16 nt, Streptococcus pneumoniae R6
agauuaugaugcaaaa

SEQ ID NO: 4090453 - RNA, 15 nt, Streptococcus pneumoniae R6
agauucaacaucacu

SEQ ID NO: 4090454 - RNA, 17 nt, Streptococcus pneumoniae R6
agauucaauauacuaua

SEQ ID NO: 4090455 - RNA, 15 nt, Streptococcus pneumoniae R6
agauucaucagggca

SEQ ID NO: 4090456 - RNA, 12 nt, Streptococcus pneumoniae R6
agauucauucug

SEQ ID NO: 4090457 - RNA, 17 nt, Streptococcus pneumoniae R6
agauucggauaaguuuu

SEQ ID NO: 4090458 - RNA, 20 nt, Streptococcus pneumoniae R6
agauucuauuuuuuauaaua

SEQ ID NO: 4090459 - RNA, 22 nt, Streptococcus pneumoniae R6
agauucuauuuuuuauaauauc

SEQ ID NO: 4090460 - RNA, 21 nt, Streptococcus pneumoniae R6
agauucugugguaaugcuuuc

SEQ ID NO: 4090461 - RNA, 15 nt, Streptococcus pneumoniae R6
agauucuuauaaaua

SEQ ID NO: 4090462 - RNA, 14 nt, Streptococcus pneumoniae R6
agauucuucugguu

SEQ ID NO: 4090463 - RNA, 15 nt, Streptococcus pneumoniae R6
agauugaaacuagaa

SEQ ID NO: 4090464 - RNA, 12 nt, Streptococcus pneumoniae R6
agauugagaaac

SEQ ID NO: 4090465 - RNA, 16 nt, Streptococcus pneumoniae R6
agauugaguucucguu

SEQ ID NO: 4090466 - RNA, 20 nt, Streptococcus pneumoniae R6
agauugaugcaaaucucauu

SEQ ID NO: 4090467 - RNA, 20 nt, Streptococcus pneumoniae R6
agauugcccaucauuccuga

SEQ ID NO: 4090468 - RNA, 23 nt, Streptococcus pneumoniae R6
agauugcgauacuguuauagaag

SEQ ID NO: 4090469 - RNA, 18 nt, Streptococcus pneumoniae R6
agauugcucaaaacacug

SEQ ID NO: 4090470 - RNA, 18 nt, Streptococcus pneumoniae R6
agauugcuuuccaauaau

SEQ ID NO: 4090471 - RNA, 17 nt, Streptococcus pneumoniae R6
agauuggaaaccaagaa

SEQ ID NO: 4090472 - RNA, 18 nt, Streptococcus pneumoniae R6
agauuguaaaggaugaca

SEQ ID NO: 4090473 - RNA, 21 nt, Streptococcus pneumoniae R6
agauugucgguagaacgauaa

SEQ ID NO: 4090474 - RNA, 20 nt, Streptococcus pneumoniae R6
agauuuaaaaauguugcauu

SEQ ID NO: 4090475 - RNA, 12 nt, Streptococcus pneumoniae R6
agauuuaguucu

SEQ ID NO: 4090476 - RNA, 16 nt, Streptococcus pneumoniae R6
agauuuaguucuguau

SEQ ID NO: 4090477 - RNA, 20 nt, Streptococcus pneumoniae R6
agauuuauacucuucgaaaa

SEQ ID NO: 4090478 - RNA, 23 nt, Streptococcus pneumoniae R6
agauuuauacucuucgaaaaucu

SEQ ID NO: 4090479 - RNA, 14 nt, Streptococcus pneumoniae R6
agauuuauuuuugg

SEQ ID NO: 4090480 - RNA, 15 nt, Streptococcus pneumoniae R6
agauuuccugagaug

SEQ ID NO: 4090481 - RNA, 18 nt, Streptococcus pneumoniae R6
agauuucgcuccagcaua

SEQ ID NO: 4090482 - RNA, 12 nt, Streptococcus pneumoniae R6
agauuucuuuua

SEQ ID NO: 4090483 - RNA, 15 nt, Streptococcus pneumoniae R6
agauuugaaaacuga

SEQ ID NO: 4090484 - RNA, 14 nt, Streptococcus pneumoniae R6
agauuugaaacuaa

SEQ ID NO: 4090485 - RNA, 13 nt, Streptococcus pneumoniae R6
agauuugcaucaa

SEQ ID NO: 4090486 - RNA, 15 nt, Streptococcus pneumoniae R6
agauuuggaaacuca

SEQ ID NO: 4090487 - RNA, 14 nt, Streptococcus pneumoniae R6
agauuugucaaauu

SEQ ID NO: 4090488 - RNA, 24 nt, Streptococcus pneumoniae R6
agauuugugaaucaucacuaguaa

SEQ ID NO: 4090489 - RNA, 18 nt, Streptococcus pneumoniae R6
agauuuguugauagagua

SEQ ID NO: 4090490 - RNA, 14 nt, Streptococcus pneumoniae R6
agauuuguuuuuca

SEQ ID NO: 4090491 - RNA, 14 nt, Streptococcus pneumoniae R6
agauuuucaaagag

SEQ ID NO: 4090492 - RNA, 18 nt, Streptococcus pneumoniae R6
agauuuuccucauuuucu

SEQ ID NO: 4090493 - RNA, 21 nt, Streptococcus pneumoniae R6
agauuuucuaagaguauaaaa

SEQ ID NO: 4090494 - RNA, 13 nt, Streptococcus pneumoniae R6
agauuuuggaaga

SEQ ID NO: 4090495 - RNA, 19 nt, Streptococcus pneumoniae R6
agauuuuuaaauucuucca

SEQ ID NO: 4090496 - RNA, 21 nt, Streptococcus pneumoniae R6
agauuuuucaaggugaaguuc

SEQ ID NO: 4090497 - RNA, 15 nt, Streptococcus pneumoniae R6
agauuuuuuaaaaag

SEQ ID NO: 4090498 - RNA, 20 nt, Streptococcus pneumoniae R6
agcaaaaaaagcccuauauu

SEQ ID NO: 4090499 - RNA, 19 nt, Streptococcus pneumoniae R6
agcaaaaaauuaugcuuaa

SEQ ID NO: 4090500 - RNA, 12 nt, Streptococcus pneumoniae R6
agcaaaaacaau

SEQ ID NO: 4090501 - RNA, 12 nt, Streptococcus pneumoniae R6
agcaaaacacua

SEQ ID NO: 4090502 - RNA, 13 nt, Streptococcus pneumoniae R6
agcaaaagaacaa

SEQ ID NO: 4090503 - RNA, 14 nt, Streptococcus pneumoniae R6
agcaaaagaacaag

SEQ ID NO: 4090504 - RNA, 22 nt, Streptococcus pneumoniae R6
agcaaacgaacgccuuaaaaaa

SEQ ID NO: 4090505 - RNA, 12 nt, Streptococcus pneumoniae R6
agcaaagauauu

SEQ ID NO: 4090506 - RNA, 21 nt, Streptococcus pneumoniae R6
agcaaaguuuuaggaacugga

SEQ ID NO: 4090507 - RNA, 17 nt, Streptococcus pneumoniae R6
agcaaaucaacuggcau

SEQ ID NO: 4090508 - RNA, 20 nt, Streptococcus pneumoniae R6
agcaaauuaaccuuauuucu

SEQ ID NO: 4090509 - RNA, 12 nt, Streptococcus pneumoniae R6
agcaaauuuaau

SEQ ID NO: 4090510 - RNA, 19 nt, Streptococcus pneumoniae R6
agcaacagcuggaaucaca

SEQ ID NO: 4090511 - RNA, 18 nt, Streptococcus pneumoniae R6
agcaaccacguuccuugg

SEQ ID NO: 4090512 - RNA, 18 nt, Streptococcus pneumoniae R6
agcaacuaaaaaggaacc

SEQ ID NO: 4090513 - RNA, 20 nt, Streptococcus pneumoniae R6
agcaacuaaaaaggaaccag

SEQ ID NO: 4090514 - RNA, 14 nt, Streptococcus pneumoniae R6
agcaacuaaaauca

SEQ ID NO: 4090515 - RNA, 16 nt, Streptococcus pneumoniae R6
agcaacuaucugaaua

SEQ ID NO: 4090516 - RNA, 18 nt, Streptococcus pneumoniae R6
agcaacuguuuuuucaac

SEQ ID NO: 4090517 - RNA, 19 nt, Streptococcus pneumoniae R6
agcaacuguuuuuucaaca

SEQ ID NO: 4090518 - RNA, 13 nt, Streptococcus pneumoniae R6
agcaacuucagau

SEQ ID NO: 4090519 - RNA, 21 nt, Streptococcus pneumoniae R6
agcaagaauucaauugcagga

SEQ ID NO: 4090520 - RNA, 16 nt, Streptococcus pneumoniae R6
agcaagauaguaaaga

SEQ ID NO: 4090521 - RNA, 14 nt, Streptococcus pneumoniae R6
agcaagcuccuaaa

SEQ ID NO: 4090522 - RNA, 15 nt, Streptococcus pneumoniae R6
agcaagcuccuaaau

SEQ ID NO: 4090523 - RNA, 19 nt, Streptococcus pneumoniae R6
agcaagcuccuaaaucaac

SEQ ID NO: 4090524 - RNA, 23 nt, Streptococcus pneumoniae R6
agcaagucuagacugauuaaaua

SEQ ID NO: 4090525 - RNA, 15 nt, Streptococcus pneumoniae R6
agcaagugacaaaga

SEQ ID NO: 4090526 - RNA, 14 nt, Streptococcus pneumoniae R6
agcaagugcuaaga

SEQ ID NO: 4090527 - RNA, 20 nt, Streptococcus pneumoniae R6
agcaagugcuuuuacaauau

SEQ ID NO: 4090528 - RNA, 17 nt, Streptococcus pneumoniae R6
agcaagugguucuccaa

SEQ ID NO: 4090529 - RNA, 24 nt, Streptococcus pneumoniae R6
agcaagugguucuccaaagauaga

SEQ ID NO: 4090530 - RNA, 13 nt, Streptococcus pneumoniae R6
agcaauaagacua

SEQ ID NO: 4090531 - RNA, 17 nt, Streptococcus pneumoniae R6
agcaaucauaccugcau

SEQ ID NO: 4090532 - RNA, 18 nt, Streptococcus pneumoniae R6
agcaaucauaccugcauu

SEQ ID NO: 4090533 - RNA, 21 nt, Streptococcus pneumoniae R6
agcaaucauaccugcauuguc

SEQ ID NO: 4090534 - RNA, 16 nt, Streptococcus pneumoniae R6
agcaaucucuuccaaa

SEQ ID NO: 4090535 - RNA, 22 nt, Streptococcus pneumoniae R6
agcaaucuuccuuacuagcaaa

SEQ ID NO: 4090536 - RNA, 16 nt, Streptococcus pneumoniae R6
agcaaugguuuagaag

SEQ ID NO: 4090537 - RNA, 16 nt, Streptococcus pneumoniae R6
agcaauucaauuuuau

SEQ ID NO: 4090538 - RNA, 20 nt, Streptococcus pneumoniae R6
agcaauuccuuacgaacaac

SEQ ID NO: 4090539 - RNA, 20 nt, Streptococcus pneumoniae R6
agcaauucuugguugccuuu

SEQ ID NO: 4090540 - RNA, 21 nt, Streptococcus pneumoniae R6
agcacacaaaucuucuguaga

SEQ ID NO: 4090541 - RNA, 22 nt, Streptococcus pneumoniae R6
agcaccauauuuguugcucuua

SEQ ID NO: 4090542 - RNA, 18 nt, Streptococcus pneumoniae R6
agcaccuacaacauagac

SEQ ID NO: 4090543 - RNA, 20 nt, Streptococcus pneumoniae R6
agcaccuaguacaaagaaua

SEQ ID NO: 4090544 - RNA, 14 nt, Streptococcus pneumoniae R6
agcaccugaacgua

SEQ ID NO: 4090545 - RNA, 22 nt, Streptococcus pneumoniae R6
agcaccuuuugcgucuucuaca

SEQ ID NO: 4090546 - RNA, 13 nt, Streptococcus pneumoniae R6
agcacgauuauua

SEQ ID NO: 4090547 - RNA, 16 nt, Streptococcus pneumoniae R6
agcacggagaaucuuc

SEQ ID NO: 4090548 - RNA, 18 nt, Streptococcus pneumoniae R6
agcacggagaaucuuccc

SEQ ID NO: 4090549 - RNA, 19 nt, Streptococcus pneumoniae R6
agcacggagaaucuucccg

SEQ ID NO: 4090550 - RNA, 17 nt, Streptococcus pneumoniae R6
agcacuauuguuauuuu

SEQ ID NO: 4090551 - RNA, 12 nt, Streptococcus pneumoniae R6
agcacugauuug

SEQ ID NO: 4090552 - RNA, 18 nt, Streptococcus pneumoniae R6
agcacugauuugagguug

SEQ ID NO: 4090553 - RNA, 14 nt, Streptococcus pneumoniae R6
agcacuuaaaaagu

SEQ ID NO: 4090554 - RNA, 20 nt, Streptococcus pneumoniae R6
agcacuugaugaaaaaaagu

SEQ ID NO: 4090555 - RNA, 14 nt, Streptococcus pneumoniae R6
agcacuugcuuuug

SEQ ID NO: 4090556 - RNA, 13 nt, Streptococcus pneumoniae R6
agcacuuuuccau

SEQ ID NO: 4090557 - RNA, 17 nt, Streptococcus pneumoniae R6
agcagaaaaauuucauu

SEQ ID NO: 4090558 - RNA, 23 nt, Streptococcus pneumoniae R6
agcagaaaaauuucauuuucuac

SEQ ID NO: 4090559 - RNA, 22 nt, Streptococcus pneumoniae R6
agcagaaccccgauaacagccg

SEQ ID NO: 4090560 - RNA, 14 nt, Streptococcus pneumoniae R6
agcagaauuuaacu

SEQ ID NO: 4090561 - RNA, 14 nt, Streptococcus pneumoniae R6
agcagagaaagaaa

SEQ ID NO: 4090562 - RNA, 15 nt, Streptococcus pneumoniae R6
agcagagaaagaaaa

SEQ ID NO: 4090563 - RNA, 13 nt, Streptococcus pneumoniae R6
agcagagaagagg

SEQ ID NO: 4090564 - RNA, 16 nt, Streptococcus pneumoniae R6
agcagagaagcacaug

SEQ ID NO: 4090565 - RNA, 18 nt, Streptococcus pneumoniae R6
agcagauaaguuugguuu

SEQ ID NO: 4090566 - RNA, 17 nt, Streptococcus pneumoniae R6
agcagauagccagccua

SEQ ID NO: 4090567 - RNA, 20 nt, Streptococcus pneumoniae R6
agcagaugaguguaaaaaga

SEQ ID NO: 4090568 - RNA, 23 nt, Streptococcus pneumoniae R6
agcagaugaguguaaaaagaaag

SEQ ID NO: 4090569 - RNA, 17 nt, Streptococcus pneumoniae R6
agcagauugaaauaaga

SEQ ID NO: 4090570 - RNA, 22 nt, Streptococcus pneumoniae R6
agcagccacuuuuuauccguca

SEQ ID NO: 4090571 - RNA, 16 nt, Streptococcus pneumoniae R6
agcagcuaaaagcaaa

SEQ ID NO: 4090572 - RNA, 19 nt, Streptococcus pneumoniae R6
agcagcuuucaaagcggga

SEQ ID NO: 4090573 - RNA, 19 nt, Streptococcus pneumoniae R6
agcaggaagguaacuccca

SEQ ID NO: 4090574 - RNA, 12 nt, Streptococcus pneumoniae R6
agcaggagaaag

SEQ ID NO: 4090575 - RNA, 20 nt, Streptococcus pneumoniae R6
agcaguaacuucugucuauu

SEQ ID NO: 4090576 - RNA, 20 nt, Streptococcus pneumoniae R6
agcaguaguuggcuugucuu

SEQ ID NO: 4090577 - RNA, 19 nt, Streptococcus pneumoniae R6
agcaguaugcaaggcaaug

SEQ ID NO: 4090578 - RNA, 15 nt, Streptococcus pneumoniae R6
agcagucaagaugga

SEQ ID NO: 4090579 - RNA, 15 nt, Streptococcus pneumoniae R6
agcaguccaaggaga

SEQ ID NO: 4090580 - RNA, 13 nt, Streptococcus pneumoniae R6
agcaguuaugaua

SEQ ID NO: 4090581 - RNA, 23 nt, Streptococcus pneumoniae R6
agcaguuccacgauauuguuguu

SEQ ID NO: 4090582 - RNA, 21 nt, Streptococcus pneumoniae R6
agcaguuguguacuacucuaa

SEQ ID NO: 4090583 - RNA, 13 nt, Streptococcus pneumoniae R6
agcauaaaagccu

SEQ ID NO: 4090584 - RNA, 18 nt, Streptococcus pneumoniae R6
agcauaacgacagaagaa

SEQ ID NO: 4090585 - RNA, 21 nt, Streptococcus pneumoniae R6
agcauaacgacagaagaagug

SEQ ID NO: 4090586 - RNA, 21 nt, Streptococcus pneumoniae R6
agcauaagccggcuugucuuu

SEQ ID NO: 4090587 - RNA, 19 nt, Streptococcus pneumoniae R6
agcauaaugauuucaagac

SEQ ID NO: 4090588 - RNA, 21 nt, Streptococcus pneumoniae R6
agcauacagagaaagucagcu

SEQ ID NO: 4090589 - RNA, 18 nt, Streptococcus pneumoniae R6
agcauacugaauuuagaa

SEQ ID NO: 4090590 - RNA, 15 nt, Streptococcus pneumoniae R6
agcauacugcccuga

SEQ ID NO: 4090591 - RNA, 20 nt, Streptococcus pneumoniae R6
agcauacugcccugaaaucc

SEQ ID NO: 4090592 - RNA, 13 nt, Streptococcus pneumoniae R6
agcauagagaaaa

SEQ ID NO: 4090593 - RNA, 18 nt, Streptococcus pneumoniae R6
agcauagagaaaaacagc

SEQ ID NO: 4090594 - RNA, 19 nt, Streptococcus pneumoniae R6
agcauauuuuguuucgcug

SEQ ID NO: 4090595 - RNA, 17 nt, Streptococcus pneumoniae R6
agcaucaaucaaacgag

SEQ ID NO: 4090596 - RNA, 18 nt, Streptococcus pneumoniae R6
agcaucaggaaagacuag

SEQ ID NO: 4090597 - RNA, 19 nt, Streptococcus pneumoniae R6
agcaucgcccauggccaua

SEQ ID NO: 4090598 - RNA, 15 nt, Streptococcus pneumoniae R6
agcaucgguaagaaa

SEQ ID NO: 4090599 - RNA, 16 nt, Streptococcus pneumoniae R6
agcaucuccauccuca

SEQ ID NO: 4090600 - RNA, 21 nt, Streptococcus pneumoniae R6
agcaucucccgucaagacuag

SEQ ID NO: 4090601 - RNA, 21 nt, Streptococcus pneumoniae R6
agcaugaagcgguccaauccu

SEQ ID NO: 4090602 - RNA, 15 nt, Streptococcus pneumoniae R6
agcauggcaccgccg

SEQ ID NO: 4090603 - RNA, 18 nt, Streptococcus pneumoniae R6
agcauggucaggcuagga

SEQ ID NO: 4090604 - RNA, 22 nt, Streptococcus pneumoniae R6
agcauucuaguccaucuccgau

SEQ ID NO: 4090605 - RNA, 16 nt, Streptococcus pneumoniae R6
agcauucuuuuguuca

SEQ ID NO: 4090606 - RNA, 18 nt, Streptococcus pneumoniae R6
agcauugucauuuaugua

SEQ ID NO: 4090607 - RNA, 22 nt, Streptococcus pneumoniae R6
agcauuuccaccugcagcaagu

SEQ ID NO: 4090608 - RNA, 22 nt, Streptococcus pneumoniae R6
agcauuucgauaucguuauuag

SEQ ID NO: 4090609 - RNA, 12 nt, Streptococcus pneumoniae R6
agcauuuucaaa

SEQ ID NO: 4090610 - RNA, 20 nt, Streptococcus pneumoniae R6
agcauuuucaaagaagaggu

SEQ ID NO: 4090611 - RNA, 20 nt, Streptococcus pneumoniae R6
agcauuuucuuuuugaaguu

SEQ ID NO: 4090612 - RNA, 20 nt, Streptococcus pneumoniae R6
agccaaaaguccaaagauga

SEQ ID NO: 4090613 - RNA, 18 nt, Streptococcus pneumoniae R6
agccaaaccguucaagac

SEQ ID NO: 4090614 - RNA, 23 nt, Streptococcus pneumoniae R6
agccaaacuaggauuuucuuaca

SEQ ID NO: 4090615 - RNA, 21 nt, Streptococcus pneumoniae R6
agccaacaacugauucuacuu

SEQ ID NO: 4090616 - RNA, 18 nt, Streptococcus pneumoniae R6
agccaacucauacuuucu

SEQ ID NO: 4090617 - RNA, 12 nt, Streptococcus pneumoniae R6
agccaagacacu

SEQ ID NO: 4090618 - RNA, 13 nt, Streptococcus pneumoniae R6
agccaagacuuuu

SEQ ID NO: 4090619 - RNA, 18 nt, Streptococcus pneumoniae R6
agccaagcuaguacauuc

SEQ ID NO: 4090620 - RNA, 18 nt, Streptococcus pneumoniae R6
agccaaggaagucuuguu

SEQ ID NO: 4090621 - RNA, 21 nt, Streptococcus pneumoniae R6
agccaaucaaaaaaucucacu

SEQ ID NO: 4090622 - RNA, 18 nt, Streptococcus pneumoniae R6
agccaauguauuaagaac

SEQ ID NO: 4090623 - RNA, 14 nt, Streptococcus pneumoniae R6
agccaauugagggu

SEQ ID NO: 4090624 - RNA, 14 nt, Streptococcus pneumoniae R6
agccaccgccagaa

SEQ ID NO: 4090625 - RNA, 19 nt, Streptococcus pneumoniae R6
agccacggcacguuccaua

SEQ ID NO: 4090626 - RNA, 17 nt, Streptococcus pneumoniae R6
agccacuguacguccaa

SEQ ID NO: 4090627 - RNA, 15 nt, Streptococcus pneumoniae R6
agccagacugggcag

SEQ ID NO: 4090628 - RNA, 13 nt, Streptococcus pneumoniae R6
agccagagcacca

SEQ ID NO: 4090629 - RNA, 16 nt, Streptococcus pneumoniae R6
agccagagcaccaacc

SEQ ID NO: 4090630 - RNA, 22 nt, Streptococcus pneumoniae R6
agccaggcuaauugcaaauuua

SEQ ID NO: 4090631 - RNA, 17 nt, Streptococcus pneumoniae R6
agccaguuuucguagca

SEQ ID NO: 4090632 - RNA, 13 nt, Streptococcus pneumoniae R6
agccauaaaaaua

SEQ ID NO: 4090633 - RNA, 14 nt, Streptococcus pneumoniae R6
agccauaaaaauaa

SEQ ID NO: 4090634 - RNA, 19 nt, Streptococcus pneumoniae R6
agccauaaaaauaacuuca

SEQ ID NO: 4090635 - RNA, 17 nt, Streptococcus pneumoniae R6
agccaucauccaccuug

SEQ ID NO: 4090636 - RNA, 17 nt, Streptococcus pneumoniae R6
agccaucuuuugacagu

SEQ ID NO: 4090637 - RNA, 18 nt, Streptococcus pneumoniae R6
agccauucccaucaauau

SEQ ID NO: 4090638 - RNA, 16 nt, Streptococcus pneumoniae R6
agccauugaaaauccu

SEQ ID NO: 4090639 - RNA, 20 nt, Streptococcus pneumoniae R6
agccauugaaaauccuguuu

SEQ ID NO: 4090640 - RNA, 23 nt, Streptococcus pneumoniae R6
agcccaguugacuguguuugaga

SEQ ID NO: 4090641 - RNA, 20 nt, Streptococcus pneumoniae R6
agccccagcuaggagagcua

SEQ ID NO: 4090642 - RNA, 18 nt, Streptococcus pneumoniae R6
agccccuaugcuuuccuu

SEQ ID NO: 4090643 - RNA, 16 nt, Streptococcus pneumoniae R6
agcccgaaaaauuucu

SEQ ID NO: 4090644 - RNA, 14 nt, Streptococcus pneumoniae R6
agcccgagcucaaa

SEQ ID NO: 4090645 - RNA, 22 nt, Streptococcus pneumoniae R6
agcccuauauuauaagacuuuu

SEQ ID NO: 4090646 - RNA, 19 nt, Streptococcus pneumoniae R6
agcccuccuauagaaaaau

SEQ ID NO: 4090647 - RNA, 16 nt, Streptococcus pneumoniae R6
agcccuucaucaguca

SEQ ID NO: 4090648 - RNA, 12 nt, Streptococcus pneumoniae R6
agcccuuuauga

SEQ ID NO: 4090649 - RNA, 19 nt, Streptococcus pneumoniae R6
agccgaagccaaucaaacu

SEQ ID NO: 4090650 - RNA, 18 nt, Streptococcus pneumoniae R6
agccgacccaggcaaaga

SEQ ID NO: 4090651 - RNA, 16 nt, Streptococcus pneumoniae R6
agccggcuugucuuug

SEQ ID NO: 4090652 - RNA, 14 nt, Streptococcus pneumoniae R6
agccgggauuuuuu

SEQ ID NO: 4090653 - RNA, 14 nt, Streptococcus pneumoniae R6
agccuaagacaacc

SEQ ID NO: 4090654 - RNA, 17 nt, Streptococcus pneumoniae R6
agccuaagacaaccaaa

SEQ ID NO: 4090655 - RNA, 15 nt, Streptococcus pneumoniae R6
agccucauaaaaggu

SEQ ID NO: 4090656 - RNA, 18 nt, Streptococcus pneumoniae R6
agccuccuaguuugcucu

SEQ ID NO: 4090657 - RNA, 21 nt, Streptococcus pneumoniae R6
agccucuugaguaauucucca

SEQ ID NO: 4090658 - RNA, 16 nt, Streptococcus pneumoniae R6
agccugaaucauguag

SEQ ID NO: 4090659 - RNA, 13 nt, Streptococcus pneumoniae R6
agccugagaagac

SEQ ID NO: 4090660 - RNA, 21 nt, Streptococcus pneumoniae R6
agccugagaagacaucuucuc

SEQ ID NO: 4090661 - RNA, 18 nt, Streptococcus pneumoniae R6
agccugagaugauucuca

SEQ ID NO: 4090662 - RNA, 18 nt, Streptococcus pneumoniae R6
agccuguaaaaagugaaa

SEQ ID NO: 4090663 - RNA, 22 nt, Streptococcus pneumoniae R6
agccuuaccaccuuuaaauccu

SEQ ID NO: 4090664 - RNA, 21 nt, Streptococcus pneumoniae R6
agccuucuggucugauuuuca

SEQ ID NO: 4090665 - RNA, 12 nt, Streptococcus pneumoniae R6
agccuucuucca

SEQ ID NO: 4090666 - RNA, 20 nt, Streptococcus pneumoniae R6
agccuucuugguuuuugcca

SEQ ID NO: 4090667 - RNA, 12 nt, Streptococcus pneumoniae R6
agccuucuuuuu

SEQ ID NO: 4090668 - RNA, 17 nt, Streptococcus pneumoniae R6
agccuucuuuuuacaua

SEQ ID NO: 4090669 - RNA, 17 nt, Streptococcus pneumoniae R6
agccuugacuccccauu

SEQ ID NO: 4090670 - RNA, 22 nt, Streptococcus pneumoniae R6
agccuugaguggauuuuuaaga

SEQ ID NO: 4090671 - RNA, 18 nt, Streptococcus pneumoniae R6
agccuuugucguuccaag

SEQ ID NO: 4090672 - RNA, 15 nt, Streptococcus pneumoniae R6
agccuuuuucuucuu

SEQ ID NO: 4090673 - RNA, 17 nt, Streptococcus pneumoniae R6
agcgaaaggagaaaaaa

SEQ ID NO: 4090674 - RNA, 18 nt, Streptococcus pneumoniae R6
agcgaaaggagaaaaaua

SEQ ID NO: 4090675 - RNA, 12 nt, Streptococcus pneumoniae R6
agcgaaaucaac

SEQ ID NO: 4090676 - RNA, 14 nt, Streptococcus pneumoniae R6
agcgaaaucaacac

SEQ ID NO: 4090677 - RNA, 13 nt, Streptococcus pneumoniae R6
agcgaaauucucg

SEQ ID NO: 4090678 - RNA, 12 nt, Streptococcus pneumoniae R6
agcgaacaucuc

SEQ ID NO: 4090679 - RNA, 16 nt, Streptococcus pneumoniae R6
agcgaacaucuccaac

SEQ ID NO: 4090680 - RNA, 21 nt, Streptococcus pneumoniae R6
agcgaagaucuagaaaggaca

SEQ ID NO: 4090681 - RNA, 13 nt, Streptococcus pneumoniae R6
agcgacauugacu

SEQ ID NO: 4090682 - RNA, 15 nt, Streptococcus pneumoniae R6
agcgacuauaaaaaa

SEQ ID NO: 4090683 - RNA, 20 nt, Streptococcus pneumoniae R6
agcgacuauaaaaaagugaa

SEQ ID NO: 4090684 - RNA, 22 nt, Streptococcus pneumoniae R6
agcgacuauaaaaaagugaaca

SEQ ID NO: 4090685 - RNA, 22 nt, Streptococcus pneumoniae R6
agcgacuuucuucgaaauucca

SEQ ID NO: 4090686 - RNA, 20 nt, Streptococcus pneumoniae R6
agcgaguuucgauugaaauu

SEQ ID NO: 4090687 - RNA, 12 nt, Streptococcus pneumoniae R6
agcgauagaugu

SEQ ID NO: 4090688 - RNA, 15 nt, Streptococcus pneumoniae R6
agcgauugaaacagc

SEQ ID NO: 4090689 - RNA, 14 nt, Streptococcus pneumoniae R6
agcgcaaagcuaaa

SEQ ID NO: 4090690 - RNA, 14 nt, Streptococcus pneumoniae R6
agcgcaggaagaaa

SEQ ID NO: 4090691 - RNA, 15 nt, Streptococcus pneumoniae R6
agcgccuuaagaaca

SEQ ID NO: 4090692 - RNA, 18 nt, Streptococcus pneumoniae R6
agcgcucgaugucuugga

SEQ ID NO: 4090693 - RNA, 15 nt, Streptococcus pneumoniae R6
agcgcuugauagccu

SEQ ID NO: 4090694 - RNA, 17 nt, Streptococcus pneumoniae R6
agcggauauucguugga

SEQ ID NO: 4090695 - RNA, 19 nt, Streptococcus pneumoniae R6
agcggauguuauagcugga

SEQ ID NO: 4090696 - RNA, 15 nt, Streptococcus pneumoniae R6
agcggauuuggcuuu

SEQ ID NO: 4090697 - RNA, 22 nt, Streptococcus pneumoniae R6
agcgggauuuaaaauaagagga

SEQ ID NO: 4090698 - RNA, 16 nt, Streptococcus pneumoniae R6
agcggugaaucuagua

SEQ ID NO: 4090699 - RNA, 20 nt, Streptococcus pneumoniae R6
agcgguucagcucaacugcg

SEQ ID NO: 4090700 - RNA, 23 nt, Streptococcus pneumoniae R6
agcgucuaacaauuaggaacuuu

SEQ ID NO: 4090701 - RNA, 12 nt, Streptococcus pneumoniae R6
agcgugucaaga

SEQ ID NO: 4090702 - RNA, 12 nt, Streptococcus pneumoniae R6
agcguugauucc

SEQ ID NO: 4090703 - RNA, 15 nt, Streptococcus pneumoniae R6
agcguuggcugucau

SEQ ID NO: 4090704 - RNA, 19 nt, Streptococcus pneumoniae R6
agcguuuucuacagcugua

SEQ ID NO: 4090705 - RNA, 16 nt, Streptococcus pneumoniae R6
agcuaaaagcaaagca

SEQ ID NO: 4090706 - RNA, 23 nt, Streptococcus pneumoniae R6
agcuaaaucuaaucauucugaac

SEQ ID NO: 4090707 - RNA, 15 nt, Streptococcus pneumoniae R6
agcuaagaaaguaag

SEQ ID NO: 4090708 - RNA, 13 nt, Streptococcus pneumoniae R6
agcuaagcucgag

SEQ ID NO: 4090709 - RNA, 20 nt, Streptococcus pneumoniae R6
agcuaagcucgauaaaggac

SEQ ID NO: 4090710 - RNA, 22 nt, Streptococcus pneumoniae R6
agcuaaggaggcaaagaaaaaa

SEQ ID NO: 4090711 - RNA, 14 nt, Streptococcus pneumoniae R6
agcuaauagagcug

SEQ ID NO: 4090712 - RNA, 14 nt, Streptococcus pneumoniae R6
agcuaauuuugcca

SEQ ID NO: 4090713 - RNA, 19 nt, Streptococcus pneumoniae R6
agcuaauuuuuugagcaau

SEQ ID NO: 4090714 - RNA, 12 nt, Streptococcus pneumoniae R6
agcuacaaucug

SEQ ID NO: 4090715 - RNA, 14 nt, Streptococcus pneumoniae R6
agcuacagagcuaa

SEQ ID NO: 4090716 - RNA, 22 nt, Streptococcus pneumoniae R6
agcuacauagagauugauaucu

SEQ ID NO: 4090717 - RNA, 16 nt, Streptococcus pneumoniae R6
agcuaccagaccaagu

SEQ ID NO: 4090718 - RNA, 22 nt, Streptococcus pneumoniae R6
agcuacgacaccugacaaugua

SEQ ID NO: 4090719 - RNA, 16 nt, Streptococcus pneumoniae R6
agcuacggaacagucg

SEQ ID NO: 4090720 - RNA, 15 nt, Streptococcus pneumoniae R6
agcuagaguuucaau

SEQ ID NO: 4090721 - RNA, 15 nt, Streptococcus pneumoniae R6
agcuagauauuucca

SEQ ID NO: 4090722 - RNA, 16 nt, Streptococcus pneumoniae R6
agcuagcaacagauga

SEQ ID NO: 4090723 - RNA, 19 nt, Streptococcus pneumoniae R6
agcuagccgcagguugcuc

SEQ ID NO: 4090724 - RNA, 13 nt, Streptococcus pneumoniae R6
agcuaggagagcu

SEQ ID NO: 4090725 - RNA, 20 nt, Streptococcus pneumoniae R6
agcuagucucagcuugcuca

SEQ ID NO: 4090726 - RNA, 13 nt, Streptococcus pneumoniae R6
agcuauaagccca

SEQ ID NO: 4090727 - RNA, 14 nt, Streptococcus pneumoniae R6
agcuauaagcccaa

SEQ ID NO: 4090728 - RNA, 19 nt, Streptococcus pneumoniae R6
agcuauaagcccaaaucau

SEQ ID NO: 4090729 - RNA, 23 nt, Streptococcus pneumoniae R6
agcuaugaauaugaguucuucaa

SEQ ID NO: 4090730 - RNA, 20 nt, Streptococcus pneumoniae R6
agcuauuaagaaaaaugauu

SEQ ID NO: 4090731 - RNA, 12 nt, Streptococcus pneumoniae R6
agcuauuucuug

SEQ ID NO: 4090732 - RNA, 15 nt, Streptococcus pneumoniae R6
agcuauuucuugcuu

SEQ ID NO: 4090733 - RNA, 16 nt, Streptococcus pneumoniae R6
agcuauuucuugcuua

SEQ ID NO: 4090734 - RNA, 21 nt, Streptococcus pneumoniae R6
uggaugauuuaauuagaaaaa

SEQ ID NO: 4090735 - RNA, 16 nt, Streptococcus pneumoniae R6
uggauguuucuuuaaa

SEQ ID NO: 4090736 - RNA, 20 nt, Streptococcus pneumoniae R6
uggauuaauccccauuugcu

SEQ ID NO: 4090737 - RNA, 23 nt, Streptococcus pneumoniae R6
uggauuaauccccauuugcuuca

SEQ ID NO: 4090738 - RNA, 15 nt, Streptococcus pneumoniae R6
uggauuauuaccuug

SEQ ID NO: 4090739 - RNA, 21 nt, Streptococcus pneumoniae R6
uggauuauuaccuugaacgac

SEQ ID NO: 4090740 - RNA, 19 nt, Streptococcus pneumoniae R6
uggauucuuuguuaaauga

SEQ ID NO: 4090741 - RNA, 20 nt, Streptococcus pneumoniae R6
uggauucuuuguuaaaugaa

SEQ ID NO: 4090742 - RNA, 14 nt, Streptococcus pneumoniae R6
uggauugaaauaag

SEQ ID NO: 4090743 - RNA, 18 nt, Streptococcus pneumoniae R6
uggauugaccaagcuauc

SEQ ID NO: 4090744 - RNA, 13 nt, Streptococcus pneumoniae R6
uggauuuaaaaac

SEQ ID NO: 4090745 - RNA, 19 nt, Streptococcus pneumoniae R6
uggauuuauaguaaaauga

SEQ ID NO: 4090746 - RNA, 21 nt, Streptococcus pneumoniae R6
uggauuuaucaguauauugaa

SEQ ID NO: 4090747 - RNA, 18 nt, Streptococcus pneumoniae R6
uggauuugucauucagau

SEQ ID NO: 4090748 - RNA, 21 nt, Streptococcus pneumoniae R6
uggauuuuaaaaguuuuauua

SEQ ID NO: 4090749 - RNA, 17 nt, Streptococcus pneumoniae R6
uggauuuucacgaguca

SEQ ID NO: 4090750 - RNA, 22 nt, Streptococcus pneumoniae R6
uggauuuucagccucuauacuu

SEQ ID NO: 4090751 - RNA, 15 nt, Streptococcus pneumoniae R6
uggauuuuguuucuu

SEQ ID NO: 4090752 - RNA, 15 nt, Streptococcus pneumoniae R6
uggauuuuucuucuu

SEQ ID NO: 4090753 - RNA, 16 nt, Streptococcus pneumoniae R6
uggauuuuugauucag

SEQ ID NO: 4090754 - RNA, 19 nt, Streptococcus pneumoniae R6
uggcaaaaaauugagaaag

SEQ ID NO: 4090755 - RNA, 21 nt, Streptococcus pneumoniae R6
uggcaaaauuagcucaaaaca

SEQ ID NO: 4090756 - RNA, 23 nt, Streptococcus pneumoniae R6
uggcaaauagaagauuuccucca

SEQ ID NO: 4090757 - RNA, 23 nt, Streptococcus pneumoniae R6
uggcaaauuccuugaugagcaaa

SEQ ID NO: 4090758 - RNA, 21 nt, Streptococcus pneumoniae R6
uggcaaauuugaccauuucaa

SEQ ID NO: 4090759 - RNA, 15 nt, Streptococcus pneumoniae R6
uggcaacgacaggag

SEQ ID NO: 4090760 - RNA, 18 nt, Streptococcus pneumoniae R6
uggcaacguuaaagaguu

SEQ ID NO: 4090761 - RNA, 15 nt, Streptococcus pneumoniae R6
uggcaagaucaaguu

SEQ ID NO: 4090762 - RNA, 15 nt, Streptococcus pneumoniae R6
uggucuucaugcugg

SEQ ID NO: 4090763 - RNA, 18 nt, Streptococcus pneumoniae R6
uggugacauggacacaua

SEQ ID NO: 4090764 - RNA, 12 nt, Streptococcus pneumoniae R6
uggugagaaagu

SEQ ID NO: 4090765 - RNA, 14 nt, Streptococcus pneumoniae R6
uggugagaagaggg

SEQ ID NO: 4090766 - RNA, 19 nt, Streptococcus pneumoniae R6
uggugcuauuuguuguaag

SEQ ID NO: 4090767 - RNA, 17 nt, Streptococcus pneumoniae R6
ugguggcuaccaaguaa

SEQ ID NO: 4090768 - RNA, 22 nt, Streptococcus pneumoniae R6
uggugggaccuguccuaggucu

SEQ ID NO: 4090769 - RNA, 15 nt, Streptococcus pneumoniae R6
ugguguaauaaacug

SEQ ID NO: 4090770 - RNA, 22 nt, Streptococcus pneumoniae R6
ugguguuggauuaugauuuaaa

SEQ ID NO: 4090771 - RNA, 12 nt, Streptococcus pneumoniae R6
ugguuaaaaguu

SEQ ID NO: 4090772 - RNA, 13 nt, Streptococcus pneumoniae R6
ugguuaaaggcug

SEQ ID NO: 4090773 - RNA, 19 nt, Streptococcus pneumoniae R6
ugguuaccucauaucucuu

SEQ ID NO: 4090774 - RNA, 13 nt, Streptococcus pneumoniae R6
ugguuauacauag

SEQ ID NO: 4090775 - RNA, 14 nt, Streptococcus pneumoniae R6
ugguuaucuuuaaa

SEQ ID NO: 4090776 - RNA, 16 nt, Streptococcus pneumoniae R6
ugguuauggaaaauga

SEQ ID NO: 4090777 - RNA, 18 nt, Streptococcus pneumoniae R6
ugguuauggaaaaugaua

SEQ ID NO: 4090778 - RNA, 18 nt, Streptococcus pneumoniae R6
ugguucccagcaugguca

SEQ ID NO: 4090779 - RNA, 12 nt, Streptococcus pneumoniae R6
ugguucucucuu

SEQ ID NO: 4090780 - RNA, 18 nt, Streptococcus pneumoniae R6
ugguucucucuuuuugau

SEQ ID NO: 4090781 - RNA, 13 nt, Streptococcus pneumoniae R6
ugguugaaaacaa

SEQ ID NO: 4090782 - RNA, 17 nt, Streptococcus pneumoniae R6
ugguugacuggaccaga

SEQ ID NO: 4090783 - RNA, 14 nt, Streptococcus pneumoniae R6
ugguugcuuccucc

SEQ ID NO: 4090784 - RNA, 13 nt, Streptococcus pneumoniae R6
ugguuuaaaaaga

SEQ ID NO: 4090785 - RNA, 17 nt, Streptococcus pneumoniae R6
ugguuuauuggcuacga

SEQ ID NO: 4090786 - RNA, 22 nt, Streptococcus pneumoniae R6
ugguuucagucaauaccaggua

SEQ ID NO: 4090787 - RNA, 23 nt, Streptococcus pneumoniae R6
ugguuuccuaguuugcucuauga

SEQ ID NO: 4090788 - RNA, 13 nt, Streptococcus pneumoniae R6
ugguuuccuuggu

SEQ ID NO: 4090789 - RNA, 17 nt, Streptococcus pneumoniae R6
ugguuucuggcuauuaa

SEQ ID NO: 4090790 - RNA, 15 nt, Streptococcus pneumoniae R6
ugguuugaaaaugua

SEQ ID NO: 4090791 - RNA, 15 nt, Streptococcus pneumoniae R6
ugguuugaagagauu

SEQ ID NO: 4090792 - RNA, 19 nt, Streptococcus pneumoniae R6
ugguuuuuacugucuucag

SEQ ID NO: 4090793 - RNA, 13 nt, Streptococcus pneumoniae R6
ugguuuuucuuca

SEQ ID NO: 4090794 - RNA, 21 nt, Streptococcus pneumoniae R6
ugguuuuuuaacaaaaauuug

SEQ ID NO: 4090795 - RNA, 20 nt, Streptococcus pneumoniae R6
uguaaaaaaguaaaaagggu

SEQ ID NO: 4090796 - RNA, 13 nt, Streptococcus pneumoniae R6
uguaaaaagugaa

SEQ ID NO: 4090797 - RNA, 14 nt, Streptococcus pneumoniae R6
uguaaaaagugaaa

SEQ ID NO: 4090798 - RNA, 20 nt, Streptococcus pneumoniae R6
uguaaaaucuuugcauuauc

SEQ ID NO: 4090799 - RNA, 23 nt, Streptococcus pneumoniae R6
uguaaacaaguugcuugaaaacu

SEQ ID NO: 4090800 - RNA, 16 nt, Streptococcus pneumoniae R6
uguaaacgaauacuuu

SEQ ID NO: 4090801 - RNA, 18 nt, Streptococcus pneumoniae R6
uguaaacgaauacuuugu

SEQ ID NO: 4090802 - RNA, 16 nt, Streptococcus pneumoniae R6
uguaaacugugaugga

SEQ ID NO: 4090803 - RNA, 20 nt, Streptococcus pneumoniae R6
uguaaagcgaaaggagaaaa

SEQ ID NO: 4090804 - RNA, 21 nt, Streptococcus pneumoniae R6
uguaaagcgaaaggagaaaaa

SEQ ID NO: 4090805 - RNA, 22 nt, Streptococcus pneumoniae R6
uguaaagcgaaaggagaaaaaa

SEQ ID NO: 4090806 - RNA, 18 nt, Streptococcus pneumoniae R6
uguaaaguagcaaaacac

SEQ ID NO: 4090807 - RNA, 19 nt, Streptococcus pneumoniae R6
uguaaaguuaauugaauuu

SEQ ID NO: 4090808 - RNA, 23 nt, Streptococcus pneumoniae R6
uguaacaacuucacgagccaaga

SEQ ID NO: 4090809 - RNA, 22 nt, Streptococcus pneumoniae R6
uguaacgaugaccguugacuuc

SEQ ID NO: 4090810 - RNA, 20 nt, Streptococcus pneumoniae R6
uguaacguucuucaacaucg

SEQ ID NO: 4090811 - RNA, 15 nt, Streptococcus pneumoniae R6
uguaagaacuuuuua

SEQ ID NO: 4090812 - RNA, 21 nt, Streptococcus pneumoniae R6
uguaagaacuuuuuaaaguau

SEQ ID NO: 4090813 - RNA, 16 nt, Streptococcus pneumoniae R6
uguaagaauuugauua

SEQ ID NO: 4090814 - RNA, 17 nt, Streptococcus pneumoniae R6
uguaagauagagagauu

SEQ ID NO: 4090815 - RNA, 23 nt, Streptococcus pneumoniae R6
uguaaggagcagggcauagacug

SEQ ID NO: 4090816 - RNA, 16 nt, Streptococcus pneumoniae R6
uguaaggugcaaaaac

SEQ ID NO: 4090817 - RNA, 21 nt, Streptococcus pneumoniae R6
uguaagucaagucuucuuggu

SEQ ID NO: 4090818 - RNA, 16 nt, Streptococcus pneumoniae R6
uguaauaugaacaaaa

SEQ ID NO: 4090819 - RNA, 17 nt, Streptococcus pneumoniae R6
uguaaucuuagcaaaga

SEQ ID NO: 4090820 - RNA, 13 nt, Streptococcus pneumoniae R6
uguaaugaaauac

SEQ ID NO: 4090821 - RNA, 19 nt, Streptococcus pneumoniae R6
uguaaugacaauuauauaa

SEQ ID NO: 4090822 - RNA, 15 nt, Streptococcus pneumoniae R6
uguaaugacagugau

SEQ ID NO: 4090823 - RNA, 12 nt, Streptococcus pneumoniae R6
uguaauggcugu

SEQ ID NO: 4090824 - RNA, 19 nt, Streptococcus pneumoniae R6
uguaauuucugaaaucaac

SEQ ID NO: 4090825 - RNA, 20 nt, Streptococcus pneumoniae R6
uguacacauuauguaaacaa

SEQ ID NO: 4090826 - RNA, 15 nt, Streptococcus pneumoniae R6
uguacagaagacuag

SEQ ID NO: 4090827 - RNA, 19 nt, Streptococcus pneumoniae R6
uguacagaagacuaggcuu

SEQ ID NO: 4090828 - RNA, 21 nt, Streptococcus pneumoniae R6
uguacauuagaauucagcuuu

SEQ ID NO: 4090829 - RNA, 19 nt, Streptococcus pneumoniae R6
uguacccaaguaaucugca

SEQ ID NO: 4090830 - RNA, 21 nt, Streptococcus pneumoniae R6
uguaccguccccuuuuggauc

SEQ ID NO: 4090831 - RNA, 23 nt, Streptococcus pneumoniae R6
uguaccuaauuuuuuggcaaccu

SEQ ID NO: 4090832 - RNA, 22 nt, Streptococcus pneumoniae R6
uguacgaauuagguugaccauu

SEQ ID NO: 4090833 - RNA, 18 nt, Streptococcus pneumoniae R6
uguacuaugcguuuuauu

SEQ ID NO: 4090834 - RNA, 21 nt, Streptococcus pneumoniae R6
uguacugccccccaaaaaagu

SEQ ID NO: 4090835 - RNA, 21 nt, Streptococcus pneumoniae R6
uguacugccccccaaaaguua

SEQ ID NO: 4090836 - RNA, 23 nt, Streptococcus pneumoniae R6
uguacugccccccaaaaguuaga

SEQ ID NO: 4090837 - RNA, 19 nt, Streptococcus pneumoniae R6
uguacuuagccaagucagu

SEQ ID NO: 4090838 - RNA, 12 nt, Streptococcus pneumoniae R6
uguacuuuccaa

SEQ ID NO: 4090839 - RNA, 17 nt, Streptococcus pneumoniae R6
uguagaggcguuauuug

SEQ ID NO: 4090840 - RNA, 23 nt, Streptococcus pneumoniae R6
uguagcacuuuuccauuguuuua

SEQ ID NO: 4090841 - RNA, 11 nt, Streptococcus pneumoniae R6
uguaggcuagc

SEQ ID NO: 4090842 - RNA, 15 nt, Streptococcus pneumoniae R6
uguaggcuucuucuc

SEQ ID NO: 4090843 - RNA, 18 nt, Streptococcus pneumoniae R6
uguagguucgguuuccau

SEQ ID NO: 4090844 - RNA, 15 nt, Streptococcus pneumoniae R6
uguaguaaaagaauu

SEQ ID NO: 4090845 - RNA, 21 nt, Streptococcus pneumoniae R6
uguagucagcugucuuuucaa

SEQ ID NO: 4090846 - RNA, 17 nt, Streptococcus pneumoniae R6
uguaguggguugaagaa

SEQ ID NO: 4090847 - RNA, 19 nt, Streptococcus pneumoniae R6
uguaguggguugaagaaaa

SEQ ID NO: 4090848 - RNA, 13 nt, Streptococcus pneumoniae R6
uguaguuaauuga

SEQ ID NO: 4090849 - RNA, 20 nt, Streptococcus pneumoniae R6
uguaguuggauuuccacuaa

SEQ ID NO: 4090850 - RNA, 16 nt, Streptococcus pneumoniae R6
uguaguuuuaccacua

SEQ ID NO: 4090851 - RNA, 15 nt, Streptococcus pneumoniae R6
uguauaauaggugga

SEQ ID NO: 4090852 - RNA, 14 nt, Streptococcus pneumoniae R6
uguauacguuuuua

SEQ ID NO: 4090853 - RNA, 17 nt, Streptococcus pneumoniae R6
uguauacguuuuuacua

SEQ ID NO: 4090854 - RNA, 13 nt, Streptococcus pneumoniae R6
uguauacuuugca

SEQ ID NO: 4090855 - RNA, 12 nt, Streptococcus pneumoniae R6
uguauacuuuuu

SEQ ID NO: 4090856 - RNA, 19 nt, Streptococcus pneumoniae R6
uguauagugaacugaaucu

SEQ ID NO: 4090857 - RNA, 15 nt, Streptococcus pneumoniae R6
uguauagugaauuga

SEQ ID NO: 4090858 - RNA, 20 nt, Streptococcus pneumoniae R6
uguauagugaauugaaauaa

SEQ ID NO: 4090859 - RNA, 14 nt, Streptococcus pneumoniae R6
uguauccuccucua

SEQ ID NO: 4090860 - RNA, 23 nt, Streptococcus pneumoniae R6
uguaucgccucuucaauuuguuu

SEQ ID NO: 4090861 - RNA, 23 nt, Streptococcus pneumoniae R6
uguaucugaaccugauuggccgc

SEQ ID NO: 4090862 - RNA, 14 nt, Streptococcus pneumoniae R6
uguaugaaaaguuu

SEQ ID NO: 4090863 - RNA, 20 nt, Streptococcus pneumoniae R6
uguaugagaaacagcuccug

SEQ ID NO: 4090864 - RNA, 20 nt, Streptococcus pneumoniae R6
uguauggacgaagugcuucu

SEQ ID NO: 4090865 - RNA, 12 nt, Streptococcus pneumoniae R6
uguauuaagaac

SEQ ID NO: 4090866 - RNA, 14 nt, Streptococcus pneumoniae R6
uguauuaucaauau

SEQ ID NO: 4090867 - RNA, 17 nt, Streptococcus pneumoniae R6
uguauugguaacaaaaa

SEQ ID NO: 4090868 - RNA, 17 nt, Streptococcus pneumoniae R6
uguauuguacuuuccaa

SEQ ID NO: 4090869 - RNA, 13 nt, Streptococcus pneumoniae R6
uguauuuauagua

SEQ ID NO: 4090870 - RNA, 18 nt, Streptococcus pneumoniae R6
uguauuuggcgauuuuuu

SEQ ID NO: 4090871 - RNA, 23 nt, Streptococcus pneumoniae R6
ugucaaaaaggaaaacuuccaag

SEQ ID NO: 4090872 - RNA, 21 nt, Streptococcus pneumoniae R6
ugucaaaccaugagguaagag

SEQ ID NO: 4090873 - RNA, 21 nt, Streptococcus pneumoniae R6
ugucaaaucauccgaagcaaa

SEQ ID NO: 4090874 - RNA, 21 nt, Streptococcus pneumoniae R6
ugucaacuguaguggguugaa

SEQ ID NO: 4090875 - RNA, 22 nt, Streptococcus pneumoniae R6
ugucaaguuuggacggguaaag

SEQ ID NO: 4090876 - RNA, 14 nt, Streptococcus pneumoniae R6
ugucaauuuccauu

SEQ ID NO: 4090877 - RNA, 22 nt, Streptococcus pneumoniae R6
ugucacaauuacguuuaaagac

SEQ ID NO: 4090878 - RNA, 13 nt, Streptococcus pneumoniae R6
ugucacacaaaaa

SEQ ID NO: 4090879 - RNA, 16 nt, Streptococcus pneumoniae R6
ugucacauugagaaag

SEQ ID NO: 4090880 - RNA, 19 nt, Streptococcus pneumoniae R6
ugucagauaggauugcccu

SEQ ID NO: 4090881 - RNA, 15 nt, Streptococcus pneumoniae R6
ugucagcugaaagca

SEQ ID NO: 4090882 - RNA, 15 nt, Streptococcus pneumoniae R6
ugucagugacagaaa

SEQ ID NO: 4090883 - RNA, 18 nt, Streptococcus pneumoniae R6
ugucaucguuuuccuaga

SEQ ID NO: 4090884 - RNA, 20 nt, Streptococcus pneumoniae R6
ugucaucguuuuccuagaau

SEQ ID NO: 4090885 - RNA, 22 nt, Streptococcus pneumoniae R6
ugucauggcugaaagggcagua

SEQ ID NO: 4090886 - RNA, 22 nt, Streptococcus pneumoniae R6
ugucauguuagaaaaaugcaaa

SEQ ID NO: 4090887 - RNA, 14 nt, Streptococcus pneumoniae R6
uguccaacagacuc

SEQ ID NO: 4090888 - RNA, 19 nt, Streptococcus pneumoniae R6
uguccauaacgaguaaaag

SEQ ID NO: 4090889 - RNA, 17 nt, Streptococcus pneumoniae R6
uguccaucuguaauaug

SEQ ID NO: 4090890 - RNA, 14 nt, Streptococcus pneumoniae R6
uguccauuaugaua

SEQ ID NO: 4090891 - RNA, 15 nt, Streptococcus pneumoniae R6
ugucccugggacauc

SEQ ID NO: 4090892 - RNA, 19 nt, Streptococcus pneumoniae R6
uguccgcauagccaaauaa

SEQ ID NO: 4090893 - RNA, 21 nt, Streptococcus pneumoniae R6
uguccguaaaacgauaaauuc

SEQ ID NO: 4090894 - RNA, 17 nt, Streptococcus pneumoniae R6
uguccuaaauagaagau

SEQ ID NO: 4090895 - RNA, 15 nt, Streptococcus pneumoniae R6
uguccuaggucuaga

SEQ ID NO: 4090896 - RNA, 21 nt, Streptococcus pneumoniae R6
uguccuaguuggugacugacu

SEQ ID NO: 4090897 - RNA, 22 nt, Streptococcus pneumoniae R6
uguccucaauaagcccgaaaaa

SEQ ID NO: 4090898 - RNA, 22 nt, Streptococcus pneumoniae R6
uguccucaaugaguccgaaaaa

SEQ ID NO: 4090899 - RNA, 19 nt, Streptococcus pneumoniae R6
uguccugaaugauuucuuc

SEQ ID NO: 4090900 - RNA, 20 nt, Streptococcus pneumoniae R6
uguccugaucgauuuguucu

SEQ ID NO: 4090901 - RNA, 23 nt, Streptococcus pneumoniae R6
uguccugauuggugauauugucu

SEQ ID NO: 4090902 - RNA, 20 nt, Streptococcus pneumoniae R6
uguccuggucuuauuucauu

SEQ ID NO: 4090903 - RNA, 20 nt, Streptococcus pneumoniae R6
uguccuuucucgagcuuagc

SEQ ID NO: 4090904 - RNA, 17 nt, Streptococcus pneumoniae R6
uguccuuuuauuaucuu

SEQ ID NO: 4090905 - RNA, 19 nt, Streptococcus pneumoniae R6
ugucgauguuuugguuuuu

SEQ ID NO: 4090906 - RNA, 20 nt, Streptococcus pneumoniae R6
ugucgauugugauagcagua

SEQ ID NO: 4090907 - RNA, 15 nt, Streptococcus pneumoniae R6
ugucguagucuagga

SEQ ID NO: 4090908 - RNA, 17 nt, Streptococcus pneumoniae R6
ugucguugaaugaaaug

SEQ ID NO: 4090909 - RNA, 12 nt, Streptococcus pneumoniae R6
ugucguuuccuu

SEQ ID NO: 4090910 - RNA, 14 nt, Streptococcus pneumoniae R6
ugucguuuccuucc

SEQ ID NO: 4090911 - RNA, 22 nt, Streptococcus pneumoniae R6
ugucguuuccuuccaugauaga

SEQ ID NO: 4090912 - RNA, 15 nt, Streptococcus pneumoniae R6
ugucuaaaaauuuaa

SEQ ID NO: 4090913 - RNA, 22 nt, Streptococcus pneumoniae R6
ugucuaaaauuucauccucagg

SEQ ID NO: 4090914 - RNA, 13 nt, Streptococcus pneumoniae R6
ugucuaacuuuug

SEQ ID NO: 4090915 - RNA, 15 nt, Streptococcus pneumoniae R6
ugucuccaacaauua

SEQ ID NO: 4090916 - RNA, 14 nt, Streptococcus pneumoniae R6
ugucuccccaugag

SEQ ID NO: 4090917 - RNA, 18 nt, Streptococcus pneumoniae R6
ugucucuagguuaaaggu

SEQ ID NO: 4090918 - RNA, 15 nt, Streptococcus pneumoniae R6
ugucugaagauguga

SEQ ID NO: 4090919 - RNA, 16 nt, Streptococcus pneumoniae R6
ugucugaauauauaau

SEQ ID NO: 4090920 - RNA, 20 nt, Streptococcus pneumoniae R6
ugucugaauauauaauuaua

SEQ ID NO: 4090921 - RNA, 16 nt, Streptococcus pneumoniae R6
ugucuggaaugauaac

SEQ ID NO: 4090922 - RNA, 20 nt, Streptococcus pneumoniae R6
ugucuuaacaaaauuauuaa

SEQ ID NO: 4090923 - RNA, 16 nt, Streptococcus pneumoniae R6
ugucuuaccacaaaca

SEQ ID NO: 4090924 - RNA, 17 nt, Streptococcus pneumoniae R6
ugucuuacguucaucca

SEQ ID NO: 4090925 - RNA, 23 nt, Streptococcus pneumoniae R6
ugucuuacguucauccauaucuu

SEQ ID NO: 4090926 - RNA, 18 nt, Streptococcus pneumoniae R6
ugucuucaaaggucaaau

SEQ ID NO: 4090927 - RNA, 13 nt, Streptococcus pneumoniae R6
ugucuucagccuu

SEQ ID NO: 4090928 - RNA, 16 nt, Streptococcus pneumoniae R6
ugucuugcauuuuaau

SEQ ID NO: 4090929 - RNA, 17 nt, Streptococcus pneumoniae R6
ugucuugcauuuuaauu

SEQ ID NO: 4090930 - RNA, 19 nt, Streptococcus pneumoniae R6
ugucuugcauuuuaauuuc

SEQ ID NO: 4090931 - RNA, 11 nt, Streptococcus pneumoniae R6
ugugaaaaacu

SEQ ID NO: 4090932 - RNA, 23 nt, Streptococcus pneumoniae R6
ugugaaaaucgcaaguuuuuccc

SEQ ID NO: 4090933 - RNA, 23 nt, Streptococcus pneumoniae R6
ugugaacaacucuaucaggaaag

SEQ ID NO: 4090934 - RNA, 20 nt, Streptococcus pneumoniae R6
ugugaauauucuuggcaaag

SEQ ID NO: 4090935 - RNA, 21 nt, Streptococcus pneumoniae R6
ugugaauuuucaauuugauua

SEQ ID NO: 4090936 - RNA, 20 nt, Streptococcus pneumoniae R6
ugugacaaaauaaaaacauc

SEQ ID NO: 4090937 - RNA, 13 nt, Streptococcus pneumoniae R6
ugugacacuagcu

SEQ ID NO: 4090938 - RNA, 19 nt, Streptococcus pneumoniae R6
ugugacguggguguagaug

SEQ ID NO: 4090939 - RNA, 21 nt, Streptococcus pneumoniae R6
ugugaggaccagguuuuucac

SEQ ID NO: 4090940 - RNA, 12 nt, Streptococcus pneumoniae R6
ugugauaauggu

SEQ ID NO: 4090941 - RNA, 17 nt, Streptococcus pneumoniae R6
ugugauacgugaacaag

SEQ ID NO: 4090942 - RNA, 20 nt, Streptococcus pneumoniae R6
ugugauauaauaaaaagaga

SEQ ID NO: 4090943 - RNA, 21 nt, Streptococcus pneumoniae R6
ugugauauaauaaaaagagaa

SEQ ID NO: 4090944 - RNA, 18 nt, Streptococcus pneumoniae R6
ugugauuuaguagcauca

SEQ ID NO: 4090945 - RNA, 13 nt, Streptococcus pneumoniae R6
ugugauuucuaaa

SEQ ID NO: 4090946 - RNA, 15 nt, Streptococcus pneumoniae R6
ugugauuuuaaauuu

SEQ ID NO: 4090947 - RNA, 17 nt, Streptococcus pneumoniae R6
ugugauuuuaaauuuac

SEQ ID NO: 4090948 - RNA, 20 nt, Streptococcus pneumoniae R6
ugugauuuucgaaaauucuu

SEQ ID NO: 4090949 - RNA, 13 nt, Streptococcus pneumoniae R6
ugugauuuucuua

SEQ ID NO: 4090950 - RNA, 16 nt, Streptococcus pneumoniae R6
ugugauuuucuuauca

SEQ ID NO: 4090951 - RNA, 17 nt, Streptococcus pneumoniae R6
ugugauuuuuuuuggua

SEQ ID NO: 4090952 - RNA, 19 nt, Streptococcus pneumoniae R6
ugugcagggcgcuacaaca

SEQ ID NO: 4090953 - RNA, 16 nt, Streptococcus pneumoniae R6
ugugccaauucuuauc

SEQ ID NO: 4090954 - RNA, 15 nt, Streptococcus pneumoniae R6
ugugcuauucuaaau

SEQ ID NO: 4090955 - RNA, 22 nt, Streptococcus pneumoniae R6
ugugcucaaucaaguaagccau

SEQ ID NO: 4090956 - RNA, 15 nt, Streptococcus pneumoniae R6
ugugcuugauaaguu

SEQ ID NO: 4090957 - RNA, 15 nt, Streptococcus pneumoniae R6
uguggaauuggugca

SEQ ID NO: 4090958 - RNA, 14 nt, Streptococcus pneumoniae R6
uguggaugaaacug

SEQ ID NO: 4090959 - RNA, 17 nt, Streptococcus pneumoniae R6
uguggcgacuuccuugc

SEQ ID NO: 4090960 - RNA, 16 nt, Streptococcus pneumoniae R6
ugugguauuaacagcu

SEQ ID NO: 4090961 - RNA, 21 nt, Streptococcus pneumoniae R6
uguggucuugcuuuuuuauau

SEQ ID NO: 4090962 - RNA, 15 nt, Streptococcus pneumoniae R6
uguguaaaaaaguaa

SEQ ID NO: 4090963 - RNA, 18 nt, Streptococcus pneumoniae R6
uguguagcacuuuuccau

SEQ ID NO: 4090964 - RNA, 17 nt, Streptococcus pneumoniae R6
uguguauucguccaucc

SEQ ID NO: 4090965 - RNA, 23 nt, Streptococcus pneumoniae R6
ugugucuucgucuggauugacca

SEQ ID NO: 4090966 - RNA, 20 nt, Streptococcus pneumoniae R6
ugugugacaaaauaaaaaca

SEQ ID NO: 4090967 - RNA, 22 nt, Streptococcus pneumoniae R6
ugugugacaaaauaaaaacauc

SEQ ID NO: 4090968 - RNA, 18 nt, Streptococcus pneumoniae R6
uguguuaccgguuacaua

SEQ ID NO: 4090969 - RNA, 12 nt, Streptococcus pneumoniae R6
uguguucuacuc

SEQ ID NO: 4090970 - RNA, 15 nt, Streptococcus pneumoniae R6
uguguucuacucuaa

SEQ ID NO: 4090971 - RNA, 16 nt, Streptococcus pneumoniae R6
uguguugcuuuuugau

SEQ ID NO: 4090972 - RNA, 13 nt, Streptococcus pneumoniae R6
uguguuuuuucuu

SEQ ID NO: 4090973 - RNA, 18 nt, Streptococcus pneumoniae R6
uguguuuuuucuugcuug

SEQ ID NO: 4090974 - RNA, 21 nt, Streptococcus pneumoniae R6
uguuaaaaugagucuaucaaa

SEQ ID NO: 4090975 - RNA, 16 nt, Streptococcus pneumoniae R6
uguuaaacaaggcaga

SEQ ID NO: 4090976 - RNA, 19 nt, Streptococcus pneumoniae R6
uguuaaaugaauauauucc

SEQ ID NO: 4090977 - RNA, 17 nt, Streptococcus pneumoniae R6
uguuaagccuauucccu

SEQ ID NO: 4090978 - RNA, 15 nt, Streptococcus pneumoniae R6
uguuaaugauagcuu

SEQ ID NO: 4090979 - RNA, 18 nt, Streptococcus pneumoniae R6
uguuacagacaaaacugg

SEQ ID NO: 4090980 - RNA, 17 nt, Streptococcus pneumoniae R6
uguuaccacuuccuacc

SEQ ID NO: 4090981 - RNA, 21 nt, Streptococcus pneumoniae R6
uguuaccacuuccuaccuauu

SEQ ID NO: 4090982 - RNA, 22 nt, Streptococcus pneumoniae R6
uguuaccacuuccuaccuauuc

SEQ ID NO: 4090983 - RNA, 21 nt, Streptococcus pneumoniae R6
uguuacuuggcgaaggucuuu

SEQ ID NO: 4090984 - RNA, 15 nt, Streptococcus pneumoniae R6
uguuagaaaaaugca

SEQ ID NO: 4090985 - RNA, 14 nt, Streptococcus pneumoniae R6
uguuagaacaguca

SEQ ID NO: 4090986 - RNA, 20 nt, Streptococcus pneumoniae R6
uguuagauuaggaauuagag

SEQ ID NO: 4090987 - RNA, 23 nt, Streptococcus pneumoniae R6
uguuauagaaguacuaaugcccu

SEQ ID NO: 4090988 - RNA, 13 nt, Streptococcus pneumoniae R6
uguuauagauuca

SEQ ID NO: 4090989 - RNA, 17 nt, Streptococcus pneumoniae R6
uguuauagguaaaaucu

SEQ ID NO: 4090990 - RNA, 14 nt, Streptococcus pneumoniae R6
uguuaugauucucc

SEQ ID NO: 4090991 - RNA, 21 nt, Streptococcus pneumoniae R6
uguuauuaagauuacagauca

SEQ ID NO: 4090992 - RNA, 19 nt, Streptococcus pneumoniae R6
uguuauuuaggacaucaua

SEQ ID NO: 4090993 - RNA, 13 nt, Streptococcus pneumoniae R6
uguuauuucuuga

SEQ ID NO: 4090994 - RNA, 12 nt, Streptococcus pneumoniae R6
uguucaauggcu

SEQ ID NO: 4090995 - RNA, 20 nt, Streptococcus pneumoniae R6
uguucaaugggguucaucuc

SEQ ID NO: 4090996 - RNA, 23 nt, Streptococcus pneumoniae R6
uguucacgauuggggucagaaag

SEQ ID NO: 4090997 - RNA, 20 nt, Streptococcus pneumoniae R6
uguucaggugcgagagcuuu

SEQ ID NO: 4090998 - RNA, 13 nt, Streptococcus pneumoniae R6
uguucauaucuua

SEQ ID NO: 4090999 - RNA, 18 nt, Streptococcus pneumoniae R6
uguucaucuucuuucucc

SEQ ID NO: 4091000 - RNA, 23 nt, Streptococcus pneumoniae R6
uguuccacucgcugacacuggca

SEQ ID NO: 4091001 - RNA, 17 nt, Streptococcus pneumoniae R6
uguuccagacucaucug

SEQ ID NO: 4091002 - RNA, 19 nt, Streptococcus pneumoniae R6
uguuccgauuuuauuucau

SEQ ID NO: 4091003 - RNA, 14 nt, Streptococcus pneumoniae R6
uguuccuaaaacag

SEQ ID NO: 4091004 - RNA, 15 nt, Streptococcus pneumoniae R6
uguuccucuuuuugu

SEQ ID NO: 4091005 - RNA, 15 nt, Streptococcus pneumoniae R6
uguucgcaagauaga

SEQ ID NO: 4091006 - RNA, 13 nt, Streptococcus pneumoniae R6
uguucuaagaacu

SEQ ID NO: 4091007 - RNA, 18 nt, Streptococcus pneumoniae R6
uguucuaagguuucaaaa

SEQ ID NO: 4091008 - RNA, 21 nt, Streptococcus pneumoniae R6
uguucuacucuaaccauuaua

SEQ ID NO: 4091009 - RNA, 16 nt, Streptococcus pneumoniae R6
uguucuaucacauugu

SEQ ID NO: 4091010 - RNA, 14 nt, Streptococcus pneumoniae R6
uguucucauauuuu

SEQ ID NO: 4091011 - RNA, 14 nt, Streptococcus pneumoniae R6
uguucuguaaugaa

SEQ ID NO: 4091012 - RNA, 18 nt, Streptococcus pneumoniae R6
uguucuguaaugaaauac

SEQ ID NO: 4091013 - RNA, 17 nt, Streptococcus pneumoniae R6
uguucugucuguucucu

SEQ ID NO: 4091014 - RNA, 14 nt, Streptococcus pneumoniae R6
uguucuuauuucau

SEQ ID NO: 4091015 - RNA, 20 nt, Streptococcus pneumoniae R6
uguucuuauuucauuuuacu

SEQ ID NO: 4091016 - RNA, 17 nt, Streptococcus pneumoniae R6
uguucuucuaucuucuu

SEQ ID NO: 4091017 - RNA, 13 nt, Streptococcus pneumoniae R6
uguucuucugcug

SEQ ID NO: 4091018 - RNA, 12 nt, Streptococcus pneumoniae R6
uguucuuggaga

SEQ ID NO: 4091019 - RNA, 18 nt, Streptococcus pneumoniae R6
uguucuuuagaaagguuu

SEQ ID NO: 4091020 - RNA, 15 nt, Streptococcus pneumoniae R6
uguucuuuuucaaaa

SEQ ID NO: 4091021 - RNA, 17 nt, Streptococcus pneumoniae R6
uguugaccgacuauuuu

SEQ ID NO: 4091022 - RNA, 14 nt, Streptococcus pneumoniae R6
uguugauauuucca

SEQ ID NO: 4091023 - RNA, 14 nt, Streptococcus pneumoniae R6
uguugcaaauuuau

SEQ ID NO: 4091024 - RNA, 21 nt, Streptococcus pneumoniae R6
uguugcuggcaagauuuguuc

SEQ ID NO: 4091025 - RNA, 15 nt, Streptococcus pneumoniae R6
uguugcuuuucuuca

SEQ ID NO: 4091026 - RNA, 22 nt, Streptococcus pneumoniae R6
uguugguaagagaaauuucuga

SEQ ID NO: 4091027 - RNA, 18 nt, Streptococcus pneumoniae R6
uguuguaagcuagcaaca

SEQ ID NO: 4091028 - RNA, 14 nt, Streptococcus pneumoniae R6
uguuguaauuuuaa

SEQ ID NO: 4091029 - RNA, 16 nt, Streptococcus pneumoniae R6
uguuguaauuuuaaaa

SEQ ID NO: 4091030 - RNA, 13 nt, Streptococcus pneumoniae R6
uguuguaugaaaa

SEQ ID NO: 4091031 - RNA, 13 nt, Streptococcus pneumoniae R6
uguuuaaaaucug

SEQ ID NO: 4091032 - RNA, 19 nt, Streptococcus pneumoniae R6
uguuuaaagacgauguuga

SEQ ID NO: 4091033 - RNA, 18 nt, Streptococcus pneumoniae R6
uguuuaaagucucugucc

SEQ ID NO: 4091034 - RNA, 14 nt, Streptococcus pneumoniae R6
uguuuaaauacuuu

SEQ ID NO: 4091035 - RNA, 17 nt, Streptococcus pneumoniae R6
uguuuaagagcacaaaa

SEQ ID NO: 4091036 - RNA, 22 nt, Streptococcus pneumoniae R6
uguuuaagguggcgauuuuuuc

SEQ ID NO: 4091037 - RNA, 12 nt, Streptococcus pneumoniae R6
uguuuaauacuc

SEQ ID NO: 4091038 - RNA, 16 nt, Streptococcus pneumoniae R6
uguuuagcaucuaaau

SEQ ID NO: 4091039 - RNA, 18 nt, Streptococcus pneumoniae R6
uguuuagcaucuaaauga

SEQ ID NO: 4091040 - RNA, 18 nt, Streptococcus pneumoniae R6
uguuuauaaucauuaaaa

SEQ ID NO: 4091041 - RNA, 16 nt, Streptococcus pneumoniae R6
uguuuauagauaaaug

SEQ ID NO: 4091042 - RNA, 18 nt, Streptococcus pneumoniae R6
uguuuauagauaaauguu

SEQ ID NO: 4091043 - RNA, 12 nt, Streptococcus pneumoniae R6
uguuuauaucua

SEQ ID NO: 4091044 - RNA, 23 nt, Streptococcus pneumoniae R6
uguuucaaaugaaauauuuuuua

SEQ ID NO: 4091045 - RNA, 21 nt, Streptococcus pneumoniae R6
uguuucauggcaaauucacca

SEQ ID NO: 4091046 - RNA, 17 nt, Streptococcus pneumoniae R6
uguuucauguaagaguu

SEQ ID NO: 4091047 - RNA, 23 nt, Streptococcus pneumoniae R6
uguuuccaaggaaaguucuuccc

SEQ ID NO: 4091048 - RNA, 21 nt, Streptococcus pneumoniae R6
uguuucggaucauauuuucug

SEQ ID NO: 4091049 - RNA, 19 nt, Streptococcus pneumoniae R6
uguuucguacuauuucaga

SEQ ID NO: 4091050 - RNA, 16 nt, Streptococcus pneumoniae R6
uguuucguuucuucgu

SEQ ID NO: 4091051 - RNA, 12 nt, Streptococcus pneumoniae R6
uguuucuaaaac

SEQ ID NO: 4091052 - RNA, 14 nt, Streptococcus pneumoniae R6
uguuucuaaaacau

SEQ ID NO: 4091053 - RNA, 19 nt, Streptococcus pneumoniae R6
uguuucuaaaacauuguga

SEQ ID NO: 4091054 - RNA, 20 nt, Streptococcus pneumoniae R6
uguuucuaaaacauugugag

SEQ ID NO: 4091055 - RNA, 23 nt, Streptococcus pneumoniae R6
uguuucucggucuuguuuuuaua

SEQ ID NO: 4091056 - RNA, 14 nt, Streptococcus pneumoniae R6
uguuucuggaaguu

SEQ ID NO: 4091057 - RNA, 12 nt, Streptococcus pneumoniae R6
uguuucuuuuug

SEQ ID NO: 4091058 - RNA, 19 nt, Streptococcus pneumoniae R6
uguuugaaucaauucuuca

SEQ ID NO: 4091059 - RNA, 18 nt, Streptococcus pneumoniae R6
uguuugccaucuagacua

SEQ ID NO: 4091060 - RNA, 15 nt, Streptococcus pneumoniae R6
uguuuggauuauuac

SEQ ID NO: 4091061 - RNA, 13 nt, Streptococcus pneumoniae R6
uguuugucaaaca

SEQ ID NO: 4091062 - RNA, 17 nt, Streptococcus pneumoniae R6
uguuuuaauauaauauc

SEQ ID NO: 4091063 - RNA, 15 nt, Streptococcus pneumoniae R6
uguuuuagaaaucac

SEQ ID NO: 4091064 - RNA, 23 nt, Streptococcus pneumoniae R6
uguuuuagaugauuggaaauuca

SEQ ID NO: 4091065 - RNA, 18 nt, Streptococcus pneumoniae R6
uguuuuaggaacaauaaa

SEQ ID NO: 4091066 - RNA, 20 nt, Streptococcus pneumoniae R6
uguuuuaggagguuauuggc

SEQ ID NO: 4091067 - RNA, 18 nt, Streptococcus pneumoniae R6
uguuuucaaaaagcauuc

SEQ ID NO: 4091068 - RNA, 22 nt, Streptococcus pneumoniae R6
uguuuucacuggaguucuuuuc

SEQ ID NO: 4091069 - RNA, 13 nt, Streptococcus pneumoniae R6
uguuuuccuuuca

SEQ ID NO: 4091070 - RNA, 16 nt, Streptococcus pneumoniae R6
uguuuuccuuucaaug

SEQ ID NO: 4091071 - RNA, 19 nt, Streptococcus pneumoniae R6
uguuuucuauagaaagcuu

SEQ ID NO: 4091072 - RNA, 12 nt, Streptococcus pneumoniae R6
uguuuucucaau

SEQ ID NO: 4091073 - RNA, 16 nt, Streptococcus pneumoniae R6
uguuuucuuaucuugu

SEQ ID NO: 4091074 - RNA, 19 nt, Streptococcus pneumoniae R6
uguuuucuuggucauuuga

SEQ ID NO: 4091075 - RNA, 18 nt, Streptococcus pneumoniae R6
uguuuugagguuguagau

SEQ ID NO: 4091076 - RNA, 21 nt, Streptococcus pneumoniae R6
uguuuuggcaacgacaggagu

SEQ ID NO: 4091077 - RNA, 14 nt, Streptococcus pneumoniae R6
uguuuugucgcuuu

SEQ ID NO: 4091078 - RNA, 15 nt, Streptococcus pneumoniae R6
uguuuuuaugauaua

SEQ ID NO: 4091079 - RNA, 21 nt, Streptococcus pneumoniae R6
uguuuuuccugauuaaaauca

SEQ ID NO: 4091080 - RNA, 21 nt, Streptococcus pneumoniae R6
uguuuuuucaaguaaagagcu

SEQ ID NO: 4091081 - RNA, 12 nt, Streptococcus pneumoniae R6
uguuuuuucaca

SEQ ID NO: 4091082 - RNA, 11 nt, Streptococcus pneumoniae R6
uguuuuuucau

SEQ ID NO: 4091083 - RNA, 18 nt, Streptococcus pneumoniae R6
uguuuuuuccguuuuaua

SEQ ID NO: 4091084 - RNA, 23 nt, Streptococcus pneumoniae R6
uuaaaaaaccaauucccaaacau

SEQ ID NO: 4091085 - RNA, 23 nt, Streptococcus pneumoniae R6
uuaaaaaagugguaucauauaaa

SEQ ID NO: 4091086 - RNA, 17 nt, Streptococcus pneumoniae R6
uuaaaaaauaacucugu

SEQ ID NO: 4091087 - RNA, 12 nt, Streptococcus pneumoniae R6
uuaaaacaaaga

SEQ ID NO: 4091088 - RNA, 15 nt, Streptococcus pneumoniae R6
uuaaaacaaagaaaa

SEQ ID NO: 4091089 - RNA, 19 nt, Streptococcus pneumoniae R6
uuaaaacaaagaaaaagaa

SEQ ID NO: 4091090 - RNA, 12 nt, Streptococcus pneumoniae R6
uuaaaacagugu

SEQ ID NO: 4091091 - RNA, 13 nt, Streptococcus pneumoniae R6
uuaaaacaguguu

SEQ ID NO: 4091092 - RNA, 22 nt, Streptococcus pneumoniae R6
uuaaaacaguguuuugagcuga

SEQ ID NO: 4091093 - RNA, 15 nt, Streptococcus pneumoniae R6
uuaaaaguaagagaa

SEQ ID NO: 4091094 - RNA, 16 nt, Streptococcus pneumoniae R6
uuaaaaguaagagaaa

SEQ ID NO: 4091095 - RNA, 17 nt, Streptococcus pneumoniae R6
uuaaaaguaagagaaac

SEQ ID NO: 4091096 - RNA, 22 nt, Streptococcus pneumoniae R6
uuaaaauaaguucaacaaauca

SEQ ID NO: 4091097 - RNA, 14 nt, Streptococcus pneumoniae R6
uuaaaaucaaaaaa

SEQ ID NO: 4091098 - RNA, 21 nt, Streptococcus pneumoniae R6
uuaaaaucaaaaaacguauaa

SEQ ID NO: 4091099 - RNA, 15 nt, Streptococcus pneumoniae R6
uuaaaauccauaauu

SEQ ID NO: 4091100 - RNA, 18 nt, Streptococcus pneumoniae R6
uuaaaauccauaauuacc

SEQ ID NO: 4091101 - RNA, 17 nt, Streptococcus pneumoniae R6
uuaaaaucguagucuuu

SEQ ID NO: 4091102 - RNA, 15 nt, Streptococcus pneumoniae R6
uuaaaaugccaaaga

SEQ ID NO: 4091103 - RNA, 12 nt, Streptococcus pneumoniae R6
uuaaaauuaaaa

SEQ ID NO: 4091104 - RNA, 15 nt, Streptococcus pneumoniae R6
uuaaaauuaaaaaga

SEQ ID NO: 4091105 - RNA, 14 nt, Streptococcus pneumoniae R6
uuaaacaaaaagaa

SEQ ID NO: 4091106 - RNA, 15 nt, Streptococcus pneumoniae R6
uuaaacaaagucuga

SEQ ID NO: 4091107 - RNA, 12 nt, Streptococcus pneumoniae R6
uuaaacaaccuu

SEQ ID NO: 4091108 - RNA, 19 nt, Streptococcus pneumoniae R6
uuaaacaugucuauagaac

SEQ ID NO: 4091109 - RNA, 20 nt, Streptococcus pneumoniae R6
uuaaacaugucuauagaacu

SEQ ID NO: 4091110 - RNA, 18 nt, Streptococcus pneumoniae R6
uuaaaccaauuuuaagaa

SEQ ID NO: 4091111 - RNA, 15 nt, Streptococcus pneumoniae R6
uuaaaccuuccaaga

SEQ ID NO: 4091112 - RNA, 21 nt, Streptococcus pneumoniae R6
uuaaacgugcuauaucaaaac

SEQ ID NO: 4091113 - RNA, 18 nt, Streptococcus pneumoniae R6
uuaaacuaauguaaaaaa

SEQ ID NO: 4091114 - RNA, 22 nt, Streptococcus pneumoniae R6
uuaaacuaauguaaaaaaguug

SEQ ID NO: 4091115 - RNA, 19 nt, Streptococcus pneumoniae R6
uuaaacuaguuuucuaaag

SEQ ID NO: 4091116 - RNA, 11 nt, Streptococcus pneumoniae R6
uuaaacuuuuc

SEQ ID NO: 4091117 - RNA, 14 nt, Streptococcus pneumoniae R6
uuaaagaaauagaa

SEQ ID NO: 4091118 - RNA, 22 nt, Streptococcus pneumoniae R6
uuaaagacagucugaaaaagag

SEQ ID NO: 4091119 - RNA, 21 nt, Streptococcus pneumoniae R6
uuaaagacagucugaaaaaua

SEQ ID NO: 4091120 - RNA, 11 nt, Streptococcus pneumoniae R6
uuaaagauucc

SEQ ID NO: 4091121 - RNA, 16 nt, Streptococcus pneumoniae R6
uuaaaggaauuuuauu

SEQ ID NO: 4091122 - RNA, 17 nt, Streptococcus pneumoniae R6
uuaaaguuaauagaaga

SEQ ID NO: 4091123 - RNA, 19 nt, Streptococcus pneumoniae R6
uuaaaguuccggaaaccaa

SEQ ID NO: 4091124 - RNA, 21 nt, Streptococcus pneumoniae R6
uuaaauaaaauuuuuuucaaa

SEQ ID NO: 4091125 - RNA, 22 nt, Streptococcus pneumoniae R6
uuaaauagagccuucuuccauc

SEQ ID NO: 4091126 - RNA, 17 nt, Streptococcus pneumoniae R6
uuaaauaguucuuccaa

SEQ ID NO: 4091127 - RNA, 13 nt, Streptococcus pneumoniae R6
uuaaaucauaauc

SEQ ID NO: 4091128 - RNA, 23 nt, Streptococcus pneumoniae R6
uuaaauccaagccugucuguaag

SEQ ID NO: 4091129 - RNA, 18 nt, Streptococcus pneumoniae R6
uuaaauccgauaauauau

SEQ ID NO: 4091130 - RNA, 24 nt, Streptococcus pneumoniae R6
uuaaauccuauaccaagcucagca

SEQ ID NO: 4091131 - RNA, 18 nt, Streptococcus pneumoniae R6
uuaaauccugcaaagaua

SEQ ID NO: 4091132 - RNA, 18 nt, Streptococcus pneumoniae R6
uuaaaucgcuucuguaac

SEQ ID NO: 4091133 - RNA, 16 nt, Streptococcus pneumoniae R6
uuaaaugaguaugaaa

SEQ ID NO: 4091134 - RNA, 17 nt, Streptococcus pneumoniae R6
uuaaaugcugguuuuua

SEQ ID NO: 4091135 - RNA, 17 nt, Streptococcus pneumoniae R6
uuaaauguuuucucaua

SEQ ID NO: 4091136 - RNA, 17 nt, Streptococcus pneumoniae R6
uuaaauugcgauuuugc

SEQ ID NO: 4091137 - RNA, 20 nt, Streptococcus pneumoniae R6
uuaaauugcgauuuugccaa

SEQ ID NO: 4091138 - RNA, 21 nt, Streptococcus pneumoniae R6
uuaaauugguguuguuuauua

SEQ ID NO: 4091139 - RNA, 23 nt, Streptococcus pneumoniae R6
uuaaauuuuucugcaaaaaauau

SEQ ID NO: 4091140 - RNA, 23 nt, Streptococcus pneumoniae R6
uuaacaaaaucgcuaagaggguc

SEQ ID NO: 4091141 - RNA, 21 nt, Streptococcus pneumoniae R6
uuaacaauaaucuaugauagg

SEQ ID NO: 4091142 - RNA, 20 nt, Streptococcus pneumoniae R6
uuaacagauuuuucuguuuu

SEQ ID NO: 4091143 - RNA, 21 nt, Streptococcus pneumoniae R6
uuaacaggauauuucuccaaa

SEQ ID NO: 4091144 - RNA, 15 nt, Streptococcus pneumoniae R6
uuaacauuaacauca

SEQ ID NO: 4091145 - RNA, 17 nt, Streptococcus pneumoniae R6
uuaaccacaaaaagugu

SEQ ID NO: 4091146 - RNA, 13 nt, Streptococcus pneumoniae R6
uuaacccaaccac

SEQ ID NO: 4091147 - RNA, 21 nt, Streptococcus pneumoniae R6
uuaacgauugaaauaacccac

SEQ ID NO: 4091148 - RNA, 19 nt, Streptococcus pneumoniae R6
uuaacgccucccaauuaaa

SEQ ID NO: 4091149 - RNA, 20 nt, Streptococcus pneumoniae R6
uuaacuccuuuguuuauaga

SEQ ID NO: 4091150 - RNA, 23 nt, Streptococcus pneumoniae R6
uuaacuucaggauuuuuacagua

SEQ ID NO: 4091151 - RNA, 14 nt, Streptococcus pneumoniae R6
uuaacuuucugguc

SEQ ID NO: 4091152 - RNA, 16 nt, Streptococcus pneumoniae R6
uuaacuuuuccaguaa

SEQ ID NO: 4091153 - RNA, 13 nt, Streptococcus pneumoniae R6
uuaagaacaucuu

SEQ ID NO: 4091154 - RNA, 19 nt, Streptococcus pneumoniae R6
uuaagaacucuuuccaacu

SEQ ID NO: 4091155 - RNA, 18 nt, Streptococcus pneumoniae R6
uuaagaagucaucuauca

SEQ ID NO: 4091156 - RNA, 12 nt, Streptococcus pneumoniae R6
uuaagaaucuuu

SEQ ID NO: 4091157 - RNA, 20 nt, Streptococcus pneumoniae R6
uuaagacacuuuuauuaugg

SEQ ID NO: 4091158 - RNA, 20 nt, Streptococcus pneumoniae R6
uuaagacuaaguuagaauaa

SEQ ID NO: 4091159 - RNA, 22 nt, Streptococcus pneumoniae R6
uuaagacuuguuagcugauuuu

SEQ ID NO: 4091160 - RNA, 12 nt, Streptococcus pneumoniae R6
uuaagagaguua

SEQ ID NO: 4091161 - RNA, 19 nt, Streptococcus pneumoniae R6
uuaagagguuuuacuaaau

SEQ ID NO: 4091162 - RNA, 13 nt, Streptococcus pneumoniae R6
uuaagaguaguau

SEQ ID NO: 4091163 - RNA, 13 nt, Streptococcus pneumoniae R6
uuaagaguuaaug

SEQ ID NO: 4091164 - RNA, 16 nt, Streptococcus pneumoniae R6
uuaagcaaaaaaagcc

SEQ ID NO: 4091165 - RNA, 23 nt, Streptococcus pneumoniae R6
uuaagccucuuucauagcaaaau

SEQ ID NO: 4091166 - RNA, 18 nt, Streptococcus pneumoniae R6
uuaagcugacuucgucag

SEQ ID NO: 4091167 - RNA, 23 nt, Streptococcus pneumoniae R6
uuaagcugacuucgucaguucua

SEQ ID NO: 4091168 - RNA, 23 nt, Streptococcus pneumoniae R6
uuaagcugacuucgucaguuuca

SEQ ID NO: 4091169 - RNA, 23 nt, Streptococcus pneumoniae R6
uuaagguugcagauagaacugac

SEQ ID NO: 4091170 - RNA, 23 nt, Streptococcus pneumoniae R6
uuaagguuguggauggaacugac

SEQ ID NO: 4091171 - RNA, 20 nt, Streptococcus pneumoniae R6
uuaaguaaucucugauaaua

SEQ ID NO: 4091172 - RNA, 18 nt, Streptococcus pneumoniae R6
uuaaguauccaucacagu

SEQ ID NO: 4091173 - RNA, 18 nt, Streptococcus pneumoniae R6
uuaagugacuauuaguuu

SEQ ID NO: 4091174 - RNA, 21 nt, Streptococcus pneumoniae R6
uuaagugguugauaaauuuca

SEQ ID NO: 4091175 - RNA, 23 nt, Streptococcus pneumoniae R6
uuaaguuauuucuccuaaagaaa

SEQ ID NO: 4091176 - RNA, 22 nt, Streptococcus pneumoniae R6
uuaauaacucgaucaacaaaca

SEQ ID NO: 4091177 - RNA, 15 nt, Streptococcus pneumoniae R6
uuaauaacucucauc

SEQ ID NO: 4091178 - RNA, 17 nt, Streptococcus pneumoniae R6
uuaauauauaaaaaaua

SEQ ID NO: 4091179 - RNA, 19 nt, Streptococcus pneumoniae R6
uuaauauauaaaaaauaua

SEQ ID NO: 4091180 - RNA, 14 nt, Streptococcus pneumoniae R6
uuaauauauaaaau

SEQ ID NO: 4091181 - RNA, 15 nt, Streptococcus pneumoniae R6
uuaauauauuuauua

SEQ ID NO: 4091182 - RNA, 17 nt, Streptococcus pneumoniae R6
uuaaucaaaauaaagca

SEQ ID NO: 4091183 - RNA, 15 nt, Streptococcus pneumoniae R6
uuaaucaaaugagca

SEQ ID NO: 4091184 - RNA, 16 nt, Streptococcus pneumoniae R6
uuaaucaauuaucauu

SEQ ID NO: 4091185 - RNA, 17 nt, Streptococcus pneumoniae R6
uuaaucacuaauuaucu

SEQ ID NO: 4091186 - RNA, 19 nt, Streptococcus pneumoniae R6
uuaaucauacacauguuaa

SEQ ID NO: 4091187 - RNA, 14 nt, Streptococcus pneumoniae R6
uuaaucauguaccu

SEQ ID NO: 4091188 - RNA, 15 nt, Streptococcus pneumoniae R6
uuaaucauuuaauaa

SEQ ID NO: 4091189 - RNA, 20 nt, Streptococcus pneumoniae R6
uuaaucauuuaauaaugaag

SEQ ID NO: 4091190 - RNA, 14 nt, Streptococcus pneumoniae R6
uuaaucucuccuua

SEQ ID NO: 4091191 - RNA, 21 nt, Streptococcus pneumoniae R6
uuaaucugaauguuucccuug

SEQ ID NO: 4091192 - RNA, 17 nt, Streptococcus pneumoniae R6
uuaaucugcuuacaugc

SEQ ID NO: 4091193 - RNA, 12 nt, Streptococcus pneumoniae R6
uuaaucuucaaa

SEQ ID NO: 4091194 - RNA, 19 nt, Streptococcus pneumoniae R6
uuaaucuucaaauuuuuca

SEQ ID NO: 4091195 - RNA, 18 nt, Streptococcus pneumoniae R6
uuaaugcuaauuuagaaa

SEQ ID NO: 4091196 - RNA, 16 nt, Streptococcus pneumoniae R6
uuaauggguguuuaua

SEQ ID NO: 4091197 - RNA, 18 nt, Streptococcus pneumoniae R6
uuaauguugguaagagaa

SEQ ID NO: 4091198 - RNA, 14 nt, Streptococcus pneumoniae R6
uuaauuagaaaaaa

SEQ ID NO: 4091199 - RNA, 18 nt, Streptococcus pneumoniae R6
uuaauuauacuauaaaac

SEQ ID NO: 4091200 - RNA, 13 nt, Streptococcus pneumoniae R6
uuaauuauuuuca

SEQ ID NO: 4091201 - RNA, 17 nt, Streptococcus pneumoniae R6
uuaauucucuuauuguu

SEQ ID NO: 4091202 - RNA, 21 nt, Streptococcus pneumoniae R6
uuaauugaauuucaagaauga

SEQ ID NO: 4091203 - RNA, 15 nt, Streptococcus pneumoniae R6
uuaauuggaaaauaa

SEQ ID NO: 4091204 - RNA, 14 nt, Streptococcus pneumoniae R6
uuaauuguagcuuu

SEQ ID NO: 4091205 - RNA, 22 nt, Streptococcus pneumoniae R6
uuaauuguagcuuuauuaagcc

SEQ ID NO: 4091206 - RNA, 13 nt, Streptococcus pneumoniae R6
uuaauuguauacg

SEQ ID NO: 4091207 - RNA, 14 nt, Streptococcus pneumoniae R6
uuaauuuaagagua

SEQ ID NO: 4091208 - RNA, 16 nt, Streptococcus pneumoniae R6
uuaauuuaaugcagua

SEQ ID NO: 4091209 - RNA, 16 nt, Streptococcus pneumoniae R6
uuaauuuauagaaaaa

SEQ ID NO: 4091210 - RNA, 12 nt, Streptococcus pneumoniae R6
uuaauuucuaua

SEQ ID NO: 4091211 - RNA, 13 nt, Streptococcus pneumoniae R6
uuaauuuuacuuu

SEQ ID NO: 4091212 - RNA, 18 nt, Streptococcus pneumoniae R6
uuaauuuuacuuucccaa

SEQ ID NO: 4091213 - RNA, 19 nt, Streptococcus pneumoniae R6
uuacaaguguuuucacuuc

SEQ ID NO: 4091214 - RNA, 16 nt, Streptococcus pneumoniae R6
uuacaaucauagacuu

SEQ ID NO: 4091215 - RNA, 13 nt, Streptococcus pneumoniae R6
uuacaauguaaua

SEQ ID NO: 4091216 - RNA, 17 nt, Streptococcus pneumoniae R6
uuacaauuuaccugcua

SEQ ID NO: 4091217 - RNA, 17 nt, Streptococcus pneumoniae R6
uuacacucaauuuaucu

SEQ ID NO: 4091218 - RNA, 16 nt, Streptococcus pneumoniae R6
uuacagaaagaacaaa

SEQ ID NO: 4091219 - RNA, 21 nt, Streptococcus pneumoniae R6
uuacaggcaggacaaaagaua

SEQ ID NO: 4091220 - RNA, 22 nt, Streptococcus pneumoniae R6
uuacaggcaggacaaaagauaa

SEQ ID NO: 4091221 - RNA, 13 nt, Streptococcus pneumoniae R6
uuacaguauuuau

SEQ ID NO: 4091222 - RNA, 14 nt, Streptococcus pneumoniae R6
uuacaguauuuaua

SEQ ID NO: 4091223 - RNA, 17 nt, Streptococcus pneumoniae R6
uuacauaauuuaaaaua

SEQ ID NO: 4091224 - RNA, 13 nt, Streptococcus pneumoniae R6
uuacauagacuuc

SEQ ID NO: 4091225 - RNA, 16 nt, Streptococcus pneumoniae R6
uuacauauucuaacuu

SEQ ID NO: 4091226 - RNA, 14 nt, Streptococcus pneumoniae R6
uuacaucuguuuua

SEQ ID NO: 4091227 - RNA, 18 nt, Streptococcus pneumoniae R6
uuacauuugaguuucucu

SEQ ID NO: 4091228 - RNA, 22 nt, Streptococcus pneumoniae R6
uuacauuugaguuucucuuacu

SEQ ID NO: 4091229 - RNA, 15 nt, Streptococcus pneumoniae R6
uuaccaaccucagaa

SEQ ID NO: 4091230 - RNA, 21 nt, Streptococcus pneumoniae R6
uuaccaagcucgauauucuuu

SEQ ID NO: 4091231 - RNA, 20 nt, Streptococcus pneumoniae R6
uuaccaagguuguuuaacuu

SEQ ID NO: 4091232 - RNA, 18 nt, Streptococcus pneumoniae R6
uuaccaaguccaagccuu

SEQ ID NO: 4091233 - RNA, 19 nt, Streptococcus pneumoniae R6
uuaccaaguccaagccuua

SEQ ID NO: 4091234 - RNA, 16 nt, Streptococcus pneumoniae R6
uuaccaaguuaaacaa

SEQ ID NO: 4091235 - RNA, 16 nt, Streptococcus pneumoniae R6
uuaccaauacaggaaa

SEQ ID NO: 4091236 - RNA, 17 nt, Streptococcus pneumoniae R6
uuaccacuuccuaccua

SEQ ID NO: 4091237 - RNA, 15 nt, Streptococcus pneumoniae R6
uuaccauaguuccga

SEQ ID NO: 4091238 - RNA, 21 nt, Streptococcus pneumoniae R6
uuacccauagauuuuuauuau

SEQ ID NO: 4091239 - RNA, 17 nt, Streptococcus pneumoniae R6
uuaccguauauauguua

SEQ ID NO: 4091240 - RNA, 18 nt, Streptococcus pneumoniae R6
uuaccugaaauauacuca

SEQ ID NO: 4091241 - RNA, 12 nt, Streptococcus pneumoniae R6
uuaccuguuuuc

SEQ ID NO: 4091242 - RNA, 17 nt, Streptococcus pneumoniae R6
uuaccuuucuuguaaua

SEQ ID NO: 4091243 - RNA, 19 nt, Streptococcus pneumoniae R6
uuacgaauuauuuccuuga

SEQ ID NO: 4091244 - RNA, 18 nt, Streptococcus pneumoniae R6
uuacgacaacgguaucuu

SEQ ID NO: 4091245 - RNA, 14 nt, Streptococcus pneumoniae R6
uuacgacauccuau

SEQ ID NO: 4091246 - RNA, 19 nt, Streptococcus pneumoniae R6
uuacgacauccuauuuauu

SEQ ID NO: 4091247 - RNA, 22 nt, Streptococcus pneumoniae R6
uuacgauucauaguuacuccuu

SEQ ID NO: 4091248 - RNA, 15 nt, Streptococcus pneumoniae R6
uuacggguuuuaaac

SEQ ID NO: 4091249 - RNA, 19 nt, Streptococcus pneumoniae R6
uuacguccaccacaaaaga

SEQ ID NO: 4091250 - RNA, 22 nt, Streptococcus pneumoniae R6
uuacguccaccacaaaagagaa

SEQ ID NO: 4091251 - RNA, 21 nt, Streptococcus pneumoniae R6
uuacuaaauacuagucuuucu

SEQ ID NO: 4091252 - RNA, 24 nt, Streptococcus pneumoniae R6
uuacuaaggcccaauuaaaaucaa

SEQ ID NO: 4091253 - RNA, 14 nt, Streptococcus pneumoniae R6
uuacuaauuaauua

SEQ ID NO: 4091254 - RNA, 15 nt, Streptococcus pneumoniae R6
uuacuaauuaauuaa

SEQ ID NO: 4091255 - RNA, 15 nt, Streptococcus pneumoniae R6
uuacuauacuagcuu

SEQ ID NO: 4091256 - RNA, 24 nt, Streptococcus pneumoniae R6
uuacuaucaaugauuuauuuguuu

SEQ ID NO: 4091257 - RNA, 16 nt, Streptococcus pneumoniae R6
uuacucaaauaaaaga

SEQ ID NO: 4091258 - RNA, 19 nt, Streptococcus pneumoniae R6
uuacucaaggacuaaguuc

SEQ ID NO: 4091259 - RNA, 12 nt, Streptococcus pneumoniae R6
uuacucucauuc

SEQ ID NO: 4091260 - RNA, 22 nt, Streptococcus pneumoniae R6
uuacucuccuccauaaaaagac

SEQ ID NO: 4091261 - RNA, 18 nt, Streptococcus pneumoniae R6
uuacucuuauuauucucu

SEQ ID NO: 4091262 - RNA, 17 nt, Streptococcus pneumoniae R6
uuacucuuugauuuuca

SEQ ID NO: 4091263 - RNA, 21 nt, Streptococcus pneumoniae R6
uuacugaacggugaacuucuu

SEQ ID NO: 4091264 - RNA, 21 nt, Streptococcus pneumoniae R6
uuacugacuucgucaguuuca

SEQ ID NO: 4091265 - RNA, 18 nt, Streptococcus pneumoniae R6
uuacuguugcugugcuug

SEQ ID NO: 4091266 - RNA, 20 nt, Streptococcus pneumoniae R6
uuacuuaccauaauuaaaga

SEQ ID NO: 4091267 - RNA, 21 nt, Streptococcus pneumoniae R6
uuagaaaaagacuugaaauac

SEQ ID NO: 4091268 - RNA, 12 nt, Streptococcus pneumoniae R6
uuagaaaaaguu

SEQ ID NO: 4091269 - RNA, 17 nt, Streptococcus pneumoniae R6
uuagaaaaucucuucaa

SEQ ID NO: 4091270 - RNA, 17 nt, Streptococcus pneumoniae R6
uuagaaauagauucucu

SEQ ID NO: 4091271 - RNA, 20 nt, Streptococcus pneumoniae R6
uuagaaauaucugcacucuc

SEQ ID NO: 4091272 - RNA, 22 nt, Streptococcus pneumoniae R6
uuagaaauaucugcacucucau

SEQ ID NO: 4091273 - RNA, 20 nt, Streptococcus pneumoniae R6
uuagaaccaagaucuugucu

SEQ ID NO: 4091274 - RNA, 12 nt, Streptococcus pneumoniae R6
uuagaagacuuu

SEQ ID NO: 4091275 - RNA, 17 nt, Streptococcus pneumoniae R6
uuagaagagguaucugu

SEQ ID NO: 4091276 - RNA, 21 nt, Streptococcus pneumoniae R6
uuagaagcagagguguacuau

SEQ ID NO: 4091277 - RNA, 16 nt, Streptococcus pneumoniae R6
uuagaagcuucuugga

SEQ ID NO: 4091278 - RNA, 21 nt, Streptococcus pneumoniae R6
uuagaaguagagguguacuau

SEQ ID NO: 4091279 - RNA, 19 nt, Streptococcus pneumoniae R6
uuagaauaaggaaaacauu

SEQ ID NO: 4091280 - RNA, 16 nt, Streptococcus pneumoniae R6
uuagaauauguaagug

SEQ ID NO: 4091281 - RNA, 22 nt, Streptococcus pneumoniae R6
uuagacaaauaauuuauccaaa

SEQ ID NO: 4091282 - RNA, 14 nt, Streptococcus pneumoniae R6
uuagacagaaaaaa

SEQ ID NO: 4091283 - RNA, 17 nt, Streptococcus pneumoniae R6
uuagagccgcugaguca

SEQ ID NO: 4091284 - RNA, 16 nt, Streptococcus pneumoniae R6
uuagaggcgagacauu

SEQ ID NO: 4091285 - RNA, 19 nt, Streptococcus pneumoniae R6
uuagagggcaaaaaaggga

SEQ ID NO: 4091286 - RNA, 16 nt, Streptococcus pneumoniae R6
uuagauaaaacuauug

SEQ ID NO: 4091287 - RNA, 23 nt, Streptococcus pneumoniae R6
uuagauagauaaaggccaagucc

SEQ ID NO: 4091288 - RNA, 19 nt, Streptococcus pneumoniae R6
uuagaucaucaaccucacu

SEQ ID NO: 4091289 - RNA, 12 nt, Streptococcus pneumoniae R6
uuagcaaucacu

SEQ ID NO: 4091290 - RNA, 13 nt, Streptococcus pneumoniae R6
uuagcagacuucu

SEQ ID NO: 4091291 - RNA, 22 nt, Streptococcus pneumoniae R6
uuagcagacuucuuuuuuacuu

SEQ ID NO: 4091292 - RNA, 21 nt, Streptococcus pneumoniae R6
uuagcauggaaccaaaguucc

SEQ ID NO: 4091293 - RNA, 22 nt, Streptococcus pneumoniae R6
uuagcauggucaaaguagucau

SEQ ID NO: 4091294 - RNA, 16 nt, Streptococcus pneumoniae R6
uuagccacugcaucug

SEQ ID NO: 4091295 - RNA, 20 nt, Streptococcus pneumoniae R6
uuagcguuggaauaaggcag

SEQ ID NO: 4091296 - RNA, 23 nt, Streptococcus pneumoniae R6
uuagcuaauuuucuaccgaucuc

SEQ ID NO: 4091297 - RNA, 14 nt, Streptococcus pneumoniae R6
uuagcuauuucuag

SEQ ID NO: 4091298 - RNA, 16 nt, Streptococcus pneumoniae R6
uuaggacaauuucucg

SEQ ID NO: 4091299 - RNA, 20 nt, Streptococcus pneumoniae R6
uuaggauagauaccuuguua

SEQ ID NO: 4091300 - RNA, 22 nt, Streptococcus pneumoniae R6
uuaggccuaaggcuguuucaaa

SEQ ID NO: 4091301 - RNA, 13 nt, Streptococcus pneumoniae R6
uuagggaaacaaa

SEQ ID NO: 4091302 - RNA, 20 nt, Streptococcus pneumoniae R6
uuagggaaacaaaagucuuc

SEQ ID NO: 4091303 - RNA, 23 nt, Streptococcus pneumoniae R6
uuagggaaacaaaagucuucuaa

SEQ ID NO: 4091304 - RNA, 15 nt, Streptococcus pneumoniae R6
uuagggucuuuaaug

SEQ ID NO: 4091305 - RNA, 17 nt, Streptococcus pneumoniae R6
uuagguaguuaaucuau

SEQ ID NO: 4091306 - RNA, 17 nt, Streptococcus pneumoniae R6
uuaggugcgagacaaaa

SEQ ID NO: 4091307 - RNA, 17 nt, Streptococcus pneumoniae R6
uuaguaaaaacguuuuu

SEQ ID NO: 4091308 - RNA, 13 nt, Streptococcus pneumoniae R6
uuaguaaacaaag

SEQ ID NO: 4091309 - RNA, 14 nt, Streptococcus pneumoniae R6
uuaguaaucugguc

SEQ ID NO: 4091310 - RNA, 21 nt, Streptococcus pneumoniae R6
uuaguaaugacuuguguuuuu

SEQ ID NO: 4091311 - RNA, 17 nt, Streptococcus pneumoniae R6
uuaguaauucaauuaag

SEQ ID NO: 4091312 - RNA, 19 nt, Streptococcus pneumoniae R6
uuaguaugagcacuauugu

SEQ ID NO: 4091313 - RNA, 14 nt, Streptococcus pneumoniae R6
uuagucaaaaagaa

SEQ ID NO: 4091314 - RNA, 15 nt, Streptococcus pneumoniae R6
uuagucaaaaagaag

SEQ ID NO: 4091315 - RNA, 17 nt, Streptococcus pneumoniae R6
uuagucaaaaagaagga

SEQ ID NO: 4091316 - RNA, 19 nt, Streptococcus pneumoniae R6
uuagucauuagauauagaa

SEQ ID NO: 4091317 - RNA, 14 nt, Streptococcus pneumoniae R6
uuagucuuauccuu

SEQ ID NO: 4091318 - RNA, 20 nt, Streptococcus pneumoniae R6
uuagucuucuuuucuuuuag

SEQ ID NO: 4091319 - RNA, 17 nt, Streptococcus pneumoniae R6
uuaguucagaauuuucu

SEQ ID NO: 4091320 - RNA, 16 nt, Streptococcus pneumoniae R6
uuaguuccaauaacuu

SEQ ID NO: 4091321 - RNA, 12 nt, Streptococcus pneumoniae R6
uuaguucuacuu

SEQ ID NO: 4091322 - RNA, 13 nt, Streptococcus pneumoniae R6
uuaguucuguauu

SEQ ID NO: 4091323 - RNA, 19 nt, Streptococcus pneumoniae R6
uuaguuggccaacuucuuu

SEQ ID NO: 4091324 - RNA, 21 nt, Streptococcus pneumoniae R6
uuaguuuuggcuaguaaauau

SEQ ID NO: 4091325 - RNA, 13 nt, Streptococcus pneumoniae R6
uuauaaaaaacac

SEQ ID NO: 4091326 - RNA, 14 nt, Streptococcus pneumoniae R6
uuauaaaaaacaca

SEQ ID NO: 4091327 - RNA, 12 nt, Streptococcus pneumoniae R6
uuauaaaauaac

SEQ ID NO: 4091328 - RNA, 16 nt, Streptococcus pneumoniae R6
uuauaaaauuuaauaa

SEQ ID NO: 4091329 - RNA, 13 nt, Streptococcus pneumoniae R6
uuauaaacuuuau

SEQ ID NO: 4091330 - RNA, 12 nt, Streptococcus pneumoniae R6
uuauaaauauag

SEQ ID NO: 4091331 - RNA, 13 nt, Streptococcus pneumoniae R6
uuauaaauuauuu

SEQ ID NO: 4091332 - RNA, 13 nt, Streptococcus pneumoniae R6
uuauaacaguaua

SEQ ID NO: 4091333 - RNA, 19 nt, Streptococcus pneumoniae R6
uuauaauauaaacuuuuuc

SEQ ID NO: 4091334 - RNA, 13 nt, Streptococcus pneumoniae R6
uuauaauauguau

SEQ ID NO: 4091335 - RNA, 21 nt, Streptococcus pneumoniae R6
uuauaauauguauuuauagua

SEQ ID NO: 4091336 - RNA, 17 nt, Streptococcus pneumoniae R6
uuauaaucauuaaaaua

SEQ ID NO: 4091337 - RNA, 16 nt, Streptococcus pneumoniae R6
uuauaaucguuuaaaa

SEQ ID NO: 4091338 - RNA, 17 nt, Streptococcus pneumoniae R6
uuauaaucguuuaaaac

SEQ ID NO: 4091339 - RNA, 14 nt, Streptococcus pneumoniae R6
uuauaauuucaacu

SEQ ID NO: 4091340 - RNA, 18 nt, Streptococcus pneumoniae R6
uuauaauuuccaugucaa

SEQ ID NO: 4091341 - RNA, 14 nt, Streptococcus pneumoniae R6
uuauacaaauuaau

SEQ ID NO: 4091342 - RNA, 14 nt, Streptococcus pneumoniae R6
uuauaccaaaaaaa

SEQ ID NO: 4091343 - RNA, 16 nt, Streptococcus pneumoniae R6
uuauaccaaaaaaacu

SEQ ID NO: 4091344 - RNA, 19 nt, Streptococcus pneumoniae R6
uuauacucuucgaaaaucu

SEQ ID NO: 4091345 - RNA, 17 nt, Streptococcus pneumoniae R6
uuauacuuuuaauauuu

SEQ ID NO: 4091346 - RNA, 22 nt, Streptococcus pneumoniae R6
uuauagaaaauuaacuucagga

SEQ ID NO: 4091347 - RNA, 15 nt, Streptococcus pneumoniae R6
uuauagaaaugaggu

SEQ ID NO: 4091348 - RNA, 21 nt, Streptococcus pneumoniae R6
uuauagaaggcaauuaaaagg

SEQ ID NO: 4091349 - RNA, 14 nt, Streptococcus pneumoniae R6
uuauagaaguacua

SEQ ID NO: 4091350 - RNA, 13 nt, Streptococcus pneumoniae R6
uuauagacauugu

SEQ ID NO: 4091351 - RNA, 18 nt, Streptococcus pneumoniae R6
uuauagacuauauugauu

SEQ ID NO: 4091352 - RNA, 23 nt, Streptococcus pneumoniae R6
uuauagaggagauuuaaaaaugu

SEQ ID NO: 4091353 - RNA, 18 nt, Streptococcus pneumoniae R6
uuauagauaaauguugaa

SEQ ID NO: 4091354 - RNA, 15 nt, Streptococcus pneumoniae R6
uuauagauucaacga

SEQ ID NO: 4091355 - RNA, 19 nt, Streptococcus pneumoniae R6
uuauagauucaauauacua

SEQ ID NO: 4091356 - RNA, 19 nt, Streptococcus pneumoniae R6
uuauagcgacuauaaaaaa

SEQ ID NO: 4091357 - RNA, 19 nt, Streptococcus pneumoniae R6
uuauaggcgauaauuucgc

SEQ ID NO: 4091358 - RNA, 14 nt, Streptococcus pneumoniae R6
uuauagguaaaauc

SEQ ID NO: 4091359 - RNA, 14 nt, Streptococcus pneumoniae R6
uuauauaaaaagac

SEQ ID NO: 4091360 - RNA, 15 nt, Streptococcus pneumoniae R6
uuauauaaaaagacc

SEQ ID NO: 4091361 - RNA, 13 nt, Streptococcus pneumoniae R6
uuauauacccaaa

SEQ ID NO: 4091362 - RNA, 20 nt, Streptococcus pneumoniae R6
uuauauacccaaaacacaaa

SEQ ID NO: 4091363 - RNA, 16 nt, Streptococcus pneumoniae R6
uuauauaguagccaaa

SEQ ID NO: 4091364 - RNA, 15 nt, Streptococcus pneumoniae R6
uuauauccuaaaaaa

SEQ ID NO: 4091365 - RNA, 14 nt, Streptococcus pneumoniae R6
uuauaucuaauaau

SEQ ID NO: 4091366 - RNA, 15 nt, Streptococcus pneumoniae R6
uuauaucuaauaauu

SEQ ID NO: 4091367 - RNA, 19 nt, Streptococcus pneumoniae R6
uuauaucuuauuucaguuu

SEQ ID NO: 4091368 - RNA, 14 nt, Streptococcus pneumoniae R6
uuauaugauuucaa

SEQ ID NO: 4091369 - RNA, 17 nt, Streptococcus pneumoniae R6
uuauaugauuucaauuu

SEQ ID NO: 4091370 - RNA, 14 nt, Streptococcus pneumoniae R6
uuauauuaaaaaaa

SEQ ID NO: 4091371 - RNA, 15 nt, Streptococcus pneumoniae R6
uuauauugacagaag

SEQ ID NO: 4091372 - RNA, 17 nt, Streptococcus pneumoniae R6
uuaucaaaucccuagcu

SEQ ID NO: 4091373 - RNA, 18 nt, Streptococcus pneumoniae R6
uuaucaagcaaaucaaag

SEQ ID NO: 4091374 - RNA, 15 nt, Streptococcus pneumoniae R6
uuaucaauaauagcg

SEQ ID NO: 4091375 - RNA, 16 nt, Streptococcus pneumoniae R6
uuaucaauaucaaaac

SEQ ID NO: 4091376 - RNA, 17 nt, Streptococcus pneumoniae R6
uuaucaauugauuugaa

SEQ ID NO: 4091377 - RNA, 21 nt, Streptococcus pneumoniae R6
uuaucacagcuagucuagucu

SEQ ID NO: 4091378 - RNA, 16 nt, Streptococcus pneumoniae R6
uuaucacccaaaacuu

SEQ ID NO: 4091379 - RNA, 18 nt, Streptococcus pneumoniae R6
uuaucaguauauugaaau

SEQ ID NO: 4091380 - RNA, 22 nt, Streptococcus pneumoniae R6
uuaucaguauauugaaaugaaa

SEQ ID NO: 4091381 - RNA, 14 nt, Streptococcus pneumoniae R6
uuaucauagaaaua

SEQ ID NO: 4091382 - RNA, 13 nt, Streptococcus pneumoniae R6
uuaucauuuugaa

SEQ ID NO: 4091383 - RNA, 20 nt, Streptococcus pneumoniae R6
uuauccaaucuauuuaugaa

SEQ ID NO: 4091384 - RNA, 18 nt, Streptococcus pneumoniae R6
uuauccaugaaaaaugca

SEQ ID NO: 4091385 - RNA, 18 nt, Streptococcus pneumoniae R6
uuauccauuuuucaaauc

SEQ ID NO: 4091386 - RNA, 16 nt, Streptococcus pneumoniae R6
uuaucccagagcuaua

SEQ ID NO: 4091387 - RNA, 17 nt, Streptococcus pneumoniae R6
uuaucuaacaauaagau

SEQ ID NO: 4091388 - RNA, 21 nt, Streptococcus pneumoniae R6
uuaucuaacaauaagauauca

SEQ ID NO: 4091389 - RNA, 14 nt, Streptococcus pneumoniae R6
uuaucuaagguuug

SEQ ID NO: 4091390 - RNA, 11 nt, Streptococcus pneumoniae R6
uuaucuagaau

SEQ ID NO: 4091391 - RNA, 15 nt, Streptococcus pneumoniae R6
uuaucuagcucccuu

SEQ ID NO: 4091392 - RNA, 21 nt, Streptococcus pneumoniae R6
uuaucuagucgaagcuuccaa

SEQ ID NO: 4091393 - RNA, 14 nt, Streptococcus pneumoniae R6
uuaucuagugcuau

SEQ ID NO: 4091394 - RNA, 17 nt, Streptococcus pneumoniae R6
uuaucuaucucaacaaa

SEQ ID NO: 4091395 - RNA, 15 nt, Streptococcus pneumoniae R6
uuaucugcaaccuca

SEQ ID NO: 4091396 - RNA, 18 nt, Streptococcus pneumoniae R6
uuaucuggguuccagaug

SEQ ID NO: 4091397 - RNA, 22 nt, Streptococcus pneumoniae R6
uuaucuugauauucuuaucaaa

SEQ ID NO: 4091398 - RNA, 21 nt, Streptococcus pneumoniae R6
uuaucuuugggacgauuuuca

SEQ ID NO: 4091399 - RNA, 16 nt, Streptococcus pneumoniae R6
uuaugaaaaagauuuu

SEQ ID NO: 4091400 - RNA, 19 nt, Streptococcus pneumoniae R6
uuaugaaaaagauuuuuua

SEQ ID NO: 4091401 - RNA, 21 nt, Streptococcus pneumoniae R6
uuaugaaaaagauuuuuuaaa

SEQ ID NO: 4091402 - RNA, 20 nt, Streptococcus pneumoniae R6
uuaugaaaaaguuuauauua

SEQ ID NO: 4091403 - RNA, 14 nt, Streptococcus pneumoniae R6
uuaugaaaaccaag

SEQ ID NO: 4091404 - RNA, 11 nt, Streptococcus pneumoniae R6
uuaugauauac

SEQ ID NO: 4091405 - RNA, 20 nt, Streptococcus pneumoniae R6
uuaugcauaaucuuggucaa

SEQ ID NO: 4091406 - RNA, 22 nt, Streptococcus pneumoniae R6
uuaugggagcaagcuccuaaau

SEQ ID NO: 4091407 - RNA, 18 nt, Streptococcus pneumoniae R6
uuauuaaaaucccauauu

SEQ ID NO: 4091408 - RNA, 19 nt, Streptococcus pneumoniae R6
uuauuaagauuacagauca

SEQ ID NO: 4091409 - RNA, 13 nt, Streptococcus pneumoniae R6
uuauuaaguagaa

SEQ ID NO: 4091410 - RNA, 14 nt, Streptococcus pneumoniae R6
uuauuaaguagaau

SEQ ID NO: 4091411 - RNA, 15 nt, Streptococcus pneumoniae R6
uuauuaccuuucuug

SEQ ID NO: 4091412 - RNA, 20 nt, Streptococcus pneumoniae R6
uuauuaccuuucuuguaaua

SEQ ID NO: 4091413 - RNA, 19 nt, Streptococcus pneumoniae R6
uuauuauaaaauuuaauaa

SEQ ID NO: 4091414 - RNA, 22 nt, Streptococcus pneumoniae R6
uuauuaucaaguucuuccacuc

SEQ ID NO: 4091415 - RNA, 22 nt, Streptococcus pneumoniae R6
uuauuaugguauacgaaaaauc

SEQ ID NO: 4091416 - RNA, 19 nt, Streptococcus pneumoniae R6
uuauucaaaaacauaauuu

SEQ ID NO: 4091417 - RNA, 14 nt, Streptococcus pneumoniae R6
uuauucagacuaua

SEQ ID NO: 4091418 - RNA, 13 nt, Streptococcus pneumoniae R6
uuauucucuauau

SEQ ID NO: 4091419 - RNA, 22 nt, Streptococcus pneumoniae R6
uuauucuggaagugaaaaagca

SEQ ID NO: 4091420 - RNA, 23 nt, Streptococcus pneumoniae R6
uuauucuggaagugaaaaagcaa

SEQ ID NO: 4091421 - RNA, 10 nt, Streptococcus pneumoniae R6
uuauugaaac

SEQ ID NO: 4091422 - RNA, 21 nt, Streptococcus pneumoniae R6
uuauugaaacagcuaaagaca

SEQ ID NO: 4091423 - RNA, 19 nt, Streptococcus pneumoniae R6
uuauugagcgcaggaagaa

SEQ ID NO: 4091424 - RNA, 21 nt, Streptococcus pneumoniae R6
uuauugauuccgucauguuca

SEQ ID NO: 4091425 - RNA, 15 nt, Streptococcus pneumoniae R6
uuauugcucuugacu

SEQ ID NO: 4091426 - RNA, 18 nt, Streptococcus pneumoniae R6
uuauuggcugccacacca

SEQ ID NO: 4091427 - RNA, 16 nt, Streptococcus pneumoniae R6
uuauugguauuaauaa

SEQ ID NO: 4091428 - RNA, 18 nt, Streptococcus pneumoniae R6
uuauugguggcuuccagu

SEQ ID NO: 4091429 - RNA, 14 nt, Streptococcus pneumoniae R6
uuauuguacuguau

SEQ ID NO: 4091430 - RNA, 23 nt, Streptococcus pneumoniae R6
uuauugucauuuuucugcuauua

SEQ ID NO: 4091431 - RNA, 18 nt, Streptococcus pneumoniae R6
uuauugucucuaaaaaua

SEQ ID NO: 4091432 - RNA, 14 nt, Streptococcus pneumoniae R6
uuauuguuguaaua

SEQ ID NO: 4091433 - RNA, 12 nt, Streptococcus pneumoniae R6
uuauuuaacuaa

SEQ ID NO: 4091434 - RNA, 17 nt, Streptococcus pneumoniae R6
uuauuuacagaaagaac

SEQ ID NO: 4091435 - RNA, 17 nt, Streptococcus pneumoniae R6
uuauuucacauuuucaa

SEQ ID NO: 4091436 - RNA, 22 nt, Streptococcus pneumoniae R6
uuauuucacuuguauccuccuc

SEQ ID NO: 4091437 - RNA, 12 nt, Streptococcus pneumoniae R6
uuauuucauuug

SEQ ID NO: 4091438 - RNA, 16 nt, Streptococcus pneumoniae R6
uuauuucauuuggcua

SEQ ID NO: 4091439 - RNA, 12 nt, Streptococcus pneumoniae R6
uuauuucucaac

SEQ ID NO: 4091440 - RNA, 19 nt, Streptococcus pneumoniae R6
uuauuuggauuaaucccca

SEQ ID NO: 4091441 - RNA, 20 nt, Streptococcus pneumoniae R6
uuauuuguuuauaucuuauu

SEQ ID NO: 4091442 - RNA, 12 nt, Streptococcus pneumoniae R6
uuauuuuauaga

SEQ ID NO: 4091443 - RNA, 12 nt, Streptococcus pneumoniae R6
uuauuuuuuaag

SEQ ID NO: 4091444 - RNA, 14 nt, Streptococcus pneumoniae R6
uuauuuuuuaggau

SEQ ID NO: 4091445 - RNA, 20 nt, Streptococcus pneumoniae R6
uuauuuuuucuguaaaauca

SEQ ID NO: 4091446 - RNA, 21 nt, Streptococcus pneumoniae R6
uucaaaaaaagcuguuaaaaa

SEQ ID NO: 4091447 - RNA, 22 nt, Streptococcus pneumoniae R6
uucaaaaaucauuauauuucuc

SEQ ID NO: 4091448 - RNA, 18 nt, Streptococcus pneumoniae R6
uucaaaauacaaaaguug

SEQ ID NO: 4091449 - RNA, 14 nt, Streptococcus pneumoniae R6
uucaaaaucagaaa

SEQ ID NO: 4091450 - RNA, 17 nt, Streptococcus pneumoniae R6
uucaaaccaauuucuaa

SEQ ID NO: 4091451 - RNA, 21 nt, Streptococcus pneumoniae R6
uucaaaccaauuucuaacaua

SEQ ID NO: 4091452 - RNA, 22 nt, Streptococcus pneumoniae R6
uucaaaccagcaccagacauuu

SEQ ID NO: 4091453 - RNA, 16 nt, Streptococcus pneumoniae R6
uucaaaccaugucagc

SEQ ID NO: 4091454 - RNA, 15 nt, Streptococcus pneumoniae R6
uucaaagacuucuug

SEQ ID NO: 4091455 - RNA, 13 nt, Streptococcus pneumoniae R6
uucaaagccuucc

SEQ ID NO: 4091456 - RNA, 19 nt, Streptococcus pneumoniae R6
uucaaagcgggauuuaaaa

SEQ ID NO: 4091457 - RNA, 23 nt, Streptococcus pneumoniae R6
uucaaaggucaaaucagguagga

SEQ ID NO: 4091458 - RNA, 20 nt, Streptococcus pneumoniae R6
uucaaaguaauuugaguaaa

SEQ ID NO: 4091459 - RNA, 17 nt, Streptococcus pneumoniae R6
uucaaagucaucaaaau

SEQ ID NO: 4091460 - RNA, 16 nt, Streptococcus pneumoniae R6
uucaaaguuccgaaau

SEQ ID NO: 4091461 - RNA, 21 nt, Streptococcus pneumoniae R6
uucaaaguuccuaaaaccaaa

SEQ ID NO: 4091462 - RNA, 21 nt, Streptococcus pneumoniae R6
uucaaaguuucgaaaaccaaa

SEQ ID NO: 4091463 - RNA, 15 nt, Streptococcus pneumoniae R6
uucaaaucccaugua

SEQ ID NO: 4091464 - RNA, 14 nt, Streptococcus pneumoniae R6
uucaaauccugcau

SEQ ID NO: 4091465 - RNA, 16 nt, Streptococcus pneumoniae R6
uucaaauccuuuauuu

SEQ ID NO: 4091466 - RNA, 16 nt, Streptococcus pneumoniae R6
uucaaaugaaauauuu

SEQ ID NO: 4091467 - RNA, 15 nt, Streptococcus pneumoniae R6
uucaaaugaauuucu

SEQ ID NO: 4091468 - RNA, 19 nt, Streptococcus pneumoniae R6
uucaaaugaauuucuacaa

SEQ ID NO: 4091469 - RNA, 17 nt, Streptococcus pneumoniae R6
uucaaauuaauuucuag

SEQ ID NO: 4091470 - RNA, 22 nt, Streptococcus pneumoniae R6
uucaaauucuuuagaaaacuag

SEQ ID NO: 4091471 - RNA, 18 nt, Streptococcus pneumoniae R6
uucaaauuuuucauaauu

SEQ ID NO: 4091472 - RNA, 18 nt, Streptococcus pneumoniae R6
uucaacaccgacuuggua

SEQ ID NO: 4091473 - RNA, 15 nt, Streptococcus pneumoniae R6
uucaacagcuuuuuu

SEQ ID NO: 4091474 - RNA, 16 nt, Streptococcus pneumoniae R6
uucaacauuaaagaca

SEQ ID NO: 4091475 - RNA, 15 nt, Streptococcus pneumoniae R6
uucaacgaaaauaau

SEQ ID NO: 4091476 - RNA, 16 nt, Streptococcus pneumoniae R6
uucaacgaaaauaauu

SEQ ID NO: 4091477 - RNA, 17 nt, Streptococcus pneumoniae R6
uucaacgaaaauaauua

SEQ ID NO: 4091478 - RNA, 22 nt, Streptococcus pneumoniae R6
uucaacgaaaauaauuaguuca

SEQ ID NO: 4091479 - RNA, 23 nt, Streptococcus pneumoniae R6
uucaacgaacuauaaaaucugaa

SEQ ID NO: 4091480 - RNA, 20 nt, Streptococcus pneumoniae R6
uucaacugcuuuuucaauca

SEQ ID NO: 4091481 - RNA, 12 nt, Streptococcus pneumoniae R6
uucaagagacuc

SEQ ID NO: 4091482 - RNA, 15 nt, Streptococcus pneumoniae R6
uucaaggcauuuuuu

SEQ ID NO: 4091483 - RNA, 17 nt, Streptococcus pneumoniae R6
uucaaguaggucaaagc

SEQ ID NO: 4091484 - RNA, 16 nt, Streptococcus pneumoniae R6
uucaagucuuccgaau

SEQ ID NO: 4091485 - RNA, 16 nt, Streptococcus pneumoniae R6
uucaagucuucugaau

SEQ ID NO: 4091486 - RNA, 19 nt, Streptococcus pneumoniae R6
uucaagucuucugaauagc

SEQ ID NO: 4091487 - RNA, 22 nt, Streptococcus pneumoniae R6
uucaaguucugucuugcugucu

SEQ ID NO: 4091488 - RNA, 14 nt, Streptococcus pneumoniae R6
uucaauaaaauaua

SEQ ID NO: 4091489 - RNA, 22 nt, Streptococcus pneumoniae R6
uucaauaaauugagcauuaucg

SEQ ID NO: 4091490 - RNA, 14 nt, Streptococcus pneumoniae R6
uucaauaccaaaga

SEQ ID NO: 4091491 - RNA, 15 nt, Streptococcus pneumoniae R6
uucaauagcucucag

SEQ ID NO: 4091492 - RNA, 11 nt, Streptococcus pneumoniae R6
uucaaucaaag

SEQ ID NO: 4091493 - RNA, 17 nt, Streptococcus pneumoniae R6
uucaaucagcuaaaaau

SEQ ID NO: 4091494 - RNA, 18 nt, Streptococcus pneumoniae R6
uucaaucguuucuggcag

SEQ ID NO: 4091495 - RNA, 13 nt, Streptococcus pneumoniae R6
uucaaugauaaaa

SEQ ID NO: 4091496 - RNA, 16 nt, Streptococcus pneumoniae R6
uucaauggaguaaaaa

SEQ ID NO: 4091497 - RNA, 18 nt, Streptococcus pneumoniae R6
uucaauggaguaaaaaaa

SEQ ID NO: 4091498 - RNA, 19 nt, Streptococcus pneumoniae R6
uucaauggaguaaaaaaag

SEQ ID NO: 4091499 - RNA, 23 nt, Streptococcus pneumoniae R6
uucaauugcaggagaaaaugaaa

SEQ ID NO: 4091500 - RNA, 16 nt, Streptococcus pneumoniae R6
uucaauuguuuauaaa

SEQ ID NO: 4091501 - RNA, 17 nt, Streptococcus pneumoniae R6
uucaauuguuuauaaaa

SEQ ID NO: 4091502 - RNA, 20 nt, Streptococcus pneumoniae R6
uucaauuguuuauaaaauaa

SEQ ID NO: 4091503 - RNA, 13 nt, Streptococcus pneumoniae R6
uucaauuucuaau

SEQ ID NO: 4091504 - RNA, 21 nt, Streptococcus pneumoniae R6
uucaauuugauuaaaguucga

SEQ ID NO: 4091505 - RNA, 16 nt, Streptococcus pneumoniae R6
uucacaaaauccuuug

SEQ ID NO: 4091506 - RNA, 15 nt, Streptococcus pneumoniae R6
uucacaaauucuggc

SEQ ID NO: 4091507 - RNA, 15 nt, Streptococcus pneumoniae R6
uucacaaucaaaaaa

SEQ ID NO: 4091508 - RNA, 15 nt, Streptococcus pneumoniae R6
uucacacaagaguuc

SEQ ID NO: 4091509 - RNA, 20 nt, Streptococcus pneumoniae R6
uucacacaagaguucuagcu

SEQ ID NO: 4091510 - RNA, 18 nt, Streptococcus pneumoniae R6
uucacaucuuauuucaau

SEQ ID NO: 4091511 - RNA, 18 nt, Streptococcus pneumoniae R6
uucaccaaucaaaucaau

SEQ ID NO: 4091512 - RNA, 13 nt, Streptococcus pneumoniae R6
uucaccaauguuc

SEQ ID NO: 4091513 - RNA, 21 nt, Streptococcus pneumoniae R6
uucaccaauuuuaccuuucaa

SEQ ID NO: 4091514 - RNA, 16 nt, Streptococcus pneumoniae R6
uucaccagauagaaua

SEQ ID NO: 4091515 - RNA, 20 nt, Streptococcus pneumoniae R6
uucaccaguaaaguguucug

SEQ ID NO: 4091516 - RNA, 21 nt, Streptococcus pneumoniae R6
uucaccuaaccaaauaauaga

SEQ ID NO: 4091517 - RNA, 13 nt, Streptococcus pneumoniae R6
uucaccugcuuuu

SEQ ID NO: 4091518 - RNA, 16 nt, Streptococcus pneumoniae R6
uucaccuugccaucug

SEQ ID NO: 4091519 - RNA, 13 nt, Streptococcus pneumoniae R6
uucacgaacauga

SEQ ID NO: 4091520 - RNA, 22 nt, Streptococcus pneumoniae R6
uucacgcgcauucguuucuuua

SEQ ID NO: 4091521 - RNA, 21 nt, Streptococcus pneumoniae R6
uucacuaguauucaucuuauc

SEQ ID NO: 4091522 - RNA, 20 nt, Streptococcus pneumoniae R6
uucacuauauugcaagagaa

SEQ ID NO: 4091523 - RNA, 22 nt, Streptococcus pneumoniae R6
uucacuauugaugaacugcuug

SEQ ID NO: 4091524 - RNA, 15 nt, Streptococcus pneumoniae R6
uucacucaaaccuga

SEQ ID NO: 4091525 - RNA, 17 nt, Streptococcus pneumoniae R6
uucacugagaucuucuu

SEQ ID NO: 4091526 - RNA, 19 nt, Streptococcus pneumoniae R6
uucacugagaucuucuucu

SEQ ID NO: 4091527 - RNA, 13 nt, Streptococcus pneumoniae R6
uucacuugagcaa

SEQ ID NO: 4091528 - RNA, 22 nt, Streptococcus pneumoniae R6
uucacuuucccuuuccaagaau

SEQ ID NO: 4091529 - RNA, 17 nt, Streptococcus pneumoniae R6
uucagaacuuuuaacuu

SEQ ID NO: 4091530 - RNA, 14 nt, Streptococcus pneumoniae R6
uucagaauaagagg

SEQ ID NO: 4091531 - RNA, 15 nt, Streptococcus pneumoniae R6
uucagaauuuucuua

SEQ ID NO: 4091532 - RNA, 23 nt, Streptococcus pneumoniae R6
uucagagcgauaaaaauccuuuu

SEQ ID NO: 4091533 - RNA, 19 nt, Streptococcus pneumoniae R6
uucagagggcuuuuucauu

SEQ ID NO: 4091534 - RNA, 14 nt, Streptococcus pneumoniae R6
uucagauucacuag

SEQ ID NO: 4091535 - RNA, 16 nt, Streptococcus pneumoniae R6
uucagauucaucauuu

SEQ ID NO: 4091536 - RNA, 17 nt, Streptococcus pneumoniae R6
uucagauuguccucaau

SEQ ID NO: 4091537 - RNA, 15 nt, Streptococcus pneumoniae R6
uucagcauauuuccc

SEQ ID NO: 4091538 - RNA, 20 nt, Streptococcus pneumoniae R6
uucagcgaccaucauuuuug

SEQ ID NO: 4091539 - RNA, 11 nt, Streptococcus pneumoniae R6
uucagcgauuu

SEQ ID NO: 4091540 - RNA, 17 nt, Streptococcus pneumoniae R6
uucagcuggcuccuucu

SEQ ID NO: 4091541 - RNA, 22 nt, Streptococcus pneumoniae R6
uucagcuggcuccuucuuuuuu

SEQ ID NO: 4091542 - RNA, 22 nt, Streptococcus pneumoniae R6
uucaggacagucaaaucgauuu

SEQ ID NO: 4091543 - RNA, 17 nt, Streptococcus pneumoniae R6
uucagguggguuuucug

SEQ ID NO: 4091544 - RNA, 16 nt, Streptococcus pneumoniae R6
uucagguguuucuggu

SEQ ID NO: 4091545 - RNA, 17 nt, Streptococcus pneumoniae R6
uucaguaauaucuccag

SEQ ID NO: 4091546 - RNA, 19 nt, Streptococcus pneumoniae R6
uucaguagauaauauaccc

SEQ ID NO: 4091547 - RNA, 14 nt, Streptococcus pneumoniae R6
uucaguugcauaaa

SEQ ID NO: 4091548 - RNA, 22 nt, Streptococcus pneumoniae R6
uucaguugcauaaaucgcuuuu

SEQ ID NO: 4091549 - RNA, 21 nt, Streptococcus pneumoniae R6
uucaguugccucagauucuga

SEQ ID NO: 4091550 - RNA, 23 nt, Streptococcus pneumoniae R6
uucaguugccucagauucugaca

SEQ ID NO: 4091551 - RNA, 16 nt, Streptococcus pneumoniae R6
uucaguuuacuauacu

SEQ ID NO: 4091552 - RNA, 14 nt, Streptococcus pneumoniae R6
uucaguuucauaau

SEQ ID NO: 4091553 - RNA, 13 nt, Streptococcus pneumoniae R6
uucaguuuuauuu

SEQ ID NO: 4091554 - RNA, 21 nt, Streptococcus pneumoniae R6
uucauaaggaagucuguuauu

SEQ ID NO: 4091555 - RNA, 20 nt, Streptococcus pneumoniae R6
uucauaagguaccuccuaau

SEQ ID NO: 4091556 - RNA, 15 nt, Streptococcus pneumoniae R6
uucauaaucaggcca

SEQ ID NO: 4091557 - RNA, 21 nt, Streptococcus pneumoniae R6
uucauaccagaagccuuguuu

SEQ ID NO: 4091558 - RNA, 21 nt, Streptococcus pneumoniae R6
uucauacucaaucccauauuu

SEQ ID NO: 4091559 - RNA, 15 nt, Streptococcus pneumoniae R6
uucauagcagcaauu

SEQ ID NO: 4091560 - RNA, 17 nt, Streptococcus pneumoniae R6
uucauauaauaaauugu

SEQ ID NO: 4091561 - RNA, 19 nt, Streptococcus pneumoniae R6
uucauaucuuauuucaauu

SEQ ID NO: 4091562 - RNA, 18 nt, Streptococcus pneumoniae R6
uucauauguaaacaguaa

SEQ ID NO: 4091563 - RNA, 15 nt, Streptococcus pneumoniae R6
uucaucaagagacag

SEQ ID NO: 4091564 - RNA, 21 nt, Streptococcus pneumoniae R6
uucaucaccacaccgauaucu

SEQ ID NO: 4091565 - RNA, 15 nt, Streptococcus pneumoniae R6
uucaucauuuuauuc

SEQ ID NO: 4091566 - RNA, 16 nt, Streptococcus pneumoniae R6
uucaucauuuuauuca

SEQ ID NO: 4091567 - RNA, 18 nt, Streptococcus pneumoniae R6
uucauccacaaccucaaa

SEQ ID NO: 4091568 - RNA, 21 nt, Streptococcus pneumoniae R6
uucauccagcaggagaaaguu

SEQ ID NO: 4091569 - RNA, 15 nt, Streptococcus pneumoniae R6
uucaucuacaaccuc

SEQ ID NO: 4091570 - RNA, 16 nt, Streptococcus pneumoniae R6
uucaucuacaaccuca

SEQ ID NO: 4091571 - RNA, 20 nt, Streptococcus pneumoniae R6
uucaucuggauuuucagccu

SEQ ID NO: 4091572 - RNA, 13 nt, Streptococcus pneumoniae R6
uucaucuuaucaa

SEQ ID NO: 4091573 - RNA, 19 nt, Streptococcus pneumoniae R6
uucaucuucaaaaucaaag

SEQ ID NO: 4091574 - RNA, 12 nt, Streptococcus pneumoniae R6
uucaugacagau

SEQ ID NO: 4091575 - RNA, 19 nt, Streptococcus pneumoniae R6
uucaugauugauaauacca

SEQ ID NO: 4091576 - RNA, 16 nt, Streptococcus pneumoniae R6
uucauggaucauuucu

SEQ ID NO: 4091577 - RNA, 13 nt, Streptococcus pneumoniae R6
uucauggaugcaa

SEQ ID NO: 4091578 - RNA, 20 nt, Streptococcus pneumoniae R6
uucaugguucgggauaaaau

SEQ ID NO: 4091579 - RNA, 20 nt, Streptococcus pneumoniae R6
uucauguggcuaucugucac

SEQ ID NO: 4091580 - RNA, 19 nt, Streptococcus pneumoniae R6
uucauguuuuccuaauucu

SEQ ID NO: 4091581 - RNA, 18 nt, Streptococcus pneumoniae R6
uucauuacagaacauuuu

SEQ ID NO: 4091582 - RNA, 16 nt, Streptococcus pneumoniae R6
uucauuacuuaaccca

SEQ ID NO: 4091583 - RNA, 14 nt, Streptococcus pneumoniae R6
uucauuauuucuua

SEQ ID NO: 4091584 - RNA, 19 nt, Streptococcus pneumoniae R6
uucauuccaucauaaaaau

SEQ ID NO: 4091585 - RNA, 16 nt, Streptococcus pneumoniae R6
uucauuccaugaaaau

SEQ ID NO: 4091586 - RNA, 22 nt, Streptococcus pneumoniae R6
uucauucggucauggauuuuau

SEQ ID NO: 4091587 - RNA, 14 nt, Streptococcus pneumoniae R6
uucauugaaaaaau

SEQ ID NO: 4091588 - RNA, 20 nt, Streptococcus pneumoniae R6
uucauugaaaaaauaucuuu

SEQ ID NO: 4091589 - RNA, 13 nt, Streptococcus pneumoniae R6
uucauugagcuuu

SEQ ID NO: 4091590 - RNA, 17 nt, Streptococcus pneumoniae R6
uucauuuggcuauaaaa

SEQ ID NO: 4091591 - RNA, 18 nt, Streptococcus pneumoniae R6
uucauuuggcuauaaaaa

SEQ ID NO: 4091592 - RNA, 18 nt, Streptococcus pneumoniae R6
uucauuuuaauauauaaa

SEQ ID NO: 4091593 - RNA, 20 nt, Streptococcus pneumoniae R6
uucauuuuaauauauaaaaa

SEQ ID NO: 4091594 - RNA, 13 nt, Streptococcus pneumoniae R6
uucauuuuacuau

SEQ ID NO: 4091595 - RNA, 14 nt, Streptococcus pneumoniae R6
uucauuuuacuaua

SEQ ID NO: 4091596 - RNA, 16 nt, Streptococcus pneumoniae R6
uucauuuuacuauaaa

SEQ ID NO: 4091597 - RNA, 17 nt, Streptococcus pneumoniae R6
uucauuuucuacuaaaa

SEQ ID NO: 4091598 - RNA, 17 nt, Streptococcus pneumoniae R6
uucauuuuuccuuccca

SEQ ID NO: 4091599 - RNA, 22 nt, Streptococcus pneumoniae R6
uucauuuuuccuucccacuugu

SEQ ID NO: 4091600 - RNA, 19 nt, Streptococcus pneumoniae R6
uucauuuuugccuaaaauu

SEQ ID NO: 4091601 - RNA, 22 nt, Streptococcus pneumoniae R6
uuccaaaaauucuuacuaccua

SEQ ID NO: 4091602 - RNA, 17 nt, Streptococcus pneumoniae R6
uuccaaaacgguugagc

SEQ ID NO: 4091603 - RNA, 14 nt, Streptococcus pneumoniae R6
uuccaaaauuaaaa

SEQ ID NO: 4091604 - RNA, 17 nt, Streptococcus pneumoniae R6
uuccaaaauuaaaaugu

SEQ ID NO: 4091605 - RNA, 18 nt, Streptococcus pneumoniae R6
uuccaaaauuaaaauguu

SEQ ID NO: 4091606 - RNA, 18 nt, Streptococcus pneumoniae R6
uuccaaacaacaauacuu

SEQ ID NO: 4091607 - RNA, 21 nt, Streptococcus pneumoniae R6
uuccaaagccacuugcgaguu

SEQ ID NO: 4091608 - RNA, 14 nt, Streptococcus pneumoniae R6
uuccaaauuagaaa

SEQ ID NO: 4091609 - RNA, 15 nt, Streptococcus pneumoniae R6
uuccaaauuagaaaa

SEQ ID NO: 4091610 - RNA, 17 nt, Streptococcus pneumoniae R6
uuccaaauuagaaaaag

SEQ ID NO: 4091611 - RNA, 20 nt, Streptococcus pneumoniae R6
uuccaagaccuuaaacuugu

SEQ ID NO: 4091612 - RNA, 17 nt, Streptococcus pneumoniae R6
uuccaagacuuucaauu

SEQ ID NO: 4091613 - RNA, 13 nt, Streptococcus pneumoniae R6
uuccaauaauuca

SEQ ID NO: 4091614 - RNA, 17 nt, Streptococcus pneumoniae R6
uuccaauagucauucca

SEQ ID NO: 4091615 - RNA, 13 nt, Streptococcus pneumoniae R6
uuccaaucuucuc

SEQ ID NO: 4091616 - RNA, 23 nt, Streptococcus pneumoniae R6
uuccaauuuuugcguuggaauaa

SEQ ID NO: 4091617 - RNA, 12 nt, Streptococcus pneumoniae R6
uuccacaagaac

SEQ ID NO: 4091618 - RNA, 16 nt, Streptococcus pneumoniae R6
uuccaccaccugcaac

SEQ ID NO: 4091619 - RNA, 15 nt, Streptococcus pneumoniae R6
uuccacgauauuguu

SEQ ID NO: 4091620 - RNA, 21 nt, Streptococcus pneumoniae R6
uuccacucgcugacacuggca

SEQ ID NO: 4091621 - RNA, 19 nt, Streptococcus pneumoniae R6
uuccacuuccagaagauac

SEQ ID NO: 4091622 - RNA, 21 nt, Streptococcus pneumoniae R6
uuccagacccugcacaaagaa

SEQ ID NO: 4091623 - RNA, 15 nt, Streptococcus pneumoniae R6
uuccagcgguaucaa

SEQ ID NO: 4091624 - RNA, 18 nt, Streptococcus pneumoniae R6
uuccagcgguaucaauca

SEQ ID NO: 4091625 - RNA, 17 nt, Streptococcus pneumoniae R6
uuccagcguugcgauuu

SEQ ID NO: 4091626 - RNA, 21 nt, Streptococcus pneumoniae R6
uuccagcuuuauagucaugaa

SEQ ID NO: 4091627 - RNA, 17 nt, Streptococcus pneumoniae R6
uuccaggaauguccuua

SEQ ID NO: 4091628 - RNA, 18 nt, Streptococcus pneumoniae R6
uuccaggagaguaugauu

SEQ ID NO: 4091629 - RNA, 20 nt, Streptococcus pneumoniae R6
uuccagucccaaguuccaaa

SEQ ID NO: 4091630 - RNA, 19 nt, Streptococcus pneumoniae R6
uuccauauagucuuucaaa

SEQ ID NO: 4091631 - RNA, 21 nt, Streptococcus pneumoniae R6
uuccauauccgacuugguaaa

SEQ ID NO: 4091632 - RNA, 22 nt, Streptococcus pneumoniae R6
uuccauaugauucuuucuaaug

SEQ ID NO: 4091633 - RNA, 22 nt, Streptococcus pneumoniae R6
uuccauccacaaccuuaaaaca

SEQ ID NO: 4091634 - RNA, 15 nt, Streptococcus pneumoniae R6
uuccaucuacaaccu

SEQ ID NO: 4091635 - RNA, 20 nt, Streptococcus pneumoniae R6
uuccaucuacaaccuuaaaa

SEQ ID NO: 4091636 - RNA, 22 nt, Streptococcus pneumoniae R6
uuccaucuacaaccuuaaaaca

SEQ ID NO: 4091637 - RNA, 12 nt, Streptococcus pneumoniae R6
uuccaucugcag

SEQ ID NO: 4091638 - RNA, 18 nt, Streptococcus pneumoniae R6
uuccaucugcagccucaa

SEQ ID NO: 4091639 - RNA, 22 nt, Streptococcus pneumoniae R6
uuccaugacaacgggguuucca

SEQ ID NO: 4091640 - RNA, 23 nt, Streptococcus pneumoniae R6
uuccaugacgcacaaacuucauc

SEQ ID NO: 4091641 - RNA, 15 nt, Streptococcus pneumoniae R6
uuccauguaaaauua

SEQ ID NO: 4091642 - RNA, 16 nt, Streptococcus pneumoniae R6
uuccaugucaauuuuu

SEQ ID NO: 4091643 - RNA, 17 nt, Streptococcus pneumoniae R6
uuccauucgauucguuu

SEQ ID NO: 4091644 - RNA, 19 nt, Streptococcus pneumoniae R6
uuccauuggaguaugcucg

SEQ ID NO: 4091645 - RNA, 16 nt, Streptococcus pneumoniae R6
uuccauuuaacaaacc

SEQ ID NO: 4091646 - RNA, 17 nt, Streptococcus pneumoniae R6
uuccauuucagaagaaa

SEQ ID NO: 4091647 - RNA, 15 nt, Streptococcus pneumoniae R6
uuccauuuuccauga

SEQ ID NO: 4091648 - RNA, 14 nt, Streptococcus pneumoniae R6
uucccaaacaaaaa

SEQ ID NO: 4091649 - RNA, 22 nt, Streptococcus pneumoniae R6
uucccaaguacgagucaaguca

SEQ ID NO: 4091650 - RNA, 20 nt, Streptococcus pneumoniae R6
uucccaaguaguaguuucag

SEQ ID NO: 4091651 - RNA, 15 nt, Streptococcus pneumoniae R6
uucccacaauaaaac

SEQ ID NO: 4091652 - RNA, 18 nt, Streptococcus pneumoniae R6
uucccacaauaaaacgca

SEQ ID NO: 4091653 - RNA, 15 nt, Streptococcus pneumoniae R6
uucccacccauauuu

SEQ ID NO: 4091654 - RNA, 19 nt, Streptococcus pneumoniae R6
uucccacccauauuuuucc

SEQ ID NO: 4091655 - RNA, 18 nt, Streptococcus pneumoniae R6
uucccaccuuuucucaau

SEQ ID NO: 4091656 - RNA, 19 nt, Streptococcus pneumoniae R6
uucccaucucgugaauaga

SEQ ID NO: 4091657 - RNA, 17 nt, Streptococcus pneumoniae R6
uucccaucugucuuuau

SEQ ID NO: 4091658 - RNA, 15 nt, Streptococcus pneumoniae R6
uucccauugcaaucc

SEQ ID NO: 4091659 - RNA, 15 nt, Streptococcus pneumoniae R6
uucccguaucuuuga

SEQ ID NO: 4091660 - RNA, 16 nt, Streptococcus pneumoniae R6
uucccuacaaauacca

SEQ ID NO: 4091661 - RNA, 15 nt, Streptococcus pneumoniae R6
uucccuuugauagca

SEQ ID NO: 4091662 - RNA, 17 nt, Streptococcus pneumoniae R6
uucccuuuuguauucca

SEQ ID NO: 4091663 - RNA, 22 nt, Streptococcus pneumoniae R6
uuccgaaacuagcauccauccc

SEQ ID NO: 4091664 - RNA, 15 nt, Streptococcus pneumoniae R6
uuccgaagaguucaa

SEQ ID NO: 4091665 - RNA, 20 nt, Streptococcus pneumoniae R6
uuccgaauaccugaaaccau

SEQ ID NO: 4091666 - RNA, 19 nt, Streptococcus pneumoniae R6
uuccgaauagcucaaaagc

SEQ ID NO: 4091667 - RNA, 18 nt, Streptococcus pneumoniae R6
uuccgauaaugcuuugaa

SEQ ID NO: 4091668 - RNA, 20 nt, Streptococcus pneumoniae R6
uuccgcaagauucgaugguu

SEQ ID NO: 4091669 - RNA, 17 nt, Streptococcus pneumoniae R6
uuccguuugagaagaac

SEQ ID NO: 4091670 - RNA, 12 nt, Streptococcus pneumoniae R6
uuccuaaaacag

SEQ ID NO: 4091671 - RNA, 22 nt, Streptococcus pneumoniae R6
uuccuaaaauaacacuccauuu

SEQ ID NO: 4091672 - RNA, 20 nt, Streptococcus pneumoniae R6
uuccuaaacagaauuggcua

SEQ ID NO: 4091673 - RNA, 16 nt, Streptococcus pneumoniae R6
uuccuaagauauuaag

SEQ ID NO: 4091674 - RNA, 17 nt, Streptococcus pneumoniae R6
uuccucaacaaaauguu

SEQ ID NO: 4091675 - RNA, 22 nt, Streptococcus pneumoniae R6
uuccucaacaaaauguucaguu

SEQ ID NO: 4091676 - RNA, 15 nt, Streptococcus pneumoniae R6
uuccucagcaggagc

SEQ ID NO: 4091677 - RNA, 21 nt, Streptococcus pneumoniae R6
uuccucauuuugaagauuguu

SEQ ID NO: 4091678 - RNA, 22 nt, Streptococcus pneumoniae R6
uuccucauuuugaagauuguuu

SEQ ID NO: 4091679 - RNA, 20 nt, Streptococcus pneumoniae R6
uuccuccauaaacgcaagca

SEQ ID NO: 4091680 - RNA, 11 nt, Streptococcus pneumoniae R6
uuccuccauug

SEQ ID NO: 4091681 - RNA, 20 nt, Streptococcus pneumoniae R6
uuccucccugcgacaaaauu

SEQ ID NO: 4091682 - RNA, 14 nt, Streptococcus pneumoniae R6
uuccucuuuuuccc

SEQ ID NO: 4091683 - RNA, 17 nt, Streptococcus pneumoniae R6
uuccugaaauaaaaugc

SEQ ID NO: 4091684 - RNA, 17 nt, Streptococcus pneumoniae R6
uuccugagaugacaaca

SEQ ID NO: 4091685 - RNA, 15 nt, Streptococcus pneumoniae R6
uuccugauagaguug

SEQ ID NO: 4091686 - RNA, 22 nt, Streptococcus pneumoniae R6
uuccugauuuugugcucuuaaa

SEQ ID NO: 4091687 - RNA, 14 nt, Streptococcus pneumoniae R6
uuccugcaaaacua

SEQ ID NO: 4091688 - RNA, 15 nt, Streptococcus pneumoniae R6
uuccugcaaguuuau

SEQ ID NO: 4091689 - RNA, 24 nt, Streptococcus pneumoniae R6
uuccugcaaguuuaugccuugcag

SEQ ID NO: 4091690 - RNA, 16 nt, Streptococcus pneumoniae R6
uuccugucuuauuuca

SEQ ID NO: 4091691 - RNA, 18 nt, Streptococcus pneumoniae R6
uuccugugcuacgacacu

SEQ ID NO: 4091692 - RNA, 21 nt, Streptococcus pneumoniae R6
uuccuguguacuguucuaaau

SEQ ID NO: 4091693 - RNA, 18 nt, Streptococcus pneumoniae R6
uuccuguuguauuuauau

SEQ ID NO: 4091694 - RNA, 18 nt, Streptococcus pneumoniae R6
uuccuuaaacucuugauu

SEQ ID NO: 4091695 - RNA, 14 nt, Streptococcus pneumoniae R6
uuccuuaacaaucu

SEQ ID NO: 4091696 - RNA, 15 nt, Streptococcus pneumoniae R6
uuccuuacuagcaaa

SEQ ID NO: 4091697 - RNA, 15 nt, Streptococcus pneumoniae R6
uuccuuaugcauaau

SEQ ID NO: 4091698 - RNA, 16 nt, Streptococcus pneumoniae R6
uuccuuauucugaaag

SEQ ID NO: 4091699 - RNA, 16 nt, Streptococcus pneumoniae R6
uuccuugaccaagucc

SEQ ID NO: 4091700 - RNA, 23 nt, Streptococcus pneumoniae R6
uuccuugcgcgugguccagauaa

SEQ ID NO: 4091701 - RNA, 20 nt, Streptococcus pneumoniae R6
uuccuugguguacuugagac

SEQ ID NO: 4091702 - RNA, 16 nt, Streptococcus pneumoniae R6
uuccuuucaaaauauc

SEQ ID NO: 4091703 - RNA, 17 nt, Streptococcus pneumoniae R6
uuccuuucaaaauaucu

SEQ ID NO: 4091704 - RNA, 13 nt, Streptococcus pneumoniae R6
uuccuuuccuaau

SEQ ID NO: 4091705 - RNA, 13 nt, Streptococcus pneumoniae R6
uuccuuuuuucua

SEQ ID NO: 4091706 - RNA, 15 nt, Streptococcus pneumoniae R6
uucgaaaaccaaagg

SEQ ID NO: 4091707 - RNA, 18 nt, Streptococcus pneumoniae R6
uucgaaaaucucugcaaa

SEQ ID NO: 4091708 - RNA, 13 nt, Streptococcus pneumoniae R6
uucgaagauaucu

SEQ ID NO: 4091709 - RNA, 18 nt, Streptococcus pneumoniae R6
uucgacuaauuuggaaau

SEQ ID NO: 4091710 - RNA, 21 nt, Streptococcus pneumoniae R6
uucgacuaauuuggaaauaag

SEQ ID NO: 4091711 - RNA, 17 nt, Streptococcus pneumoniae R6
uucgacugaaaauauuu

SEQ ID NO: 4091712 - RNA, 21 nt, Streptococcus pneumoniae R6
uucgacugaaaauauuucgcu

SEQ ID NO: 4091713 - RNA, 18 nt, Streptococcus pneumoniae R6
uucgaugaaucauuuccu

SEQ ID NO: 4091714 - RNA, 19 nt, Streptococcus pneumoniae R6
uucgaugucaccaaacaaa

SEQ ID NO: 4091715 - RNA, 18 nt, Streptococcus pneumoniae R6
uucgauguuacagacaaa

SEQ ID NO: 4091716 - RNA, 19 nt, Streptococcus pneumoniae R6
uucgauugaaauucgcuuu

SEQ ID NO: 4091717 - RNA, 15 nt, Streptococcus pneumoniae R6
uucgauuuaaugaua

SEQ ID NO: 4091718 - RNA, 18 nt, Streptococcus pneumoniae R6
uucgauuuaucuguuugu

SEQ ID NO: 4091719 - RNA, 17 nt, Streptococcus pneumoniae R6
uucgccacguucaacau

SEQ ID NO: 4091720 - RNA, 19 nt, Streptococcus pneumoniae R6
uucgccauagaauuuugga

SEQ ID NO: 4091721 - RNA, 16 nt, Streptococcus pneumoniae R6
uucgcuguuaaagcca

SEQ ID NO: 4091722 - RNA, 18 nt, Streptococcus pneumoniae R6
uucgcuguuaaagccauc

SEQ ID NO: 4091723 - RNA, 20 nt, Streptococcus pneumoniae R6
uucgcuuagacaauuuauau

SEQ ID NO: 4091724 - RNA, 17 nt, Streptococcus pneumoniae R6
uucgcuuauaaacugua

SEQ ID NO: 4091725 - RNA, 23 nt, Streptococcus pneumoniae R6
uucggagaagaaaacagaaaaau

SEQ ID NO: 4091726 - RNA, 23 nt, Streptococcus pneumoniae R6
uucggauaaguuuuguuugucag

SEQ ID NO: 4091727 - RNA, 17 nt, Streptococcus pneumoniae R6
uucggaucauauuuucu

SEQ ID NO: 4091728 - RNA, 14 nt, Streptococcus pneumoniae R6
uucggauuuuaaaa

SEQ ID NO: 4091729 - RNA, 24 nt, Streptococcus pneumoniae R6
uucgguaguuguuaguucuugaaa

SEQ ID NO: 4091730 - RNA, 24 nt, Streptococcus pneumoniae R6
uucggugaguuuggcuucaguaau

SEQ ID NO: 4091731 - RNA, 16 nt, Streptococcus pneumoniae R6
uucguaaccaaaucag

SEQ ID NO: 4091732 - RNA, 21 nt, Streptococcus pneumoniae R6
uucguacacucaaaucaaaau

SEQ ID NO: 4091733 - RNA, 18 nt, Streptococcus pneumoniae R6
uucguacuauuucagauu

SEQ ID NO: 4091734 - RNA, 16 nt, Streptococcus pneumoniae R6
uucguacucucuuuuu

SEQ ID NO: 4091735 - RNA, 15 nt, Streptococcus pneumoniae R6
uucgucaauaauagc

SEQ ID NO: 4091736 - RNA, 19 nt, Streptococcus pneumoniae R6
uucgucaguuucauccaca

SEQ ID NO: 4091737 - RNA, 14 nt, Streptococcus pneumoniae R6
uucgucauuuguuu

SEQ ID NO: 4091738 - RNA, 17 nt, Streptococcus pneumoniae R6
uucgucguaaccuucuu

SEQ ID NO: 4091739 - RNA, 17 nt, Streptococcus pneumoniae R6
uucgucuuccauuucuu

SEQ ID NO: 4091740 - RNA, 14 nt, Streptococcus pneumoniae R6
uucguuugaagcug

SEQ ID NO: 4091741 - RNA, 14 nt, Streptococcus pneumoniae R6
uucguuuuguuccu

SEQ ID NO: 4091742 - RNA, 14 nt, Streptococcus pneumoniae R6
uucguuuuuacuac

SEQ ID NO: 4091743 - RNA, 21 nt, Streptococcus pneumoniae R6
uucuaaaaaggcguucaucca

SEQ ID NO: 4091744 - RNA, 16 nt, Streptococcus pneumoniae R6
uucuaaaacauucuua

SEQ ID NO: 4091745 - RNA, 13 nt, Streptococcus pneumoniae R6
uucuaaaacauug

SEQ ID NO: 4091746 - RNA, 16 nt, Streptococcus pneumoniae R6
uucuaaaacauuguga

SEQ ID NO: 4091747 - RNA, 16 nt, Streptococcus pneumoniae R6
uucuaaaacauuguua

SEQ ID NO: 4091748 - RNA, 22 nt, Streptococcus pneumoniae R6
uucuaaaacauuguuaaaaauu

SEQ ID NO: 4091749 - RNA, 12 nt, Streptococcus pneumoniae R6
uucuaaaauaag

SEQ ID NO: 4091750 - RNA, 13 nt, Streptococcus pneumoniae R6
uucuaaagaauuu

SEQ ID NO: 4091751 - RNA, 23 nt, Streptococcus pneumoniae R6
uucuaaagaauuugaaaaaaauu

SEQ ID NO: 4091752 - RNA, 13 nt, Streptococcus pneumoniae R6
uucuaaagaguau

SEQ ID NO: 4091753 - RNA, 13 nt, Streptococcus pneumoniae R6
uucuaaauaaucu

SEQ ID NO: 4091754 - RNA, 21 nt, Streptococcus pneumoniae R6
uucuaaauuacgauucauagu

SEQ ID NO: 4091755 - RNA, 16 nt, Streptococcus pneumoniae R6
uucuaaauucaauuca

SEQ ID NO: 4091756 - RNA, 16 nt, Streptococcus pneumoniae R6
uucuaaauuuaacauu

SEQ ID NO: 4091757 - RNA, 19 nt, Streptococcus pneumoniae R6
uucuaauacaagcucaucu

SEQ ID NO: 4091758 - RNA, 21 nt, Streptococcus pneumoniae R6
uucuaauacaagcucaucuuu

SEQ ID NO: 4091759 - RNA, 20 nt, Streptococcus pneumoniae R6
uucuaauguacagaagacua

SEQ ID NO: 4091760 - RNA, 23 nt, Streptococcus pneumoniae R6
uucuaauuaaauaaaauaaaaac

SEQ ID NO: 4091761 - RNA, 14 nt, Streptococcus pneumoniae R6
uucuaauuaaauca

SEQ ID NO: 4091762 - RNA, 17 nt, Streptococcus pneumoniae R6
uucuaauuauuucaauu

SEQ ID NO: 4091763 - RNA, 17 nt, Streptococcus pneumoniae R6
uucuacaaauguuuuag

SEQ ID NO: 4091764 - RNA, 15 nt, Streptococcus pneumoniae R6
uucuacuccaagcaa

SEQ ID NO: 4091765 - RNA, 15 nt, Streptococcus pneumoniae R6
uucuacucuguuuuc

SEQ ID NO: 4091766 - RNA, 18 nt, Streptococcus pneumoniae R6
uucuacuugccgauuauc

SEQ ID NO: 4091767 - RNA, 12 nt, Streptococcus pneumoniae R6
uucuacuuuuuc

SEQ ID NO: 4091768 - RNA, 12 nt, Streptococcus pneumoniae R6
uucuagcuaucu

SEQ ID NO: 4091769 - RNA, 19 nt, Streptococcus pneumoniae R6
uucuagggcacuaugggca

SEQ ID NO: 4091770 - RNA, 22 nt, Streptococcus pneumoniae R6
uucuaguccaacuguaaagaca

SEQ ID NO: 4091771 - RNA, 18 nt, Streptococcus pneumoniae R6
uucuaguugguuuccuug

SEQ ID NO: 4091772 - RNA, 14 nt, Streptococcus pneumoniae R6
uucuaguuucaauc

SEQ ID NO: 4091773 - RNA, 14 nt, Streptococcus pneumoniae R6
uucuaguuugcucu

SEQ ID NO: 4091774 - RNA, 20 nt, Streptococcus pneumoniae R6
uucuaguuugcucuuugauu

SEQ ID NO: 4091775 - RNA, 13 nt, Streptococcus pneumoniae R6
uucuauaaauguu

SEQ ID NO: 4091776 - RNA, 15 nt, Streptococcus pneumoniae R6
uucuauaaauguuuu

SEQ ID NO: 4091777 - RNA, 23 nt, Streptococcus pneumoniae R6
uucuauagaaagcuuacaucauc

SEQ ID NO: 4091778 - RNA, 21 nt, Streptococcus pneumoniae R6
uucuauaggauuuauuuuucu

SEQ ID NO: 4091779 - RNA, 17 nt, Streptococcus pneumoniae R6
uucuauaggucguguau

SEQ ID NO: 4091780 - RNA, 19 nt, Streptococcus pneumoniae R6
uucuauaguagauugaaau

SEQ ID NO: 4091781 - RNA, 14 nt, Streptococcus pneumoniae R6
uucuaucacauugu

SEQ ID NO: 4091782 - RNA, 15 nt, Streptococcus pneumoniae R6
uucuaucagcuuauc

SEQ ID NO: 4091783 - RNA, 15 nt, Streptococcus pneumoniae R6
uucuauccacaaccu

SEQ ID NO: 4091784 - RNA, 15 nt, Streptococcus pneumoniae R6
uucuaucugcaaccu

SEQ ID NO: 4091785 - RNA, 18 nt, Streptococcus pneumoniae R6
uucuaugauaaaaggcau

SEQ ID NO: 4091786 - RNA, 19 nt, Streptococcus pneumoniae R6
uucuauuucauuuuacuau

SEQ ID NO: 4091787 - RNA, 14 nt, Streptococcus pneumoniae R6
uucuauuuuaaaaa

SEQ ID NO: 4091788 - RNA, 15 nt, Streptococcus pneumoniae R6
uucuauuuuaaaaau

SEQ ID NO: 4091789 - RNA, 17 nt, Streptococcus pneumoniae R6
uucuauuuuaaaaauag

SEQ ID NO: 4091790 - RNA, 13 nt, Streptococcus pneumoniae R6
uucucaaaacuag

SEQ ID NO: 4091791 - RNA, 13 nt, Streptococcus pneumoniae R6
uucucaaacauug

SEQ ID NO: 4091792 - RNA, 17 nt, Streptococcus pneumoniae R6
uucucaaacauugugag

SEQ ID NO: 4091793 - RNA, 13 nt, Streptococcus pneumoniae R6
uucucaaagcguu

SEQ ID NO: 4091794 - RNA, 22 nt, Streptococcus pneumoniae R6
uucucaaagcguuuauauagua

SEQ ID NO: 4091795 - RNA, 18 nt, Streptococcus pneumoniae R6
uucucaaccacaaaaaag

SEQ ID NO: 4091796 - RNA, 16 nt, Streptococcus pneumoniae R6
uucucaaucaguuuuu

SEQ ID NO: 4091797 - RNA, 20 nt, Streptococcus pneumoniae R6
uucucacguccuagcucucg

SEQ ID NO: 4091798 - RNA, 16 nt, Streptococcus pneumoniae R6
uucucagauaauaauu

SEQ ID NO: 4091799 - RNA, 18 nt, Streptococcus pneumoniae R6
uucucagggucuuuguuc

SEQ ID NO: 4091800 - RNA, 21 nt, Streptococcus pneumoniae R6
uucucagggucuuuguucuga

SEQ ID NO: 4091801 - RNA, 21 nt, Streptococcus pneumoniae R6
uucucauagccauaaaacauu

SEQ ID NO: 4091802 - RNA, 15 nt, Streptococcus pneumoniae R6
uucucaucuauuuuu

SEQ ID NO: 4091803 - RNA, 13 nt, Streptococcus pneumoniae R6
uucuccaaagaua

SEQ ID NO: 4091804 - RNA, 23 nt, Streptococcus pneumoniae R6
uucuccaaagauagaauccauuu

SEQ ID NO: 4091805 - RNA, 17 nt, Streptococcus pneumoniae R6
uucuccaaagccuucuu

SEQ ID NO: 4091806 - RNA, 13 nt, Streptococcus pneumoniae R6
uucuccaauaagc

SEQ ID NO: 4091807 - RNA, 17 nt, Streptococcus pneumoniae R6
uucuccaaucaaauugu

SEQ ID NO: 4091808 - RNA, 14 nt, Streptococcus pneumoniae R6
uucuccaauccuug

SEQ ID NO: 4091809 - RNA, 14 nt, Streptococcus pneumoniae R6
uucuccgaagucaa

SEQ ID NO: 4091810 - RNA, 17 nt, Streptococcus pneumoniae R6
uucuccgaggauuuccc

SEQ ID NO: 4091811 - RNA, 17 nt, Streptococcus pneumoniae R6
uucuccuaaagaaaaag

SEQ ID NO: 4091812 - RNA, 19 nt, Streptococcus pneumoniae R6
uucuccuacuugcuuccca

SEQ ID NO: 4091813 - RNA, 14 nt, Streptococcus pneumoniae R6
uucuccuguuucaa

SEQ ID NO: 4091814 - RNA, 21 nt, Streptococcus pneumoniae R6
uucuccuuugagguuaaucaa

SEQ ID NO: 4091815 - RNA, 13 nt, Streptococcus pneumoniae R6
uucucgcaaaauc

SEQ ID NO: 4091816 - RNA, 19 nt, Streptococcus pneumoniae R6
uucucggucuuguuuuuau

SEQ ID NO: 4091817 - RNA, 15 nt, Streptococcus pneumoniae R6
uucucguauauagug

SEQ ID NO: 4091818 - RNA, 13 nt, Streptococcus pneumoniae R6
uucucuacaaaua

SEQ ID NO: 4091819 - RNA, 16 nt, Streptococcus pneumoniae R6
uucucuagaaaucucu

SEQ ID NO: 4091820 - RNA, 14 nt, Streptococcus pneumoniae R6
uucucuauauaguu

SEQ ID NO: 4091821 - RNA, 12 nt, Streptococcus pneumoniae R6
uucucuaucucu

SEQ ID NO: 4091822 - RNA, 19 nt, Streptococcus pneumoniae R6
uucucuccuaaccuaaaag

SEQ ID NO: 4091823 - RNA, 20 nt, Streptococcus pneumoniae R6
uucucuggcgcuucuacucc

SEQ ID NO: 4091824 - RNA, 20 nt, Streptococcus pneumoniae R6
uucucugugaaugccuguuc

SEQ ID NO: 4091825 - RNA, 20 nt, Streptococcus pneumoniae R6
uucucuguuaccacaggagc

SEQ ID NO: 4091826 - RNA, 17 nt, Streptococcus pneumoniae R6
uucucuugaaaaugaaa

SEQ ID NO: 4091827 - RNA, 16 nt, Streptococcus pneumoniae R6
uucucuugcaauauag

SEQ ID NO: 4091828 - RNA, 21 nt, Streptococcus pneumoniae R6
uucucuuguuguuguaauaau

SEQ ID NO: 4091829 - RNA, 16 nt, Streptococcus pneumoniae R6
uucugaaagugaaaca

SEQ ID NO: 4091830 - RNA, 18 nt, Streptococcus pneumoniae R6
uucugaaagugaaacagc

SEQ ID NO: 4091831 - RNA, 15 nt, Streptococcus pneumoniae R6
uucugaaauaacuca

SEQ ID NO: 4091832 - RNA, 12 nt, Streptococcus pneumoniae R6
uucugaaauuga

SEQ ID NO: 4091833 - RNA, 15 nt, Streptococcus pneumoniae R6
uucugaagacaaauc

SEQ ID NO: 4091834 - RNA, 22 nt, Streptococcus pneumoniae R6
uucugaaugcuuuccaacgauu

SEQ ID NO: 4091835 - RNA, 23 nt, Streptococcus pneumoniae R6
uucugagguuaaaaucuuuuacu

SEQ ID NO: 4091836 - RNA, 15 nt, Streptococcus pneumoniae R6
uucugaugcacuauu

SEQ ID NO: 4091837 - RNA, 19 nt, Streptococcus pneumoniae R6
uucugauggauuuauagua

SEQ ID NO: 4091838 - RNA, 22 nt, Streptococcus pneumoniae R6
uucugcaaccucuacaauaaca

SEQ ID NO: 4091839 - RNA, 20 nt, Streptococcus pneumoniae R6
uucugcaguuucucuacuaa

SEQ ID NO: 4091840 - RNA, 19 nt, Streptococcus pneumoniae R6
uucugcaucguucaaugga

SEQ ID NO: 4091841 - RNA, 20 nt, Streptococcus pneumoniae R6
uucugcaucugcguuaacuu

SEQ ID NO: 4091842 - RNA, 15 nt, Streptococcus pneumoniae R6
uucugcuaauuuuau

SEQ ID NO: 4091843 - RNA, 21 nt, Streptococcus pneumoniae R6
uucugcuauuaugcuaaagaa

SEQ ID NO: 4091844 - RNA, 14 nt, Streptococcus pneumoniae R6
uucugcuucuaaaa

SEQ ID NO: 4091845 - RNA, 14 nt, Streptococcus pneumoniae R6
uucugcuucuaaau

SEQ ID NO: 4091846 - RNA, 18 nt, Streptococcus pneumoniae R6
uucuggaagugaaaaagc

SEQ ID NO: 4091847 - RNA, 18 nt, Streptococcus pneumoniae R6
uucuggaagugaaacagc

SEQ ID NO: 4091848 - RNA, 14 nt, Streptococcus pneumoniae R6
uucuggaaguucga

SEQ ID NO: 4091849 - RNA, 20 nt, Streptococcus pneumoniae R6
uucuggaaguucuacgauuu

SEQ ID NO: 4091850 - RNA, 17 nt, Streptococcus pneumoniae R6
uucuggcagauuuugaa

SEQ ID NO: 4091851 - RNA, 20 nt, Streptococcus pneumoniae R6
uucuggcaggucgguuuuau

SEQ ID NO: 4091852 - RNA, 14 nt, Streptococcus pneumoniae R6
uucuggcucuuugu

SEQ ID NO: 4091853 - RNA, 22 nt, Streptococcus pneumoniae R6
uucugggcuuucauccaagaua

SEQ ID NO: 4091854 - RNA, 12 nt, Streptococcus pneumoniae R6
uucuggucuaca

SEQ ID NO: 4091855 - RNA, 17 nt, Streptococcus pneumoniae R6
uucuggucuagcuauuu

SEQ ID NO: 4091856 - RNA, 20 nt, Streptococcus pneumoniae R6
uucuggucuagcuauuucuu

SEQ ID NO: 4091857 - RNA, 20 nt, Streptococcus pneumoniae R6
uucuguaaaaauacaucuau

SEQ ID NO: 4091858 - RNA, 15 nt, Streptococcus pneumoniae R6
uucuguaaucuuacc

SEQ ID NO: 4091859 - RNA, 23 nt, Streptococcus pneumoniae R6
uucuguaauuucuacuguauacu

SEQ ID NO: 4091860 - RNA, 21 nt, Streptococcus pneumoniae R6
uucuguacugcacaggacuaa

SEQ ID NO: 4091861 - RNA, 17 nt, Streptococcus pneumoniae R6
uucuguacuuagccaag

SEQ ID NO: 4091862 - RNA, 16 nt, Streptococcus pneumoniae R6
uucugugauauaaucu

SEQ ID NO: 4091863 - RNA, 18 nt, Streptococcus pneumoniae R6
uucugugcuuuuucaaug

SEQ ID NO: 4091864 - RNA, 15 nt, Streptococcus pneumoniae R6
uucuuaaaagcuucu

SEQ ID NO: 4091865 - RNA, 21 nt, Streptococcus pneumoniae R6
uucuuaaaauugguuuaaaua

SEQ ID NO: 4091866 - RNA, 22 nt, Streptococcus pneumoniae R6
uucuuaaaugacauuccugucu

SEQ ID NO: 4091867 - RNA, 20 nt, Streptococcus pneumoniae R6
uucuuaaccaaguuuguauc

SEQ ID NO: 4091868 - RNA, 23 nt, Streptococcus pneumoniae R6
uucuuaaguuaaauuauuaaaau

SEQ ID NO: 4091869 - RNA, 22 nt, Streptococcus pneumoniae R6
uucuuaauuguagcuuuauuaa

SEQ ID NO: 4091870 - RNA, 18 nt, Streptococcus pneumoniae R6
uucuuaccaucuagccau

SEQ ID NO: 4091871 - RNA, 21 nt, Streptococcus pneumoniae R6
uucuuagcaauucuaaaaaca

SEQ ID NO: 4091872 - RNA, 21 nt, Streptococcus pneumoniae R6
uucuuagugaguuuuacaaug

SEQ ID NO: 4091873 - RNA, 23 nt, Streptococcus pneumoniae R6
uucuuauaaauauaguaaaauga

SEQ ID NO: 4091874 - RNA, 14 nt, Streptococcus pneumoniae R6
uucuuauccagaaa

SEQ ID NO: 4091875 - RNA, 20 nt, Streptococcus pneumoniae R6
uucuuaucucgaacguuguu

SEQ ID NO: 4091876 - RNA, 16 nt, Streptococcus pneumoniae R6
uucuuauuucaaaaaa

SEQ ID NO: 4091877 - RNA, 20 nt, Streptococcus pneumoniae R6
uucuuauuucauuuuacuau

SEQ ID NO: 4091878 - RNA, 21 nt, Streptococcus pneumoniae R6
uucuuauuuggcaauucaauu

SEQ ID NO: 4091879 - RNA, 13 nt, Streptococcus pneumoniae R6
uucuuauuuuccu

SEQ ID NO: 4091880 - RNA, 22 nt, Streptococcus pneumoniae R6
uucuucaacccacuacaguuga

SEQ ID NO: 4091881 - RNA, 13 nt, Streptococcus pneumoniae R6
uucuucaagagcu

SEQ ID NO: 4091882 - RNA, 13 nt, Streptococcus pneumoniae R6
uucuucacaaccu

SEQ ID NO: 4091883 - RNA, 17 nt, Streptococcus pneumoniae R6
uucuucacauccucuac

SEQ ID NO: 4091884 - RNA, 22 nt, Streptococcus pneumoniae R6
uucuucacgaauggcuagaacc

SEQ ID NO: 4091885 - RNA, 19 nt, Streptococcus pneumoniae R6
uucuucaggauugauaaaa

SEQ ID NO: 4091886 - RNA, 13 nt, Streptococcus pneumoniae R6
uucuucauacauu

SEQ ID NO: 4091887 - RNA, 22 nt, Streptococcus pneumoniae R6
uucuucauacucaaucccauau

SEQ ID NO: 4091888 - RNA, 15 nt, Streptococcus pneumoniae R6
uucuucauagaguug

SEQ ID NO: 4091889 - RNA, 15 nt, Streptococcus pneumoniae R6
uucuucccacgacgg

SEQ ID NO: 4091890 - RNA, 18 nt, Streptococcus pneumoniae R6
uucuuccgacaauacagu

SEQ ID NO: 4091891 - RNA, 11 nt, Streptococcus pneumoniae R6
uucuuccuacu

SEQ ID NO: 4091892 - RNA, 18 nt, Streptococcus pneumoniae R6
uucuucgacaguaaaaua

SEQ ID NO: 4091893 - RNA, 20 nt, Streptococcus pneumoniae R6
uucuucgucaccgauugcca

SEQ ID NO: 4091894 - RNA, 12 nt, Streptococcus pneumoniae R6
uucuucucuuuu

SEQ ID NO: 4091895 - RNA, 15 nt, Streptococcus pneumoniae R6
uucuucucuuuucuu

SEQ ID NO: 4091896 - RNA, 20 nt, Streptococcus pneumoniae R6
uucuucugugauauaaucuu

SEQ ID NO: 4091897 - RNA, 14 nt, Streptococcus pneumoniae R6
uucuucuuggucug

SEQ ID NO: 4091898 - RNA, 17 nt, Streptococcus pneumoniae R6
uucuucuuuauaauauu

SEQ ID NO: 4091899 - RNA, 11 nt, Streptococcus pneumoniae R6
uucuucuuuuu

SEQ ID NO: 4091900 - RNA, 20 nt, Streptococcus pneumoniae R6
uucuugacagcuugcccuuu

SEQ ID NO: 4091901 - RNA, 22 nt, Streptococcus pneumoniae R6
uucuugacagcuugcccuuugu

SEQ ID NO: 4091902 - RNA, 21 nt, Streptococcus pneumoniae R6
uucuugaccagcgauagcucc

SEQ ID NO: 4091903 - RNA, 17 nt, Streptococcus pneumoniae R6
uucuugagaacuuucuu

SEQ ID NO: 4091904 - RNA, 16 nt, Streptococcus pneumoniae R6
uucuugaguaguucca

SEQ ID NO: 4091905 - RNA, 23 nt, Streptococcus pneumoniae R6
uucuugaguaguuccagugauuu

SEQ ID NO: 4091906 - RNA, 21 nt, Streptococcus pneumoniae R6
uucuugauacugaucaaaaaa

SEQ ID NO: 4091907 - RNA, 23 nt, Streptococcus pneumoniae R6
uucuugauacugaucaaaaaauu

SEQ ID NO: 4091908 - RNA, 18 nt, Streptococcus pneumoniae R6
uucuugauuuccauuucu

SEQ ID NO: 4091909 - RNA, 16 nt, Streptococcus pneumoniae R6
uucuuggaauucugga

SEQ ID NO: 4091910 - RNA, 22 nt, Streptococcus pneumoniae R6
uucuuggagaaacuccuuggcu

SEQ ID NO: 4091911 - RNA, 16 nt, Streptococcus pneumoniae R6
uucuuggguuucuucu

SEQ ID NO: 4091912 - RNA, 23 nt, Streptococcus pneumoniae R6
uucuugguaguagcaccaagaau

SEQ ID NO: 4091913 - RNA, 15 nt, Streptococcus pneumoniae R6
uucuugguauuguuu

SEQ ID NO: 4091914 - RNA, 16 nt, Streptococcus pneumoniae R6
uucuuggucauuugag

SEQ ID NO: 4091915 - RNA, 16 nt, Streptococcus pneumoniae R6
uucuuguguuuaaaua

SEQ ID NO: 4091916 - RNA, 18 nt, Streptococcus pneumoniae R6
uucuuuaaucuugacuau

SEQ ID NO: 4091917 - RNA, 13 nt, Streptococcus pneumoniae R6
uucuuuacuucug

SEQ ID NO: 4091918 - RNA, 14 nt, Streptococcus pneumoniae R6
uucuuuacuucuga

SEQ ID NO: 4091919 - RNA, 18 nt, Streptococcus pneumoniae R6
uucuuuagcuuucaaguu

SEQ ID NO: 4091920 - RNA, 12 nt, Streptococcus pneumoniae R6
uucuuuaucaag

SEQ ID NO: 4091921 - RNA, 19 nt, Streptococcus pneumoniae R6
uucuuuaucauuaaagacc

SEQ ID NO: 4091922 - RNA, 13 nt, Streptococcus pneumoniae R6
uucuuuauguuca

SEQ ID NO: 4091923 - RNA, 13 nt, Streptococcus pneumoniae R6
uucuuuauuagca

SEQ ID NO: 4091924 - RNA, 15 nt, Streptococcus pneumoniae R6
uucuuuauuagucaa

SEQ ID NO: 4091925 - RNA, 17 nt, Streptococcus pneumoniae R6
uucuuucaagcgcucca

SEQ ID NO: 4091926 - RNA, 23 nt, Streptococcus pneumoniae R6
uucuuucaugaguggagccccuu

SEQ ID NO: 4091927 - RNA, 20 nt, Streptococcus pneumoniae R6
uucuuucucaaacauuguga

SEQ ID NO: 4091928 - RNA, 22 nt, Streptococcus pneumoniae R6
uucuuugguugcuacaucuucu

SEQ ID NO: 4091929 - RNA, 15 nt, Streptococcus pneumoniae R6
uucuuuguuaaauga

SEQ ID NO: 4091930 - RNA, 16 nt, Streptococcus pneumoniae R6
uucuuuuacucuaguu

SEQ ID NO: 4091931 - RNA, 16 nt, Streptococcus pneumoniae R6
uucuuuuauccuguuc

SEQ ID NO: 4091932 - RNA, 18 nt, Streptococcus pneumoniae R6
uucuuuuauccuguucuu

SEQ ID NO: 4091933 - RNA, 17 nt, Streptococcus pneumoniae R6
uucuuuucauaaagaga

SEQ ID NO: 4091934 - RNA, 16 nt, Streptococcus pneumoniae R6
uucuuuuguaaagggu

SEQ ID NO: 4091935 - RNA, 12 nt, Streptococcus pneumoniae R6
uucuuuuuacuu

SEQ ID NO: 4091936 - RNA, 11 nt, Streptococcus pneumoniae R6
uucuuuuucag

SEQ ID NO: 4091937 - RNA, 15 nt, Streptococcus pneumoniae R6
uucuuuuucagaacu

SEQ ID NO: 4091938 - RNA, 19 nt, Streptococcus pneumoniae R6
uucuuuuuguauuucuucu

SEQ ID NO: 4091939 - RNA, 14 nt, Streptococcus pneumoniae R6
uucuuuuuuauccu

SEQ ID NO: 4091940 - RNA, 20 nt, Streptococcus pneumoniae R6
uucuuuuuuauccucaaaau

SEQ ID NO: 4091941 - RNA, 17 nt, Streptococcus pneumoniae R6
uucuuuuuuauucaaug

SEQ ID NO: 4091942 - RNA, 20 nt, Streptococcus pneumoniae R6
uucuuuuuugaaguuuucaa

SEQ ID NO: 4091943 - RNA, 16 nt, Streptococcus pneumoniae R6
uucuuuuuugguuucu

SEQ ID NO: 4091944 - RNA, 21 nt, Streptococcus pneumoniae R6
uucuuuuuuuacuaaaauaac

SEQ ID NO: 4091945 - RNA, 19 nt, Streptococcus pneumoniae R6
uucuuuuuuugauauuuau

SEQ ID NO: 4091946 - RNA, 19 nt, Streptococcus pneumoniae R6
uugaaaaacuagaauagaa

SEQ ID NO: 4091947 - RNA, 20 nt, Streptococcus pneumoniae R6
uugaaaaacuagaauagaaa

SEQ ID NO: 4091948 - RNA, 17 nt, Streptococcus pneumoniae R6
uugaaaacgguaacaaa

SEQ ID NO: 4091949 - RNA, 20 nt, Streptococcus pneumoniae R6
uugaaaacugaacaagacga

SEQ ID NO: 4091950 - RNA, 18 nt, Streptococcus pneumoniae R6
uugaaaacugaugaaguc

SEQ ID NO: 4091951 - RNA, 19 nt, Streptococcus pneumoniae R6
uugaaaauccuaguggaaa

SEQ ID NO: 4091952 - RNA, 21 nt, Streptococcus pneumoniae R6
uugaaaaugaauuugaaacaa

SEQ ID NO: 4091953 - RNA, 23 nt, Streptococcus pneumoniae R6
uugaaaccaguuccuuugucuuu

SEQ ID NO: 4091954 - RNA, 14 nt, Streptococcus pneumoniae R6
uugaaacuagaaca

SEQ ID NO: 4091955 - RNA, 18 nt, Streptococcus pneumoniae R6
uugaaacuggaauaguac

SEQ ID NO: 4091956 - RNA, 14 nt, Streptococcus pneumoniae R6
uugaaagauuauag

SEQ ID NO: 4091957 - RNA, 16 nt, Streptococcus pneumoniae R6
uugaaagucauauuuc

SEQ ID NO: 4091958 - RNA, 14 nt, Streptococcus pneumoniae R6
uugaaauaagauau

SEQ ID NO: 4091959 - RNA, 19 nt, Streptococcus pneumoniae R6
uugaaauaagaugagaaca

SEQ ID NO: 4091960 - RNA, 18 nt, Streptococcus pneumoniae R6
uugaaauagaauaugaac

SEQ ID NO: 4091961 - RNA, 15 nt, Streptococcus pneumoniae R6
uugaaaucagaaaaa

SEQ ID NO: 4091962 - RNA, 17 nt, Streptococcus pneumoniae R6
uugaaaucagaaaaaac

SEQ ID NO: 4091963 - RNA, 14 nt, Streptococcus pneumoniae R6
uugaaaugaaauaa

SEQ ID NO: 4091964 - RNA, 15 nt, Streptococcus pneumoniae R6
uugaaauuuaucaac

SEQ ID NO: 4091965 - RNA, 14 nt, Streptococcus pneumoniae R6
uugaacaccugauu

SEQ ID NO: 4091966 - RNA, 22 nt, Streptococcus pneumoniae R6
uugaacauuacuacuaucccuu

SEQ ID NO: 4091967 - RNA, 14 nt, Streptococcus pneumoniae R6
uugaacuucuugac

SEQ ID NO: 4091968 - RNA, 12 nt, Streptococcus pneumoniae R6
uugaacuuuaga

SEQ ID NO: 4091969 - RNA, 15 nt, Streptococcus pneumoniae R6
uugaagaaaagcuaa

SEQ ID NO: 4091970 - RNA, 14 nt, Streptococcus pneumoniae R6
uugaagagauuuuu

SEQ ID NO: 4091971 - RNA, 19 nt, Streptococcus pneumoniae R6
uugaagaguauaagucuuu

SEQ ID NO: 4091972 - RNA, 13 nt, Streptococcus pneumoniae R6
uugaagcaaauca

SEQ ID NO: 4091973 - RNA, 16 nt, Streptococcus pneumoniae R6
uugaagcacuuauaga

SEQ ID NO: 4091974 - RNA, 17 nt, Streptococcus pneumoniae R6
uugaagucagcuaagcu

SEQ ID NO: 4091975 - RNA, 18 nt, Streptococcus pneumoniae R6
uugaaguugauucaugac

SEQ ID NO: 4091976 - RNA, 19 nt, Streptococcus pneumoniae R6
uugaaguugauucaugaca

SEQ ID NO: 4091977 - RNA, 21 nt, Streptococcus pneumoniae R6
uugaauagauacaaaaccaaa

SEQ ID NO: 4091978 - RNA, 19 nt, Streptococcus pneumoniae R6
uugaauagcuuuugugaua

SEQ ID NO: 4091979 - RNA, 21 nt, Streptococcus pneumoniae R6
uugaauauggauaauugaaua

SEQ ID NO: 4091980 - RNA, 20 nt, Streptococcus pneumoniae R6
uugaauauuaguaaauagaa

SEQ ID NO: 4091981 - RNA, 18 nt, Streptococcus pneumoniae R6
uugaaucaccuaaaguag

SEQ ID NO: 4091982 - RNA, 22 nt, Streptococcus pneumoniae R6
uugaaucuggcuuucaauaugu

SEQ ID NO: 4091983 - RNA, 18 nt, Streptococcus pneumoniae R6
uugaaugccaaaauucca

SEQ ID NO: 4091984 - RNA, 19 nt, Streptococcus pneumoniae R6
uugaaugccuguuccaaca

SEQ ID NO: 4091985 - RNA, 19 nt, Streptococcus pneumoniae R6
uugaaugcucccuucuuua

SEQ ID NO: 4091986 - RNA, 14 nt, Streptococcus pneumoniae R6
uugaauguccuuga

SEQ ID NO: 4091987 - RNA, 22 nt, Streptococcus pneumoniae R6
uugacaaagagccaaaaaagaa

SEQ ID NO: 4091988 - RNA, 23 nt, Streptococcus pneumoniae R6
uugacaaagagccacucuuuauu

SEQ ID NO: 4091989 - RNA, 20 nt, Streptococcus pneumoniae R6
uugacaaagagccauaaaaa

SEQ ID NO: 4091990 - RNA, 21 nt, Streptococcus pneumoniae R6
uugacaaagagccccuuucuc

SEQ ID NO: 4091991 - RNA, 20 nt, Streptococcus pneumoniae R6
uugacaaagagccuaauucc

SEQ ID NO: 4091992 - RNA, 20 nt, Streptococcus pneumoniae R6
uugacaaagagccuauaaaa

SEQ ID NO: 4091993 - RNA, 17 nt, Streptococcus pneumoniae R6
uugacaaaguuugaaaa

SEQ ID NO: 4091994 - RNA, 18 nt, Streptococcus pneumoniae R6
uugacaccacuuuugguc

SEQ ID NO: 4091995 - RNA, 19 nt, Streptococcus pneumoniae R6
uugacauacaacuuaaaaa

SEQ ID NO: 4091996 - RNA, 20 nt, Streptococcus pneumoniae R6
uugacauccuuuucuguacu

SEQ ID NO: 4091997 - RNA, 16 nt, Streptococcus pneumoniae R6
uugacauggaaauuau

SEQ ID NO: 4091998 - RNA, 19 nt, Streptococcus pneumoniae R6
uugacauuguagaggagga

SEQ ID NO: 4091999 - RNA, 14 nt, Streptococcus pneumoniae R6
uugaccaucccagu

SEQ ID NO: 4092000 - RNA, 13 nt, Streptococcus pneumoniae R6
uugacccugacuc

SEQ ID NO: 4092001 - RNA, 21 nt, Streptococcus pneumoniae R6
uugacccugacucuccuuagu

SEQ ID NO: 4092002 - RNA, 13 nt, Streptococcus pneumoniae R6
uugacgauuuucu

SEQ ID NO: 4092003 - RNA, 15 nt, Streptococcus pneumoniae R6
uugacguugcaaguu

SEQ ID NO: 4092004 - RNA, 14 nt, Streptococcus pneumoniae R6
uugacuauauuucu

SEQ ID NO: 4092005 - RNA, 19 nt, Streptococcus pneumoniae R6
uugacuauauuucuuaauu

SEQ ID NO: 4092006 - RNA, 19 nt, Streptococcus pneumoniae R6
uugacuccccauuuaccaa

SEQ ID NO: 4092007 - RNA, 20 nt, Streptococcus pneumoniae R6
uugacucguuacuauaagac

SEQ ID NO: 4092008 - RNA, 23 nt, Streptococcus pneumoniae R6
uugacucguuacuauaagacucc

SEQ ID NO: 4092009 - RNA, 19 nt, Streptococcus pneumoniae R6
uugacugcccagacacuua

SEQ ID NO: 4092010 - RNA, 18 nt, Streptococcus pneumoniae R6
uugacuuaaugaauacca

SEQ ID NO: 4092011 - RNA, 18 nt, Streptococcus pneumoniae R6
uugacuuccaaaauuaaa

SEQ ID NO: 4092012 - RNA, 19 nt, Streptococcus pneumoniae R6
uugacuugcaaaaagacuu

SEQ ID NO: 4092013 - RNA, 20 nt, Streptococcus pneumoniae R6
uugacuuucuuguuuucuua

SEQ ID NO: 4092014 - RNA, 13 nt, Streptococcus pneumoniae R6
uugagaaaauaug

SEQ ID NO: 4092015 - RNA, 17 nt, Streptococcus pneumoniae R6
uugagaaacuagaagug

SEQ ID NO: 4092016 - RNA, 17 nt, Streptococcus pneumoniae R6
uugagaaaguuaaaaaa

SEQ ID NO: 4092017 - RNA, 21 nt, Streptococcus pneumoniae R6
uugagaaaguuaaaaaaacua

SEQ ID NO: 4092018 - RNA, 18 nt, Streptococcus pneumoniae R6
uugagaacuuucuuuuuu

SEQ ID NO: 4092019 - RNA, 13 nt, Streptococcus pneumoniae R6
uugagaagagcuu

SEQ ID NO: 4092020 - RNA, 16 nt, Streptococcus pneumoniae R6
uugagaagagcuucuu

SEQ ID NO: 4092021 - RNA, 11 nt, Streptococcus pneumoniae R6
uugagaagcca

SEQ ID NO: 4092022 - RNA, 18 nt, Streptococcus pneumoniae R6
uugagagcauuuuucgaa

SEQ ID NO: 4092023 - RNA, 19 nt, Streptococcus pneumoniae R6
uugagaucuuuuucgcuug

SEQ ID NO: 4092024 - RNA, 23 nt, Streptococcus pneumoniae R6
uugagauuggcguguuugucaaa

SEQ ID NO: 4092025 - RNA, 13 nt, Streptococcus pneumoniae R6
uugagcaaccugc

SEQ ID NO: 4092026 - RNA, 16 nt, Streptococcus pneumoniae R6
uugagcaaguucaaga

SEQ ID NO: 4092027 - RNA, 19 nt, Streptococcus pneumoniae R6
uugagccuagugucucaaa

SEQ ID NO: 4092028 - RNA, 11 nt, Streptococcus pneumoniae R6
uugagcgaauc

SEQ ID NO: 4092029 - RNA, 23 nt, Streptococcus pneumoniae R6
uugagcuacguucugucaaacca

SEQ ID NO: 4092030 - RNA, 23 nt, Streptococcus pneumoniae R6
uugagcugacuucgucaguucca

SEQ ID NO: 4092031 - RNA, 22 nt, Streptococcus pneumoniae R6
uugagcugacuucgucaguucu

SEQ ID NO: 4092032 - RNA, 13 nt, Streptococcus pneumoniae R6
uugagcuggcuca

SEQ ID NO: 4092033 - RNA, 21 nt, Streptococcus pneumoniae R6
uugaggaagguuuuaaacaaa

SEQ ID NO: 4092034 - RNA, 16 nt, Streptococcus pneumoniae R6
uugagggcugcaaaau

SEQ ID NO: 4092035 - RNA, 20 nt, Streptococcus pneumoniae R6
uugagguuguagaugaaacu

SEQ ID NO: 4092036 - RNA, 23 nt, Streptococcus pneumoniae R6
uugagguuguggauagaacugac

SEQ ID NO: 4092037 - RNA, 20 nt, Streptococcus pneumoniae R6
uugagguuguggaugaaacu

SEQ ID NO: 4092038 - RNA, 21 nt, Streptococcus pneumoniae R6
uugaguaaauaaaacaaaaaa

SEQ ID NO: 4092039 - RNA, 22 nt, Streptococcus pneumoniae R6
uugaguaaccugcggcuaacuu

SEQ ID NO: 4092040 - RNA, 13 nt, Streptococcus pneumoniae R6
uugaguaaguuua

SEQ ID NO: 4092041 - RNA, 22 nt, Streptococcus pneumoniae R6
uugagucaagauaacaguuuuu

SEQ ID NO: 4092042 - RNA, 20 nt, Streptococcus pneumoniae R6
uugagucguucucuuauugu

SEQ ID NO: 4092043 - RNA, 16 nt, Streptococcus pneumoniae R6
uugaguggauuuuuaa

SEQ ID NO: 4092044 - RNA, 17 nt, Streptococcus pneumoniae R6
uugaguugggauaaacg

SEQ ID NO: 4092045 - RNA, 21 nt, Streptococcus pneumoniae R6
uugauaaaggcagauuucaaa

SEQ ID NO: 4092046 - RNA, 19 nt, Streptococcus pneumoniae R6
uugauaaauuucaaaguag

SEQ ID NO: 4092047 - RNA, 15 nt, Streptococcus pneumoniae R6
uugauaaccuuaauc

SEQ ID NO: 4092048 - RNA, 16 nt, Streptococcus pneumoniae R6
uugauaagauaauaaa

SEQ ID NO: 4092049 - RNA, 17 nt, Streptococcus pneumoniae R6
uugauaagauaauaaau

SEQ ID NO: 4092050 - RNA, 19 nt, Streptococcus pneumoniae R6
uugauaauacgaccaaucu

SEQ ID NO: 4092051 - RNA, 22 nt, Streptococcus pneumoniae R6
uugauaauaggagcuuuuggga

SEQ ID NO: 4092052 - RNA, 12 nt, Streptococcus pneumoniae R6
uugauaauagua

SEQ ID NO: 4092053 - RNA, 19 nt, Streptococcus pneumoniae R6
uugauaauaguaugucuga

SEQ ID NO: 4092054 - RNA, 14 nt, Streptococcus pneumoniae R6
uugauaaucuuauc

SEQ ID NO: 4092055 - RNA, 22 nt, Streptococcus pneumoniae R6
uugauacucuucgaaaaucucu

SEQ ID NO: 4092056 - RNA, 21 nt, Streptococcus pneumoniae R6
uugauacuguacguuuuauca

SEQ ID NO: 4092057 - RNA, 18 nt, Streptococcus pneumoniae R6
uugauacuguuaauaaaa

SEQ ID NO: 4092058 - RNA, 19 nt, Streptococcus pneumoniae R6
uugauacuguuaauaaaau

SEQ ID NO: 4092059 - RNA, 14 nt, Streptococcus pneumoniae R6
uugauagaaagcaa

SEQ ID NO: 4092060 - RNA, 18 nt, Streptococcus pneumoniae R6
uugauaggauauugacaa

SEQ ID NO: 4092061 - RNA, 20 nt, Streptococcus pneumoniae R6
uugauauauaaaugaaaacc

SEQ ID NO: 4092062 - RNA, 18 nt, Streptococcus pneumoniae R6
uugauaugagcccauguu

SEQ ID NO: 4092063 - RNA, 11 nt, Streptococcus pneumoniae R6
uugauaugaug

SEQ ID NO: 4092064 - RNA, 18 nt, Streptococcus pneumoniae R6
uugauaugguaauguucu

SEQ ID NO: 4092065 - RNA, 17 nt, Streptococcus pneumoniae R6
uugauauuggcugcuug

SEQ ID NO: 4092066 - RNA, 17 nt, Streptococcus pneumoniae R6
uugauauuuauagaaaa

SEQ ID NO: 4092067 - RNA, 15 nt, Streptococcus pneumoniae R6
uugauauuuccauca

SEQ ID NO: 4092068 - RNA, 20 nt, Streptococcus pneumoniae R6
uugauccuggcucaggacga

SEQ ID NO: 4092069 - RNA, 17 nt, Streptococcus pneumoniae R6
uugaucggaagcuacag

SEQ ID NO: 4092070 - RNA, 18 nt, Streptococcus pneumoniae R6
uugaucugacuucgucag

SEQ ID NO: 4092071 - RNA, 18 nt, Streptococcus pneumoniae R6
uugaugaaaaaaaguuua

SEQ ID NO: 4092072 - RNA, 23 nt, Streptococcus pneumoniae R6
uugaugaacugcuugagcugcug

SEQ ID NO: 4092073 - RNA, 18 nt, Streptococcus pneumoniae R6
uugaugaagaacuggcug

SEQ ID NO: 4092074 - RNA, 17 nt, Streptococcus pneumoniae R6
uugaugagauuauuggu

SEQ ID NO: 4092075 - RNA, 21 nt, Streptococcus pneumoniae R6
uugaugauauacguuuucuug

SEQ ID NO: 4092076 - RNA, 17 nt, Streptococcus pneumoniae R6
uugauggacaacaauga

SEQ ID NO: 4092077 - RNA, 16 nt, Streptococcus pneumoniae R6
uugauggaguuuucaa

SEQ ID NO: 4092078 - RNA, 18 nt, Streptococcus pneumoniae R6
uugauggguucuuugcca

SEQ ID NO: 4092079 - RNA, 14 nt, Streptococcus pneumoniae R6
uugauuacauaaau

SEQ ID NO: 4092080 - RNA, 14 nt, Streptococcus pneumoniae R6
uugauuauuuuuua

SEQ ID NO: 4092081 - RNA, 18 nt, Streptococcus pneumoniae R6
uugauucaaagucauaaa

SEQ ID NO: 4092082 - RNA, 14 nt, Streptococcus pneumoniae R6
uugauucagauuca

SEQ ID NO: 4092083 - RNA, 14 nt, Streptococcus pneumoniae R6
uugauucaugacau

SEQ ID NO: 4092084 - RNA, 15 nt, Streptococcus pneumoniae R6
uugauucaugacauc

SEQ ID NO: 4092085 - RNA, 16 nt, Streptococcus pneumoniae R6
uugauucaugacaucu

SEQ ID NO: 4092086 - RNA, 21 nt, Streptococcus pneumoniae R6
uugauucaugacaucuuccaa

SEQ ID NO: 4092087 - RNA, 16 nt, Streptococcus pneumoniae R6
uugauugcaagcccuu

SEQ ID NO: 4092088 - RNA, 14 nt, Streptococcus pneumoniae R6
uugauugcuucauc

SEQ ID NO: 4092089 - RNA, 14 nt, Streptococcus pneumoniae R6
uugauuuaugccau

SEQ ID NO: 4092090 - RNA, 16 nt, Streptococcus pneumoniae R6
uugauuuaugccauau

SEQ ID NO: 4092091 - RNA, 12 nt, Streptococcus pneumoniae R6
uugauuuccagc

SEQ ID NO: 4092092 - RNA, 12 nt, Streptococcus pneumoniae R6
uugauuuccauu

SEQ ID NO: 4092093 - RNA, 20 nt, Streptococcus pneumoniae R6
uugauuucuggauuuccauu

SEQ ID NO: 4092094 - RNA, 14 nt, Streptococcus pneumoniae R6
uugauuugaaugcc

SEQ ID NO: 4092095 - RNA, 20 nt, Streptococcus pneumoniae R6
uugauuuggacuauucguuu

SEQ ID NO: 4092096 - RNA, 15 nt, Streptococcus pneumoniae R6
uugauuuuaaagaaa

SEQ ID NO: 4092097 - RNA, 18 nt, Streptococcus pneumoniae R6
uugauuuuaaagaaauag

SEQ ID NO: 4092098 - RNA, 11 nt, Streptococcus pneumoniae R6
uugauuuuaau

SEQ ID NO: 4092099 - RNA, 13 nt, Streptococcus pneumoniae R6
uugauuuucauug

SEQ ID NO: 4092100 - RNA, 22 nt, Streptococcus pneumoniae R6
uugauuuuccuaaucaauuugu

SEQ ID NO: 4092101 - RNA, 12 nt, Streptococcus pneumoniae R6
uugauuuuuucc

SEQ ID NO: 4092102 - RNA, 19 nt, Streptococcus pneumoniae R6
uugcaaaaagacuuagcaa

SEQ ID NO: 4092103 - RNA, 12 nt, Streptococcus pneumoniae R6
uugcaaaggaga

SEQ ID NO: 4092104 - RNA, 18 nt, Streptococcus pneumoniae R6
uugcaacuggagacuuuc

SEQ ID NO: 4092105 - RNA, 15 nt, Streptococcus pneumoniae R6
uugcaagaaaguaga

SEQ ID NO: 4092106 - RNA, 16 nt, Streptococcus pneumoniae R6
uugcaagagaaaucau

SEQ ID NO: 4092107 - RNA, 21 nt, Streptococcus pneumoniae R6
uugcaagcccuuauuuccauc

SEQ ID NO: 4092108 - RNA, 18 nt, Streptococcus pneumoniae R6
uugcaagugcuccaugac

SEQ ID NO: 4092109 - RNA, 12 nt, Streptococcus pneumoniae R6
uugcaaguuuua

SEQ ID NO: 4092110 - RNA, 16 nt, Streptococcus pneumoniae R6
uugcaaucauuucaaa

SEQ ID NO: 4092111 - RNA, 20 nt, Streptococcus pneumoniae R6
uugcaaucucuguuaagaaa

SEQ ID NO: 4092112 - RNA, 13 nt, Streptococcus pneumoniae R6
uugcaauucuuuu

SEQ ID NO: 4092113 - RNA, 17 nt, Streptococcus pneumoniae R6
uugcacggguuuaacua

SEQ ID NO: 4092114 - RNA, 16 nt, Streptococcus pneumoniae R6
uugcacuuuccucuug

SEQ ID NO: 4092115 - RNA, 17 nt, Streptococcus pneumoniae R6
uugcagaugaaagcuga

SEQ ID NO: 4092116 - RNA, 17 nt, Streptococcus pneumoniae R6
uugcaggauuuuugcuu

SEQ ID NO: 4092117 - RNA, 23 nt, Streptococcus pneumoniae R6
uugcauagcgaagaacaauaauc

SEQ ID NO: 4092118 - RNA, 13 nt, Streptococcus pneumoniae R6
uugcaucaaauca

SEQ ID NO: 4092119 - RNA, 21 nt, Streptococcus pneumoniae R6
uugcaugauugagaaaguuaa

SEQ ID NO: 4092120 - RNA, 18 nt, Streptococcus pneumoniae R6
uugcauuaaaaaguuuug

SEQ ID NO: 4092121 - RNA, 16 nt, Streptococcus pneumoniae R6
uugcauuucaucuucu

SEQ ID NO: 4092122 - RNA, 13 nt, Streptococcus pneumoniae R6
uugcauuuuaauu

SEQ ID NO: 4092123 - RNA, 12 nt, Streptococcus pneumoniae R6
uugccaccuuuu

SEQ ID NO: 4092124 - RNA, 13 nt, Streptococcus pneumoniae R6
uugccagguuucg

SEQ ID NO: 4092125 - RNA, 18 nt, Streptococcus pneumoniae R6
uugcccucuaaauacaaa

SEQ ID NO: 4092126 - RNA, 12 nt, Streptococcus pneumoniae R6
uugcccuuggcu

SEQ ID NO: 4092127 - RNA, 15 nt, Streptococcus pneumoniae R6
uugccgauaucacca

SEQ ID NO: 4092128 - RNA, 17 nt, Streptococcus pneumoniae R6
uugccgugcucuaaaau

SEQ ID NO: 4092129 - RNA, 18 nt, Streptococcus pneumoniae R6
uugccuagcgauuuccau

SEQ ID NO: 4092130 - RNA, 20 nt, Streptococcus pneumoniae R6
uugccuagggugacaguaaa

SEQ ID NO: 4092131 - RNA, 23 nt, Streptococcus pneumoniae R6
uugccuagggugacaguaaaaaa

SEQ ID NO: 4092132 - RNA, 20 nt, Streptococcus pneumoniae R6
uugccucaauaucuucugcu

SEQ ID NO: 4092133 - RNA, 13 nt, Streptococcus pneumoniae R6
uugccugaacgcu

SEQ ID NO: 4092134 - RNA, 21 nt, Streptococcus pneumoniae R6
uugccugaacgcuagcuacuu

SEQ ID NO: 4092135 - RNA, 22 nt, Streptococcus pneumoniae R6
uugcgaggacagauaagagcaa

SEQ ID NO: 4092136 - RNA, 13 nt, Streptococcus pneumoniae R6
uugcgauacuguu

SEQ ID NO: 4092137 - RNA, 15 nt, Streptococcus pneumoniae R6
uugcgauuuugccaa

SEQ ID NO: 4092138 - RNA, 16 nt, Streptococcus pneumoniae R6
uugcuaaaaaaaggga

SEQ ID NO: 4092139 - RNA, 14 nt, Streptococcus pneumoniae R6
uugcuaaaacauuu

SEQ ID NO: 4092140 - RNA, 22 nt, Streptococcus pneumoniae R6
uugcuaggcguucucugagacc

SEQ ID NO: 4092141 - RNA, 18 nt, Streptococcus pneumoniae R6
uugcucaaaguacagauu

SEQ ID NO: 4092142 - RNA, 13 nt, Streptococcus pneumoniae R6
uugcucaacuucu

SEQ ID NO: 4092143 - RNA, 16 nt, Streptococcus pneumoniae R6
uugcucaauaaccacu

SEQ ID NO: 4092144 - RNA, 18 nt, Streptococcus pneumoniae R6
uugcucaaucaauccaaa

SEQ ID NO: 4092145 - RNA, 16 nt, Streptococcus pneumoniae R6
uugcucauagccauaa

SEQ ID NO: 4092146 - RNA, 17 nt, Streptococcus pneumoniae R6
uugcucauauagaccaa

SEQ ID NO: 4092147 - RNA, 14 nt, Streptococcus pneumoniae R6
uugcuccauucuuu

SEQ ID NO: 4092148 - RNA, 14 nt, Streptococcus pneumoniae R6
uugcucuauacaca

SEQ ID NO: 4092149 - RNA, 18 nt, Streptococcus pneumoniae R6
uugcucuuaucuguccuc

SEQ ID NO: 4092150 - RNA, 18 nt, Streptococcus pneumoniae R6
uugcuggagcuggggcua

SEQ ID NO: 4092151 - RNA, 17 nt, Streptococcus pneumoniae R6
uugcugucaaaaagauc

SEQ ID NO: 4092152 - RNA, 13 nt, Streptococcus pneumoniae R6
uugcuguuuauau

SEQ ID NO: 4092153 - RNA, 21 nt, Streptococcus pneumoniae R6
uugcuuagucggauggaaaua

SEQ ID NO: 4092154 - RNA, 19 nt, Streptococcus pneumoniae R6
uugcuucauugacagaacc

SEQ ID NO: 4092155 - RNA, 18 nt, Streptococcus pneumoniae R6
uugcuugaccagcuacug

SEQ ID NO: 4092156 - RNA, 16 nt, Streptococcus pneumoniae R6
uugcuugccaugagcu

SEQ ID NO: 4092157 - RNA, 12 nt, Streptococcus pneumoniae R6
uugcuuguucca

SEQ ID NO: 4092158 - RNA, 20 nt, Streptococcus pneumoniae R6
uugcuuuccucagcaggagc

SEQ ID NO: 4092159 - RNA, 13 nt, Streptococcus pneumoniae R6
uugcuuucuucag

SEQ ID NO: 4092160 - RNA, 19 nt, Streptococcus pneumoniae R6
uugcuuugcugacuugccu

SEQ ID NO: 4092161 - RNA, 18 nt, Streptococcus pneumoniae R6
uugcuuuuugauuucuaa

SEQ ID NO: 4092162 - RNA, 19 nt, Streptococcus pneumoniae R6
uuggaaaccaagaagucca

SEQ ID NO: 4092163 - RNA, 13 nt, Streptococcus pneumoniae R6
uuggaaacuuuuu

SEQ ID NO: 4092164 - RNA, 19 nt, Streptococcus pneumoniae R6
uuggaaauagcauccacca

SEQ ID NO: 4092165 - RNA, 16 nt, Streptococcus pneumoniae R6
uuggaacguguucaau

SEQ ID NO: 4092166 - RNA, 22 nt, Streptococcus pneumoniae R6
uuggaagaaugagugcuguaau

SEQ ID NO: 4092167 - RNA, 14 nt, Streptococcus pneumoniae R6
uuggaauaagguaa

SEQ ID NO: 4092168 - RNA, 14 nt, Streptococcus pneumoniae R6
uuggaauaguugaa

SEQ ID NO: 4092169 - RNA, 19 nt, Streptococcus pneumoniae R6
uuggaauaguugaaaucaa

SEQ ID NO: 4092170 - RNA, 22 nt, Streptococcus pneumoniae R6
uuggacauagccaauaaauguu

SEQ ID NO: 4092171 - RNA, 20 nt, Streptococcus pneumoniae R6
uuggagaaacuccuuggcua

SEQ ID NO: 4092172 - RNA, 15 nt, Streptococcus pneumoniae R6
uuggagcuuaaaauc

SEQ ID NO: 4092173 - RNA, 16 nt, Streptococcus pneumoniae R6
uuggagggagcaacca

SEQ ID NO: 4092174 - RNA, 19 nt, Streptococcus pneumoniae R6
uuggaguugauucaugaca

SEQ ID NO: 4092175 - RNA, 22 nt, Streptococcus pneumoniae R6
uuggaguuguaaucuuagcaaa

SEQ ID NO: 4092176 - RNA, 17 nt, Streptococcus pneumoniae R6
uuggauaaguuuagaau

SEQ ID NO: 4092177 - RNA, 15 nt, Streptococcus pneumoniae R6
uuggauaauauccac

SEQ ID NO: 4092178 - RNA, 15 nt, Streptococcus pneumoniae R6
uuggauauaagaagc

SEQ ID NO: 4092179 - RNA, 17 nt, Streptococcus pneumoniae R6
uuggauccaauuucuaa

SEQ ID NO: 4092180 - RNA, 17 nt, Streptococcus pneumoniae R6
uuggauuaugaaaaauc

SEQ ID NO: 4092181 - RNA, 13 nt, Streptococcus pneumoniae R6
uuggauuuaaaaa

SEQ ID NO: 4092182 - RNA, 15 nt, Streptococcus pneumoniae R6
uuggauuuucugaag

SEQ ID NO: 4092183 - RNA, 18 nt, Streptococcus pneumoniae R6
uuggcaaauugauaagga

SEQ ID NO: 4092184 - RNA, 11 nt, Streptococcus pneumoniae R6
uuggcaagagc

SEQ ID NO: 4092185 - RNA, 20 nt, Streptococcus pneumoniae R6
uuggcaauuuuugaaaggau

SEQ ID NO: 4092186 - RNA, 23 nt, Streptococcus pneumoniae R6
uuggcagauuuaaucugaauguu

SEQ ID NO: 4092187 - RNA, 22 nt, Streptococcus pneumoniae R6
uuggcagccucuuucuugucgu

SEQ ID NO: 4092188 - RNA, 15 nt, Streptococcus pneumoniae R6
uuggcaggcguuuuu

SEQ ID NO: 4092189 - RNA, 23 nt, Streptococcus pneumoniae R6
uuggccaacuaaccaacuucuuu

SEQ ID NO: 4092190 - RNA, 19 nt, Streptococcus pneumoniae R6
uuggcgaauauagacaaaa

SEQ ID NO: 4092191 - RNA, 21 nt, Streptococcus pneumoniae R6
uuggcgaauuggauauagucu

SEQ ID NO: 4092192 - RNA, 20 nt, Streptococcus pneumoniae R6
uuggcgauaugguaggcuuu

SEQ ID NO: 4092193 - RNA, 19 nt, Streptococcus pneumoniae R6
uuggcguuuugaguuaacu

SEQ ID NO: 4092194 - RNA, 14 nt, Streptococcus pneumoniae R6
uuggcuaaagauaa

SEQ ID NO: 4092195 - RNA, 22 nt, Streptococcus pneumoniae R6
uuggcuaggcgcuucacuaguu

SEQ ID NO: 4092196 - RNA, 12 nt, Streptococcus pneumoniae R6
uuggcuucagua

SEQ ID NO: 4092197 - RNA, 18 nt, Streptococcus pneumoniae R6
uuggcuucguguuccaaa

SEQ ID NO: 4092198 - RNA, 20 nt, Streptococcus pneumoniae R6
uuggcuuugagauauuucuu

SEQ ID NO: 4092199 - RNA, 19 nt, Streptococcus pneumoniae R6
uugggaaaauggcuccugu

SEQ ID NO: 4092200 - RNA, 19 nt, Streptococcus pneumoniae R6
uugggcaagggcaccaaac

SEQ ID NO: 4092201 - RNA, 21 nt, Streptococcus pneumoniae R6
uugggcaaucguugucaaguu

SEQ ID NO: 4092202 - RNA, 19 nt, Streptococcus pneumoniae R6
uugggcacgaaguugguca

SEQ ID NO: 4092203 - RNA, 16 nt, Streptococcus pneumoniae R6
uugggcagaaguuuug

SEQ ID NO: 4092204 - RNA, 15 nt, Streptococcus pneumoniae R6
uugggcgaugaagac

SEQ ID NO: 4092205 - RNA, 21 nt, Streptococcus pneumoniae R6
uugggucguaaaccuucaaga

SEQ ID NO: 4092206 - RNA, 14 nt, Streptococcus pneumoniae R6
uugggucuguuuuu

SEQ ID NO: 4092207 - RNA, 22 nt, Streptococcus pneumoniae R6
uugguaagagaaauuucugaaa

SEQ ID NO: 4092208 - RNA, 14 nt, Streptococcus pneumoniae R6
uugguaagagucac

SEQ ID NO: 4092209 - RNA, 13 nt, Streptococcus pneumoniae R6
uugguaagaguug

SEQ ID NO: 4092210 - RNA, 16 nt, Streptococcus pneumoniae R6
uugguaauuuucaaga

SEQ ID NO: 4092211 - RNA, 19 nt, Streptococcus pneumoniae R6
uugguaccgcugaaagcaa

SEQ ID NO: 4092212 - RNA, 12 nt, Streptococcus pneumoniae R6
uugguaggauaa

SEQ ID NO: 4092213 - RNA, 22 nt, Streptococcus pneumoniae R6
uugguaguuuggcacaccacga

SEQ ID NO: 4092214 - RNA, 15 nt, Streptococcus pneumoniae R6
uugguaucuuggcua

SEQ ID NO: 4092215 - RNA, 15 nt, Streptococcus pneumoniae R6
uugguauguguauuc

SEQ ID NO: 4092216 - RNA, 23 nt, Streptococcus pneumoniae R6
uuggucagaaugaugauagucau

SEQ ID NO: 4092217 - RNA, 24 nt, Streptococcus pneumoniae R6
uuggucauuaaauuuuuuucucaa

SEQ ID NO: 4092218 - RNA, 15 nt, Streptococcus pneumoniae R6
uuggucgcuuccaau

SEQ ID NO: 4092219 - RNA, 18 nt, Streptococcus pneumoniae R6
uuggucuuauaagccucu

SEQ ID NO: 4092220 - RNA, 17 nt, Streptococcus pneumoniae R6
uuggugaacguggucca

SEQ ID NO: 4092221 - RNA, 14 nt, Streptococcus pneumoniae R6
uugguggcuuccag

SEQ ID NO: 4092222 - RNA, 14 nt, Streptococcus pneumoniae R6
uugguguaaauaga

SEQ ID NO: 4092223 - RNA, 19 nt, Streptococcus pneumoniae R6
uugguguaaauagaaacca

SEQ ID NO: 4092224 - RNA, 18 nt, Streptococcus pneumoniae R6
uugguguuugguugacca

SEQ ID NO: 4092225 - RNA, 18 nt, Streptococcus pneumoniae R6
uugguuaaaugcauacga

SEQ ID NO: 4092226 - RNA, 12 nt, Streptococcus pneumoniae R6
uugguucugcuc

SEQ ID NO: 4092227 - RNA, 16 nt, Streptococcus pneumoniae R6
uugguugauuuaccau

SEQ ID NO: 4092228 - RNA, 17 nt, Streptococcus pneumoniae R6
uugguugcuacaucuuc

SEQ ID NO: 4092229 - RNA, 16 nt, Streptococcus pneumoniae R6
uugguuuuucuucagc

SEQ ID NO: 4092230 - RNA, 14 nt, Streptococcus pneumoniae R6
uuguaaaaaaggac

SEQ ID NO: 4092231 - RNA, 16 nt, Streptococcus pneumoniae R6
uuguaaacugugaugg

SEQ ID NO: 4092232 - RNA, 19 nt, Streptococcus pneumoniae R6
uuguaaagaguacagucuu

SEQ ID NO: 4092233 - RNA, 23 nt, Streptococcus pneumoniae R6
uuguaaagcgaaaggagaaaaaa

SEQ ID NO: 4092234 - RNA, 23 nt, Streptococcus pneumoniae R6
uuguaaagcgaaaggagaaaaau

SEQ ID NO: 4092235 - RNA, 19 nt, Streptococcus pneumoniae R6
uuguaaccgauauuuccug

SEQ ID NO: 4092236 - RNA, 20 nt, Streptococcus pneumoniae R6
uuguaacuagcugccuaguu

SEQ ID NO: 4092237 - RNA, 14 nt, Streptococcus pneumoniae R6
uuguaagcuagcaa

SEQ ID NO: 4092238 - RNA, 17 nt, Streptococcus pneumoniae R6
uuguaaucuaggaaaac

SEQ ID NO: 4092239 - RNA, 14 nt, Streptococcus pneumoniae R6
uuguacuuguucua

SEQ ID NO: 4092240 - RNA, 18 nt, Streptococcus pneumoniae R6
uuguagauagaacugacg

SEQ ID NO: 4092241 - RNA, 18 nt, Streptococcus pneumoniae R6
uuguagaugaaacugacg

SEQ ID NO: 4092242 - RNA, 14 nt, Streptococcus pneumoniae R6
uuguagauggaacu

SEQ ID NO: 4092243 - RNA, 18 nt, Streptococcus pneumoniae R6
uuguagauggaacugacg

SEQ ID NO: 4092244 - RNA, 16 nt, Streptococcus pneumoniae R6
uuguagauguucuuug

SEQ ID NO: 4092245 - RNA, 15 nt, Streptococcus pneumoniae R6
uuguaguaaaagaau

SEQ ID NO: 4092246 - RNA, 13 nt, Streptococcus pneumoniae R6
uuguagucugcug

SEQ ID NO: 4092247 - RNA, 18 nt, Streptococcus pneumoniae R6
uuguauacguuuuuacua

SEQ ID NO: 4092248 - RNA, 20 nt, Streptococcus pneumoniae R6
uuguaucaccaagcauuuuc

SEQ ID NO: 4092249 - RNA, 20 nt, Streptococcus pneumoniae R6
uuguauccugaaaagccacg

SEQ ID NO: 4092250 - RNA, 20 nt, Streptococcus pneumoniae R6
uuguaugaaaaguuuuagcu

SEQ ID NO: 4092251 - RNA, 22 nt, Streptococcus pneumoniae R6
uuguauggaaacucaaaagaag

SEQ ID NO: 4092252 - RNA, 16 nt, Streptococcus pneumoniae R6
uuguauucgcuuacau

SEQ ID NO: 4092253 - RNA, 18 nt, Streptococcus pneumoniae R6
uugucaaacaagaccuca

SEQ ID NO: 4092254 - RNA, 15 nt, Streptococcus pneumoniae R6
uugucaaacaucaug

SEQ ID NO: 4092255 - RNA, 10 nt, Streptococcus pneumoniae R6
uugucaacug

SEQ ID NO: 4092256 - RNA, 15 nt, Streptococcus pneumoniae R6
uugucaauuuccauu

SEQ ID NO: 4092257 - RNA, 17 nt, Streptococcus pneumoniae R6
uugucacacaaaaaaga

SEQ ID NO: 4092258 - RNA, 13 nt, Streptococcus pneumoniae R6
uugucaucaucuu

SEQ ID NO: 4092259 - RNA, 24 nt, Streptococcus pneumoniae R6
uugucauccuuacggucaaaguca

SEQ ID NO: 4092260 - RNA, 20 nt, Streptococcus pneumoniae R6
uugucaucguuuucucguuu

SEQ ID NO: 4092261 - RNA, 16 nt, Streptococcus pneumoniae R6
uuguccuaaauagaag

SEQ ID NO: 4092262 - RNA, 22 nt, Streptococcus pneumoniae R6
uuguccugaaugauuucuucuu

SEQ ID NO: 4092263 - RNA, 19 nt, Streptococcus pneumoniae R6
uuguccuuuagaaagguuu

SEQ ID NO: 4092264 - RNA, 14 nt, Streptococcus pneumoniae R6
uugucuaaaaauag

SEQ ID NO: 4092265 - RNA, 18 nt, Streptococcus pneumoniae R6
uugucuaaaaauuuaaaa

SEQ ID NO: 4092266 - RNA, 12 nt, Streptococcus pneumoniae R6
uugucuaaaauu

SEQ ID NO: 4092267 - RNA, 21 nt, Streptococcus pneumoniae R6
uugucucuaaaaauaaaaaag

SEQ ID NO: 4092268 - RNA, 12 nt, Streptococcus pneumoniae R6
uugucugaaguu

SEQ ID NO: 4092269 - RNA, 11 nt, Streptococcus pneumoniae R6
uugucuguaac

SEQ ID NO: 4092270 - RNA, 11 nt, Streptococcus pneumoniae R6
uugucuucaaa

SEQ ID NO: 4092271 - RNA, 18 nt, Streptococcus pneumoniae R6
uugucuucaaaggucaaa

SEQ ID NO: 4092272 - RNA, 23 nt, Streptococcus pneumoniae R6
uugucuucugcggauaaaaccug

SEQ ID NO: 4092273 - RNA, 19 nt, Streptococcus pneumoniae R6
uugugaaagcucuucuaaa

SEQ ID NO: 4092274 - RNA, 14 nt, Streptococcus pneumoniae R6
uugugaauacaaaa

SEQ ID NO: 4092275 - RNA, 20 nt, Streptococcus pneumoniae R6
uugugaauuauaguagaguu

SEQ ID NO: 4092276 - RNA, 22 nt, Streptococcus pneumoniae R6
uugugagaaauugguuugaauu

SEQ ID NO: 4092277 - RNA, 16 nt, Streptococcus pneumoniae R6
uugugauuuuaaauuu

SEQ ID NO: 4092278 - RNA, 16 nt, Streptococcus pneumoniae R6
uugugcuugauaaguu

SEQ ID NO: 4092279 - RNA, 18 nt, Streptococcus pneumoniae R6
uuguggauagaacugacg

SEQ ID NO: 4092280 - RNA, 18 nt, Streptococcus pneumoniae R6
uuguggauggaacugacg

SEQ ID NO: 4092281 - RNA, 22 nt, Streptococcus pneumoniae R6
uugugggaagauguauaaugga

SEQ ID NO: 4092282 - RNA, 19 nt, Streptococcus pneumoniae R6
uuguggggccagaauaauu

SEQ ID NO: 4092283 - RNA, 15 nt, Streptococcus pneumoniae R6
uuguguuugaccacu

SEQ ID NO: 4092284 - RNA, 14 nt, Streptococcus pneumoniae R6
uuguuaaacaaggc

SEQ ID NO: 4092285 - RNA, 20 nt, Streptococcus pneumoniae R6
uuguuaagagguuuuacuaa

SEQ ID NO: 4092286 - RNA, 16 nt, Streptococcus pneumoniae R6
uuguuagauuuauaau

SEQ ID NO: 4092287 - RNA, 21 nt, Streptococcus pneumoniae R6
uuguucagguguuucuggucu

SEQ ID NO: 4092288 - RNA, 14 nt, Streptococcus pneumoniae R6
uuguucucuuugca

SEQ ID NO: 4092289 - RNA, 21 nt, Streptococcus pneumoniae R6
uuguucucuuugcauuucauc

SEQ ID NO: 4092290 - RNA, 22 nt, Streptococcus pneumoniae R6
uuguucuuguuucaauugacua

SEQ ID NO: 4092291 - RNA, 20 nt, Streptococcus pneumoniae R6
uuguucuuuagaaagguuuu

SEQ ID NO: 4092292 - RNA, 21 nt, Streptococcus pneumoniae R6
uuguugaaacggcauaaaauc

SEQ ID NO: 4092293 - RNA, 19 nt, Streptococcus pneumoniae R6
uuguuguaagcuagcaaca

SEQ ID NO: 4092294 - RNA, 19 nt, Streptococcus pneumoniae R6
uuguuuaagagcacaaaau

SEQ ID NO: 4092295 - RNA, 18 nt, Streptococcus pneumoniae R6
uuguuuaauacucaauga

SEQ ID NO: 4092296 - RNA, 22 nt, Streptococcus pneumoniae R6
uuguuuaauacucaaugaaaau

SEQ ID NO: 4092297 - RNA, 16 nt, Streptococcus pneumoniae R6
uuguuuauaaaauaac

SEQ ID NO: 4092298 - RNA, 15 nt, Streptococcus pneumoniae R6
uuguuucgcuuagac

SEQ ID NO: 4092299 - RNA, 14 nt, Streptococcus pneumoniae R6
uuguuucguuucuu

SEQ ID NO: 4092300 - RNA, 15 nt, Streptococcus pneumoniae R6
uuguuuuuaaaggaa

SEQ ID NO: 4092301 - RNA, 12 nt, Streptococcus pneumoniae R6
uuguuuuuggua

SEQ ID NO: 4092302 - RNA, 17 nt, Streptococcus pneumoniae R6
uuguuuuuuaucuauau

SEQ ID NO: 4092303 - RNA, 12 nt, Streptococcus pneumoniae R6
uuuaaaaaagug

SEQ ID NO: 4092304 - RNA, 18 nt, Streptococcus pneumoniae R6
uuuaaaaaaucuuuuuca

SEQ ID NO: 4092305 - RNA, 13 nt, Streptococcus pneumoniae R6
uuuaaaaaguuuu

SEQ ID NO: 4092306 - RNA, 20 nt, Streptococcus pneumoniae R6
uuuaaaaauuuuuuucuaau

SEQ ID NO: 4092307 - RNA, 19 nt, Streptococcus pneumoniae R6
uuuaaaacucauuaauaaa

SEQ ID NO: 4092308 - RNA, 13 nt, Streptococcus pneumoniae R6
uuuaaaauaagag

SEQ ID NO: 4092309 - RNA, 23 nt, Streptococcus pneumoniae R6
uuuaaaauacgcaaaaucauaaa

SEQ ID NO: 4092310 - RNA, 23 nt, Streptococcus pneumoniae R6
uuuaaaaucaaaaagggaauuua

SEQ ID NO: 4092311 - RNA, 20 nt, Streptococcus pneumoniae R6
uuuaaaaucaaaguagcucu

SEQ ID NO: 4092312 - RNA, 16 nt, Streptococcus pneumoniae R6
uuuaaaaucugaaaaa

SEQ ID NO: 4092313 - RNA, 14 nt, Streptococcus pneumoniae R6
uuuaaaaucuggac

SEQ ID NO: 4092314 - RNA, 18 nt, Streptococcus pneumoniae R6
uuuaaaauguugggcaga

SEQ ID NO: 4092315 - RNA, 14 nt, Streptococcus pneumoniae R6
uuuaaaauuacucc

SEQ ID NO: 4092316 - RNA, 20 nt, Streptococcus pneumoniae R6
uuuaaaccaauuuuaagaau

SEQ ID NO: 4092317 - RNA, 18 nt, Streptococcus pneumoniae R6
uuuaaacguuuuuacuuu

SEQ ID NO: 4092318 - RNA, 23 nt, Streptococcus pneumoniae R6
uuuaaacuaguuuucuaaagaau

SEQ ID NO: 4092319 - RNA, 20 nt, Streptococcus pneumoniae R6
uuuaaagacagucugaaaaa

SEQ ID NO: 4092320 - RNA, 23 nt, Streptococcus pneumoniae R6
uuuaaagacagucugaaaaagag

SEQ ID NO: 4092321 - RNA, 23 nt, Streptococcus pneumoniae R6
uuuaaagacgauguugacaugag

SEQ ID NO: 4092322 - RNA, 16 nt, Streptococcus pneumoniae R6
uuuaaagauguccuuu

SEQ ID NO: 4092323 - RNA, 23 nt, Streptococcus pneumoniae R6
uuuaaaggaauuuuauuuucuga

SEQ ID NO: 4092324 - RNA, 15 nt, Streptococcus pneumoniae R6
uuuaaaguaaucucu

SEQ ID NO: 4092325 - RNA, 19 nt, Streptococcus pneumoniae R6
uuuaaagucucugucccau

SEQ ID NO: 4092326 - RNA, 15 nt, Streptococcus pneumoniae R6
uuuaaauucauuaaa

SEQ ID NO: 4092327 - RNA, 18 nt, Streptococcus pneumoniae R6
uuuaaauucauuuacucu

SEQ ID NO: 4092328 - RNA, 21 nt, Streptococcus pneumoniae R6
uuuaaauuuuucugcaaaaaa

SEQ ID NO: 4092329 - RNA, 23 nt, Streptococcus pneumoniae R6
uuuaaauuuuucugcaaaaaaua

SEQ ID NO: 4092330 - RNA, 22 nt, Streptococcus pneumoniae R6
uuuaacaaucuaucuuuuaauu

SEQ ID NO: 4092331 - RNA, 22 nt, Streptococcus pneumoniae R6
uuuaacaggauauuucuccaaa

SEQ ID NO: 4092332 - RNA, 13 nt, Streptococcus pneumoniae R6
uuuaacauuugag

SEQ ID NO: 4092333 - RNA, 22 nt, Streptococcus pneumoniae R6
uuuaacuacuugauaaaaguua

SEQ ID NO: 4092334 - RNA, 14 nt, Streptococcus pneumoniae R6
uuuaacuugaacuu

SEQ ID NO: 4092335 - RNA, 11 nt, Streptococcus pneumoniae R6
uuuaacuuuuu

SEQ ID NO: 4092336 - RNA, 14 nt, Streptococcus pneumoniae R6
uuuaagaaaucaua

SEQ ID NO: 4092337 - RNA, 13 nt, Streptococcus pneumoniae R6
uuuaagcaaaaaa

SEQ ID NO: 4092338 - RNA, 15 nt, Streptococcus pneumoniae R6
uuuaagcaaaaaaag

SEQ ID NO: 4092339 - RNA, 13 nt, Streptococcus pneumoniae R6
uuuaagcugacuu

SEQ ID NO: 4092340 - RNA, 21 nt, Streptococcus pneumoniae R6
uuuaagguugcagauagaacu

SEQ ID NO: 4092341 - RNA, 23 nt, Streptococcus pneumoniae R6
uuuaagguuguagauggaacuga

SEQ ID NO: 4092342 - RNA, 13 nt, Streptococcus pneumoniae R6
uuuaaguuuuuug

SEQ ID NO: 4092343 - RNA, 20 nt, Streptococcus pneumoniae R6
uuuaauaauuuuguuaagac

SEQ ID NO: 4092344 - RNA, 22 nt, Streptococcus pneumoniae R6
uuuaauaauuuuguuaagacac

SEQ ID NO: 4092345 - RNA, 18 nt, Streptococcus pneumoniae R6
uuuaauacucugugaaaa

SEQ ID NO: 4092346 - RNA, 23 nt, Streptococcus pneumoniae R6
uuuaauacucugugaaaaucaua

SEQ ID NO: 4092347 - RNA, 14 nt, Streptococcus pneumoniae R6
uuuaauauaagaau

SEQ ID NO: 4092348 - RNA, 15 nt, Streptococcus pneumoniae R6
uuuaauauauaaaaa

SEQ ID NO: 4092349 - RNA, 16 nt, Streptococcus pneumoniae R6
uuuaauauauaaaaaa

SEQ ID NO: 4092350 - RNA, 18 nt, Streptococcus pneumoniae R6
uuuaauauauaaaaaaua

SEQ ID NO: 4092351 - RNA, 15 nt, Streptococcus pneumoniae R6
uuuaauauuucccca

SEQ ID NO: 4092352 - RNA, 17 nt, Streptococcus pneumoniae R6
uuuaaucauguuuuuaa

SEQ ID NO: 4092353 - RNA, 16 nt, Streptococcus pneumoniae R6
uuuaauccaaaguaaa

SEQ ID NO: 4092354 - RNA, 23 nt, Streptococcus pneumoniae R6
uuuaauccaaaguaaaauacaaa

SEQ ID NO: 4092355 - RNA, 16 nt, Streptococcus pneumoniae R6
uuuaaucgauuauuuu

SEQ ID NO: 4092356 - RNA, 17 nt, Streptococcus pneumoniae R6
uuuaaugaccagaauag

SEQ ID NO: 4092357 - RNA, 19 nt, Streptococcus pneumoniae R6
uuuaaugcaguaaaucaua

SEQ ID NO: 4092358 - RNA, 17 nt, Streptococcus pneumoniae R6
uuuaaugcuaauuuaga

SEQ ID NO: 4092359 - RNA, 15 nt, Streptococcus pneumoniae R6
uuuaauucuuuuuca

SEQ ID NO: 4092360 - RNA, 18 nt, Streptococcus pneumoniae R6
uuuaauugguugagauaa

SEQ ID NO: 4092361 - RNA, 14 nt, Streptococcus pneumoniae R6
uuuaauuuaagagu

SEQ ID NO: 4092362 - RNA, 19 nt, Streptococcus pneumoniae R6
uuuaauuuuggaagucaaa

SEQ ID NO: 4092363 - RNA, 18 nt, Streptococcus pneumoniae R6
uuuacaauaucuccagaa

SEQ ID NO: 4092364 - RNA, 16 nt, Streptococcus pneumoniae R6
uuuacagaaagaacaa

SEQ ID NO: 4092365 - RNA, 21 nt, Streptococcus pneumoniae R6
uuuacaguauuuauaaacuuu

SEQ ID NO: 4092366 - RNA, 18 nt, Streptococcus pneumoniae R6
uuuacauaauuuaaaaua

SEQ ID NO: 4092367 - RNA, 17 nt, Streptococcus pneumoniae R6
uuuaccaauuuuuccuu

SEQ ID NO: 4092368 - RNA, 14 nt, Streptococcus pneumoniae R6
uuuaccauccugaa

SEQ ID NO: 4092369 - RNA, 14 nt, Streptococcus pneumoniae R6
uuuaccauucaauu

SEQ ID NO: 4092370 - RNA, 16 nt, Streptococcus pneumoniae R6
uuuaccugcuacugca

SEQ ID NO: 4092371 - RNA, 17 nt, Streptococcus pneumoniae R6
uuuaccuuaauucucuu

SEQ ID NO: 4092372 - RNA, 15 nt, Streptococcus pneumoniae R6
uuuacguccaccaca

SEQ ID NO: 4092373 - RNA, 15 nt, Streptococcus pneumoniae R6
uuuacuaaacaaggg

SEQ ID NO: 4092374 - RNA, 19 nt, Streptococcus pneumoniae R6
uuuacuaaggcccaauuaa

SEQ ID NO: 4092375 - RNA, 21 nt, Streptococcus pneumoniae R6
uuuacuacaaagagagcagau

SEQ ID NO: 4092376 - RNA, 23 nt, Streptococcus pneumoniae R6
uuuacuacuuuugucaguaaaaa

SEQ ID NO: 4092377 - RNA, 15 nt, Streptococcus pneumoniae R6
uuuacuauaaaauaa

SEQ ID NO: 4092378 - RNA, 14 nt, Streptococcus pneumoniae R6
uuuacucucauucu

SEQ ID NO: 4092379 - RNA, 13 nt, Streptococcus pneumoniae R6
uuuacuuaaaauu

SEQ ID NO: 4092380 - RNA, 13 nt, Streptococcus pneumoniae R6
uuuacuuaauuua

SEQ ID NO: 4092381 - RNA, 20 nt, Streptococcus pneumoniae R6
uuuacuucauguuuuccuaa

SEQ ID NO: 4092382 - RNA, 22 nt, Streptococcus pneumoniae R6
uuuacuucauguuuuccuaauu

SEQ ID NO: 4092383 - RNA, 18 nt, Streptococcus pneumoniae R6
uuuacuucauuuuugccu

SEQ ID NO: 4092384 - RNA, 13 nt, Streptococcus pneumoniae R6
uuuacuuccuuuu

SEQ ID NO: 4092385 - RNA, 13 nt, Streptococcus pneumoniae R6
uuuacuuuccuga

SEQ ID NO: 4092386 - RNA, 19 nt, Streptococcus pneumoniae R6
uuuacuuuccugauagagu

SEQ ID NO: 4092387 - RNA, 20 nt, Streptococcus pneumoniae R6
uuuacuuuuuuucuucugaa

SEQ ID NO: 4092388 - RNA, 18 nt, Streptococcus pneumoniae R6
uuuagaaacuaugaugug

SEQ ID NO: 4092389 - RNA, 20 nt, Streptococcus pneumoniae R6
uuuagaaagguaaaauauag

SEQ ID NO: 4092390 - RNA, 14 nt, Streptococcus pneumoniae R6
uuuagaagcuucuu

SEQ ID NO: 4092391 - RNA, 22 nt, Streptococcus pneumoniae R6
uuuagaaggauaaauuuuauug

SEQ ID NO: 4092392 - RNA, 21 nt, Streptococcus pneumoniae R6
uuuagaaguagagguguacua

SEQ ID NO: 4092393 - RNA, 23 nt, Streptococcus pneumoniae R6
uuuagaaguagagguguacuauu

SEQ ID NO: 4092394 - RNA, 17 nt, Streptococcus pneumoniae R6
uuuagagaaugaaauau

SEQ ID NO: 4092395 - RNA, 13 nt, Streptococcus pneumoniae R6
uuuagauuaaaaa

SEQ ID NO: 4092396 - RNA, 15 nt, Streptococcus pneumoniae R6
uuuagauuaaaaaau

SEQ ID NO: 4092397 - RNA, 21 nt, Streptococcus pneumoniae R6
uuuagauuguccucaauaagc

SEQ ID NO: 4092398 - RNA, 19 nt, Streptococcus pneumoniae R6
uuuaggaucaugagccaca

SEQ ID NO: 4092399 - RNA, 17 nt, Streptococcus pneumoniae R6
uuuaggcaauaaaauau

SEQ ID NO: 4092400 - RNA, 17 nt, Streptococcus pneumoniae R6
uuuaggugaaaugucua

SEQ ID NO: 4092401 - RNA, 15 nt, Streptococcus pneumoniae R6
uuuaguaaaaauugc

SEQ ID NO: 4092402 - RNA, 13 nt, Streptococcus pneumoniae R6
uuuaguaaacaaa

SEQ ID NO: 4092403 - RNA, 14 nt, Streptococcus pneumoniae R6
uuuaguaaacaaag

SEQ ID NO: 4092404 - RNA, 23 nt, Streptococcus pneumoniae R6
uuuaguaccagcucguucuaugg

SEQ ID NO: 4092405 - RNA, 13 nt, Streptococcus pneumoniae R6
uuuaguagaaaau

SEQ ID NO: 4092406 - RNA, 17 nt, Streptococcus pneumoniae R6
uuuaguccacgguaaau

SEQ ID NO: 4092407 - RNA, 16 nt, Streptococcus pneumoniae R6
uuuaguucucaggaau

SEQ ID NO: 4092408 - RNA, 13 nt, Streptococcus pneumoniae R6
uuuauaaacuuua

SEQ ID NO: 4092409 - RNA, 23 nt, Streptococcus pneumoniae R6
uuuauaaacuuugguuauaaaaa

SEQ ID NO: 4092410 - RNA, 17 nt, Streptococcus pneumoniae R6
uuuauaaaucuucuaaa

SEQ ID NO: 4092411 - RNA, 15 nt, Streptococcus pneumoniae R6
uuuauaaauuuucca

SEQ ID NO: 4092412 - RNA, 19 nt, Streptococcus pneumoniae R6
uuuauaauuuuaaagacuu

SEQ ID NO: 4092413 - RNA, 22 nt, Streptococcus pneumoniae R6
uuuauacucaucuguuuucaaa

SEQ ID NO: 4092414 - RNA, 22 nt, Streptococcus pneumoniae R6
uuuauacucuuagaaaaucucu

SEQ ID NO: 4092415 - RNA, 14 nt, Streptococcus pneumoniae R6
uuuauagaaaauua

SEQ ID NO: 4092416 - RNA, 14 nt, Streptococcus pneumoniae R6
uuuauagaaauuaa

SEQ ID NO: 4092417 - RNA, 22 nt, Streptococcus pneumoniae R6
uuuauagaaauuaauuuuacuu

SEQ ID NO: 4092418 - RNA, 15 nt, Streptococcus pneumoniae R6
uuuauagaauauauu

SEQ ID NO: 4092419 - RNA, 21 nt, Streptococcus pneumoniae R6
uuuauagaauauauuucucaa

SEQ ID NO: 4092420 - RNA, 19 nt, Streptococcus pneumoniae R6
uuuauaguaaaaugaaaua

SEQ ID NO: 4092421 - RNA, 22 nt, Streptococcus pneumoniae R6
uuuauaguaaaaugaaauaaga

SEQ ID NO: 4092422 - RNA, 16 nt, Streptococcus pneumoniae R6
uuuauaguaauuccac

SEQ ID NO: 4092423 - RNA, 21 nt, Streptococcus pneumoniae R6
uuuauauaaaaagaaauguca

SEQ ID NO: 4092424 - RNA, 16 nt, Streptococcus pneumoniae R6
uuuauauccuaaaaaa

SEQ ID NO: 4092425 - RNA, 17 nt, Streptococcus pneumoniae R6
uuuauaugauuucaauu

SEQ ID NO: 4092426 - RNA, 18 nt, Streptococcus pneumoniae R6
uuuauauggaaaaaugga

SEQ ID NO: 4092427 - RNA, 21 nt, Streptococcus pneumoniae R6
uuuauauuauaaauuucgaaa

SEQ ID NO: 4092428 - RNA, 19 nt, Streptococcus pneumoniae R6
uuuaucaagcaaaucaaag

SEQ ID NO: 4092429 - RNA, 13 nt, Streptococcus pneumoniae R6
uuuaucaauaaua

SEQ ID NO: 4092430 - RNA, 18 nt, Streptococcus pneumoniae R6
uuuaucaccuccuucucc

SEQ ID NO: 4092431 - RNA, 19 nt, Streptococcus pneumoniae R6
uuuaucagccaaaccguuc

SEQ ID NO: 4092432 - RNA, 13 nt, Streptococcus pneumoniae R6
uuuaucauagaaa

SEQ ID NO: 4092433 - RNA, 19 nt, Streptococcus pneumoniae R6
uuuauccaucugcucucca

SEQ ID NO: 4092434 - RNA, 23 nt, Streptococcus pneumoniae R6
uuuauccauucacaacaucuucu

SEQ ID NO: 4092435 - RNA, 19 nt, Streptococcus pneumoniae R6
uuuaucuaaacuauuucuu

SEQ ID NO: 4092436 - RNA, 20 nt, Streptococcus pneumoniae R6
uuuaucuaaacuauuucuua

SEQ ID NO: 4092437 - RNA, 14 nt, Streptococcus pneumoniae R6
uuuaucucccauac

SEQ ID NO: 4092438 - RNA, 15 nt, Streptococcus pneumoniae R6
uuuaucucccauacc

SEQ ID NO: 4092439 - RNA, 19 nt, Streptococcus pneumoniae R6
uuuaucugcccaaagacag

SEQ ID NO: 4092440 - RNA, 12 nt, Streptococcus pneumoniae R6
uuuaucuuaauu

SEQ ID NO: 4092441 - RNA, 16 nt, Streptococcus pneumoniae R6
uuuaucuuaauucucu

SEQ ID NO: 4092442 - RNA, 17 nt, Streptococcus pneumoniae R6
uuuaucuucuauugcau

SEQ ID NO: 4092443 - RNA, 13 nt, Streptococcus pneumoniae R6
uuuaucuuugaaa

SEQ ID NO: 4092444 - RNA, 14 nt, Streptococcus pneumoniae R6
uuuaugaaaaaguu

SEQ ID NO: 4092445 - RNA, 18 nt, Streptococcus pneumoniae R6
uuuaugccuugcaggauu

SEQ ID NO: 4092446 - RNA, 14 nt, Streptococcus pneumoniae R6
uuuaugcuauauau

SEQ ID NO: 4092447 - RNA, 19 nt, Streptococcus pneumoniae R6
uuuaugcuuggugagaaag

SEQ ID NO: 4092448 - RNA, 19 nt, Streptococcus pneumoniae R6
uuuaugguguuuuaaggag

SEQ ID NO: 4092449 - RNA, 13 nt, Streptococcus pneumoniae R6
uuuauguccuaaa

SEQ ID NO: 4092450 - RNA, 23 nt, Streptococcus pneumoniae R6
uuuauuaagcccuacuguacuua

SEQ ID NO: 4092451 - RNA, 20 nt, Streptococcus pneumoniae R6
uuuauuacuucaauuucuaa

SEQ ID NO: 4092452 - RNA, 20 nt, Streptococcus pneumoniae R6
uuuauucagccaaggcuccc

SEQ ID NO: 4092453 - RNA, 12 nt, Streptococcus pneumoniae R6
uuuauucuaagc

SEQ ID NO: 4092454 - RNA, 18 nt, Streptococcus pneumoniae R6
uuuauucuaagcgaccau

SEQ ID NO: 4092455 - RNA, 14 nt, Streptococcus pneumoniae R6
uuuauugaguuuuu

SEQ ID NO: 4092456 - RNA, 19 nt, Streptococcus pneumoniae R6
uuuauugcaauuuaucagu

SEQ ID NO: 4092457 - RNA, 19 nt, Streptococcus pneumoniae R6
uuuauugucucuaaaaaua

SEQ ID NO: 4092458 - RNA, 18 nt, Streptococcus pneumoniae R6
uuuauugucuucaucucu

SEQ ID NO: 4092459 - RNA, 22 nt, Streptococcus pneumoniae R6
uuuauugugggaauguuugcuu

SEQ ID NO: 4092460 - RNA, 17 nt, Streptococcus pneumoniae R6
uuuauuuaagcaaaaaa

SEQ ID NO: 4092461 - RNA, 21 nt, Streptococcus pneumoniae R6
uuuauuugcuuaauccucaau

SEQ ID NO: 4092462 - RNA, 14 nt, Streptococcus pneumoniae R6
uuuauuuucaagcg

SEQ ID NO: 4092463 - RNA, 23 nt, Streptococcus pneumoniae R6
uuuauuuuuauaacaacccaauu

SEQ ID NO: 4092464 - RNA, 22 nt, Streptococcus pneumoniae R6
uuucaaaaaaaucguaaaaaag

SEQ ID NO: 4092465 - RNA, 18 nt, Streptococcus pneumoniae R6
uuucaaaaagcauucuau

SEQ ID NO: 4092466 - RNA, 19 nt, Streptococcus pneumoniae R6
uuucaaaaucuucuggcac

SEQ ID NO: 4092467 - RNA, 12 nt, Streptococcus pneumoniae R6
uuucaaagaaga

SEQ ID NO: 4092468 - RNA, 21 nt, Streptococcus pneumoniae R6
uuucaaagacuucuugagcua

SEQ ID NO: 4092469 - RNA, 22 nt, Streptococcus pneumoniae R6
uuucaaagcgggauuuaaaaua

SEQ ID NO: 4092470 - RNA, 22 nt, Streptococcus pneumoniae R6
uuucaaagcuacuuuuuuacca

SEQ ID NO: 4092471 - RNA, 16 nt, Streptococcus pneumoniae R6
uuucaaaguuccgaaa

SEQ ID NO: 4092472 - RNA, 12 nt, Streptococcus pneumoniae R6
uuucaaaugaaa

SEQ ID NO: 4092473 - RNA, 21 nt, Streptococcus pneumoniae R6
uuucaaaugaaauauuuuuua

SEQ ID NO: 4092474 - RNA, 18 nt, Streptococcus pneumoniae R6
uuucaaauguauuugaaa

SEQ ID NO: 4092475 - RNA, 19 nt, Streptococcus pneumoniae R6
uuucaaauucuuuagaaaa

SEQ ID NO: 4092476 - RNA, 22 nt, Streptococcus pneumoniae R6
uuucaaauucuuuagaaaacua

SEQ ID NO: 4092477 - RNA, 13 nt, Streptococcus pneumoniae R6
uuucaacccacua

SEQ ID NO: 4092478 - RNA, 17 nt, Streptococcus pneumoniae R6
uuucaacccacuacagu

SEQ ID NO: 4092479 - RNA, 21 nt, Streptococcus pneumoniae R6
uuucaacucagcauuuucuuu

SEQ ID NO: 4092480 - RNA, 13 nt, Streptococcus pneumoniae R6
uuucaacuccuua

SEQ ID NO: 4092481 - RNA, 17 nt, Streptococcus pneumoniae R6
uuucaacuccuuacuuu

SEQ ID NO: 4092482 - RNA, 15 nt, Streptococcus pneumoniae R6
uuucaacugaugaga

SEQ ID NO: 4092483 - RNA, 23 nt, Streptococcus pneumoniae R6
uuucaagaaugaaaguuuauaaa

SEQ ID NO: 4092484 - RNA, 16 nt, Streptococcus pneumoniae R6
uuucaaggucgauauc

SEQ ID NO: 4092485 - RNA, 18 nt, Streptococcus pneumoniae R6
uuucaaggugaaguucac

SEQ ID NO: 4092486 - RNA, 13 nt, Streptococcus pneumoniae R6
uuucaauguacua

SEQ ID NO: 4092487 - RNA, 14 nt, Streptococcus pneumoniae R6
uuucaauuuacuau

SEQ ID NO: 4092488 - RNA, 16 nt, Streptococcus pneumoniae R6
uuucaauuuuaaauuu

SEQ ID NO: 4092489 - RNA, 13 nt, Streptococcus pneumoniae R6
uuucacaaauucu

SEQ ID NO: 4092490 - RNA, 21 nt, Streptococcus pneumoniae R6
uuucacaacucuuauacuuuu

SEQ ID NO: 4092491 - RNA, 17 nt, Streptococcus pneumoniae R6
uuucacaauuucauuuc

SEQ ID NO: 4092492 - RNA, 16 nt, Streptococcus pneumoniae R6
uuucacauuuucaaaa

SEQ ID NO: 4092493 - RNA, 16 nt, Streptococcus pneumoniae R6
uuucaccgccugcuca

SEQ ID NO: 4092494 - RNA, 17 nt, Streptococcus pneumoniae R6
uuucacuagaaaaugag

SEQ ID NO: 4092495 - RNA, 22 nt, Streptococcus pneumoniae R6
uuucacuuuauuuuuucuguaa

SEQ ID NO: 4092496 - RNA, 18 nt, Streptococcus pneumoniae R6
uuucagaagaaaaugaag

SEQ ID NO: 4092497 - RNA, 15 nt, Streptococcus pneumoniae R6
uuucagaaucccaaa

SEQ ID NO: 4092498 - RNA, 19 nt, Streptococcus pneumoniae R6
uuucagaaucccaaagaag

SEQ ID NO: 4092499 - RNA, 14 nt, Streptococcus pneumoniae R6
uuucagagggcuuu

SEQ ID NO: 4092500 - RNA, 22 nt, Streptococcus pneumoniae R6
uuucagagggcuuuuucauuga

SEQ ID NO: 4092501 - RNA, 14 nt, Streptococcus pneumoniae R6
uuucagauaaccau

SEQ ID NO: 4092502 - RNA, 12 nt, Streptococcus pneumoniae R6
uuucuauauuua

SEQ ID NO: 4092503 - RNA, 15 nt, Streptococcus pneumoniae R6
uuucuauauuuauau

SEQ ID NO: 4092504 - RNA, 14 nt, Streptococcus pneumoniae R6
uuucuaucacucca

SEQ ID NO: 4092505 - RNA, 19 nt, Streptococcus pneumoniae R6
uuucuaucuucauuuugca

SEQ ID NO: 4092506 - RNA, 15 nt, Streptococcus pneumoniae R6
uuucuaugauuuuca

SEQ ID NO: 4092507 - RNA, 16 nt, Streptococcus pneumoniae R6
uuucuauuaagcuggc

SEQ ID NO: 4092508 - RNA, 12 nt, Streptococcus pneumoniae R6
uuucuauuucuu

SEQ ID NO: 4092509 - RNA, 15 nt, Streptococcus pneumoniae R6
uuucucaaaaaaguu

SEQ ID NO: 4092510 - RNA, 21 nt, Streptococcus pneumoniae R6
uuucucaaacauugugaggaa

SEQ ID NO: 4092511 - RNA, 12 nt, Streptococcus pneumoniae R6
uuucucaauauc

SEQ ID NO: 4092512 - RNA, 15 nt, Streptococcus pneumoniae R6
uuucucaaucaguuu

SEQ ID NO: 4092513 - RNA, 17 nt, Streptococcus pneumoniae R6
uuucucacuuaauucuu

SEQ ID NO: 4092514 - RNA, 22 nt, Streptococcus pneumoniae R6
uuucucauagccauaaaacauu

SEQ ID NO: 4092515 - RNA, 16 nt, Streptococcus pneumoniae R6
uuucucaucuauuuuu

SEQ ID NO: 4092516 - RNA, 14 nt, Streptococcus pneumoniae R6
uuucuccuaaaauu

SEQ ID NO: 4092517 - RNA, 16 nt, Streptococcus pneumoniae R6
uuucuccuauuuucuu

SEQ ID NO: 4092518 - RNA, 18 nt, Streptococcus pneumoniae R6
uuucuccuauuuucuucu

SEQ ID NO: 4092519 - RNA, 15 nt, Streptococcus pneumoniae R6
uuucucggucuuguu

SEQ ID NO: 4092520 - RNA, 16 nt, Streptococcus pneumoniae R6
uuucucggucuuguuu

SEQ ID NO: 4092521 - RNA, 15 nt, Streptococcus pneumoniae R6
uuucucuacaaauaa

SEQ ID NO: 4092522 - RNA, 16 nt, Streptococcus pneumoniae R6
uuucucucugaauaga

SEQ ID NO: 4092523 - RNA, 22 nt, Streptococcus pneumoniae R6
uuucugaagacaaaucauuuug

SEQ ID NO: 4092524 - RNA, 16 nt, Streptococcus pneumoniae R6
uuucugauagaagagu

SEQ ID NO: 4092525 - RNA, 21 nt, Streptococcus pneumoniae R6
uuucugauagaagagucagcu

SEQ ID NO: 4092526 - RNA, 22 nt, Streptococcus pneumoniae R6
uuucugauagaagagucagcuc

SEQ ID NO: 4092527 - RNA, 14 nt, Streptococcus pneumoniae R6
uuucugauuucaaa

SEQ ID NO: 4092528 - RNA, 18 nt, Streptococcus pneumoniae R6
uuucugauuucaaagaau

SEQ ID NO: 4092529 - RNA, 23 nt, Streptococcus pneumoniae R6
uuucugcauccaccuucaucucu

SEQ ID NO: 4092530 - RNA, 16 nt, Streptococcus pneumoniae R6
uuucuggauuuccauu

SEQ ID NO: 4092531 - RNA, 17 nt, Streptococcus pneumoniae R6
uuucuggcagauuuuga

SEQ ID NO: 4092532 - RNA, 22 nt, Streptococcus pneumoniae R6
uuucuggcaggucgguuuuauu

SEQ ID NO: 4092533 - RNA, 14 nt, Streptococcus pneumoniae R6
uuucuguaaaauca

SEQ ID NO: 4092534 - RNA, 16 nt, Streptococcus pneumoniae R6
uuucugugcuuuuuca

SEQ ID NO: 4092535 - RNA, 13 nt, Streptococcus pneumoniae R6
uuucuguuuucuu

SEQ ID NO: 4092536 - RNA, 21 nt, Streptococcus pneumoniae R6
uuucuuaaguaaguacaugca

SEQ ID NO: 4092537 - RNA, 14 nt, Streptococcus pneumoniae R6
uuucuuauuuuccu

SEQ ID NO: 4092538 - RNA, 16 nt, Streptococcus pneumoniae R6
uuucuuauuuuccuaa

SEQ ID NO: 4092539 - RNA, 22 nt, Streptococcus pneumoniae R6
uuucuucaacaaaccuuguucu

SEQ ID NO: 4092540 - RNA, 14 nt, Streptococcus pneumoniae R6
uuucuucagauuuu

SEQ ID NO: 4092541 - RNA, 16 nt, Streptococcus pneumoniae R6
uuucuucagauuuuau

SEQ ID NO: 4092542 - RNA, 18 nt, Streptococcus pneumoniae R6
uuucuucguccagacguu

SEQ ID NO: 4092543 - RNA, 13 nt, Streptococcus pneumoniae R6
uuucuucuagcuu

SEQ ID NO: 4092544 - RNA, 20 nt, Streptococcus pneumoniae R6
uuucuucuagcuucauauca

SEQ ID NO: 4092545 - RNA, 12 nt, Streptococcus pneumoniae R6
uuucuucuuuca

SEQ ID NO: 4092546 - RNA, 23 nt, Streptococcus pneumoniae R6
uuucuucuuuuuguccuucuucu

SEQ ID NO: 4092547 - RNA, 19 nt, Streptococcus pneumoniae R6
uuucuugaaaucaacugcu

SEQ ID NO: 4092548 - RNA, 21 nt, Streptococcus pneumoniae R6
uuucuugaugaaagauauuuu

SEQ ID NO: 4092549 - RNA, 21 nt, Streptococcus pneumoniae R6
uuucuugucguugaaaaagug

SEQ ID NO: 4092550 - RNA, 19 nt, Streptococcus pneumoniae R6
uuucuuucaacuucgucac

SEQ ID NO: 4092551 - RNA, 12 nt, Streptococcus pneumoniae R6
uuucuuuuauuu

SEQ ID NO: 4092552 - RNA, 20 nt, Streptococcus pneumoniae R6
uuucuuuugcaaucauuuca

SEQ ID NO: 4092553 - RNA, 13 nt, Streptococcus pneumoniae R6
uuucuuuuuccua

SEQ ID NO: 4092554 - RNA, 18 nt, Streptococcus pneumoniae R6
uuugaaaaaccuugauau

SEQ ID NO: 4092555 - RNA, 15 nt, Streptococcus pneumoniae R6
uuugaaaaauauaca

SEQ ID NO: 4092556 - RNA, 20 nt, Streptococcus pneumoniae R6
uuugaaaaauauacaaaaaa

SEQ ID NO: 4092557 - RNA, 12 nt, Streptococcus pneumoniae R6
uuugaaaacuga

SEQ ID NO: 4092558 - RNA, 15 nt, Streptococcus pneumoniae R6
uuugaaaacugaaca

SEQ ID NO: 4092559 - RNA, 13 nt, Streptococcus pneumoniae R6
uuugaaacuagaa

SEQ ID NO: 4092560 - RNA, 14 nt, Streptococcus pneumoniae R6
uuugaaacuagaau

SEQ ID NO: 4092561 - RNA, 16 nt, Streptococcus pneumoniae R6
uuugaaacuagaauag

SEQ ID NO: 4092562 - RNA, 22 nt, Streptococcus pneumoniae R6
uuugaaaggguagugaaaguua

SEQ ID NO: 4092563 - RNA, 15 nt, Streptococcus pneumoniae R6
uuugaaaucagaaaa

SEQ ID NO: 4092564 - RNA, 16 nt, Streptococcus pneumoniae R6
uuugaaaucagaaaaa

SEQ ID NO: 4092565 - RNA, 19 nt, Streptococcus pneumoniae R6
uuugaaaucagaaaaaacg

SEQ ID NO: 4092566 - RNA, 15 nt, Streptococcus pneumoniae R6
uuugaacaaauuaau

SEQ ID NO: 4092567 - RNA, 15 nt, Streptococcus pneumoniae R6
uuugaacauguccau

SEQ ID NO: 4092568 - RNA, 13 nt, Streptococcus pneumoniae R6
uuugaacauuacu

SEQ ID NO: 4092569 - RNA, 23 nt, Streptococcus pneumoniae R6
uuugaauagaaaguauagucaau

SEQ ID NO: 4092570 - RNA, 19 nt, Streptococcus pneumoniae R6
uuugaauaggguaguugaa

SEQ ID NO: 4092571 - RNA, 19 nt, Streptococcus pneumoniae R6
uuugaaucaccuaaaguag

SEQ ID NO: 4092572 - RNA, 21 nt, Streptococcus pneumoniae R6
uuugaaugcucccuucuuuag

SEQ ID NO: 4092573 - RNA, 14 nt, Streptococcus pneumoniae R6
uuugaauucuccaa

SEQ ID NO: 4092574 - RNA, 16 nt, Streptococcus pneumoniae R6
uuugaauucuccaauc

SEQ ID NO: 4092575 - RNA, 12 nt, Streptococcus pneumoniae R6
uuugaauuucau

SEQ ID NO: 4092576 - RNA, 17 nt, Streptococcus pneumoniae R6
uuugacaaguaaguagc

SEQ ID NO: 4092577 - RNA, 14 nt, Streptococcus pneumoniae R6
uuugacauccuuuu

SEQ ID NO: 4092578 - RNA, 17 nt, Streptococcus pneumoniae R6
uuugacgagugaagaau

SEQ ID NO: 4092579 - RNA, 18 nt, Streptococcus pneumoniae R6
uuugacguuuccuucuac

SEQ ID NO: 4092580 - RNA, 16 nt, Streptococcus pneumoniae R6
uuugacuggagaguug

SEQ ID NO: 4092581 - RNA, 23 nt, Streptococcus pneumoniae R6
uuugacuugcaaaaagacuuagc

SEQ ID NO: 4092582 - RNA, 22 nt, Streptococcus pneumoniae R6
uuugagacuggcgauuuuagga

SEQ ID NO: 4092583 - RNA, 13 nt, Streptococcus pneumoniae R6
uuugagaucuuuu

SEQ ID NO: 4092584 - RNA, 19 nt, Streptococcus pneumoniae R6
uuugagaucuuuuucgcuu

SEQ ID NO: 4092585 - RNA, 13 nt, Streptococcus pneumoniae R6
uuugagaugagac

SEQ ID NO: 4092586 - RNA, 19 nt, Streptococcus pneumoniae R6
uuugagauuacugauaaaa

SEQ ID NO: 4092587 - RNA, 21 nt, Streptococcus pneumoniae R6
uuugagcaauacuuuuucguu

SEQ ID NO: 4092588 - RNA, 14 nt, Streptococcus pneumoniae R6
uuugagcagaacaa

SEQ ID NO: 4092589 - RNA, 20 nt, Streptococcus pneumoniae R6
uuugagcuaauuuugccagu

SEQ ID NO: 4092590 - RNA, 18 nt, Streptococcus pneumoniae R6
uuugagcucuuugacaga

SEQ ID NO: 4092591 - RNA, 22 nt, Streptococcus pneumoniae R6
uuugagcugacuucgucaguuu

SEQ ID NO: 4092592 - RNA, 22 nt, Streptococcus pneumoniae R6
uuugaggauaaaaaagaaggag

SEQ ID NO: 4092593 - RNA, 19 nt, Streptococcus pneumoniae R6
uuugagguuguagaugaaa

SEQ ID NO: 4092594 - RNA, 19 nt, Streptococcus pneumoniae R6
uuugaguaaaagacaucag

SEQ ID NO: 4092595 - RNA, 19 nt, Streptococcus pneumoniae R6
uuugaguaaggacuuugcu

SEQ ID NO: 4092596 - RNA, 17 nt, Streptococcus pneumoniae R6
uuugauaucuaucaaac

SEQ ID NO: 4092597 - RNA, 17 nt, Streptococcus pneumoniae R6
uuugaugaggaaagaau

SEQ ID NO: 4092598 - RNA, 20 nt, Streptococcus pneumoniae R6
uuugauguuuccugcaaaga

SEQ ID NO: 4092599 - RNA, 14 nt, Streptococcus pneumoniae R6
uuugauuaguccau

SEQ ID NO: 4092600 - RNA, 17 nt, Streptococcus pneumoniae R6
uuugauuauuuuugaaa

SEQ ID NO: 4092601 - RNA, 19 nt, Streptococcus pneumoniae R6
uuugauucaucuccaaccu

SEQ ID NO: 4092602 - RNA, 12 nt, Streptococcus pneumoniae R6
uuugauuucuaa

SEQ ID NO: 4092603 - RNA, 23 nt, Streptococcus pneumoniae R6
uuugauuucuggaugauucuuuu

SEQ ID NO: 4092604 - RNA, 13 nt, Streptococcus pneumoniae R6
uuugauuucuugg

SEQ ID NO: 4092605 - RNA, 18 nt, Streptococcus pneumoniae R6
uuuuaucauagaaauuuu

SEQ ID NO: 4092606 - RNA, 14 nt, Streptococcus pneumoniae R6
uuuuaucauucugc

SEQ ID NO: 4092607 - RNA, 13 nt, Streptococcus pneumoniae R6
uuuuaucuaguau

SEQ ID NO: 4092608 - RNA, 21 nt, Streptococcus pneumoniae R6
uuuuaugaggugcuuuuugau

SEQ ID NO: 4092609 - RNA, 14 nt, Streptococcus pneumoniae R6
uuuuaugauauaca

SEQ ID NO: 4092610 - RNA, 22 nt, Streptococcus pneumoniae R6
uuuuaugauauacacacuuaaa

SEQ ID NO: 4092611 - RNA, 12 nt, Streptococcus pneumoniae R6
uuuuaugcguuu

SEQ ID NO: 4092612 - RNA, 20 nt, Streptococcus pneumoniae R6
uuuuauguuauccuauucuu

SEQ ID NO: 4092613 - RNA, 16 nt, Streptococcus pneumoniae R6
uuuuauguucuaagaa

SEQ ID NO: 4092614 - RNA, 17 nt, Streptococcus pneumoniae R6
uuuuauuaaguagaaua

SEQ ID NO: 4092615 - RNA, 15 nt, Streptococcus pneumoniae R6
uuuuauuauugguuu

SEQ ID NO: 4092616 - RNA, 18 nt, Streptococcus pneumoniae R6
uuuuauuauuuccucaau

SEQ ID NO: 4092617 - RNA, 15 nt, Streptococcus pneumoniae R6
uuuuauugcaauuua

SEQ ID NO: 4092618 - RNA, 22 nt, Streptococcus pneumoniae R6
uuuuauuguuccuaaaacaguu

SEQ ID NO: 4092619 - RNA, 19 nt, Streptococcus pneumoniae R6
uuuuauuucauuccaucau

SEQ ID NO: 4092620 - RNA, 11 nt, Streptococcus pneumoniae R6
uuuuauuucuu

SEQ ID NO: 4092621 - RNA, 12 nt, Streptococcus pneumoniae R6
uuuuauuuuuua

SEQ ID NO: 4092622 - RNA, 12 nt, Streptococcus pneumoniae R6
uuuucaaaacug

SEQ ID NO: 4092623 - RNA, 22 nt, Streptococcus pneumoniae R6
uuuucaaaacugguccagagau

SEQ ID NO: 4092624 - RNA, 20 nt, Streptococcus pneumoniae R6
uuuucaaaaucagaaaaacg

SEQ ID NO: 4092625 - RNA, 14 nt, Streptococcus pneumoniae R6
uuuucaaaaugaca

SEQ ID NO: 4092626 - RNA, 15 nt, Streptococcus pneumoniae R6
uuuucaaacaauuga

SEQ ID NO: 4092627 - RNA, 24 nt, Streptococcus pneumoniae R6
uuuucaaaguccucccaccaaacu

SEQ ID NO: 4092628 - RNA, 18 nt, Streptococcus pneumoniae R6
uuuucaaaguuccgaaau

SEQ ID NO: 4092629 - RNA, 22 nt, Streptococcus pneumoniae R6
uuuucaaauguauuugaaaggg

SEQ ID NO: 4092630 - RNA, 16 nt, Streptococcus pneumoniae R6
uuuucaaauucuuuag

SEQ ID NO: 4092631 - RNA, 18 nt, Streptococcus pneumoniae R6
uuuucaaauucuuuagaa

SEQ ID NO: 4092632 - RNA, 21 nt, Streptococcus pneumoniae R6
uuuucaacccacuacaguuga

SEQ ID NO: 4092633 - RNA, 18 nt, Streptococcus pneumoniae R6
uuuucaagaauugcagcc

SEQ ID NO: 4092634 - RNA, 17 nt, Streptococcus pneumoniae R6
uuuucaagggcuuuuug

SEQ ID NO: 4092635 - RNA, 21 nt, Streptococcus pneumoniae R6
uuuucaaguaggucaaagcug

SEQ ID NO: 4092636 - RNA, 18 nt, Streptococcus pneumoniae R6
uuuucacagaguauuaaa

SEQ ID NO: 4092637 - RNA, 19 nt, Streptococcus pneumoniae R6
uuuucacagaguauuaaau

SEQ ID NO: 4092638 - RNA, 21 nt, Streptococcus pneumoniae R6
uuuucaccaaaacuauauucu

SEQ ID NO: 4092639 - RNA, 15 nt, Streptococcus pneumoniae R6
uuuucagauuuuaaa

SEQ ID NO: 4092640 - RNA, 14 nt, Streptococcus pneumoniae R6
uuuucagcagaguu

SEQ ID NO: 4092641 - RNA, 19 nt, Streptococcus pneumoniae R6
uuuucagccucuauacuua

SEQ ID NO: 4092642 - RNA, 19 nt, Streptococcus pneumoniae R6
uuuucagcuggcuccuucu

SEQ ID NO: 4092643 - RNA, 14 nt, Streptococcus pneumoniae R6
uuuucauaacuuua

SEQ ID NO: 4092644 - RNA, 23 nt, Streptococcus pneumoniae R6
uuuucauaagccguaaucaugug

SEQ ID NO: 4092645 - RNA, 22 nt, Streptococcus pneumoniae R6
uuuucaucuaguugaacuuuag

SEQ ID NO: 4092646 - RNA, 13 nt, Streptococcus pneumoniae R6
uuuucauuccaaa

SEQ ID NO: 4092647 - RNA, 23 nt, Streptococcus pneumoniae R6
uuuucauugagcuuuaaaaucca

SEQ ID NO: 4092648 - RNA, 17 nt, Streptococcus pneumoniae R6
uuuucauuuaauauauu

SEQ ID NO: 4092649 - RNA, 16 nt, Streptococcus pneumoniae R6
uuuuccaacucagcca

SEQ ID NO: 4092650 - RNA, 22 nt, Streptococcus pneumoniae R6
uuuuccagcguugcgauuuuug

SEQ ID NO: 4092651 - RNA, 19 nt, Streptococcus pneumoniae R6
uuuuccauauaaaaaagca

SEQ ID NO: 4092652 - RNA, 16 nt, Streptococcus pneumoniae R6
uuuucccaccuuuucu

SEQ ID NO: 4092653 - RNA, 20 nt, Streptococcus pneumoniae R6
uuuucccaccuuuucucaau

SEQ ID NO: 4092654 - RNA, 21 nt, Streptococcus pneumoniae R6
uuuucccagccuucagcccaa

SEQ ID NO: 4092655 - RNA, 21 nt, Streptococcus pneumoniae R6
uuuuccgauaaugcuuugaac

SEQ ID NO: 4092656 - RNA, 15 nt, Streptococcus pneumoniae R6
uuuuccuaauucuuu

SEQ ID NO: 4092657 - RNA, 13 nt, Streptococcus pneumoniae R6
uuuuccuagaaua

SEQ ID NO: 4092658 - RNA, 18 nt, Streptococcus pneumoniae R6
uuuuccuagauuacaaaa

SEQ ID NO: 4092659 - RNA, 17 nt, Streptococcus pneumoniae R6
uuuuccuauucugaagu

SEQ ID NO: 4092660 - RNA, 15 nt, Streptococcus pneumoniae R6
uuuuccuucauuucc

SEQ ID NO: 4092661 - RNA, 12 nt, Streptococcus pneumoniae R6
uuuuccuugacc

SEQ ID NO: 4092662 - RNA, 11 nt, Streptococcus pneumoniae R6
uuuuccuugcu

SEQ ID NO: 4092663 - RNA, 14 nt, Streptococcus pneumoniae R6
uuuucgaaaauucu

SEQ ID NO: 4092664 - RNA, 14 nt, Streptococcus pneumoniae R6
uuuucgaaauuuau

SEQ ID NO: 4092665 - RNA, 19 nt, Streptococcus pneumoniae R6
uuuucgaagaguauaaauc

SEQ ID NO: 4092666 - RNA, 16 nt, Streptococcus pneumoniae R6
uuuucgagccaauacu

SEQ ID NO: 4092667 - RNA, 21 nt, Streptococcus pneumoniae R6
uuuucguaguugguuaccuca

SEQ ID NO: 4092668 - RNA, 20 nt, Streptococcus pneumoniae R6
uuuucgucaccaaauuucau

SEQ ID NO: 4092669 - RNA, 21 nt, Streptococcus pneumoniae R6
uuuucuauaguagauugaaau

SEQ ID NO: 4092670 - RNA, 14 nt, Streptococcus pneumoniae R6
uuuucucaauagga

SEQ ID NO: 4092671 - RNA, 23 nt, Streptococcus pneumoniae R6
uuuucucaucuauuuuuacucaa

SEQ ID NO: 4092672 - RNA, 16 nt, Streptococcus pneumoniae R6
uuuucuccuauuuucu

SEQ ID NO: 4092673 - RNA, 13 nt, Streptococcus pneumoniae R6
uuuucucuuuguc

SEQ ID NO: 4092674 - RNA, 15 nt, Streptococcus pneumoniae R6
uuuucugauuuugaa

SEQ ID NO: 4092675 - RNA, 19 nt, Streptococcus pneumoniae R6
uuuucuggcagauuuugaa

SEQ ID NO: 4092676 - RNA, 12 nt, Streptococcus pneumoniae R6
uuuucuguacug

SEQ ID NO: 4092677 - RNA, 19 nt, Streptococcus pneumoniae R6
uuuucuguugauauuucca

SEQ ID NO: 4092678 - RNA, 12 nt, Streptococcus pneumoniae R6
uuuucuguuuaa

SEQ ID NO: 4092679 - RNA, 22 nt, Streptococcus pneumoniae R6
uuuucuguuuucuucuccgaag

SEQ ID NO: 4092680 - RNA, 17 nt, Streptococcus pneumoniae R6
uuuucuuauuuuccuaa

SEQ ID NO: 4092681 - RNA, 11 nt, Streptococcus pneumoniae R6
uuuucuucuuc

SEQ ID NO: 4092682 - RNA, 19 nt, Streptococcus pneumoniae R6
uuuucuuguacaacuuuag

SEQ ID NO: 4092683 - RNA, 14 nt, Streptococcus pneumoniae R6
uuuucuuuguucuu

SEQ ID NO: 4092684 - RNA, 18 nt, Streptococcus pneumoniae R6
uuuucuuuuaccugaaau

SEQ ID NO: 4092685 - RNA, 14 nt, Streptococcus pneumoniae R6
uuuucuuuuucaga

SEQ ID NO: 4092686 - RNA, 17 nt, Streptococcus pneumoniae R6
uuuucuuuuucagaacu

SEQ ID NO: 4092687 - RNA, 16 nt, Streptococcus pneumoniae R6
uuuugaaaaugaauuu

SEQ ID NO: 4092688 - RNA, 16 nt, Streptococcus pneumoniae R6
uuuugaaacuagaaua

SEQ ID NO: 4092689 - RNA, 20 nt, Streptococcus pneumoniae R6
uuuugaaaggaaagcauagg

SEQ ID NO: 4092690 - RNA, 19 nt, Streptococcus pneumoniae R6
uuuugaagauggucuaagc

SEQ ID NO: 4092691 - RNA, 23 nt, Streptococcus pneumoniae R6
uuuugaauauuaguaaauagaag

SEQ ID NO: 4092692 - RNA, 21 nt, Streptococcus pneumoniae R6
uuuugaaugcucccuucuuua

SEQ ID NO: 4092693 - RNA, 21 nt, Streptococcus pneumoniae R6
uuuugacguaucuuagcgauu

SEQ ID NO: 4092694 - RNA, 18 nt, Streptococcus pneumoniae R6
uuuugagguugcagauaa

SEQ ID NO: 4092695 - RNA, 16 nt, Streptococcus pneumoniae R6
uuuugagucaagauaa

SEQ ID NO: 4092696 - RNA, 23 nt, Streptococcus pneumoniae R6
uuuugauacagccuucuuuuuac

SEQ ID NO: 4092697 - RNA, 15 nt, Streptococcus pneumoniae R6
uuuugauaccacaga

SEQ ID NO: 4092698 - RNA, 14 nt, Streptococcus pneumoniae R6
uuuugauaucuucc

SEQ ID NO: 4092699 - RNA, 19 nt, Streptococcus pneumoniae R6
uuuugauaugagcccaugu

SEQ ID NO: 4092700 - RNA, 21 nt, Streptococcus pneumoniae R6
uuuugauggguucuuugccag

SEQ ID NO: 4092701 - RNA, 14 nt, Streptococcus pneumoniae R6
uuuugauguucaga

SEQ ID NO: 4092702 - RNA, 13 nt, Streptococcus pneumoniae R6
uuuugauuauuuu

SEQ ID NO: 4092703 - RNA, 15 nt, Streptococcus pneumoniae R6
uuuugauucaguaac

SEQ ID NO: 4092704 - RNA, 10 nt, Streptococcus pneumoniae R6
uuuugauuuc

SEQ ID NO: 4092705 - RNA, 18 nt, Streptococcus pneumoniae R6
uuuugcaaucauuucaaa

SEQ ID NO: 4092706 - RNA, 16 nt, Streptococcus pneumoniae R6
uuuugcccauucuuua

SEQ ID NO: 4092707 - RNA, 21 nt, Streptococcus pneumoniae R6
uuuugcccucuaaauacaaaa

SEQ ID NO: 4092708 - RNA, 20 nt, Streptococcus pneumoniae R6
uauuacaucguugguuuauu

SEQ ID NO: 4092709 - RNA, 23 nt, Streptococcus pneumoniae R6
uauuaccaaguuaaacaaccuug

SEQ ID NO: 4092710 - RNA, 13 nt, Streptococcus pneumoniae R6
uauuaccuugaac

SEQ ID NO: 4092711 - RNA, 13 nt, Streptococcus pneumoniae R6
uauuaccuuucuu

SEQ ID NO: 4092712 - RNA, 19 nt, Streptococcus pneumoniae R6
uauuacguccuguugcuuc

SEQ ID NO: 4092713 - RNA, 12 nt, Streptococcus pneumoniae R6
uauuacuuacca

SEQ ID NO: 4092714 - RNA, 18 nt, Streptococcus pneumoniae R6
uauuacuucaauuucuaa

SEQ ID NO: 4092715 - RNA, 18 nt, Streptococcus pneumoniae R6
uauuacuucuaaaacauu

SEQ ID NO: 4092716 - RNA, 19 nt, Streptococcus pneumoniae R6
uauuagcaucuuaucagaa

SEQ ID NO: 4092717 - RNA, 22 nt, Streptococcus pneumoniae R6
uauuagggaaacaaaagucuuc

SEQ ID NO: 4092718 - RNA, 15 nt, Streptococcus pneumoniae R6
uauuaguaauuucca

SEQ ID NO: 4092719 - RNA, 14 nt, Streptococcus pneumoniae R6
uauuaguuacauaa

SEQ ID NO: 4092720 - RNA, 17 nt, Streptococcus pneumoniae R6
uauuauaagacuuuucc

SEQ ID NO: 4092721 - RNA, 13 nt, Streptococcus pneumoniae R6
uauuauaauauaa

SEQ ID NO: 4092722 - RNA, 14 nt, Streptococcus pneumoniae R6
uauuauaauauaau

SEQ ID NO: 4092723 - RNA, 15 nt, Streptococcus pneumoniae R6
uauuauaauauaauu

SEQ ID NO: 4092724 - RNA, 18 nt, Streptococcus pneumoniae R6
uauuauacguuuuuugau

SEQ ID NO: 4092725 - RNA, 22 nt, Streptococcus pneumoniae R6
uauuauagugugggacuccuac

SEQ ID NO: 4092726 - RNA, 21 nt, Streptococcus pneumoniae R6
uauuauauauaugcacagaca

SEQ ID NO: 4092727 - RNA, 13 nt, Streptococcus pneumoniae R6
uauuauauaucug

SEQ ID NO: 4092728 - RNA, 17 nt, Streptococcus pneumoniae R6
uauuauauuuauagaau

SEQ ID NO: 4092729 - RNA, 13 nt, Streptococcus pneumoniae R6
uauuaucuuucca

SEQ ID NO: 4092730 - RNA, 18 nt, Streptococcus pneumoniae R6
uauuaugaaaaccaagaa

SEQ ID NO: 4092731 - RNA, 21 nt, Streptococcus pneumoniae R6
uauuaugaguuauuucagaau

SEQ ID NO: 4092732 - RNA, 15 nt, Streptococcus pneumoniae R6
uauuaugcguuuuuu

SEQ ID NO: 4092733 - RNA, 14 nt, Streptococcus pneumoniae R6
uauuauuaauauau

SEQ ID NO: 4092734 - RNA, 21 nt, Streptococcus pneumoniae R6
uauuauuaaugcuuaaaucgc

SEQ ID NO: 4092735 - RNA, 15 nt, Streptococcus pneumoniae R6
uauuauucucuauau

SEQ ID NO: 4092736 - RNA, 19 nt, Streptococcus pneumoniae R6
uauuauucucuauauaguu

SEQ ID NO: 4092737 - RNA, 19 nt, Streptococcus pneumoniae R6
uauuauuucauuuucuccu

SEQ ID NO: 4092738 - RNA, 13 nt, Streptococcus pneumoniae R6
uauuauuuccuca

SEQ ID NO: 4092739 - RNA, 19 nt, Streptococcus pneumoniae R6
uauucaaaauacaaaaguu

SEQ ID NO: 4092740 - RNA, 18 nt, Streptococcus pneumoniae R6
uauucaacgaaaauaauu

SEQ ID NO: 4092741 - RNA, 15 nt, Streptococcus pneumoniae R6
uauucaccaaucugc

SEQ ID NO: 4092742 - RNA, 17 nt, Streptococcus pneumoniae R6
uauucagacuauauaug

SEQ ID NO: 4092743 - RNA, 16 nt, Streptococcus pneumoniae R6
uauucauauccccaga

SEQ ID NO: 4092744 - RNA, 17 nt, Streptococcus pneumoniae R6
uauucauauccccagac

SEQ ID NO: 4092745 - RNA, 20 nt, Streptococcus pneumoniae R6
uauucauauccccagacaua

SEQ ID NO: 4092746 - RNA, 13 nt, Streptococcus pneumoniae R6
uauucaucagguu

SEQ ID NO: 4092747 - RNA, 16 nt, Streptococcus pneumoniae R6
uauuccacauucauac

SEQ ID NO: 4092748 - RNA, 15 nt, Streptococcus pneumoniae R6
uauuccauauucaau

SEQ ID NO: 4092749 - RNA, 15 nt, Streptococcus pneumoniae R6
uauuccauuggaagu

SEQ ID NO: 4092750 - RNA, 18 nt, Streptococcus pneumoniae R6
uauucgcuuacauaaagu

SEQ ID NO: 4092751 - RNA, 14 nt, Streptococcus pneumoniae R6
uauucguccaucca

SEQ ID NO: 4092752 - RNA, 13 nt, Streptococcus pneumoniae R6
uauucguuaucac

SEQ ID NO: 4092753 - RNA, 21 nt, Streptococcus pneumoniae R6
uauucuaagcgaccaucuuga

SEQ ID NO: 4092754 - RNA, 16 nt, Streptococcus pneumoniae R6
uauucuagugaaaaau

SEQ ID NO: 4092755 - RNA, 22 nt, Streptococcus pneumoniae R6
uauucuaguuucaauauauuau

SEQ ID NO: 4092756 - RNA, 21 nt, Streptococcus pneumoniae R6
uauucucguagugcuucucuu

SEQ ID NO: 4092757 - RNA, 14 nt, Streptococcus pneumoniae R6
uauucucucuuacu

SEQ ID NO: 4092758 - RNA, 19 nt, Streptococcus pneumoniae R6
uauucugaaugcuuuccaa

SEQ ID NO: 4092759 - RNA, 19 nt, Streptococcus pneumoniae R6
uauucuggaagugaaaaag

SEQ ID NO: 4092760 - RNA, 18 nt, Streptococcus pneumoniae R6
uauucuguagaauugcug

SEQ ID NO: 4092761 - RNA, 16 nt, Streptococcus pneumoniae R6
uauucuuaaauccaca

SEQ ID NO: 4092762 - RNA, 15 nt, Streptococcus pneumoniae R6
uauucuuaaaugaca

SEQ ID NO: 4092763 - RNA, 14 nt, Streptococcus pneumoniae R6
uauucuuauuucau

SEQ ID NO: 4092764 - RNA, 17 nt, Streptococcus pneumoniae R6
uauucuuggcaaaguuu

SEQ ID NO: 4092765 - RNA, 13 nt, Streptococcus pneumoniae R6
uauucuuuuucua

SEQ ID NO: 4092766 - RNA, 21 nt, Streptococcus pneumoniae R6
uauucuuuuuugguuucuuga

SEQ ID NO: 4092767 - RNA, 18 nt, Streptococcus pneumoniae R6
uauugaaaggaaaaugau

SEQ ID NO: 4092768 - RNA, 21 nt, Streptococcus pneumoniae R6
uauugaaaggaaaaugauuuu

SEQ ID NO: 4092769 - RNA, 20 nt, Streptococcus pneumoniae R6
uauugaaaugaaauaaaauu

SEQ ID NO: 4092770 - RNA, 14 nt, Streptococcus pneumoniae R6
uauugauauuuaua

SEQ ID NO: 4092771 - RNA, 13 nt, Streptococcus pneumoniae R6
uauugauuccguc

SEQ ID NO: 4092772 - RNA, 15 nt, Streptococcus pneumoniae R6
uauugcaagagaaau

SEQ ID NO: 4092773 - RNA, 18 nt, Streptococcus pneumoniae R6
uauugccgauaucaccaa

SEQ ID NO: 4092774 - RNA, 20 nt, Streptococcus pneumoniae R6
uauugccgauaucaccaaac

SEQ ID NO: 4092775 - RNA, 14 nt, Streptococcus pneumoniae R6
uauuggaugaguuu

SEQ ID NO: 4092776 - RNA, 21 nt, Streptococcus pneumoniae R6
uauuggcugccacaccaccug

SEQ ID NO: 4092777 - RNA, 21 nt, Streptococcus pneumoniae R6
uauugguaacaaaaauacggu

SEQ ID NO: 4092778 - RNA, 22 nt, Streptococcus pneumoniae R6
uauugguauuaauaauuuucac

SEQ ID NO: 4092779 - RNA, 18 nt, Streptococcus pneumoniae R6
uauuggucgcuucaaguu

SEQ ID NO: 4092780 - RNA, 23 nt, Streptococcus pneumoniae R6
uauugguugugaaggucuucuug

SEQ ID NO: 4092781 - RNA, 22 nt, Streptococcus pneumoniae R6
uauuguaagaauuugauuauuu

SEQ ID NO: 4092782 - RNA, 18 nt, Streptococcus pneumoniae R6
uauuguacuguauacuuu

SEQ ID NO: 4092783 - RNA, 15 nt, Streptococcus pneumoniae R6
uauuguacuuuccaa

SEQ ID NO: 4092784 - RNA, 15 nt, Streptococcus pneumoniae R6
uauuguauaguagau

SEQ ID NO: 4092785 - RNA, 18 nt, Streptococcus pneumoniae R6
uauugucucuaaaaauaa

SEQ ID NO: 4092786 - RNA, 16 nt, Streptococcus pneumoniae R6
uauugucuucaucucu

SEQ ID NO: 4092787 - RNA, 23 nt, Streptococcus pneumoniae R6
uauugugggaauauguauuucau

SEQ ID NO: 4092788 - RNA, 17 nt, Streptococcus pneumoniae R6
uauuguugcauuaaaaa

SEQ ID NO: 4092789 - RNA, 16 nt, Streptococcus pneumoniae R6
uauuguuuuaauauaa

SEQ ID NO: 4092790 - RNA, 18 nt, Streptococcus pneumoniae R6
uauuuaaaccaauuuuaa

SEQ ID NO: 4092791 - RNA, 13 nt, Streptococcus pneumoniae R6
uauuuaacuaaau

SEQ ID NO: 4092792 - RNA, 21 nt, Streptococcus pneumoniae R6
uauuuaaucauuuaauaauga

SEQ ID NO: 4092793 - RNA, 18 nt, Streptococcus pneumoniae R6
uauuuaauguuuucccuu

SEQ ID NO: 4092794 - RNA, 18 nt, Streptococcus pneumoniae R6
uauuuacauaauuuaaaa

SEQ ID NO: 4092795 - RNA, 12 nt, Streptococcus pneumoniae R6
uauuuaccaaaa

SEQ ID NO: 4092796 - RNA, 18 nt, Streptococcus pneumoniae R6
uauuuaccaaaaagggug

SEQ ID NO: 4092797 - RNA, 11 nt, Streptococcus pneumoniae R6
uauuuacccag

SEQ ID NO: 4092798 - RNA, 19 nt, Streptococcus pneumoniae R6
uauuuacgaauuauuuccu

SEQ ID NO: 4092799 - RNA, 22 nt, Streptococcus pneumoniae R6
uauuuacgaauuauuuccuuga

SEQ ID NO: 4092800 - RNA, 13 nt, Streptococcus pneumoniae R6
uauuuacuaauua

SEQ ID NO: 4092801 - RNA, 18 nt, Streptococcus pneumoniae R6
uauuuacuaauuaauuaa

SEQ ID NO: 4092802 - RNA, 17 nt, Streptococcus pneumoniae R6
uauuuacuuaccauaau

SEQ ID NO: 4092803 - RNA, 23 nt, Streptococcus pneumoniae R6
uauuuaguaaaaacguuuuucaa

SEQ ID NO: 4092804 - RNA, 23 nt, Streptococcus pneumoniae R6
uauuuauguccuaaaacuaguga

SEQ ID NO: 4092805 - RNA, 15 nt, Streptococcus pneumoniae R6
uauuuauuuacauaa

SEQ ID NO: 4092806 - RNA, 17 nt, Streptococcus pneumoniae R6
uauuucaaaaaauguag

SEQ ID NO: 4092807 - RNA, 22 nt, Streptococcus pneumoniae R6
uauuucaaagaacaucuacaau

SEQ ID NO: 4092808 - RNA, 12 nt, Streptococcus pneumoniae R6
uauuucaaauca

SEQ ID NO: 4092809 - RNA, 12 nt, Streptococcus pneumoniae R6
uauuucaaucca

SEQ ID NO: 4092810 - RNA, 17 nt, Streptococcus pneumoniae R6
uauuucaauuugaugau

SEQ ID NO: 4092811 - RNA, 18 nt, Streptococcus pneumoniae R6
uauuucaauuugaugauu

SEQ ID NO: 4092812 - RNA, 22 nt, Streptococcus pneumoniae R6
uauuucacaguuaaauuauaaa

SEQ ID NO: 4092813 - RNA, 21 nt, Streptococcus pneumoniae R6
uauuucauacgauaaaaauca

SEQ ID NO: 4092814 - RNA, 24 nt, Streptococcus pneumoniae R6
uauuucaugcuugccugaacgcua

SEQ ID NO: 4092815 - RNA, 17 nt, Streptococcus pneumoniae R6
uauuucauuacagaaca

SEQ ID NO: 4092816 - RNA, 20 nt, Streptococcus pneumoniae R6
uauuucauuuggcuauaaaa

SEQ ID NO: 4092817 - RNA, 13 nt, Streptococcus pneumoniae R6
uauuucauuuuaa

SEQ ID NO: 4092818 - RNA, 18 nt, Streptococcus pneumoniae R6
uauuucauuuuacuauaa

SEQ ID NO: 4092819 - RNA, 14 nt, Streptococcus pneumoniae R6
uauuucauuuucua

SEQ ID NO: 4092820 - RNA, 15 nt, Streptococcus pneumoniae R6
uauuuccugcuuuag

SEQ ID NO: 4092821 - RNA, 21 nt, Streptococcus pneumoniae R6
uauuuccuugaccaaguccuc

SEQ ID NO: 4092822 - RNA, 16 nt, Streptococcus pneumoniae R6
uauuucgcuuauaaac

SEQ ID NO: 4092823 - RNA, 17 nt, Streptococcus pneumoniae R6
uauuucguaagaaauuu

SEQ ID NO: 4092824 - RNA, 22 nt, Streptococcus pneumoniae R6
uauuucguaagaaauuuuggau

SEQ ID NO: 4092825 - RNA, 14 nt, Streptococcus pneumoniae R6
uauuucuaugauaa

SEQ ID NO: 4092826 - RNA, 15 nt, Streptococcus pneumoniae R6
uauuucuuaauugua

SEQ ID NO: 4092827 - RNA, 15 nt, Streptococcus pneumoniae R6
uauuucuuauuucaa

SEQ ID NO: 4092828 - RNA, 16 nt, Streptococcus pneumoniae R6
uauuucuucuucugaa

SEQ ID NO: 4092829 - RNA, 12 nt, Streptococcus pneumoniae R6
uauuucuucuuu

SEQ ID NO: 4092830 - RNA, 21 nt, Streptococcus pneumoniae R6
uauuucuucuuuucauaauuu

SEQ ID NO: 4092831 - RNA, 17 nt, Streptococcus pneumoniae R6
uauuucuuguuuucuaa

SEQ ID NO: 4092832 - RNA, 11 nt, Streptococcus pneumoniae R6
uauuucuuuug

SEQ ID NO: 4092833 - RNA, 16 nt, Streptococcus pneumoniae R6
uauuucuuuuuaugau

SEQ ID NO: 4092834 - RNA, 16 nt, Streptococcus pneumoniae R6
uauuugaaaaauauac

SEQ ID NO: 4092835 - RNA, 21 nt, Streptococcus pneumoniae R6
uauuugaaaggguagugaaag

SEQ ID NO: 4092836 - RNA, 23 nt, Streptococcus pneumoniae R6
uauuugaguaacggcuuccugug

SEQ ID NO: 4092837 - RNA, 16 nt, Streptococcus pneumoniae R6
uauuugauauagaguu

SEQ ID NO: 4092838 - RNA, 18 nt, Streptococcus pneumoniae R6
uauuuggauuaaucccca

SEQ ID NO: 4092839 - RNA, 20 nt, Streptococcus pneumoniae R6
uauuuggauuaugaaaaauc

SEQ ID NO: 4092840 - RNA, 23 nt, Streptococcus pneumoniae R6
uauuuggcaauucaauuauagac

SEQ ID NO: 4092841 - RNA, 17 nt, Streptococcus pneumoniae R6
uauuuggcgauuuuuuu

SEQ ID NO: 4092842 - RNA, 14 nt, Streptococcus pneumoniae R6
uauuuguaaaauug

SEQ ID NO: 4092843 - RNA, 15 nt, Streptococcus pneumoniae R6
uauuuguugcucuua

SEQ ID NO: 4092844 - RNA, 21 nt, Streptococcus pneumoniae R6
uauuuuaggaaacucuuacaa

SEQ ID NO: 4092845 - RNA, 14 nt, Streptococcus pneumoniae R6
uauuuuaguaaaaa

SEQ ID NO: 4092846 - RNA, 23 nt, Streptococcus pneumoniae R6
uauuuuaucccgaaccaugaaau

SEQ ID NO: 4092847 - RNA, 13 nt, Streptococcus pneumoniae R6
uauuuucaaaaua

SEQ ID NO: 4092848 - RNA, 21 nt, Streptococcus pneumoniae R6
uauuuucaguguaucauugau

SEQ ID NO: 4092849 - RNA, 13 nt, Streptococcus pneumoniae R6
uauuuuuaaauuu

SEQ ID NO: 4092850 - RNA, 13 nt, Streptococcus pneumoniae R6
uauuuuuccucua

SEQ ID NO: 4092851 - RNA, 17 nt, Streptococcus pneumoniae R6
uauuuuuccuucaucaa

SEQ ID NO: 4092852 - RNA, 20 nt, Streptococcus pneumoniae R6
uauuuuucuauuuaaaucgc

SEQ ID NO: 4092853 - RNA, 14 nt, Streptococcus pneumoniae R6
uauuuuucuuuuuc

SEQ ID NO: 4092854 - RNA, 17 nt, Streptococcus pneumoniae R6
uauuuuugcaagugcuc

SEQ ID NO: 4092855 - RNA, 15 nt, Streptococcus pneumoniae R6
uauuuuuuaacagau

SEQ ID NO: 4092856 - RNA, 22 nt, Streptococcus pneumoniae R6
uauuuuuuaacagauuuuucug

SEQ ID NO: 4092857 - RNA, 18 nt, Streptococcus pneumoniae R6
uauuuuuugaaucaauuu

SEQ ID NO: 4092858 - RNA, 14 nt, Streptococcus pneumoniae R6
ucaaaaaaagaagu

SEQ ID NO: 4092859 - RNA, 15 nt, Streptococcus pneumoniae R6
ucaaaaaaagaaguu

SEQ ID NO: 4092860 - RNA, 22 nt, Streptococcus pneumoniae R6
ucaaaaaaagcuguuaaaaacu

SEQ ID NO: 4092861 - RNA, 14 nt, Streptococcus pneumoniae R6
ucaaaaaaaucgua

SEQ ID NO: 4092862 - RNA, 13 nt, Streptococcus pneumoniae R6
ucaaaaaaauucu

SEQ ID NO: 4092863 - RNA, 17 nt, Streptococcus pneumoniae R6
ucaaaaaaauucuucac

SEQ ID NO: 4092864 - RNA, 17 nt, Streptococcus pneumoniae R6
ucaaaaaaguuaaaucu

SEQ ID NO: 4092865 - RNA, 21 nt, Streptococcus pneumoniae R6
ucaaaaaauguagucauucga

SEQ ID NO: 4092866 - RNA, 20 nt, Streptococcus pneumoniae R6
ucaaaaaauugcacuuuccu

SEQ ID NO: 4092867 - RNA, 19 nt, Streptococcus pneumoniae R6
ucaaaaaauuucauuucga

SEQ ID NO: 4092868 - RNA, 17 nt, Streptococcus pneumoniae R6
ucaaaaacaucucagaa

SEQ ID NO: 4092869 - RNA, 22 nt, Streptococcus pneumoniae R6
ucaaaaacaucucagaauaaua

SEQ ID NO: 4092870 - RNA, 13 nt, Streptococcus pneumoniae R6
ucaaaaacauguu

SEQ ID NO: 4092871 - RNA, 11 nt, Streptococcus pneumoniae R6
ucaaaaagaag

SEQ ID NO: 4092872 - RNA, 14 nt, Streptococcus pneumoniae R6
ucaaaaagaaguuc

SEQ ID NO: 4092873 - RNA, 21 nt, Streptococcus pneumoniae R6
ucaaaaagaucaguucauuuu

SEQ ID NO: 4092874 - RNA, 23 nt, Streptococcus pneumoniae R6
ucaaaaagaucaguucauuuuuc

SEQ ID NO: 4092875 - RNA, 17 nt, Streptococcus pneumoniae R6
ucaaaaauagaaauaaa

SEQ ID NO: 4092876 - RNA, 20 nt, Streptococcus pneumoniae R6
ucaaaaauagaaauaaaaau

SEQ ID NO: 4092877 - RNA, 20 nt, Streptococcus pneumoniae R6
ucaaaaaucauuauauuucu

SEQ ID NO: 4092878 - RNA, 18 nt, Streptococcus pneumoniae R6
ucaaaacaauguuuugau

SEQ ID NO: 4092879 - RNA, 20 nt, Streptococcus pneumoniae R6
ucaaaacacuguuuuaaggu

SEQ ID NO: 4092880 - RNA, 16 nt, Streptococcus pneumoniae R6
ucaaaacacuguuuug

SEQ ID NO: 4092881 - RNA, 19 nt, Streptococcus pneumoniae R6
ucaaaacaugguuuugagg

SEQ ID NO: 4092882 - RNA, 20 nt, Streptococcus pneumoniae R6
ucaaaagauguuagaaaaag

SEQ ID NO: 4092883 - RNA, 19 nt, Streptococcus pneumoniae R6
ucaaaagcuuguuuaaaau

SEQ ID NO: 4092884 - RNA, 16 nt, Streptococcus pneumoniae R6
ucaaaaguuagaaaua

SEQ ID NO: 4092885 - RNA, 14 nt, Streptococcus pneumoniae R6
ucaaaauaaccaag

SEQ ID NO: 4092886 - RNA, 12 nt, Streptococcus pneumoniae R6
ucaaaauacuag

SEQ ID NO: 4092887 - RNA, 14 nt, Streptococcus pneumoniae R6
ucaaaauaguguga

SEQ ID NO: 4092888 - RNA, 22 nt, Streptococcus pneumoniae R6
ucaaaaucuucuggcacagaaa

SEQ ID NO: 4092889 - RNA, 14 nt, Streptococcus pneumoniae R6
ucaaaauucugucu

SEQ ID NO: 4092890 - RNA, 22 nt, Streptococcus pneumoniae R6
ucaaaauucugucuuagacuuu

SEQ ID NO: 4092891 - RNA, 22 nt, Streptococcus pneumoniae R6
ucaaaauuguugucccuuuuuc

SEQ ID NO: 4092892 - RNA, 11 nt, Streptococcus pneumoniae R6
ucaaacaaaag

SEQ ID NO: 4092893 - RNA, 12 nt, Streptococcus pneumoniae R6
ucaaacaaaagc

SEQ ID NO: 4092894 - RNA, 18 nt, Streptococcus pneumoniae R6
ucaaacaagaccucaaua

SEQ ID NO: 4092895 - RNA, 13 nt, Streptococcus pneumoniae R6
ucaaacaaugugc

SEQ ID NO: 4092896 - RNA, 13 nt, Streptococcus pneumoniae R6
ucaaacauuguga

SEQ ID NO: 4092897 - RNA, 15 nt, Streptococcus pneumoniae R6
ucaaacauugugagg

SEQ ID NO: 4092898 - RNA, 22 nt, Streptococcus pneumoniae R6
ucaaacauugugaggaauugau

SEQ ID NO: 4092899 - RNA, 11 nt, Streptococcus pneumoniae R6
ucaaaccacaa

SEQ ID NO: 4092900 - RNA, 21 nt, Streptococcus pneumoniae R6
ucaaaccaugagguaagagaa

SEQ ID NO: 4092901 - RNA, 22 nt, Streptococcus pneumoniae R6
ucaaacggccauuguauccuga

SEQ ID NO: 4092902 - RNA, 22 nt, Streptococcus pneumoniae R6
ucaaacuacgucagcuuccauc

SEQ ID NO: 4092903 - RNA, 16 nt, Streptococcus pneumoniae R6
ucaaacucaaauuuac

SEQ ID NO: 4092904 - RNA, 18 nt, Streptococcus pneumoniae R6
ucaaacucaauuuaauac

SEQ ID NO: 4092905 - RNA, 15 nt, Streptococcus pneumoniae R6
ucaaacuuuuucucu

SEQ ID NO: 4092906 - RNA, 22 nt, Streptococcus pneumoniae R6
ucaaacuuuuucucucugaaua

SEQ ID NO: 4092907 - RNA, 14 nt, Streptococcus pneumoniae R6
ucaaagaaccugca

SEQ ID NO: 4092908 - RNA, 21 nt, Streptococcus pneumoniae R6
ucaaagacuugcccaucacga

SEQ ID NO: 4092909 - RNA, 14 nt, Streptococcus pneumoniae R6
ucaaagagcaaacu

SEQ ID NO: 4092910 - RNA, 22 nt, Streptococcus pneumoniae R6
ucaaagagcaaacuagaaaacu

SEQ ID NO: 4092911 - RNA, 22 nt, Streptococcus pneumoniae R6
ucaaagagcaaacuaggaaacu

SEQ ID NO: 4092912 - RNA, 16 nt, Streptococcus pneumoniae R6
ucaaagcaguacuuug

SEQ ID NO: 4092913 - RNA, 23 nt, Streptococcus pneumoniae R6
ucaaagcauuugccagaaaaagu

SEQ ID NO: 4092914 - RNA, 19 nt, Streptococcus pneumoniae R6
ucaaagccaaucaaaaaau

SEQ ID NO: 4092915 - RNA, 22 nt, Streptococcus pneumoniae R6
ucaaagccaaucaaaaaaucuc

SEQ ID NO: 4092916 - RNA, 14 nt, Streptococcus pneumoniae R6
ucaaagcgauaaaa

SEQ ID NO: 4092917 - RNA, 15 nt, Streptococcus pneumoniae R6
ucaaagcgauaaaaa

SEQ ID NO: 4092918 - RNA, 16 nt, Streptococcus pneumoniae R6
ucaaagcgauaaaaau

SEQ ID NO: 4092919 - RNA, 17 nt, Streptococcus pneumoniae R6
ucaaagcgauaaaaauc

SEQ ID NO: 4092920 - RNA, 17 nt, Streptococcus pneumoniae R6
ucaaagcgggauuuaaa

SEQ ID NO: 4092921 - RNA, 22 nt, Streptococcus pneumoniae R6
ucaaagcgggauuuaaaauaag

SEQ ID NO: 4092922 - RNA, 19 nt, Streptococcus pneumoniae R6
ucaaagcuaguuguuuuuc

SEQ ID NO: 4092923 - RNA, 13 nt, Streptococcus pneumoniae R6
ucaaagcuggcuu

SEQ ID NO: 4092924 - RNA, 18 nt, Streptococcus pneumoniae R6
ucaaaggagauaguaucc

SEQ ID NO: 4092925 - RNA, 16 nt, Streptococcus pneumoniae R6
ucaaagggcaaaucuu

SEQ ID NO: 4092926 - RNA, 19 nt, Streptococcus pneumoniae R6
ucaaaggucucuucuucug

SEQ ID NO: 4092927 - RNA, 14 nt, Streptococcus pneumoniae R6
ucaaaguaaugguu

SEQ ID NO: 4092928 - RNA, 14 nt, Streptococcus pneumoniae R6
ucaaaguagauacu

SEQ ID NO: 4092929 - RNA, 12 nt, Streptococcus pneumoniae R6
ucaaaguaguca

SEQ ID NO: 4092930 - RNA, 16 nt, Streptococcus pneumoniae R6
ucaaaguagucauuuu

SEQ ID NO: 4092931 - RNA, 16 nt, Streptococcus pneumoniae R6
ucaaaguagugaauga

SEQ ID NO: 4092932 - RNA, 19 nt, Streptococcus pneumoniae R6
ucaaagucauaaacaucug

SEQ ID NO: 4092933 - RNA, 22 nt, Streptococcus pneumoniae R6
ucaaagucauaaacaucugucg

SEQ ID NO: 4092934 - RNA, 14 nt, Streptococcus pneumoniae R6
ucaaagucaucaaa

SEQ ID NO: 4092935 - RNA, 16 nt, Streptococcus pneumoniae R6
ucaaagugcaaacuag

SEQ ID NO: 4092936 - RNA, 22 nt, Streptococcus pneumoniae R6
ucaaaguggguuuuaacuacau

SEQ ID NO: 4092937 - RNA, 18 nt, Streptococcus pneumoniae R6
ucaaaguuaacuuuucca

SEQ ID NO: 4092938 - RNA, 22 nt, Streptococcus pneumoniae R6
ucaaaguuccgaaaaccaaagg

SEQ ID NO: 4092939 - RNA, 22 nt, Streptococcus pneumoniae R6
ucaaaguuuacgacacauucua

SEQ ID NO: 4092940 - RNA, 16 nt, Streptococcus pneumoniae R6
ucaaaucaaaauauag

SEQ ID NO: 4092941 - RNA, 15 nt, Streptococcus pneumoniae R6
ucaaaucaaauuuau

SEQ ID NO: 4092942 - RNA, 19 nt, Streptococcus pneumoniae R6
ucaaaucagguaggauuuc

SEQ ID NO: 4092943 - RNA, 23 nt, Streptococcus pneumoniae R6
ucaaaucagguaggauuucuccu

SEQ ID NO: 4092944 - RNA, 23 nt, Streptococcus pneumoniae R6
ucaaaucauuucuuuggcaccuu

SEQ ID NO: 4092945 - RNA, 12 nt, Streptococcus pneumoniae R6
ucaaaucccaug

SEQ ID NO: 4092946 - RNA, 19 nt, Streptococcus pneumoniae R6
ucaaauccgacuucaauaa

SEQ ID NO: 4092947 - RNA, 21 nt, Streptococcus pneumoniae R6
ucaaauccuucagcuuuggca

SEQ ID NO: 4092948 - RNA, 14 nt, Streptococcus pneumoniae R6
ucaaauccuuuauu

SEQ ID NO: 4092949 - RNA, 16 nt, Streptococcus pneumoniae R6
ucaaaucgauuucuaa

SEQ ID NO: 4092950 - RNA, 22 nt, Streptococcus pneumoniae R6
ucaaaucgauuucuaacaauau

SEQ ID NO: 4092951 - RNA, 15 nt, Streptococcus pneumoniae R6
ucaaaugacuaaccu

SEQ ID NO: 4092952 - RNA, 23 nt, Streptococcus pneumoniae R6
ucaaaugacuaagcccaaagaua

SEQ ID NO: 4092953 - RNA, 20 nt, Streptococcus pneumoniae R6
ucaaaugagauuugcaucaa

SEQ ID NO: 4092954 - RNA, 15 nt, Streptococcus pneumoniae R6
ucaaaugucuuggca

SEQ ID NO: 4092955 - RNA, 15 nt, Streptococcus pneumoniae R6
ucaaauuaauuuaua

SEQ ID NO: 4092956 - RNA, 22 nt, Streptococcus pneumoniae R6
ucaaauuaauuuauagaaaaau

SEQ ID NO: 4092957 - RNA, 16 nt, Streptococcus pneumoniae R6
ucaaauucauucguaa

SEQ ID NO: 4092958 - RNA, 18 nt, Streptococcus pneumoniae R6
ucaaauucauucguaauc

SEQ ID NO: 4092959 - RNA, 20 nt, Streptococcus pneumoniae R6
ucaaauugaaaauucacaaa

SEQ ID NO: 4092960 - RNA, 23 nt, Streptococcus pneumoniae R6
ucaaauugaaaauucacaaaauc

SEQ ID NO: 4092961 - RNA, 15 nt, Streptococcus pneumoniae R6
ucaaauugaaauaag

SEQ ID NO: 4092962 - RNA, 11 nt, Streptococcus pneumoniae R6
ucaaauugaua

SEQ ID NO: 4092963 - RNA, 22 nt, Streptococcus pneumoniae R6
ucaaauuuagcuguaucauucu

SEQ ID NO: 4092964 - RNA, 14 nt, Streptococcus pneumoniae R6
ucaaauuucccauc

SEQ ID NO: 4092965 - RNA, 16 nt, Streptococcus pneumoniae R6
ucaaauuuucuuuacu

SEQ ID NO: 4092966 - RNA, 18 nt, Streptococcus pneumoniae R6
ucaaauuuuucauaauuu

SEQ ID NO: 4092967 - RNA, 20 nt, Streptococcus pneumoniae R6
ucaacaaaucagaaaaguaa

SEQ ID NO: 4092968 - RNA, 20 nt, Streptococcus pneumoniae R6
ucaacaagcuguagucagcu

SEQ ID NO: 4092969 - RNA, 12 nt, Streptococcus pneumoniae R6
ucaacagaagaa

SEQ ID NO: 4092970 - RNA, 22 nt, Streptococcus pneumoniae R6
ucaacagaagaauccugccaau

SEQ ID NO: 4092971 - RNA, 17 nt, Streptococcus pneumoniae R6
ucaacagcuccauaaca

SEQ ID NO: 4092972 - RNA, 18 nt, Streptococcus pneumoniae R6
ucaacagcuccauaacaa

SEQ ID NO: 4092973 - RNA, 20 nt, Streptococcus pneumoniae R6
ucaacagcuccuucaaguuc

SEQ ID NO: 4092974 - RNA, 21 nt, Streptococcus pneumoniae R6
ucaacaugaccaccaggaaaa

SEQ ID NO: 4092975 - RNA, 13 nt, Streptococcus pneumoniae R6
ucaacaugagaau

SEQ ID NO: 4092976 - RNA, 17 nt, Streptococcus pneumoniae R6
ucaacaugagaauacaa

SEQ ID NO: 4092977 - RNA, 20 nt, Streptococcus pneumoniae R6
ucaacaugagaauacaaaaa

SEQ ID NO: 4092978 - RNA, 14 nt, Streptococcus pneumoniae R6
ucaaucuuaucuaa

SEQ ID NO: 4092979 - RNA, 15 nt, Streptococcus pneumoniae R6
ucaaucuucaaaauc

SEQ ID NO: 4092980 - RNA, 20 nt, Streptococcus pneumoniae R6
ucaaugaaaaucaaagagca

SEQ ID NO: 4092981 - RNA, 21 nt, Streptococcus pneumoniae R6
ucaaugaaaaucaaagagcaa

SEQ ID NO: 4092982 - RNA, 22 nt, Streptococcus pneumoniae R6
ucaaugaaaaucaaagagcaaa

SEQ ID NO: 4092983 - RNA, 18 nt, Streptococcus pneumoniae R6
ucaaugaauccgaaaaau

SEQ ID NO: 4092984 - RNA, 21 nt, Streptococcus pneumoniae R6
ucaaugagucagggaaaaaac

SEQ ID NO: 4092985 - RNA, 23 nt, Streptococcus pneumoniae R6
ucaaugcccuugauaauaaagaa

SEQ ID NO: 4092986 - RNA, 15 nt, Streptococcus pneumoniae R6
ucaauggaguaaaaa

SEQ ID NO: 4092987 - RNA, 19 nt, Streptococcus pneumoniae R6
ucaauggaguaaaaaaaga

SEQ ID NO: 4092988 - RNA, 13 nt, Streptococcus pneumoniae R6
ucaauguuuuauu

SEQ ID NO: 4092989 - RNA, 18 nt, Streptococcus pneumoniae R6
ucaauguuuuauuacaua

SEQ ID NO: 4092990 - RNA, 19 nt, Streptococcus pneumoniae R6
ucaauguuuuauuacauaa

SEQ ID NO: 4092991 - RNA, 12 nt, Streptococcus pneumoniae R6
ucaauuaagaaa

SEQ ID NO: 4092992 - RNA, 16 nt, Streptococcus pneumoniae R6
ucaauuaaguuuuacg

SEQ ID NO: 4092993 - RNA, 13 nt, Streptococcus pneumoniae R6
ucaauuagaaaau

SEQ ID NO: 4092994 - RNA, 17 nt, Streptococcus pneumoniae R6
ucaauuagaaaauucaa

SEQ ID NO: 4092995 - RNA, 18 nt, Streptococcus pneumoniae R6
ucaauuagaaaauucaaa

SEQ ID NO: 4092996 - RNA, 19 nt, Streptococcus pneumoniae R6
ucaauuagaaaauucaaau

SEQ ID NO: 4092997 - RNA, 18 nt, Streptococcus pneumoniae R6
ucaauuaguuuaagacau

SEQ ID NO: 4092998 - RNA, 19 nt, Streptococcus pneumoniae R6
ucaauuaucauuuccauug

SEQ ID NO: 4092999 - RNA, 12 nt, Streptococcus pneumoniae R6
ucaauucacuau

SEQ ID NO: 4093000 - RNA, 20 nt, Streptococcus pneumoniae R6
ucaauuccaagguagcaaca

SEQ ID NO: 4093001 - RNA, 17 nt, Streptococcus pneumoniae R6
ucaauucuuuaacaaaa

SEQ ID NO: 4093002 - RNA, 16 nt, Streptococcus pneumoniae R6
ucaauugaaacaagaa

SEQ ID NO: 4093003 - RNA, 14 nt, Streptococcus pneumoniae R6
ucaauugacuauau

SEQ ID NO: 4093004 - RNA, 13 nt, Streptococcus pneumoniae R6
ucaauugauuuga

SEQ ID NO: 4093005 - RNA, 16 nt, Streptococcus pneumoniae R6
ucaauugguuaaaagc

SEQ ID NO: 4093006 - RNA, 11 nt, Streptococcus pneumoniae R6
ucaauuguaua

SEQ ID NO: 4093007 - RNA, 15 nt, Streptococcus pneumoniae R6
ucaauuuacuauacu

SEQ ID NO: 4093008 - RNA, 21 nt, Streptococcus pneumoniae R6
ucaauuuacuauacuuacuua

SEQ ID NO: 4093009 - RNA, 12 nt, Streptococcus pneumoniae R6
ucaauuucacua

SEQ ID NO: 4093010 - RNA, 16 nt, Streptococcus pneumoniae R6
ucaauuucaggagaaa

SEQ ID NO: 4093011 - RNA, 11 nt, Streptococcus pneumoniae R6
ucaauuucuag

SEQ ID NO: 4093012 - RNA, 22 nt, Streptococcus pneumoniae R6
ucaauuucuauuuuaaaaauag

SEQ ID NO: 4093013 - RNA, 16 nt, Streptococcus pneumoniae R6
ucaauuucucuacaaa

SEQ ID NO: 4093014 - RNA, 23 nt, Streptococcus pneumoniae R6
ucaauuuguucguauccuauuuc

SEQ ID NO: 4093015 - RNA, 12 nt, Streptococcus pneumoniae R6
ucaauuuuuaac

SEQ ID NO: 4093016 - RNA, 19 nt, Streptococcus pneumoniae R6
ucacaaagaguucccugcu

SEQ ID NO: 4093017 - RNA, 17 nt, Streptococcus pneumoniae R6
ucacaacucuuauacuu

SEQ ID NO: 4093018 - RNA, 16 nt, Streptococcus pneumoniae R6
ucacaauccagccugc

SEQ ID NO: 4093019 - RNA, 19 nt, Streptococcus pneumoniae R6
ucacaauccagccugccug

SEQ ID NO: 4093020 - RNA, 19 nt, Streptococcus pneumoniae R6
ucacaaucucacuaugauu

SEQ ID NO: 4093021 - RNA, 22 nt, Streptococcus pneumoniae R6
ucaucugcuuuagcagcgucac

SEQ ID NO: 4093022 - RNA, 11 nt, Streptococcus pneumoniae R6
ucaucuggaua

SEQ ID NO: 4093023 - RNA, 14 nt, Streptococcus pneumoniae R6
ucaucuggauuuuc

SEQ ID NO: 4093024 - RNA, 16 nt, Streptococcus pneumoniae R6
ucaucuggauuuucag

SEQ ID NO: 4093025 - RNA, 18 nt, Streptococcus pneumoniae R6
ucaucuguuuucaaaaag

SEQ ID NO: 4093026 - RNA, 22 nt, Streptococcus pneumoniae R6
ucaucuuauagcgacuauaaaa

SEQ ID NO: 4093027 - RNA, 18 nt, Streptococcus pneumoniae R6
ucaucuuauuucaaucug

SEQ ID NO: 4093028 - RNA, 13 nt, Streptococcus pneumoniae R6
ucaucuugauaga

SEQ ID NO: 4093029 - RNA, 12 nt, Streptococcus pneumoniae R6
ucaucuuucaug

SEQ ID NO: 4093030 - RNA, 12 nt, Streptococcus pneumoniae R6
ucaugaaaccac

SEQ ID NO: 4093031 - RNA, 13 nt, Streptococcus pneumoniae R6
ucaugaauacgua

SEQ ID NO: 4093032 - RNA, 18 nt, Streptococcus pneumoniae R6
ucaugacagccucaauga

SEQ ID NO: 4093033 - RNA, 15 nt, Streptococcus pneumoniae R6
ucaugacaucuucca

SEQ ID NO: 4093034 - RNA, 16 nt, Streptococcus pneumoniae R6
ucaugacaucuuccaa

SEQ ID NO: 4093035 - RNA, 15 nt, Streptococcus pneumoniae R6
ucaugacuagugaag

SEQ ID NO: 4093036 - RNA, 13 nt, Streptococcus pneumoniae R6
ucaugagccacaa

SEQ ID NO: 4093037 - RNA, 21 nt, Streptococcus pneumoniae R6
ucaugaggauggcuuucuuuc

SEQ ID NO: 4093038 - RNA, 21 nt, Streptococcus pneumoniae R6
ucaugaguggagccccuugau

SEQ ID NO: 4093039 - RNA, 20 nt, Streptococcus pneumoniae R6
ucaugagugggcucauguaa

SEQ ID NO: 4093040 - RNA, 16 nt, Streptococcus pneumoniae R6
ucaugauuagaaauag

SEQ ID NO: 4093041 - RNA, 23 nt, Streptococcus pneumoniae R6
ucaugcaaaaaaaaugaaaaaaa

SEQ ID NO: 4093042 - RNA, 23 nt, Streptococcus pneumoniae R6
ucaugcaggaaguucaguagauu

SEQ ID NO: 4093043 - RNA, 21 nt, Streptococcus pneumoniae R6
ucaugcgaaacagugaugaga

SEQ ID NO: 4093044 - RNA, 19 nt, Streptococcus pneumoniae R6
ucaugcgauagaugaucga

SEQ ID NO: 4093045 - RNA, 19 nt, Streptococcus pneumoniae R6
ucaugcuggcagaaacugu

SEQ ID NO: 4093046 - RNA, 19 nt, Streptococcus pneumoniae R6
ucaugcuuuacuaguucuc

SEQ ID NO: 4093047 - RNA, 19 nt, Streptococcus pneumoniae R6
ucauggccacgguuagaag

SEQ ID NO: 4093048 - RNA, 22 nt, Streptococcus pneumoniae R6
ucaugguucgggauaaaauagu

SEQ ID NO: 4093049 - RNA, 20 nt, Streptococcus pneumoniae R6
ucaugucauguuagaaaaau

SEQ ID NO: 4093050 - RNA, 16 nt, Streptococcus pneumoniae R6
ucauguggugcuucug

SEQ ID NO: 4093051 - RNA, 13 nt, Streptococcus pneumoniae R6
ucauguucauuug

SEQ ID NO: 4093052 - RNA, 18 nt, Streptococcus pneumoniae R6
ucauguuucaacauguca

SEQ ID NO: 4093053 - RNA, 22 nt, Streptococcus pneumoniae R6
ucauguuuuccuaauucuuuuc

SEQ ID NO: 4093054 - RNA, 14 nt, Streptococcus pneumoniae R6
ucauuaaaacggag

SEQ ID NO: 4093055 - RNA, 17 nt, Streptococcus pneumoniae R6
ucauuacagaacauuuu

SEQ ID NO: 4093056 - RNA, 22 nt, Streptococcus pneumoniae R6
ucauuauagaaggcaauuaaaa

SEQ ID NO: 4093057 - RNA, 15 nt, Streptococcus pneumoniae R6
ucauuauuuaacuaa

SEQ ID NO: 4093058 - RNA, 17 nt, Streptococcus pneumoniae R6
ucauucacuacuuugac

SEQ ID NO: 4093059 - RNA, 13 nt, Streptococcus pneumoniae R6
ucauucaucacca

SEQ ID NO: 4093060 - RNA, 19 nt, Streptococcus pneumoniae R6
ucauuccaucauaaaaaua

SEQ ID NO: 4093061 - RNA, 14 nt, Streptococcus pneumoniae R6
ucauuccaugaaaa

SEQ ID NO: 4093062 - RNA, 21 nt, Streptococcus pneumoniae R6
ucauuccauggcugacaacaa

SEQ ID NO: 4093063 - RNA, 15 nt, Streptococcus pneumoniae R6
ucauucccuccuuuu

SEQ ID NO: 4093064 - RNA, 17 nt, Streptococcus pneumoniae R6
ucauuccgacucugaag

SEQ ID NO: 4093065 - RNA, 23 nt, Streptococcus pneumoniae R6
ucauuccuucaagggcagacaua

SEQ ID NO: 4093066 - RNA, 15 nt, Streptococcus pneumoniae R6
ucauucgaaugauuu

SEQ ID NO: 4093067 - RNA, 20 nt, Streptococcus pneumoniae R6
ucauucgaaugauuucucuu

SEQ ID NO: 4093068 - RNA, 13 nt, Streptococcus pneumoniae R6
ucauucguaaucc

SEQ ID NO: 4093069 - RNA, 12 nt, Streptococcus pneumoniae R6
ucauucugcuag

SEQ ID NO: 4093070 - RNA, 23 nt, Streptococcus pneumoniae R6
ucauugaaaaaauaucuuuuauu

SEQ ID NO: 4093071 - RNA, 21 nt, Streptococcus pneumoniae R6
ucauugaguaugaaauaagau

SEQ ID NO: 4093072 - RNA, 19 nt, Streptococcus pneumoniae R6
ucauuggaaaagauagaga

SEQ ID NO: 4093073 - RNA, 24 nt, Streptococcus pneumoniae R6
ucauuggaguuguaaucuuagcaa

SEQ ID NO: 4093074 - RNA, 19 nt, Streptococcus pneumoniae R6
ucauuuaaaauuaaaaaga

SEQ ID NO: 4093075 - RNA, 15 nt, Streptococcus pneumoniae R6
ucauuuaauauauuu

SEQ ID NO: 4093076 - RNA, 17 nt, Streptococcus pneumoniae R6
ucauuuaauauauuuau

SEQ ID NO: 4093077 - RNA, 20 nt, Streptococcus pneumoniae R6
ucauuucuuuggcaccuuug

SEQ ID NO: 4093078 - RNA, 14 nt, Streptococcus pneumoniae R6
ucauuugaugagaa

SEQ ID NO: 4093079 - RNA, 22 nt, Streptococcus pneumoniae R6
ucauuugauuuuccuaaucaau

SEQ ID NO: 4093080 - RNA, 12 nt, Streptococcus pneumoniae R6
ucauuuggaaaa

SEQ ID NO: 4093081 - RNA, 18 nt, Streptococcus pneumoniae R6
ucauuuggcuauaaaaaa

SEQ ID NO: 4093082 - RNA, 14 nt, Streptococcus pneumoniae R6
ucauuuuacaucug

SEQ ID NO: 4093083 - RNA, 15 nt, Streptococcus pneumoniae R6
ucauuuuacuauaaa

SEQ ID NO: 4093084 - RNA, 17 nt, Streptococcus pneumoniae R6
ucauuuuacuauaaaau

SEQ ID NO: 4093085 - RNA, 24 nt, Streptococcus pneumoniae R6
ucauuuuacuauauaucaugcuuu

SEQ ID NO: 4093086 - RNA, 22 nt, Streptococcus pneumoniae R6
ucauuuucuuuuaccugaaaua

SEQ ID NO: 4093087 - RNA, 14 nt, Streptococcus pneumoniae R6
ucauuuugaaaucu

SEQ ID NO: 4093088 - RNA, 17 nt, Streptococcus pneumoniae R6
ucauuuuuuaugguguu

SEQ ID NO: 4093089 - RNA, 13 nt, Streptococcus pneumoniae R6
ucauuuuuuccug

SEQ ID NO: 4093090 - RNA, 17 nt, Streptococcus pneumoniae R6
uccaaaaaguaggcaua

SEQ ID NO: 4093091 - RNA, 12 nt, Streptococcus pneumoniae R6
uccaaaacaucu

SEQ ID NO: 4093092 - RNA, 20 nt, Streptococcus pneumoniae R6
uccaaaaggcaucuugucaa

SEQ ID NO: 4093093 - RNA, 15 nt, Streptococcus pneumoniae R6
uccaaaccaaccuuc

SEQ ID NO: 4093094 - RNA, 23 nt, Streptococcus pneumoniae R6
uccaaacgauuaucuaacaauaa

SEQ ID NO: 4093095 - RNA, 12 nt, Streptococcus pneumoniae R6
uccaaacgucca

SEQ ID NO: 4093096 - RNA, 19 nt, Streptococcus pneumoniae R6
uccaaagaccaugaggaaa

SEQ ID NO: 4093097 - RNA, 21 nt, Streptococcus pneumoniae R6
uccaaagaccaugaggaaacg

SEQ ID NO: 4093098 - RNA, 17 nt, Streptococcus pneumoniae R6
uccaaagguccagaagc

SEQ ID NO: 4093099 - RNA, 16 nt, Streptococcus pneumoniae R6
uccaaagguucaauca

SEQ ID NO: 4093100 - RNA, 22 nt, Streptococcus pneumoniae R6
uccaaagguucaaucauuuugu

SEQ ID NO: 4093101 - RNA, 14 nt, Streptococcus pneumoniae R6
uccaaaguaaaaua

SEQ ID NO: 4093102 - RNA, 17 nt, Streptococcus pneumoniae R6
uccaaaguaaaauacaa

SEQ ID NO: 4093103 - RNA, 19 nt, Streptococcus pneumoniae R6
uccaaaguaaaauacaaac

SEQ ID NO: 4093104 - RNA, 21 nt, Streptococcus pneumoniae R6
uccaaaguaaaauacaaacca

SEQ ID NO: 4093105 - RNA, 19 nt, Streptococcus pneumoniae R6
uccaaaguagcuugcucca

SEQ ID NO: 4093106 - RNA, 22 nt, Streptococcus pneumoniae R6
uccaacaccaauuuuacaaaua

SEQ ID NO: 4093107 - RNA, 16 nt, Streptococcus pneumoniae R6
uccaacgacuuccagc

SEQ ID NO: 4093108 - RNA, 14 nt, Streptococcus pneumoniae R6
uccaacucaggaaa

SEQ ID NO: 4093109 - RNA, 21 nt, Streptococcus pneumoniae R6
uccaacucaggaaagaugaua

SEQ ID NO: 4093110 - RNA, 19 nt, Streptococcus pneumoniae R6
uccaacucuggguguuucu

SEQ ID NO: 4093111 - RNA, 15 nt, Streptococcus pneumoniae R6
uccaagaaagagaau

SEQ ID NO: 4093112 - RNA, 22 nt, Streptococcus pneumoniae R6
uccaagcauaacagcauuucca

SEQ ID NO: 4093113 - RNA, 20 nt, Streptococcus pneumoniae R6
uccaagccuuacucuuucga

SEQ ID NO: 4093114 - RNA, 19 nt, Streptococcus pneumoniae R6
uccaaggcugaaauuggcu

SEQ ID NO: 4093115 - RNA, 22 nt, Streptococcus pneumoniae R6
uccaaguuugcaaaguuuucuu

SEQ ID NO: 4093116 - RNA, 14 nt, Streptococcus pneumoniae R6
uccaaguuuuguug

SEQ ID NO: 4093117 - RNA, 15 nt, Streptococcus pneumoniae R6
uccaauagucauucc

SEQ ID NO: 4093118 - RNA, 14 nt, Streptococcus pneumoniae R6
uccaaucagaugac

SEQ ID NO: 4093119 - RNA, 19 nt, Streptococcus pneumoniae R6
uccaaucagaugacuggaa

SEQ ID NO: 4093120 - RNA, 17 nt, Streptococcus pneumoniae R6
uccaaucaucaucgugg

SEQ ID NO: 4093121 - RNA, 14 nt, Streptococcus pneumoniae R6
uccaauccuaaauc

SEQ ID NO: 4093122 - RNA, 21 nt, Streptococcus pneumoniae R6
uccaauccuuguaugacaucu

SEQ ID NO: 4093123 - RNA, 23 nt, Streptococcus pneumoniae R6
uccauuuggcaccgaauuuuuca

SEQ ID NO: 4093124 - RNA, 14 nt, Streptococcus pneumoniae R6
uccauuuuccauga

SEQ ID NO: 4093125 - RNA, 18 nt, Streptococcus pneumoniae R6
uccauuuuuuaaaaaggc

SEQ ID NO: 4093126 - RNA, 22 nt, Streptococcus pneumoniae R6
ucccaagguuuugccagccagu

SEQ ID NO: 4093127 - RNA, 14 nt, Streptococcus pneumoniae R6
ucccaaguaaauua

SEQ ID NO: 4093128 - RNA, 19 nt, Streptococcus pneumoniae R6
ucccaaguaguaguuucag

SEQ ID NO: 4093129 - RNA, 18 nt, Streptococcus pneumoniae R6
ucccaaucgauuuguucu

SEQ ID NO: 4093130 - RNA, 20 nt, Streptococcus pneumoniae R6
ucccaaucgauuuguucuca

SEQ ID NO: 4093131 - RNA, 20 nt, Streptococcus pneumoniae R6
ucccaccaaacuuucccuuc

SEQ ID NO: 4093132 - RNA, 18 nt, Streptococcus pneumoniae R6
ucccacccauauuuuucc

SEQ ID NO: 4093133 - RNA, 17 nt, Streptococcus pneumoniae R6
ucccagagcuauaagcc

SEQ ID NO: 4093134 - RNA, 13 nt, Streptococcus pneumoniae R6
ucccauaaaaaua

SEQ ID NO: 4093135 - RNA, 15 nt, Streptococcus pneumoniae R6
ucccauaaaaauaau

SEQ ID NO: 4093136 - RNA, 16 nt, Streptococcus pneumoniae R6
ucccauaaaaauaaua

SEQ ID NO: 4093137 - RNA, 14 nt, Streptococcus pneumoniae R6
ucccauaguagucu

SEQ ID NO: 4093138 - RNA, 18 nt, Streptococcus pneumoniae R6
ucccauauuuggcauauu

SEQ ID NO: 4093139 - RNA, 14 nt, Streptococcus pneumoniae R6
ucccaucauuccuu

SEQ ID NO: 4093140 - RNA, 17 nt, Streptococcus pneumoniae R6
ucccaucauuccuucaa

SEQ ID NO: 4093141 - RNA, 18 nt, Streptococcus pneumoniae R6
ucccaucgcgaccaagag

SEQ ID NO: 4093142 - RNA, 17 nt, Streptococcus pneumoniae R6
ucccaugacaaucauuu

SEQ ID NO: 4093143 - RNA, 19 nt, Streptococcus pneumoniae R6
ucccaugacaaucauuuca

SEQ ID NO: 4093144 - RNA, 22 nt, Streptococcus pneumoniae R6
ucccaugacaaucauuucaguu

SEQ ID NO: 4093145 - RNA, 12 nt, Streptococcus pneumoniae R6
ucccaugcuucc

SEQ ID NO: 4093146 - RNA, 13 nt, Streptococcus pneumoniae R6
ucccauucuucag

SEQ ID NO: 4093147 - RNA, 17 nt, Streptococcus pneumoniae R6
ucccauugagaaaauau

SEQ ID NO: 4093148 - RNA, 16 nt, Streptococcus pneumoniae R6
ucccauugcaauccca

SEQ ID NO: 4093149 - RNA, 23 nt, Streptococcus pneumoniae R6
ucccauuuuuggaucauaaccua

SEQ ID NO: 4093150 - RNA, 16 nt, Streptococcus pneumoniae R6
uccccaaucgguuaca

SEQ ID NO: 4093151 - RNA, 22 nt, Streptococcus pneumoniae R6
uccccaguuacuuucuagggca

SEQ ID NO: 4093152 - RNA, 14 nt, Streptococcus pneumoniae R6
uccccaucuucaac

SEQ ID NO: 4093153 - RNA, 15 nt, Streptococcus pneumoniae R6
uccccaucuucaacu

SEQ ID NO: 4093154 - RNA, 17 nt, Streptococcus pneumoniae R6
uccccaugaguuuucaa

SEQ ID NO: 4093155 - RNA, 15 nt, Streptococcus pneumoniae R6
ucccccuuuuuuuaa

SEQ ID NO: 4093156 - RNA, 17 nt, Streptococcus pneumoniae R6
uccccuaggagaugagc

SEQ ID NO: 4093157 - RNA, 14 nt, Streptococcus pneumoniae R6
uccccucaaccuga

SEQ ID NO: 4093158 - RNA, 21 nt, Streptococcus pneumoniae R6
ucccgaaccguguuguaugaa

SEQ ID NO: 4093159 - RNA, 18 nt, Streptococcus pneumoniae R6
ucccguaucuuugauaca

SEQ ID NO: 4093160 - RNA, 18 nt, Streptococcus pneumoniae R6
ucccgucucaugaaagga

SEQ ID NO: 4093161 - RNA, 23 nt, Streptococcus pneumoniae R6
ucccgucucaugaaaggauuucu

SEQ ID NO: 4093162 - RNA, 19 nt, Streptococcus pneumoniae R6
ucccuaaagggauccucau

SEQ ID NO: 4093163 - RNA, 13 nt, Streptococcus pneumoniae R6
ucccuaauaauac

SEQ ID NO: 4093164 - RNA, 22 nt, Streptococcus pneumoniae R6
ucccuaauaauacaaaaaauag

SEQ ID NO: 4093165 - RNA, 23 nt, Streptococcus pneumoniae R6
ucccuaauaauacaaaaaauagu

SEQ ID NO: 4093166 - RNA, 20 nt, Streptococcus pneumoniae R6
ucccuaccucauaucugucu

SEQ ID NO: 4093167 - RNA, 23 nt, Streptococcus pneumoniae R6
ucccuccauuucauagcuaauca

SEQ ID NO: 4093168 - RNA, 15 nt, Streptococcus pneumoniae R6
ucccuccuaaggagu

SEQ ID NO: 4093169 - RNA, 19 nt, Streptococcus pneumoniae R6
ucccucuuuuuacaauugu

SEQ ID NO: 4093170 - RNA, 22 nt, Streptococcus pneumoniae R6
ucccuguaaucaugaugauaga

SEQ ID NO: 4093171 - RNA, 13 nt, Streptococcus pneumoniae R6
ucccuuaucauua

SEQ ID NO: 4093172 - RNA, 22 nt, Streptococcus pneumoniae R6
ucccuucaauggaguaaaaaaa

SEQ ID NO: 4093173 - RNA, 14 nt, Streptococcus pneumoniae R6
ucccuuccuaucaa

SEQ ID NO: 4093174 - RNA, 20 nt, Streptococcus pneumoniae R6
ucccuuguuuaguaaacaaa

SEQ ID NO: 4093175 - RNA, 15 nt, Streptococcus pneumoniae R6
ucccuuuccaagaau

SEQ ID NO: 4093176 - RNA, 20 nt, Streptococcus pneumoniae R6
ucccuuuuuaagauuuuacc

SEQ ID NO: 4093177 - RNA, 19 nt, Streptococcus pneumoniae R6
uccgaaccacaacaaaaaa

SEQ ID NO: 4093178 - RNA, 20 nt, Streptococcus pneumoniae R6
uccgaaccacaacaaaaaag

SEQ ID NO: 4093179 - RNA, 19 nt, Streptococcus pneumoniae R6
uccgaacuuguggggccag

SEQ ID NO: 4093180 - RNA, 17 nt, Streptococcus pneumoniae R6
uccgaagacuuuaaaaa

SEQ ID NO: 4093181 - RNA, 21 nt, Streptococcus pneumoniae R6
uccgaagauuuaguucuguau

SEQ ID NO: 4093182 - RNA, 14 nt, Streptococcus pneumoniae R6
uccgaauaaauaga

SEQ ID NO: 4093183 - RNA, 18 nt, Streptococcus pneumoniae R6
uccgaauagcucaaaagc

SEQ ID NO: 4093184 - RNA, 18 nt, Streptococcus pneumoniae R6
uccgacuucaauaaaaua

SEQ ID NO: 4093185 - RNA, 12 nt, Streptococcus pneumoniae R6
uccgagugcaag

SEQ ID NO: 4093186 - RNA, 14 nt, Streptococcus pneumoniae R6
uccgaguuuuucag

SEQ ID NO: 4093187 - RNA, 12 nt, Streptococcus pneumoniae R6
uccgauaugugu

SEQ ID NO: 4093188 - RNA, 18 nt, Streptococcus pneumoniae R6
uccgauuuuauuucauuc

SEQ ID NO: 4093189 - RNA, 17 nt, Streptococcus pneumoniae R6
uccgcaaggaugguaua

SEQ ID NO: 4093190 - RNA, 20 nt, Streptococcus pneumoniae R6
uccgcacugucguuccuuuu

SEQ ID NO: 4093191 - RNA, 18 nt, Streptococcus pneumoniae R6
uccgcaucucggaaagau

SEQ ID NO: 4093192 - RNA, 15 nt, Streptococcus pneumoniae R6
uccgccuccagagaa

SEQ ID NO: 4093193 - RNA, 16 nt, Streptococcus pneumoniae R6
uccgcuugggaaacca

SEQ ID NO: 4093194 - RNA, 18 nt, Streptococcus pneumoniae R6
uccgcuuuuaucaaagac

SEQ ID NO: 4093195 - RNA, 13 nt, Streptococcus pneumoniae R6
uccggaaaccaaa

SEQ ID NO: 4093196 - RNA, 21 nt, Streptococcus pneumoniae R6
uccguaaaacgauaaauuccc

SEQ ID NO: 4093197 - RNA, 16 nt, Streptococcus pneumoniae R6
uccguaaucuuguuaa

SEQ ID NO: 4093198 - RNA, 19 nt, Streptococcus pneumoniae R6
uccguaccaacacauucaa

SEQ ID NO: 4093199 - RNA, 19 nt, Streptococcus pneumoniae R6
uccguauucuuauuucaaa

SEQ ID NO: 4093200 - RNA, 17 nt, Streptococcus pneumoniae R6
uccgugaagugaaagga

SEQ ID NO: 4093201 - RNA, 16 nt, Streptococcus pneumoniae R6
uccguguaaaaccuuu

SEQ ID NO: 4093202 - RNA, 20 nt, Streptococcus pneumoniae R6
uccguucugagauagguggg

SEQ ID NO: 4093203 - RNA, 15 nt, Streptococcus pneumoniae R6
uccguuggucaaggg

SEQ ID NO: 4093204 - RNA, 14 nt, Streptococcus pneumoniae R6
uccguuuuucuccu

SEQ ID NO: 4093205 - RNA, 18 nt, Streptococcus pneumoniae R6
uccguuuuuugaaguuuu

SEQ ID NO: 4093206 - RNA, 19 nt, Streptococcus pneumoniae R6
uccguuuuuugaaguuuuc

SEQ ID NO: 4093207 - RNA, 13 nt, Streptococcus pneumoniae R6
uccuaaagaaaaa

SEQ ID NO: 4093208 - RNA, 19 nt, Streptococcus pneumoniae R6
uccuaaauccucuaucaug

SEQ ID NO: 4093209 - RNA, 13 nt, Streptococcus pneumoniae R6
uccuaacuuaaaa

SEQ ID NO: 4093210 - RNA, 15 nt, Streptococcus pneumoniae R6
uccuaagcuuucagc

SEQ ID NO: 4093211 - RNA, 19 nt, Streptococcus pneumoniae R6
uccuaagcuuucagcagcu

SEQ ID NO: 4093212 - RNA, 11 nt, Streptococcus pneumoniae R6
uccuaaggagu

SEQ ID NO: 4093213 - RNA, 23 nt, Streptococcus pneumoniae R6
uccuaaucuggagauuucuuauu

SEQ ID NO: 4093214 - RNA, 11 nt, Streptococcus pneumoniae R6
uccuaauuugc

SEQ ID NO: 4093215 - RNA, 20 nt, Streptococcus pneumoniae R6
uccuacaaugaucaagauga

SEQ ID NO: 4093216 - RNA, 22 nt, Streptococcus pneumoniae R6
uccuacaaugaucaagaugaga

SEQ ID NO: 4093217 - RNA, 19 nt, Streptococcus pneumoniae R6
uccuacauauguaagaaga

SEQ ID NO: 4093218 - RNA, 14 nt, Streptococcus pneumoniae R6
uccuacgaacaaga

SEQ ID NO: 4093219 - RNA, 14 nt, Streptococcus pneumoniae R6
uccuacuucaaauc

SEQ ID NO: 4093220 - RNA, 20 nt, Streptococcus pneumoniae R6
uccuacuucaaauccuuuau

SEQ ID NO: 4093221 - RNA, 14 nt, Streptococcus pneumoniae R6
uccuacuugcuucc

SEQ ID NO: 4093222 - RNA, 18 nt, Streptococcus pneumoniae R6
uccuacuugcuucccauu

SEQ ID NO: 4093223 - RNA, 20 nt, Streptococcus pneumoniae R6
uccuagaauaugaacauuuu

SEQ ID NO: 4093224 - RNA, 15 nt, Streptococcus pneumoniae R6
uccuagauacaguga

SEQ ID NO: 4093225 - RNA, 21 nt, Streptococcus pneumoniae R6
uccuaggaagauuuauacucu

SEQ ID NO: 4093226 - RNA, 22 nt, Streptococcus pneumoniae R6
ucgagaaaggggcucuuuguca

SEQ ID NO: 4093227 - RNA, 21 nt, Streptococcus pneumoniae R6
ucgagacauaccauuuuccaa

SEQ ID NO: 4093228 - RNA, 14 nt, Streptococcus pneumoniae R6
ucgagcaguuccau

SEQ ID NO: 4093229 - RNA, 20 nt, Streptococcus pneumoniae R6
ucgagcaguuccaucaaucu

SEQ ID NO: 4093230 - RNA, 14 nt, Streptococcus pneumoniae R6
ucgaggaaaucccu

SEQ ID NO: 4093231 - RNA, 16 nt, Streptococcus pneumoniae R6
ucgaggucuaaaucua

SEQ ID NO: 4093232 - RNA, 12 nt, Streptococcus pneumoniae R6
ucgauaaaguag

SEQ ID NO: 4093233 - RNA, 22 nt, Streptococcus pneumoniae R6
ucgauaacgauagauccuucaa

SEQ ID NO: 4093234 - RNA, 18 nt, Streptococcus pneumoniae R6
ucgauaauaccuaccaga

SEQ ID NO: 4093235 - RNA, 20 nt, Streptococcus pneumoniae R6
ucgauaccugggaagaugaa

SEQ ID NO: 4093236 - RNA, 16 nt, Streptococcus pneumoniae R6
ucgauaccuucagcca

SEQ ID NO: 4093237 - RNA, 16 nt, Streptococcus pneumoniae R6
ucgauagauuuuucaa

SEQ ID NO: 4093238 - RNA, 19 nt, Streptococcus pneumoniae R6
ucgauagauuuuucaaggu

SEQ ID NO: 4093239 - RNA, 13 nt, Streptococcus pneumoniae R6
ucgaucaggacag

SEQ ID NO: 4093240 - RNA, 21 nt, Streptococcus pneumoniae R6
ucgaucaggacagucaaaucg

SEQ ID NO: 4093241 - RNA, 19 nt, Streptococcus pneumoniae R6
ucgaucaguccuauuccuu

SEQ ID NO: 4093242 - RNA, 15 nt, Streptococcus pneumoniae R6
ucgaucuaaggaaga

SEQ ID NO: 4093243 - RNA, 18 nt, Streptococcus pneumoniae R6
ucgaucugauauauuuuc

SEQ ID NO: 4093244 - RNA, 18 nt, Streptococcus pneumoniae R6
ucgaugaaucauuuccuu

SEQ ID NO: 4093245 - RNA, 22 nt, Streptococcus pneumoniae R6
ucgaugaccaugucguuuccuu

SEQ ID NO: 4093246 - RNA, 19 nt, Streptococcus pneumoniae R6
ucgaugguugucccuggga

SEQ ID NO: 4093247 - RNA, 19 nt, Streptococcus pneumoniae R6
ucgaugucaccaaacaaau

SEQ ID NO: 4093248 - RNA, 14 nt, Streptococcus pneumoniae R6
ucgauuacaaucau

SEQ ID NO: 4093249 - RNA, 19 nt, Streptococcus pneumoniae R6
ucgauugggaaaguaaaau

SEQ ID NO: 4093250 - RNA, 20 nt, Streptococcus pneumoniae R6
ucgauuucuaacaauauuuu

SEQ ID NO: 4093251 - RNA, 19 nt, Streptococcus pneumoniae R6
ucgauuuguucauaucuua

SEQ ID NO: 4093252 - RNA, 19 nt, Streptococcus pneumoniae R6
ucgauuuguucuguucuua

SEQ ID NO: 4093253 - RNA, 13 nt, Streptococcus pneumoniae R6
ucgauuuuuucac

SEQ ID NO: 4093254 - RNA, 16 nt, Streptococcus pneumoniae R6
ucgcaaagaggaagag

SEQ ID NO: 4093255 - RNA, 20 nt, Streptococcus pneumoniae R6
ucgcaacugucuuauccaaa

SEQ ID NO: 4093256 - RNA, 14 nt, Streptococcus pneumoniae R6
ucgcaccucuuuuu

SEQ ID NO: 4093257 - RNA, 18 nt, Streptococcus pneumoniae R6
ucgcaccugacuccauag

SEQ ID NO: 4093258 - RNA, 22 nt, Streptococcus pneumoniae R6
ucgcagcaucgagaauuucugg

SEQ ID NO: 4093259 - RNA, 19 nt, Streptococcus pneumoniae R6
ucgcagguugcucaaagua

SEQ ID NO: 4093260 - RNA, 19 nt, Streptococcus pneumoniae R6
ucgcauaggcaauuucgau

SEQ ID NO: 4093261 - RNA, 16 nt, Streptococcus pneumoniae R6
ucgcauuugagcgaaa

SEQ ID NO: 4093262 - RNA, 15 nt, Streptococcus pneumoniae R6
ucgccaauucuuuca

SEQ ID NO: 4093263 - RNA, 18 nt, Streptococcus pneumoniae R6
ucgccaauucuuucaagc

SEQ ID NO: 4093264 - RNA, 20 nt, Streptococcus pneumoniae R6
ucgccaauucuuucaagcgc

SEQ ID NO: 4093265 - RNA, 20 nt, Streptococcus pneumoniae R6
ucgccucacuaucgaaaaau

SEQ ID NO: 4093266 - RNA, 16 nt, Streptococcus pneumoniae R6
ucgcgaccaagagcaa

SEQ ID NO: 4093267 - RNA, 20 nt, Streptococcus pneumoniae R6
ucgcgauugauuuccaaaaa

SEQ ID NO: 4093268 - RNA, 14 nt, Streptococcus pneumoniae R6
ucgcuaucaauggu

SEQ ID NO: 4093269 - RNA, 22 nt, Streptococcus pneumoniae R6
ucgcuauuuuuugaaucaauuu

SEQ ID NO: 4093270 - RNA, 18 nt, Streptococcus pneumoniae R6
ucgcucaguguaguuuua

SEQ ID NO: 4093271 - RNA, 16 nt, Streptococcus pneumoniae R6
ucgcucgucaucgucu

SEQ ID NO: 4093272 - RNA, 16 nt, Streptococcus pneumoniae R6
ucgcugaguaaagacu

SEQ ID NO: 4093273 - RNA, 11 nt, Streptococcus pneumoniae R6
ucgcuggagag

SEQ ID NO: 4093274 - RNA, 20 nt, Streptococcus pneumoniae R6
ucgcuggagagacuugcuca

SEQ ID NO: 4093275 - RNA, 13 nt, Streptococcus pneumoniae R6
ucgcuuacauaaa

SEQ ID NO: 4093276 - RNA, 12 nt, Streptococcus pneumoniae R6
ucgcuugcuaga

SEQ ID NO: 4093277 - RNA, 18 nt, Streptococcus pneumoniae R6
ucgcuuucuucauuuugu

SEQ ID NO: 4093278 - RNA, 22 nt, Streptococcus pneumoniae R6
ucgcuuuucauuauaggucaua

SEQ ID NO: 4093279 - RNA, 19 nt, Streptococcus pneumoniae R6
ucgcuuuuuuaguuugcau

SEQ ID NO: 4093280 - RNA, 17 nt, Streptococcus pneumoniae R6
ucggaacaucuuuucca

SEQ ID NO: 4093281 - RNA, 12 nt, Streptococcus pneumoniae R6
ucggauaaaauc

SEQ ID NO: 4093282 - RNA, 11 nt, Streptococcus pneumoniae R6
ucggcagucuu

SEQ ID NO: 4093283 - RNA, 16 nt, Streptococcus pneumoniae R6
ucggcaguuuuuucuu

SEQ ID NO: 4093284 - RNA, 20 nt, Streptococcus pneumoniae R6
ucggcauucuucucuugaaa

SEQ ID NO: 4093285 - RNA, 17 nt, Streptococcus pneumoniae R6
ucggcugguauuuuuuc

SEQ ID NO: 4093286 - RNA, 19 nt, Streptococcus pneumoniae R6
ucggcugguauuuuuucaa

SEQ ID NO: 4093287 - RNA, 15 nt, Streptococcus pneumoniae R6
ucggcuguucuuuuu

SEQ ID NO: 4093288 - RNA, 16 nt, Streptococcus pneumoniae R6
ucggcuguuuuuucuu

SEQ ID NO: 4093289 - RNA, 14 nt, Streptococcus pneumoniae R6
ucggcuucaucugg

SEQ ID NO: 4093290 - RNA, 20 nt, Streptococcus pneumoniae R6
ucggcuuuuuuaucuuuccu

SEQ ID NO: 4093291 - RNA, 13 nt, Streptococcus pneumoniae R6
ucgggauaaaaua

SEQ ID NO: 4093292 - RNA, 15 nt, Streptococcus pneumoniae R6
ucgggugucaaauca

SEQ ID NO: 4093293 - RNA, 20 nt, Streptococcus pneumoniae R6
ucgguacuuaaacgugcuau

SEQ ID NO: 4093294 - RNA, 16 nt, Streptococcus pneumoniae R6
ucggucauggauuuua

SEQ ID NO: 4093295 - RNA, 12 nt, Streptococcus pneumoniae R6
ucguaaaaaagu

SEQ ID NO: 4093296 - RNA, 15 nt, Streptococcus pneumoniae R6
ucguaaaaaagucuu

SEQ ID NO: 4093297 - RNA, 17 nt, Streptococcus pneumoniae R6
ucguaaaccuucaagac

SEQ ID NO: 4093298 - RNA, 18 nt, Streptococcus pneumoniae R6
ucguacacucaaaucaaa

SEQ ID NO: 4093299 - RNA, 23 nt, Streptococcus pneumoniae R6
ucguacacucaaaucaaaauaua

SEQ ID NO: 4093300 - RNA, 19 nt, Streptococcus pneumoniae R6
ucguacucucuuuuuugau

SEQ ID NO: 4093301 - RNA, 14 nt, Streptococcus pneumoniae R6
ucguagauuaaaac

SEQ ID NO: 4093302 - RNA, 14 nt, Streptococcus pneumoniae R6
ucguagucuuucac

SEQ ID NO: 4093303 - RNA, 19 nt, Streptococcus pneumoniae R6
ucguagucuuucaccacuu

SEQ ID NO: 4093304 - RNA, 16 nt, Streptococcus pneumoniae R6
ucguauaguagaagug

SEQ ID NO: 4093305 - RNA, 16 nt, Streptococcus pneumoniae R6
ucguauccuauuucac

SEQ ID NO: 4093306 - RNA, 15 nt, Streptococcus pneumoniae R6
ucguaugcuugccaa

SEQ ID NO: 4093307 - RNA, 15 nt, Streptococcus pneumoniae R6
ucguauggcaagauc

SEQ ID NO: 4093308 - RNA, 12 nt, Streptococcus pneumoniae R6
ucguauugaaug

SEQ ID NO: 4093309 - RNA, 20 nt, Streptococcus pneumoniae R6
ucgucacauucccauucccu

SEQ ID NO: 4093310 - RNA, 17 nt, Streptococcus pneumoniae R6
ucgucacuaacaaagcu

SEQ ID NO: 4093311 - RNA, 18 nt, Streptococcus pneumoniae R6
ucgucaguucuaucuaca

SEQ ID NO: 4093312 - RNA, 18 nt, Streptococcus pneumoniae R6
ucgucaguucuaucugca

SEQ ID NO: 4093313 - RNA, 18 nt, Streptococcus pneumoniae R6
ucgucaucacgacuaauu

SEQ ID NO: 4093314 - RNA, 13 nt, Streptococcus pneumoniae R6
ucgucauuuaaag

SEQ ID NO: 4093315 - RNA, 17 nt, Streptococcus pneumoniae R6
ucgucauuuguuuuagu

SEQ ID NO: 4093316 - RNA, 23 nt, Streptococcus pneumoniae R6
ucguccgaauccguauucuuauu

SEQ ID NO: 4093317 - RNA, 13 nt, Streptococcus pneumoniae R6
ucguccuuucuuu

SEQ ID NO: 4093318 - RNA, 15 nt, Streptococcus pneumoniae R6
ucguccuuucuuuuu

SEQ ID NO: 4093319 - RNA, 22 nt, Streptococcus pneumoniae R6
ucguccuuucuuuuuugaaguu

SEQ ID NO: 4093320 - RNA, 16 nt, Streptococcus pneumoniae R6
ucgucugaguuuuuau

SEQ ID NO: 4093321 - RNA, 12 nt, Streptococcus pneumoniae R6
ucgugaauagag

SEQ ID NO: 4093322 - RNA, 15 nt, Streptococcus pneumoniae R6
ucgugaauagagucu

SEQ ID NO: 4093323 - RNA, 19 nt, Streptococcus pneumoniae R6
ucgugauguuaaaaugagu

SEQ ID NO: 4093324 - RNA, 16 nt, Streptococcus pneumoniae R6
ucgugcauuucauccc

SEQ ID NO: 4093325 - RNA, 13 nt, Streptococcus pneumoniae R6
ucgugccaaucuc

SEQ ID NO: 4093326 - RNA, 22 nt, Streptococcus pneumoniae R6
ucguggcgagggagaccggaga

SEQ ID NO: 4093327 - RNA, 21 nt, Streptococcus pneumoniae R6
ucguguaggggauaaugagga

SEQ ID NO: 4093328 - RNA, 16 nt, Streptococcus pneumoniae R6
ucguguugacuugggu

SEQ ID NO: 4093329 - RNA, 20 nt, Streptococcus pneumoniae R6
ucuaucucaccaggcauuau

SEQ ID NO: 4093330 - RNA, 15 nt, Streptococcus pneumoniae R6
ucuaucugcaaccuc

SEQ ID NO: 4093331 - RNA, 23 nt, Streptococcus pneumoniae R6
ucuaucugcaaccucaaaacagu

SEQ ID NO: 4093332 - RNA, 17 nt, Streptococcus pneumoniae R6
ucuaucugcaaccuuaa

SEQ ID NO: 4093333 - RNA, 20 nt, Streptococcus pneumoniae R6
ucuaucugcaaccuuaaaac

SEQ ID NO: 4093334 - RNA, 23 nt, Streptococcus pneumoniae R6
ucuaucugcaaccuuaaaacagu

SEQ ID NO: 4093335 - RNA, 23 nt, Streptococcus pneumoniae R6
ucuaucugccaccucaaaacggu

SEQ ID NO: 4093336 - RNA, 15 nt, Streptococcus pneumoniae R6
ucuaucuuaguaguu

SEQ ID NO: 4093337 - RNA, 18 nt, Streptococcus pneumoniae R6
ucuaucuucauuuugcac

SEQ ID NO: 4093338 - RNA, 20 nt, Streptococcus pneumoniae R6
ucuaucuucuugauacugau

SEQ ID NO: 4093339 - RNA, 13 nt, Streptococcus pneumoniae R6
ucuaugauaaaac

SEQ ID NO: 4093340 - RNA, 19 nt, Streptococcus pneumoniae R6
ucuaugauaggagcuaugu

SEQ ID NO: 4093341 - RNA, 21 nt, Streptococcus pneumoniae R6
ucuaugcuuuuauucagccaa

SEQ ID NO: 4093342 - RNA, 17 nt, Streptococcus pneumoniae R6
ucuauggcuuguucaau

SEQ ID NO: 4093343 - RNA, 14 nt, Streptococcus pneumoniae R6
ucuauuauauauau

SEQ ID NO: 4093344 - RNA, 14 nt, Streptococcus pneumoniae R6
ucuauuccaucucc

SEQ ID NO: 4093345 - RNA, 17 nt, Streptococcus pneumoniae R6
ucuauuccaucuccgau

SEQ ID NO: 4093346 - RNA, 14 nt, Streptococcus pneumoniae R6
ucuauucuuuccuu

SEQ ID NO: 4093347 - RNA, 15 nt, Streptococcus pneumoniae R6
ucuauugauuagucc

SEQ ID NO: 4093348 - RNA, 13 nt, Streptococcus pneumoniae R6
ucuauugcauaua

SEQ ID NO: 4093349 - RNA, 18 nt, Streptococcus pneumoniae R6
ucuauuguagaguggcuu

SEQ ID NO: 4093350 - RNA, 16 nt, Streptococcus pneumoniae R6
ucuauuguugcauuaa

SEQ ID NO: 4093351 - RNA, 21 nt, Streptococcus pneumoniae R6
ucuauuguugcauuaaaaagu

SEQ ID NO: 4093352 - RNA, 22 nt, Streptococcus pneumoniae R6
ucuauuuaagucaaagccaauc

SEQ ID NO: 4093353 - RNA, 22 nt, Streptococcus pneumoniae R6
ucuauuucuuuaaaaucaaagu

SEQ ID NO: 4093354 - RNA, 14 nt, Streptococcus pneumoniae R6
ucuauuuuaaaaau

SEQ ID NO: 4093355 - RNA, 16 nt, Streptococcus pneumoniae R6
ucuauuuucuuugauu

SEQ ID NO: 4093356 - RNA, 18 nt, Streptococcus pneumoniae R6
ucuauuuuugagcagaac

SEQ ID NO: 4093357 - RNA, 15 nt, Streptococcus pneumoniae R6
ucucaaaacaguguu

SEQ ID NO: 4093358 - RNA, 16 nt, Streptococcus pneumoniae R6
ucucaaaaguuagaaa

SEQ ID NO: 4093359 - RNA, 18 nt, Streptococcus pneumoniae R6
ucucaaaaguuagaaaua

SEQ ID NO: 4093360 - RNA, 20 nt, Streptococcus pneumoniae R6
ucucaaaaguuagaaauaaa

SEQ ID NO: 4093361 - RNA, 22 nt, Streptococcus pneumoniae R6
ucucaaaaguuagaaauaaaac

SEQ ID NO: 4093362 - RNA, 23 nt, Streptococcus pneumoniae R6
ucucaaaaguuagaaauaaaacu

SEQ ID NO: 4093363 - RNA, 16 nt, Streptococcus pneumoniae R6
ucucaaaaucaaagac

SEQ ID NO: 4093364 - RNA, 22 nt, Streptococcus pneumoniae R6
ucucaaaaucaaagacuuauac

SEQ ID NO: 4093365 - RNA, 21 nt, Streptococcus pneumoniae R6
ucucaaacagugcuagaaauu

SEQ ID NO: 4093366 - RNA, 15 nt, Streptococcus pneumoniae R6
ucucaaccuugcuuc

SEQ ID NO: 4093367 - RNA, 20 nt, Streptococcus pneumoniae R6
ucucaacgcgugauuuguug

SEQ ID NO: 4093368 - RNA, 21 nt, Streptococcus pneumoniae R6
ucucaacuuuuuuugauguac

SEQ ID NO: 4093369 - RNA, 18 nt, Streptococcus pneumoniae R6
ucucaaggagagcuuuua

SEQ ID NO: 4093370 - RNA, 19 nt, Streptococcus pneumoniae R6
ucucaauaggauuguacuc

SEQ ID NO: 4093371 - RNA, 19 nt, Streptococcus pneumoniae R6
ucucaaucaguuuuuucac

SEQ ID NO: 4093372 - RNA, 14 nt, Streptococcus pneumoniae R6
ucucaauuccuuau

SEQ ID NO: 4093373 - RNA, 20 nt, Streptococcus pneumoniae R6
ucucaauuucuauuuuaaaa

SEQ ID NO: 4093374 - RNA, 23 nt, Streptococcus pneumoniae R6
ucucaauuucuauuuuaaaaaua

SEQ ID NO: 4093375 - RNA, 18 nt, Streptococcus pneumoniae R6
ucucacguccuagcucuc

SEQ ID NO: 4093376 - RNA, 18 nt, Streptococcus pneumoniae R6
ucucacuaugauuagguu

SEQ ID NO: 4093377 - RNA, 14 nt, Streptococcus pneumoniae R6
ucucacuauucauc

SEQ ID NO: 4093378 - RNA, 19 nt, Streptococcus pneumoniae R6
ucucacuuaauucuucaua

SEQ ID NO: 4093379 - RNA, 15 nt, Streptococcus pneumoniae R6
ucucagaauaauauu

SEQ ID NO: 4093380 - RNA, 13 nt, Streptococcus pneumoniae R6
ucucagauaauaa

SEQ ID NO: 4093381 - RNA, 21 nt, Streptococcus pneumoniae R6
ucucagggucuuuguucugaa

SEQ ID NO: 4093382 - RNA, 12 nt, Streptococcus pneumoniae R6
ucucauagccau

SEQ ID NO: 4093383 - RNA, 18 nt, Streptococcus pneumoniae R6
ucucaucuauuuuuacuc

SEQ ID NO: 4093384 - RNA, 20 nt, Streptococcus pneumoniae R6
ucucauggcgaucauuauca

SEQ ID NO: 4093385 - RNA, 17 nt, Streptococcus pneumoniae R6
ucucauuugaugagaaa

SEQ ID NO: 4093386 - RNA, 22 nt, Streptococcus pneumoniae R6
ucuccaaaccauuuuuggcuga

SEQ ID NO: 4093387 - RNA, 13 nt, Streptococcus pneumoniae R6
ucuccacagaccu

SEQ ID NO: 4093388 - RNA, 14 nt, Streptococcus pneumoniae R6
ucuccacagaccug

SEQ ID NO: 4093389 - RNA, 22 nt, Streptococcus pneumoniae R6
ucuccacagaccuguccaacag

SEQ ID NO: 4093390 - RNA, 22 nt, Streptococcus pneumoniae R6
ucucccgcccuuuuuucucaau

SEQ ID NO: 4093391 - RNA, 14 nt, Streptococcus pneumoniae R6
ucucccguugucuu

SEQ ID NO: 4093392 - RNA, 14 nt, Streptococcus pneumoniae R6
ucuccgaagucaag

SEQ ID NO: 4093393 - RNA, 19 nt, Streptococcus pneumoniae R6
ucuccgaagucaagccucc

SEQ ID NO: 4093394 - RNA, 18 nt, Streptococcus pneumoniae R6
ucuccgcuuuuaucaaag

SEQ ID NO: 4093395 - RNA, 20 nt, Streptococcus pneumoniae R6
ucuccgcuuuuaucaaagac

SEQ ID NO: 4093396 - RNA, 21 nt, Streptococcus pneumoniae R6
ucuccguaaaagacacaugga

SEQ ID NO: 4093397 - RNA, 14 nt, Streptococcus pneumoniae R6
ucuccguuuuuaau

SEQ ID NO: 4093398 - RNA, 12 nt, Streptococcus pneumoniae R6
ucuccuaaaauu

SEQ ID NO: 4093399 - RNA, 23 nt, Streptococcus pneumoniae R6
ucuccuaaaauugacuuucuugu

SEQ ID NO: 4093400 - RNA, 16 nt, Streptococcus pneumoniae R6
ucuccuaaaauugugu

SEQ ID NO: 4093401 - RNA, 17 nt, Streptococcus pneumoniae R6
ucuccuaaaauuguguu

SEQ ID NO: 4093402 - RNA, 16 nt, Streptococcus pneumoniae R6
ucuccuagucuacaaa

SEQ ID NO: 4093403 - RNA, 16 nt, Streptococcus pneumoniae R6
ucuccuccauaaaaag

SEQ ID NO: 4093404 - RNA, 15 nt, Streptococcus pneumoniae R6
ucuccucuaccugcc

SEQ ID NO: 4093405 - RNA, 16 nt, Streptococcus pneumoniae R6
ucuccugggaaauucc

SEQ ID NO: 4093406 - RNA, 22 nt, Streptococcus pneumoniae R6
ucuccugugcuccauuuuuuaa

SEQ ID NO: 4093407 - RNA, 13 nt, Streptococcus pneumoniae R6
ucuccuguuucaa

SEQ ID NO: 4093408 - RNA, 14 nt, Streptococcus pneumoniae R6
ucuccuguuucaaa

SEQ ID NO: 4093409 - RNA, 16 nt, Streptococcus pneumoniae R6
ucuccuguuucaaagu

SEQ ID NO: 4093410 - RNA, 19 nt, Streptococcus pneumoniae R6
ucuccuguuucaaaguaau

SEQ ID NO: 4093411 - RNA, 20 nt, Streptococcus pneumoniae R6
ucucgagcuuagcuuuucuu

SEQ ID NO: 4093412 - RNA, 16 nt, Streptococcus pneumoniae R6
ucucggacuuuuucca

SEQ ID NO: 4093413 - RNA, 19 nt, Streptococcus pneumoniae R6
ucucggacuuuuuccaaau

SEQ ID NO: 4093414 - RNA, 20 nt, Streptococcus pneumoniae R6
ucucgugcauuucaucccca

SEQ ID NO: 4093415 - RNA, 20 nt, Streptococcus pneumoniae R6
ucucuaaaaauaaaaaagag

SEQ ID NO: 4093416 - RNA, 13 nt, Streptococcus pneumoniae R6
ucucuaaauaaau

SEQ ID NO: 4093417 - RNA, 16 nt, Streptococcus pneumoniae R6
ucucuaaaucuucuaa

SEQ ID NO: 4093418 - RNA, 17 nt, Streptococcus pneumoniae R6
ucucuaacaaugcuuua

SEQ ID NO: 4093419 - RNA, 15 nt, Streptococcus pneumoniae R6
ucucuaggaauauca

SEQ ID NO: 4093420 - RNA, 23 nt, Streptococcus pneumoniae R6
ucucuagucuggagauuuuucaa

SEQ ID NO: 4093421 - RNA, 16 nt, Streptococcus pneumoniae R6
ucucuauaauaacucc

SEQ ID NO: 4093422 - RNA, 21 nt, Streptococcus pneumoniae R6
ucucuauaauaacuccgaacu

SEQ ID NO: 4093423 - RNA, 15 nt, Streptococcus pneumoniae R6
ucucuaucucuuaaa

SEQ ID NO: 4093424 - RNA, 14 nt, Streptococcus pneumoniae R6
ucucuccuuaucaa

SEQ ID NO: 4093425 - RNA, 13 nt, Streptococcus pneumoniae R6
ucucucugauuuc

SEQ ID NO: 4093426 - RNA, 13 nt, Streptococcus pneumoniae R6
ucucugaaaacaa

SEQ ID NO: 4093427 - RNA, 22 nt, Streptococcus pneumoniae R6
ucucugaaaacaaguucuuuuc

SEQ ID NO: 4093428 - RNA, 23 nt, Streptococcus pneumoniae R6
ucucugagaccuuuauuggcugc

SEQ ID NO: 4093429 - RNA, 17 nt, Streptococcus pneumoniae R6
ucucugcaauuucuaau

SEQ ID NO: 4093430 - RNA, 15 nt, Streptococcus pneumoniae R6
ucucugcuauuucua

SEQ ID NO: 4093431 - RNA, 14 nt, Streptococcus pneumoniae R6
ucugucaugcgaua

SEQ ID NO: 4093432 - RNA, 22 nt, Streptococcus pneumoniae R6
ucugucgcaaggaugccagccu

SEQ ID NO: 4093433 - RNA, 15 nt, Streptococcus pneumoniae R6
ucugucuaacuuuug

SEQ ID NO: 4093434 - RNA, 14 nt, Streptococcus pneumoniae R6
ucugucuauuugcu

SEQ ID NO: 4093435 - RNA, 23 nt, Streptococcus pneumoniae R6
ucugucugcugacugauuuacaa

SEQ ID NO: 4093436 - RNA, 14 nt, Streptococcus pneumoniae R6
ucugugauuucagu

SEQ ID NO: 4093437 - RNA, 21 nt, Streptococcus pneumoniae R6
ucugugguaaugcuuuccauu

SEQ ID NO: 4093438 - RNA, 16 nt, Streptococcus pneumoniae R6
ucuguguguuuaugcu

SEQ ID NO: 4093439 - RNA, 12 nt, Streptococcus pneumoniae R6
ucuguuaaaaaa

SEQ ID NO: 4093440 - RNA, 16 nt, Streptococcus pneumoniae R6
ucuguuaaaaaauaau

SEQ ID NO: 4093441 - RNA, 23 nt, Streptococcus pneumoniae R6
ucuguuaccacaggagcuggauc

SEQ ID NO: 4093442 - RNA, 14 nt, Streptococcus pneumoniae R6
ucuguucuauaaaa

SEQ ID NO: 4093443 - RNA, 17 nt, Streptococcus pneumoniae R6
ucuguuuggcaagugcc

SEQ ID NO: 4093444 - RNA, 20 nt, Streptococcus pneumoniae R6
ucuguuuggcaagugccuuc

SEQ ID NO: 4093445 - RNA, 18 nt, Streptococcus pneumoniae R6
ucuguuuuugaagaaaag

SEQ ID NO: 4093446 - RNA, 24 nt, Streptococcus pneumoniae R6
ucuuaagacaccuguuacaguugc

SEQ ID NO: 4093447 - RNA, 21 nt, Streptococcus pneumoniae R6
ucuuaaugucagucugguucc

SEQ ID NO: 4093448 - RNA, 23 nt, Streptococcus pneumoniae R6
ucuuaauucucuuauuguuguaa

SEQ ID NO: 4093449 - RNA, 22 nt, Streptococcus pneumoniae R6
ucuuacuguccuucuuuuacuu

SEQ ID NO: 4093450 - RNA, 13 nt, Streptococcus pneumoniae R6
ucuuacuuuuaau

SEQ ID NO: 4093451 - RNA, 15 nt, Streptococcus pneumoniae R6
ucuuagcaauucuaa

SEQ ID NO: 4093452 - RNA, 17 nt, Streptococcus pneumoniae R6
ucuuauacuuuucucuu

SEQ ID NO: 4093453 - RNA, 15 nt, Streptococcus pneumoniae R6
ucuuauauuaaaaaa

SEQ ID NO: 4093454 - RNA, 15 nt, Streptococcus pneumoniae R6
ucuuaucaaaucccu

SEQ ID NO: 4093455 - RNA, 15 nt, Streptococcus pneumoniae R6
ucuuaucaaucaaac

SEQ ID NO: 4093456 - RNA, 21 nt, Streptococcus pneumoniae R6
ucuuaucacccaaaacuucug

SEQ ID NO: 4093457 - RNA, 17 nt, Streptococcus pneumoniae R6
ucuuauccagaaauuga

SEQ ID NO: 4093458 - RNA, 17 nt, Streptococcus pneumoniae R6
ucuuauccuugucaugc

SEQ ID NO: 4093459 - RNA, 13 nt, Streptococcus pneumoniae R6
ucuuaucuaaaac

SEQ ID NO: 4093460 - RNA, 23 nt, Streptococcus pneumoniae R6
ucuuaucuggguuccagaugaag

SEQ ID NO: 4093461 - RNA, 14 nt, Streptococcus pneumoniae R6
ucuuauuauucucu

SEQ ID NO: 4093462 - RNA, 14 nt, Streptococcus pneumoniae R6
ucuuauugauuuuu

SEQ ID NO: 4093463 - RNA, 19 nt, Streptococcus pneumoniae R6
ucuuauuucaaaaaaugua

SEQ ID NO: 4093464 - RNA, 18 nt, Streptococcus pneumoniae R6
ucuuauuucauuucacua

SEQ ID NO: 4093465 - RNA, 19 nt, Streptococcus pneumoniae R6
ucuuauuucauuuuaauau

SEQ ID NO: 4093466 - RNA, 18 nt, Streptococcus pneumoniae R6
ucuuauuucauuuuacua

SEQ ID NO: 4093467 - RNA, 15 nt, Streptococcus pneumoniae R6
ucuucaaaaaagugu

SEQ ID NO: 4093468 - RNA, 20 nt, Streptococcus pneumoniae R6
ucuucaaaccacgucagcuu

SEQ ID NO: 4093469 - RNA, 20 nt, Streptococcus pneumoniae R6
ucuucaaacuacgucagcuu

SEQ ID NO: 4093470 - RNA, 16 nt, Streptococcus pneumoniae R6
ucuucaaagaagucca

SEQ ID NO: 4093471 - RNA, 13 nt, Streptococcus pneumoniae R6
ucuucaaauuuuu

SEQ ID NO: 4093472 - RNA, 16 nt, Streptococcus pneumoniae R6
ucuucaaauuuuucau

SEQ ID NO: 4093473 - RNA, 22 nt, Streptococcus pneumoniae R6
ucuucaaauuuuucauaauuuu

SEQ ID NO: 4093474 - RNA, 14 nt, Streptococcus pneumoniae R6
ucuucaacccacua

SEQ ID NO: 4093475 - RNA, 21 nt, Streptococcus pneumoniae R6
ucuucaacccacuacaguuga

SEQ ID NO: 4093476 - RNA, 16 nt, Streptococcus pneumoniae R6
ucuucaauaccaaaga

SEQ ID NO: 4093477 - RNA, 21 nt, Streptococcus pneumoniae R6
ucuucaauaccaaagaaguca

SEQ ID NO: 4093478 - RNA, 22 nt, Streptococcus pneumoniae R6
ucuucaaucaaagcucccaaau

SEQ ID NO: 4093479 - RNA, 13 nt, Streptococcus pneumoniae R6
ucuucacucuuca

SEQ ID NO: 4093480 - RNA, 23 nt, Streptococcus pneumoniae R6
ucuucagauucagcuaaaauguu

SEQ ID NO: 4093481 - RNA, 23 nt, Streptococcus pneumoniae R6
ucuucaggauugauaaaauuuaa

SEQ ID NO: 4093482 - RNA, 16 nt, Streptococcus pneumoniae R6
ucuucaguauaaacug

SEQ ID NO: 4093483 - RNA, 12 nt, Streptococcus pneumoniae R6
ucuucaguuccc

SEQ ID NO: 4093484 - RNA, 19 nt, Streptococcus pneumoniae R6
ucuucaugcuggcagaaac

SEQ ID NO: 4093485 - RNA, 13 nt, Streptococcus pneumoniae R6
ucuucauggacuu

SEQ ID NO: 4093486 - RNA, 18 nt, Streptococcus pneumoniae R6
ucuucauggacuuuuuug

SEQ ID NO: 4093487 - RNA, 21 nt, Streptococcus pneumoniae R6
ucuucauguggcuaucuguca

SEQ ID NO: 4093488 - RNA, 23 nt, Streptococcus pneumoniae R6
ucuucauuggacaaguuagccac

SEQ ID NO: 4093489 - RNA, 21 nt, Streptococcus pneumoniae R6
ucuuccaaaguucgaaaggcu

SEQ ID NO: 4093490 - RNA, 18 nt, Streptococcus pneumoniae R6
ucuuccaacucuuccuua

SEQ ID NO: 4093491 - RNA, 14 nt, Streptococcus pneumoniae R6
ucuuccaagaccug

SEQ ID NO: 4093492 - RNA, 13 nt, Streptococcus pneumoniae R6
ucuuccaauuucu

SEQ ID NO: 4093493 - RNA, 18 nt, Streptococcus pneumoniae R6
ucuuccaguuuauaacuu

SEQ ID NO: 4093494 - RNA, 16 nt, Streptococcus pneumoniae R6
ucuuccauaucugcuu

SEQ ID NO: 4093495 - RNA, 14 nt, Streptococcus pneumoniae R6
ucuuccauuucuuu

SEQ ID NO: 4093496 - RNA, 16 nt, Streptococcus pneumoniae R6
ucuucccguagguuuu

SEQ ID NO: 4093497 - RNA, 19 nt, Streptococcus pneumoniae R6
ucuucccguagguuuucuc

SEQ ID NO: 4093498 - RNA, 20 nt, Streptococcus pneumoniae R6
ucuucccguagguuuucucc

SEQ ID NO: 4093499 - RNA, 20 nt, Streptococcus pneumoniae R6
ucuuccgaauaacucaaaag

SEQ ID NO: 4093500 - RNA, 19 nt, Streptococcus pneumoniae R6
ucuuccuacauauguaaga

SEQ ID NO: 4093501 - RNA, 23 nt, Streptococcus pneumoniae R6
ucuuccuucuucguuucgucauu

SEQ ID NO: 4093502 - RNA, 15 nt, Streptococcus pneumoniae R6
ucuuccuuucucugu

SEQ ID NO: 4093503 - RNA, 15 nt, Streptococcus pneumoniae R6
ucuucgaaaaucucu

SEQ ID NO: 4093504 - RNA, 16 nt, Streptococcus pneumoniae R6
ucuucgaaaaucucuu

SEQ ID NO: 4093505 - RNA, 18 nt, Streptococcus pneumoniae R6
ucuucgaaauuccauacc

SEQ ID NO: 4093506 - RNA, 22 nt, Streptococcus pneumoniae R6
ucuucgaaauuccauaccuaaa

SEQ ID NO: 4093507 - RNA, 17 nt, Streptococcus pneumoniae R6
ucuucgacaguaaaaua

SEQ ID NO: 4093508 - RNA, 17 nt, Streptococcus pneumoniae R6
ucuucgcuuucuucauu

SEQ ID NO: 4093509 - RNA, 20 nt, Streptococcus pneumoniae R6
ucuucgcuuucuucauuuug

SEQ ID NO: 4093510 - RNA, 19 nt, Streptococcus pneumoniae R6
ucuucggagaagaaaacag

SEQ ID NO: 4093511 - RNA, 16 nt, Streptococcus pneumoniae R6
ucuucggauuuuucuu

SEQ ID NO: 4093512 - RNA, 16 nt, Streptococcus pneumoniae R6
ucuucgguuaggaugu

SEQ ID NO: 4093513 - RNA, 21 nt, Streptococcus pneumoniae R6
ucuucgguuaggauguaggau

SEQ ID NO: 4093514 - RNA, 23 nt, Streptococcus pneumoniae R6
ucuucgguuaggauguaggauug

SEQ ID NO: 4093515 - RNA, 14 nt, Streptococcus pneumoniae R6
ucuucguccagacg

SEQ ID NO: 4093516 - RNA, 23 nt, Streptococcus pneumoniae R6
ucuucguuucgucauuccaauca

SEQ ID NO: 4093517 - RNA, 17 nt, Streptococcus pneumoniae R6
ucuucuaguugguuucc

SEQ ID NO: 4093518 - RNA, 15 nt, Streptococcus pneumoniae R6
ucuucuaucuucuug

SEQ ID NO: 4093519 - RNA, 14 nt, Streptococcus pneumoniae R6
ucuucucagcuagu

SEQ ID NO: 4093520 - RNA, 20 nt, Streptococcus pneumoniae R6
ucuucuccaaaccauuuuug

SEQ ID NO: 4093521 - RNA, 21 nt, Streptococcus pneumoniae R6
ucuucuccaaaccauuuuugg

SEQ ID NO: 4093522 - RNA, 23 nt, Streptococcus pneumoniae R6
ucuucuccaaaccauuuuuggcu

SEQ ID NO: 4093523 - RNA, 13 nt, Streptococcus pneumoniae R6
ucuucuccaguuu

SEQ ID NO: 4093524 - RNA, 20 nt, Streptococcus pneumoniae R6
ucuucuccgaagacuuuaaa

SEQ ID NO: 4093525 - RNA, 24 nt, Streptococcus pneumoniae R6
ucuucuccgugaacaaguguaaca

SEQ ID NO: 4093526 - RNA, 17 nt, Streptococcus pneumoniae R6
ucuucucgauucccuga

SEQ ID NO: 4093527 - RNA, 14 nt, Streptococcus pneumoniae R6
ucuucucuuuucuu

SEQ ID NO: 4093528 - RNA, 16 nt, Streptococcus pneumoniae R6
ucuucucuuuucuuau

SEQ ID NO: 4093529 - RNA, 20 nt, Streptococcus pneumoniae R6
ucuucugggagaaauuccuu

SEQ ID NO: 4093530 - RNA, 23 nt, Streptococcus pneumoniae R6
ucuucuguaccaauacuacaaua

SEQ ID NO: 4093531 - RNA, 13 nt, Streptococcus pneumoniae R6
ucuucuguuucug

SEQ ID NO: 4093532 - RNA, 11 nt, Streptococcus pneumoniae R6
ucuucuuccau

SEQ ID NO: 4093533 - RNA, 20 nt, Streptococcus pneumoniae R6
ucuuuuuaaauaaaucucug

SEQ ID NO: 4093534 - RNA, 12 nt, Streptococcus pneumoniae R6
ucuuuuuacuua

SEQ ID NO: 4093535 - RNA, 17 nt, Streptococcus pneumoniae R6
ucuuuuucagaacuuuu

SEQ ID NO: 4093536 - RNA, 15 nt, Streptococcus pneumoniae R6
ucuuuuucauaacuu

SEQ ID NO: 4093537 - RNA, 23 nt, Streptococcus pneumoniae R6
ucuuuuuccaagaucuuuuuaua

SEQ ID NO: 4093538 - RNA, 12 nt, Streptococcus pneumoniae R6
ucuuuuuccuaa

SEQ ID NO: 4093539 - RNA, 17 nt, Streptococcus pneumoniae R6
ucuuuuuccuaauaguu

SEQ ID NO: 4093540 - RNA, 11 nt, Streptococcus pneumoniae R6
ucuuuuucgcu

SEQ ID NO: 4093541 - RNA, 13 nt, Streptococcus pneumoniae R6
ucuuuuuguauca

SEQ ID NO: 4093542 - RNA, 18 nt, Streptococcus pneumoniae R6
ucuuuuuguauuucuucu

SEQ ID NO: 4093543 - RNA, 14 nt, Streptococcus pneumoniae R6
ucuuuuuuagcucu

SEQ ID NO: 4093544 - RNA, 13 nt, Streptococcus pneumoniae R6
ucuuuuuuuacua

SEQ ID NO: 4093545 - RNA, 19 nt, Streptococcus pneumoniae R6
ugaaaaaaacaauaaaucu

SEQ ID NO: 4093546 - RNA, 16 nt, Streptococcus pneumoniae R6
ugaaaaaaacugguuc

SEQ ID NO: 4093547 - RNA, 19 nt, Streptococcus pneumoniae R6
ugaaaaaaauuagaaaaag

SEQ ID NO: 4093548 - RNA, 12 nt, Streptococcus pneumoniae R6
ugaaaaaaugga

SEQ ID NO: 4093549 - RNA, 22 nt, Streptococcus pneumoniae R6
ugaaaaacuagaauagaaacaa

SEQ ID NO: 4093550 - RNA, 13 nt, Streptococcus pneumoniae R6
ugaaaaaguaaga

SEQ ID NO: 4093551 - RNA, 23 nt, Streptococcus pneumoniae R6
ugaaaacaauauuuuugagccuu

SEQ ID NO: 4093552 - RNA, 20 nt, Streptococcus pneumoniae R6
ugaaaacaggaguucuuuua

SEQ ID NO: 4093553 - RNA, 21 nt, Streptococcus pneumoniae R6
ugaaaacgguaacaaaacuaa

SEQ ID NO: 4093554 - RNA, 20 nt, Streptococcus pneumoniae R6
ugaaaacugaacaagacgaa

SEQ ID NO: 4093555 - RNA, 21 nt, Streptococcus pneumoniae R6
ugaaaagaacuccagugaaaa

SEQ ID NO: 4093556 - RNA, 17 nt, Streptococcus pneumoniae R6
ugaaaauaccaaguuca

SEQ ID NO: 4093557 - RNA, 19 nt, Streptococcus pneumoniae R6
ugaaaauaccaaguucauu

SEQ ID NO: 4093558 - RNA, 20 nt, Streptococcus pneumoniae R6
ugaaaauaccaaguucauuu

SEQ ID NO: 4093559 - RNA, 17 nt, Streptococcus pneumoniae R6
ugaaaaucaaagaguaa

SEQ ID NO: 4093560 - RNA, 22 nt, Streptococcus pneumoniae R6
ugaaaaucauagagcaaacuag

SEQ ID NO: 4093561 - RNA, 23 nt, Streptococcus pneumoniae R6
ugaaaaucaucugcaucaagaac

SEQ ID NO: 4093562 - RNA, 23 nt, Streptococcus pneumoniae R6
ugaaaaugaauuugaaacaauga

SEQ ID NO: 4093563 - RNA, 14 nt, Streptococcus pneumoniae R6
ugaaaaugugaaau

SEQ ID NO: 4093564 - RNA, 19 nt, Streptococcus pneumoniae R6
ugaaaauucacaaaauccu

SEQ ID NO: 4093565 - RNA, 15 nt, Streptococcus pneumoniae R6
ugaaaauuuccauug

SEQ ID NO: 4093566 - RNA, 15 nt, Streptococcus pneumoniae R6
ugaaaauuuuuccca

SEQ ID NO: 4093567 - RNA, 19 nt, Streptococcus pneumoniae R6
ugaaacaaaaacaggacaa

SEQ ID NO: 4093568 - RNA, 17 nt, Streptococcus pneumoniae R6
ugaaacaaauaaaucau

SEQ ID NO: 4093569 - RNA, 15 nt, Streptococcus pneumoniae R6
ugaaacaagaacaag

SEQ ID NO: 4093570 - RNA, 16 nt, Streptococcus pneumoniae R6
ugaaacaagaacaaga

SEQ ID NO: 4093571 - RNA, 20 nt, Streptococcus pneumoniae R6
ugaaacaagaacaagacaaa

SEQ ID NO: 4093572 - RNA, 18 nt, Streptococcus pneumoniae R6
ugaaacacugauuucaag

SEQ ID NO: 4093573 - RNA, 22 nt, Streptococcus pneumoniae R6
ugaaacagcaagagcugauagu

SEQ ID NO: 4093574 - RNA, 13 nt, Streptococcus pneumoniae R6
ugaaaccccaaga

SEQ ID NO: 4093575 - RNA, 21 nt, Streptococcus pneumoniae R6
ugaaaccccaagaaacaacaa

SEQ ID NO: 4093576 - RNA, 17 nt, Streptococcus pneumoniae R6
ugaaacccuugauuuuu

SEQ ID NO: 4093577 - RNA, 22 nt, Streptococcus pneumoniae R6
ugaaacccuugauuuuuuccua

SEQ ID NO: 4093578 - RNA, 13 nt, Streptococcus pneumoniae R6
ugaaacuaaauuc

SEQ ID NO: 4093579 - RNA, 21 nt, Streptococcus pneumoniae R6
ugaaacuaagcuucaaaaaag

SEQ ID NO: 4093580 - RNA, 22 nt, Streptococcus pneumoniae R6
ugaaacuaauagguacaaaaau

SEQ ID NO: 4093581 - RNA, 22 nt, Streptococcus pneumoniae R6
ugaaacuagaauaggacaucau

SEQ ID NO: 4093582 - RNA, 23 nt, Streptococcus pneumoniae R6
ugaaacuagaauaguacacuucu

SEQ ID NO: 4093583 - RNA, 20 nt, Streptococcus pneumoniae R6
ugaaacugacgaagucagcu

SEQ ID NO: 4093584 - RNA, 20 nt, Streptococcus pneumoniae R6
ugaaacugacgaagucagua

SEQ ID NO: 4093585 - RNA, 18 nt, Streptococcus pneumoniae R6
ugaaacuggaauaguaca

SEQ ID NO: 4093586 - RNA, 15 nt, Streptococcus pneumoniae R6
ugaaacuguggaaaa

SEQ ID NO: 4093587 - RNA, 19 nt, Streptococcus pneumoniae R6
ugaaacuguggaaaauaga

SEQ ID NO: 4093588 - RNA, 23 nt, Streptococcus pneumoniae R6
ugaaacuguggaaaauagaaaaa

SEQ ID NO: 4093589 - RNA, 17 nt, Streptococcus pneumoniae R6
ugaaagaaacucuaaac

SEQ ID NO: 4093590 - RNA, 15 nt, Streptococcus pneumoniae R6
ugaaagcucuucuaa

SEQ ID NO: 4093591 - RNA, 14 nt, Streptococcus pneumoniae R6
ugaaaggaaaauga

SEQ ID NO: 4093592 - RNA, 21 nt, Streptococcus pneumoniae R6
ugaaaggaaagcauaggggcu

SEQ ID NO: 4093593 - RNA, 13 nt, Streptococcus pneumoniae R6
ugaaaggaaauaa

SEQ ID NO: 4093594 - RNA, 16 nt, Streptococcus pneumoniae R6
ugaaaggauuucucua

SEQ ID NO: 4093595 - RNA, 17 nt, Streptococcus pneumoniae R6
ugaaaggguagugaaag

SEQ ID NO: 4093596 - RNA, 20 nt, Streptococcus pneumoniae R6
ugaaagugagaagcccagua

SEQ ID NO: 4093597 - RNA, 19 nt, Streptococcus pneumoniae R6
ugaaagugggcugauuuug

SEQ ID NO: 4093598 - RNA, 16 nt, Streptococcus pneumoniae R6
ugaaauaaaauuugaa

SEQ ID NO: 4093599 - RNA, 21 nt, Streptococcus pneumoniae R6
ugaaauaaaauuugaacaaau

SEQ ID NO: 4093600 - RNA, 19 nt, Streptococcus pneumoniae R6
ugaaauaacccaccaaguc

SEQ ID NO: 4093601 - RNA, 19 nt, Streptococcus pneumoniae R6
ugaaauaacucauaauagu

SEQ ID NO: 4093602 - RNA, 13 nt, Streptococcus pneumoniae R6
ugaaauaagauau

SEQ ID NO: 4093603 - RNA, 19 nt, Streptococcus pneumoniae R6
ugaaauaagaugagaacaa

SEQ ID NO: 4093604 - RNA, 21 nt, Streptococcus pneumoniae R6
ugaaauaagggcaaagaaaag

SEQ ID NO: 4093605 - RNA, 14 nt, Streptococcus pneumoniae R6
ugaaauaauacuca

SEQ ID NO: 4093606 - RNA, 17 nt, Streptococcus pneumoniae R6
ugaaauacuaaaaaaaa

SEQ ID NO: 4093607 - RNA, 22 nt, Streptococcus pneumoniae R6
ugaaauacuaaaaaaaaaaagu

SEQ ID NO: 4093608 - RNA, 20 nt, Streptococcus pneumoniae R6
ugaaauacugauguaacugu

SEQ ID NO: 4093609 - RNA, 19 nt, Streptococcus pneumoniae R6
ugaaauaguacgaaacaau

SEQ ID NO: 4093610 - RNA, 22 nt, Streptococcus pneumoniae R6
ugaaauauuuuuuacuuuugca

SEQ ID NO: 4093611 - RNA, 17 nt, Streptococcus pneumoniae R6
ugaaaucaaggcaguga

SEQ ID NO: 4093612 - RNA, 14 nt, Streptococcus pneumoniae R6
ugaaaucagaaaaa

SEQ ID NO: 4093613 - RNA, 17 nt, Streptococcus pneumoniae R6
ugaaaucagaaaaaacg

SEQ ID NO: 4093614 - RNA, 17 nt, Streptococcus pneumoniae R6
ugaaaucccauaguagu

SEQ ID NO: 4093615 - RNA, 21 nt, Streptococcus pneumoniae R6
ugaaaucugcucaaucuuauc

SEQ ID NO: 4093616 - RNA, 18 nt, Streptococcus pneumoniae R6
ugaaaucuuuuugauaca

SEQ ID NO: 4093617 - RNA, 12 nt, Streptococcus pneumoniae R6
ugaaaugaaaua

SEQ ID NO: 4093618 - RNA, 13 nt, Streptococcus pneumoniae R6
ugaaaugaaauaa

SEQ ID NO: 4093619 - RNA, 17 nt, Streptococcus pneumoniae R6
ugaaaugucuauuuucu

SEQ ID NO: 4093620 - RNA, 17 nt, Streptococcus pneumoniae R6
ugaaauguuccaagucc

SEQ ID NO: 4093621 - RNA, 17 nt, Streptococcus pneumoniae R6
ugaaauucgcuuuuuua

SEQ ID NO: 4093622 - RNA, 22 nt, Streptococcus pneumoniae R6
ugaaauucgcuuuuuuaaaugc

SEQ ID NO: 4093623 - RNA, 20 nt, Streptococcus pneumoniae R6
ugaaauugagucuuuuucca

SEQ ID NO: 4093624 - RNA, 14 nt, Streptococcus pneumoniae R6
ugaaauuuaaaaag

SEQ ID NO: 4093625 - RNA, 15 nt, Streptococcus pneumoniae R6
ugaaauuuaaaaaga

SEQ ID NO: 4093626 - RNA, 17 nt, Streptococcus pneumoniae R6
ugaaauuuaucaaccac

SEQ ID NO: 4093627 - RNA, 13 nt, Streptococcus pneumoniae R6
ugaacaaauuaau

SEQ ID NO: 4093628 - RNA, 20 nt, Streptococcus pneumoniae R6
ugaacaaauuaauucggaaa

SEQ ID NO: 4093629 - RNA, 15 nt, Streptococcus pneumoniae R6
ugaacaaauugauaa

SEQ ID NO: 4093630 - RNA, 15 nt, Streptococcus pneumoniae R6
ugaacaaugaaaaaa

SEQ ID NO: 4093631 - RNA, 16 nt, Streptococcus pneumoniae R6
ugaacaaugaaaaaaa

SEQ ID NO: 4093632 - RNA, 20 nt, Streptococcus pneumoniae R6
ugaacaaugguaacagucuu

SEQ ID NO: 4093633 - RNA, 17 nt, Streptococcus pneumoniae R6
ugaacagcuugagauuu

SEQ ID NO: 4093634 - RNA, 19 nt, Streptococcus pneumoniae R6
ugaacaucucuaucaggaa

SEQ ID NO: 4093635 - RNA, 13 nt, Streptococcus pneumoniae R6
ugacaaauucucc

SEQ ID NO: 4093636 - RNA, 15 nt, Streptococcus pneumoniae R6
ugacaaauucuccac

SEQ ID NO: 4093637 - RNA, 20 nt, Streptococcus pneumoniae R6
ugacaacaagggcguuaccu

SEQ ID NO: 4093638 - RNA, 17 nt, Streptococcus pneumoniae R6
ugacaaguaaguagcau

SEQ ID NO: 4093639 - RNA, 14 nt, Streptococcus pneumoniae R6
ugacaagugaaagu

SEQ ID NO: 4093640 - RNA, 18 nt, Streptococcus pneumoniae R6
ugacaaucauuucaguug

SEQ ID NO: 4093641 - RNA, 22 nt, Streptococcus pneumoniae R6
ugacaauccacggcucaugaga

SEQ ID NO: 4093642 - RNA, 14 nt, Streptococcus pneumoniae R6
ugacaaucuuuuua

SEQ ID NO: 4093643 - RNA, 15 nt, Streptococcus pneumoniae R6
ugacaauguaccugc

SEQ ID NO: 4093644 - RNA, 21 nt, Streptococcus pneumoniae R6
ugacaauuaagguuuuaccuu

SEQ ID NO: 4093645 - RNA, 15 nt, Streptococcus pneumoniae R6
ugacaauuauauaaa

SEQ ID NO: 4093646 - RNA, 21 nt, Streptococcus pneumoniae R6
ugacaauuuaaccaaaccaac

SEQ ID NO: 4093647 - RNA, 19 nt, Streptococcus pneumoniae R6
ugacaauuuuuccagcuuu

SEQ ID NO: 4093648 - RNA, 20 nt, Streptococcus pneumoniae R6
ugacaccacuuuuggucaga

SEQ ID NO: 4093649 - RNA, 14 nt, Streptococcus pneumoniae R6
ugacagaaaugagu

SEQ ID NO: 4093650 - RNA, 19 nt, Streptococcus pneumoniae R6
ugacagaaaugaguaagaa

SEQ ID NO: 4093651 - RNA, 17 nt, Streptococcus pneumoniae R6
ugacagaaccuuggaaa

SEQ ID NO: 4093652 - RNA, 19 nt, Streptococcus pneumoniae R6
ugacagagcuugaagcuau

SEQ ID NO: 4093653 - RNA, 15 nt, Streptococcus pneumoniae R6
ugacagauucaucac

SEQ ID NO: 4093654 - RNA, 21 nt, Streptococcus pneumoniae R6
ugacagcaucgacaaaggauu

SEQ ID NO: 4093655 - RNA, 16 nt, Streptococcus pneumoniae R6
ugacagccucaaugau

SEQ ID NO: 4093656 - RNA, 21 nt, Streptococcus pneumoniae R6
ugacagucgcaaagaggaaga

SEQ ID NO: 4093657 - RNA, 20 nt, Streptococcus pneumoniae R6
ugacauacaacuuaaaaaga

SEQ ID NO: 4093658 - RNA, 23 nt, Streptococcus pneumoniae R6
ugacauacaacuuaaaaagaggu

SEQ ID NO: 4093659 - RNA, 18 nt, Streptococcus pneumoniae R6
ugacauaccaccaaguac

SEQ ID NO: 4093660 - RNA, 15 nt, Streptococcus pneumoniae R6
ugacauaugauuguc

SEQ ID NO: 4093661 - RNA, 16 nt, Streptococcus pneumoniae R6
ugacaugcuccucugu

SEQ ID NO: 4093662 - RNA, 17 nt, Streptococcus pneumoniae R6
ugacaugcuccucugua

SEQ ID NO: 4093663 - RNA, 18 nt, Streptococcus pneumoniae R6
ugacaugcuccucuguau

SEQ ID NO: 4093664 - RNA, 15 nt, Streptococcus pneumoniae R6
ugacauucuuuagcu

SEQ ID NO: 4093665 - RNA, 19 nt, Streptococcus pneumoniae R6
ugaccaacuuuaagagcuu

SEQ ID NO: 4093666 - RNA, 15 nt, Streptococcus pneumoniae R6
ugaccaccauuuuua

SEQ ID NO: 4093667 - RNA, 15 nt, Streptococcus pneumoniae R6
ugaccacucugcgac

SEQ ID NO: 4093668 - RNA, 14 nt, Streptococcus pneumoniae R6
ugaccagugauaac

SEQ ID NO: 4093669 - RNA, 13 nt, Streptococcus pneumoniae R6
ugaccggcuuccu

SEQ ID NO: 4093670 - RNA, 14 nt, Streptococcus pneumoniae R6
ugaccguugacuuc

SEQ ID NO: 4093671 - RNA, 17 nt, Streptococcus pneumoniae R6
ugaccuguuuucacauu

SEQ ID NO: 4093672 - RNA, 21 nt, Streptococcus pneumoniae R6
ugaccuguuuucacauuuuca

SEQ ID NO: 4093673 - RNA, 19 nt, Streptococcus pneumoniae R6
ugaccuuaucuauagcuuu

SEQ ID NO: 4093674 - RNA, 18 nt, Streptococcus pneumoniae R6
ugaccuugaugaucuaaa

SEQ ID NO: 4093675 - RNA, 16 nt, Streptococcus pneumoniae R6
ugacgaagaaaccaag

SEQ ID NO: 4093676 - RNA, 22 nt, Streptococcus pneumoniae R6
ugacgaagucagcucaaaacac

SEQ ID NO: 4093677 - RNA, 20 nt, Streptococcus pneumoniae R6
ugacgagagugauaacauaa

SEQ ID NO: 4093678 - RNA, 16 nt, Streptococcus pneumoniae R6
ugacgagugaagaauu

SEQ ID NO: 4093679 - RNA, 15 nt, Streptococcus pneumoniae R6
ugacgauuuucucuu

SEQ ID NO: 4093680 - RNA, 19 nt, Streptococcus pneumoniae R6
ugacgauuuucucuuuauc

SEQ ID NO: 4093681 - RNA, 19 nt, Streptococcus pneumoniae R6
ugacgcauaguugcauuaa

SEQ ID NO: 4093682 - RNA, 16 nt, Streptococcus pneumoniae R6
ugacgcgguuugaaga

SEQ ID NO: 4093683 - RNA, 19 nt, Streptococcus pneumoniae R6
ugacgcuggaaauaagaau

SEQ ID NO: 4093684 - RNA, 15 nt, Streptococcus pneumoniae R6
ugacgucguaaccag

SEQ ID NO: 4093685 - RNA, 21 nt, Streptococcus pneumoniae R6
ugacuaaaaacucuucuuuug

SEQ ID NO: 4093686 - RNA, 18 nt, Streptococcus pneumoniae R6
ugacuaacccuucuuuuu

SEQ ID NO: 4093687 - RNA, 13 nt, Streptococcus pneumoniae R6
ugacuagugaagc

SEQ ID NO: 4093688 - RNA, 14 nt, Streptococcus pneumoniae R6
ugacuauauuucua

SEQ ID NO: 4093689 - RNA, 20 nt, Streptococcus pneumoniae R6
ugacuauauuucuauacuuu

SEQ ID NO: 4093690 - RNA, 23 nt, Streptococcus pneumoniae R6
ugacuauauuucuauacuuuuuc

SEQ ID NO: 4093691 - RNA, 14 nt, Streptococcus pneumoniae R6
ugacuauauuucuu

SEQ ID NO: 4093692 - RNA, 16 nt, Streptococcus pneumoniae R6
ugacucagcuucugcu

SEQ ID NO: 4093693 - RNA, 17 nt, Streptococcus pneumoniae R6
ugacucagcuucugcuu

SEQ ID NO: 4093694 - RNA, 18 nt, Streptococcus pneumoniae R6
ugacucagcuucugcuug

SEQ ID NO: 4093695 - RNA, 16 nt, Streptococcus pneumoniae R6
ugacucccauaaaaau

SEQ ID NO: 4093696 - RNA, 17 nt, Streptococcus pneumoniae R6
ugacuccccauuuacca

SEQ ID NO: 4093697 - RNA, 19 nt, Streptococcus pneumoniae R6
ugacucggccuucuuuuua

SEQ ID NO: 4093698 - RNA, 19 nt, Streptococcus pneumoniae R6
ugacucgucacuugccucu

SEQ ID NO: 4093699 - RNA, 22 nt, Streptococcus pneumoniae R6
ugacucuccuuagucucaaaau

SEQ ID NO: 4093700 - RNA, 17 nt, Streptococcus pneumoniae R6
ugacugacuucgucagu

SEQ ID NO: 4093701 - RNA, 12 nt, Streptococcus pneumoniae R6
ugacugagagcu

SEQ ID NO: 4093702 - RNA, 23 nt, Streptococcus pneumoniae R6
ugacugcaucagaugggucaaga

SEQ ID NO: 4093703 - RNA, 14 nt, Streptococcus pneumoniae R6
ugacugucaauaua

SEQ ID NO: 4093704 - RNA, 20 nt, Streptococcus pneumoniae R6
ugacuguguuugagacuggc

SEQ ID NO: 4093705 - RNA, 20 nt, Streptococcus pneumoniae R6
ugacuguugucacauagacu

SEQ ID NO: 4093706 - RNA, 23 nt, Streptococcus pneumoniae R6
ugacuuagccauguuuuucuccu

SEQ ID NO: 4093707 - RNA, 13 nt, Streptococcus pneumoniae R6
ugacuucagcucc

SEQ ID NO: 4093708 - RNA, 12 nt, Streptococcus pneumoniae R6
ugacuucgucag

SEQ ID NO: 4093709 - RNA, 17 nt, Streptococcus pneumoniae R6
ugacuucgucaguucua

SEQ ID NO: 4093710 - RNA, 18 nt, Streptococcus pneumoniae R6
ugacuucgucaguucuau

SEQ ID NO: 4093711 - RNA, 20 nt, Streptococcus pneumoniae R6
ugacuucgucaguuucaucc

SEQ ID NO: 4093712 - RNA, 22 nt, Streptococcus pneumoniae R6
ugacuucuguaagucauuuucu

SEQ ID NO: 4093713 - RNA, 23 nt, Streptococcus pneumoniae R6
ugacuucuuaaucaauuaucauu

SEQ ID NO: 4093714 - RNA, 15 nt, Streptococcus pneumoniae R6
ugacuuguacucaau

SEQ ID NO: 4093715 - RNA, 18 nt, Streptococcus pneumoniae R6
ugacuuguguuuuuccuu

SEQ ID NO: 4093716 - RNA, 19 nt, Streptococcus pneumoniae R6
ugacuuuccacaauuuuca

SEQ ID NO: 4093717 - RNA, 21 nt, Streptococcus pneumoniae R6
ugagaaaauaaaguaaaaauu

SEQ ID NO: 4093718 - RNA, 21 nt, Streptococcus pneumoniae R6
ugagaaacagcuccugaaaua

SEQ ID NO: 4093719 - RNA, 23 nt, Streptococcus pneumoniae R6
ugagaaacagcuccugaaauaag

SEQ ID NO: 4093720 - RNA, 17 nt, Streptococcus pneumoniae R6
ugagaaaguuaaaaaaa

SEQ ID NO: 4093721 - RNA, 15 nt, Streptococcus pneumoniae R6
ugagaaccucuguau

SEQ ID NO: 4093722 - RNA, 18 nt, Streptococcus pneumoniae R6
ugagaacuaaauuacuga

SEQ ID NO: 4093723 - RNA, 14 nt, Streptococcus pneumoniae R6
ugagaacuuucuuu

SEQ ID NO: 4093724 - RNA, 18 nt, Streptococcus pneumoniae R6
ugagaagagcuucuuuca

SEQ ID NO: 4093725 - RNA, 19 nt, Streptococcus pneumoniae R6
ugagaagagcuucuuucau

SEQ ID NO: 4093726 - RNA, 20 nt, Streptococcus pneumoniae R6
ugagaagcccauaucuccag

SEQ ID NO: 4093727 - RNA, 20 nt, Streptococcus pneumoniae R6
ugagaaggagaacuccagau

SEQ ID NO: 4093728 - RNA, 22 nt, Streptococcus pneumoniae R6
ugagaauauuuacuucauuuuu

SEQ ID NO: 4093729 - RNA, 21 nt, Streptococcus pneumoniae R6
ugagacaguuuguguuucuuu

SEQ ID NO: 4093730 - RNA, 22 nt, Streptococcus pneumoniae R6
ugagaccuuuauuggcugccac

SEQ ID NO: 4093731 - RNA, 15 nt, Streptococcus pneumoniae R6
ugagacuugcaagaa

SEQ ID NO: 4093732 - RNA, 18 nt, Streptococcus pneumoniae R6
ugagacuugcaagaaagu

SEQ ID NO: 4093733 - RNA, 23 nt, Streptococcus pneumoniae R6
ugagagcauuuuucgaaauuuau

SEQ ID NO: 4093734 - RNA, 20 nt, Streptococcus pneumoniae R6
ugagaggaggugaaacuaau

SEQ ID NO: 4093735 - RNA, 20 nt, Streptococcus pneumoniae R6
ugagauaaaacguugguaaa

SEQ ID NO: 4093736 - RNA, 15 nt, Streptococcus pneumoniae R6
ugagauaaggacugc

SEQ ID NO: 4093737 - RNA, 15 nt, Streptococcus pneumoniae R6
ugauauauaaaugaa

SEQ ID NO: 4093738 - RNA, 15 nt, Streptococcus pneumoniae R6
ugauauauuuaucca

SEQ ID NO: 4093739 - RNA, 13 nt, Streptococcus pneumoniae R6
ugauaucuaucaa

SEQ ID NO: 4093740 - RNA, 16 nt, Streptococcus pneumoniae R6
ugauaucuggauuuuc

SEQ ID NO: 4093741 - RNA, 20 nt, Streptococcus pneumoniae R6
ugauaucuggauuuucaacu

SEQ ID NO: 4093742 - RNA, 19 nt, Streptococcus pneumoniae R6
ugauaucugguauauuuug

SEQ ID NO: 4093743 - RNA, 14 nt, Streptococcus pneumoniae R6
ugauaucuuuagaa

SEQ ID NO: 4093744 - RNA, 19 nt, Streptococcus pneumoniae R6
ugauaugagagauuucucc

SEQ ID NO: 4093745 - RNA, 20 nt, Streptococcus pneumoniae R6
ugauaugggauuuucauaua

SEQ ID NO: 4093746 - RNA, 20 nt, Streptococcus pneumoniae R6
ugauaugguauuuaaaaccu

SEQ ID NO: 4093747 - RNA, 15 nt, Streptococcus pneumoniae R6
ugauauuaugcguuu

SEQ ID NO: 4093748 - RNA, 13 nt, Streptococcus pneumoniae R6
ugauauucuuauc

SEQ ID NO: 4093749 - RNA, 21 nt, Streptococcus pneumoniae R6
ugauauuggcugcuugcaauu

SEQ ID NO: 4093750 - RNA, 15 nt, Streptococcus pneumoniae R6
ugauauuggucagau

SEQ ID NO: 4093751 - RNA, 18 nt, Streptococcus pneumoniae R6
ugauauugucuacauuga

SEQ ID NO: 4093752 - RNA, 19 nt, Streptococcus pneumoniae R6
ugauauugucuacauugau

SEQ ID NO: 4093753 - RNA, 23 nt, Streptococcus pneumoniae R6
ugauauuuauuuacauaauuuaa

SEQ ID NO: 4093754 - RNA, 14 nt, Streptococcus pneumoniae R6
ugaucaagaugaga

SEQ ID NO: 4093755 - RNA, 17 nt, Streptococcus pneumoniae R6
ugaucaagcguuuuucu

SEQ ID NO: 4093756 - RNA, 14 nt, Streptococcus pneumoniae R6
ugaucaaucauguu

SEQ ID NO: 4093757 - RNA, 14 nt, Streptococcus pneumoniae R6
ugaucagaguuuug

SEQ ID NO: 4093758 - RNA, 23 nt, Streptococcus pneumoniae R6
ugauccaagcuucuacagaugcu

SEQ ID NO: 4093759 - RNA, 13 nt, Streptococcus pneumoniae R6
ugaucgagcagau

SEQ ID NO: 4093760 - RNA, 21 nt, Streptococcus pneumoniae R6
ugaucgagcagauuucuuuua

SEQ ID NO: 4093761 - RNA, 11 nt, Streptococcus pneumoniae R6
ugaucuuccau

SEQ ID NO: 4093762 - RNA, 23 nt, Streptococcus pneumoniae R6
ugaugaaccuucaucaaaugacu

SEQ ID NO: 4093763 - RNA, 21 nt, Streptococcus pneumoniae R6
ugaugaacggagauaguacca

SEQ ID NO: 4093764 - RNA, 22 nt, Streptococcus pneumoniae R6
ugaugaacggagauaguaccau

SEQ ID NO: 4093765 - RNA, 20 nt, Streptococcus pneumoniae R6
ugaugaacugcuugagcugc

SEQ ID NO: 4093766 - RNA, 17 nt, Streptococcus pneumoniae R6
ugaugaagauugauaaa

SEQ ID NO: 4093767 - RNA, 22 nt, Streptococcus pneumoniae R6
ugaugaagggcuuuucuaucac

SEQ ID NO: 4093768 - RNA, 18 nt, Streptococcus pneumoniae R6
ugaugacuucagcuccac

SEQ ID NO: 4093769 - RNA, 21 nt, Streptococcus pneumoniae R6
ugaugagauuauugguggcuu

SEQ ID NO: 4093770 - RNA, 18 nt, Streptococcus pneumoniae R6
ugaugagcaaaggauugu

SEQ ID NO: 4093771 - RNA, 18 nt, Streptococcus pneumoniae R6
ugaugagggcgauuuucc

SEQ ID NO: 4093772 - RNA, 21 nt, Streptococcus pneumoniae R6
ugaugagggcgauuuucccuu

SEQ ID NO: 4093773 - RNA, 20 nt, Streptococcus pneumoniae R6
ugaugagguuucgcauuuga

SEQ ID NO: 4093774 - RNA, 13 nt, Streptococcus pneumoniae R6
ugaugauguuuaa

SEQ ID NO: 4093775 - RNA, 17 nt, Streptococcus pneumoniae R6
ugaugauuuggcgauga

SEQ ID NO: 4093776 - RNA, 22 nt, Streptococcus pneumoniae R6
ugaugcaaaucucauuugauga

SEQ ID NO: 4093777 - RNA, 15 nt, Streptococcus pneumoniae R6
ugauggaagacugag

SEQ ID NO: 4093778 - RNA, 16 nt, Streptococcus pneumoniae R6
ugauggaguuuucaau

SEQ ID NO: 4093779 - RNA, 13 nt, Streptococcus pneumoniae R6
ugauggcuugugu

SEQ ID NO: 4093780 - RNA, 20 nt, Streptococcus pneumoniae R6
ugauggguuagguucaaucc

SEQ ID NO: 4093781 - RNA, 22 nt, Streptococcus pneumoniae R6
ugauguaacuguuuuaggaaca

SEQ ID NO: 4093782 - RNA, 21 nt, Streptococcus pneumoniae R6
ugaugugcuauucuaaauuca

SEQ ID NO: 4093783 - RNA, 14 nt, Streptococcus pneumoniae R6
ugauguuaaaauga

SEQ ID NO: 4093784 - RNA, 22 nt, Streptococcus pneumoniae R6
ugauguuaagugcuucuuugua

SEQ ID NO: 4093785 - RNA, 20 nt, Streptococcus pneumoniae R6
ugauguuacuucugaaucug

SEQ ID NO: 4093786 - RNA, 18 nt, Streptococcus pneumoniae R6
ugauuaagugauuuaaau

SEQ ID NO: 4093787 - RNA, 21 nt, Streptococcus pneumoniae R6
ugauuaagugauuuaaauguu

SEQ ID NO: 4093788 - RNA, 16 nt, Streptococcus pneumoniae R6
ugauuacauaaauugg

SEQ ID NO: 4093789 - RNA, 22 nt, Streptococcus pneumoniae R6
ugauuauuacaacaauaagaga

SEQ ID NO: 4093790 - RNA, 22 nt, Streptococcus pneumoniae R6
ugauucaaagucauaaacaucu

SEQ ID NO: 4093791 - RNA, 22 nt, Streptococcus pneumoniae R6
ugauucaaggaguugucuauag

SEQ ID NO: 4093792 - RNA, 17 nt, Streptococcus pneumoniae R6
ugauucagauucaucau

SEQ ID NO: 4093793 - RNA, 13 nt, Streptococcus pneumoniae R6
ugauucaucucca

SEQ ID NO: 4093794 - RNA, 13 nt, Streptococcus pneumoniae R6
ugauucaugacau

SEQ ID NO: 4093795 - RNA, 20 nt, Streptococcus pneumoniae R6
ugauucaugacaucuuccaa

SEQ ID NO: 4093796 - RNA, 21 nt, Streptococcus pneumoniae R6
ugauucaugacaucuuccaaa

SEQ ID NO: 4093797 - RNA, 18 nt, Streptococcus pneumoniae R6
ugauucgcucuucaaucu

SEQ ID NO: 4093798 - RNA, 16 nt, Streptococcus pneumoniae R6
ugauucuacuuuuuca

SEQ ID NO: 4093799 - RNA, 14 nt, Streptococcus pneumoniae R6
ugauucucagguuu

SEQ ID NO: 4093800 - RNA, 15 nt, Streptococcus pneumoniae R6
ugauucuuucuaaug

SEQ ID NO: 4093801 - RNA, 19 nt, Streptococcus pneumoniae R6
ugauugcaaagcaaucuaa

SEQ ID NO: 4093802 - RNA, 21 nt, Streptococcus pneumoniae R6
ugauugccaugcugagacuca

SEQ ID NO: 4093803 - RNA, 16 nt, Streptococcus pneumoniae R6
ugauuggugauauugu

SEQ ID NO: 4093804 - RNA, 14 nt, Streptococcus pneumoniae R6
ugauuguuuuuaaa

SEQ ID NO: 4093805 - RNA, 19 nt, Streptococcus pneumoniae R6
ugauuuaacaaucuaucuu

SEQ ID NO: 4093806 - RNA, 20 nt, Streptococcus pneumoniae R6
ugauuuagaaccaagaucuu

SEQ ID NO: 4093807 - RNA, 13 nt, Streptococcus pneumoniae R6
ugauuucaaagaa

SEQ ID NO: 4093808 - RNA, 17 nt, Streptococcus pneumoniae R6
ugauuucaagaccauuu

SEQ ID NO: 4093809 - RNA, 16 nt, Streptococcus pneumoniae R6
ugauuucaauuuuaaa

SEQ ID NO: 4093810 - RNA, 20 nt, Streptococcus pneumoniae R6
ugauuucuaaagaguauaau

SEQ ID NO: 4093811 - RNA, 22 nt, Streptococcus pneumoniae R6
ugauuucuccgaggauuuccca

SEQ ID NO: 4093812 - RNA, 17 nt, Streptococcus pneumoniae R6
ugauuucuccgcuucca

SEQ ID NO: 4093813 - RNA, 15 nt, Streptococcus pneumoniae R6
ugauuucucuugcaa

SEQ ID NO: 4093814 - RNA, 12 nt, Streptococcus pneumoniae R6
ugauuucuggau

SEQ ID NO: 4093815 - RNA, 18 nt, Streptococcus pneumoniae R6
ugauuucuguaaaaauac

SEQ ID NO: 4093816 - RNA, 19 nt, Streptococcus pneumoniae R6
ugauuucuuggaacuugcc

SEQ ID NO: 4093817 - RNA, 19 nt, Streptococcus pneumoniae R6
ugauuucuugugcugacau

SEQ ID NO: 4093818 - RNA, 21 nt, Streptococcus pneumoniae R6
ugauuugaaugccaaaauucc

SEQ ID NO: 4093819 - RNA, 18 nt, Streptococcus pneumoniae R6
ugauuugagguuguagau

SEQ ID NO: 4093820 - RNA, 14 nt, Streptococcus pneumoniae R6
ugauuugagugaau

SEQ ID NO: 4093821 - RNA, 19 nt, Streptococcus pneumoniae R6
ugauuuggcgaugauuuua

SEQ ID NO: 4093822 - RNA, 22 nt, Streptococcus pneumoniae R6
ugauuuggcgaugauuuuagag

SEQ ID NO: 4093823 - RNA, 17 nt, Streptococcus pneumoniae R6
ugauuugguugaagagg

SEQ ID NO: 4093824 - RNA, 12 nt, Streptococcus pneumoniae R6
ugauuuuaaaga

SEQ ID NO: 4093825 - RNA, 16 nt, Streptococcus pneumoniae R6
ugauuuuaaagaaaua

SEQ ID NO: 4093826 - RNA, 14 nt, Streptococcus pneumoniae R6
ugauuuuaauaauu

SEQ ID NO: 4093827 - RNA, 17 nt, Streptococcus pneumoniae R6
ugauuuuauauaaaaua

SEQ ID NO: 4093828 - RNA, 13 nt, Streptococcus pneumoniae R6
ugauuuucaucau

SEQ ID NO: 4093829 - RNA, 15 nt, Streptococcus pneumoniae R6
ugauuuucaucauca

SEQ ID NO: 4093830 - RNA, 16 nt, Streptococcus pneumoniae R6
ugauuuucaucaucac

SEQ ID NO: 4093831 - RNA, 21 nt, Streptococcus pneumoniae R6
ugauuuucauugaguuuuaau

SEQ ID NO: 4093832 - RNA, 15 nt, Streptococcus pneumoniae R6
ugauuuuccugaaua

SEQ ID NO: 4093833 - RNA, 17 nt, Streptococcus pneumoniae R6
ugauuuucuuuaaaaaa

SEQ ID NO: 4093834 - RNA, 21 nt, Streptococcus pneumoniae R6
ugauuuugaaaauuuuuccca

SEQ ID NO: 4093835 - RNA, 18 nt, Streptococcus pneumoniae R6
ugauuuugugcucuuaaa

SEQ ID NO: 4093836 - RNA, 22 nt, Streptococcus pneumoniae R6
ugauuuuuauugaguauuagag

SEQ ID NO: 4093837 - RNA, 14 nt, Streptococcus pneumoniae R6
ugauuuuucuaaau

SEQ ID NO: 4093838 - RNA, 19 nt, Streptococcus pneumoniae R6
ugauuuuuuuuaaaaaagu

SEQ ID NO: 4093839 - RNA, 20 nt, Streptococcus pneumoniae R6
ugccuaaacacuucacuaau

SEQ ID NO: 4093840 - RNA, 15 nt, Streptococcus pneumoniae R6
ugccuaauacaugca

SEQ ID NO: 4093841 - RNA, 14 nt, Streptococcus pneumoniae R6
ugccuaauuuuuca

SEQ ID NO: 4093842 - RNA, 16 nt, Streptococcus pneumoniae R6
ugccucaauccuuuuc

SEQ ID NO: 4093843 - RNA, 18 nt, Streptococcus pneumoniae R6
ugccucaauccuuuucug

SEQ ID NO: 4093844 - RNA, 19 nt, Streptococcus pneumoniae R6
ugccuccaagaaagagaau

SEQ ID NO: 4093845 - RNA, 17 nt, Streptococcus pneumoniae R6
ugccucccacuaucuaa

SEQ ID NO: 4093846 - RNA, 14 nt, Streptococcus pneumoniae R6
ugccucucuucugu

SEQ ID NO: 4093847 - RNA, 19 nt, Streptococcus pneumoniae R6
ugccugaacgcuagcuacu

SEQ ID NO: 4093848 - RNA, 23 nt, Streptococcus pneumoniae R6
ugccuguuccaacauuguuugua

SEQ ID NO: 4093849 - RNA, 22 nt, Streptococcus pneumoniae R6
ugccuuagcaacuguuuuuuca

SEQ ID NO: 4093850 - RNA, 19 nt, Streptococcus pneumoniae R6
ugccuuccuugucuaucca

SEQ ID NO: 4093851 - RNA, 18 nt, Streptococcus pneumoniae R6
ugccuugaccaaucaauc

SEQ ID NO: 4093852 - RNA, 23 nt, Streptococcus pneumoniae R6
ugcgaaagcgagguuuuuaaagg

SEQ ID NO: 4093853 - RNA, 22 nt, Streptococcus pneumoniae R6
ugcgaacaaaucaauuagaaaa

SEQ ID NO: 4093854 - RNA, 18 nt, Streptococcus pneumoniae R6
ugcgaaguuuuggacgaa

SEQ ID NO: 4093855 - RNA, 15 nt, Streptococcus pneumoniae R6
ugcgaaucaauuuuu

SEQ ID NO: 4093856 - RNA, 16 nt, Streptococcus pneumoniae R6
ugcgacaaaaagaggc

SEQ ID NO: 4093857 - RNA, 17 nt, Streptococcus pneumoniae R6
ugcgacguuuucuccuu

SEQ ID NO: 4093858 - RNA, 18 nt, Streptococcus pneumoniae R6
ugcgacuacuaguucugc

SEQ ID NO: 4093859 - RNA, 19 nt, Streptococcus pneumoniae R6
ugcgacugguuuccuaguu

SEQ ID NO: 4093860 - RNA, 21 nt, Streptococcus pneumoniae R6
ugcgagaaucaaagccaccau

SEQ ID NO: 4093861 - RNA, 18 nt, Streptococcus pneumoniae R6
ugcgcaacacacuguuuu

SEQ ID NO: 4093862 - RNA, 13 nt, Streptococcus pneumoniae R6
ugcgcacuuguuc

SEQ ID NO: 4093863 - RNA, 14 nt, Streptococcus pneumoniae R6
ugcgccuagcuuuc

SEQ ID NO: 4093864 - RNA, 20 nt, Streptococcus pneumoniae R6
ugcgccuagcuuucuaguuu

SEQ ID NO: 4093865 - RNA, 19 nt, Streptococcus pneumoniae R6
ugcgcgcuugaaugauaaa

SEQ ID NO: 4093866 - RNA, 15 nt, Streptococcus pneumoniae R6
ugcggauaaaagaga

SEQ ID NO: 4093867 - RNA, 19 nt, Streptococcus pneumoniae R6
ugcggcggaaacaaaauua

SEQ ID NO: 4093868 - RNA, 22 nt, Streptococcus pneumoniae R6
ugcggcugcagcugcggcuuuu

SEQ ID NO: 4093869 - RNA, 13 nt, Streptococcus pneumoniae R6
ugcggucccaguu

SEQ ID NO: 4093870 - RNA, 16 nt, Streptococcus pneumoniae R6
ugcgucugcuccuccg

SEQ ID NO: 4093871 - RNA, 16 nt, Streptococcus pneumoniae R6
ugcgucugucuugacu

SEQ ID NO: 4093872 - RNA, 14 nt, Streptococcus pneumoniae R6
ugcgucuucuacaa

SEQ ID NO: 4093873 - RNA, 13 nt, Streptococcus pneumoniae R6
ugcguuggaauaa

SEQ ID NO: 4093874 - RNA, 20 nt, Streptococcus pneumoniae R6
ugcguuucagcauauuuccc

SEQ ID NO: 4093875 - RNA, 22 nt, Streptococcus pneumoniae R6
ugcguuucagcauauuucccau

SEQ ID NO: 4093876 - RNA, 16 nt, Streptococcus pneumoniae R6
ugcguuuuauuguggg

SEQ ID NO: 4093877 - RNA, 22 nt, Streptococcus pneumoniae R6
ugcguuuuuuugauuuuaaaga

SEQ ID NO: 4093878 - RNA, 21 nt, Streptococcus pneumoniae R6
ugcuaaaacaaaauucuuccu

SEQ ID NO: 4093879 - RNA, 18 nt, Streptococcus pneumoniae R6
ugcuaaucaaaacgcagu

SEQ ID NO: 4093880 - RNA, 17 nt, Streptococcus pneumoniae R6
ugcuaauucuuugacaa

SEQ ID NO: 4093881 - RNA, 11 nt, Streptococcus pneumoniae R6
ugcuaauuuag

SEQ ID NO: 4093882 - RNA, 21 nt, Streptococcus pneumoniae R6
ugcuacaaggacauugacuuu

SEQ ID NO: 4093883 - RNA, 23 nt, Streptococcus pneumoniae R6
ugcuacgacacuauuuacaagug

SEQ ID NO: 4093884 - RNA, 18 nt, Streptococcus pneumoniae R6
ugcuacugcauccaacaa

SEQ ID NO: 4093885 - RNA, 14 nt, Streptococcus pneumoniae R6
ugcuagcaaugguu

SEQ ID NO: 4093886 - RNA, 19 nt, Streptococcus pneumoniae R6
ugcuaggaagagggcugug

SEQ ID NO: 4093887 - RNA, 19 nt, Streptococcus pneumoniae R6
ugcuaguguggacaugagu

SEQ ID NO: 4093888 - RNA, 21 nt, Streptococcus pneumoniae R6
ugcuauagucaauugaaacaa

SEQ ID NO: 4093889 - RNA, 20 nt, Streptococcus pneumoniae R6
ugcuauaucaaaaccagucc

SEQ ID NO: 4093890 - RNA, 14 nt, Streptococcus pneumoniae R6
ugcuauaucuuauu

SEQ ID NO: 4093891 - RNA, 18 nt, Streptococcus pneumoniae R6
ugcuauguugcaaauuua

SEQ ID NO: 4093892 - RNA, 19 nt, Streptococcus pneumoniae R6
ugcuauugaaaggaaaaug

SEQ ID NO: 4093893 - RNA, 20 nt, Streptococcus pneumoniae R6
ugcucaaaacacuguuuuaa

SEQ ID NO: 4093894 - RNA, 19 nt, Streptococcus pneumoniae R6
ugcucaaaacacuguuuug

SEQ ID NO: 4093895 - RNA, 19 nt, Streptococcus pneumoniae R6
ugcucaaagcacugauuug

SEQ ID NO: 4093896 - RNA, 23 nt, Streptococcus pneumoniae R6
ugcucaaaguacagauuugaaaa

SEQ ID NO: 4093897 - RNA, 17 nt, Streptococcus pneumoniae R6
ugcucaaaguacugcuu

SEQ ID NO: 4093898 - RNA, 13 nt, Streptococcus pneumoniae R6
ugcucaacuucuu

SEQ ID NO: 4093899 - RNA, 14 nt, Streptococcus pneumoniae R6
ugcucaauaaccac

SEQ ID NO: 4093900 - RNA, 19 nt, Streptococcus pneumoniae R6
ugcucaaucuuaucaauca

SEQ ID NO: 4093901 - RNA, 15 nt, Streptococcus pneumoniae R6
ugcucacugaugaaa

SEQ ID NO: 4093902 - RNA, 16 nt, Streptococcus pneumoniae R6
ugcuccauaggcagcu

SEQ ID NO: 4093903 - RNA, 17 nt, Streptococcus pneumoniae R6
ugcuccauuuuuuaaaa

SEQ ID NO: 4093904 - RNA, 23 nt, Streptococcus pneumoniae R6
ugcuccgcggugcaauuuuuuau

SEQ ID NO: 4093905 - RNA, 21 nt, Streptococcus pneumoniae R6
ugcucgccccauuucuucagu

SEQ ID NO: 4093906 - RNA, 14 nt, Streptococcus pneumoniae R6
ugcucgcuggagag

SEQ ID NO: 4093907 - RNA, 20 nt, Streptococcus pneumoniae R6
ugcucggcauugugaugaag

SEQ ID NO: 4093908 - RNA, 17 nt, Streptococcus pneumoniae R6
ugcucuuaucuguccuc

SEQ ID NO: 4093909 - RNA, 14 nt, Streptococcus pneumoniae R6
ugcucuucugaaau

SEQ ID NO: 4093910 - RNA, 15 nt, Streptococcus pneumoniae R6
ugcucuuugauuuuc

SEQ ID NO: 4093911 - RNA, 19 nt, Streptococcus pneumoniae R6
ugcucuuugauuuucauug

SEQ ID NO: 4093912 - RNA, 20 nt, Streptococcus pneumoniae R6
ugcucuuugauuuucauuga

SEQ ID NO: 4093913 - RNA, 19 nt, Streptococcus pneumoniae R6
ugcucuuugauuuuuauug

SEQ ID NO: 4093914 - RNA, 15 nt, Streptococcus pneumoniae R6
ugcugacaagucauc

SEQ ID NO: 4093915 - RNA, 22 nt, Streptococcus pneumoniae R6
ugcugacacgcuugccaacccu

SEQ ID NO: 4093916 - RNA, 18 nt, Streptococcus pneumoniae R6
ugcugacugauuuacaaa

SEQ ID NO: 4093917 - RNA, 19 nt, Streptococcus pneumoniae R6
ugcugacuugccuucaaca

SEQ ID NO: 4093918 - RNA, 18 nt, Streptococcus pneumoniae R6
ugcugccaauugcucaac

SEQ ID NO: 4093919 - RNA, 20 nt, Streptococcus pneumoniae R6
ugcuggagaaucaucaugaa

SEQ ID NO: 4093920 - RNA, 20 nt, Streptococcus pneumoniae R6
ugcuggagcuggggcuacug

SEQ ID NO: 4093921 - RNA, 22 nt, Streptococcus pneumoniae R6
ugcugguuugugaagcacggau

SEQ ID NO: 4093922 - RNA, 19 nt, Streptococcus pneumoniae R6
ugcugguuuuuacugucuu

SEQ ID NO: 4093923 - RNA, 21 nt, Streptococcus pneumoniae R6
ugcuguuaauaacucucaucu

SEQ ID NO: 4093924 - RNA, 12 nt, Streptococcus pneumoniae R6
ugcuguuuucau

SEQ ID NO: 4093925 - RNA, 23 nt, Streptococcus pneumoniae R6
ugcuuaaauaaaauuuuuuucaa

SEQ ID NO: 4093926 - RNA, 20 nt, Streptococcus pneumoniae R6
ugcuuaaauaggccucuuca

SEQ ID NO: 4093927 - RNA, 13 nt, Streptococcus pneumoniae R6
ugcuuacugcugc

SEQ ID NO: 4093928 - RNA, 14 nt, Streptococcus pneumoniae R6
ugcuuagaaacucu

SEQ ID NO: 4093929 - RNA, 12 nt, Streptococcus pneumoniae R6
ugcuuauaaaaa

SEQ ID NO: 4093930 - RNA, 16 nt, Streptococcus pneumoniae R6
ugcuucaacucuauuu

SEQ ID NO: 4093931 - RNA, 15 nt, Streptococcus pneumoniae R6
ugcuucacuagucau

SEQ ID NO: 4093932 - RNA, 20 nt, Streptococcus pneumoniae R6
ugcuuccaaaaauucuuacu

SEQ ID NO: 4093933 - RNA, 14 nt, Streptococcus pneumoniae R6
ugcuuccuccugcc

SEQ ID NO: 4093934 - RNA, 14 nt, Streptococcus pneumoniae R6
ugcuucuaaaacau

SEQ ID NO: 4093935 - RNA, 13 nt, Streptococcus pneumoniae R6
ugcuucuguuguc

SEQ ID NO: 4093936 - RNA, 16 nt, Streptococcus pneumoniae R6
ugcuucuuuuuuuacu

SEQ ID NO: 4093937 - RNA, 18 nt, Streptococcus pneumoniae R6
ugcuugagcuugaaucuc

SEQ ID NO: 4093938 - RNA, 18 nt, Streptococcus pneumoniae R6
ugcuugguauugguugug

SEQ ID NO: 4093939 - RNA, 14 nt, Streptococcus pneumoniae R6
ugcuugucaucuuc

SEQ ID NO: 4093940 - RNA, 17 nt, Streptococcus pneumoniae R6
ugcuugucaucuuccaa

SEQ ID NO: 4093941 - RNA, 23 nt, Streptococcus pneumoniae R6
ucacaaucucacuaugauuaggu

SEQ ID NO: 4093942 - RNA, 15 nt, Streptococcus pneumoniae R6
ucacaauuccuaaga

SEQ ID NO: 4093943 - RNA, 14 nt, Streptococcus pneumoniae R6
ucacacaaaaaaga

SEQ ID NO: 4093944 - RNA, 14 nt, Streptococcus pneumoniae R6
ucacacaaagugga

SEQ ID NO: 4093945 - RNA, 14 nt, Streptococcus pneumoniae R6
ucacacggaaguau

SEQ ID NO: 4093946 - RNA, 14 nt, Streptococcus pneumoniae R6
ucacagaaugaaca

SEQ ID NO: 4093947 - RNA, 18 nt, Streptococcus pneumoniae R6
ucacagaccgacacacca

SEQ ID NO: 4093948 - RNA, 17 nt, Streptococcus pneumoniae R6
ucacagaguauuaaauu

SEQ ID NO: 4093949 - RNA, 18 nt, Streptococcus pneumoniae R6
ucacaguuaaauuauaaa

SEQ ID NO: 4093950 - RNA, 14 nt, Streptococcus pneumoniae R6
ucacauccucuaca

SEQ ID NO: 4093951 - RNA, 22 nt, Streptococcus pneumoniae R6
ucacaucuuauuucaauucacu

SEQ ID NO: 4093952 - RNA, 20 nt, Streptococcus pneumoniae R6
ucacaugacguucaaaggca

SEQ ID NO: 4093953 - RNA, 21 nt, Streptococcus pneumoniae R6
ucacauucgaaugauauuuuc

SEQ ID NO: 4093954 - RNA, 18 nt, Streptococcus pneumoniae R6
ucacauugaaaaugugaa

SEQ ID NO: 4093955 - RNA, 16 nt, Streptococcus pneumoniae R6
ucacauuuucaaaaac

SEQ ID NO: 4093956 - RNA, 12 nt, Streptococcus pneumoniae R6
ucaccaaauuuc

SEQ ID NO: 4093957 - RNA, 20 nt, Streptococcus pneumoniae R6
ucaccaaauuucauauuuuc

SEQ ID NO: 4093958 - RNA, 15 nt, Streptococcus pneumoniae R6
ucaccaaucaaauca

SEQ ID NO: 4093959 - RNA, 20 nt, Streptococcus pneumoniae R6
ucaccaaucaaaucaauaac

SEQ ID NO: 4093960 - RNA, 14 nt, Streptococcus pneumoniae R6
ucaccagauagaau

SEQ ID NO: 4093961 - RNA, 14 nt, Streptococcus pneumoniae R6
ucaccaggagccaa

SEQ ID NO: 4093962 - RNA, 15 nt, Streptococcus pneumoniae R6
ucaccaggcauuauu

SEQ ID NO: 4093963 - RNA, 21 nt, Streptococcus pneumoniae R6
ucaccaggcauuauuucacuu

SEQ ID NO: 4093964 - RNA, 14 nt, Streptococcus pneumoniae R6
ucaccauaaaucuu

SEQ ID NO: 4093965 - RNA, 12 nt, Streptococcus pneumoniae R6
ucaccaucaagg

SEQ ID NO: 4093966 - RNA, 22 nt, Streptococcus pneumoniae R6
ucaccaucuaagguauauucaa

SEQ ID NO: 4093967 - RNA, 20 nt, Streptococcus pneumoniae R6
ucacccaaaacuucugcaau

SEQ ID NO: 4093968 - RNA, 13 nt, Streptococcus pneumoniae R6
ucaccccacgaag

SEQ ID NO: 4093969 - RNA, 16 nt, Streptococcus pneumoniae R6
ucaccccacgaaggac

SEQ ID NO: 4093970 - RNA, 15 nt, Streptococcus pneumoniae R6
ucaccgaccaauucu

SEQ ID NO: 4093971 - RNA, 19 nt, Streptococcus pneumoniae R6
ucaccgccugcucaccauc

SEQ ID NO: 4093972 - RNA, 21 nt, Streptococcus pneumoniae R6
ucaccgccugcucaccaucuu

SEQ ID NO: 4093973 - RNA, 20 nt, Streptococcus pneumoniae R6
ucaccguagguugggugaag

SEQ ID NO: 4093974 - RNA, 16 nt, Streptococcus pneumoniae R6
ucaccguccccaaaaa

SEQ ID NO: 4093975 - RNA, 21 nt, Streptococcus pneumoniae R6
ucaccguuaucuggugcuagg

SEQ ID NO: 4093976 - RNA, 16 nt, Streptococcus pneumoniae R6
ucaccuccuucuccaa

SEQ ID NO: 4093977 - RNA, 14 nt, Streptococcus pneumoniae R6
ucaccugcaauaau

SEQ ID NO: 4093978 - RNA, 22 nt, Streptococcus pneumoniae R6
ucacgaauauucaccaaucugc

SEQ ID NO: 4093979 - RNA, 20 nt, Streptococcus pneumoniae R6
ucacgaauggcuagaaccac

SEQ ID NO: 4093980 - RNA, 20 nt, Streptococcus pneumoniae R6
ucacgaauuucuuguucaac

SEQ ID NO: 4093981 - RNA, 18 nt, Streptococcus pneumoniae R6
ucacgacauuaccucuuu

SEQ ID NO: 4093982 - RNA, 16 nt, Streptococcus pneumoniae R6
ucacgacuaauuucaa

SEQ ID NO: 4093983 - RNA, 21 nt, Streptococcus pneumoniae R6
ucacgacuuucugauagauuu

SEQ ID NO: 4093984 - RNA, 22 nt, Streptococcus pneumoniae R6
ucacgauacuguaguuuuuccu

SEQ ID NO: 4093985 - RNA, 19 nt, Streptococcus pneumoniae R6
ucacgauucaucaagagac

SEQ ID NO: 4093986 - RNA, 19 nt, Streptococcus pneumoniae R6
ucacgauuggggucagaaa

SEQ ID NO: 4093987 - RNA, 21 nt, Streptococcus pneumoniae R6
ucacgcaccuugguaauuccu

SEQ ID NO: 4093988 - RNA, 15 nt, Streptococcus pneumoniae R6
ucacgcauaagcaau

SEQ ID NO: 4093989 - RNA, 23 nt, Streptococcus pneumoniae R6
ucacggagacuggugugauuuuc

SEQ ID NO: 4093990 - RNA, 15 nt, Streptococcus pneumoniae R6
ucacggcuaauacca

SEQ ID NO: 4093991 - RNA, 14 nt, Streptococcus pneumoniae R6
ucacgguaacggau

SEQ ID NO: 4093992 - RNA, 19 nt, Streptococcus pneumoniae R6
ucacguaaauugcccuugu

SEQ ID NO: 4093993 - RNA, 17 nt, Streptococcus pneumoniae R6
ucacguaacauauuuuc

SEQ ID NO: 4093994 - RNA, 20 nt, Streptococcus pneumoniae R6
ucacguucgguauuuucaua

SEQ ID NO: 4093995 - RNA, 22 nt, Streptococcus pneumoniae R6
ucacuaaauccaccuaauuaua

SEQ ID NO: 4093996 - RNA, 17 nt, Streptococcus pneumoniae R6
ucacuaauucaccuaac

SEQ ID NO: 4093997 - RNA, 13 nt, Streptococcus pneumoniae R6
ucacuagaaaaug

SEQ ID NO: 4093998 - RNA, 23 nt, Streptococcus pneumoniae R6
ucacuaguuuuaggacauaaaua

SEQ ID NO: 4093999 - RNA, 21 nt, Streptococcus pneumoniae R6
ucacuauauugcaagagaaau

SEQ ID NO: 4094000 - RNA, 15 nt, Streptococcus pneumoniae R6
ucacuaucgaaaaau

SEQ ID NO: 4094001 - RNA, 17 nt, Streptococcus pneumoniae R6
ucacuaucgaaaaauau

SEQ ID NO: 4094002 - RNA, 13 nt, Streptococcus pneumoniae R6
ucacuauguuuua

SEQ ID NO: 4094003 - RNA, 15 nt, Streptococcus pneumoniae R6
ucacucaguuucuga

SEQ ID NO: 4094004 - RNA, 14 nt, Streptococcus pneumoniae R6
ucacucaucugcuu

SEQ ID NO: 4094005 - RNA, 15 nt, Streptococcus pneumoniae R6
ucacucuaacuucug

SEQ ID NO: 4094006 - RNA, 13 nt, Streptococcus pneumoniae R6
ucacugaugaaac

SEQ ID NO: 4094007 - RNA, 16 nt, Streptococcus pneumoniae R6
ucacuggcauuuagca

SEQ ID NO: 4094008 - RNA, 19 nt, Streptococcus pneumoniae R6
ucacugugacuagcaauca

SEQ ID NO: 4094009 - RNA, 18 nt, Streptococcus pneumoniae R6
ucacuuacauauucuaac

SEQ ID NO: 4094010 - RNA, 18 nt, Streptococcus pneumoniae R6
ucacuuaguugaauuauc

SEQ ID NO: 4094011 - RNA, 12 nt, Streptococcus pneumoniae R6
ucacuuccuuac

SEQ ID NO: 4094012 - RNA, 17 nt, Streptococcus pneumoniae R6
ucacuugaccuguuuuc

SEQ ID NO: 4094013 - RNA, 16 nt, Streptococcus pneumoniae R6
ucacuugccucuuuaa

SEQ ID NO: 4094014 - RNA, 19 nt, Streptococcus pneumoniae R6
ucacuuguauccuccucua

SEQ ID NO: 4094015 - RNA, 23 nt, Streptococcus pneumoniae R6
ucacuuuauuuuuucuguaaaau

SEQ ID NO: 4094016 - RNA, 21 nt, Streptococcus pneumoniae R6
ucacuuucccuuuccaagaau

SEQ ID NO: 4094017 - RNA, 13 nt, Streptococcus pneumoniae R6
ucacuuuuuucuu

SEQ ID NO: 4094018 - RNA, 21 nt, Streptococcus pneumoniae R6
ucagaaaacccaccaauucag

SEQ ID NO: 4094019 - RNA, 19 nt, Streptococcus pneumoniae R6
ucagaaaaguaacuauuuu

SEQ ID NO: 4094020 - RNA, 15 nt, Streptococcus pneumoniae R6
ucagaaaauaaaauu

SEQ ID NO: 4094021 - RNA, 12 nt, Streptococcus pneumoniae R6
ucagaaagaagu

SEQ ID NO: 4094022 - RNA, 23 nt, Streptococcus pneumoniae R6
ucagaaaucuaguuggucaacuu

SEQ ID NO: 4094023 - RNA, 13 nt, Streptococcus pneumoniae R6
ucagaacacuucc

SEQ ID NO: 4094024 - RNA, 20 nt, Streptococcus pneumoniae R6
ucagaacacuuccaauaaug

SEQ ID NO: 4094025 - RNA, 22 nt, Streptococcus pneumoniae R6
ucagaacauuacccauagauuu

SEQ ID NO: 4094026 - RNA, 16 nt, Streptococcus pneumoniae R6
ucagaauaagagguug

SEQ ID NO: 4094027 - RNA, 15 nt, Streptococcus pneumoniae R6
ucagaaucccaaaga

SEQ ID NO: 4094028 - RNA, 17 nt, Streptococcus pneumoniae R6
ucagaauccuuauuuuc

SEQ ID NO: 4094029 - RNA, 13 nt, Streptococcus pneumoniae R6
ucagaauuuucuu

SEQ ID NO: 4094030 - RNA, 16 nt, Streptococcus pneumoniae R6
ucagacaauccuuggu

SEQ ID NO: 4094031 - RNA, 16 nt, Streptococcus pneumoniae R6
ucagacugguucucuc

SEQ ID NO: 4094032 - RNA, 14 nt, Streptococcus pneumoniae R6
ucagacuguuuuuc

SEQ ID NO: 4094033 - RNA, 19 nt, Streptococcus pneumoniae R6
ucagagcgauaaaaauccu

SEQ ID NO: 4094034 - RNA, 18 nt, Streptococcus pneumoniae R6
ucagagggcuuuuucauu

SEQ ID NO: 4094035 - RNA, 16 nt, Streptococcus pneumoniae R6
ucagaggggugcugag

SEQ ID NO: 4094036 - RNA, 15 nt, Streptococcus pneumoniae R6
ucagaguuuugaaaa

SEQ ID NO: 4094037 - RNA, 12 nt, Streptococcus pneumoniae R6
ucagaugacugg

SEQ ID NO: 4094038 - RNA, 23 nt, Streptococcus pneumoniae R6
ucagaugaugagcuggaagaauu

SEQ ID NO: 4094039 - RNA, 14 nt, Streptococcus pneumoniae R6
ucagauuacaucuc

SEQ ID NO: 4094040 - RNA, 15 nt, Streptococcus pneumoniae R6
ucagauucaucauuu

SEQ ID NO: 4094041 - RNA, 19 nt, Streptococcus pneumoniae R6
ucagauucaucauuuauag

SEQ ID NO: 4094042 - RNA, 14 nt, Streptococcus pneumoniae R6
ucagauucugacaa

SEQ ID NO: 4094043 - RNA, 12 nt, Streptococcus pneumoniae R6
ucagauuguccu

SEQ ID NO: 4094044 - RNA, 19 nt, Streptococcus pneumoniae R6
ucagauugucgguagaacg

SEQ ID NO: 4094045 - RNA, 13 nt, Streptococcus pneumoniae R6
ucagauuuuaaag

SEQ ID NO: 4094046 - RNA, 22 nt, Streptococcus pneumoniae R6
ucagcaaaacgcugcucaaaau

SEQ ID NO: 4094047 - RNA, 17 nt, Streptococcus pneumoniae R6
ucagcaauagcggcuug

SEQ ID NO: 4094048 - RNA, 18 nt, Streptococcus pneumoniae R6
ucagcagagaaagaaaac

SEQ ID NO: 4094049 - RNA, 19 nt, Streptococcus pneumoniae R6
ucagcagaguuuuuaucua

SEQ ID NO: 4094050 - RNA, 12 nt, Streptococcus pneumoniae R6
ucagcaggagca

SEQ ID NO: 4094051 - RNA, 15 nt, Streptococcus pneumoniae R6
ucagcagucguuccu

SEQ ID NO: 4094052 - RNA, 13 nt, Streptococcus pneumoniae R6
ucagcauaagaca

SEQ ID NO: 4094053 - RNA, 17 nt, Streptococcus pneumoniae R6
ucagcauauuucccauu

SEQ ID NO: 4094054 - RNA, 12 nt, Streptococcus pneumoniae R6
ucagccaaggcu

SEQ ID NO: 4094055 - RNA, 17 nt, Streptococcus pneumoniae R6
ucagccagagcaccaac

SEQ ID NO: 4094056 - RNA, 18 nt, Streptococcus pneumoniae R6
ucagccagagcaccaacc

SEQ ID NO: 4094057 - RNA, 21 nt, Streptococcus pneumoniae R6
ucagccgacuauacuccguua

SEQ ID NO: 4094058 - RNA, 17 nt, Streptococcus pneumoniae R6
ucagccuuauauuuuuu

SEQ ID NO: 4094059 - RNA, 20 nt, Streptococcus pneumoniae R6
ucagccuuauauuuuuucgu

SEQ ID NO: 4094060 - RNA, 15 nt, Streptococcus pneumoniae R6
ucagcuagcuuagga

SEQ ID NO: 4094061 - RNA, 17 nt, Streptococcus pneumoniae R6
ucagcuagcuuaggaaa

SEQ ID NO: 4094062 - RNA, 23 nt, Streptococcus pneumoniae R6
ucagcuaggcucgagaaaggaca

SEQ ID NO: 4094063 - RNA, 20 nt, Streptococcus pneumoniae R6
ucagcucaaaacauguuuuu

SEQ ID NO: 4094064 - RNA, 21 nt, Streptococcus pneumoniae R6
ucagcuccgauguauuugagg

SEQ ID NO: 4094065 - RNA, 18 nt, Streptococcus pneumoniae R6
ucagcugggcuaaugggc

SEQ ID NO: 4094066 - RNA, 17 nt, Streptococcus pneumoniae R6
ucagcuuccaucugcag

SEQ ID NO: 4094067 - RNA, 16 nt, Streptococcus pneumoniae R6
ucagcuucuauuucuu

SEQ ID NO: 4094068 - RNA, 19 nt, Streptococcus pneumoniae R6
ucagcuuuggcaacugcuu

SEQ ID NO: 4094069 - RNA, 14 nt, Streptococcus pneumoniae R6
ucaggaaagucaaa

SEQ ID NO: 4094070 - RNA, 20 nt, Streptococcus pneumoniae R6
ucaggaaagucaaauuaauu

SEQ ID NO: 4094071 - RNA, 13 nt, Streptococcus pneumoniae R6
ucaggaaaucuuc

SEQ ID NO: 4094072 - RNA, 15 nt, Streptococcus pneumoniae R6
ucaggacgaacgcug

SEQ ID NO: 4094073 - RNA, 22 nt, Streptococcus pneumoniae R6
ucaggagcacuugaugaaaaaa

SEQ ID NO: 4094074 - RNA, 23 nt, Streptococcus pneumoniae R6
ucaggagcacuugaugaaaaaaa

SEQ ID NO: 4094075 - RNA, 17 nt, Streptococcus pneumoniae R6
ucaggauaguugacaag

SEQ ID NO: 4094076 - RNA, 16 nt, Streptococcus pneumoniae R6
ucaggauuuuuaacuu

SEQ ID NO: 4094077 - RNA, 15 nt, Streptococcus pneumoniae R6
ucaggccagaugacu

SEQ ID NO: 4094078 - RNA, 14 nt, Streptococcus pneumoniae R6
ucagggaaaaaacu

SEQ ID NO: 4094079 - RNA, 16 nt, Streptococcus pneumoniae R6
ucagggucuuuguucu

SEQ ID NO: 4094080 - RNA, 14 nt, Streptococcus pneumoniae R6
ucagguauugaaaa

SEQ ID NO: 4094081 - RNA, 14 nt, Streptococcus pneumoniae R6
ucagguguugaaac

SEQ ID NO: 4094082 - RNA, 15 nt, Streptococcus pneumoniae R6
ucagguguuucuggu

SEQ ID NO: 4094083 - RNA, 23 nt, Streptococcus pneumoniae R6
ucagguuuuucgucuuuuuuccg

SEQ ID NO: 4094084 - RNA, 21 nt, Streptococcus pneumoniae R6
ucaguaaaaaaaacauauauu

SEQ ID NO: 4094085 - RNA, 21 nt, Streptococcus pneumoniae R6
ucaguacaccuaaaacuuuga

SEQ ID NO: 4094086 - RNA, 18 nt, Streptococcus pneumoniae R6
ucaguagucuagcuagug

SEQ ID NO: 4094087 - RNA, 21 nt, Streptococcus pneumoniae R6
ucaguauauugaaaugaaaua

SEQ ID NO: 4094088 - RNA, 15 nt, Streptococcus pneumoniae R6
ucaguauuacaucca

SEQ ID NO: 4094089 - RNA, 13 nt, Streptococcus pneumoniae R6
ucaguauuuggau

SEQ ID NO: 4094090 - RNA, 20 nt, Streptococcus pneumoniae R6
ucaguauuuggauuaugaaa

SEQ ID NO: 4094091 - RNA, 21 nt, Streptococcus pneumoniae R6
ucaguauuuggauuaugaaaa

SEQ ID NO: 4094092 - RNA, 13 nt, Streptococcus pneumoniae R6
ucagucaagaguu

SEQ ID NO: 4094093 - RNA, 13 nt, Streptococcus pneumoniae R6
ucagucacauaua

SEQ ID NO: 4094094 - RNA, 20 nt, Streptococcus pneumoniae R6
ucagucugaccaccauuuuu

SEQ ID NO: 4094095 - RNA, 15 nt, Streptococcus pneumoniae R6
ucagugaacuauuuu

SEQ ID NO: 4094096 - RNA, 19 nt, Streptococcus pneumoniae R6
ucagugggcuauuccagcu

SEQ ID NO: 4094097 - RNA, 22 nt, Streptococcus pneumoniae R6
ucaguuccauccacaaccuuaa

SEQ ID NO: 4094098 - RNA, 22 nt, Streptococcus pneumoniae R6
ucaguuccaucuacaaccuuaa

SEQ ID NO: 4094099 - RNA, 19 nt, Streptococcus pneumoniae R6
ucaguuccccaaaaaguag

SEQ ID NO: 4094100 - RNA, 16 nt, Streptococcus pneumoniae R6
ucaguucuaucuacaa

SEQ ID NO: 4094101 - RNA, 11 nt, Streptococcus pneumoniae R6
aaaaauaaaaa

SEQ ID NO: 4094102 - RNA, 13 nt, Streptococcus pneumoniae R6
aaaaauaaaaaaa

SEQ ID NO: 4094103 - RNA, 13 nt, Streptococcus pneumoniae R6
aaaaauaaaaaag

SEQ ID NO: 4094104 - RNA, 15 nt, Streptococcus pneumoniae R6
aaaaauaaaaaagag

SEQ ID NO: 4094105 - RNA, 16 nt, Streptococcus pneumoniae R6
aaaaauaaacagcgag

SEQ ID NO: 4094106 - RNA, 14 nt, Streptococcus pneumoniae R6
aaaaauaaucaaaa

SEQ ID NO: 4094107 - RNA, 18 nt, Streptococcus pneumoniae R6
aaaaauaaucaaaacuau

SEQ ID NO: 4094108 - RNA, 15 nt, Streptococcus pneumoniae R6
aaaaauagaaauaaa

SEQ ID NO: 4094109 - RNA, 23 nt, Streptococcus pneumoniae R6
aaaaauagcccuucggauaaaau

SEQ ID NO: 4094110 - RNA, 14 nt, Streptococcus pneumoniae R6
aaaaauaucauuaa

SEQ ID NO: 4094111 - RNA, 14 nt, Streptococcus pneumoniae R6
aaaaauaugaugga

SEQ ID NO: 4094112 - RNA, 15 nt, Streptococcus pneumoniae R6
aaaaauaugauggaa

SEQ ID NO: 4094113 - RNA, 20 nt, Streptococcus pneumoniae R6
aaaaauaugauggaagacug

SEQ ID NO: 4094114 - RNA, 15 nt, Streptococcus pneumoniae R6
aaaaauaugcauaau

SEQ ID NO: 4094115 - RNA, 18 nt, Streptococcus pneumoniae R6
aaaaauaugcuauugaaa

SEQ ID NO: 4094116 - RNA, 19 nt, Streptococcus pneumoniae R6
aaaaaucaagcacuagacc

SEQ ID NO: 4094117 - RNA, 22 nt, Streptococcus pneumoniae R6
aaaaauccacuugggaaaccaa

SEQ ID NO: 4094118 - RNA, 20 nt, Streptococcus pneumoniae R6
aaaaauccaugauccuucau

SEQ ID NO: 4094119 - RNA, 22 nt, Streptococcus pneumoniae R6
aaaaaucccgucucaugaaagg

SEQ ID NO: 4094120 - RNA, 14 nt, Streptococcus pneumoniae R6
aaaaaucguaaaaa

SEQ ID NO: 4094121 - RNA, 20 nt, Streptococcus pneumoniae R6
aaaaaucguguuucauaugu

SEQ ID NO: 4094122 - RNA, 15 nt, Streptococcus pneumoniae R6
aaaaaucuaacuuuu

SEQ ID NO: 4094123 - RNA, 17 nt, Streptococcus pneumoniae R6
aaaaaucuagucaucag

SEQ ID NO: 4094124 - RNA, 18 nt, Streptococcus pneumoniae R6
aaaaaucuucaaaaaagu

SEQ ID NO: 4094125 - RNA, 14 nt, Streptococcus pneumoniae R6
aaaaaugaaaaaaa

SEQ ID NO: 4094126 - RNA, 17 nt, Streptococcus pneumoniae R6
aaaaaugacaauaaaau

SEQ ID NO: 4094127 - RNA, 14 nt, Streptococcus pneumoniae R6
aaaaaugauaauag

SEQ ID NO: 4094128 - RNA, 18 nt, Streptococcus pneumoniae R6
aaaaauguuuuaagaagu

SEQ ID NO: 4094129 - RNA, 13 nt, Streptococcus pneumoniae R6
aaaaauuaugcuu

SEQ ID NO: 4094130 - RNA, 13 nt, Streptococcus pneumoniae R6
aaaaauucugcca

SEQ ID NO: 4094131 - RNA, 21 nt, Streptococcus pneumoniae R6
aaaaauugcacuuuccucuug

SEQ ID NO: 4094132 - RNA, 17 nt, Streptococcus pneumoniae R6
aaaaauuucauuucgac

SEQ ID NO: 4094133 - RNA, 19 nt, Streptococcus pneumoniae R6
aaaaauuugaucauccaaa

SEQ ID NO: 4094134 - RNA, 22 nt, Streptococcus pneumoniae R6
aaaaauuuuauuuaagcaaaaa

SEQ ID NO: 4094135 - RNA, 23 nt, Streptococcus pneumoniae R6
aaaaauuuuauuuaagcaaaaaa

SEQ ID NO: 4094136 - RNA, 18 nt, Streptococcus pneumoniae R6
aaaaauuuuuuucuaauu

SEQ ID NO: 4094137 - RNA, 22 nt, Streptococcus pneumoniae R6
aaaaauuuuuuucuaauuaaau

SEQ ID NO: 4094138 - RNA, 16 nt, Streptococcus pneumoniae R6
aaaacaaaaaagaggu

SEQ ID NO: 4094139 - RNA, 16 nt, Streptococcus pneumoniae R6
aaaacaaagaaaaaga

SEQ ID NO: 4094140 - RNA, 22 nt, Streptococcus pneumoniae R6
aaaacaaagagauugcccauca

SEQ ID NO: 4094141 - RNA, 19 nt, Streptococcus pneumoniae R6
aaaacaaaggauuucugcu

SEQ ID NO: 4094142 - RNA, 20 nt, Streptococcus pneumoniae R6
aaaacaaguucuuuucuguu

SEQ ID NO: 4094143 - RNA, 18 nt, Streptococcus pneumoniae R6
aaaacaauguuuugaucu

SEQ ID NO: 4094144 - RNA, 15 nt, Streptococcus pneumoniae R6
aaaacacauuuugaa

SEQ ID NO: 4094145 - RNA, 11 nt, Streptococcus pneumoniae R6
aaaacacuguu

SEQ ID NO: 4094146 - RNA, 12 nt, Streptococcus pneumoniae R6
aaaacacuguuu

SEQ ID NO: 4094147 - RNA, 16 nt, Streptococcus pneumoniae R6
aaaacacuguuuuaag

SEQ ID NO: 4094148 - RNA, 22 nt, Streptococcus pneumoniae R6
aaaacacuguuuuaagguugua

SEQ ID NO: 4094149 - RNA, 22 nt, Streptococcus pneumoniae R6
aaaacacuguuuuaagguugug

SEQ ID NO: 4094150 - RNA, 13 nt, Streptococcus pneumoniae R6
aaaacagaaaaau

SEQ ID NO: 4094151 - RNA, 15 nt, Streptococcus pneumoniae R6
aaaacagacaaaacu

SEQ ID NO: 4094152 - RNA, 17 nt, Streptococcus pneumoniae R6
aaaacagccgaaaggag

SEQ ID NO: 4094153 - RNA, 18 nt, Streptococcus pneumoniae R6
aaaacagccgaggguacu

SEQ ID NO: 4094154 - RNA, 20 nt, Streptococcus pneumoniae R6
aaaacaggaguucuuuuaca

SEQ ID NO: 4094155 - RNA, 12 nt, Streptococcus pneumoniae R6
aaaacaguguuu

SEQ ID NO: 4094156 - RNA, 22 nt, Streptococcus pneumoniae R6
aaaacaguguuuuaagcugacu

SEQ ID NO: 4094157 - RNA, 22 nt, Streptococcus pneumoniae R6
aaaacaguguuuugagcugacu

SEQ ID NO: 4094158 - RNA, 15 nt, Streptococcus pneumoniae R6
aaaacauaauuuuag

SEQ ID NO: 4094159 - RNA, 23 nt, Streptococcus pneumoniae R6
aaaacaucuaccuauucauauau

SEQ ID NO: 4094160 - RNA, 14 nt, Streptococcus pneumoniae R6
aaaacaucucagaa

SEQ ID NO: 4094161 - RNA, 17 nt, Streptococcus pneumoniae R6
aaaacaucucagaauaa

SEQ ID NO: 4094162 - RNA, 20 nt, Streptococcus pneumoniae R6
aaaacaugaaguaaauauuu

SEQ ID NO: 4094163 - RNA, 11 nt, Streptococcus pneumoniae R6
aaaacauucuu

SEQ ID NO: 4094164 - RNA, 23 nt, Streptococcus pneumoniae R6
aaaacauucuuaucaauugauuu

SEQ ID NO: 4094165 - RNA, 11 nt, Streptococcus pneumoniae R6
aaaacauugug

SEQ ID NO: 4094166 - RNA, 22 nt, Streptococcus pneumoniae R6
aaaacauugugagaaauugguu

SEQ ID NO: 4094167 - RNA, 16 nt, Streptococcus pneumoniae R6
aaaacauuguuaaaaa

SEQ ID NO: 4094168 - RNA, 21 nt, Streptococcus pneumoniae R6
aaaacauuuccgauuucagaa

SEQ ID NO: 4094169 - RNA, 12 nt, Streptococcus pneumoniae R6
aaaaccaaaaag

SEQ ID NO: 4094170 - RNA, 21 nt, Streptococcus pneumoniae R6
aaaaccaaaaaguggaaagag

SEQ ID NO: 4094171 - RNA, 13 nt, Streptococcus pneumoniae R6
aaaaccaaacauc

SEQ ID NO: 4094172 - RNA, 20 nt, Streptococcus pneumoniae R6
aaaaccagguucuucaauca

SEQ ID NO: 4094173 - RNA, 18 nt, Streptococcus pneumoniae R6
aaaaccuaucauauccag

SEQ ID NO: 4094174 - RNA, 13 nt, Streptococcus pneumoniae R6
aaaaccuugaaga

SEQ ID NO: 4094175 - RNA, 16 nt, Streptococcus pneumoniae R6
aaaaccuugauauuau

SEQ ID NO: 4094176 - RNA, 18 nt, Streptococcus pneumoniae R6
aaaaccuuguuuuaaaau

SEQ ID NO: 4094177 - RNA, 21 nt, Streptococcus pneumoniae R6
aaaacgacguccagaauacuc

SEQ ID NO: 4094178 - RNA, 22 nt, Streptococcus pneumoniae R6
aaaacgauaauagcgauugaau

SEQ ID NO: 4094179 - RNA, 20 nt, Streptococcus pneumoniae R6
aaaacgcauaaaaucaaggu

SEQ ID NO: 4094180 - RNA, 16 nt, Streptococcus pneumoniae R6
aaaacgcauaauauca

SEQ ID NO: 4094181 - RNA, 19 nt, Streptococcus pneumoniae R6
aaaacgcauaauaucaagu

SEQ ID NO: 4094182 - RNA, 18 nt, Streptococcus pneumoniae R6
aaaacgcauaauauugag

SEQ ID NO: 4094183 - RNA, 20 nt, Streptococcus pneumoniae R6
aaaacgcauaguaucaaggu

SEQ ID NO: 4094184 - RNA, 19 nt, Streptococcus pneumoniae R6
aaaacgcauaguaucaagu

SEQ ID NO: 4094185 - RNA, 20 nt, Streptococcus pneumoniae R6
aaaacgcauaguaucaaguu

SEQ ID NO: 4094186 - RNA, 20 nt, Streptococcus pneumoniae R6
aaaacgcauauuaccaaguu

SEQ ID NO: 4094187 - RNA, 20 nt, Streptococcus pneumoniae R6
aaaacgcaucauaucaaggu

SEQ ID NO: 4094188 - RNA, 18 nt, Streptococcus pneumoniae R6
aaaacgcugcucaaaauc

SEQ ID NO: 4094189 - RNA, 15 nt, Streptococcus pneumoniae R6
aaaacgguaacaaaa

SEQ ID NO: 4094190 - RNA, 17 nt, Streptococcus pneumoniae R6
aaaacgguugagcaugu

SEQ ID NO: 4094191 - RNA, 17 nt, Streptococcus pneumoniae R6
aaaacgucguaaucuua

SEQ ID NO: 4094192 - RNA, 19 nt, Streptococcus pneumoniae R6
aaaacguucccaacgugag

SEQ ID NO: 4094193 - RNA, 23 nt, Streptococcus pneumoniae R6
aaaacuaaaguguaaugcuauug

SEQ ID NO: 4094194 - RNA, 15 nt, Streptococcus pneumoniae R6
aaaacuaauuuagag

SEQ ID NO: 4094195 - RNA, 23 nt, Streptococcus pneumoniae R6
aaaacuaauuuagagaaugaaau

SEQ ID NO: 4094196 - RNA, 15 nt, Streptococcus pneumoniae R6
aaaacuagaauccua

SEQ ID NO: 4094197 - RNA, 11 nt, Streptococcus pneumoniae R6
aaaacuagcaa

SEQ ID NO: 4094198 - RNA, 19 nt, Streptococcus pneumoniae R6
aaaacuagcaaugccaaag

SEQ ID NO: 4094199 - RNA, 14 nt, Streptococcus pneumoniae R6
aaaacuagugaagc

SEQ ID NO: 4094200 - RNA, 14 nt, Streptococcus pneumoniae R6
aaaacuaguuuaaa

SEQ ID NO: 4094201 - RNA, 15 nt, Streptococcus pneumoniae R6
aaaacuaguuuaaaa

SEQ ID NO: 4094202 - RNA, 19 nt, Streptococcus pneumoniae R6
aaaacuaguuuaaaagacu

SEQ ID NO: 4094203 - RNA, 17 nt, Streptococcus pneumoniae R6
aaaacuauaaaugauga

SEQ ID NO: 4094204 - RNA, 16 nt, Streptococcus pneumoniae R6
aaaauaaaucuaucag

SEQ ID NO: 4094205 - RNA, 13 nt, Streptococcus pneumoniae R6
aaaauaacacucc

SEQ ID NO: 4094206 - RNA, 19 nt, Streptococcus pneumoniae R6
aaaauaacucuguaaucuc

SEQ ID NO: 4094207 - RNA, 14 nt, Streptococcus pneumoniae R6
aaaauaacuucaga

SEQ ID NO: 4094208 - RNA, 23 nt, Streptococcus pneumoniae R6
aaaauaagauauagcauacugaa

SEQ ID NO: 4094209 - RNA, 22 nt, Streptococcus pneumoniae R6
aaaauaaguuagaauauguaag

SEQ ID NO: 4094210 - RNA, 13 nt, Streptococcus pneumoniae R6
aaaauaaucaaaa

SEQ ID NO: 4094211 - RNA, 14 nt, Streptococcus pneumoniae R6
aaaauaauuaaaau

SEQ ID NO: 4094212 - RNA, 21 nt, Streptococcus pneumoniae R6
aaaauaauuaaaaugugauuu

SEQ ID NO: 4094213 - RNA, 15 nt, Streptococcus pneumoniae R6
aaaauaauuuugauu

SEQ ID NO: 4094214 - RNA, 14 nt, Streptococcus pneumoniae R6
aaaauacaaaccaa

SEQ ID NO: 4094215 - RNA, 15 nt, Streptococcus pneumoniae R6
aaaauacaaaccaaa

SEQ ID NO: 4094216 - RNA, 19 nt, Streptococcus pneumoniae R6
aaaauacaguauccacauu

SEQ ID NO: 4094217 - RNA, 16 nt, Streptococcus pneumoniae R6
aaaauacaucuaugau

SEQ ID NO: 4094218 - RNA, 17 nt, Streptococcus pneumoniae R6
aaaauacccucuaucaa

SEQ ID NO: 4094219 - RNA, 13 nt, Streptococcus pneumoniae R6
aaaauacgcaaaa

SEQ ID NO: 4094220 - RNA, 13 nt, Streptococcus pneumoniae R6
aaaauagaaaaaa

SEQ ID NO: 4094221 - RNA, 14 nt, Streptococcus pneumoniae R6
aaaauagaaaaaau

SEQ ID NO: 4094222 - RNA, 13 nt, Streptococcus pneumoniae R6
aaaauagaaauaa

SEQ ID NO: 4094223 - RNA, 15 nt, Streptococcus pneumoniae R6
aaaauaggcagaaca

SEQ ID NO: 4094224 - RNA, 20 nt, Streptococcus pneumoniae R6
aaaauaggcagaacaagagu

SEQ ID NO: 4094225 - RNA, 22 nt, Streptococcus pneumoniae R6
aaaauagggaaauccuagauac

SEQ ID NO: 4094226 - RNA, 16 nt, Streptococcus pneumoniae R6
aaaauaguacgaaaca

SEQ ID NO: 4094227 - RNA, 19 nt, Streptococcus pneumoniae R6
aaaauaguacgaaacaauu

SEQ ID NO: 4094228 - RNA, 14 nt, Streptococcus pneumoniae R6
aaaauauacaaaaa

SEQ ID NO: 4094229 - RNA, 21 nt, Streptococcus pneumoniae R6
aaaauauacaaaaaaggaacc

SEQ ID NO: 4094230 - RNA, 14 nt, Streptococcus pneumoniae R6
aaaauauagaauug

SEQ ID NO: 4094231 - RNA, 22 nt, Streptococcus pneumoniae R6
aaaauaugaucuauuguugcau

SEQ ID NO: 4094232 - RNA, 23 nt, Streptococcus pneumoniae R6
aaaauaugcuauugaaaggaaaa

SEQ ID NO: 4094233 - RNA, 16 nt, Streptococcus pneumoniae R6
aaaauauggcacaaaa

SEQ ID NO: 4094234 - RNA, 23 nt, Streptococcus pneumoniae R6
aaaauauggcacaaaagguucuu

SEQ ID NO: 4094235 - RNA, 13 nt, Streptococcus pneumoniae R6
aaaauauuagcaa

SEQ ID NO: 4094236 - RNA, 15 nt, Streptococcus pneumoniae R6
aaaauauuucuagaa

SEQ ID NO: 4094237 - RNA, 16 nt, Streptococcus pneumoniae R6
aaaauauuucuagaaa

SEQ ID NO: 4094238 - RNA, 19 nt, Streptococcus pneumoniae R6
aaaauauuucuagaaauua

SEQ ID NO: 4094239 - RNA, 20 nt, Streptococcus pneumoniae R6
aaaauauuucuagaaauuaa

SEQ ID NO: 4094240 - RNA, 13 nt, Streptococcus pneumoniae R6
aaaauauuuggaa

SEQ ID NO: 4094241 - RNA, 16 nt, Streptococcus pneumoniae R6
aaaauauuuggagcaa

SEQ ID NO: 4094242 - RNA, 14 nt, Streptococcus pneumoniae R6
aaaauauuuuaaac

SEQ ID NO: 4094243 - RNA, 13 nt, Streptococcus pneumoniae R6
aaaaucaaaaagg

SEQ ID NO: 4094244 - RNA, 14 nt, Streptococcus pneumoniae R6
aaaaucaaacaaaa

SEQ ID NO: 4094245 - RNA, 12 nt, Streptococcus pneumoniae R6
aaaaucaaagag

SEQ ID NO: 4094246 - RNA, 14 nt, Streptococcus pneumoniae R6
aaaaucaaagagca

SEQ ID NO: 4094247 - RNA, 16 nt, Streptococcus pneumoniae R6
aaaaucaaagagcaaa

SEQ ID NO: 4094248 - RNA, 14 nt, Streptococcus pneumoniae R6
aaaaucaaagugca

SEQ ID NO: 4094249 - RNA, 23 nt, Streptococcus pneumoniae R6
aaaaucaaguaggcucauccccu

SEQ ID NO: 4094250 - RNA, 18 nt, Streptococcus pneumoniae R6
aaaaucaaugacaaucuc

SEQ ID NO: 4094251 - RNA, 15 nt, Streptococcus pneumoniae R6
aaaaucacguggagu

SEQ ID NO: 4094252 - RNA, 14 nt, Streptococcus pneumoniae R6
aaaaucaggaaauc

SEQ ID NO: 4094253 - RNA, 16 nt, Streptococcus pneumoniae R6
aaaaucaggaaaucuu

SEQ ID NO: 4094254 - RNA, 16 nt, Streptococcus pneumoniae R6
aaaaucaggaagguca

SEQ ID NO: 4094255 - RNA, 23 nt, Streptococcus pneumoniae R6
aaaaucaggucuuauagaaacau

SEQ ID NO: 4094256 - RNA, 18 nt, Streptococcus pneumoniae R6
aaaaucauaaacuaucca

SEQ ID NO: 4094257 - RNA, 22 nt, Streptococcus pneumoniae R6
aaaaucauagagcaaacuagga

SEQ ID NO: 4094258 - RNA, 21 nt, Streptococcus pneumoniae R6
aaaauccacuugggaaaccaa

SEQ ID NO: 4094259 - RNA, 22 nt, Streptococcus pneumoniae R6
aaaauccacuugggaaaccaaa

SEQ ID NO: 4094260 - RNA, 21 nt, Streptococcus pneumoniae R6
aaaauccguuuuuugaaguuu

SEQ ID NO: 4094261 - RNA, 17 nt, Streptococcus pneumoniae R6
aaaauccuaagauuacu

SEQ ID NO: 4094262 - RNA, 20 nt, Streptococcus pneumoniae R6
aaaauccuaguggaaaagau

SEQ ID NO: 4094263 - RNA, 23 nt, Streptococcus pneumoniae R6
aaaauccugcaaggcauaaacuu

SEQ ID NO: 4094264 - RNA, 14 nt, Streptococcus pneumoniae R6
aaaauccuugacca

SEQ ID NO: 4094265 - RNA, 13 nt, Streptococcus pneumoniae R6
aaaauccuuuguu

SEQ ID NO: 4094266 - RNA, 20 nt, Streptococcus pneumoniae R6
aaaauccuuuuuuugaaguu

SEQ ID NO: 4094267 - RNA, 14 nt, Streptococcus pneumoniae R6
aaaaucguaaaaaa

SEQ ID NO: 4094268 - RNA, 16 nt, Streptococcus pneumoniae R6
aaaaucguaaaaaagu

SEQ ID NO: 4094269 - RNA, 22 nt, Streptococcus pneumoniae R6
aaaaucuauuuuuaaauuuuau

SEQ ID NO: 4094270 - RNA, 19 nt, Streptococcus pneumoniae R6
aaaaucucuucaaacaacg

SEQ ID NO: 4094271 - RNA, 12 nt, Streptococcus pneumoniae R6
aaaaucugaaaa

SEQ ID NO: 4094272 - RNA, 14 nt, Streptococcus pneumoniae R6
aaaaucugaagaaa

SEQ ID NO: 4094273 - RNA, 18 nt, Streptococcus pneumoniae R6
aaaaucugaagaaagcaa

SEQ ID NO: 4094274 - RNA, 22 nt, Streptococcus pneumoniae R6
aaaaucugauuccuuuuuucua

SEQ ID NO: 4094275 - RNA, 21 nt, Streptococcus pneumoniae R6
aaaaucuggacauuagggucu

SEQ ID NO: 4094276 - RNA, 18 nt, Streptococcus pneumoniae R6
aaaaucuuaaaaauuaca

SEQ ID NO: 4094277 - RNA, 14 nt, Streptococcus pneumoniae R6
aaaaucuucaaaaa

SEQ ID NO: 4094278 - RNA, 15 nt, Streptococcus pneumoniae R6
aaaaucuucaaaaaa

SEQ ID NO: 4094279 - RNA, 16 nt, Streptococcus pneumoniae R6
aaaaucuucaaaaaag

SEQ ID NO: 4094280 - RNA, 19 nt, Streptococcus pneumoniae R6
aaaaucuuuuacuucugaa

SEQ ID NO: 4094281 - RNA, 10 nt, Streptococcus pneumoniae R6
aaaaugaaaa

SEQ ID NO: 4094282 - RNA, 22 nt, Streptococcus pneumoniae R6
aaaaugaaaaaaauuagaaaaa

SEQ ID NO: 4094283 - RNA, 14 nt, Streptococcus pneumoniae R6
aaaaugaaacaaga

SEQ ID NO: 4094284 - RNA, 14 nt, Streptococcus pneumoniae R6
aaaaugaaauacau

SEQ ID NO: 4094285 - RNA, 20 nt, Streptococcus pneumoniae R6
aaaaugaaauuuuucugcuu

SEQ ID NO: 4094286 - RNA, 15 nt, Streptococcus pneumoniae R6
aaaaugaauuugaaa

SEQ ID NO: 4094287 - RNA, 21 nt, Streptococcus pneumoniae R6
aaaaugaauuugaaacaauga

SEQ ID NO: 4094288 - RNA, 18 nt, Streptococcus pneumoniae R6
aaaaugacuugcaaucuc

SEQ ID NO: 4094289 - RNA, 16 nt, Streptococcus pneumoniae R6
aaaaugaggaaaaucu

SEQ ID NO: 4094290 - RNA, 20 nt, Streptococcus pneumoniae R6
aaaaugagggcauaggcugc

SEQ ID NO: 4094291 - RNA, 16 nt, Streptococcus pneumoniae R6
aaaaugagucuaucaa

SEQ ID NO: 4094292 - RNA, 17 nt, Streptococcus pneumoniae R6
aaaaugauugaaaggau

SEQ ID NO: 4094293 - RNA, 14 nt, Streptococcus pneumoniae R6
aaaaugcucucaaa

SEQ ID NO: 4094294 - RNA, 16 nt, Streptococcus pneumoniae R6
aaaaugguaugucucg

SEQ ID NO: 4094295 - RNA, 15 nt, Streptococcus pneumoniae R6
aaaaugguuccaaaa

SEQ ID NO: 4094296 - RNA, 19 nt, Streptococcus pneumoniae R6
aaaaugguuccaaaaggca

SEQ ID NO: 4094297 - RNA, 18 nt, Streptococcus pneumoniae R6
aaaauguagucauucgaa

SEQ ID NO: 4094298 - RNA, 12 nt, Streptococcus pneumoniae R6
aaaauguaguua

SEQ ID NO: 4094299 - RNA, 12 nt, Streptococcus pneumoniae R6
aaaaugugaaau

SEQ ID NO: 4094300 - RNA, 20 nt, Streptococcus pneumoniae R6
aaaaugugauuucuguaaaa

SEQ ID NO: 4094301 - RNA, 20 nt, Streptococcus pneumoniae R6
aaaauuaaaaagaguagaaa

SEQ ID NO: 4094302 - RNA, 19 nt, Streptococcus pneumoniae R6
aaaauuaaggcgauugcua

SEQ ID NO: 4094303 - RNA, 22 nt, Streptococcus pneumoniae R6
aaaauuacucccauucuucuuu

SEQ ID NO: 4094304 - RNA, 17 nt, Streptococcus pneumoniae R6
aaaauuagcucaaaaca

SEQ ID NO: 4094305 - RNA, 18 nt, Streptococcus pneumoniae R6
aaaauuagcucaaaacac

SEQ ID NO: 4094306 - RNA, 22 nt, Streptococcus pneumoniae R6
aaaauuauagucuuuucacuuu

SEQ ID NO: 4094307 - RNA, 16 nt, Streptococcus pneumoniae R6
aaaccuuguuuuaaaa

SEQ ID NO: 4094308 - RNA, 19 nt, Streptococcus pneumoniae R6
aaacgaaaggauuauaaaa

SEQ ID NO: 4094309 - RNA, 14 nt, Streptococcus pneumoniae R6
aaacgaauacuuug

SEQ ID NO: 4094310 - RNA, 17 nt, Streptococcus pneumoniae R6
aaacgaauacuuuguuu

SEQ ID NO: 4094311 - RNA, 15 nt, Streptococcus pneumoniae R6
aaacgacggucaugc

SEQ ID NO: 4094312 - RNA, 18 nt, Streptococcus pneumoniae R6
aaacgacuagauaaaaga

SEQ ID NO: 4094313 - RNA, 17 nt, Streptococcus pneumoniae R6
aaacgaggacuuagacg

SEQ ID NO: 4094314 - RNA, 19 nt, Streptococcus pneumoniae R6
aaacgagucaagaagaggg

SEQ ID NO: 4094315 - RNA, 23 nt, Streptococcus pneumoniae R6
aaacgauaauagcgauugaauau

SEQ ID NO: 4094316 - RNA, 16 nt, Streptococcus pneumoniae R6
aaacgauuaucuaaca

SEQ ID NO: 4094317 - RNA, 19 nt, Streptococcus pneumoniae R6
aaacgcaagcaacaaaaac

SEQ ID NO: 4094318 - RNA, 18 nt, Streptococcus pneumoniae R6
aaacgcauaguaucaagu

SEQ ID NO: 4094319 - RNA, 17 nt, Streptococcus pneumoniae R6
aaacgcgauacaauaaa

SEQ ID NO: 4094320 - RNA, 18 nt, Streptococcus pneumoniae R6
aaacgcgauacaauaaag

SEQ ID NO: 4094321 - RNA, 19 nt, Streptococcus pneumoniae R6
aaacgcugcucaaaaucgu

SEQ ID NO: 4094322 - RNA, 21 nt, Streptococcus pneumoniae R6
aaacggauuuugugguugaaa

SEQ ID NO: 4094323 - RNA, 20 nt, Streptococcus pneumoniae R6
aaacgguguuuugagcaguc

SEQ ID NO: 4094324 - RNA, 19 nt, Streptococcus pneumoniae R6
aaacguccagccuugucuu

SEQ ID NO: 4094325 - RNA, 20 nt, Streptococcus pneumoniae R6
aaacgucguaaucuuaaagu

SEQ ID NO: 4094326 - RNA, 18 nt, Streptococcus pneumoniae R6
aaacguucccccuuuuuu

SEQ ID NO: 4094327 - RNA, 23 nt, Streptococcus pneumoniae R6
aaacguuuuuacuuuggcaaaga

SEQ ID NO: 4094328 - RNA, 19 nt, Streptococcus pneumoniae R6
aaacguuuuucaaaccuuc

SEQ ID NO: 4094329 - RNA, 23 nt, Streptococcus pneumoniae R6
aaacuaaagcuuuuuucuuuuau

SEQ ID NO: 4094330 - RNA, 18 nt, Streptococcus pneumoniae R6
aaacuaauagguacaaaa

SEQ ID NO: 4094331 - RNA, 11 nt, Streptococcus pneumoniae R6
aaacuaaugag

SEQ ID NO: 4094332 - RNA, 16 nt, Streptococcus pneumoniae R6
aaacuaauguaaaaaa

SEQ ID NO: 4094333 - RNA, 20 nt, Streptococcus pneumoniae R6
aaacuacacccgcauaaaua

SEQ ID NO: 4094334 - RNA, 15 nt, Streptococcus pneumoniae R6
aaacuacgucagcuu

SEQ ID NO: 4094335 - RNA, 20 nt, Streptococcus pneumoniae R6
aaacuacgucagcuuccauc

SEQ ID NO: 4094336 - RNA, 13 nt, Streptococcus pneumoniae R6
aaacuagaaagcu

SEQ ID NO: 4094337 - RNA, 16 nt, Streptococcus pneumoniae R6
aaacuagaaagcuagu

SEQ ID NO: 4094338 - RNA, 13 nt, Streptococcus pneumoniae R6
aaacuagaagugg

SEQ ID NO: 4094339 - RNA, 17 nt, Streptococcus pneumoniae R6
aaacuagaauagaaaca

SEQ ID NO: 4094340 - RNA, 22 nt, Streptococcus pneumoniae R6
aaacuagaauagaaacaaaaua

SEQ ID NO: 4094341 - RNA, 19 nt, Streptococcus pneumoniae R6
aaacuagcaagugcuaaga

SEQ ID NO: 4094342 - RNA, 22 nt, Streptococcus pneumoniae R6
aaacuagcauccaucccauuua

SEQ ID NO: 4094343 - RNA, 20 nt, Streptococcus pneumoniae R6
aaacuagcugcaggcugcuc

SEQ ID NO: 4094344 - RNA, 17 nt, Streptococcus pneumoniae R6
aaacuauauucucucuu

SEQ ID NO: 4094345 - RNA, 18 nt, Streptococcus pneumoniae R6
aaacuauugacuuuucuu

SEQ ID NO: 4094346 - RNA, 16 nt, Streptococcus pneumoniae R6
aaacucaaauguaagu

SEQ ID NO: 4094347 - RNA, 16 nt, Streptococcus pneumoniae R6
aaacucaaauuuacca

SEQ ID NO: 4094348 - RNA, 19 nt, Streptococcus pneumoniae R6
aaacucaauuguauaguga

SEQ ID NO: 4094349 - RNA, 17 nt, Streptococcus pneumoniae R6
aaacucaauuuaauacu

SEQ ID NO: 4094350 - RNA, 20 nt, Streptococcus pneumoniae R6
aaacucacgaagauacugaa

SEQ ID NO: 4094351 - RNA, 14 nt, Streptococcus pneumoniae R6
aaacucagguuucu

SEQ ID NO: 4094352 - RNA, 15 nt, Streptococcus pneumoniae R6
aaacucagguuucuc

SEQ ID NO: 4094353 - RNA, 20 nt, Streptococcus pneumoniae R6
aaacucaguuaaaaucaguu

SEQ ID NO: 4094354 - RNA, 12 nt, Streptococcus pneumoniae R6
aaacucauuaau

SEQ ID NO: 4094355 - RNA, 15 nt, Streptococcus pneumoniae R6
aaacucgaucugaau

SEQ ID NO: 4094356 - RNA, 18 nt, Streptococcus pneumoniae R6
aaacucgaucugaauguc

SEQ ID NO: 4094357 - RNA, 21 nt, Streptococcus pneumoniae R6
aaacucuccugggaaauucca

SEQ ID NO: 4094358 - RNA, 20 nt, Streptococcus pneumoniae R6
aaacucuuaucuaaucacgu

SEQ ID NO: 4094359 - RNA, 12 nt, Streptococcus pneumoniae R6
aaacugaacaag

SEQ ID NO: 4094360 - RNA, 15 nt, Streptococcus pneumoniae R6
aaacugacgaaguca

SEQ ID NO: 4094361 - RNA, 19 nt, Streptococcus pneumoniae R6
aaacugaugaagucaaguc

SEQ ID NO: 4094362 - RNA, 18 nt, Streptococcus pneumoniae R6
aaacugcgaagaaaucau

SEQ ID NO: 4094363 - RNA, 19 nt, Streptococcus pneumoniae R6
aaacugcgaagaaaucauu

SEQ ID NO: 4094364 - RNA, 16 nt, Streptococcus pneumoniae R6
aaacuggagcauuucg

SEQ ID NO: 4094365 - RNA, 15 nt, Streptococcus pneumoniae R6
aaacuggcaaaauua

SEQ ID NO: 4094366 - RNA, 17 nt, Streptococcus pneumoniae R6
aaacugguagaaagucu

SEQ ID NO: 4094367 - RNA, 13 nt, Streptococcus pneumoniae R6
aaacugguuccuu

SEQ ID NO: 4094368 - RNA, 22 nt, Streptococcus pneumoniae R6
aaacugguuccuuuuuagguac

SEQ ID NO: 4094369 - RNA, 20 nt, Streptococcus pneumoniae R6
aaacuguaaacgaauacuuu

SEQ ID NO: 4094370 - RNA, 18 nt, Streptococcus pneumoniae R6
aaacuguaaaguagcaaa

SEQ ID NO: 4094371 - RNA, 23 nt, Streptococcus pneumoniae R6
aaacuguaaaguagcaaaacacu

SEQ ID NO: 4094372 - RNA, 18 nt, Streptococcus pneumoniae R6
aaacuguacaagaacaaa

SEQ ID NO: 4094373 - RNA, 15 nt, Streptococcus pneumoniae R6
aaacuguaugagaaa

SEQ ID NO: 4094374 - RNA, 22 nt, Streptococcus pneumoniae R6
aaacuguccacaaagauaucac

SEQ ID NO: 4094375 - RNA, 19 nt, Streptococcus pneumoniae R6
aaacugugauggauacuua

SEQ ID NO: 4094376 - RNA, 22 nt, Streptococcus pneumoniae R6
aaacuguggaaaauagaaaaaa

SEQ ID NO: 4094377 - RNA, 12 nt, Streptococcus pneumoniae R6
aaacuuaaaaau

SEQ ID NO: 4094378 - RNA, 16 nt, Streptococcus pneumoniae R6
aaacuuaaauuuuugu

SEQ ID NO: 4094379 - RNA, 15 nt, Streptococcus pneumoniae R6
aaacuuaggaagcag

SEQ ID NO: 4094380 - RNA, 16 nt, Streptococcus pneumoniae R6
aaacuuaguaaacagu

SEQ ID NO: 4094381 - RNA, 18 nt, Streptococcus pneumoniae R6
aaacuucacgguuuguau

SEQ ID NO: 4094382 - RNA, 22 nt, Streptococcus pneumoniae R6
aaacuucgucauuuaaagaugu

SEQ ID NO: 4094383 - RNA, 13 nt, Streptococcus pneumoniae R6
aaacuugaaauga

SEQ ID NO: 4094384 - RNA, 18 nt, Streptococcus pneumoniae R6
aaacuugcaggaaauuuu

SEQ ID NO: 4094385 - RNA, 21 nt, Streptococcus pneumoniae R6
aaacuugguaauuugaacaaa

SEQ ID NO: 4094386 - RNA, 20 nt, Streptococcus pneumoniae R6
aaacuugugauuuaguagca

SEQ ID NO: 4094387 - RNA, 22 nt, Streptococcus pneumoniae R6
aaacuuuauaauauguauuuau

SEQ ID NO: 4094388 - RNA, 16 nt, Streptococcus pneumoniae R6
aaacuuugagccuagu

SEQ ID NO: 4094389 - RNA, 21 nt, Streptococcus pneumoniae R6
aaacuuuuuaaaaaaucuuuu

SEQ ID NO: 4094390 - RNA, 13 nt, Streptococcus pneumoniae R6
aaacuuuuucucu

SEQ ID NO: 4094391 - RNA, 23 nt, Streptococcus pneumoniae R6
aaacuuuuucucucugaauagaa

SEQ ID NO: 4094392 - RNA, 13 nt, Streptococcus pneumoniae R6
aaagaaaaaacaa

SEQ ID NO: 4094393 - RNA, 11 nt, Streptococcus pneumoniae R6
aaagaaaaagu

SEQ ID NO: 4094394 - RNA, 16 nt, Streptococcus pneumoniae R6
aaagaaacucuaaaca

SEQ ID NO: 4094395 - RNA, 14 nt, Streptococcus pneumoniae R6
aaagaaacuuggca

SEQ ID NO: 4094396 - RNA, 16 nt, Streptococcus pneumoniae R6
aaagaaauagaaaaca

SEQ ID NO: 4094397 - RNA, 23 nt, Streptococcus pneumoniae R6
aaagaaauuauucuuaucuuugg

SEQ ID NO: 4094398 - RNA, 21 nt, Streptococcus pneumoniae R6
aaagaaauuggcugcaauaau

SEQ ID NO: 4094399 - RNA, 14 nt, Streptococcus pneumoniae R6
aaagaacaaaaaau

SEQ ID NO: 4094400 - RNA, 12 nt, Streptococcus pneumoniae R6
aaagaacuccug

SEQ ID NO: 4094401 - RNA, 15 nt, Streptococcus pneumoniae R6
aaagaagcagaaaaa

SEQ ID NO: 4094402 - RNA, 23 nt, Streptococcus pneumoniae R6
aaagaaggaauucaagcaaaaca

SEQ ID NO: 4094403 - RNA, 21 nt, Streptococcus pneumoniae R6
aaagaaggagccagcugaaaa

SEQ ID NO: 4094404 - RNA, 20 nt, Streptococcus pneumoniae R6
aaagaaggcuuuaccaaaaa

SEQ ID NO: 4094405 - RNA, 22 nt, Streptococcus pneumoniae R6
aaagaaggcuuuaccaaaaaug

SEQ ID NO: 4094406 - RNA, 20 nt, Streptococcus pneumoniae R6
aaagaagguauucauaaaau

SEQ ID NO: 4094407 - RNA, 19 nt, Streptococcus pneumoniae R6
aaagaaguaaaucuuccca

SEQ ID NO: 4094408 - RNA, 21 nt, Streptococcus pneumoniae R6
aaagaaguaaaucuucccaua

SEQ ID NO: 4094409 - RNA, 14 nt, Streptococcus pneumoniae R6
aaagcuuacaucau

SEQ ID NO: 4094410 - RNA, 20 nt, Streptococcus pneumoniae R6
aaagcuucuguuucuagucc

SEQ ID NO: 4094411 - RNA, 23 nt, Streptococcus pneumoniae R6
aaagcuuggcuuugauucaucuc

SEQ ID NO: 4094412 - RNA, 15 nt, Streptococcus pneumoniae R6
aaagcuuguuuaaaa

SEQ ID NO: 4094413 - RNA, 17 nt, Streptococcus pneumoniae R6
aaagcuuuugaguacuu

SEQ ID NO: 4094414 - RNA, 14 nt, Streptococcus pneumoniae R6
aaagcuuuuuucuu

SEQ ID NO: 4094415 - RNA, 17 nt, Streptococcus pneumoniae R6
aaagcuuuuuucuuuua

SEQ ID NO: 4094416 - RNA, 14 nt, Streptococcus pneumoniae R6
aaaggaaaacuucc

SEQ ID NO: 4094417 - RNA, 14 nt, Streptococcus pneumoniae R6
aaaggaaaauugau

SEQ ID NO: 4094418 - RNA, 17 nt, Streptococcus pneumoniae R6
aaaggaaaauugauuua

SEQ ID NO: 4094419 - RNA, 22 nt, Streptococcus pneumoniae R6
aaaggaaucugcguuauaugcu

SEQ ID NO: 4094420 - RNA, 22 nt, Streptococcus pneumoniae R6
aaaggacaaauuuuguccuuuc

SEQ ID NO: 4094421 - RNA, 13 nt, Streptococcus pneumoniae R6
aaaggagaaaaaa

SEQ ID NO: 4094422 - RNA, 14 nt, Streptococcus pneumoniae R6
aaaggagaaaaaau

SEQ ID NO: 4094423 - RNA, 20 nt, Streptococcus pneumoniae R6
aaaggagaagauuucagaaa

SEQ ID NO: 4094424 - RNA, 18 nt, Streptococcus pneumoniae R6
aaaggagaggagaauuuu

SEQ ID NO: 4094425 - RNA, 18 nt, Streptococcus pneumoniae R6
aaaggagcgauugaagau

SEQ ID NO: 4094426 - RNA, 23 nt, Streptococcus pneumoniae R6
aaaggaguagaaaaugaaauuuu

SEQ ID NO: 4094427 - RNA, 19 nt, Streptococcus pneumoniae R6
aaaggauagacacaauggu

SEQ ID NO: 4094428 - RNA, 15 nt, Streptococcus pneumoniae R6
aaaggauaugaggag

SEQ ID NO: 4094429 - RNA, 16 nt, Streptococcus pneumoniae R6
aaaggauaugaggaga

SEQ ID NO: 4094430 - RNA, 16 nt, Streptococcus pneumoniae R6
aaaggauugagccagg

SEQ ID NO: 4094431 - RNA, 20 nt, Streptococcus pneumoniae R6
aaaggcaacgaagcuagaaa

SEQ ID NO: 4094432 - RNA, 19 nt, Streptococcus pneumoniae R6
aaaggcaucuugucaaaga

SEQ ID NO: 4094433 - RNA, 20 nt, Streptococcus pneumoniae R6
aaaggcauugcguuugauaa

SEQ ID NO: 4094434 - RNA, 18 nt, Streptococcus pneumoniae R6
aaaggccaaguccagagg

SEQ ID NO: 4094435 - RNA, 20 nt, Streptococcus pneumoniae R6
aaaggcuauagucaaaggga

SEQ ID NO: 4094436 - RNA, 16 nt, Streptococcus pneumoniae R6
aaaggcuuagccaguc

SEQ ID NO: 4094437 - RNA, 20 nt, Streptococcus pneumoniae R6
aaaggcuugcguuuuugccu

SEQ ID NO: 4094438 - RNA, 14 nt, Streptococcus pneumoniae R6
aaaggcuuuuucuu

SEQ ID NO: 4094439 - RNA, 17 nt, Streptococcus pneumoniae R6
aaagggaaaucugaaaa

SEQ ID NO: 4094440 - RNA, 21 nt, Streptococcus pneumoniae R6
aaagggauaaguugauacuua

SEQ ID NO: 4094441 - RNA, 21 nt, Streptococcus pneumoniae R6
aaaggggcucuuugucaacug

SEQ ID NO: 4094442 - RNA, 22 nt, Streptococcus pneumoniae R6
aaaggggcucuuugucaacugu

SEQ ID NO: 4094443 - RNA, 18 nt, Streptococcus pneumoniae R6
aaaggguucuacaaaucc

SEQ ID NO: 4094444 - RNA, 20 nt, Streptococcus pneumoniae R6
aaaggucaaaauuccuaaaa

SEQ ID NO: 4094445 - RNA, 16 nt, Streptococcus pneumoniae R6
aaagguguucaaucca

SEQ ID NO: 4094446 - RNA, 22 nt, Streptococcus pneumoniae R6
aaagguguucaauccaauugua

SEQ ID NO: 4094447 - RNA, 20 nt, Streptococcus pneumoniae R6
aaagguucuuuuauccuguu

SEQ ID NO: 4094448 - RNA, 23 nt, Streptococcus pneumoniae R6
aaagguucuuuuauccuguucuu

SEQ ID NO: 4094449 - RNA, 16 nt, Streptococcus pneumoniae R6
aaagguuuuaaagaca

SEQ ID NO: 4094450 - RNA, 17 nt, Streptococcus pneumoniae R6
aaagguuuuaaagacag

SEQ ID NO: 4094451 - RNA, 14 nt, Streptococcus pneumoniae R6
aaagguuuuugaug

SEQ ID NO: 4094452 - RNA, 22 nt, Streptococcus pneumoniae R6
aaaguaaaaauuucuaugauaa

SEQ ID NO: 4094453 - RNA, 22 nt, Streptococcus pneumoniae R6
aaaguaaaauacaaaccaaacg

SEQ ID NO: 4094454 - RNA, 17 nt, Streptococcus pneumoniae R6
aaaguaaaauuaauuuc

SEQ ID NO: 4094455 - RNA, 13 nt, Streptococcus pneumoniae R6
aaaguaaccaucu

SEQ ID NO: 4094456 - RNA, 17 nt, Streptococcus pneumoniae R6
aaaguaagaaucugcau

SEQ ID NO: 4094457 - RNA, 12 nt, Streptococcus pneumoniae R6
aaaguaagagaa

SEQ ID NO: 4094458 - RNA, 19 nt, Streptococcus pneumoniae R6
aaaguaagaguugauagau

SEQ ID NO: 4094459 - RNA, 21 nt, Streptococcus pneumoniae R6
aaaguacagauuugaaaacug

SEQ ID NO: 4094460 - RNA, 13 nt, Streptococcus pneumoniae R6
aaaguacgaaggg

SEQ ID NO: 4094461 - RNA, 14 nt, Streptococcus pneumoniae R6
aaaguacugccuug

SEQ ID NO: 4094462 - RNA, 14 nt, Streptococcus pneumoniae R6
aaaguacugcuuug

SEQ ID NO: 4094463 - RNA, 21 nt, Streptococcus pneumoniae R6
aaaguacugcuuugagguugu

SEQ ID NO: 4094464 - RNA, 15 nt, Streptococcus pneumoniae R6
aaaguacuuuuaaua

SEQ ID NO: 4094465 - RNA, 21 nt, Streptococcus pneumoniae R6
aaaguagagauaaguggcaaa

SEQ ID NO: 4094466 - RNA, 19 nt, Streptococcus pneumoniae R6
aaaguagaguccaaagacc

SEQ ID NO: 4094467 - RNA, 13 nt, Streptococcus pneumoniae R6
aaaguagcaaaac

SEQ ID NO: 4094468 - RNA, 18 nt, Streptococcus pneumoniae R6
aaaguagcaaaacacuac

SEQ ID NO: 4094469 - RNA, 18 nt, Streptococcus pneumoniae R6
aaaguaggacgauaaaaa

SEQ ID NO: 4094470 - RNA, 20 nt, Streptococcus pneumoniae R6
aaaguaggacgauaaaaacg

SEQ ID NO: 4094471 - RNA, 21 nt, Streptococcus pneumoniae R6
aaaguaguaacuuuuucagga

SEQ ID NO: 4094472 - RNA, 21 nt, Streptococcus pneumoniae R6
aaaguagucauuuuguucucc

SEQ ID NO: 4094473 - RNA, 13 nt, Streptococcus pneumoniae R6
aaaguauacucua

SEQ ID NO: 4094474 - RNA, 14 nt, Streptococcus pneumoniae R6
aaaguauuaaucac

SEQ ID NO: 4094475 - RNA, 15 nt, Streptococcus pneumoniae R6
aaaguauuauaauau

SEQ ID NO: 4094476 - RNA, 17 nt, Streptococcus pneumoniae R6
aaaguauuauaauauaa

SEQ ID NO: 4094477 - RNA, 18 nt, Streptococcus pneumoniae R6
aaaguauuauaauauaau

SEQ ID NO: 4094478 - RNA, 15 nt, Streptococcus pneumoniae R6
aaagucaaacaaugu

SEQ ID NO: 4094479 - RNA, 16 nt, Streptococcus pneumoniae R6
aaagucauacuuucuc

SEQ ID NO: 4094480 - RNA, 16 nt, Streptococcus pneumoniae R6
aaagucaucaaaaucc

SEQ ID NO: 4094481 - RNA, 16 nt, Streptococcus pneumoniae R6
aaaguccaaagaugag

SEQ ID NO: 4094482 - RNA, 21 nt, Streptococcus pneumoniae R6
aaagucuaauguaauucucaa

SEQ ID NO: 4094483 - RNA, 20 nt, Streptococcus pneumoniae R6
aaagucugaaucaaaaauga

SEQ ID NO: 4094484 - RNA, 17 nt, Streptococcus pneumoniae R6
aaagucuugacaaagaa

SEQ ID NO: 4094485 - RNA, 19 nt, Streptococcus pneumoniae R6
aaagucuugacaaagaaaa

SEQ ID NO: 4094486 - RNA, 13 nt, Streptococcus pneumoniae R6
aaagucuuuaaaa

SEQ ID NO: 4094487 - RNA, 14 nt, Streptococcus pneumoniae R6
aaagucuuuaaaau

SEQ ID NO: 4094488 - RNA, 18 nt, Streptococcus pneumoniae R6
aaagucuuuaaaauuaua

SEQ ID NO: 4094489 - RNA, 13 nt, Streptococcus pneumoniae R6
aaagugaaaggaa

SEQ ID NO: 4094490 - RNA, 15 nt, Streptococcus pneumoniae R6
aaagugaaaggaaga

SEQ ID NO: 4094491 - RNA, 17 nt, Streptococcus pneumoniae R6
aaagugagauauauuga

SEQ ID NO: 4094492 - RNA, 20 nt, Streptococcus pneumoniae R6
aaagugcaaauaagaaaucu

SEQ ID NO: 4094493 - RNA, 22 nt, Streptococcus pneumoniae R6
aaagugcaaauaagaaaucucc

SEQ ID NO: 4094494 - RNA, 17 nt, Streptococcus pneumoniae R6
aaaguggaaagagcaga

SEQ ID NO: 4094495 - RNA, 15 nt, Streptococcus pneumoniae R6
aaagugggaacuaga

SEQ ID NO: 4094496 - RNA, 19 nt, Streptococcus pneumoniae R6
aaaguggguuuuaacuaca

SEQ ID NO: 4094497 - RNA, 19 nt, Streptococcus pneumoniae R6
aaagugguaucauauaaau

SEQ ID NO: 4094498 - RNA, 20 nt, Streptococcus pneumoniae R6
aaagugguaucauauaaaua

SEQ ID NO: 4094499 - RNA, 21 nt, Streptococcus pneumoniae R6
aaagugguaucauauaaauau

SEQ ID NO: 4094500 - RNA, 21 nt, Streptococcus pneumoniae R6
aaaguggucguuuuucaugaa

SEQ ID NO: 4094501 - RNA, 14 nt, Streptococcus pneumoniae R6
aaagugucagauag

SEQ ID NO: 4094502 - RNA, 24 nt, Streptococcus pneumoniae R6
aaagugucagauaggauugcccua

SEQ ID NO: 4094503 - RNA, 14 nt, Streptococcus pneumoniae R6
aaagugugacacua

SEQ ID NO: 4094504 - RNA, 16 nt, Streptococcus pneumoniae R6
aaaguguucugucuug

SEQ ID NO: 4094505 - RNA, 16 nt, Streptococcus pneumoniae R6
aaaguuaaaaaaacua

SEQ ID NO: 4094506 - RNA, 19 nt, Streptococcus pneumoniae R6
aaaguuacuugauugcaaa

SEQ ID NO: 4094507 - RNA, 19 nt, Streptococcus pneumoniae R6
aaaguuagacaaauaauuu

SEQ ID NO: 4094508 - RNA, 20 nt, Streptococcus pneumoniae R6
aaaguuagacaaauaauuua

SEQ ID NO: 4094509 - RNA, 24 nt, Streptococcus pneumoniae R6
aaaguuagacaaauaauuuaucca

SEQ ID NO: 4094510 - RNA, 15 nt, Streptococcus pneumoniae R6
aaaguuagacagaaa

SEQ ID NO: 4094511 - RNA, 14 nt, Streptococcus pneumoniae R6
aaaucaaauuuauu

SEQ ID NO: 4094512 - RNA, 21 nt, Streptococcus pneumoniae R6
aaaucaacggccgaacuuuug

SEQ ID NO: 4094513 - RNA, 13 nt, Streptococcus pneumoniae R6
aaaucaagggaaa

SEQ ID NO: 4094514 - RNA, 17 nt, Streptococcus pneumoniae R6
aaaucaagggaaaauga

SEQ ID NO: 4094515 - RNA, 23 nt, Streptococcus pneumoniae R6
aaaucaagguuuuugaacaccug

SEQ ID NO: 4094516 - RNA, 23 nt, Streptococcus pneumoniae R6
aaaucaauuucuagcaaaguuuu

SEQ ID NO: 4094517 - RNA, 14 nt, Streptococcus pneumoniae R6
aaaucaauuuuccu

SEQ ID NO: 4094518 - RNA, 14 nt, Streptococcus pneumoniae R6
aaaucacagaccga

SEQ ID NO: 4094519 - RNA, 20 nt, Streptococcus pneumoniae R6
aaaucacagugggcuauucc

SEQ ID NO: 4094520 - RNA, 16 nt, Streptococcus pneumoniae R6
aaaucacaucugcuag

SEQ ID NO: 4094521 - RNA, 19 nt, Streptococcus pneumoniae R6
aaaucacgcuaaguagaaa

SEQ ID NO: 4094522 - RNA, 23 nt, Streptococcus pneumoniae R6
aaaucacguggagucugaccaug

SEQ ID NO: 4094523 - RNA, 14 nt, Streptococcus pneumoniae R6
aaaucagaaaaacg

SEQ ID NO: 4094524 - RNA, 14 nt, Streptococcus pneumoniae R6
aaaucagaaaagua

SEQ ID NO: 4094525 - RNA, 23 nt, Streptococcus pneumoniae R6
aaaucagaaccuuugagaaaaau

SEQ ID NO: 4094526 - RNA, 21 nt, Streptococcus pneumoniae R6
aaaucagccauugaaaauccu

SEQ ID NO: 4094527 - RNA, 22 nt, Streptococcus pneumoniae R6
aaaucagcuaagccuuuuucuu

SEQ ID NO: 4094528 - RNA, 18 nt, Streptococcus pneumoniae R6
aaaucagcucucugauuu

SEQ ID NO: 4094529 - RNA, 15 nt, Streptococcus pneumoniae R6
aaaucaggaaaucuu

SEQ ID NO: 4094530 - RNA, 13 nt, Streptococcus pneumoniae R6
aaaucauaaacac

SEQ ID NO: 4094531 - RNA, 18 nt, Streptococcus pneumoniae R6
aaaucauaaacuauccag

SEQ ID NO: 4094532 - RNA, 18 nt, Streptococcus pneumoniae R6
aaaucauaaagccagucg

SEQ ID NO: 4094533 - RNA, 20 nt, Streptococcus pneumoniae R6
aaaucauaauccaacaccaa

SEQ ID NO: 4094534 - RNA, 21 nt, Streptococcus pneumoniae R6
aaaucauacaccucuucugau

SEQ ID NO: 4094535 - RNA, 13 nt, Streptococcus pneumoniae R6
aaaucauccauau

SEQ ID NO: 4094536 - RNA, 17 nt, Streptococcus pneumoniae R6
aaaucaucgccaaauca

SEQ ID NO: 4094537 - RNA, 22 nt, Streptococcus pneumoniae R6
aaaucaucgccaaaucaucaaa

SEQ ID NO: 4094538 - RNA, 23 nt, Streptococcus pneumoniae R6
aaaucaucugcaucaagaacaau

SEQ ID NO: 4094539 - RNA, 19 nt, Streptococcus pneumoniae R6
aaaucauuauagaaggcaa

SEQ ID NO: 4094540 - RNA, 16 nt, Streptococcus pneumoniae R6
aaaucauugauaguaa

SEQ ID NO: 4094541 - RNA, 13 nt, Streptococcus pneumoniae R6
aaaucauuuucuu

SEQ ID NO: 4094542 - RNA, 13 nt, Streptococcus pneumoniae R6
aaaucauuuugac

SEQ ID NO: 4094543 - RNA, 20 nt, Streptococcus pneumoniae R6
aaauccaaacgauuaucuaa

SEQ ID NO: 4094544 - RNA, 18 nt, Streptococcus pneumoniae R6
aaauccaaucuucuagcu

SEQ ID NO: 4094545 - RNA, 21 nt, Streptococcus pneumoniae R6
aaauccacuugggaaaccaaa

SEQ ID NO: 4094546 - RNA, 22 nt, Streptococcus pneumoniae R6
aaauccacuugggaaaccaaac

SEQ ID NO: 4094547 - RNA, 17 nt, Streptococcus pneumoniae R6
aaauccauaauuaccac

SEQ ID NO: 4094548 - RNA, 22 nt, Streptococcus pneumoniae R6
aaauccauaauuaccaccaaca

SEQ ID NO: 4094549 - RNA, 22 nt, Streptococcus pneumoniae R6
aaauccauaguaaacuucuucu

SEQ ID NO: 4094550 - RNA, 18 nt, Streptococcus pneumoniae R6
aaauccaugauccuucau

SEQ ID NO: 4094551 - RNA, 15 nt, Streptococcus pneumoniae R6
aaaucccaaguaaau

SEQ ID NO: 4094552 - RNA, 17 nt, Streptococcus pneumoniae R6
aaaucccauaguagucu

SEQ ID NO: 4094553 - RNA, 14 nt, Streptococcus pneumoniae R6
aaaucccuagcuca

SEQ ID NO: 4094554 - RNA, 23 nt, Streptococcus pneumoniae R6
aaaucccuuguuuaguaaacaaa

SEQ ID NO: 4094555 - RNA, 20 nt, Streptococcus pneumoniae R6
aaauccgcuugggaaaccaa

SEQ ID NO: 4094556 - RNA, 21 nt, Streptococcus pneumoniae R6
aaauccgcuugggaaaccaaa

SEQ ID NO: 4094557 - RNA, 18 nt, Streptococcus pneumoniae R6
aaauccgguguaagggaa

SEQ ID NO: 4094558 - RNA, 22 nt, Streptococcus pneumoniae R6
aaauccuagauacagugaaggc

SEQ ID NO: 4094559 - RNA, 17 nt, Streptococcus pneumoniae R6
aaauccuccaguuuugu

SEQ ID NO: 4094560 - RNA, 20 nt, Streptococcus pneumoniae R6
aaauccucuacaugagccag

SEQ ID NO: 4094561 - RNA, 23 nt, Streptococcus pneumoniae R6
aaauccucuacaugagccaguuu

SEQ ID NO: 4094562 - RNA, 22 nt, Streptococcus pneumoniae R6
aaauccucugaguauuuagcaa

SEQ ID NO: 4094563 - RNA, 19 nt, Streptococcus pneumoniae R6
aaauccugcaaagauaggg

SEQ ID NO: 4094564 - RNA, 22 nt, Streptococcus pneumoniae R6
aaauccuuuuuucuuuacucuu

SEQ ID NO: 4094565 - RNA, 18 nt, Streptococcus pneumoniae R6
aaauccuuuuuuugaagu

SEQ ID NO: 4094566 - RNA, 19 nt, Streptococcus pneumoniae R6
aaauccuuuuuuugaaguu

SEQ ID NO: 4094567 - RNA, 16 nt, Streptococcus pneumoniae R6
aaaucgauaaagaaga

SEQ ID NO: 4094568 - RNA, 16 nt, Streptococcus pneumoniae R6
aaaucgaucuguucuu

SEQ ID NO: 4094569 - RNA, 16 nt, Streptococcus pneumoniae R6
aaaucgauuucuaaca

SEQ ID NO: 4094570 - RNA, 23 nt, Streptococcus pneumoniae R6
aaaucgauuucuaacaauguuuu

SEQ ID NO: 4094571 - RNA, 17 nt, Streptococcus pneumoniae R6
aaaucguaaaaaagucu

SEQ ID NO: 4094572 - RNA, 14 nt, Streptococcus pneumoniae R6
aaaucguucaggac

SEQ ID NO: 4094573 - RNA, 22 nt, Streptococcus pneumoniae R6
aaaucguuccagcgguaucaau

SEQ ID NO: 4094574 - RNA, 22 nt, Streptococcus pneumoniae R6
aaaucguuuaucacucaguuuc

SEQ ID NO: 4094575 - RNA, 18 nt, Streptococcus pneumoniae R6
aaaucuaagucaaauaag

SEQ ID NO: 4094576 - RNA, 17 nt, Streptococcus pneumoniae R6
aaaucuaaucauucuga

SEQ ID NO: 4094577 - RNA, 22 nt, Streptococcus pneumoniae R6
aaaucuacuaucucuacauucc

SEQ ID NO: 4094578 - RNA, 16 nt, Streptococcus pneumoniae R6
aaaucuaggacaaagc

SEQ ID NO: 4094579 - RNA, 18 nt, Streptococcus pneumoniae R6
aaaucuagucaucagaaa

SEQ ID NO: 4094580 - RNA, 16 nt, Streptococcus pneumoniae R6
aaaucucauuugauga

SEQ ID NO: 4094581 - RNA, 18 nt, Streptococcus pneumoniae R6
aaaucuccagaccaccuu

SEQ ID NO: 4094582 - RNA, 16 nt, Streptococcus pneumoniae R6
aaaucuccucuaccug

SEQ ID NO: 4094583 - RNA, 20 nt, Streptococcus pneumoniae R6
aaaucuggacauuagggucu

SEQ ID NO: 4094584 - RNA, 13 nt, Streptococcus pneumoniae R6
aaaucugucuacc

SEQ ID NO: 4094585 - RNA, 21 nt, Streptococcus pneumoniae R6
aaaucuucagauucagcuaaa

SEQ ID NO: 4094586 - RNA, 20 nt, Streptococcus pneumoniae R6
aaaucuucccacaauaaaaa

SEQ ID NO: 4094587 - RNA, 22 nt, Streptococcus pneumoniae R6
aaaucuucccacaauaaaaagc

SEQ ID NO: 4094588 - RNA, 23 nt, Streptococcus pneumoniae R6
aaaucuucccacaauaaaaagca

SEQ ID NO: 4094589 - RNA, 20 nt, Streptococcus pneumoniae R6
aaaucuuccuacauauguaa

SEQ ID NO: 4094590 - RNA, 20 nt, Streptococcus pneumoniae R6
aaaucuuccuagaauaugaa

SEQ ID NO: 4094591 - RNA, 15 nt, Streptococcus pneumoniae R6
aaaucuucuuacaua

SEQ ID NO: 4094592 - RNA, 17 nt, Streptococcus pneumoniae R6
aaaucuuuaaggcacua

SEQ ID NO: 4094593 - RNA, 13 nt, Streptococcus pneumoniae R6
aaaucuuugauuu

SEQ ID NO: 4094594 - RNA, 22 nt, Streptococcus pneumoniae R6
aaaucuuuggaggcaauacguu

SEQ ID NO: 4094595 - RNA, 15 nt, Streptococcus pneumoniae R6
aaaucuuuuucauaa

SEQ ID NO: 4094596 - RNA, 15 nt, Streptococcus pneumoniae R6
aaaugaaaaggcaga

SEQ ID NO: 4094597 - RNA, 18 nt, Streptococcus pneumoniae R6
aaaugaaaaggcagauuc

SEQ ID NO: 4094598 - RNA, 20 nt, Streptococcus pneumoniae R6
aaaugaaacaaaaacaggac

SEQ ID NO: 4094599 - RNA, 15 nt, Streptococcus pneumoniae R6
aaaugaaagaaacuc

SEQ ID NO: 4094600 - RNA, 20 nt, Streptococcus pneumoniae R6
aaaugaaauaagaacaggac

SEQ ID NO: 4094601 - RNA, 15 nt, Streptococcus pneumoniae R6
aaaugaaauaagaau

SEQ ID NO: 4094602 - RNA, 20 nt, Streptococcus pneumoniae R6
aaaugaaauaauaacaggac

SEQ ID NO: 4094603 - RNA, 17 nt, Streptococcus pneumoniae R6
aaaugaaauauuuuuua

SEQ ID NO: 4094604 - RNA, 12 nt, Streptococcus pneumoniae R6
aaaugaaauuuu

SEQ ID NO: 4094605 - RNA, 23 nt, Streptococcus pneumoniae R6
aaaugaauuugaaacaaugaaaa

SEQ ID NO: 4094606 - RNA, 24 nt, Streptococcus pneumoniae R6
aaaugaauuugaaacaaugaaaau

SEQ ID NO: 4094607 - RNA, 15 nt, Streptococcus pneumoniae R6
aaaugacaauaaaau

SEQ ID NO: 4094608 - RNA, 16 nt, Streptococcus pneumoniae R6
aaaugacuacgcgacc

SEQ ID NO: 4094609 - RNA, 23 nt, Streptococcus pneumoniae R6
aaaugacuuucuaauuauuucaa

SEQ ID NO: 4094610 - RNA, 12 nt, Streptococcus pneumoniae R6
aaaugagaaauu

SEQ ID NO: 4094611 - RNA, 23 nt, Streptococcus pneumoniae R6
aaaugagagauucauucugcuag

SEQ ID NO: 4094612 - RNA, 21 nt, Streptococcus pneumoniae R6
aaauuucuccgguuccuuauu

SEQ ID NO: 4094613 - RNA, 21 nt, Streptococcus pneumoniae R6
aaauuucucugguuccuuauu

SEQ ID NO: 4094614 - RNA, 14 nt, Streptococcus pneumoniae R6
aaauuugaaaaucu

SEQ ID NO: 4094615 - RNA, 11 nt, Streptococcus pneumoniae R6
aaauuugacca

SEQ ID NO: 4094616 - RNA, 10 nt, Streptococcus pneumoniae R6
aaauuugacu

SEQ ID NO: 4094617 - RNA, 17 nt, Streptococcus pneumoniae R6
aaauuugaucauccaaa

SEQ ID NO: 4094618 - RNA, 15 nt, Streptococcus pneumoniae R6
aaauuuggaaaauag

SEQ ID NO: 4094619 - RNA, 22 nt, Streptococcus pneumoniae R6
aaauuugugauacgugaacaag

SEQ ID NO: 4094620 - RNA, 14 nt, Streptococcus pneumoniae R6
aaauuuuauacaaa

SEQ ID NO: 4094621 - RNA, 19 nt, Streptococcus pneumoniae R6
aaauuuuaucuuugaaaua

SEQ ID NO: 4094622 - RNA, 14 nt, Streptococcus pneumoniae R6
aaauuuucaaaauc

SEQ ID NO: 4094623 - RNA, 20 nt, Streptococcus pneumoniae R6
aaauuuugauaccuucuuua

SEQ ID NO: 4094624 - RNA, 14 nt, Streptococcus pneumoniae R6
aaauuuuguccuuu

SEQ ID NO: 4094625 - RNA, 18 nt, Streptococcus pneumoniae R6
aaauuuuguccuuucuuu

SEQ ID NO: 4094626 - RNA, 16 nt, Streptococcus pneumoniae R6
aaauuuuucugcaaaa

SEQ ID NO: 4094627 - RNA, 13 nt, Streptococcus pneumoniae R6
aaauuuuuuucua

SEQ ID NO: 4094628 - RNA, 14 nt, Streptococcus pneumoniae R6
aacaaaaaagguca

SEQ ID NO: 4094629 - RNA, 20 nt, Streptococcus pneumoniae R6
aacaaaaaaggucaucagca

SEQ ID NO: 4094630 - RNA, 16 nt, Streptococcus pneumoniae R6
aacaaaaaaugcucug

SEQ ID NO: 4094631 - RNA, 12 nt, Streptococcus pneumoniae R6
aacaaaaauacg

SEQ ID NO: 4094632 - RNA, 13 nt, Streptococcus pneumoniae R6
aacaaaaauuuga

SEQ ID NO: 4094633 - RNA, 15 nt, Streptococcus pneumoniae R6
aacaaaaauuugauc

SEQ ID NO: 4094634 - RNA, 13 nt, Streptococcus pneumoniae R6
aacaaaagagcua

SEQ ID NO: 4094635 - RNA, 17 nt, Streptococcus pneumoniae R6
aacaaaagucuucuaac

SEQ ID NO: 4094636 - RNA, 19 nt, Streptococcus pneumoniae R6
aacaaaaucgcuaagaggg

SEQ ID NO: 4094637 - RNA, 15 nt, Streptococcus pneumoniae R6
aacaaaauuaucaac

SEQ ID NO: 4094638 - RNA, 15 nt, Streptococcus pneumoniae R6
aacaaaauuauuaaa

SEQ ID NO: 4094639 - RNA, 22 nt, Streptococcus pneumoniae R6
aacaaaauuauuaaaaucaaaa

SEQ ID NO: 4094640 - RNA, 12 nt, Streptococcus pneumoniae R6
aacaaagagguu

SEQ ID NO: 4094641 - RNA, 16 nt, Streptococcus pneumoniae R6
aacaaaggauuucugc

SEQ ID NO: 4094642 - RNA, 14 nt, Streptococcus pneumoniae R6
aacaaauaaaucau

SEQ ID NO: 4094643 - RNA, 19 nt, Streptococcus pneumoniae R6
aacaaauaauauguaaaga

SEQ ID NO: 4094644 - RNA, 16 nt, Streptococcus pneumoniae R6
aacaaaucagaaaagu

SEQ ID NO: 4094645 - RNA, 15 nt, Streptococcus pneumoniae R6
aacaaauccaaucuu

SEQ ID NO: 4094646 - RNA, 23 nt, Streptococcus pneumoniae R6
aacaaaucgauugggaaaguaaa

SEQ ID NO: 4094647 - RNA, 17 nt, Streptococcus pneumoniae R6
aacaaauugauaagagg

SEQ ID NO: 4094648 - RNA, 21 nt, Streptococcus pneumoniae R6
aacaaauugauaagaggauuu

SEQ ID NO: 4094649 - RNA, 18 nt, Streptococcus pneumoniae R6
aacaaauuguuauuaaga

SEQ ID NO: 4094650 - RNA, 21 nt, Streptococcus pneumoniae R6
aacaacaccgcagucuucaau

SEQ ID NO: 4094651 - RNA, 22 nt, Streptococcus pneumoniae R6
aacaacaucuuuccagaacuuc

SEQ ID NO: 4094652 - RNA, 14 nt, Streptococcus pneumoniae R6
aacaaccgauaaga

SEQ ID NO: 4094653 - RNA, 18 nt, Streptococcus pneumoniae R6
aacaaccugcacauuggu

SEQ ID NO: 4094654 - RNA, 16 nt, Streptococcus pneumoniae R6
aacaacugauucuacu

SEQ ID NO: 4094655 - RNA, 21 nt, Streptococcus pneumoniae R6
aacaacuuauaaaaaacacaa

SEQ ID NO: 4094656 - RNA, 13 nt, Streptococcus pneumoniae R6
aacaagaacaaga

SEQ ID NO: 4094657 - RNA, 13 nt, Streptococcus pneumoniae R6
aacaagaacucuc

SEQ ID NO: 4094658 - RNA, 20 nt, Streptococcus pneumoniae R6
aacaagaccgagaaacaaga

SEQ ID NO: 4094659 - RNA, 22 nt, Streptococcus pneumoniae R6
aacaagaccgagaguucuuguu

SEQ ID NO: 4094660 - RNA, 20 nt, Streptococcus pneumoniae R6
aacaagauaggagaccagcu

SEQ ID NO: 4094661 - RNA, 15 nt, Streptococcus pneumoniae R6
aacaagggcaaaaaa

SEQ ID NO: 4094662 - RNA, 19 nt, Streptococcus pneumoniae R6
aacaagucuuaaaaucaca

SEQ ID NO: 4094663 - RNA, 20 nt, Streptococcus pneumoniae R6
aacaagucuuaaaaucacaa

SEQ ID NO: 4094664 - RNA, 23 nt, Streptococcus pneumoniae R6
aacaagucuuaaaaucacaaaaa

SEQ ID NO: 4094665 - RNA, 16 nt, Streptococcus pneumoniae R6
aacaaguucuuuucug

SEQ ID NO: 4094666 - RNA, 14 nt, Streptococcus pneumoniae R6
aacaaguugugcag

SEQ ID NO: 4094667 - RNA, 21 nt, Streptococcus pneumoniae R6
aacaauaaaaucaaacaaaag

SEQ ID NO: 4094668 - RNA, 14 nt, Streptococcus pneumoniae R6
aacaauaagagaau

SEQ ID NO: 4094669 - RNA, 12 nt, Streptococcus pneumoniae R6
aacaauagcgaa

SEQ ID NO: 4094670 - RNA, 14 nt, Streptococcus pneumoniae R6
aacaauauuuuaga

SEQ ID NO: 4094671 - RNA, 18 nt, Streptococcus pneumoniae R6
aacaauauuuuagaagca

SEQ ID NO: 4094672 - RNA, 12 nt, Streptococcus pneumoniae R6
aacaaucguaac

SEQ ID NO: 4094673 - RNA, 14 nt, Streptococcus pneumoniae R6
aacaaucuaucuuu

SEQ ID NO: 4094674 - RNA, 12 nt, Streptococcus pneumoniae R6
aacaaugaaaaa

SEQ ID NO: 4094675 - RNA, 13 nt, Streptococcus pneumoniae R6
aacaaugaaaauu

SEQ ID NO: 4094676 - RNA, 15 nt, Streptococcus pneumoniae R6
aacaauggaaaugau

SEQ ID NO: 4094677 - RNA, 23 nt, Streptococcus pneumoniae R6
aacaauggaaaugauaauugauu

SEQ ID NO: 4094678 - RNA, 16 nt, Streptococcus pneumoniae R6
aacaaugguaacaguc

SEQ ID NO: 4094679 - RNA, 21 nt, Streptococcus pneumoniae R6
aacaauguuuuagaaaucaca

SEQ ID NO: 4094680 - RNA, 17 nt, Streptococcus pneumoniae R6
aacaauguuuuagaagu

SEQ ID NO: 4094681 - RNA, 22 nt, Streptococcus pneumoniae R6
aacaauguuuugaucugacuuc

SEQ ID NO: 4094682 - RNA, 16 nt, Streptococcus pneumoniae R6
aacaauuaauucuaaa

SEQ ID NO: 4094683 - RNA, 20 nt, Streptococcus pneumoniae R6
aacaauuaauucuaaaucuu

SEQ ID NO: 4094684 - RNA, 14 nt, Streptococcus pneumoniae R6
aacaauuaauuggu

SEQ ID NO: 4094685 - RNA, 15 nt, Streptococcus pneumoniae R6
aacaauuaggaacuu

SEQ ID NO: 4094686 - RNA, 14 nt, Streptococcus pneumoniae R6
aacaauugacuguc

SEQ ID NO: 4094687 - RNA, 17 nt, Streptococcus pneumoniae R6
aacaauugacugucaau

SEQ ID NO: 4094688 - RNA, 23 nt, Streptococcus pneumoniae R6
aacaauugcuaaaacauuuauag

SEQ ID NO: 4094689 - RNA, 14 nt, Streptococcus pneumoniae R6
aacaauuucacaac

SEQ ID NO: 4094690 - RNA, 22 nt, Streptococcus pneumoniae R6
aacaauuucacaacucuuauac

SEQ ID NO: 4094691 - RNA, 17 nt, Streptococcus pneumoniae R6
aacacaaaaaguccucu

SEQ ID NO: 4094692 - RNA, 22 nt, Streptococcus pneumoniae R6
aacacacuguuuugagguugug

SEQ ID NO: 4094693 - RNA, 21 nt, Streptococcus pneumoniae R6
aacacauauugauauuuauag

SEQ ID NO: 4094694 - RNA, 20 nt, Streptococcus pneumoniae R6
aacaccaucacgauuaucua

SEQ ID NO: 4094695 - RNA, 14 nt, Streptococcus pneumoniae R6
aacacccauaauau

SEQ ID NO: 4094696 - RNA, 15 nt, Streptococcus pneumoniae R6
aacacccauaauauc

SEQ ID NO: 4094697 - RNA, 14 nt, Streptococcus pneumoniae R6
aacaccgacagcaa

SEQ ID NO: 4094698 - RNA, 16 nt, Streptococcus pneumoniae R6
aacaccgacuuuacca

SEQ ID NO: 4094699 - RNA, 12 nt, Streptococcus pneumoniae R6
aacaccugauag

SEQ ID NO: 4094700 - RNA, 14 nt, Streptococcus pneumoniae R6
aacaccugauuuua

SEQ ID NO: 4094701 - RNA, 15 nt, Streptococcus pneumoniae R6
aacaccuuuauuauu

SEQ ID NO: 4094702 - RNA, 17 nt, Streptococcus pneumoniae R6
aacacgagaaacaauaa

SEQ ID NO: 4094703 - RNA, 18 nt, Streptococcus pneumoniae R6
aacacgagaaacaauaaa

SEQ ID NO: 4094704 - RNA, 15 nt, Streptococcus pneumoniae R6
aacacguaaauuaua

SEQ ID NO: 4094705 - RNA, 14 nt, Streptococcus pneumoniae R6
aacacguuugauaa

SEQ ID NO: 4094706 - RNA, 20 nt, Streptococcus pneumoniae R6
aacacuagaggggugauuuu

SEQ ID NO: 4094707 - RNA, 23 nt, Streptococcus pneumoniae R6
aacacuagaggggugauuuuaua

SEQ ID NO: 4094708 - RNA, 12 nt, Streptococcus pneumoniae R6
aacacuccauuu

SEQ ID NO: 4094709 - RNA, 20 nt, Streptococcus pneumoniae R6
aacacuuacgacauccuauu

SEQ ID NO: 4094710 - RNA, 14 nt, Streptococcus pneumoniae R6
aacagacaaaacua

SEQ ID NO: 4094711 - RNA, 13 nt, Streptococcus pneumoniae R6
aacagagaaaauu

SEQ ID NO: 4094712 - RNA, 15 nt, Streptococcus pneumoniae R6
aacagaggcuggaca

SEQ ID NO: 4094713 - RNA, 11 nt, Streptococcus pneumoniae R6
aacagccaaua

SEQ ID NO: 4094714 - RNA, 13 nt, Streptococcus pneumoniae R6
aacagccaucaga

SEQ ID NO: 4094715 - RNA, 20 nt, Streptococcus pneumoniae R6
aacagccgaggguacuccuu

SEQ ID NO: 4094716 - RNA, 13 nt, Streptococcus pneumoniae R6
aaccgucaucagc

SEQ ID NO: 4094717 - RNA, 22 nt, Streptococcus pneumoniae R6
aaccguguuguaugaaaaguuu

SEQ ID NO: 4094718 - RNA, 18 nt, Streptococcus pneumoniae R6
aaccguucaagguaugaa

SEQ ID NO: 4094719 - RNA, 12 nt, Streptococcus pneumoniae R6
aaccucaaaaac

SEQ ID NO: 4094720 - RNA, 12 nt, Streptococcus pneumoniae R6
aaccucaaaaca

SEQ ID NO: 4094721 - RNA, 13 nt, Streptococcus pneumoniae R6
aaccucaaaacac

SEQ ID NO: 4094722 - RNA, 15 nt, Streptococcus pneumoniae R6
aaccucaaaacacug

SEQ ID NO: 4094723 - RNA, 21 nt, Streptococcus pneumoniae R6
aaccucaaaacaguguuuuga

SEQ ID NO: 4094724 - RNA, 14 nt, Streptococcus pneumoniae R6
aaccucaaaaccau

SEQ ID NO: 4094725 - RNA, 15 nt, Streptococcus pneumoniae R6
aaccucaaaaccaug

SEQ ID NO: 4094726 - RNA, 13 nt, Streptococcus pneumoniae R6
aaccucaaagcag

SEQ ID NO: 4094727 - RNA, 22 nt, Streptococcus pneumoniae R6
aaccucaaagcagugcuuugag

SEQ ID NO: 4094728 - RNA, 21 nt, Streptococcus pneumoniae R6
aaccucagaauccuuauuuuc

SEQ ID NO: 4094729 - RNA, 23 nt, Streptococcus pneumoniae R6
aaccucgagaaagguaacuccuu

SEQ ID NO: 4094730 - RNA, 16 nt, Streptococcus pneumoniae R6
aaccucgauaccuguu

SEQ ID NO: 4094731 - RNA, 17 nt, Streptococcus pneumoniae R6
aaccucgauaugaauaa

SEQ ID NO: 4094732 - RNA, 20 nt, Streptococcus pneumoniae R6
aaccucuguauaaauagcua

SEQ ID NO: 4094733 - RNA, 22 nt, Streptococcus pneumoniae R6
aaccucuguauaaauagcuaca

SEQ ID NO: 4094734 - RNA, 15 nt, Streptococcus pneumoniae R6
aaccucuugaaguuc

SEQ ID NO: 4094735 - RNA, 19 nt, Streptococcus pneumoniae R6
aaccugauaggaugcguuu

SEQ ID NO: 4094736 - RNA, 14 nt, Streptococcus pneumoniae R6
aaccugcacauugg

SEQ ID NO: 4094737 - RNA, 21 nt, Streptococcus pneumoniae R6
aaccugcuuaagauuguccuc

SEQ ID NO: 4094738 - RNA, 21 nt, Streptococcus pneumoniae R6
aaccugcuuuagauuguccuc

SEQ ID NO: 4094739 - RNA, 13 nt, Streptococcus pneumoniae R6
aaccuuaaaacag

SEQ ID NO: 4094740 - RNA, 14 nt, Streptococcus pneumoniae R6
aaccuuaaaacagu

SEQ ID NO: 4094741 - RNA, 16 nt, Streptococcus pneumoniae R6
aaccuuaaaacagugu

SEQ ID NO: 4094742 - RNA, 17 nt, Streptococcus pneumoniae R6
aaccuuaccgaugaugu

SEQ ID NO: 4094743 - RNA, 13 nt, Streptococcus pneumoniae R6
aaccuucaucaua

SEQ ID NO: 4094744 - RNA, 17 nt, Streptococcus pneumoniae R6
aaccuucccacaauaaa

SEQ ID NO: 4094745 - RNA, 14 nt, Streptococcus pneumoniae R6
aaccuucuaauaga

SEQ ID NO: 4094746 - RNA, 11 nt, Streptococcus pneumoniae R6
aaccuucuucu

SEQ ID NO: 4094747 - RNA, 20 nt, Streptococcus pneumoniae R6
aaccuucuucugugauauaa

SEQ ID NO: 4094748 - RNA, 19 nt, Streptococcus pneumoniae R6
aaccuuggcuugcucuccc

SEQ ID NO: 4094749 - RNA, 12 nt, Streptococcus pneumoniae R6
aaccuuguggaa

SEQ ID NO: 4094750 - RNA, 21 nt, Streptococcus pneumoniae R6
aaccuuucucagauaauaauu

SEQ ID NO: 4094751 - RNA, 15 nt, Streptococcus pneumoniae R6
aaccuuugagaaaaa

SEQ ID NO: 4094752 - RNA, 22 nt, Streptococcus pneumoniae R6
aaccuuuuugcgcaauuugacg

SEQ ID NO: 4094753 - RNA, 21 nt, Streptococcus pneumoniae R6
aacgaacgccuuaaaaaacca

SEQ ID NO: 4094754 - RNA, 22 nt, Streptococcus pneumoniae R6
aacgaacuauaaaaucugaaga

SEQ ID NO: 4094755 - RNA, 21 nt, Streptococcus pneumoniae R6
aacgaagcuagaaauggcagc

SEQ ID NO: 4094756 - RNA, 15 nt, Streptococcus pneumoniae R6
aacgaauagaaaaau

SEQ ID NO: 4094757 - RNA, 17 nt, Streptococcus pneumoniae R6
aacgacacgguauggaa

SEQ ID NO: 4094758 - RNA, 14 nt, Streptococcus pneumoniae R6
aacgacauagucaa

SEQ ID NO: 4094759 - RNA, 19 nt, Streptococcus pneumoniae R6
aacgacaugcguuaaaagu

SEQ ID NO: 4094760 - RNA, 22 nt, Streptococcus pneumoniae R6
aacgauaaacaagggcaaaaaa

SEQ ID NO: 4094761 - RNA, 18 nt, Streptococcus pneumoniae R6
aacgauauaguugacgau

SEQ ID NO: 4094762 - RNA, 13 nt, Streptococcus pneumoniae R6
aacgcauaaaauc

SEQ ID NO: 4094763 - RNA, 22 nt, Streptococcus pneumoniae R6
aacgcauauuaccaagguuguu

SEQ ID NO: 4094764 - RNA, 19 nt, Streptococcus pneumoniae R6
aacgccaucguagauuaaa

SEQ ID NO: 4094765 - RNA, 21 nt, Streptococcus pneumoniae R6
aacgccucccaauuaaaauag

SEQ ID NO: 4094766 - RNA, 15 nt, Streptococcus pneumoniae R6
aacgcgauacaauaa

SEQ ID NO: 4094767 - RNA, 21 nt, Streptococcus pneumoniae R6
aacgcucuucuggcagauaga

SEQ ID NO: 4094768 - RNA, 16 nt, Streptococcus pneumoniae R6
aacgcugcucaaaauc

SEQ ID NO: 4094769 - RNA, 17 nt, Streptococcus pneumoniae R6
aacggacaaaacuguaa

SEQ ID NO: 4094770 - RNA, 18 nt, Streptococcus pneumoniae R6
aacggacguugauuuguc

SEQ ID NO: 4094771 - RNA, 14 nt, Streptococcus pneumoniae R6
aacggcauaaaauc

SEQ ID NO: 4094772 - RNA, 15 nt, Streptococcus pneumoniae R6
aacggcauaaaaucu

SEQ ID NO: 4094773 - RNA, 14 nt, Streptococcus pneumoniae R6
aacgguaacaaaac

SEQ ID NO: 4094774 - RNA, 19 nt, Streptococcus pneumoniae R6
aacgguaucuguuucuguu

SEQ ID NO: 4094775 - RNA, 19 nt, Streptococcus pneumoniae R6
aacgguguuuugagcugac

SEQ ID NO: 4094776 - RNA, 13 nt, Streptococcus pneumoniae R6
aacguccagccuu

SEQ ID NO: 4094777 - RNA, 15 nt, Streptococcus pneumoniae R6
aacgucuaaacugua

SEQ ID NO: 4094778 - RNA, 19 nt, Streptococcus pneumoniae R6
aacgucuucaauaccaaag

SEQ ID NO: 4094779 - RNA, 12 nt, Streptococcus pneumoniae R6
aacgucuuuucg

SEQ ID NO: 4094780 - RNA, 18 nt, Streptococcus pneumoniae R6
aacgugauaauaaggccu

SEQ ID NO: 4094781 - RNA, 14 nt, Streptococcus pneumoniae R6
aacguggaaacucu

SEQ ID NO: 4094782 - RNA, 20 nt, Streptococcus pneumoniae R6
aacuaaaguuccuaauuguu

SEQ ID NO: 4094783 - RNA, 21 nt, Streptococcus pneumoniae R6
aacuaaauaccuuauccaauu

SEQ ID NO: 4094784 - RNA, 17 nt, Streptococcus pneumoniae R6
aacuaaauuacugauug

SEQ ID NO: 4094785 - RNA, 21 nt, Streptococcus pneumoniae R6
aacuaacccuagaaaaccaag

SEQ ID NO: 4094786 - RNA, 16 nt, Streptococcus pneumoniae R6
aacuaagcuucaaaaa

SEQ ID NO: 4094787 - RNA, 18 nt, Streptococcus pneumoniae R6
aacuaagcuucaaaaaag

SEQ ID NO: 4094788 - RNA, 18 nt, Streptococcus pneumoniae R6
aacuaauguaaaaaaguu

SEQ ID NO: 4094789 - RNA, 20 nt, Streptococcus pneumoniae R6
aacuaauucacgaacaugaa

SEQ ID NO: 4094790 - RNA, 16 nt, Streptococcus pneumoniae R6
aacuaauuuagagaau

SEQ ID NO: 4094791 - RNA, 21 nt, Streptococcus pneumoniae R6
aacuacacccgcauaaauacu

SEQ ID NO: 4094792 - RNA, 16 nt, Streptococcus pneumoniae R6
aacuacaguauagcau

SEQ ID NO: 4094793 - RNA, 19 nt, Streptococcus pneumoniae R6
aacuacgucagcuuccauc

SEQ ID NO: 4094794 - RNA, 21 nt, Streptococcus pneumoniae R6
aacuagaauagaaacaaaaua

SEQ ID NO: 4094795 - RNA, 21 nt, Streptococcus pneumoniae R6
aacuagaauccuaguucauga

SEQ ID NO: 4094796 - RNA, 22 nt, Streptococcus pneumoniae R6
aacuagagaguuuuuuucuuaa

SEQ ID NO: 4094797 - RNA, 16 nt, Streptococcus pneumoniae R6
aacuagaucaaccagu

SEQ ID NO: 4094798 - RNA, 19 nt, Streptococcus pneumoniae R6
aacuagauuucugaauauc

SEQ ID NO: 4094799 - RNA, 22 nt, Streptococcus pneumoniae R6
aacuagcaagugcuaagauaau

SEQ ID NO: 4094800 - RNA, 19 nt, Streptococcus pneumoniae R6
aacuagcauccaucccauu

SEQ ID NO: 4094801 - RNA, 20 nt, Streptococcus pneumoniae R6
aacuagcauccaucccauuu

SEQ ID NO: 4094802 - RNA, 19 nt, Streptococcus pneumoniae R6
aacuaggaaacuagcugca

SEQ ID NO: 4094803 - RNA, 16 nt, Streptococcus pneumoniae R6
aacuaggacaagaaga

SEQ ID NO: 4094804 - RNA, 17 nt, Streptococcus pneumoniae R6
aacuaguaaauugucua

SEQ ID NO: 4094805 - RNA, 14 nt, Streptococcus pneumoniae R6
aacuaguuuucuaa

SEQ ID NO: 4094806 - RNA, 19 nt, Streptococcus pneumoniae R6
aacuaguuuucuaaagaau

SEQ ID NO: 4094807 - RNA, 16 nt, Streptococcus pneumoniae R6
aacuauaaaaucugaa

SEQ ID NO: 4094808 - RNA, 20 nt, Streptococcus pneumoniae R6
aacuauaaaaucugaagaaa

SEQ ID NO: 4094809 - RNA, 21 nt, Streptococcus pneumoniae R6
aacuauaaaaucugaagaaag

SEQ ID NO: 4094810 - RNA, 22 nt, Streptococcus pneumoniae R6
aacuauaaaaucugaagaaagc

SEQ ID NO: 4094811 - RNA, 17 nt, Streptococcus pneumoniae R6
aacuauaguagauugaa

SEQ ID NO: 4094812 - RNA, 19 nt, Streptococcus pneumoniae R6
aacuauccagagcauucuu

SEQ ID NO: 4094813 - RNA, 21 nt, Streptococcus pneumoniae R6
aacuauuguagauuauaugcu

SEQ ID NO: 4094814 - RNA, 17 nt, Streptococcus pneumoniae R6
aacuauuuuauuuuuua

SEQ ID NO: 4094815 - RNA, 14 nt, Streptococcus pneumoniae R6
aacucaaaagaaga

SEQ ID NO: 4094816 - RNA, 20 nt, Streptococcus pneumoniae R6
aacucaaaagaagauugguc

SEQ ID NO: 4094817 - RNA, 14 nt, Streptococcus pneumoniae R6
aacucaaauguaag

SEQ ID NO: 4094818 - RNA, 16 nt, Streptococcus pneumoniae R6
aagaaagagaauaaca

SEQ ID NO: 4094819 - RNA, 14 nt, Streptococcus pneumoniae R6
aagaaagcaauuuu

SEQ ID NO: 4094820 - RNA, 20 nt, Streptococcus pneumoniae R6
aagaaagcgaagaucuagaa

SEQ ID NO: 4094821 - RNA, 23 nt, Streptococcus pneumoniae R6
aagaaaggauauaaaucucagaa

SEQ ID NO: 4094822 - RNA, 19 nt, Streptococcus pneumoniae R6
aagaaaguaagaaucugca

SEQ ID NO: 4094823 - RNA, 15 nt, Streptococcus pneumoniae R6
aagaaauagaaaaca

SEQ ID NO: 4094824 - RNA, 17 nt, Streptococcus pneumoniae R6
aagaaauagaaaacaaa

SEQ ID NO: 4094825 - RNA, 20 nt, Streptococcus pneumoniae R6
aagaaauagaaaacaaaaag

SEQ ID NO: 4094826 - RNA, 20 nt, Streptococcus pneumoniae R6
aagaaauaguuuagauaaaa

SEQ ID NO: 4094827 - RNA, 19 nt, Streptococcus pneumoniae R6
aagaaaucauacaccucuu

SEQ ID NO: 4094828 - RNA, 13 nt, Streptococcus pneumoniae R6
aagaaaucaucca

SEQ ID NO: 4094829 - RNA, 23 nt, Streptococcus pneumoniae R6
aagaaaucauuggauacaaggag

SEQ ID NO: 4094830 - RNA, 13 nt, Streptococcus pneumoniae R6
aagaaauccaaac

SEQ ID NO: 4094831 - RNA, 20 nt, Streptococcus pneumoniae R6
aagaaauuggcugcaauaau

SEQ ID NO: 4094832 - RNA, 13 nt, Streptococcus pneumoniae R6
aagaaauuuucuu

SEQ ID NO: 4094833 - RNA, 13 nt, Streptococcus pneumoniae R6
aagaacaaguaaa

SEQ ID NO: 4094834 - RNA, 17 nt, Streptococcus pneumoniae R6
aagaacaaguaaagagu

SEQ ID NO: 4094835 - RNA, 15 nt, Streptococcus pneumoniae R6
aagaacaauccaaau

SEQ ID NO: 4094836 - RNA, 21 nt, Streptococcus pneumoniae R6
aagaacaauuucacaacucuu

SEQ ID NO: 4094837 - RNA, 18 nt, Streptococcus pneumoniae R6
aagaacaggacaaaucga

SEQ ID NO: 4094838 - RNA, 14 nt, Streptococcus pneumoniae R6
aagaacaucuacaa

SEQ ID NO: 4094839 - RNA, 20 nt, Streptococcus pneumoniae R6
aagaacaucuacaauugaaa

SEQ ID NO: 4094840 - RNA, 15 nt, Streptococcus pneumoniae R6
aagaacauuuggaag

SEQ ID NO: 4094841 - RNA, 21 nt, Streptococcus pneumoniae R6
aagaacuccuuaaauuuuaua

SEQ ID NO: 4094842 - RNA, 22 nt, Streptococcus pneumoniae R6
aagaacuccuuaaauuuuauac

SEQ ID NO: 4094843 - RNA, 12 nt, Streptococcus pneumoniae R6
aagaacucuuuc

SEQ ID NO: 4094844 - RNA, 14 nt, Streptococcus pneumoniae R6
aagaacucuuucca

SEQ ID NO: 4094845 - RNA, 15 nt, Streptococcus pneumoniae R6
aagaacucuuuccaa

SEQ ID NO: 4094846 - RNA, 15 nt, Streptococcus pneumoniae R6
aagaacuuuuuaaag

SEQ ID NO: 4094847 - RNA, 18 nt, Streptococcus pneumoniae R6
aagaacuuuuuaaaguau

SEQ ID NO: 4094848 - RNA, 23 nt, Streptococcus pneumoniae R6
aagaagagcauaggaaguugagc

SEQ ID NO: 4094849 - RNA, 19 nt, Streptococcus pneumoniae R6
aagaagagggcuucuucaa

SEQ ID NO: 4094850 - RNA, 15 nt, Streptococcus pneumoniae R6
aagaagcagaaaaau

SEQ ID NO: 4094851 - RNA, 21 nt, Streptococcus pneumoniae R6
aagaagccugauggaaacauc

SEQ ID NO: 4094852 - RNA, 16 nt, Streptococcus pneumoniae R6
aagaagcuguaaaucu

SEQ ID NO: 4094853 - RNA, 20 nt, Streptococcus pneumoniae R6
aagaagcuguaaaucuagga

SEQ ID NO: 4094854 - RNA, 22 nt, Streptococcus pneumoniae R6
aagaagguauucauaaaauacc

SEQ ID NO: 4094855 - RNA, 19 nt, Streptococcus pneumoniae R6
aagaagucaccauaaaucu

SEQ ID NO: 4094856 - RNA, 22 nt, Streptococcus pneumoniae R6
aagaaguccauagcgucaaaga

SEQ ID NO: 4094857 - RNA, 22 nt, Streptococcus pneumoniae R6
aagaaguuggccaacuaaccaa

SEQ ID NO: 4094858 - RNA, 22 nt, Streptococcus pneumoniae R6
aagaaguugguuaguuggccaa

SEQ ID NO: 4094859 - RNA, 15 nt, Streptococcus pneumoniae R6
aagaauaaaauaguu

SEQ ID NO: 4094860 - RNA, 17 nt, Streptococcus pneumoniae R6
aagaauagcgauuuaau

SEQ ID NO: 4094861 - RNA, 12 nt, Streptococcus pneumoniae R6
aagaauccaauu

SEQ ID NO: 4094862 - RNA, 18 nt, Streptococcus pneumoniae R6
aagaaucgucagaggaag

SEQ ID NO: 4094863 - RNA, 14 nt, Streptococcus pneumoniae R6
aagaaucuuuucua

SEQ ID NO: 4094864 - RNA, 22 nt, Streptococcus pneumoniae R6
aagaaucuuuucuauuuuauag

SEQ ID NO: 4094865 - RNA, 18 nt, Streptococcus pneumoniae R6
aagaaugaacaucccaag

SEQ ID NO: 4094866 - RNA, 22 nt, Streptococcus pneumoniae R6
aagaauggcggcauucaagaga

SEQ ID NO: 4094867 - RNA, 23 nt, Streptococcus pneumoniae R6
aagaaugggauacuaucuccuuu

SEQ ID NO: 4094868 - RNA, 17 nt, Streptococcus pneumoniae R6
aagaaugggcucccacu

SEQ ID NO: 4094869 - RNA, 19 nt, Streptococcus pneumoniae R6
aagaaugggcucccacuuu

SEQ ID NO: 4094870 - RNA, 22 nt, Streptococcus pneumoniae R6
aagaaugggcucccacuuucaa

SEQ ID NO: 4094871 - RNA, 11 nt, Streptococcus pneumoniae R6
aagaauguuuu

SEQ ID NO: 4094872 - RNA, 14 nt, Streptococcus pneumoniae R6
aagaauuaggaaaa

SEQ ID NO: 4094873 - RNA, 19 nt, Streptococcus pneumoniae R6
aagaauuaggaaaacauga

SEQ ID NO: 4094874 - RNA, 22 nt, Streptococcus pneumoniae R6
aagaauucaauugcaggagaaa

SEQ ID NO: 4094875 - RNA, 22 nt, Streptococcus pneumoniae R6
aagaauugaaagucuuggaaaa

SEQ ID NO: 4094876 - RNA, 14 nt, Streptococcus pneumoniae R6
aagaauuuaaaaau

SEQ ID NO: 4094877 - RNA, 17 nt, Streptococcus pneumoniae R6
aagaauuugaaaaaaau

SEQ ID NO: 4094878 - RNA, 13 nt, Streptococcus pneumoniae R6
aagaauuugauua

SEQ ID NO: 4094879 - RNA, 15 nt, Streptococcus pneumoniae R6
aagacaccaccgaag

SEQ ID NO: 4094880 - RNA, 23 nt, Streptococcus pneumoniae R6
aagacagggccuuagcagacuuc

SEQ ID NO: 4094881 - RNA, 15 nt, Streptococcus pneumoniae R6
aagacagucugaaaa

SEQ ID NO: 4094882 - RNA, 20 nt, Streptococcus pneumoniae R6
aagacagucugaaaaagagg

SEQ ID NO: 4094883 - RNA, 20 nt, Streptococcus pneumoniae R6
aagacagucugaaaaauagg

SEQ ID NO: 4094884 - RNA, 19 nt, Streptococcus pneumoniae R6
aagacaucauauaaauaau

SEQ ID NO: 4094885 - RNA, 23 nt, Streptococcus pneumoniae R6
aagacaucuucucaggcuuuuuc

SEQ ID NO: 4094886 - RNA, 14 nt, Streptococcus pneumoniae R6
aagaccaaagaaaa

SEQ ID NO: 4094887 - RNA, 15 nt, Streptococcus pneumoniae R6
aagaccaccucaucu

SEQ ID NO: 4094888 - RNA, 16 nt, Streptococcus pneumoniae R6
aagaccaugaggaaac

SEQ ID NO: 4094889 - RNA, 21 nt, Streptococcus pneumoniae R6
aagaccuucuuacguuccaag

SEQ ID NO: 4094890 - RNA, 22 nt, Streptococcus pneumoniae R6
aagaccuuugaaaacugaacaa

SEQ ID NO: 4094891 - RNA, 17 nt, Streptococcus pneumoniae R6
aagacgaaccaaugugc

SEQ ID NO: 4094892 - RNA, 15 nt, Streptococcus pneumoniae R6
aagacuaaguuagaa

SEQ ID NO: 4094893 - RNA, 14 nt, Streptococcus pneumoniae R6
aagacuagacuugc

SEQ ID NO: 4094894 - RNA, 11 nt, Streptococcus pneumoniae R6
aagacuccucu

SEQ ID NO: 4094895 - RNA, 14 nt, Streptococcus pneumoniae R6
aagacucuugcccu

SEQ ID NO: 4094896 - RNA, 22 nt, Streptococcus pneumoniae R6
aagacucuugcccuuggcuagu

SEQ ID NO: 4094897 - RNA, 13 nt, Streptococcus pneumoniae R6
aagacugaaaauu

SEQ ID NO: 4094898 - RNA, 16 nt, Streptococcus pneumoniae R6
aagacugacgaaguca

SEQ ID NO: 4094899 - RNA, 21 nt, Streptococcus pneumoniae R6
aagacugacgaagucagcuca

SEQ ID NO: 4094900 - RNA, 17 nt, Streptococcus pneumoniae R6
aagacugaguauuuuau

SEQ ID NO: 4094901 - RNA, 18 nt, Streptococcus pneumoniae R6
aagacuggguguuugcca

SEQ ID NO: 4094902 - RNA, 22 nt, Streptococcus pneumoniae R6
aagacuggugagauaaaacguu

SEQ ID NO: 4094903 - RNA, 22 nt, Streptococcus pneumoniae R6
aagacuuagcaaaucagcuaag

SEQ ID NO: 4094904 - RNA, 12 nt, Streptococcus pneumoniae R6
aagacuuauacu

SEQ ID NO: 4094905 - RNA, 18 nt, Streptococcus pneumoniae R6
aagacuuauacucuucaa

SEQ ID NO: 4094906 - RNA, 14 nt, Streptococcus pneumoniae R6
aagacuugaaauac

SEQ ID NO: 4094907 - RNA, 22 nt, Streptococcus pneumoniae R6
aagacuugaccggagaaagaau

SEQ ID NO: 4094908 - RNA, 19 nt, Streptococcus pneumoniae R6
aagacuuguuagcugauuu

SEQ ID NO: 4094909 - RNA, 22 nt, Streptococcus pneumoniae R6
aagacuuguuagcugauuuuuu

SEQ ID NO: 4094910 - RNA, 13 nt, Streptococcus pneumoniae R6
aagacuuuaaaaa

SEQ ID NO: 4094911 - RNA, 15 nt, Streptococcus pneumoniae R6
aagacuuuaaaaauu

SEQ ID NO: 4094912 - RNA, 18 nt, Streptococcus pneumoniae R6
aagacuuucaauucuuca

SEQ ID NO: 4094913 - RNA, 23 nt, Streptococcus pneumoniae R6
aagacuuuuccuguuguauuuau

SEQ ID NO: 4094914 - RNA, 14 nt, Streptococcus pneumoniae R6
aagacuuuuuaaag

SEQ ID NO: 4094915 - RNA, 15 nt, Streptococcus pneumoniae R6
aagacuuuuuucuau

SEQ ID NO: 4094916 - RNA, 13 nt, Streptococcus pneumoniae R6
aagagaaaaccaa

SEQ ID NO: 4094917 - RNA, 18 nt, Streptococcus pneumoniae R6
aagagaaaaccaaaacuc

SEQ ID NO: 4094918 - RNA, 15 nt, Streptococcus pneumoniae R6
aagagaacuucacgu

SEQ ID NO: 4094919 - RNA, 14 nt, Streptococcus pneumoniae R6
aagagaagagagca

SEQ ID NO: 4094920 - RNA, 14 nt, Streptococcus pneumoniae R6
aagauuuguuuuuc

SEQ ID NO: 4094921 - RNA, 20 nt, Streptococcus pneumoniae R6
aagauuuuauccaaucuauu

SEQ ID NO: 4094922 - RNA, 20 nt, Streptococcus pneumoniae R6
aagauuuuccucauuuucua

SEQ ID NO: 4094923 - RNA, 17 nt, Streptococcus pneumoniae R6
aagauuuuuggaaaaaa

SEQ ID NO: 4094924 - RNA, 14 nt, Streptococcus pneumoniae R6
aagauuuuuuaaaa

SEQ ID NO: 4094925 - RNA, 20 nt, Streptococcus pneumoniae R6
aagauuuuuuggauucucaa

SEQ ID NO: 4094926 - RNA, 15 nt, Streptococcus pneumoniae R6
aagcaaaagaacaag

SEQ ID NO: 4094927 - RNA, 12 nt, Streptococcus pneumoniae R6
aagcaaaucaaa

SEQ ID NO: 4094928 - RNA, 14 nt, Streptococcus pneumoniae R6
aagcaagacaaaaa

SEQ ID NO: 4094929 - RNA, 19 nt, Streptococcus pneumoniae R6
aagcaagugacaaagaccu

SEQ ID NO: 4094930 - RNA, 16 nt, Streptococcus pneumoniae R6
aagcaauuuugaaaga

SEQ ID NO: 4094931 - RNA, 17 nt, Streptococcus pneumoniae R6
aagcaauuuugaaagau

SEQ ID NO: 4094932 - RNA, 20 nt, Streptococcus pneumoniae R6
aagcaauuuugaaagauucg

SEQ ID NO: 4094933 - RNA, 17 nt, Streptococcus pneumoniae R6
aagcacacaaaucuucu

SEQ ID NO: 4094934 - RNA, 16 nt, Streptococcus pneumoniae R6
aagcacggagaacaau

SEQ ID NO: 4094935 - RNA, 17 nt, Streptococcus pneumoniae R6
aagcacugauuugaggu

SEQ ID NO: 4094936 - RNA, 13 nt, Streptococcus pneumoniae R6
aagcagaaaaauu

SEQ ID NO: 4094937 - RNA, 17 nt, Streptococcus pneumoniae R6
aagcagaaaaauuucau

SEQ ID NO: 4094938 - RNA, 14 nt, Streptococcus pneumoniae R6
aagcagaggcaaug

SEQ ID NO: 4094939 - RNA, 22 nt, Streptococcus pneumoniae R6
aagcagaugaguguaaaaagaa

SEQ ID NO: 4094940 - RNA, 14 nt, Streptococcus pneumoniae R6
aagcauaacuaaaa

SEQ ID NO: 4094941 - RNA, 20 nt, Streptococcus pneumoniae R6
aagcauagaaaaaaggaauc

SEQ ID NO: 4094942 - RNA, 19 nt, Streptococcus pneumoniae R6
aagcauagagaaaaacagc

SEQ ID NO: 4094943 - RNA, 15 nt, Streptococcus pneumoniae R6
aagcaugauaugaag

SEQ ID NO: 4094944 - RNA, 12 nt, Streptococcus pneumoniae R6
aagccaaaucaa

SEQ ID NO: 4094945 - RNA, 14 nt, Streptococcus pneumoniae R6
aagccaaaucaauu

SEQ ID NO: 4094946 - RNA, 23 nt, Streptococcus pneumoniae R6
aagccagucgucaccguuuuugu

SEQ ID NO: 4094947 - RNA, 20 nt, Streptococcus pneumoniae R6
aagcccaguugacuguguuu

SEQ ID NO: 4094948 - RNA, 17 nt, Streptococcus pneumoniae R6
aagcccaugauaucuuu

SEQ ID NO: 4094949 - RNA, 15 nt, Streptococcus pneumoniae R6
aagcccuacuguacu

SEQ ID NO: 4094950 - RNA, 21 nt, Streptococcus pneumoniae R6
aagccgacccaggcaaagagu

SEQ ID NO: 4094951 - RNA, 20 nt, Streptococcus pneumoniae R6
aagccgagcaagaauucaau

SEQ ID NO: 4094952 - RNA, 16 nt, Streptococcus pneumoniae R6
aagccggcuugucuuu

SEQ ID NO: 4094953 - RNA, 14 nt, Streptococcus pneumoniae R6
aagccuguccuguu

SEQ ID NO: 4094954 - RNA, 13 nt, Streptococcus pneumoniae R6
aagccuucauccu

SEQ ID NO: 4094955 - RNA, 14 nt, Streptococcus pneumoniae R6
aagccuucuguugg

SEQ ID NO: 4094956 - RNA, 22 nt, Streptococcus pneumoniae R6
aagccuucuugguuuuugccau

SEQ ID NO: 4094957 - RNA, 14 nt, Streptococcus pneumoniae R6
aagccuuguuucca

SEQ ID NO: 4094958 - RNA, 23 nt, Streptococcus pneumoniae R6
aagccuuuaucugcccaaagaca

SEQ ID NO: 4094959 - RNA, 14 nt, Streptococcus pneumoniae R6
aagcgaaacaaccg

SEQ ID NO: 4094960 - RNA, 16 nt, Streptococcus pneumoniae R6
aagcgauaaaaauccg

SEQ ID NO: 4094961 - RNA, 22 nt, Streptococcus pneumoniae R6
aagcgaucaaccgauuuaagau

SEQ ID NO: 4094962 - RNA, 17 nt, Streptococcus pneumoniae R6
aagcgccugacauucuu

SEQ ID NO: 4094963 - RNA, 16 nt, Streptococcus pneumoniae R6
aagcgcuggaacuugu

SEQ ID NO: 4094964 - RNA, 12 nt, Streptococcus pneumoniae R6
aagcggagagca

SEQ ID NO: 4094965 - RNA, 13 nt, Streptococcus pneumoniae R6
aagcgugagauuu

SEQ ID NO: 4094966 - RNA, 16 nt, Streptococcus pneumoniae R6
aagcguuuacgaugau

SEQ ID NO: 4094967 - RNA, 15 nt, Streptococcus pneumoniae R6
aagcuaaauccuuuu

SEQ ID NO: 4094968 - RNA, 14 nt, Streptococcus pneumoniae R6
aagcuacauagaga

SEQ ID NO: 4094969 - RNA, 13 nt, Streptococcus pneumoniae R6
aagcuacuauaaa

SEQ ID NO: 4094970 - RNA, 21 nt, Streptococcus pneumoniae R6
aagcuacuauaaaagaggagg

SEQ ID NO: 4094971 - RNA, 21 nt, Streptococcus pneumoniae R6
aagcuagauuuaaaacuguga

SEQ ID NO: 4094972 - RNA, 17 nt, Streptococcus pneumoniae R6
aagcuagcaacagauga

SEQ ID NO: 4094973 - RNA, 21 nt, Streptococcus pneumoniae R6
aagcuagcaauuuguggaaaa

SEQ ID NO: 4094974 - RNA, 19 nt, Streptococcus pneumoniae R6
aagcuagccgcagguugcu

SEQ ID NO: 4094975 - RNA, 20 nt, Streptococcus pneumoniae R6
aagcuagccguagguugcuc

SEQ ID NO: 4094976 - RNA, 18 nt, Streptococcus pneumoniae R6
aagcuagguccaagcgga

SEQ ID NO: 4094977 - RNA, 15 nt, Streptococcus pneumoniae R6
aagcuaguacauucu

SEQ ID NO: 4094978 - RNA, 18 nt, Streptococcus pneumoniae R6
aagcuagucgcagguugc

SEQ ID NO: 4094979 - RNA, 22 nt, Streptococcus pneumoniae R6
aagcuauccuggcguaguaaau

SEQ ID NO: 4094980 - RNA, 20 nt, Streptococcus pneumoniae R6
aagcucaucuaauguuuuua

SEQ ID NO: 4094981 - RNA, 21 nt, Streptococcus pneumoniae R6
aagcuccaauuuauuuguuua

SEQ ID NO: 4094982 - RNA, 14 nt, Streptococcus pneumoniae R6
aagcucgagaaagg

SEQ ID NO: 4094983 - RNA, 15 nt, Streptococcus pneumoniae R6
aagcucgagaaagga

SEQ ID NO: 4094984 - RNA, 17 nt, Streptococcus pneumoniae R6
aagcucguucaaccguu

SEQ ID NO: 4094985 - RNA, 22 nt, Streptococcus pneumoniae R6
aagcugacgcgguuugaagaga

SEQ ID NO: 4094986 - RNA, 23 nt, Streptococcus pneumoniae R6
aagcugacgcgguuugaagagau

SEQ ID NO: 4094987 - RNA, 19 nt, Streptococcus pneumoniae R6
aagcugacgggcaaauuuc

SEQ ID NO: 4094988 - RNA, 21 nt, Streptococcus pneumoniae R6
aagcugacgggcaaauuucau

SEQ ID NO: 4094989 - RNA, 23 nt, Streptococcus pneumoniae R6
aagcugacgggcaaauuucauga

SEQ ID NO: 4094990 - RNA, 13 nt, Streptococcus pneumoniae R6
aagcugagcucuu

SEQ ID NO: 4094991 - RNA, 16 nt, Streptococcus pneumoniae R6
aagcugauuuuuucau

SEQ ID NO: 4094992 - RNA, 15 nt, Streptococcus pneumoniae R6
aagcugccaaagcau

SEQ ID NO: 4094993 - RNA, 15 nt, Streptococcus pneumoniae R6
aagcugccccaccug

SEQ ID NO: 4094994 - RNA, 22 nt, Streptococcus pneumoniae R6
aagcugcuuucauagcugcguu

SEQ ID NO: 4094995 - RNA, 20 nt, Streptococcus pneumoniae R6
aagcuuauauacccaaaaca

SEQ ID NO: 4094996 - RNA, 17 nt, Streptococcus pneumoniae R6
aagcuuccgguaaaguu

SEQ ID NO: 4094997 - RNA, 15 nt, Streptococcus pneumoniae R6
aagcuucuacagaug

SEQ ID NO: 4094998 - RNA, 16 nt, Streptococcus pneumoniae R6
aagcuugaguggaaaa

SEQ ID NO: 4094999 - RNA, 18 nt, Streptococcus pneumoniae R6
aagcuugaguggaaaaac

SEQ ID NO: 4095000 - RNA, 20 nt, Streptococcus pneumoniae R6
aagcuugaguggaaaaaccu

SEQ ID NO: 4095001 - RNA, 23 nt, Streptococcus pneumoniae R6
aagcuugcgauaaagcuaaagau

SEQ ID NO: 4095002 - RNA, 17 nt, Streptococcus pneumoniae R6
aagcuugcuuccaaaaa

SEQ ID NO: 4095003 - RNA, 21 nt, Streptococcus pneumoniae R6
aagcuuggcuuugauucaucu

SEQ ID NO: 4095004 - RNA, 15 nt, Streptococcus pneumoniae R6
aagcuugugaaagcu

SEQ ID NO: 4095005 - RNA, 20 nt, Streptococcus pneumoniae R6
aagcuuguuguugugauaaa

SEQ ID NO: 4095006 - RNA, 23 nt, Streptococcus pneumoniae R6
aagcuuuaugcuuggugagaaag

SEQ ID NO: 4095007 - RNA, 23 nt, Streptococcus pneumoniae R6
aagcuuuauugucucuaaaaaua

SEQ ID NO: 4095008 - RNA, 23 nt, Streptococcus pneumoniae R6
aagcuuuuuguuagauuuauaau

SEQ ID NO: 4095009 - RNA, 15 nt, Streptococcus pneumoniae R6
aaggaaaaaggcaac

SEQ ID NO: 4095010 - RNA, 14 nt, Streptococcus pneumoniae R6
aaggaaaauugauu

SEQ ID NO: 4095011 - RNA, 15 nt, Streptococcus pneumoniae R6
aaggaaagucggaag

SEQ ID NO: 4095012 - RNA, 20 nt, Streptococcus pneumoniae R6
aaggaaccaguuuuuuucag

SEQ ID NO: 4095013 - RNA, 14 nt, Streptococcus pneumoniae R6
aaggaacuaacuca

SEQ ID NO: 4095014 - RNA, 14 nt, Streptococcus pneumoniae R6
aaggaagauguaaa

SEQ ID NO: 4095015 - RNA, 21 nt, Streptococcus pneumoniae R6
aaggaagcacacaaaucuucu

SEQ ID NO: 4095016 - RNA, 14 nt, Streptococcus pneumoniae R6
aaggaagucuuguu

SEQ ID NO: 4095017 - RNA, 17 nt, Streptococcus pneumoniae R6
aaggaaguugaguucag

SEQ ID NO: 4095018 - RNA, 21 nt, Streptococcus pneumoniae R6
aaggaaguuguguucauuguu

SEQ ID NO: 4095019 - RNA, 16 nt, Streptococcus pneumoniae R6
aaggaaugccaaagac

SEQ ID NO: 4095020 - RNA, 17 nt, Streptococcus pneumoniae R6
aaggaaugccaaagaca

SEQ ID NO: 4095021 - RNA, 22 nt, Streptococcus pneumoniae R6
aaggacaaauuucguccuuucu

SEQ ID NO: 4095022 - RNA, 21 nt, Streptococcus pneumoniae R6
aaggacaaauuuuguccuuuc

SEQ ID NO: 4095023 - RNA, 23 nt, Streptococcus pneumoniae R6
aaggacaccagcacaggcaacca

SEQ ID NO: 4095024 - RNA, 12 nt, Streptococcus pneumoniae R6
aaggacaucuuc

SEQ ID NO: 4095025 - RNA, 22 nt, Streptococcus pneumoniae R6
aaggacuccaccauaguguuuc

SEQ ID NO: 4095026 - RNA, 15 nt, Streptococcus pneumoniae R6
aaggacuugaguaau

SEQ ID NO: 4095027 - RNA, 15 nt, Streptococcus pneumoniae R6
aaggagaaaaaauau

SEQ ID NO: 4095028 - RNA, 23 nt, Streptococcus pneumoniae R6
aaggagaacuccagauuaucuuc

SEQ ID NO: 4095029 - RNA, 15 nt, Streptococcus pneumoniae R6
aaggagaagauuuca

SEQ ID NO: 4095030 - RNA, 19 nt, Streptococcus pneumoniae R6
aaggagaggagaauuuuug

SEQ ID NO: 4095031 - RNA, 20 nt, Streptococcus pneumoniae R6
aaggaggauuggguaaaucu

SEQ ID NO: 4095032 - RNA, 16 nt, Streptococcus pneumoniae R6
aaggaggcaaagaaaa

SEQ ID NO: 4095033 - RNA, 18 nt, Streptococcus pneumoniae R6
aaggaggcaaagaaaaaa

SEQ ID NO: 4095034 - RNA, 13 nt, Streptococcus pneumoniae R6
aaggaguagaaaa

SEQ ID NO: 4095035 - RNA, 15 nt, Streptococcus pneumoniae R6
aaggauaaaaagucc

SEQ ID NO: 4095036 - RNA, 17 nt, Streptococcus pneumoniae R6
aaggauaugaggagaaa

SEQ ID NO: 4095037 - RNA, 23 nt, Streptococcus pneumoniae R6
aaggaucuagcgcaaagcuaaau

SEQ ID NO: 4095038 - RNA, 16 nt, Streptococcus pneumoniae R6
aaggauugagaagcca

SEQ ID NO: 4095039 - RNA, 23 nt, Streptococcus pneumoniae R6
aaggauugagaagccaaaaucau

SEQ ID NO: 4095040 - RNA, 15 nt, Streptococcus pneumoniae R6
aaggauuuaguucug

SEQ ID NO: 4095041 - RNA, 13 nt, Streptococcus pneumoniae R6
aaggauuucugcu

SEQ ID NO: 4095042 - RNA, 23 nt, Streptococcus pneumoniae R6
aaggcaagacuugguuuggcauu

SEQ ID NO: 4095043 - RNA, 17 nt, Streptococcus pneumoniae R6
aaggcacuagcuccaaa

SEQ ID NO: 4095044 - RNA, 23 nt, Streptococcus pneumoniae R6
aaggcacuagcuccaaacauaac

SEQ ID NO: 4095045 - RNA, 21 nt, Streptococcus pneumoniae R6
aaggcaguacuuugagcaacc

SEQ ID NO: 4095046 - RNA, 16 nt, Streptococcus pneumoniae R6
aaggcauaaacuugca

SEQ ID NO: 4095047 - RNA, 20 nt, Streptococcus pneumoniae R6
aaggcaucacgaaaauauuu

SEQ ID NO: 4095048 - RNA, 15 nt, Streptococcus pneumoniae R6
aaggcaucaucugaa

SEQ ID NO: 4095049 - RNA, 20 nt, Streptococcus pneumoniae R6
aaggcaucuugucaaagagu

SEQ ID NO: 4095050 - RNA, 21 nt, Streptococcus pneumoniae R6
aaggcaugggccccagcuucg

SEQ ID NO: 4095051 - RNA, 23 nt, Streptococcus pneumoniae R6
aaggcauucucgugaaauuuuag

SEQ ID NO: 4095052 - RNA, 13 nt, Streptococcus pneumoniae R6
aaggcgaugcuga

SEQ ID NO: 4095053 - RNA, 14 nt, Streptococcus pneumoniae R6
aaggcgaugcugac

SEQ ID NO: 4095054 - RNA, 13 nt, Streptococcus pneumoniae R6
aaggcguucaucc

SEQ ID NO: 4095055 - RNA, 16 nt, Streptococcus pneumoniae R6
aaggcuagguaagucc

SEQ ID NO: 4095056 - RNA, 18 nt, Streptococcus pneumoniae R6
aaggcuauagucaaaggg

SEQ ID NO: 4095057 - RNA, 19 nt, Streptococcus pneumoniae R6
aaggcuauuauuaauguuu

SEQ ID NO: 4095058 - RNA, 21 nt, Streptococcus pneumoniae R6
aaggcugcgcaacacacuguu

SEQ ID NO: 4095059 - RNA, 23 nt, Streptococcus pneumoniae R6
aaggcugcgcaacacacuguuuu

SEQ ID NO: 4095060 - RNA, 13 nt, Streptococcus pneumoniae R6
aaggcuuugaaca

SEQ ID NO: 4095061 - RNA, 15 nt, Streptococcus pneumoniae R6
aaggcuuuuucuucu

SEQ ID NO: 4095062 - RNA, 18 nt, Streptococcus pneumoniae R6
aagggacuggauuuuaag

SEQ ID NO: 4095063 - RNA, 19 nt, Streptococcus pneumoniae R6
aagggagguaaagauagcc

SEQ ID NO: 4095064 - RNA, 19 nt, Streptococcus pneumoniae R6
aagggaugauguuaucaaa

SEQ ID NO: 4095065 - RNA, 22 nt, Streptococcus pneumoniae R6
aagggauuuuucuggcucuuug

SEQ ID NO: 4095066 - RNA, 23 nt, Streptococcus pneumoniae R6
aagggcaccaaacuuaggaagca

SEQ ID NO: 4095067 - RNA, 19 nt, Streptococcus pneumoniae R6
aagggcguugacaaucuuu

SEQ ID NO: 4095068 - RNA, 20 nt, Streptococcus pneumoniae R6
aagggcuucaucaaccccca

SEQ ID NO: 4095069 - RNA, 19 nt, Streptococcus pneumoniae R6
aagggcuuuuuugacguau

SEQ ID NO: 4095070 - RNA, 15 nt, Streptococcus pneumoniae R6
aaggggcucuuuguc

SEQ ID NO: 4095071 - RNA, 18 nt, Streptococcus pneumoniae R6
aaggguagccaauuccuu

SEQ ID NO: 4095072 - RNA, 21 nt, Streptococcus pneumoniae R6
aaggguuagucauucccuccu

SEQ ID NO: 4095073 - RNA, 13 nt, Streptococcus pneumoniae R6
aagguaaaauaua

SEQ ID NO: 4095074 - RNA, 12 nt, Streptococcus pneumoniae R6
aagguaauccaa

SEQ ID NO: 4095075 - RNA, 20 nt, Streptococcus pneumoniae R6
aagguaauccaauugaggaa

SEQ ID NO: 4095076 - RNA, 23 nt, Streptococcus pneumoniae R6
aagguaauccaauugaggaagua

SEQ ID NO: 4095077 - RNA, 15 nt, Streptococcus pneumoniae R6
aagguaauugaagag

SEQ ID NO: 4095078 - RNA, 15 nt, Streptococcus pneumoniae R6
aagguacuugauuua

SEQ ID NO: 4095079 - RNA, 16 nt, Streptococcus pneumoniae R6
aagguauucauaaaau

SEQ ID NO: 4095080 - RNA, 15 nt, Streptococcus pneumoniae R6
aaggucaaaaugaug

SEQ ID NO: 4095081 - RNA, 13 nt, Streptococcus pneumoniae R6
aaggucaaacuuu

SEQ ID NO: 4095082 - RNA, 17 nt, Streptococcus pneumoniae R6
aaggucacuuuuuucuu

SEQ ID NO: 4095083 - RNA, 15 nt, Streptococcus pneumoniae R6
aaggucaguugcaag

SEQ ID NO: 4095084 - RNA, 14 nt, Streptococcus pneumoniae R6
aaggucaucagcag

SEQ ID NO: 4095085 - RNA, 17 nt, Streptococcus pneumoniae R6
aaggucauuugaaucau

SEQ ID NO: 4095086 - RNA, 17 nt, Streptococcus pneumoniae R6
aaggucgcauaggcaau

SEQ ID NO: 4095087 - RNA, 22 nt, Streptococcus pneumoniae R6
aaggucuuuugucuugcuugcu

SEQ ID NO: 4095088 - RNA, 19 nt, Streptococcus pneumoniae R6
aaggugagggcugagaagg

SEQ ID NO: 4095089 - RNA, 17 nt, Streptococcus pneumoniae R6
aaggugcagagagauaa

SEQ ID NO: 4095090 - RNA, 17 nt, Streptococcus pneumoniae R6
aagguguucaauccaau

SEQ ID NO: 4095091 - RNA, 19 nt, Streptococcus pneumoniae R6
aagguuaacgucaaaugac

SEQ ID NO: 4095092 - RNA, 14 nt, Streptococcus pneumoniae R6
aagguuauuuggau

SEQ ID NO: 4095093 - RNA, 17 nt, Streptococcus pneumoniae R6
aagguucauggcaugga

SEQ ID NO: 4095094 - RNA, 21 nt, Streptococcus pneumoniae R6
aagguugcauagaccaagaga

SEQ ID NO: 4095095 - RNA, 20 nt, Streptococcus pneumoniae R6
aagguuuccugcaugaaggu

SEQ ID NO: 4095096 - RNA, 21 nt, Streptococcus pneumoniae R6
aagguuuggauugauugagaa

SEQ ID NO: 4095097 - RNA, 18 nt, Streptococcus pneumoniae R6
aagguuuuucaaaaaccu

SEQ ID NO: 4095098 - RNA, 22 nt, Streptococcus pneumoniae R6
aagguuuuucuuauacaaauaa

SEQ ID NO: 4095099 - RNA, 13 nt, Streptococcus pneumoniae R6
aaguaaaauacaa

SEQ ID NO: 4095100 - RNA, 17 nt, Streptococcus pneumoniae R6
aaguaaaauacaaacca

SEQ ID NO: 4095101 - RNA, 19 nt, Streptococcus pneumoniae R6
aaguaaaauacaaaccaaa

SEQ ID NO: 4095102 - RNA, 14 nt, Streptococcus pneumoniae R6
aaguaaaauuaauu

SEQ ID NO: 4095103 - RNA, 13 nt, Streptococcus pneumoniae R6
aaguaaauauuuc

SEQ ID NO: 4095104 - RNA, 22 nt, Streptococcus pneumoniae R6
aaguaaaucuacaaagguuuga

SEQ ID NO: 4095105 - RNA, 22 nt, Streptococcus pneumoniae R6
aaguaaaugugagcuuugguuu

SEQ ID NO: 4095106 - RNA, 18 nt, Streptococcus pneumoniae R6
aaguaacaccucuuccga

SEQ ID NO: 4095107 - RNA, 15 nt, Streptococcus pneumoniae R6
aaguaagaaucugca

SEQ ID NO: 4095108 - RNA, 13 nt, Streptococcus pneumoniae R6
aaguaagagaaac

SEQ ID NO: 4095109 - RNA, 16 nt, Streptococcus pneumoniae R6
aaguaauaaauaggau

SEQ ID NO: 4095110 - RNA, 16 nt, Streptococcus pneumoniae R6
aaguaaucucuaacaa

SEQ ID NO: 4095111 - RNA, 13 nt, Streptococcus pneumoniae R6
aaguaaucugcac

SEQ ID NO: 4095112 - RNA, 18 nt, Streptococcus pneumoniae R6
aaguaaugccaggccagu

SEQ ID NO: 4095113 - RNA, 19 nt, Streptococcus pneumoniae R6
aaguaauuugaguaaaaga

SEQ ID NO: 4095114 - RNA, 13 nt, Streptococcus pneumoniae R6
aaguacagauuug

SEQ ID NO: 4095115 - RNA, 14 nt, Streptococcus pneumoniae R6
aaguacgagucaag

SEQ ID NO: 4095116 - RNA, 17 nt, Streptococcus pneumoniae R6
aaguacgagucaaguca

SEQ ID NO: 4095117 - RNA, 22 nt, Streptococcus pneumoniae R6
aaguacuuuuaauauacuugau

SEQ ID NO: 4095118 - RNA, 15 nt, Streptococcus pneumoniae R6
aaguagagauaagug

SEQ ID NO: 4095119 - RNA, 18 nt, Streptococcus pneumoniae R6
aaguagagauaaguggca

SEQ ID NO: 4095120 - RNA, 14 nt, Streptococcus pneumoniae R6
aaguagcaaaacac

SEQ ID NO: 4095121 - RNA, 15 nt, Streptococcus pneumoniae R6
aaguaguaaccaccu

SEQ ID NO: 4095122 - RNA, 12 nt, Streptococcus pneumoniae R6
aaguagucauuu

SEQ ID NO: 4095123 - RNA, 19 nt, Streptococcus pneumoniae R6
aaguauagucaauuaguuu

SEQ ID NO: 4095124 - RNA, 12 nt, Streptococcus pneumoniae R6
aaguuaaaaaac

SEQ ID NO: 4095125 - RNA, 13 nt, Streptococcus pneumoniae R6
aaguuaaaaaacu

SEQ ID NO: 4095126 - RNA, 16 nt, Streptococcus pneumoniae R6
aaguuaaaucuuauau

SEQ ID NO: 4095127 - RNA, 21 nt, Streptococcus pneumoniae R6
aaguuaacuaggcuagcaaau

SEQ ID NO: 4095128 - RNA, 16 nt, Streptococcus pneumoniae R6
aaguuaacuuuuccag

SEQ ID NO: 4095129 - RNA, 18 nt, Streptococcus pneumoniae R6
aaguuaaguuuuuugacu

SEQ ID NO: 4095130 - RNA, 19 nt, Streptococcus pneumoniae R6
aaguuaauugaauuucaag

SEQ ID NO: 4095131 - RNA, 16 nt, Streptococcus pneumoniae R6
aaguuacuugauugca

SEQ ID NO: 4095132 - RNA, 13 nt, Streptococcus pneumoniae R6
aaguuagaaauaa

SEQ ID NO: 4095133 - RNA, 12 nt, Streptococcus pneumoniae R6
aaguuagaauaa

SEQ ID NO: 4095134 - RNA, 14 nt, Streptococcus pneumoniae R6
aaguuagacagaaa

SEQ ID NO: 4095135 - RNA, 19 nt, Streptococcus pneumoniae R6
aaguuagguuuuguuucuu

SEQ ID NO: 4095136 - RNA, 15 nt, Streptococcus pneumoniae R6
aaguuaugaaaaaga

SEQ ID NO: 4095137 - RNA, 22 nt, Streptococcus pneumoniae R6
aaguuaugaaaaagauuuuuua

SEQ ID NO: 4095138 - RNA, 21 nt, Streptococcus pneumoniae R6
aaguuauuucuccuaaagaaa

SEQ ID NO: 4095139 - RNA, 22 nt, Streptococcus pneumoniae R6
aaguuauuucuccuaaagaaaa

SEQ ID NO: 4095140 - RNA, 17 nt, Streptococcus pneumoniae R6
aaguucaaucagcuaaa

SEQ ID NO: 4095141 - RNA, 18 nt, Streptococcus pneumoniae R6
aaguucaaucagcuaaaa

SEQ ID NO: 4095142 - RNA, 19 nt, Streptococcus pneumoniae R6
aaguucacucaaaccugau

SEQ ID NO: 4095143 - RNA, 21 nt, Streptococcus pneumoniae R6
aaguucacuugagcaaacuga

SEQ ID NO: 4095144 - RNA, 12 nt, Streptococcus pneumoniae R6
aaguucaucuuc

SEQ ID NO: 4095145 - RNA, 20 nt, Streptococcus pneumoniae R6
aaguucaucuucaaaaucaa

SEQ ID NO: 4095146 - RNA, 21 nt, Streptococcus pneumoniae R6
aaguucaucuucaaaaucaaa

SEQ ID NO: 4095147 - RNA, 20 nt, Streptococcus pneumoniae R6
aaguucauuuucuuuacuuc

SEQ ID NO: 4095148 - RNA, 21 nt, Streptococcus pneumoniae R6
aaguucauuuucuuuacuucu

SEQ ID NO: 4095149 - RNA, 15 nt, Streptococcus pneumoniae R6
aaguuccggaaacca

SEQ ID NO: 4095150 - RNA, 17 nt, Streptococcus pneumoniae R6
aaguuccuaaaaccaaa

SEQ ID NO: 4095151 - RNA, 20 nt, Streptococcus pneumoniae R6
aaguucgaaaggcuuuauuc

SEQ ID NO: 4095152 - RNA, 22 nt, Streptococcus pneumoniae R6
aaguucucuuucuaaaauagug

SEQ ID NO: 4095153 - RNA, 22 nt, Streptococcus pneumoniae R6
aaguucuuccacucaaaucauu

SEQ ID NO: 4095154 - RNA, 12 nt, Streptococcus pneumoniae R6
aaguucuucccc

SEQ ID NO: 4095155 - RNA, 21 nt, Streptococcus pneumoniae R6
aaguucuucucuuuucuuauc

SEQ ID NO: 4095156 - RNA, 14 nt, Streptococcus pneumoniae R6
aaguucuuuuguaa

SEQ ID NO: 4095157 - RNA, 14 nt, Streptococcus pneumoniae R6
aaguugaaagauua

SEQ ID NO: 4095158 - RNA, 20 nt, Streptococcus pneumoniae R6
aaguugaccaacuagauuuc

SEQ ID NO: 4095159 - RNA, 19 nt, Streptococcus pneumoniae R6
aaguugacgaaguuguucu

SEQ ID NO: 4095160 - RNA, 19 nt, Streptococcus pneumoniae R6
aaguugauacuuauccuuu

SEQ ID NO: 4095161 - RNA, 13 nt, Streptococcus pneumoniae R6
aaguuggucagga

SEQ ID NO: 4095162 - RNA, 15 nt, Streptococcus pneumoniae R6
aaguuguacaagaaa

SEQ ID NO: 4095163 - RNA, 19 nt, Streptococcus pneumoniae R6
aaguuguaguacugaacaa

SEQ ID NO: 4095164 - RNA, 17 nt, Streptococcus pneumoniae R6
aaguuguucuugaaguc

SEQ ID NO: 4095165 - RNA, 15 nt, Streptococcus pneumoniae R6
aaguuuaaaaaaacu

SEQ ID NO: 4095166 - RNA, 23 nt, Streptococcus pneumoniae R6
aaguuuagaaucgucuguacaaa

SEQ ID NO: 4095167 - RNA, 20 nt, Streptococcus pneumoniae R6
aaguuuauaaacuuugguua

SEQ ID NO: 4095168 - RNA, 18 nt, Streptococcus pneumoniae R6
aaguuuauaucuaauaau

SEQ ID NO: 4095169 - RNA, 23 nt, Streptococcus pneumoniae R6
aaguuuauaucuaauaauuuuuc

SEQ ID NO: 4095170 - RNA, 17 nt, Streptococcus pneumoniae R6
aaguuuaucuagaauuu

SEQ ID NO: 4095171 - RNA, 17 nt, Streptococcus pneumoniae R6
aaguuuaugccuugcag

SEQ ID NO: 4095172 - RNA, 12 nt, Streptococcus pneumoniae R6
aaguuucgaaaa

SEQ ID NO: 4095173 - RNA, 15 nt, Streptococcus pneumoniae R6
aaguuucgaaaacca

SEQ ID NO: 4095174 - RNA, 19 nt, Streptococcus pneumoniae R6
aaguuucggcaccaauaca

SEQ ID NO: 4095175 - RNA, 15 nt, Streptococcus pneumoniae R6
aaguuugaugagauu

SEQ ID NO: 4095176 - RNA, 18 nt, Streptococcus pneumoniae R6
aaguuugaugagauuauu

SEQ ID NO: 4095177 - RNA, 14 nt, Streptococcus pneumoniae R6
aaguuuuaggaacu

SEQ ID NO: 4095178 - RNA, 12 nt, Streptococcus pneumoniae R6
aaguuuuuguau

SEQ ID NO: 4095179 - RNA, 18 nt, Streptococcus pneumoniae R6
aaguuuuuuaucucgguu

SEQ ID NO: 4095180 - RNA, 13 nt, Streptococcus pneumoniae R6
aaguuuuuucucu

SEQ ID NO: 4095181 - RNA, 16 nt, Streptococcus pneumoniae R6
aaguuuuuugacuucu

SEQ ID NO: 4095182 - RNA, 14 nt, Streptococcus pneumoniae R6
aauaaaaaagagag

SEQ ID NO: 4095183 - RNA, 23 nt, Streptococcus pneumoniae R6
aauaaaacgcauaguacaagguu

SEQ ID NO: 4095184 - RNA, 19 nt, Streptococcus pneumoniae R6
aauaaaacgcauaguauca

SEQ ID NO: 4095185 - RNA, 15 nt, Streptococcus pneumoniae R6
aauaaaacuuuuaaa

SEQ ID NO: 4095186 - RNA, 14 nt, Streptococcus pneumoniae R6
aauaaaauauaacu

SEQ ID NO: 4095187 - RNA, 14 nt, Streptococcus pneumoniae R6
aauaaaaugaaaua

SEQ ID NO: 4095188 - RNA, 16 nt, Streptococcus pneumoniae R6
aauaaaaugaaauaag

SEQ ID NO: 4095189 - RNA, 21 nt, Streptococcus pneumoniae R6
aauaaaauuccuuuaaaaaca

SEQ ID NO: 4095190 - RNA, 13 nt, Streptococcus pneumoniae R6
aauaaaauuugaa

SEQ ID NO: 4095191 - RNA, 23 nt, Streptococcus pneumoniae R6
aauaaaauuugaacaaauuaauu

SEQ ID NO: 4095192 - RNA, 19 nt, Streptococcus pneumoniae R6
aauaaacagcgagauugaa

SEQ ID NO: 4095193 - RNA, 20 nt, Streptococcus pneumoniae R6
aauaaacuugauuaggauuu

SEQ ID NO: 4095194 - RNA, 17 nt, Streptococcus pneumoniae R6
aauaaagacacuaagaa

SEQ ID NO: 4095195 - RNA, 19 nt, Streptococcus pneumoniae R6
aauaaagguaaaaccaaua

SEQ ID NO: 4095196 - RNA, 15 nt, Streptococcus pneumoniae R6
aauaaaguuccuuua

SEQ ID NO: 4095197 - RNA, 14 nt, Streptococcus pneumoniae R6
aauaaauaaaacuc

SEQ ID NO: 4095198 - RNA, 16 nt, Streptococcus pneumoniae R6
aauaaauaaaacucuu

SEQ ID NO: 4095199 - RNA, 14 nt, Streptococcus pneumoniae R6
aauaaauagauagu

SEQ ID NO: 4095200 - RNA, 20 nt, Streptococcus pneumoniae R6
aauaaauaucaaaaaaagaa

SEQ ID NO: 4095201 - RNA, 19 nt, Streptococcus pneumoniae R6
aauaaaucauugauaguaa

SEQ ID NO: 4095202 - RNA, 16 nt, Streptococcus pneumoniae R6
aauaaaucuaucagaa

SEQ ID NO: 4095203 - RNA, 14 nt, Streptococcus pneumoniae R6
aauaaaucucugga

SEQ ID NO: 4095204 - RNA, 19 nt, Streptococcus pneumoniae R6
aauaaaucuuacugauaua

SEQ ID NO: 4095205 - RNA, 16 nt, Streptococcus pneumoniae R6
aauaaaugcaaagcca

SEQ ID NO: 4095206 - RNA, 21 nt, Streptococcus pneumoniae R6
aauaacacgagaaacaauaaa

SEQ ID NO: 4095207 - RNA, 23 nt, Streptococcus pneumoniae R6
aauaacauuuccucgaagcaaga

SEQ ID NO: 4095208 - RNA, 14 nt, Streptococcus pneumoniae R6
aauaaccaucauuu

SEQ ID NO: 4095209 - RNA, 22 nt, Streptococcus pneumoniae R6
aauaacccaccaagucaucaaa

SEQ ID NO: 4095210 - RNA, 23 nt, Streptococcus pneumoniae R6
aauaacgaagucuauugaaaaau

SEQ ID NO: 4095211 - RNA, 15 nt, Streptococcus pneumoniae R6
aauaacucaauuaag

SEQ ID NO: 4095212 - RNA, 19 nt, Streptococcus pneumoniae R6
aauaacucaauuaagaaau

SEQ ID NO: 4095213 - RNA, 18 nt, Streptococcus pneumoniae R6
aauaacucucaucuaucu

SEQ ID NO: 4095214 - RNA, 22 nt, Streptococcus pneumoniae R6
aauaacucucaucuaucuauuu

SEQ ID NO: 4095215 - RNA, 19 nt, Streptococcus pneumoniae R6
aauaacucuguaaucucua

SEQ ID NO: 4095216 - RNA, 17 nt, Streptococcus pneumoniae R6
aauaacuguaauuucuu

SEQ ID NO: 4095217 - RNA, 13 nt, Streptococcus pneumoniae R6
aauaacuucaaua

SEQ ID NO: 4095218 - RNA, 18 nt, Streptococcus pneumoniae R6
aauaacuucaauaucuuu

SEQ ID NO: 4095219 - RNA, 20 nt, Streptococcus pneumoniae R6
aauaagaaagaccauagcaa

SEQ ID NO: 4095220 - RNA, 18 nt, Streptococcus pneumoniae R6
aauaagauaugaacaaau

SEQ ID NO: 4095221 - RNA, 23 nt, Streptococcus pneumoniae R6
aauaagaugcgaacaaaucaauu

SEQ ID NO: 4095222 - RNA, 13 nt, Streptococcus pneumoniae R6
aauaagaugugaa

SEQ ID NO: 4095223 - RNA, 14 nt, Streptococcus pneumoniae R6
aauaagcuuugaaa

SEQ ID NO: 4095224 - RNA, 20 nt, Streptococcus pneumoniae R6
aauaagcuuugaaaauucca

SEQ ID NO: 4095225 - RNA, 14 nt, Streptococcus pneumoniae R6
aauaaggaaaacau

SEQ ID NO: 4095226 - RNA, 20 nt, Streptococcus pneumoniae R6
aauauacuugauauaguuaa

SEQ ID NO: 4095227 - RNA, 17 nt, Streptococcus pneumoniae R6
aauauagaggauauuuc

SEQ ID NO: 4095228 - RNA, 16 nt, Streptococcus pneumoniae R6
aauauaguaaaaugaa

SEQ ID NO: 4095229 - RNA, 23 nt, Streptococcus pneumoniae R6
aauauagucuacaauagcuuguu

SEQ ID NO: 4095230 - RNA, 15 nt, Streptococcus pneumoniae R6
aauauauaaaaaaua

SEQ ID NO: 4095231 - RNA, 13 nt, Streptococcus pneumoniae R6
aauauauaaaauu

SEQ ID NO: 4095232 - RNA, 16 nt, Streptococcus pneumoniae R6
aauauauuauauaucu

SEQ ID NO: 4095233 - RNA, 14 nt, Streptococcus pneumoniae R6
aauauauucuccag

SEQ ID NO: 4095234 - RNA, 15 nt, Streptococcus pneumoniae R6
aauauauucuccagc

SEQ ID NO: 4095235 - RNA, 14 nt, Streptococcus pneumoniae R6
aauauauuuauuau

SEQ ID NO: 4095236 - RNA, 21 nt, Streptococcus pneumoniae R6
aauauauuuauuauaaaauuu

SEQ ID NO: 4095237 - RNA, 20 nt, Streptococcus pneumoniae R6
aauauauuucucaauagcac

SEQ ID NO: 4095238 - RNA, 19 nt, Streptococcus pneumoniae R6
aauaucaaaaaaagaaguu

SEQ ID NO: 4095239 - RNA, 13 nt, Streptococcus pneumoniae R6
aauaucaaaguuu

SEQ ID NO: 4095240 - RNA, 23 nt, Streptococcus pneumoniae R6
aauaucaagauaagaaaaaacag

SEQ ID NO: 4095241 - RNA, 20 nt, Streptococcus pneumoniae R6
aauaucaaggauuuuuugaa

SEQ ID NO: 4095242 - RNA, 15 nt, Streptococcus pneumoniae R6
aauaucagccagagc

SEQ ID NO: 4095243 - RNA, 16 nt, Streptococcus pneumoniae R6
aauaucaggugugaaa

SEQ ID NO: 4095244 - RNA, 13 nt, Streptococcus pneumoniae R6
aauaucauuucca

SEQ ID NO: 4095245 - RNA, 23 nt, Streptococcus pneumoniae R6
aauauccccugaaugaauugccu

SEQ ID NO: 4095246 - RNA, 14 nt, Streptococcus pneumoniae R6
aauaucugauauua

SEQ ID NO: 4095247 - RNA, 16 nt, Streptococcus pneumoniae R6
aauaugaacaaaaccu

SEQ ID NO: 4095248 - RNA, 17 nt, Streptococcus pneumoniae R6
aauaugaacaaauugau

SEQ ID NO: 4095249 - RNA, 20 nt, Streptococcus pneumoniae R6
aauaugaguucuucaacaau

SEQ ID NO: 4095250 - RNA, 14 nt, Streptococcus pneumoniae R6
aauaugauggaaga

SEQ ID NO: 4095251 - RNA, 23 nt, Streptococcus pneumoniae R6
aauaugcucacugaugaaacuaa

SEQ ID NO: 4095252 - RNA, 14 nt, Streptococcus pneumoniae R6
aauaugucuagcca

SEQ ID NO: 4095253 - RNA, 16 nt, Streptococcus pneumoniae R6
aauauuagaugauuuu

SEQ ID NO: 4095254 - RNA, 22 nt, Streptococcus pneumoniae R6
aauauuagaugauuuuucuguu

SEQ ID NO: 4095255 - RNA, 14 nt, Streptococcus pneumoniae R6
aauauuagcaaaaa

SEQ ID NO: 4095256 - RNA, 20 nt, Streptococcus pneumoniae R6
aauauuagucggaaucuuua

SEQ ID NO: 4095257 - RNA, 22 nt, Streptococcus pneumoniae R6
aauauuaugcguuuuuucugau

SEQ ID NO: 4095258 - RNA, 15 nt, Streptococcus pneumoniae R6
aauauucucuagaaa

SEQ ID NO: 4095259 - RNA, 18 nt, Streptococcus pneumoniae R6
aauauucucuagaaaucu

SEQ ID NO: 4095260 - RNA, 15 nt, Streptococcus pneumoniae R6
aauauuggcuacugu

SEQ ID NO: 4095261 - RNA, 19 nt, Streptococcus pneumoniae R6
aauauuguaaauucuuaaa

SEQ ID NO: 4095262 - RNA, 16 nt, Streptococcus pneumoniae R6
aauauuuaauuguaua

SEQ ID NO: 4095263 - RNA, 19 nt, Streptococcus pneumoniae R6
aauauuuacuucauguuuu

SEQ ID NO: 4095264 - RNA, 21 nt, Streptococcus pneumoniae R6
aauauuuauaguaauuccaca

SEQ ID NO: 4095265 - RNA, 17 nt, Streptococcus pneumoniae R6
aauauuucuaugauaaa

SEQ ID NO: 4095266 - RNA, 23 nt, Streptococcus pneumoniae R6
aauauuucuaugauaaaacgcau

SEQ ID NO: 4095267 - RNA, 20 nt, Streptococcus pneumoniae R6
aauauuuuaguauuccugug

SEQ ID NO: 4095268 - RNA, 11 nt, Streptococcus pneumoniae R6
aauauuuugcu

SEQ ID NO: 4095269 - RNA, 18 nt, Streptococcus pneumoniae R6
aaucaaaaaaauucuuca

SEQ ID NO: 4095270 - RNA, 17 nt, Streptococcus pneumoniae R6
aaucaaaaagcaacaca

SEQ ID NO: 4095271 - RNA, 15 nt, Streptococcus pneumoniae R6
aaucaaaaaugaagu

SEQ ID NO: 4095272 - RNA, 17 nt, Streptococcus pneumoniae R6
aaucaaaacuauaaaug

SEQ ID NO: 4095273 - RNA, 12 nt, Streptococcus pneumoniae R6
aaucaaaauuau

SEQ ID NO: 4095274 - RNA, 18 nt, Streptococcus pneumoniae R6
aaucaaacgagaaucugu

SEQ ID NO: 4095275 - RNA, 14 nt, Streptococcus pneumoniae R6
aaucaaagaacaaa

SEQ ID NO: 4095276 - RNA, 16 nt, Streptococcus pneumoniae R6
aaucaaagaacaaacu

SEQ ID NO: 4095277 - RNA, 21 nt, Streptococcus pneumoniae R6
aaucaaagaacaaacuaggaa

SEQ ID NO: 4095278 - RNA, 12 nt, Streptococcus pneumoniae R6
aaucaaagagca

SEQ ID NO: 4095279 - RNA, 17 nt, Streptococcus pneumoniae R6
aaucaaagagcaaacua

SEQ ID NO: 4095280 - RNA, 13 nt, Streptococcus pneumoniae R6
aaucaaagccacc

SEQ ID NO: 4095281 - RNA, 17 nt, Streptococcus pneumoniae R6
aaucaaaggagauagua

SEQ ID NO: 4095282 - RNA, 19 nt, Streptococcus pneumoniae R6
aaucaaaggagauaguauc

SEQ ID NO: 4095283 - RNA, 10 nt, Streptococcus pneumoniae R6
aaucaaauca

SEQ ID NO: 4095284 - RNA, 11 nt, Streptococcus pneumoniae R6
aaucaaaucaa

SEQ ID NO: 4095285 - RNA, 17 nt, Streptococcus pneumoniae R6
aaucaaaucaauaacac

SEQ ID NO: 4095286 - RNA, 21 nt, Streptococcus pneumoniae R6
aaucaacacaggauuaccuuu

SEQ ID NO: 4095287 - RNA, 19 nt, Streptococcus pneumoniae R6
aaucaacaugagaauacaa

SEQ ID NO: 4095288 - RNA, 17 nt, Streptococcus pneumoniae R6
aaucaacugcuguuuuc

SEQ ID NO: 4095289 - RNA, 19 nt, Streptococcus pneumoniae R6
aaucaagauagcugugaag

SEQ ID NO: 4095290 - RNA, 18 nt, Streptococcus pneumoniae R6
aaucaagcuggcuacaga

SEQ ID NO: 4095291 - RNA, 17 nt, Streptococcus pneumoniae R6
aaucaagggaaaaugaa

SEQ ID NO: 4095292 - RNA, 15 nt, Streptococcus pneumoniae R6
aaucaagguuuccaa

SEQ ID NO: 4095293 - RNA, 21 nt, Streptococcus pneumoniae R6
aaucaagguuuccaaaccaac

SEQ ID NO: 4095294 - RNA, 21 nt, Streptococcus pneumoniae R6
aaucaagugaguuaggagcca

SEQ ID NO: 4095295 - RNA, 22 nt, Streptococcus pneumoniae R6
aaucaauaacacgagaaacaau

SEQ ID NO: 4095296 - RNA, 20 nt, Streptococcus pneumoniae R6
aaucaaucguccuugauuua

SEQ ID NO: 4095297 - RNA, 20 nt, Streptococcus pneumoniae R6
aaucaaucuucaaaaucuca

SEQ ID NO: 4095298 - RNA, 15 nt, Streptococcus pneumoniae R6
aaucaauuagaaaau

SEQ ID NO: 4095299 - RNA, 21 nt, Streptococcus pneumoniae R6
aaucaauuucuagcaaaguuu

SEQ ID NO: 4095300 - RNA, 13 nt, Streptococcus pneumoniae R6
aaucaauuuuucg

SEQ ID NO: 4095301 - RNA, 13 nt, Streptococcus pneumoniae R6
aaucacaucugcu

SEQ ID NO: 4095302 - RNA, 14 nt, Streptococcus pneumoniae R6
aaucacaucugcua

SEQ ID NO: 4095303 - RNA, 20 nt, Streptococcus pneumoniae R6
aaucacauuggcaagagcug

SEQ ID NO: 4095304 - RNA, 23 nt, Streptococcus pneumoniae R6
aaucacauuggcaagagcuguuc

SEQ ID NO: 4095305 - RNA, 18 nt, Streptococcus pneumoniae R6
aaucaccguccccaaaaa

SEQ ID NO: 4095306 - RNA, 16 nt, Streptococcus pneumoniae R6
aaucaccguuugauuc

SEQ ID NO: 4095307 - RNA, 19 nt, Streptococcus pneumoniae R6
aaucaccguuugauucaca

SEQ ID NO: 4095308 - RNA, 13 nt, Streptococcus pneumoniae R6
aaucaccuauucu

SEQ ID NO: 4095309 - RNA, 18 nt, Streptococcus pneumoniae R6
aaucacgcuaaguagaaa

SEQ ID NO: 4095310 - RNA, 21 nt, Streptococcus pneumoniae R6
aaucacgcuaaguagaaaguu

SEQ ID NO: 4095311 - RNA, 17 nt, Streptococcus pneumoniae R6
aaucacgcuuuucuuga

SEQ ID NO: 4095312 - RNA, 20 nt, Streptococcus pneumoniae R6
aaucacguacaacagcuaca

SEQ ID NO: 4095313 - RNA, 20 nt, Streptococcus pneumoniae R6
aaucacgugugaaaaccuug

SEQ ID NO: 4095314 - RNA, 20 nt, Streptococcus pneumoniae R6
aaucacguugcuuauacuca

SEQ ID NO: 4095315 - RNA, 20 nt, Streptococcus pneumoniae R6
aaucacucuaacuucugcua

SEQ ID NO: 4095316 - RNA, 15 nt, Streptococcus pneumoniae R6
aaucacuuaguugaa

SEQ ID NO: 4095317 - RNA, 23 nt, Streptococcus pneumoniae R6
aaucacuuaguugaauuaucaua

SEQ ID NO: 4095318 - RNA, 13 nt, Streptococcus pneumoniae R6
aaucacuugacca

SEQ ID NO: 4095319 - RNA, 14 nt, Streptococcus pneumoniae R6
aaucacuugaccaa

SEQ ID NO: 4095320 - RNA, 13 nt, Streptococcus pneumoniae R6
aaucagaaaaaac

SEQ ID NO: 4095321 - RNA, 13 nt, Streptococcus pneumoniae R6
aaucagaaaagua

SEQ ID NO: 4095322 - RNA, 17 nt, Streptococcus pneumoniae R6
aaucagaacacuuccaa

SEQ ID NO: 4095323 - RNA, 20 nt, Streptococcus pneumoniae R6
aaucagccauugaaaauccu

SEQ ID NO: 4095324 - RNA, 20 nt, Streptococcus pneumoniae R6
aaucaggauuuuuucaugga

SEQ ID NO: 4095325 - RNA, 20 nt, Streptococcus pneumoniae R6
aaucaggccuacaauuggaa

SEQ ID NO: 4095326 - RNA, 19 nt, Streptococcus pneumoniae R6
aaucagguaggauuucucc

SEQ ID NO: 4095327 - RNA, 21 nt, Streptococcus pneumoniae R6
aaucagguaggauuucuccug

SEQ ID NO: 4095328 - RNA, 20 nt, Streptococcus pneumoniae R6
aaucaggucuuauagaaaca

SEQ ID NO: 4095329 - RNA, 13 nt, Streptococcus pneumoniae R6
aaugcuucuuuga

SEQ ID NO: 4095330 - RNA, 15 nt, Streptococcus pneumoniae R6
aaugcuugcaaauca

SEQ ID NO: 4095331 - RNA, 17 nt, Streptococcus pneumoniae R6
aaugcuugcaaaucauu

SEQ ID NO: 4095332 - RNA, 17 nt, Streptococcus pneumoniae R6
aaugcuugcgacaaaaa

SEQ ID NO: 4095333 - RNA, 18 nt, Streptococcus pneumoniae R6
aaugcuugcgacaaaaag

SEQ ID NO: 4095334 - RNA, 18 nt, Streptococcus pneumoniae R6
aaugcuuuuugaaagcag

SEQ ID NO: 4095335 - RNA, 21 nt, Streptococcus pneumoniae R6
aauggaaguuucaaaauuccc

SEQ ID NO: 4095336 - RNA, 20 nt, Streptococcus pneumoniae R6
aauggaugaaucugccagau

SEQ ID NO: 4095337 - RNA, 16 nt, Streptococcus pneumoniae R6
aauggauugaaauaag

SEQ ID NO: 4095338 - RNA, 18 nt, Streptococcus pneumoniae R6
aauggauugaaauaagau

SEQ ID NO: 4095339 - RNA, 16 nt, Streptococcus pneumoniae R6
aauggcaaauucuguc

SEQ ID NO: 4095340 - RNA, 12 nt, Streptococcus pneumoniae R6
aauggcaaccgu

SEQ ID NO: 4095341 - RNA, 21 nt, Streptococcus pneumoniae R6
aauggccagauaauucucuaa

SEQ ID NO: 4095342 - RNA, 16 nt, Streptococcus pneumoniae R6
aaugggauacuaucuc

SEQ ID NO: 4095343 - RNA, 17 nt, Streptococcus pneumoniae R6
aaugggcgcauuuuccu

SEQ ID NO: 4095344 - RNA, 17 nt, Streptococcus pneumoniae R6
aaugggcuuuuucuguu

SEQ ID NO: 4095345 - RNA, 21 nt, Streptococcus pneumoniae R6
aaugggcuuuuucuguuuaau

SEQ ID NO: 4095346 - RNA, 22 nt, Streptococcus pneumoniae R6
aaugguaacagucuuagcaaaa

SEQ ID NO: 4095347 - RNA, 21 nt, Streptococcus pneumoniae R6
aaugguaucugcuaaaacaaa

SEQ ID NO: 4095348 - RNA, 13 nt, Streptococcus pneumoniae R6
aaugguaugucuc

SEQ ID NO: 4095349 - RNA, 15 nt, Streptococcus pneumoniae R6
aauggucuucaugcu

SEQ ID NO: 4095350 - RNA, 21 nt, Streptococcus pneumoniae R6
aauguacugcccccaaacagu

SEQ ID NO: 4095351 - RNA, 20 nt, Streptococcus pneumoniae R6
aauguaguuggauuuccacu

SEQ ID NO: 4095352 - RNA, 13 nt, Streptococcus pneumoniae R6
aauguauuugaaa

SEQ ID NO: 4095353 - RNA, 16 nt, Streptococcus pneumoniae R6
aauguccauaacugcu

SEQ ID NO: 4095354 - RNA, 20 nt, Streptococcus pneumoniae R6
aaugucuaguaauuuuguga

SEQ ID NO: 4095355 - RNA, 21 nt, Streptococcus pneumoniae R6
aaugugauuucuguaaaaaua

SEQ ID NO: 4095356 - RNA, 16 nt, Streptococcus pneumoniae R6
aaugugggaaacagau

SEQ ID NO: 4095357 - RNA, 16 nt, Streptococcus pneumoniae R6
aauguuaaccacaaaa

SEQ ID NO: 4095358 - RNA, 15 nt, Streptococcus pneumoniae R6
aauguugaauaguuu

SEQ ID NO: 4095359 - RNA, 20 nt, Streptococcus pneumoniae R6
aauguugucaauuuccauuu

SEQ ID NO: 4095360 - RNA, 22 nt, Streptococcus pneumoniae R6
aauguuugcuucauuuuuuccu

SEQ ID NO: 4095361 - RNA, 14 nt, Streptococcus pneumoniae R6
aauguuuuagaaau

SEQ ID NO: 4095362 - RNA, 16 nt, Streptococcus pneumoniae R6
aauguuuuagaaauag

SEQ ID NO: 4095363 - RNA, 14 nt, Streptococcus pneumoniae R6
aauguuuuauuaca

SEQ ID NO: 4095364 - RNA, 13 nt, Streptococcus pneumoniae R6
aauguuuucucau

SEQ ID NO: 4095365 - RNA, 19 nt, Streptococcus pneumoniae R6
aauguuuugaucugacuuc

SEQ ID NO: 4095366 - RNA, 17 nt, Streptococcus pneumoniae R6
aauuaaaaggcucauaa

SEQ ID NO: 4095367 - RNA, 19 nt, Streptococcus pneumoniae R6
aauuaaaaugcaagacaca

SEQ ID NO: 4095368 - RNA, 13 nt, Streptococcus pneumoniae R6
aauuaaaguuaau

SEQ ID NO: 4095369 - RNA, 17 nt, Streptococcus pneumoniae R6
aauuaaauaaaauaaaa

SEQ ID NO: 4095370 - RNA, 13 nt, Streptococcus pneumoniae R6
aauuaacaaaaag

SEQ ID NO: 4095371 - RNA, 16 nt, Streptococcus pneumoniae R6
aauuaacaaaaagaaa

SEQ ID NO: 4095372 - RNA, 17 nt, Streptococcus pneumoniae R6
aauuaagaaauuuucuu

SEQ ID NO: 4095373 - RNA, 13 nt, Streptococcus pneumoniae R6
aauuaauucggaa

SEQ ID NO: 4095374 - RNA, 17 nt, Streptococcus pneumoniae R6
aauuaauuuauagaaaa

SEQ ID NO: 4095375 - RNA, 18 nt, Streptococcus pneumoniae R6
aauuaauuuauagaaaua

SEQ ID NO: 4095376 - RNA, 24 nt, Streptococcus pneumoniae R6
aauuaauuuauagaaauauuuuag

SEQ ID NO: 4095377 - RNA, 21 nt, Streptococcus pneumoniae R6
aauuaauuuauuuaaucauuu

SEQ ID NO: 4095378 - RNA, 17 nt, Streptococcus pneumoniae R6
aauuaauuugaauuuuc

SEQ ID NO: 4095379 - RNA, 20 nt, Streptococcus pneumoniae R6
aauuacgauucauaguuacu

SEQ ID NO: 4095380 - RNA, 22 nt, Streptococcus pneumoniae R6
aauuacucccauucuucuuuuc

SEQ ID NO: 4095381 - RNA, 14 nt, Streptococcus pneumoniae R6
aauuagaaaaaaau

SEQ ID NO: 4095382 - RNA, 16 nt, Streptococcus pneumoniae R6
aauuagaaaaagacuu

SEQ ID NO: 4095383 - RNA, 12 nt, Streptococcus pneumoniae R6
aauuagaaaauu

SEQ ID NO: 4095384 - RNA, 15 nt, Streptococcus pneumoniae R6
aauuagaaaauucaa

SEQ ID NO: 4095385 - RNA, 14 nt, Streptococcus pneumoniae R6
aauuagaguuucau

SEQ ID NO: 4095386 - RNA, 19 nt, Streptococcus pneumoniae R6
aauuagcaaucacucuaac

SEQ ID NO: 4095387 - RNA, 17 nt, Streptococcus pneumoniae R6
aauuagccuucauuacu

SEQ ID NO: 4095388 - RNA, 17 nt, Streptococcus pneumoniae R6
aauuagcucaaaacacu

SEQ ID NO: 4095389 - RNA, 14 nt, Streptococcus pneumoniae R6
aauuaggaaaacau

SEQ ID NO: 4095390 - RNA, 19 nt, Streptococcus pneumoniae R6
aauuaggauagauaccuug

SEQ ID NO: 4095391 - RNA, 14 nt, Streptococcus pneumoniae R6
aauuaggcucuuug

SEQ ID NO: 4095392 - RNA, 16 nt, Streptococcus pneumoniae R6
aauuaggcucuuuguc

SEQ ID NO: 4095393 - RNA, 17 nt, Streptococcus pneumoniae R6
aauuaguucagaauuuu

SEQ ID NO: 4095394 - RNA, 18 nt, Streptococcus pneumoniae R6
aauuaguucagaauuuuc

SEQ ID NO: 4095395 - RNA, 14 nt, Streptococcus pneumoniae R6
aauuauaaaaccau

SEQ ID NO: 4095396 - RNA, 16 nt, Streptococcus pneumoniae R6
aauuauaaaaccauua

SEQ ID NO: 4095397 - RNA, 20 nt, Streptococcus pneumoniae R6
aauuauaaaaccauuauuag

SEQ ID NO: 4095398 - RNA, 20 nt, Streptococcus pneumoniae R6
aauuauacuauaaaacaaua

SEQ ID NO: 4095399 - RNA, 17 nt, Streptococcus pneumoniae R6
aauuauacucuuagaaa

SEQ ID NO: 4095400 - RNA, 17 nt, Streptococcus pneumoniae R6
aauuauagacacauucg

SEQ ID NO: 4095401 - RNA, 19 nt, Streptococcus pneumoniae R6
aauuauauauaaaaagcua

SEQ ID NO: 4095402 - RNA, 16 nt, Streptococcus pneumoniae R6
aauuaucuaucucaac

SEQ ID NO: 4095403 - RNA, 21 nt, Streptococcus pneumoniae R6
aauuaugggagcaagcuccua

SEQ ID NO: 4095404 - RNA, 21 nt, Streptococcus pneumoniae R6
aauuauuuacagaaagaacaa

SEQ ID NO: 4095405 - RNA, 20 nt, Streptococcus pneumoniae R6
aauuauuuuuuaucuaguau

SEQ ID NO: 4095406 - RNA, 15 nt, Streptococcus pneumoniae R6
aauucaaacucaaau

SEQ ID NO: 4095407 - RNA, 23 nt, Streptococcus pneumoniae R6
aauucaaaugaauuucuacaaau

SEQ ID NO: 4095408 - RNA, 18 nt, Streptococcus pneumoniae R6
aauucaagcaaaacaaau

SEQ ID NO: 4095409 - RNA, 14 nt, Streptococcus pneumoniae R6
aauucaauguuuac

SEQ ID NO: 4095410 - RNA, 11 nt, Streptococcus pneumoniae R6
aauucaauuau

SEQ ID NO: 4095411 - RNA, 21 nt, Streptococcus pneumoniae R6
aauucaauugcaggagaaaau

SEQ ID NO: 4095412 - RNA, 21 nt, Streptococcus pneumoniae R6
aauucaccuaaccaaauaaua

SEQ ID NO: 4095413 - RNA, 19 nt, Streptococcus pneumoniae R6
aauucaccuauuaacaaua

SEQ ID NO: 4095414 - RNA, 20 nt, Streptococcus pneumoniae R6
aauucacugagaucuucuuc

SEQ ID NO: 4095415 - RNA, 18 nt, Streptococcus pneumoniae R6
aauucaggugauuuacca

SEQ ID NO: 4095416 - RNA, 20 nt, Streptococcus pneumoniae R6
aauucaggugauuuaccaua

SEQ ID NO: 4095417 - RNA, 10 nt, Streptococcus pneumoniae R6
aauucauagg

SEQ ID NO: 4095418 - RNA, 24 nt, Streptococcus pneumoniae R6
aauucauccgcuaucuuauugauu

SEQ ID NO: 4095419 - RNA, 15 nt, Streptococcus pneumoniae R6
aauuccaaaauccca

SEQ ID NO: 4095420 - RNA, 15 nt, Streptococcus pneumoniae R6
aauuccacgagccaa

SEQ ID NO: 4095421 - RNA, 20 nt, Streptococcus pneumoniae R6
aauuccaggagaguaugauu

SEQ ID NO: 4095422 - RNA, 15 nt, Streptococcus pneumoniae R6
aauuccauugucaug

SEQ ID NO: 4095423 - RNA, 21 nt, Streptococcus pneumoniae R6
aauucccucugacgagaaaua

SEQ ID NO: 4095424 - RNA, 19 nt, Streptococcus pneumoniae R6
aauucccuuauccacauca

SEQ ID NO: 4095425 - RNA, 16 nt, Streptococcus pneumoniae R6
aauucccuuccuauca

SEQ ID NO: 4095426 - RNA, 16 nt, Streptococcus pneumoniae R6
aauuccucauuuugaa

SEQ ID NO: 4095427 - RNA, 18 nt, Streptococcus pneumoniae R6
aauuccuggcauaaguca

SEQ ID NO: 4095428 - RNA, 20 nt, Streptococcus pneumoniae R6
aauuccuucuugaccacguu

SEQ ID NO: 4095429 - RNA, 13 nt, Streptococcus pneumoniae R6
aauuccuugauau

SEQ ID NO: 4095430 - RNA, 12 nt, Streptococcus pneumoniae R6
aauuccuuuaaa

SEQ ID NO: 4095431 - RNA, 16 nt, Streptococcus pneumoniae R6
aauuccuuuaaaaaca

SEQ ID NO: 4095432 - RNA, 18 nt, Streptococcus pneumoniae R6
aauuucuauaaauguuuu

SEQ ID NO: 4095433 - RNA, 15 nt, Streptococcus pneumoniae R6
aauuucucaaaaaag

SEQ ID NO: 4095434 - RNA, 18 nt, Streptococcus pneumoniae R6
aauuucucaaaaaaguua

SEQ ID NO: 4095435 - RNA, 20 nt, Streptococcus pneumoniae R6
aauuucucaaaaaaguuaaa

SEQ ID NO: 4095436 - RNA, 14 nt, Streptococcus pneumoniae R6
aauuucugaaacua

SEQ ID NO: 4095437 - RNA, 22 nt, Streptococcus pneumoniae R6
aauuucuuuagcauaauagcag

SEQ ID NO: 4095438 - RNA, 15 nt, Streptococcus pneumoniae R6
aauuucuuuauauaa

SEQ ID NO: 4095439 - RNA, 21 nt, Streptococcus pneumoniae R6
aauuucuuuauauaaaaagac

SEQ ID NO: 4095440 - RNA, 19 nt, Streptococcus pneumoniae R6
aauuucuuuuuguguuaaa

SEQ ID NO: 4095441 - RNA, 23 nt, Streptococcus pneumoniae R6
aauuucuuuuuguguuaaaucau

SEQ ID NO: 4095442 - RNA, 17 nt, Streptococcus pneumoniae R6
aauuugaaaaaaauuuu

SEQ ID NO: 4095443 - RNA, 15 nt, Streptococcus pneumoniae R6
aauuugaaacaauga

SEQ ID NO: 4095444 - RNA, 13 nt, Streptococcus pneumoniae R6
aauuugaacaaag

SEQ ID NO: 4095445 - RNA, 20 nt, Streptococcus pneumoniae R6
aauuugaaccugcuuuaaga

SEQ ID NO: 4095446 - RNA, 15 nt, Streptococcus pneumoniae R6
aauuugaauuuucua

SEQ ID NO: 4095447 - RNA, 15 nt, Streptococcus pneumoniae R6
aauuugaccauuuca

SEQ ID NO: 4095448 - RNA, 15 nt, Streptococcus pneumoniae R6
aauuugacuaaaaac

SEQ ID NO: 4095449 - RNA, 18 nt, Streptococcus pneumoniae R6
aauuugacuguccuuauc

SEQ ID NO: 4095450 - RNA, 15 nt, Streptococcus pneumoniae R6
aauuugauauauaaa

SEQ ID NO: 4095451 - RNA, 19 nt, Streptococcus pneumoniae R6
aauuugauauauaaaugaa

SEQ ID NO: 4095452 - RNA, 19 nt, Streptococcus pneumoniae R6
aauuugauuauuuuugaaa

SEQ ID NO: 4095453 - RNA, 17 nt, Streptococcus pneumoniae R6
aauuugcacuuugauuu

SEQ ID NO: 4095454 - RNA, 14 nt, Streptococcus pneumoniae R6
aauuugcuacaaau

SEQ ID NO: 4095455 - RNA, 13 nt, Streptococcus pneumoniae R6
aauuuggaaaaua

SEQ ID NO: 4095456 - RNA, 14 nt, Streptococcus pneumoniae R6
aauuuggaaaauag

SEQ ID NO: 4095457 - RNA, 23 nt, Streptococcus pneumoniae R6
aauuuggugcuaaguccuugaug

SEQ ID NO: 4095458 - RNA, 23 nt, Streptococcus pneumoniae R6
aauuugguuuuuggcaauuuuug

SEQ ID NO: 4095459 - RNA, 16 nt, Streptococcus pneumoniae R6
aauuuguaaaguuaau

SEQ ID NO: 4095460 - RNA, 19 nt, Streptococcus pneumoniae R6
aauuuguucguauccuauu

SEQ ID NO: 4095461 - RNA, 16 nt, Streptococcus pneumoniae R6
aauuuguuuucaagug

SEQ ID NO: 4095462 - RNA, 10 nt, Streptococcus pneumoniae R6
aauuuuaaaa

SEQ ID NO: 4095463 - RNA, 15 nt, Streptococcus pneumoniae R6
aauuuuacaaauacc

SEQ ID NO: 4095464 - RNA, 19 nt, Streptococcus pneumoniae R6
aauuuuacaaauaccauaa

SEQ ID NO: 4095465 - RNA, 23 nt, Streptococcus pneumoniae R6
aauuuuacaaauaccauaaacua

SEQ ID NO: 4095466 - RNA, 17 nt, Streptococcus pneumoniae R6
aauuuuacuucuucccc

SEQ ID NO: 4095467 - RNA, 16 nt, Streptococcus pneumoniae R6
aauuuuagaacuguaa

SEQ ID NO: 4095468 - RNA, 18 nt, Streptococcus pneumoniae R6
aauuuuagaagguuuuug

SEQ ID NO: 4095469 - RNA, 16 nt, Streptococcus pneumoniae R6
aauuuuaguagaaaau

SEQ ID NO: 4095470 - RNA, 17 nt, Streptococcus pneumoniae R6
aauuuuaguagaaaaug

SEQ ID NO: 4095471 - RNA, 22 nt, Streptococcus pneumoniae R6
aauuuuaucaauccugaagaau

SEQ ID NO: 4095472 - RNA, 23 nt, Streptococcus pneumoniae R6
aauuuuaucaauccugaagaaug

SEQ ID NO: 4095473 - RNA, 17 nt, Streptococcus pneumoniae R6
aauuuuauuuucugaua

SEQ ID NO: 4095474 - RNA, 13 nt, Streptococcus pneumoniae R6
aauuuucaaaaau

SEQ ID NO: 4095475 - RNA, 19 nt, Streptococcus pneumoniae R6
aauuuucaaaaucagaaaa

SEQ ID NO: 4095476 - RNA, 12 nt, Streptococcus pneumoniae R6
aauuuucuaccg

SEQ ID NO: 4095477 - RNA, 12 nt, Streptococcus pneumoniae R6
aauuuucuuuuu

SEQ ID NO: 4095478 - RNA, 21 nt, Streptococcus pneumoniae R6
aauuuugacucggccuucuuu

SEQ ID NO: 4095479 - RNA, 17 nt, Streptococcus pneumoniae R6
aauuuugagucguucuc

SEQ ID NO: 4095480 - RNA, 17 nt, Streptococcus pneumoniae R6
aauuuugauucagauuc

SEQ ID NO: 4095481 - RNA, 14 nt, Streptococcus pneumoniae R6
aauuuugucucuga

SEQ ID NO: 4095482 - RNA, 16 nt, Streptococcus pneumoniae R6
aauuuugucucugaaa

SEQ ID NO: 4095483 - RNA, 15 nt, Streptococcus pneumoniae R6
aauuuuuaugggaau

SEQ ID NO: 4095484 - RNA, 18 nt, Streptococcus pneumoniae R6
aauuuuucauuuaauaua

SEQ ID NO: 4095485 - RNA, 17 nt, Streptococcus pneumoniae R6
aauuuuucugcaaaaaa

SEQ ID NO: 4095486 - RNA, 22 nt, Streptococcus pneumoniae R6
aauuuuugagccguuucuuugg

SEQ ID NO: 4095487 - RNA, 14 nt, Streptococcus pneumoniae R6
aauuuuuuauagac

SEQ ID NO: 4095488 - RNA, 18 nt, Streptococcus pneumoniae R6
aauuuuuugagcaauaau

SEQ ID NO: 4095489 - RNA, 24 nt, Streptococcus pneumoniae R6
aauuuuuuggcuaaaaagcuacua

SEQ ID NO: 4095490 - RNA, 21 nt, Streptococcus pneumoniae R6
aauuuuuuucaaauucuuuag

SEQ ID NO: 4095491 - RNA, 15 nt, Streptococcus pneumoniae R6
acaaaaaaaacaccc

SEQ ID NO: 4095492 - RNA, 23 nt, Streptococcus pneumoniae R6
acaaaaaagagguugucuguaac

SEQ ID NO: 4095493 - RNA, 13 nt, Streptococcus pneumoniae R6
acaaaaaagguca

SEQ ID NO: 4095494 - RNA, 21 nt, Streptococcus pneumoniae R6
acaaaaaaucuagucaucaga

SEQ ID NO: 4095495 - RNA, 11 nt, Streptococcus pneumoniae R6
acaaaaacagg

SEQ ID NO: 4095496 - RNA, 17 nt, Streptococcus pneumoniae R6
acaaaaacgauaaaagc

SEQ ID NO: 4095497 - RNA, 14 nt, Streptococcus pneumoniae R6
acaaaaagaaaaaa

SEQ ID NO: 4095498 - RNA, 12 nt, Streptococcus pneumoniae R6
acaaaaagaccu

SEQ ID NO: 4095499 - RNA, 12 nt, Streptococcus pneumoniae R6
acaaaaagaggc

SEQ ID NO: 4095500 - RNA, 17 nt, Streptococcus pneumoniae R6
acaaaaaguccucuuuc

SEQ ID NO: 4095501 - RNA, 16 nt, Streptococcus pneumoniae R6
acaaaacuggcaaaau

SEQ ID NO: 4095502 - RNA, 20 nt, Streptococcus pneumoniae R6
acaaaacuguaaaguagcaa

SEQ ID NO: 4095503 - RNA, 22 nt, Streptococcus pneumoniae R6
acaaaacuugggauauccuuau

SEQ ID NO: 4095504 - RNA, 16 nt, Streptococcus pneumoniae R6
acaaaacuuuuuaaaa

SEQ ID NO: 4095505 - RNA, 17 nt, Streptococcus pneumoniae R6
acaaaagagaaagacuu

SEQ ID NO: 4095506 - RNA, 19 nt, Streptococcus pneumoniae R6
acaaaagagaaagacuuga

SEQ ID NO: 4095507 - RNA, 15 nt, Streptococcus pneumoniae R6
acaaaagauaagaua

SEQ ID NO: 4095508 - RNA, 15 nt, Streptococcus pneumoniae R6
acaaaagcacucaau

SEQ ID NO: 4095509 - RNA, 23 nt, Streptococcus pneumoniae R6
acaaaagcgaccguauuuuuguu

SEQ ID NO: 4095510 - RNA, 13 nt, Streptococcus pneumoniae R6
acaaaaggcucau

SEQ ID NO: 4095511 - RNA, 18 nt, Streptococcus pneumoniae R6
acaaaaggcucauaguuu

SEQ ID NO: 4095512 - RNA, 18 nt, Streptococcus pneumoniae R6
acaaaaguugaccaacua

SEQ ID NO: 4095513 - RNA, 22 nt, Streptococcus pneumoniae R6
acaaaauccgcuugggaaacca

SEQ ID NO: 4095514 - RNA, 23 nt, Streptococcus pneumoniae R6
acaaaauccgcuugggaaaccaa

SEQ ID NO: 4095515 - RNA, 22 nt, Streptococcus pneumoniae R6
acaaaauguucaguuucuauuu

SEQ ID NO: 4095516 - RNA, 23 nt, Streptococcus pneumoniae R6
acaaaauguucaguuucuauuuc

SEQ ID NO: 4095517 - RNA, 12 nt, Streptococcus pneumoniae R6
acaaaauuacca

SEQ ID NO: 4095518 - RNA, 16 nt, Streptococcus pneumoniae R6
acaaaauuauuaaaau

SEQ ID NO: 4095519 - RNA, 21 nt, Streptococcus pneumoniae R6
acaaaauuauuaaaaucaaaa

SEQ ID NO: 4095520 - RNA, 14 nt, Streptococcus pneumoniae R6
acaaaauucuuccu

SEQ ID NO: 4095521 - RNA, 16 nt, Streptococcus pneumoniae R6
acaaaauugauaauag

SEQ ID NO: 4095522 - RNA, 13 nt, Streptococcus pneumoniae R6
acaaaauuugguu

SEQ ID NO: 4095523 - RNA, 20 nt, Streptococcus pneumoniae R6
acaaacaaauccaaucuucu

SEQ ID NO: 4095524 - RNA, 17 nt, Streptococcus pneumoniae R6
acaaacacgcauaguau

SEQ ID NO: 4095525 - RNA, 20 nt, Streptococcus pneumoniae R6
acaaaccaccgacaaucguu

SEQ ID NO: 4095526 - RNA, 12 nt, Streptococcus pneumoniae R6
acaaagaaaaaa

SEQ ID NO: 4095527 - RNA, 18 nt, Streptococcus pneumoniae R6
acaaagaaaaaacaaagu

SEQ ID NO: 4095528 - RNA, 21 nt, Streptococcus pneumoniae R6
acaaagaaaaaacaaaguauu

SEQ ID NO: 4095529 - RNA, 22 nt, Streptococcus pneumoniae R6
acaaagaaaacgccugcuuuuu

SEQ ID NO: 4095530 - RNA, 18 nt, Streptococcus pneumoniae R6
acaaagaacaugaaagau

SEQ ID NO: 4095531 - RNA, 21 nt, Streptococcus pneumoniae R6
acaaagaccuuugaaaacuga

SEQ ID NO: 4095532 - RNA, 15 nt, Streptococcus pneumoniae R6
acaaagagauugccc

SEQ ID NO: 4095533 - RNA, 17 nt, Streptococcus pneumoniae R6
acaaagagccaaaaaag

SEQ ID NO: 4095534 - RNA, 22 nt, Streptococcus pneumoniae R6
acaaagagccauaaaaauaacu

SEQ ID NO: 4095535 - RNA, 22 nt, Streptococcus pneumoniae R6
acaauauuuuugagccuuuccu

SEQ ID NO: 4095536 - RNA, 17 nt, Streptococcus pneumoniae R6
acaaucauagacuuaau

SEQ ID NO: 4095537 - RNA, 17 nt, Streptococcus pneumoniae R6
acaauccaguuaacuac

SEQ ID NO: 4095538 - RNA, 22 nt, Streptococcus pneumoniae R6
acaaucguaaccaauuucucaa

SEQ ID NO: 4095539 - RNA, 12 nt, Streptococcus pneumoniae R6
acaaucuuuucu

SEQ ID NO: 4095540 - RNA, 13 nt, Streptococcus pneumoniae R6
acaaucuuuucuu

SEQ ID NO: 4095541 - RNA, 15 nt, Streptococcus pneumoniae R6
acaaucuuuucuuua

SEQ ID NO: 4095542 - RNA, 14 nt, Streptococcus pneumoniae R6
acaaugaaaaaaac

SEQ ID NO: 4095543 - RNA, 15 nt, Streptococcus pneumoniae R6
acaaugaaaaaaaca

SEQ ID NO: 4095544 - RNA, 16 nt, Streptococcus pneumoniae R6
acaaugaaaaaaacaa

SEQ ID NO: 4095545 - RNA, 20 nt, Streptococcus pneumoniae R6
acaaugacucccauaaaaau

SEQ ID NO: 4095546 - RNA, 20 nt, Streptococcus pneumoniae R6
acaaugagaaauuuuugguc

SEQ ID NO: 4095547 - RNA, 15 nt, Streptococcus pneumoniae R6
acaaugcuuuagaaa

SEQ ID NO: 4095548 - RNA, 14 nt, Streptococcus pneumoniae R6
acaauggaaaugau

SEQ ID NO: 4095549 - RNA, 16 nt, Streptococcus pneumoniae R6
acaaugguuagaaaau

SEQ ID NO: 4095550 - RNA, 21 nt, Streptococcus pneumoniae R6
acaaugguuagaaaaucaagu

SEQ ID NO: 4095551 - RNA, 18 nt, Streptococcus pneumoniae R6
acaauguaauauuggcua

SEQ ID NO: 4095552 - RNA, 18 nt, Streptococcus pneumoniae R6
acaauguagccaucaucc

SEQ ID NO: 4095553 - RNA, 21 nt, Streptococcus pneumoniae R6
acaaugugcucagaaacaaga

SEQ ID NO: 4095554 - RNA, 14 nt, Streptococcus pneumoniae R6
acaauguucuuuuc

SEQ ID NO: 4095555 - RNA, 16 nt, Streptococcus pneumoniae R6
acaauguucuuuucuc

SEQ ID NO: 4095556 - RNA, 23 nt, Streptococcus pneumoniae R6
acaauguucuuuucucuagcuuu

SEQ ID NO: 4095557 - RNA, 21 nt, Streptococcus pneumoniae R6
acaauguugucaauuuccauu

SEQ ID NO: 4095558 - RNA, 15 nt, Streptococcus pneumoniae R6
acaauguuuuagaaa

SEQ ID NO: 4095559 - RNA, 21 nt, Streptococcus pneumoniae R6
acaauguuuuagaaaucacag

SEQ ID NO: 4095560 - RNA, 21 nt, Streptococcus pneumoniae R6
acaauguuuugaucugacuuc

SEQ ID NO: 4095561 - RNA, 22 nt, Streptococcus pneumoniae R6
acaauuaagguuuuaccuucaa

SEQ ID NO: 4095562 - RNA, 20 nt, Streptococcus pneumoniae R6
acaauuagcaagaaauugau

SEQ ID NO: 4095563 - RNA, 15 nt, Streptococcus pneumoniae R6
acaauuaggaacuuu

SEQ ID NO: 4095564 - RNA, 15 nt, Streptococcus pneumoniae R6
acaauugcuaaaaca

SEQ ID NO: 4095565 - RNA, 17 nt, Streptococcus pneumoniae R6
acaauugcucuucugaa

SEQ ID NO: 4095566 - RNA, 14 nt, Streptococcus pneumoniae R6
acaauuggaaauaa

SEQ ID NO: 4095567 - RNA, 14 nt, Streptococcus pneumoniae R6
acaauuguaaaaag

SEQ ID NO: 4095568 - RNA, 15 nt, Streptococcus pneumoniae R6
acaauuguaaaaaga

SEQ ID NO: 4095569 - RNA, 19 nt, Streptococcus pneumoniae R6
acaauuguaaaaagaggga

SEQ ID NO: 4095570 - RNA, 13 nt, Streptococcus pneumoniae R6
acaauuucucgug

SEQ ID NO: 4095571 - RNA, 16 nt, Streptococcus pneumoniae R6
acaauuuuaggagaaa

SEQ ID NO: 4095572 - RNA, 11 nt, Streptococcus pneumoniae R6
acacaaaauag

SEQ ID NO: 4095573 - RNA, 23 nt, Streptococcus pneumoniae R6
acacaagauccaauccuuuucuu

SEQ ID NO: 4095574 - RNA, 19 nt, Streptococcus pneumoniae R6
acacaggaauacuaaaaua

SEQ ID NO: 4095575 - RNA, 14 nt, Streptococcus pneumoniae R6
acacaguguacaua

SEQ ID NO: 4095576 - RNA, 17 nt, Streptococcus pneumoniae R6
acacaguuuugagguug

SEQ ID NO: 4095577 - RNA, 19 nt, Streptococcus pneumoniae R6
acacauaguaguaaacaca

SEQ ID NO: 4095578 - RNA, 23 nt, Streptococcus pneumoniae R6
acacauaguaguaaacacacuau

SEQ ID NO: 4095579 - RNA, 17 nt, Streptococcus pneumoniae R6
acacauucguuccuuua

SEQ ID NO: 4095580 - RNA, 19 nt, Streptococcus pneumoniae R6
acaccaaaaagugcaugag

SEQ ID NO: 4095581 - RNA, 20 nt, Streptococcus pneumoniae R6
acaccaguauucuuuuuaaa

SEQ ID NO: 4095582 - RNA, 19 nt, Streptococcus pneumoniae R6
acacccuagccucagcaaa

SEQ ID NO: 4095583 - RNA, 21 nt, Streptococcus pneumoniae R6
acaccgagaaaggcgacauca

SEQ ID NO: 4095584 - RNA, 15 nt, Streptococcus pneumoniae R6
acaccucuuucuuuc

SEQ ID NO: 4095585 - RNA, 19 nt, Streptococcus pneumoniae R6
acacgaagcauaucagaca

SEQ ID NO: 4095586 - RNA, 23 nt, Streptococcus pneumoniae R6
acacgaaucaauuucuucacacc

SEQ ID NO: 4095587 - RNA, 16 nt, Streptococcus pneumoniae R6
acacgaccuauagaaa

SEQ ID NO: 4095588 - RNA, 14 nt, Streptococcus pneumoniae R6
acacgagaaacaau

SEQ ID NO: 4095589 - RNA, 23 nt, Streptococcus pneumoniae R6
acacgauaaucugggcuaauucu

SEQ ID NO: 4095590 - RNA, 13 nt, Streptococcus pneumoniae R6
acacgcuucuuua

SEQ ID NO: 4095591 - RNA, 12 nt, Streptococcus pneumoniae R6
acacgguaugga

SEQ ID NO: 4095592 - RNA, 16 nt, Streptococcus pneumoniae R6
acacgguauuugagag

SEQ ID NO: 4095593 - RNA, 20 nt, Streptococcus pneumoniae R6
acacguccauaaugagcugu

SEQ ID NO: 4095594 - RNA, 16 nt, Streptococcus pneumoniae R6
acacuagaugcaucug

SEQ ID NO: 4095595 - RNA, 15 nt, Streptococcus pneumoniae R6
acacuagcaauuuuu

SEQ ID NO: 4095596 - RNA, 23 nt, Streptococcus pneumoniae R6
acacuauuuacaaguguuuucac

SEQ ID NO: 4095597 - RNA, 21 nt, Streptococcus pneumoniae R6
acacuauuuguagcaaauuca

SEQ ID NO: 4095598 - RNA, 14 nt, Streptococcus pneumoniae R6
acacucaaaucaaa

SEQ ID NO: 4095599 - RNA, 14 nt, Streptococcus pneumoniae R6
acacuguuuuaagg

SEQ ID NO: 4095600 - RNA, 20 nt, Streptococcus pneumoniae R6
acacuuaggcuauccagaua

SEQ ID NO: 4095601 - RNA, 20 nt, Streptococcus pneumoniae R6
acacuucugcuucuaaaaca

SEQ ID NO: 4095602 - RNA, 14 nt, Streptococcus pneumoniae R6
acacuugacaaaga

SEQ ID NO: 4095603 - RNA, 18 nt, Streptococcus pneumoniae R6
acacuuguaaagaguaca

SEQ ID NO: 4095604 - RNA, 15 nt, Streptococcus pneumoniae R6
acacuuuuauuaugg

SEQ ID NO: 4095605 - RNA, 21 nt, Streptococcus pneumoniae R6
acagaaaaaccuugauacuau

SEQ ID NO: 4095606 - RNA, 15 nt, Streptococcus pneumoniae R6
acagaacauuuuaau

SEQ ID NO: 4095607 - RNA, 22 nt, Streptococcus pneumoniae R6
acagaaccaucuucauuuuggu

SEQ ID NO: 4095608 - RNA, 18 nt, Streptococcus pneumoniae R6
acagaacuggcguuuuau

SEQ ID NO: 4095609 - RNA, 17 nt, Streptococcus pneumoniae R6
acagaagaagugacagu

SEQ ID NO: 4095610 - RNA, 20 nt, Streptococcus pneumoniae R6
acagaagaagugacagucgc

SEQ ID NO: 4095611 - RNA, 13 nt, Streptococcus pneumoniae R6
acagaagauaggc

SEQ ID NO: 4095612 - RNA, 18 nt, Streptococcus pneumoniae R6
acagaagauugauaggau

SEQ ID NO: 4095613 - RNA, 13 nt, Streptococcus pneumoniae R6
acagaagcuuuac

SEQ ID NO: 4095614 - RNA, 18 nt, Streptococcus pneumoniae R6
acagaaucccagauaaag

SEQ ID NO: 4095615 - RNA, 18 nt, Streptococcus pneumoniae R6
acagaaucuucauauaca

SEQ ID NO: 4095616 - RNA, 14 nt, Streptococcus pneumoniae R6
acagacaaaacugg

SEQ ID NO: 4095617 - RNA, 14 nt, Streptococcus pneumoniae R6
acagacauaugaaa

SEQ ID NO: 4095618 - RNA, 22 nt, Streptococcus pneumoniae R6
acagaccuguccaacagacuca

SEQ ID NO: 4095619 - RNA, 16 nt, Streptococcus pneumoniae R6
acagacgauuaaacuu

SEQ ID NO: 4095620 - RNA, 12 nt, Streptococcus pneumoniae R6
acagagaaaguc

SEQ ID NO: 4095621 - RNA, 18 nt, Streptococcus pneumoniae R6
acagagaaagucagcugg

SEQ ID NO: 4095622 - RNA, 21 nt, Streptococcus pneumoniae R6
acagagaggucaauaguauca

SEQ ID NO: 4095623 - RNA, 13 nt, Streptococcus pneumoniae R6
acagagcuugaag

SEQ ID NO: 4095624 - RNA, 17 nt, Streptococcus pneumoniae R6
acagagguggaaaagca

SEQ ID NO: 4095625 - RNA, 13 nt, Streptococcus pneumoniae R6
acagauaagagca

SEQ ID NO: 4095626 - RNA, 14 nt, Streptococcus pneumoniae R6
acagauaagagcaa

SEQ ID NO: 4095627 - RNA, 15 nt, Streptococcus pneumoniae R6
acagauaagagcaac

SEQ ID NO: 4095628 - RNA, 13 nt, Streptococcus pneumoniae R6
acagauagaaggu

SEQ ID NO: 4095629 - RNA, 22 nt, Streptococcus pneumoniae R6
acagauucuacucuguuuucac

SEQ ID NO: 4095630 - RNA, 20 nt, Streptococcus pneumoniae R6
acagauuugaaaacugauga

SEQ ID NO: 4095631 - RNA, 21 nt, Streptococcus pneumoniae R6
acagauuugaaaacugaugaa

SEQ ID NO: 4095632 - RNA, 14 nt, Streptococcus pneumoniae R6
acagauuuuucugu

SEQ ID NO: 4095633 - RNA, 16 nt, Streptococcus pneumoniae R6
acagcaaaaaauuaug

SEQ ID NO: 4095634 - RNA, 13 nt, Streptococcus pneumoniae R6
acagcaaggucaa

SEQ ID NO: 4095635 - RNA, 12 nt, Streptococcus pneumoniae R6
acagcaccaacu

SEQ ID NO: 4095636 - RNA, 14 nt, Streptococcus pneumoniae R6
acagcaccuuuugc

SEQ ID NO: 4095637 - RNA, 21 nt, Streptococcus pneumoniae R6
acagcaguuaugauauauuua

SEQ ID NO: 4095638 - RNA, 15 nt, Streptococcus pneumoniae R6
acaugcguuaaaagu

SEQ ID NO: 4095639 - RNA, 17 nt, Streptococcus pneumoniae R6
acaugcguuaaaaguua

SEQ ID NO: 4095640 - RNA, 21 nt, Streptococcus pneumoniae R6
acauggaaauuauaaaaccau

SEQ ID NO: 4095641 - RNA, 22 nt, Streptococcus pneumoniae R6
acaugguuuugagguuguagau

SEQ ID NO: 4095642 - RNA, 18 nt, Streptococcus pneumoniae R6
acauguauauuacagauu

SEQ ID NO: 4095643 - RNA, 23 nt, Streptococcus pneumoniae R6
acauguccauucaucggaauggu

SEQ ID NO: 4095644 - RNA, 14 nt, Streptococcus pneumoniae R6
acauguguuaccau

SEQ ID NO: 4095645 - RNA, 15 nt, Streptococcus pneumoniae R6
acauguguuaccaua

SEQ ID NO: 4095646 - RNA, 20 nt, Streptococcus pneumoniae R6
acauguguuaccauaguucc

SEQ ID NO: 4095647 - RNA, 14 nt, Streptococcus pneumoniae R6
acauuaaagacaau

SEQ ID NO: 4095648 - RNA, 20 nt, Streptococcus pneumoniae R6
acauuaaagacaauguucuu

SEQ ID NO: 4095649 - RNA, 14 nt, Streptococcus pneumoniae R6
acauuaacaucacu

SEQ ID NO: 4095650 - RNA, 12 nt, Streptococcus pneumoniae R6
acauuagaauuc

SEQ ID NO: 4095651 - RNA, 14 nt, Streptococcus pneumoniae R6
acauuauccaugaa

SEQ ID NO: 4095652 - RNA, 20 nt, Streptococcus pneumoniae R6
acauuaugcguuuuugugau

SEQ ID NO: 4095653 - RNA, 16 nt, Streptococcus pneumoniae R6
acauucccaaacaaaa

SEQ ID NO: 4095654 - RNA, 17 nt, Streptococcus pneumoniae R6
acauucccaaacaaaaa

SEQ ID NO: 4095655 - RNA, 11 nt, Streptococcus pneumoniae R6
acauucccauu

SEQ ID NO: 4095656 - RNA, 15 nt, Streptococcus pneumoniae R6
acauucgaaugauau

SEQ ID NO: 4095657 - RNA, 17 nt, Streptococcus pneumoniae R6
acauucguuccuuuaaa

SEQ ID NO: 4095658 - RNA, 23 nt, Streptococcus pneumoniae R6
acauucuccaguagaucacugaa

SEQ ID NO: 4095659 - RNA, 21 nt, Streptococcus pneumoniae R6
acauucucccgcccuuuuuuc

SEQ ID NO: 4095660 - RNA, 13 nt, Streptococcus pneumoniae R6
acauugaaaaugu

SEQ ID NO: 4095661 - RNA, 18 nt, Streptococcus pneumoniae R6
acauugacaucugugauu

SEQ ID NO: 4095662 - RNA, 19 nt, Streptococcus pneumoniae R6
acauugauugcaagcccuu

SEQ ID NO: 4095663 - RNA, 13 nt, Streptococcus pneumoniae R6
acauugauuucca

SEQ ID NO: 4095664 - RNA, 22 nt, Streptococcus pneumoniae R6
acauugguucuuuuuacuuaua

SEQ ID NO: 4095665 - RNA, 21 nt, Streptococcus pneumoniae R6
acauugugaggaauugauuua

SEQ ID NO: 4095666 - RNA, 20 nt, Streptococcus pneumoniae R6
acauuguuaaaaauugauuu

SEQ ID NO: 4095667 - RNA, 21 nt, Streptococcus pneumoniae R6
acauuguuaaaaauugauuug

SEQ ID NO: 4095668 - RNA, 19 nt, Streptococcus pneumoniae R6
acauuuaucuauaaacaaa

SEQ ID NO: 4095669 - RNA, 19 nt, Streptococcus pneumoniae R6
acauuuccauguaaaauua

SEQ ID NO: 4095670 - RNA, 23 nt, Streptococcus pneumoniae R6
acauuucggauuuuaaaaugcca

SEQ ID NO: 4095671 - RNA, 19 nt, Streptococcus pneumoniae R6
acauuugaguuucucuuac

SEQ ID NO: 4095672 - RNA, 21 nt, Streptococcus pneumoniae R6
acauuugcuugaccagcuacu

SEQ ID NO: 4095673 - RNA, 15 nt, Streptococcus pneumoniae R6
acauuuggaaggcug

SEQ ID NO: 4095674 - RNA, 14 nt, Streptococcus pneumoniae R6
accaaaaaaacucc

SEQ ID NO: 4095675 - RNA, 19 nt, Streptococcus pneumoniae R6
accaaaaaugugaacaucc

SEQ ID NO: 4095676 - RNA, 11 nt, Streptococcus pneumoniae R6
accaaaacagg

SEQ ID NO: 4095677 - RNA, 11 nt, Streptococcus pneumoniae R6
accaaaaccuu

SEQ ID NO: 4095678 - RNA, 14 nt, Streptococcus pneumoniae R6
accaaaacuauauu

SEQ ID NO: 4095679 - RNA, 13 nt, Streptococcus pneumoniae R6
accaaaacucaag

SEQ ID NO: 4095680 - RNA, 23 nt, Streptococcus pneumoniae R6
accaaaagcagaggcaaugacaa

SEQ ID NO: 4095681 - RNA, 12 nt, Streptococcus pneumoniae R6
accaaaaucaua

SEQ ID NO: 4095682 - RNA, 17 nt, Streptococcus pneumoniae R6
accaaacagucucaccu

SEQ ID NO: 4095683 - RNA, 18 nt, Streptococcus pneumoniae R6
accaaacaucaccagcau

SEQ ID NO: 4095684 - RNA, 17 nt, Streptococcus pneumoniae R6
accaaacggauuuugug

SEQ ID NO: 4095685 - RNA, 15 nt, Streptococcus pneumoniae R6
accaaacuuucccuu

SEQ ID NO: 4095686 - RNA, 19 nt, Streptococcus pneumoniae R6
accaaagaaaaacucuugu

SEQ ID NO: 4095687 - RNA, 21 nt, Streptococcus pneumoniae R6
accaaaggcauugcgcuugau

SEQ ID NO: 4095688 - RNA, 22 nt, Streptococcus pneumoniae R6
accaaaggcauugugcuugaua

SEQ ID NO: 4095689 - RNA, 17 nt, Streptococcus pneumoniae R6
accaaauuucauauuuu

SEQ ID NO: 4095690 - RNA, 19 nt, Streptococcus pneumoniae R6
accaaauuuucaguuuuau

SEQ ID NO: 4095691 - RNA, 20 nt, Streptococcus pneumoniae R6
accaacauagauaaagacac

SEQ ID NO: 4095692 - RNA, 15 nt, Streptococcus pneumoniae R6
accaaccucagaauc

SEQ ID NO: 4095693 - RNA, 15 nt, Streptococcus pneumoniae R6
accaacuucuuuuuu

SEQ ID NO: 4095694 - RNA, 21 nt, Streptococcus pneumoniae R6
accaacuucuuuuuuugauau

SEQ ID NO: 4095695 - RNA, 12 nt, Streptococcus pneumoniae R6
accaacuuuaag

SEQ ID NO: 4095696 - RNA, 19 nt, Streptococcus pneumoniae R6
accaacuuuaagagcuucu

SEQ ID NO: 4095697 - RNA, 13 nt, Streptococcus pneumoniae R6
accaacuuuuccu

SEQ ID NO: 4095698 - RNA, 15 nt, Streptococcus pneumoniae R6
accaacuuuuccuug

SEQ ID NO: 4095699 - RNA, 15 nt, Streptococcus pneumoniae R6
accaagaaccuuggu

SEQ ID NO: 4095700 - RNA, 11 nt, Streptococcus pneumoniae R6
accaagaaguc

SEQ ID NO: 4095701 - RNA, 15 nt, Streptococcus pneumoniae R6
accaagagacgauuc

SEQ ID NO: 4095702 - RNA, 12 nt, Streptococcus pneumoniae R6
accaagagcaaa

SEQ ID NO: 4095703 - RNA, 13 nt, Streptococcus pneumoniae R6
accaagagcaaaa

SEQ ID NO: 4095704 - RNA, 15 nt, Streptococcus pneumoniae R6
accaagagcaaaaac

SEQ ID NO: 4095705 - RNA, 18 nt, Streptococcus pneumoniae R6
accaagagcaaaaacaau

SEQ ID NO: 4095706 - RNA, 18 nt, Streptococcus pneumoniae R6
accaagaucuugucugca

SEQ ID NO: 4095707 - RNA, 15 nt, Streptococcus pneumoniae R6
accaagcauuuucau

SEQ ID NO: 4095708 - RNA, 17 nt, Streptococcus pneumoniae R6
accaaggauugucugaa

SEQ ID NO: 4095709 - RNA, 19 nt, Streptococcus pneumoniae R6
accaaggcuuugagggcug

SEQ ID NO: 4095710 - RNA, 16 nt, Streptococcus pneumoniae R6
accaaguauuggcaaa

SEQ ID NO: 4095711 - RNA, 14 nt, Streptococcus pneumoniae R6
accaagucugcaug

SEQ ID NO: 4095712 - RNA, 15 nt, Streptococcus pneumoniae R6
accaagucugcaugc

SEQ ID NO: 4095713 - RNA, 22 nt, Streptococcus pneumoniae R6
accaaguucuaaauaaucucca

SEQ ID NO: 4095714 - RNA, 17 nt, Streptococcus pneumoniae R6
accaauaauaaaacuuu

SEQ ID NO: 4095715 - RNA, 20 nt, Streptococcus pneumoniae R6
accaauaauaaaacuuuuaa

SEQ ID NO: 4095716 - RNA, 13 nt, Streptococcus pneumoniae R6
accaauacagcuu

SEQ ID NO: 4095717 - RNA, 15 nt, Streptococcus pneumoniae R6
accaauacuacaaua

SEQ ID NO: 4095718 - RNA, 16 nt, Streptococcus pneumoniae R6
accaauacuacaauaa

SEQ ID NO: 4095719 - RNA, 14 nt, Streptococcus pneumoniae R6
accaauauuagucg

SEQ ID NO: 4095720 - RNA, 24 nt, Streptococcus pneumoniae R6
accaauauuagucggaaucuuuaa

SEQ ID NO: 4095721 - RNA, 12 nt, Streptococcus pneumoniae R6
accaaucaaauc

SEQ ID NO: 4095722 - RNA, 14 nt, Streptococcus pneumoniae R6
accaaucaaaucaa

SEQ ID NO: 4095723 - RNA, 15 nt, Streptococcus pneumoniae R6
accaaucaaaucaau

SEQ ID NO: 4095724 - RNA, 13 nt, Streptococcus pneumoniae R6
accaaucauuugg

SEQ ID NO: 4095725 - RNA, 24 nt, Streptococcus pneumoniae R6
accaaucccaugucaauucucacu

SEQ ID NO: 4095726 - RNA, 22 nt, Streptococcus pneumoniae R6
accaaugagaaacuuagcgaaa

SEQ ID NO: 4095727 - RNA, 22 nt, Streptococcus pneumoniae R6
accaauucagguggguuuucug

SEQ ID NO: 4095728 - RNA, 15 nt, Streptococcus pneumoniae R6
accaauucaguaacu

SEQ ID NO: 4095729 - RNA, 14 nt, Streptococcus pneumoniae R6
accaauuuuacaaa

SEQ ID NO: 4095730 - RNA, 13 nt, Streptococcus pneumoniae R6
accaauuuuuccu

SEQ ID NO: 4095731 - RNA, 14 nt, Streptococcus pneumoniae R6
accacaacaaaaaa

SEQ ID NO: 4095732 - RNA, 14 nt, Streptococcus pneumoniae R6
accacaugacauua

SEQ ID NO: 4095733 - RNA, 18 nt, Streptococcus pneumoniae R6
accacaugacauuauuuu

SEQ ID NO: 4095734 - RNA, 19 nt, Streptococcus pneumoniae R6
accacaugacauuauuuuc

SEQ ID NO: 4095735 - RNA, 18 nt, Streptococcus pneumoniae R6
accaccaaucauuuggaa

SEQ ID NO: 4095736 - RNA, 23 nt, Streptococcus pneumoniae R6
accaccagaguggauuugguuuu

SEQ ID NO: 4095737 - RNA, 12 nt, Streptococcus pneumoniae R6
accaccgaccuc

SEQ ID NO: 4095738 - RNA, 17 nt, Streptococcus pneumoniae R6
accaccugcaacaauac

SEQ ID NO: 4095739 - RNA, 19 nt, Streptococcus pneumoniae R6
accaccugcaacaauaccu

SEQ ID NO: 4095740 - RNA, 15 nt, Streptococcus pneumoniae R6
accaccuuccuuggu

SEQ ID NO: 4095741 - RNA, 20 nt, Streptococcus pneumoniae R6
accuaguccaagacguucaa

SEQ ID NO: 4095742 - RNA, 20 nt, Streptococcus pneumoniae R6
accuauuaacaauaaucuau

SEQ ID NO: 4095743 - RNA, 21 nt, Streptococcus pneumoniae R6
accuauuauacaaaguuaagu

SEQ ID NO: 4095744 - RNA, 17 nt, Streptococcus pneumoniae R6
accuauucauauaugcu

SEQ ID NO: 4095745 - RNA, 15 nt, Streptococcus pneumoniae R6
accucaaaacagugu

SEQ ID NO: 4095746 - RNA, 22 nt, Streptococcus pneumoniae R6
accucaaaacaguguuuugagc

SEQ ID NO: 4095747 - RNA, 21 nt, Streptococcus pneumoniae R6
accucaaaacaguguuuugau

SEQ ID NO: 4095748 - RNA, 22 nt, Streptococcus pneumoniae R6
accucaaaacgguguuuugagc

SEQ ID NO: 4095749 - RNA, 21 nt, Streptococcus pneumoniae R6
accucaaagcaguacuuugag

SEQ ID NO: 4095750 - RNA, 16 nt, Streptococcus pneumoniae R6
accucacuuaauacuu

SEQ ID NO: 4095751 - RNA, 16 nt, Streptococcus pneumoniae R6
accucauaucucuugu

SEQ ID NO: 4095752 - RNA, 16 nt, Streptococcus pneumoniae R6
accuccgccuccagag

SEQ ID NO: 4095753 - RNA, 18 nt, Streptococcus pneumoniae R6
accuccgccuccagagaa

SEQ ID NO: 4095754 - RNA, 22 nt, Streptococcus pneumoniae R6
accuccucgagcaguuccauca

SEQ ID NO: 4095755 - RNA, 23 nt, Streptococcus pneumoniae R6
accucuaucuuaguaguuuguau

SEQ ID NO: 4095756 - RNA, 17 nt, Streptococcus pneumoniae R6
accucuggaucuuccgu

SEQ ID NO: 4095757 - RNA, 23 nt, Streptococcus pneumoniae R6
accucugguaugaucuauuccua

SEQ ID NO: 4095758 - RNA, 21 nt, Streptococcus pneumoniae R6
accucuguauaaauagcuaca

SEQ ID NO: 4095759 - RNA, 22 nt, Streptococcus pneumoniae R6
accucuuccgaggucaucauua

SEQ ID NO: 4095760 - RNA, 17 nt, Streptococcus pneumoniae R6
accucuugaaguucauu

SEQ ID NO: 4095761 - RNA, 19 nt, Streptococcus pneumoniae R6
accucuugaaguucauuuu

SEQ ID NO: 4095762 - RNA, 23 nt, Streptococcus pneumoniae R6
accucuugaaguucauuuucuuu

SEQ ID NO: 4095763 - RNA, 22 nt, Streptococcus pneumoniae R6
accugaaauauacucauaaagu

SEQ ID NO: 4095764 - RNA, 16 nt, Streptococcus pneumoniae R6
accugaaucuccucag

SEQ ID NO: 4095765 - RNA, 21 nt, Streptococcus pneumoniae R6
accugaaucuccucaggaacu

SEQ ID NO: 4095766 - RNA, 22 nt, Streptococcus pneumoniae R6
accugacgaaagacuugauuuu

SEQ ID NO: 4095767 - RNA, 19 nt, Streptococcus pneumoniae R6
accugauaguuuaguuauu

SEQ ID NO: 4095768 - RNA, 15 nt, Streptococcus pneumoniae R6
accugaucaaagggc

SEQ ID NO: 4095769 - RNA, 16 nt, Streptococcus pneumoniae R6
accugcaacaauaccu

SEQ ID NO: 4095770 - RNA, 17 nt, Streptococcus pneumoniae R6
accugcacauugguucu

SEQ ID NO: 4095771 - RNA, 19 nt, Streptococcus pneumoniae R6
accugcagcgauugaaaca

SEQ ID NO: 4095772 - RNA, 21 nt, Streptococcus pneumoniae R6
accugcagcgauugaaacagc

SEQ ID NO: 4095773 - RNA, 18 nt, Streptococcus pneumoniae R6
accugcggauaaaagaga

SEQ ID NO: 4095774 - RNA, 19 nt, Streptococcus pneumoniae R6
accugcggcuagcuuccua

SEQ ID NO: 4095775 - RNA, 19 nt, Streptococcus pneumoniae R6
accugcuaccguugaaauc

SEQ ID NO: 4095776 - RNA, 16 nt, Streptococcus pneumoniae R6
accugcuacugcaucc

SEQ ID NO: 4095777 - RNA, 22 nt, Streptococcus pneumoniae R6
accuguuaagccuauucccuga

SEQ ID NO: 4095778 - RNA, 20 nt, Streptococcus pneumoniae R6
accuguugaugcaucaagug

SEQ ID NO: 4095779 - RNA, 19 nt, Streptococcus pneumoniae R6
accuguuugaaucaauucu

SEQ ID NO: 4095780 - RNA, 12 nt, Streptococcus pneumoniae R6
accuguuuucac

SEQ ID NO: 4095781 - RNA, 12 nt, Streptococcus pneumoniae R6
accuuaaaacag

SEQ ID NO: 4095782 - RNA, 13 nt, Streptococcus pneumoniae R6
accuuaaaacagu

SEQ ID NO: 4095783 - RNA, 15 nt, Streptococcus pneumoniae R6
accuuaaaacagugu

SEQ ID NO: 4095784 - RNA, 16 nt, Streptococcus pneumoniae R6
accuuaaaacaguguu

SEQ ID NO: 4095785 - RNA, 15 nt, Streptococcus pneumoniae R6
accuuacucuacaga

SEQ ID NO: 4095786 - RNA, 16 nt, Streptococcus pneumoniae R6
accuuacucuacagau

SEQ ID NO: 4095787 - RNA, 17 nt, Streptococcus pneumoniae R6
accuuacucuacagauu

SEQ ID NO: 4095788 - RNA, 15 nt, Streptococcus pneumoniae R6
accuuccucaacaaa

SEQ ID NO: 4095789 - RNA, 14 nt, Streptococcus pneumoniae R6
accuucuucuguga

SEQ ID NO: 4095790 - RNA, 18 nt, Streptococcus pneumoniae R6
accuucuuuguaggcuuc

SEQ ID NO: 4095791 - RNA, 11 nt, Streptococcus pneumoniae R6
accuugaagag

SEQ ID NO: 4095792 - RNA, 19 nt, Streptococcus pneumoniae R6
accuugaccagccaagaca

SEQ ID NO: 4095793 - RNA, 15 nt, Streptococcus pneumoniae R6
accuugaucuuccau

SEQ ID NO: 4095794 - RNA, 11 nt, Streptococcus pneumoniae R6
accuugcaaaa

SEQ ID NO: 4095795 - RNA, 15 nt, Streptococcus pneumoniae R6
accuugcaaaaaaac

SEQ ID NO: 4095796 - RNA, 19 nt, Streptococcus pneumoniae R6
accuugccaucugcuucau

SEQ ID NO: 4095797 - RNA, 18 nt, Streptococcus pneumoniae R6
accuuguggaauuggugc

SEQ ID NO: 4095798 - RNA, 16 nt, Streptococcus pneumoniae R6
accuuuaaauccugca

SEQ ID NO: 4095799 - RNA, 18 nt, Streptococcus pneumoniae R6
accuuuaaauccugcaaa

SEQ ID NO: 4095800 - RNA, 14 nt, Streptococcus pneumoniae R6
accuuucucagaua

SEQ ID NO: 4095801 - RNA, 13 nt, Streptococcus pneumoniae R6
accuuugaaaaaa

SEQ ID NO: 4095802 - RNA, 19 nt, Streptococcus pneumoniae R6
accuuugaaaacugaacaa

SEQ ID NO: 4095803 - RNA, 19 nt, Streptococcus pneumoniae R6
accuuuguauggaaacuca

SEQ ID NO: 4095804 - RNA, 19 nt, Streptococcus pneumoniae R6
accuuuuccuucauuucca

SEQ ID NO: 4095805 - RNA, 20 nt, Streptococcus pneumoniae R6
accuuuuugcgcaauuugac

SEQ ID NO: 4095806 - RNA, 21 nt, Streptococcus pneumoniae R6
acgaaaaguaggacgauaaaa

SEQ ID NO: 4095807 - RNA, 17 nt, Streptococcus pneumoniae R6
acgaaaagucaucuaua

SEQ ID NO: 4095808 - RNA, 23 nt, Streptococcus pneumoniae R6
acgaaaauaauuaguucagaauu

SEQ ID NO: 4095809 - RNA, 17 nt, Streptococcus pneumoniae R6
acgaaccacacuuucau

SEQ ID NO: 4095810 - RNA, 19 nt, Streptococcus pneumoniae R6
acgaacgccuuaaaaaacc

SEQ ID NO: 4095811 - RNA, 17 nt, Streptococcus pneumoniae R6
acgaacggguucuucca

SEQ ID NO: 4095812 - RNA, 20 nt, Streptococcus pneumoniae R6
acgaacuccacugaaucguu

SEQ ID NO: 4095813 - RNA, 14 nt, Streptococcus pneumoniae R6
acgaagaaggaaga

SEQ ID NO: 4095814 - RNA, 17 nt, Streptococcus pneumoniae R6
acgaagaaggaagaguc

SEQ ID NO: 4095815 - RNA, 19 nt, Streptococcus pneumoniae R6
acgaagcauaucagacaua

SEQ ID NO: 4095816 - RNA, 23 nt, Streptococcus pneumoniae R6
acgaagcugacaugaugugaaga

SEQ ID NO: 4095817 - RNA, 21 nt, Streptococcus pneumoniae R6
acgaagucagcucaaaacaca

SEQ ID NO: 4095818 - RNA, 21 nt, Streptococcus pneumoniae R6
acgaagucaguaaccauacau

SEQ ID NO: 4095819 - RNA, 14 nt, Streptococcus pneumoniae R6
acgaaguccuuguu

SEQ ID NO: 4095820 - RNA, 23 nt, Streptococcus pneumoniae R6
acgaaguuguucuugaaguccuu

SEQ ID NO: 4095821 - RNA, 14 nt, Streptococcus pneumoniae R6
acgaauauccucuu

SEQ ID NO: 4095822 - RNA, 23 nt, Streptococcus pneumoniae R6
acgaauauccucuucacugugac

SEQ ID NO: 4095823 - RNA, 22 nt, Streptococcus pneumoniae R6
acgaaucaauacagaagaaaaa

SEQ ID NO: 4095824 - RNA, 16 nt, Streptococcus pneumoniae R6
acgaauuagguugacc

SEQ ID NO: 4095825 - RNA, 14 nt, Streptococcus pneumoniae R6
acgaauuauuuccu

SEQ ID NO: 4095826 - RNA, 14 nt, Streptococcus pneumoniae R6
acgaauuuuuuggc

SEQ ID NO: 4095827 - RNA, 15 nt, Streptococcus pneumoniae R6
acgaccaaucuuuuc

SEQ ID NO: 4095828 - RNA, 16 nt, Streptococcus pneumoniae R6
acgaccaaugagaaac

SEQ ID NO: 4095829 - RNA, 15 nt, Streptococcus pneumoniae R6
acgaccagaaaauca

SEQ ID NO: 4095830 - RNA, 20 nt, Streptococcus pneumoniae R6
acgaccagcaguaucaauca

SEQ ID NO: 4095831 - RNA, 17 nt, Streptococcus pneumoniae R6
acgaccaguacggccag

SEQ ID NO: 4095832 - RNA, 23 nt, Streptococcus pneumoniae R6
acgacgauuccguuugagaagaa

SEQ ID NO: 4095833 - RNA, 22 nt, Streptococcus pneumoniae R6
acgacggauaacagucaguuca

SEQ ID NO: 4095834 - RNA, 18 nt, Streptococcus pneumoniae R6
acgacgucauggccucua

SEQ ID NO: 4095835 - RNA, 14 nt, Streptococcus pneumoniae R6
acgacuaauuucaa

SEQ ID NO: 4095836 - RNA, 19 nt, Streptococcus pneumoniae R6
acgacuaggaauauugaaa

SEQ ID NO: 4095837 - RNA, 21 nt, Streptococcus pneumoniae R6
acgagaaacaauaaaaucaaa

SEQ ID NO: 4095838 - RNA, 13 nt, Streptococcus pneumoniae R6
acgagcaguucca

SEQ ID NO: 4095839 - RNA, 23 nt, Streptococcus pneumoniae R6
acgagcaguuccacgauauuguu

SEQ ID NO: 4095840 - RNA, 17 nt, Streptococcus pneumoniae R6
acgaggaggagaaaaag

SEQ ID NO: 4095841 - RNA, 23 nt, Streptococcus pneumoniae R6
acgaguuaaaacaaagaaaaaga

SEQ ID NO: 4095842 - RNA, 16 nt, Streptococcus pneumoniae R6
acgauaaucugggcua

SEQ ID NO: 4095843 - RNA, 22 nt, Streptococcus pneumoniae R6
acuaaagguugaugaguaaguu

SEQ ID NO: 4095844 - RNA, 23 nt, Streptococcus pneumoniae R6
acuaaauacaaaaacaaagagau

SEQ ID NO: 4095845 - RNA, 18 nt, Streptococcus pneumoniae R6
acuaaauacuagucuuuc

SEQ ID NO: 4095846 - RNA, 14 nt, Streptococcus pneumoniae R6
acuaaauauaagau

SEQ ID NO: 4095847 - RNA, 13 nt, Streptococcus pneumoniae R6
acuaaauccaaaa

SEQ ID NO: 4095848 - RNA, 16 nt, Streptococcus pneumoniae R6
acuaaaucuucggaua

SEQ ID NO: 4095849 - RNA, 16 nt, Streptococcus pneumoniae R6
acuaaauuuagaucau

SEQ ID NO: 4095850 - RNA, 19 nt, Streptococcus pneumoniae R6
acuaacaauuaugcuuaaa

SEQ ID NO: 4095851 - RNA, 18 nt, Streptococcus pneumoniae R6
acuaacccuagaaaacca

SEQ ID NO: 4095852 - RNA, 19 nt, Streptococcus pneumoniae R6
acuaacccuagaaaaccaa

SEQ ID NO: 4095853 - RNA, 16 nt, Streptococcus pneumoniae R6
acuaacccuucuuuuu

SEQ ID NO: 4095854 - RNA, 23 nt, Streptococcus pneumoniae R6
acuaaccuuguccgcauagccaa

SEQ ID NO: 4095855 - RNA, 16 nt, Streptococcus pneumoniae R6
acuaacgccaaauccu

SEQ ID NO: 4095856 - RNA, 17 nt, Streptococcus pneumoniae R6
acuaacgccaaauccua

SEQ ID NO: 4095857 - RNA, 14 nt, Streptococcus pneumoniae R6
acuaacucaucaaa

SEQ ID NO: 4095858 - RNA, 16 nt, Streptococcus pneumoniae R6
acuaagauuuguuuuu

SEQ ID NO: 4095859 - RNA, 21 nt, Streptococcus pneumoniae R6
acuaagauuuguuuuucaaag

SEQ ID NO: 4095860 - RNA, 12 nt, Streptococcus pneumoniae R6
acuaagcaugau

SEQ ID NO: 4095861 - RNA, 15 nt, Streptococcus pneumoniae R6
acuaaggaaagucaa

SEQ ID NO: 4095862 - RNA, 14 nt, Streptococcus pneumoniae R6
acuaaguuagaaua

SEQ ID NO: 4095863 - RNA, 22 nt, Streptococcus pneumoniae R6
acuaaguucacuugagcaaacu

SEQ ID NO: 4095864 - RNA, 18 nt, Streptococcus pneumoniae R6
acuaauacauuuuguaaa

SEQ ID NO: 4095865 - RNA, 22 nt, Streptococcus pneumoniae R6
acuaauacauuuuguaaaaaag

SEQ ID NO: 4095866 - RNA, 19 nt, Streptococcus pneumoniae R6
acuaauauaguugucgcuu

SEQ ID NO: 4095867 - RNA, 20 nt, Streptococcus pneumoniae R6
acuaaucuuugccaccuagc

SEQ ID NO: 4095868 - RNA, 16 nt, Streptococcus pneumoniae R6
acuaaugcccuuuuuu

SEQ ID NO: 4095869 - RNA, 19 nt, Streptococcus pneumoniae R6
acuaaugcccuuuuuuguu

SEQ ID NO: 4095870 - RNA, 20 nt, Streptococcus pneumoniae R6
acuaauuuagagaaugaaau

SEQ ID NO: 4095871 - RNA, 18 nt, Streptococcus pneumoniae R6
acuacaauaauugguaca

SEQ ID NO: 4095872 - RNA, 22 nt, Streptococcus pneumoniae R6
acuacagaaaucacaauuccua

SEQ ID NO: 4095873 - RNA, 15 nt, Streptococcus pneumoniae R6
acuacaguugacaaa

SEQ ID NO: 4095874 - RNA, 16 nt, Streptococcus pneumoniae R6
acuacaguugacaaag

SEQ ID NO: 4095875 - RNA, 20 nt, Streptococcus pneumoniae R6
acuacaguugacaaagagcc

SEQ ID NO: 4095876 - RNA, 22 nt, Streptococcus pneumoniae R6
acuacaguugacaaagagccaa

SEQ ID NO: 4095877 - RNA, 22 nt, Streptococcus pneumoniae R6
acuacaguugacaaagagccua

SEQ ID NO: 4095878 - RNA, 13 nt, Streptococcus pneumoniae R6
acuacauuuuuug

SEQ ID NO: 4095879 - RNA, 19 nt, Streptococcus pneumoniae R6
acuacgcgaccuauuucau

SEQ ID NO: 4095880 - RNA, 13 nt, Streptococcus pneumoniae R6
acuacuaaaacau

SEQ ID NO: 4095881 - RNA, 14 nt, Streptococcus pneumoniae R6
acuacuaaaccaau

SEQ ID NO: 4095882 - RNA, 13 nt, Streptococcus pneumoniae R6
acuacuaguucug

SEQ ID NO: 4095883 - RNA, 20 nt, Streptococcus pneumoniae R6
acuacuauuuacgacaacgg

SEQ ID NO: 4095884 - RNA, 14 nt, Streptococcus pneumoniae R6
acuacuugauaaaa

SEQ ID NO: 4095885 - RNA, 11 nt, Streptococcus pneumoniae R6
acuacuuugac

SEQ ID NO: 4095886 - RNA, 14 nt, Streptococcus pneumoniae R6
acuagaaaaugagg

SEQ ID NO: 4095887 - RNA, 14 nt, Streptococcus pneumoniae R6
acuagaauaguaca

SEQ ID NO: 4095888 - RNA, 11 nt, Streptococcus pneumoniae R6
acuagaaugcu

SEQ ID NO: 4095889 - RNA, 20 nt, Streptococcus pneumoniae R6
acuagaaugcuuugugaaga

SEQ ID NO: 4095890 - RNA, 18 nt, Streptococcus pneumoniae R6
acuagaaugcuuuuugaa

SEQ ID NO: 4095891 - RNA, 20 nt, Streptococcus pneumoniae R6
acuagaaugcuuuuugaaag

SEQ ID NO: 4095892 - RNA, 23 nt, Streptococcus pneumoniae R6
acuagaaugcuuuuugaaagcag

SEQ ID NO: 4095893 - RNA, 13 nt, Streptococcus pneumoniae R6
acuagacagugaa

SEQ ID NO: 4095894 - RNA, 15 nt, Streptococcus pneumoniae R6
acuagagaagccaag

SEQ ID NO: 4095895 - RNA, 22 nt, Streptococcus pneumoniae R6
acuagagagcuuucuaaacaau

SEQ ID NO: 4095896 - RNA, 15 nt, Streptococcus pneumoniae R6
acuagauaaaagaau

SEQ ID NO: 4095897 - RNA, 17 nt, Streptococcus pneumoniae R6
acuagauucuauuuuuu

SEQ ID NO: 4095898 - RNA, 22 nt, Streptococcus pneumoniae R6
acuagcgagggaaacagccaau

SEQ ID NO: 4095899 - RNA, 20 nt, Streptococcus pneumoniae R6
acuagcuaacugcuucacua

SEQ ID NO: 4095900 - RNA, 15 nt, Streptococcus pneumoniae R6
acuagcuccaaacau

SEQ ID NO: 4095901 - RNA, 17 nt, Streptococcus pneumoniae R6
acuagcuggugagaaga

SEQ ID NO: 4095902 - RNA, 21 nt, Streptococcus pneumoniae R6
acuagcuuauuauucuaguga

SEQ ID NO: 4095903 - RNA, 21 nt, Streptococcus pneumoniae R6
acuaggaaacuagcugcaggc

SEQ ID NO: 4095904 - RNA, 13 nt, Streptococcus pneumoniae R6
acuaggauuuucu

SEQ ID NO: 4095905 - RNA, 14 nt, Streptococcus pneumoniae R6
acuaggcgucuucu

SEQ ID NO: 4095906 - RNA, 17 nt, Streptococcus pneumoniae R6
acuaguaauaauuucaa

SEQ ID NO: 4095907 - RNA, 14 nt, Streptococcus pneumoniae R6
acuaguauucaucu

SEQ ID NO: 4095908 - RNA, 20 nt, Streptococcus pneumoniae R6
acuaguauucaucuuaucaa

SEQ ID NO: 4095909 - RNA, 21 nt, Streptococcus pneumoniae R6
acuaguauucaucuuaucaac

SEQ ID NO: 4095910 - RNA, 14 nt, Streptococcus pneumoniae R6
acuagucaugaccc

SEQ ID NO: 4095911 - RNA, 16 nt, Streptococcus pneumoniae R6
acuauaaaaaagugaa

SEQ ID NO: 4095912 - RNA, 17 nt, Streptococcus pneumoniae R6
acuauaaaaaagugaac

SEQ ID NO: 4095913 - RNA, 12 nt, Streptococcus pneumoniae R6
acuauaaaacau

SEQ ID NO: 4095914 - RNA, 16 nt, Streptococcus pneumoniae R6
acuauaaaagaggagg

SEQ ID NO: 4095915 - RNA, 15 nt, Streptococcus pneumoniae R6
acuauaaaaucugaa

SEQ ID NO: 4095916 - RNA, 18 nt, Streptococcus pneumoniae R6
acuauaauaaaaugaaau

SEQ ID NO: 4095917 - RNA, 17 nt, Streptococcus pneumoniae R6
acuauagaaaaaagucu

SEQ ID NO: 4095918 - RNA, 21 nt, Streptococcus pneumoniae R6
acuauagccaucucuacuccu

SEQ ID NO: 4095919 - RNA, 20 nt, Streptococcus pneumoniae R6
acuauagcguuuugaaacua

SEQ ID NO: 4095920 - RNA, 17 nt, Streptococcus pneumoniae R6
acuauaguagauugaaa

SEQ ID NO: 4095921 - RNA, 20 nt, Streptococcus pneumoniae R6
acuauaguagauugaaacua

SEQ ID NO: 4095922 - RNA, 17 nt, Streptococcus pneumoniae R6
acuauaguuuaauuuaa

SEQ ID NO: 4095923 - RNA, 22 nt, Streptococcus pneumoniae R6
acuauaguuugcaaauuauuua

SEQ ID NO: 4095924 - RNA, 16 nt, Streptococcus pneumoniae R6
acuauauaucaugcuu

SEQ ID NO: 4095925 - RNA, 20 nt, Streptococcus pneumoniae R6
acuauauaucaugcuuuacu

SEQ ID NO: 4095926 - RNA, 14 nt, Streptococcus pneumoniae R6
acuauauaugcaca

SEQ ID NO: 4095927 - RNA, 18 nt, Streptococcus pneumoniae R6
acuauauucucucuuacu

SEQ ID NO: 4095928 - RNA, 19 nt, Streptococcus pneumoniae R6
acuauauugcaagagaaau

SEQ ID NO: 4095929 - RNA, 23 nt, Streptococcus pneumoniae R6
acuauauuucuuaauuguagcuu

SEQ ID NO: 4095930 - RNA, 18 nt, Streptococcus pneumoniae R6
acuaucaaaaucaaugac

SEQ ID NO: 4095931 - RNA, 19 nt, Streptococcus pneumoniae R6
acuaucaauuauaauaaaa

SEQ ID NO: 4095932 - RNA, 23 nt, Streptococcus pneumoniae R6
acuauccagagcauucuuuuguu

SEQ ID NO: 4095933 - RNA, 15 nt, Streptococcus pneumoniae R6
acuaucccuaaaggg

SEQ ID NO: 4095934 - RNA, 13 nt, Streptococcus pneumoniae R6
acuaucuaaaaaa

SEQ ID NO: 4095935 - RNA, 16 nt, Streptococcus pneumoniae R6
acuaucucuacauucc

SEQ ID NO: 4095936 - RNA, 19 nt, Streptococcus pneumoniae R6
acuaugcuauacuguaguu

SEQ ID NO: 4095937 - RNA, 16 nt, Streptococcus pneumoniae R6
acuaugcuuuuuauug

SEQ ID NO: 4095938 - RNA, 19 nt, Streptococcus pneumoniae R6
acuauggagaaucguauuc

SEQ ID NO: 4095939 - RNA, 19 nt, Streptococcus pneumoniae R6
acuauggcuccgaugaccu

SEQ ID NO: 4095940 - RNA, 15 nt, Streptococcus pneumoniae R6
acuaugggaagauuu

SEQ ID NO: 4095941 - RNA, 17 nt, Streptococcus pneumoniae R6
acuauguacgaaaagca

SEQ ID NO: 4095942 - RNA, 17 nt, Streptococcus pneumoniae R6
acuauuaaccuugucuu

SEQ ID NO: 4095943 - RNA, 18 nt, Streptococcus pneumoniae R6
acuauuagcaucuuauca

SEQ ID NO: 4095944 - RNA, 22 nt, Streptococcus pneumoniae R6
acuauuagcaucuuaucagaaa

SEQ ID NO: 4095945 - RNA, 17 nt, Streptococcus pneumoniae R6
acugcccugaaauccca

SEQ ID NO: 4095946 - RNA, 18 nt, Streptococcus pneumoniae R6
acugccucucuucuguuc

SEQ ID NO: 4095947 - RNA, 19 nt, Streptococcus pneumoniae R6
acugccuuuauuuuuuuau

SEQ ID NO: 4095948 - RNA, 19 nt, Streptococcus pneumoniae R6
acugcgaagagggcaagga

SEQ ID NO: 4095949 - RNA, 15 nt, Streptococcus pneumoniae R6
acugcuaaaagauuu

SEQ ID NO: 4095950 - RNA, 20 nt, Streptococcus pneumoniae R6
acugcuaaaagauuucuaua

SEQ ID NO: 4095951 - RNA, 17 nt, Streptococcus pneumoniae R6
acugcuaccaauucagu

SEQ ID NO: 4095952 - RNA, 14 nt, Streptococcus pneumoniae R6
acugcuagcaucau

SEQ ID NO: 4095953 - RNA, 15 nt, Streptococcus pneumoniae R6
acugcucgguaaaac

SEQ ID NO: 4095954 - RNA, 18 nt, Streptococcus pneumoniae R6
acugcugggucaaacggc

SEQ ID NO: 4095955 - RNA, 21 nt, Streptococcus pneumoniae R6
acugcuguuguuacuuggcga

SEQ ID NO: 4095956 - RNA, 17 nt, Streptococcus pneumoniae R6
acugcuucacuagucau

SEQ ID NO: 4095957 - RNA, 15 nt, Streptococcus pneumoniae R6
acuggaaacuuuuuu

SEQ ID NO: 4095958 - RNA, 18 nt, Streptococcus pneumoniae R6
acuggaaacuuuuuuaua

SEQ ID NO: 4095959 - RNA, 14 nt, Streptococcus pneumoniae R6
acuggaacaucuac

SEQ ID NO: 4095960 - RNA, 15 nt, Streptococcus pneumoniae R6
acuggaauggcaacc

SEQ ID NO: 4095961 - RNA, 12 nt, Streptococcus pneumoniae R6
acuggaccaagu

SEQ ID NO: 4095962 - RNA, 15 nt, Streptococcus pneumoniae R6
acuggaccagaacca

SEQ ID NO: 4095963 - RNA, 17 nt, Streptococcus pneumoniae R6
acuggagaaggagauga

SEQ ID NO: 4095964 - RNA, 20 nt, Streptococcus pneumoniae R6
acuggagaauugacaaucuc

SEQ ID NO: 4095965 - RNA, 22 nt, Streptococcus pneumoniae R6
acuggauaaaguuaugaaaaag

SEQ ID NO: 4095966 - RNA, 14 nt, Streptococcus pneumoniae R6
acuggcaaaggcau

SEQ ID NO: 4095967 - RNA, 22 nt, Streptococcus pneumoniae R6
acuggcauaagcaaucauaccu

SEQ ID NO: 4095968 - RNA, 12 nt, Streptococcus pneumoniae R6
acuggcaucccc

SEQ ID NO: 4095969 - RNA, 13 nt, Streptococcus pneumoniae R6
acuggcugccauu

SEQ ID NO: 4095970 - RNA, 19 nt, Streptococcus pneumoniae R6
acuggcugccauugguguu

SEQ ID NO: 4095971 - RNA, 15 nt, Streptococcus pneumoniae R6
acuggguugaagauu

SEQ ID NO: 4095972 - RNA, 19 nt, Streptococcus pneumoniae R6
acuggucacauugaaaaug

SEQ ID NO: 4095973 - RNA, 13 nt, Streptococcus pneumoniae R6
acugguccagaga

SEQ ID NO: 4095974 - RNA, 18 nt, Streptococcus pneumoniae R6
acuggucuugccagccug

SEQ ID NO: 4095975 - RNA, 20 nt, Streptococcus pneumoniae R6
acuguaaaguagcaaaacac

SEQ ID NO: 4095976 - RNA, 21 nt, Streptococcus pneumoniae R6
acuguaaaguagcaaaacacu

SEQ ID NO: 4095977 - RNA, 21 nt, Streptococcus pneumoniae R6
acuguacuucccggagcuuuc

SEQ ID NO: 4095978 - RNA, 16 nt, Streptococcus pneumoniae R6
acuguaggcuugugug

SEQ ID NO: 4095979 - RNA, 16 nt, Streptococcus pneumoniae R6
acuguaguggguugaa

SEQ ID NO: 4095980 - RNA, 20 nt, Streptococcus pneumoniae R6
acuguaguggguugaagaaa

SEQ ID NO: 4095981 - RNA, 17 nt, Streptococcus pneumoniae R6
acuguccuuaucgauuu

SEQ ID NO: 4095982 - RNA, 15 nt, Streptococcus pneumoniae R6
acugucguuccuuuu

SEQ ID NO: 4095983 - RNA, 14 nt, Streptococcus pneumoniae R6
acugugauuucuaa

SEQ ID NO: 4095984 - RNA, 22 nt, Streptococcus pneumoniae R6
acugugccagccauaagcuaca

SEQ ID NO: 4095985 - RNA, 15 nt, Streptococcus pneumoniae R6
acuguggaaaauaga

SEQ ID NO: 4095986 - RNA, 17 nt, Streptococcus pneumoniae R6
acuguggaaaauagaaa

SEQ ID NO: 4095987 - RNA, 21 nt, Streptococcus pneumoniae R6
acuguggaaaauagaaaaaau

SEQ ID NO: 4095988 - RNA, 15 nt, Streptococcus pneumoniae R6
acugugguauuaaca

SEQ ID NO: 4095989 - RNA, 13 nt, Streptococcus pneumoniae R6
acuguuccuucua

SEQ ID NO: 4095990 - RNA, 16 nt, Streptococcus pneumoniae R6
acuguucuaaauucag

SEQ ID NO: 4095991 - RNA, 15 nt, Streptococcus pneumoniae R6
acuguuucagagaca

SEQ ID NO: 4095992 - RNA, 22 nt, Streptococcus pneumoniae R6
acuguuugggggcaguacagaa

SEQ ID NO: 4095993 - RNA, 13 nt, Streptococcus pneumoniae R6
acuguuuuaaggu

SEQ ID NO: 4095994 - RNA, 21 nt, Streptococcus pneumoniae R6
acuguuuugagauuacugaua

SEQ ID NO: 4095995 - RNA, 16 nt, Streptococcus pneumoniae R6
acuguuuugagguugu

SEQ ID NO: 4095996 - RNA, 15 nt, Streptococcus pneumoniae R6
acuuaaaaaucuuca

SEQ ID NO: 4095997 - RNA, 17 nt, Streptococcus pneumoniae R6
acuuaaauagaaaaaca

SEQ ID NO: 4095998 - RNA, 14 nt, Streptococcus pneumoniae R6
acuuaaauuuuugu

SEQ ID NO: 4095999 - RNA, 16 nt, Streptococcus pneumoniae R6
acuuaaugaauaccau

SEQ ID NO: 4096000 - RNA, 19 nt, Streptococcus pneumoniae R6
acuuaaugaauaccauaga

SEQ ID NO: 4096001 - RNA, 22 nt, Streptococcus pneumoniae R6
acuuacgugaguguagauguua

SEQ ID NO: 4096002 - RNA, 20 nt, Streptococcus pneumoniae R6
acuuacuuaacccuuuuuau

SEQ ID NO: 4096003 - RNA, 19 nt, Streptococcus pneumoniae R6
acuuagauugcuuugcaau

SEQ ID NO: 4096004 - RNA, 17 nt, Streptococcus pneumoniae R6
acuuagcucugugcaau

SEQ ID NO: 4096005 - RNA, 16 nt, Streptococcus pneumoniae R6
acuuaggcuauccaga

SEQ ID NO: 4096006 - RNA, 19 nt, Streptococcus pneumoniae R6
acuuaguauccuugaugcg

SEQ ID NO: 4096007 - RNA, 17 nt, Streptococcus pneumoniae R6
acuuauaaaaaacacaa

SEQ ID NO: 4096008 - RNA, 18 nt, Streptococcus pneumoniae R6
acuuauaaaaaacacaaa

SEQ ID NO: 4096009 - RNA, 15 nt, Streptococcus pneumoniae R6
acuuauaauuaaaag

SEQ ID NO: 4096010 - RNA, 16 nt, Streptococcus pneumoniae R6
acuuauacucuucaaa

SEQ ID NO: 4096011 - RNA, 17 nt, Streptococcus pneumoniae R6
acuuaucagcuagcuua

SEQ ID NO: 4096012 - RNA, 15 nt, Streptococcus pneumoniae R6
acuuaugaagaaauu

SEQ ID NO: 4096013 - RNA, 18 nt, Streptococcus pneumoniae R6
acuuaugagcuagguuca

SEQ ID NO: 4096014 - RNA, 18 nt, Streptococcus pneumoniae R6
acuucaacccacuacagu

SEQ ID NO: 4096015 - RNA, 23 nt, Streptococcus pneumoniae R6
acuucaacccacuacaguugaca

SEQ ID NO: 4096016 - RNA, 13 nt, Streptococcus pneumoniae R6
acuucaaccuuac

SEQ ID NO: 4096017 - RNA, 15 nt, Streptococcus pneumoniae R6
acuucaaccuuacca

SEQ ID NO: 4096018 - RNA, 16 nt, Streptococcus pneumoniae R6
acuucaaccuuaccac

SEQ ID NO: 4096019 - RNA, 15 nt, Streptococcus pneumoniae R6
acuucaauuucuaau

SEQ ID NO: 4096020 - RNA, 20 nt, Streptococcus pneumoniae R6
acuucacgaaugacagcauc

SEQ ID NO: 4096021 - RNA, 21 nt, Streptococcus pneumoniae R6
acuucacuaauucaccuaacc

SEQ ID NO: 4096022 - RNA, 16 nt, Streptococcus pneumoniae R6
acuucagcuccaccca

SEQ ID NO: 4096023 - RNA, 14 nt, Streptococcus pneumoniae R6
acuucagcuuuuuu

SEQ ID NO: 4096024 - RNA, 15 nt, Streptococcus pneumoniae R6
acuucagcuuuuuug

SEQ ID NO: 4096025 - RNA, 14 nt, Streptococcus pneumoniae R6
acuucaggaaaaaa

SEQ ID NO: 4096026 - RNA, 16 nt, Streptococcus pneumoniae R6
acuuccaaaauuaaaa

SEQ ID NO: 4096027 - RNA, 22 nt, Streptococcus pneumoniae R6
acuuccaagcgaugauauccug

SEQ ID NO: 4096028 - RNA, 21 nt, Streptococcus pneumoniae R6
acuuccaauucgguugguuuu

SEQ ID NO: 4096029 - RNA, 16 nt, Streptococcus pneumoniae R6
acuuccacuuccagaa

SEQ ID NO: 4096030 - RNA, 17 nt, Streptococcus pneumoniae R6
acuuccacuuccagaag

SEQ ID NO: 4096031 - RNA, 13 nt, Streptococcus pneumoniae R6
acuuccagcaugg

SEQ ID NO: 4096032 - RNA, 20 nt, Streptococcus pneumoniae R6
acuuccauguuguagucugc

SEQ ID NO: 4096033 - RNA, 22 nt, Streptococcus pneumoniae R6
acuuccauguuguagucugcug

SEQ ID NO: 4096034 - RNA, 18 nt, Streptococcus pneumoniae R6
acuucccacccauauuuu

SEQ ID NO: 4096035 - RNA, 17 nt, Streptococcus pneumoniae R6
acuucccagccuaccug

SEQ ID NO: 4096036 - RNA, 17 nt, Streptococcus pneumoniae R6
acuuccugcucaaaaua

SEQ ID NO: 4096037 - RNA, 14 nt, Streptococcus pneumoniae R6
acuuccuuuucuac

SEQ ID NO: 4096038 - RNA, 20 nt, Streptococcus pneumoniae R6
acuuccuuuucuacugaaau

SEQ ID NO: 4096039 - RNA, 14 nt, Streptococcus pneumoniae R6
acuuccuuuucuua

SEQ ID NO: 4096040 - RNA, 16 nt, Streptococcus pneumoniae R6
acuuccuuuucuuauc

SEQ ID NO: 4096041 - RNA, 18 nt, Streptococcus pneumoniae R6
acuucgucacauucccau

SEQ ID NO: 4096042 - RNA, 15 nt, Streptococcus pneumoniae R6
acuucgucaguucca

SEQ ID NO: 4096043 - RNA, 14 nt, Streptococcus pneumoniae R6
acuucgucaguucu

SEQ ID NO: 4096044 - RNA, 15 nt, Streptococcus pneumoniae R6
acuucgucaguucua

SEQ ID NO: 4096045 - RNA, 22 nt, Streptococcus pneumoniae R6
acuucgucaguucuaucuacaa

SEQ ID NO: 4096046 - RNA, 20 nt, Streptococcus pneumoniae R6
acuucgucaguuucaucuac

SEQ ID NO: 4096047 - RNA, 20 nt, Streptococcus pneumoniae R6
acuucgucguaaccuucuuc

SEQ ID NO: 4096048 - RNA, 18 nt, Streptococcus pneumoniae R6
acuuuuucauaaauagau

SEQ ID NO: 4096049 - RNA, 14 nt, Streptococcus pneumoniae R6
acuuuuucuaacau

SEQ ID NO: 4096050 - RNA, 14 nt, Streptococcus pneumoniae R6
acuuuuuguuuaau

SEQ ID NO: 4096051 - RNA, 12 nt, Streptococcus pneumoniae R6
acuuuuuucuua

SEQ ID NO: 4096052 - RNA, 23 nt, Streptococcus pneumoniae R6
acuuuuuucuuugauaagauaaa

SEQ ID NO: 4096053 - RNA, 14 nt, Streptococcus pneumoniae R6
acuuuuuugcgaag

SEQ ID NO: 4096054 - RNA, 13 nt, Streptococcus pneumoniae R6
agaaaaaaaguaa

SEQ ID NO: 4096055 - RNA, 11 nt, Streptococcus pneumoniae R6
agaaaaaaauu

SEQ ID NO: 4096056 - RNA, 13 nt, Streptococcus pneumoniae R6
agaaaaaacaaag

SEQ ID NO: 4096057 - RNA, 16 nt, Streptococcus pneumoniae R6
agaaaaaacagccgag

SEQ ID NO: 4096058 - RNA, 20 nt, Streptococcus pneumoniae R6
agaaaaaagcuugaguggaa

SEQ ID NO: 4096059 - RNA, 11 nt, Streptococcus pneumoniae R6
agaaaaaaggc

SEQ ID NO: 4096060 - RNA, 22 nt, Streptococcus pneumoniae R6
agaaaaaaucaagggaaaauga

SEQ ID NO: 4096061 - RNA, 14 nt, Streptococcus pneumoniae R6
agaaaaaaucuaac

SEQ ID NO: 4096062 - RNA, 19 nt, Streptococcus pneumoniae R6
agaaaaacaccccaugaua

SEQ ID NO: 4096063 - RNA, 15 nt, Streptococcus pneumoniae R6
agaaaaagccuccag

SEQ ID NO: 4096064 - RNA, 21 nt, Streptococcus pneumoniae R6
agaaaaagucugaaucaaaaa

SEQ ID NO: 4096065 - RNA, 20 nt, Streptococcus pneumoniae R6
agaaaaaguguuugauaucu

SEQ ID NO: 4096066 - RNA, 15 nt, Streptococcus pneumoniae R6
agaaaaaguucaauu

SEQ ID NO: 4096067 - RNA, 19 nt, Streptococcus pneumoniae R6
agaaaaauuucauuuucua

SEQ ID NO: 4096068 - RNA, 14 nt, Streptococcus pneumoniae R6
agaaaacagacaaa

SEQ ID NO: 4096069 - RNA, 14 nt, Streptococcus pneumoniae R6
agaaaacgaugaca

SEQ ID NO: 4096070 - RNA, 21 nt, Streptococcus pneumoniae R6
agaaaacuaguuuaaaucaua

SEQ ID NO: 4096071 - RNA, 23 nt, Streptococcus pneumoniae R6
agaaaacuaguuuaaaucauaau

SEQ ID NO: 4096072 - RNA, 12 nt, Streptococcus pneumoniae R6
agaaaagcaaaa

SEQ ID NO: 4096073 - RNA, 13 nt, Streptococcus pneumoniae R6
agaaaagcaaaau

SEQ ID NO: 4096074 - RNA, 14 nt, Streptococcus pneumoniae R6
agaaaagcaaaaug

SEQ ID NO: 4096075 - RNA, 19 nt, Streptococcus pneumoniae R6
agaaaagcguucaaagacu

SEQ ID NO: 4096076 - RNA, 20 nt, Streptococcus pneumoniae R6
agaaaaggaguagaaaauga

SEQ ID NO: 4096077 - RNA, 18 nt, Streptococcus pneumoniae R6
agaaaagucacuggaaac

SEQ ID NO: 4096078 - RNA, 13 nt, Streptococcus pneumoniae R6
agaaaauaaaauu

SEQ ID NO: 4096079 - RNA, 18 nt, Streptococcus pneumoniae R6
agaaaaugaaauacauau

SEQ ID NO: 4096080 - RNA, 14 nt, Streptococcus pneumoniae R6
agaaaauucuaaag

SEQ ID NO: 4096081 - RNA, 13 nt, Streptococcus pneumoniae R6
agaaacaauaaaa

SEQ ID NO: 4096082 - RNA, 14 nt, Streptococcus pneumoniae R6
agaaacaauaaaau

SEQ ID NO: 4096083 - RNA, 21 nt, Streptococcus pneumoniae R6
agaaacagcuccugaaauaag

SEQ ID NO: 4096084 - RNA, 15 nt, Streptococcus pneumoniae R6
agaaacaucuuauua

SEQ ID NO: 4096085 - RNA, 20 nt, Streptococcus pneumoniae R6
agaaacguccaaggcugaaa

SEQ ID NO: 4096086 - RNA, 15 nt, Streptococcus pneumoniae R6
agaaacguuguuaaa

SEQ ID NO: 4096087 - RNA, 23 nt, Streptococcus pneumoniae R6
agaaacuaugaugugcuauucua

SEQ ID NO: 4096088 - RNA, 17 nt, Streptococcus pneumoniae R6
agaaacuccuuggcuac

SEQ ID NO: 4096089 - RNA, 14 nt, Streptococcus pneumoniae R6
agaaagaaaaacug

SEQ ID NO: 4096090 - RNA, 13 nt, Streptococcus pneumoniae R6
agaaagaaaacaa

SEQ ID NO: 4096091 - RNA, 14 nt, Streptococcus pneumoniae R6
agaaagaaaacaag

SEQ ID NO: 4096092 - RNA, 12 nt, Streptococcus pneumoniae R6
agaaagaaguuu

SEQ ID NO: 4096093 - RNA, 14 nt, Streptococcus pneumoniae R6
agaaagacuugacc

SEQ ID NO: 4096094 - RNA, 15 nt, Streptococcus pneumoniae R6
agaaagacuugaccg

SEQ ID NO: 4096095 - RNA, 15 nt, Streptococcus pneumoniae R6
agaaagagaauaaca

SEQ ID NO: 4096096 - RNA, 17 nt, Streptococcus pneumoniae R6
agaaagaggaguaggag

SEQ ID NO: 4096097 - RNA, 15 nt, Streptococcus pneumoniae R6
agaaagaucauuaac

SEQ ID NO: 4096098 - RNA, 15 nt, Streptococcus pneumoniae R6
agaaagauuuucaaa

SEQ ID NO: 4096099 - RNA, 19 nt, Streptococcus pneumoniae R6
agaaagauuuucaaagucc

SEQ ID NO: 4096100 - RNA, 19 nt, Streptococcus pneumoniae R6
agaaagcgaagaucuagaa

SEQ ID NO: 4096101 - RNA, 18 nt, Streptococcus pneumoniae R6
agaaaggacaaauuucgu

SEQ ID NO: 4096102 - RNA, 22 nt, Streptococcus pneumoniae R6
agaaaggacaaauuucguccuu

SEQ ID NO: 4096103 - RNA, 16 nt, Streptococcus pneumoniae R6
agaaaggacaaauuuu

SEQ ID NO: 4096104 - RNA, 21 nt, Streptococcus pneumoniae R6
agaaaggacaaauuuuguccu

SEQ ID NO: 4096105 - RNA, 22 nt, Streptococcus pneumoniae R6
agaaaggacaaauuuuguccuu

SEQ ID NO: 4096106 - RNA, 23 nt, Streptococcus pneumoniae R6
agaaaggaccugaguucauuacu

SEQ ID NO: 4096107 - RNA, 18 nt, Streptococcus pneumoniae R6
agaaaggacgaaauuugu

SEQ ID NO: 4096108 - RNA, 22 nt, Streptococcus pneumoniae R6
agaaaggacgaaauuuguccuu

SEQ ID NO: 4096109 - RNA, 14 nt, Streptococcus pneumoniae R6
agaaaggagcagau

SEQ ID NO: 4096110 - RNA, 13 nt, Streptococcus pneumoniae R6
agaaagguuuuaa

SEQ ID NO: 4096111 - RNA, 15 nt, Streptococcus pneumoniae R6
agaaaguuaaaaaaa

SEQ ID NO: 4096112 - RNA, 16 nt, Streptococcus pneumoniae R6
agaaaguuaaaaaaac

SEQ ID NO: 4096113 - RNA, 21 nt, Streptococcus pneumoniae R6
agaaaguuaaaaaaacuaugg

SEQ ID NO: 4096114 - RNA, 12 nt, Streptococcus pneumoniae R6
agaaaguuuuuu

SEQ ID NO: 4096115 - RNA, 19 nt, Streptococcus pneumoniae R6
agaaauaaaaguaacaccu

SEQ ID NO: 4096116 - RNA, 15 nt, Streptococcus pneumoniae R6
agaaauagaaaacaa

SEQ ID NO: 4096117 - RNA, 19 nt, Streptococcus pneumoniae R6
agaaauagaaaacaaaaag

SEQ ID NO: 4096118 - RNA, 23 nt, Streptococcus pneumoniae R6
agaaauagcagagacauuagaaa

SEQ ID NO: 4096119 - RNA, 16 nt, Streptococcus pneumoniae R6
agaaauaguuuagaua

SEQ ID NO: 4096120 - RNA, 16 nt, Streptococcus pneumoniae R6
agaaaucacaauuccu

SEQ ID NO: 4096121 - RNA, 18 nt, Streptococcus pneumoniae R6
agaaaucauacaccucuu

SEQ ID NO: 4096122 - RNA, 21 nt, Streptococcus pneumoniae R6
agaaaucauacaccucuucug

SEQ ID NO: 4096123 - RNA, 22 nt, Streptococcus pneumoniae R6
agaaauccaaacgauuaucuaa

SEQ ID NO: 4096124 - RNA, 15 nt, Streptococcus pneumoniae R6
agaaaugcccaauuc

SEQ ID NO: 4096125 - RNA, 23 nt, Streptococcus pneumoniae R6
agaaauggaaguuucaaaauucc

SEQ ID NO: 4096126 - RNA, 15 nt, Streptococcus pneumoniae R6
agaaauuaauuuuac

SEQ ID NO: 4096127 - RNA, 17 nt, Streptococcus pneumoniae R6
agaaauuaauuuuacuu

SEQ ID NO: 4096128 - RNA, 23 nt, Streptococcus pneumoniae R6
agaaauuacaguuauuuuaguaa

SEQ ID NO: 4096129 - RNA, 14 nt, Streptococcus pneumoniae R6
agaaauucccucug

SEQ ID NO: 4096130 - RNA, 16 nt, Streptococcus pneumoniae R6
agaaauugaaguaaua

SEQ ID NO: 4096131 - RNA, 16 nt, Streptococcus pneumoniae R6
agaaauugauauaaug

SEQ ID NO: 4096132 - RNA, 23 nt, Streptococcus pneumoniae R6
agaaauugcggcugauuuuggug

SEQ ID NO: 4096133 - RNA, 13 nt, Streptococcus pneumoniae R6
agaaauugguuug

SEQ ID NO: 4096134 - RNA, 12 nt, Streptococcus pneumoniae R6
agaaauuucaac

SEQ ID NO: 4096135 - RNA, 13 nt, Streptococcus pneumoniae R6
agaaauuucaaca

SEQ ID NO: 4096136 - RNA, 15 nt, Streptococcus pneumoniae R6
agaaauuucaacaaa

SEQ ID NO: 4096137 - RNA, 16 nt, Streptococcus pneumoniae R6
agaaauuucaacaaaa

SEQ ID NO: 4096138 - RNA, 18 nt, Streptococcus pneumoniae R6
agaaauuucugaaacuaa

SEQ ID NO: 4096139 - RNA, 21 nt, Streptococcus pneumoniae R6
agaaauuuucuuuuuccuaau

SEQ ID NO: 4096140 - RNA, 16 nt, Streptococcus pneumoniae R6
agaaauuuugaaauaa

SEQ ID NO: 4096141 - RNA, 15 nt, Streptococcus pneumoniae R6
agaaauuuuuacuuu

SEQ ID NO: 4096142 - RNA, 20 nt, Streptococcus pneumoniae R6
agaaauuuuuacuuuauuuu

SEQ ID NO: 4096143 - RNA, 20 nt, Streptococcus pneumoniae R6
agaacaaacuaggaagcuag

SEQ ID NO: 4096144 - RNA, 14 nt, Streptococcus pneumoniae R6
agaacaauccaaau

SEQ ID NO: 4096145 - RNA, 16 nt, Streptococcus pneumoniae R6
agaacaauccaaauaa

SEQ ID NO: 4096146 - RNA, 18 nt, Streptococcus pneumoniae R6
agaacaauccaaauaagu

SEQ ID NO: 4096147 - RNA, 23 nt, Streptococcus pneumoniae R6
agaacagucucuguauaggucug

SEQ ID NO: 4096148 - RNA, 13 nt, Streptococcus pneumoniae R6
agaacaucuacaa

SEQ ID NO: 4096149 - RNA, 14 nt, Streptococcus pneumoniae R6
agaacauuuggaag

SEQ ID NO: 4096150 - RNA, 13 nt, Streptococcus pneumoniae R6
agaacauuuuaau

SEQ ID NO: 4096151 - RNA, 22 nt, Streptococcus pneumoniae R6
agacacuuaggguuagauuauu

SEQ ID NO: 4096152 - RNA, 17 nt, Streptococcus pneumoniae R6
agacacuugccuaaaca

SEQ ID NO: 4096153 - RNA, 17 nt, Streptococcus pneumoniae R6
agacagaaaaaaucuaa

SEQ ID NO: 4096154 - RNA, 22 nt, Streptococcus pneumoniae R6
agacagaaacgaaccuuggcuu

SEQ ID NO: 4096155 - RNA, 18 nt, Streptococcus pneumoniae R6
agacagagacaaaggagc

SEQ ID NO: 4096156 - RNA, 17 nt, Streptococcus pneumoniae R6
agacagaugacaaaucu

SEQ ID NO: 4096157 - RNA, 22 nt, Streptococcus pneumoniae R6
agacagcugaguggauuuuucg

SEQ ID NO: 4096158 - RNA, 20 nt, Streptococcus pneumoniae R6
agacaggcuuggauuuaaaa

SEQ ID NO: 4096159 - RNA, 13 nt, Streptococcus pneumoniae R6
agacagucugaaa

SEQ ID NO: 4096160 - RNA, 17 nt, Streptococcus pneumoniae R6
agacagucugaaaaaga

SEQ ID NO: 4096161 - RNA, 18 nt, Streptococcus pneumoniae R6
agacagucugaaaaagag

SEQ ID NO: 4096162 - RNA, 20 nt, Streptococcus pneumoniae R6
agacagucugaaaaagagga

SEQ ID NO: 4096163 - RNA, 18 nt, Streptococcus pneumoniae R6
agacauaaucaagaugaa

SEQ ID NO: 4096164 - RNA, 17 nt, Streptococcus pneumoniae R6
agacauaccauuuucca

SEQ ID NO: 4096165 - RNA, 14 nt, Streptococcus pneumoniae R6
agacauagucaagc

SEQ ID NO: 4096166 - RNA, 18 nt, Streptococcus pneumoniae R6
agacauagucaagcucuu

SEQ ID NO: 4096167 - RNA, 14 nt, Streptococcus pneumoniae R6
agacauauccauuc

SEQ ID NO: 4096168 - RNA, 16 nt, Streptococcus pneumoniae R6
agacauauccauuccu

SEQ ID NO: 4096169 - RNA, 19 nt, Streptococcus pneumoniae R6
agacauaugaaaucuuuuu

SEQ ID NO: 4096170 - RNA, 15 nt, Streptococcus pneumoniae R6
agacaucauauaaau

SEQ ID NO: 4096171 - RNA, 15 nt, Streptococcus pneumoniae R6
agaccaccucaucuu

SEQ ID NO: 4096172 - RNA, 16 nt, Streptococcus pneumoniae R6
agaccaccuuccuugg

SEQ ID NO: 4096173 - RNA, 14 nt, Streptococcus pneumoniae R6
agaccaguuucuuc

SEQ ID NO: 4096174 - RNA, 17 nt, Streptococcus pneumoniae R6
agaccaguuucuucuuu

SEQ ID NO: 4096175 - RNA, 18 nt, Streptococcus pneumoniae R6
agaccaguuucuucuuuc

SEQ ID NO: 4096176 - RNA, 13 nt, Streptococcus pneumoniae R6
agaccaugaggaa

SEQ ID NO: 4096177 - RNA, 20 nt, Streptococcus pneumoniae R6
agaccgauagcuuuugcagc

SEQ ID NO: 4096178 - RNA, 14 nt, Streptococcus pneumoniae R6
agaccggauugcuc

SEQ ID NO: 4096179 - RNA, 20 nt, Streptococcus pneumoniae R6
agaccuguauucauugaaaa

SEQ ID NO: 4096180 - RNA, 16 nt, Streptococcus pneumoniae R6
agaccuguuuggucag

SEQ ID NO: 4096181 - RNA, 22 nt, Streptococcus pneumoniae R6
agaccuuuuuucguaaccaaau

SEQ ID NO: 4096182 - RNA, 14 nt, Streptococcus pneumoniae R6
agacgaauaaagaa

SEQ ID NO: 4096183 - RNA, 20 nt, Streptococcus pneumoniae R6
agacgaccagcaguaucaau

SEQ ID NO: 4096184 - RNA, 21 nt, Streptococcus pneumoniae R6
agacgaguuaaaacaaagaaa

SEQ ID NO: 4096185 - RNA, 22 nt, Streptococcus pneumoniae R6
agacgaguuaaaacaaagaaaa

SEQ ID NO: 4096186 - RNA, 18 nt, Streptococcus pneumoniae R6
agacgaugaauaugucua

SEQ ID NO: 4096187 - RNA, 20 nt, Streptococcus pneumoniae R6
agacgauuccaaacaacaau

SEQ ID NO: 4096188 - RNA, 18 nt, Streptococcus pneumoniae R6
agacgcuggcuuucacgu

SEQ ID NO: 4096189 - RNA, 23 nt, Streptococcus pneumoniae R6
agacgguuuaccaauuuuuccuu

SEQ ID NO: 4096190 - RNA, 14 nt, Streptococcus pneumoniae R6
agacuaacuucuua

SEQ ID NO: 4096191 - RNA, 18 nt, Streptococcus pneumoniae R6
agacuaacuucuuauuag

SEQ ID NO: 4096192 - RNA, 20 nt, Streptococcus pneumoniae R6
agacuaacuucuuauuagca

SEQ ID NO: 4096193 - RNA, 16 nt, Streptococcus pneumoniae R6
agacuaaggagaguca

SEQ ID NO: 4096194 - RNA, 19 nt, Streptococcus pneumoniae R6
agacuaccgcuccuaaucu

SEQ ID NO: 4096195 - RNA, 23 nt, Streptococcus pneumoniae R6
agacuacuuccguaaucuuguua

SEQ ID NO: 4096196 - RNA, 19 nt, Streptococcus pneumoniae R6
agacuauaacagagaagaa

SEQ ID NO: 4096197 - RNA, 19 nt, Streptococcus pneumoniae R6
agacuauauugauuauuac

SEQ ID NO: 4096198 - RNA, 12 nt, Streptococcus pneumoniae R6
agacuaucugcu

SEQ ID NO: 4096199 - RNA, 19 nt, Streptococcus pneumoniae R6
agacuaucugcuaacugcu

SEQ ID NO: 4096200 - RNA, 22 nt, Streptococcus pneumoniae R6
agacuaucugcuaacugcugga

SEQ ID NO: 4096201 - RNA, 22 nt, Streptococcus pneumoniae R6
agacuauuaugaguuauuucag

SEQ ID NO: 4096202 - RNA, 18 nt, Streptococcus pneumoniae R6
agacuccucuuuacaugc

SEQ ID NO: 4096203 - RNA, 18 nt, Streptococcus pneumoniae R6
agacucuuuaagagaguu

SEQ ID NO: 4096204 - RNA, 14 nt, Streptococcus pneumoniae R6
agacugaaaauuug

SEQ ID NO: 4096205 - RNA, 15 nt, Streptococcus pneumoniae R6
agacugaaaauuuga

SEQ ID NO: 4096206 - RNA, 18 nt, Streptococcus pneumoniae R6
agacugaaucugaaauag

SEQ ID NO: 4096207 - RNA, 17 nt, Streptococcus pneumoniae R6
agacugacgaagucagc

SEQ ID NO: 4096208 - RNA, 19 nt, Streptococcus pneumoniae R6
agacugacgaagucagcuc

SEQ ID NO: 4096209 - RNA, 17 nt, Streptococcus pneumoniae R6
agacuggugagauaaaa

SEQ ID NO: 4096210 - RNA, 13 nt, Streptococcus pneumoniae R6
agacugucaaguu

SEQ ID NO: 4096211 - RNA, 15 nt, Streptococcus pneumoniae R6
agacuucaacagcac

SEQ ID NO: 4096212 - RNA, 15 nt, Streptococcus pneumoniae R6
agacuucccagccua

SEQ ID NO: 4096213 - RNA, 21 nt, Streptococcus pneumoniae R6
agacuucuuuuuuacuucguu

SEQ ID NO: 4096214 - RNA, 16 nt, Streptococcus pneumoniae R6
agacuugaaauacuaa

SEQ ID NO: 4096215 - RNA, 14 nt, Streptococcus pneumoniae R6
agacuuuaaaaauu

SEQ ID NO: 4096216 - RNA, 22 nt, Streptococcus pneumoniae R6
agacuuuacaacacuucauguu

SEQ ID NO: 4096217 - RNA, 16 nt, Streptococcus pneumoniae R6
agacuuucaaaccauu

SEQ ID NO: 4096218 - RNA, 21 nt, Streptococcus pneumoniae R6
agacuuucaaaccauugcugg

SEQ ID NO: 4096219 - RNA, 19 nt, Streptococcus pneumoniae R6
agacuuucaauucuucacu

SEQ ID NO: 4096220 - RNA, 17 nt, Streptococcus pneumoniae R6
agacuuugguauuacuu

SEQ ID NO: 4096221 - RNA, 19 nt, Streptococcus pneumoniae R6
agacuuuuauccaccuauu

SEQ ID NO: 4096222 - RNA, 19 nt, Streptococcus pneumoniae R6
agacuuuuccuguuguauu

SEQ ID NO: 4096223 - RNA, 21 nt, Streptococcus pneumoniae R6
agacuuuuugagccaagcguu

SEQ ID NO: 4096224 - RNA, 22 nt, Streptococcus pneumoniae R6
agacuuuuugccuggucucuuu

SEQ ID NO: 4096225 - RNA, 15 nt, Streptococcus pneumoniae R6
agacuuuuuuccagc

SEQ ID NO: 4096226 - RNA, 14 nt, Streptococcus pneumoniae R6
agacuuuuuucuau

SEQ ID NO: 4096227 - RNA, 11 nt, Streptococcus pneumoniae R6
agagaaaacca

SEQ ID NO: 4096228 - RNA, 13 nt, Streptococcus pneumoniae R6
agagaaaaccaaa

SEQ ID NO: 4096229 - RNA, 15 nt, Streptococcus pneumoniae R6
agagaaaaccaaaac

SEQ ID NO: 4096230 - RNA, 18 nt, Streptococcus pneumoniae R6
agagaaaaccaaaacuca

SEQ ID NO: 4096231 - RNA, 17 nt, Streptococcus pneumoniae R6
agagaaaaugggcuuuu

SEQ ID NO: 4096232 - RNA, 20 nt, Streptococcus pneumoniae R6
agagaaagaaaaacugcuua

SEQ ID NO: 4096233 - RNA, 14 nt, Streptococcus pneumoniae R6
agagaaagaaaaca

SEQ ID NO: 4096234 - RNA, 15 nt, Streptococcus pneumoniae R6
agagaaauuucugaa

SEQ ID NO: 4096235 - RNA, 22 nt, Streptococcus pneumoniae R6
agagaacuucacguucuuccaa

SEQ ID NO: 4096236 - RNA, 14 nt, Streptococcus pneumoniae R6
agagaagagagcau

SEQ ID NO: 4096237 - RNA, 18 nt, Streptococcus pneumoniae R6
agagaagaucaauaguga

SEQ ID NO: 4096238 - RNA, 14 nt, Streptococcus pneumoniae R6
agagaagcaaguga

SEQ ID NO: 4096239 - RNA, 17 nt, Streptococcus pneumoniae R6
agagaagcacaugccuu

SEQ ID NO: 4096240 - RNA, 17 nt, Streptococcus pneumoniae R6
agagaagccaagaguag

SEQ ID NO: 4096241 - RNA, 19 nt, Streptococcus pneumoniae R6
agagaagccaagaguagag

SEQ ID NO: 4096242 - RNA, 23 nt, Streptococcus pneumoniae R6
agagaagccaagaguagagagaa

SEQ ID NO: 4096243 - RNA, 12 nt, Streptococcus pneumoniae R6
agagaagccacc

SEQ ID NO: 4096244 - RNA, 14 nt, Streptococcus pneumoniae R6
agagacagaagaua

SEQ ID NO: 4096245 - RNA, 12 nt, Streptococcus pneumoniae R6
agagacagcagu

SEQ ID NO: 4096246 - RNA, 16 nt, Streptococcus pneumoniae R6
agagacauaaucaaga

SEQ ID NO: 4096247 - RNA, 20 nt, Streptococcus pneumoniae R6
agagacauaaucaagaugaa

SEQ ID NO: 4096248 - RNA, 15 nt, Streptococcus pneumoniae R6
agagaccuuucauaa

SEQ ID NO: 4096249 - RNA, 15 nt, Streptococcus pneumoniae R6
agagacuacggaguu

SEQ ID NO: 4096250 - RNA, 20 nt, Streptococcus pneumoniae R6
agagacucuuuaagagaguu

SEQ ID NO: 4096251 - RNA, 13 nt, Streptococcus pneumoniae R6
agagagauaaaua

SEQ ID NO: 4096252 - RNA, 15 nt, Streptococcus pneumoniae R6
agagagcuccaaaga

SEQ ID NO: 4096253 - RNA, 17 nt, Streptococcus pneumoniae R6
agagagcuccaaagaag

SEQ ID NO: 4096254 - RNA, 13 nt, Streptococcus pneumoniae R6
agauacagacugc

SEQ ID NO: 4096255 - RNA, 21 nt, Streptococcus pneumoniae R6
agauacagugaaggcuuuaaa

SEQ ID NO: 4096256 - RNA, 20 nt, Streptococcus pneumoniae R6
agauaccugguucagcagag

SEQ ID NO: 4096257 - RNA, 15 nt, Streptococcus pneumoniae R6
agauaccuuuuccuu

SEQ ID NO: 4096258 - RNA, 17 nt, Streptococcus pneumoniae R6
agauaccuuuuccuuca

SEQ ID NO: 4096259 - RNA, 22 nt, Streptococcus pneumoniae R6
agauaccuuuuccuucauuucc

SEQ ID NO: 4096260 - RNA, 14 nt, Streptococcus pneumoniae R6
agauacgaugacga

SEQ ID NO: 4096261 - RNA, 15 nt, Streptococcus pneumoniae R6
agauacugaaucaaa

SEQ ID NO: 4096262 - RNA, 17 nt, Streptococcus pneumoniae R6
agauacugaaucaaaaa

SEQ ID NO: 4096263 - RNA, 14 nt, Streptococcus pneumoniae R6
agauacuugauuuu

SEQ ID NO: 4096264 - RNA, 22 nt, Streptococcus pneumoniae R6
agauagagaaagaaaaacugcu

SEQ ID NO: 4096265 - RNA, 17 nt, Streptococcus pneumoniae R6
agauagagagcuccaaa

SEQ ID NO: 4096266 - RNA, 21 nt, Streptococcus pneumoniae R6
agauagagcuaacuuuuccuu

SEQ ID NO: 4096267 - RNA, 21 nt, Streptococcus pneumoniae R6
agauagcgcugggcugucucu

SEQ ID NO: 4096268 - RNA, 14 nt, Streptococcus pneumoniae R6
agauagcugcagcu

SEQ ID NO: 4096269 - RNA, 16 nt, Streptococcus pneumoniae R6
agauagcugcagcuga

SEQ ID NO: 4096270 - RNA, 17 nt, Streptococcus pneumoniae R6
agauagcugcagcugag

SEQ ID NO: 4096271 - RNA, 22 nt, Streptococcus pneumoniae R6
agauagcugcagcugaggaaau

SEQ ID NO: 4096272 - RNA, 15 nt, Streptococcus pneumoniae R6
agauaggagaccagc

SEQ ID NO: 4096273 - RNA, 17 nt, Streptococcus pneumoniae R6
agauagggcuaggcuaa

SEQ ID NO: 4096274 - RNA, 13 nt, Streptococcus pneumoniae R6
agauagguggggc

SEQ ID NO: 4096275 - RNA, 15 nt, Streptococcus pneumoniae R6
agauaguagaccuca

SEQ ID NO: 4096276 - RNA, 14 nt, Streptococcus pneumoniae R6
agauaguaucaaau

SEQ ID NO: 4096277 - RNA, 15 nt, Streptococcus pneumoniae R6
agauaguauuuuaaa

SEQ ID NO: 4096278 - RNA, 21 nt, Streptococcus pneumoniae R6
agauauaauuguaaacaaaaa

SEQ ID NO: 4096279 - RNA, 20 nt, Streptococcus pneumoniae R6
agauauagccuguaaaaagu

SEQ ID NO: 4096280 - RNA, 13 nt, Streptococcus pneumoniae R6
agauaucucuuug

SEQ ID NO: 4096281 - RNA, 15 nt, Streptococcus pneumoniae R6
agauaugaacaaauc

SEQ ID NO: 4096282 - RNA, 22 nt, Streptococcus pneumoniae R6
agauauuauuucaaagaacauc

SEQ ID NO: 4096283 - RNA, 14 nt, Streptococcus pneumoniae R6
agauauuucuucuu

SEQ ID NO: 4096284 - RNA, 22 nt, Streptococcus pneumoniae R6
agaucagaguagucuuuuuguu

SEQ ID NO: 4096285 - RNA, 18 nt, Streptococcus pneumoniae R6
agaucaguucauuuuucc

SEQ ID NO: 4096286 - RNA, 20 nt, Streptococcus pneumoniae R6
agaucaucaaccucacuuaa

SEQ ID NO: 4096287 - RNA, 21 nt, Streptococcus pneumoniae R6
agaucaugacugagagcuaca

SEQ ID NO: 4096288 - RNA, 16 nt, Streptococcus pneumoniae R6
agauccuucaaauccu

SEQ ID NO: 4096289 - RNA, 19 nt, Streptococcus pneumoniae R6
agauccuucaaauccugca

SEQ ID NO: 4096290 - RNA, 17 nt, Streptococcus pneumoniae R6
agaucuaucauuauacu

SEQ ID NO: 4096291 - RNA, 13 nt, Streptococcus pneumoniae R6
agaucuauccauu

SEQ ID NO: 4096292 - RNA, 13 nt, Streptococcus pneumoniae R6
agaucuucuucua

SEQ ID NO: 4096293 - RNA, 12 nt, Streptococcus pneumoniae R6
agaugaaacuga

SEQ ID NO: 4096294 - RNA, 21 nt, Streptococcus pneumoniae R6
agaugaaacugacgaagucag

SEQ ID NO: 4096295 - RNA, 19 nt, Streptococcus pneumoniae R6
agaugaagacauuugcuug

SEQ ID NO: 4096296 - RNA, 21 nt, Streptococcus pneumoniae R6
agaugaagcaaucaauguacu

SEQ ID NO: 4096297 - RNA, 19 nt, Streptococcus pneumoniae R6
agaugacaaaacguuccca

SEQ ID NO: 4096298 - RNA, 21 nt, Streptococcus pneumoniae R6
agaugacaaaguacuugagaa

SEQ ID NO: 4096299 - RNA, 18 nt, Streptococcus pneumoniae R6
agaugacaacauggcuuc

SEQ ID NO: 4096300 - RNA, 18 nt, Streptococcus pneumoniae R6
agaugacuucuuaaucaa

SEQ ID NO: 4096301 - RNA, 21 nt, Streptococcus pneumoniae R6
agaugacuucuuaaucaauua

SEQ ID NO: 4096302 - RNA, 21 nt, Streptococcus pneumoniae R6
agaugagaaagauuuucaaag

SEQ ID NO: 4096303 - RNA, 20 nt, Streptococcus pneumoniae R6
agaugagacgagcaguucca

SEQ ID NO: 4096304 - RNA, 20 nt, Streptococcus pneumoniae R6
agaugagacuugcaagaaag

SEQ ID NO: 4096305 - RNA, 21 nt, Streptococcus pneumoniae R6
agaugagacuugcaagaaagu

SEQ ID NO: 4096306 - RNA, 23 nt, Streptococcus pneumoniae R6
agaugagacuugcaagaaaguag

SEQ ID NO: 4096307 - RNA, 14 nt, Streptococcus pneumoniae R6
agaugagaggagaa

SEQ ID NO: 4096308 - RNA, 17 nt, Streptococcus pneumoniae R6
agaugagcgauugaaau

SEQ ID NO: 4096309 - RNA, 22 nt, Streptococcus pneumoniae R6
agaugaguguaaaaagaaaguc

SEQ ID NO: 4096310 - RNA, 23 nt, Streptococcus pneumoniae R6
agaugaguguaaaaagaaagucc

SEQ ID NO: 4096311 - RNA, 15 nt, Streptococcus pneumoniae R6
agaugauuacucaaa

SEQ ID NO: 4096312 - RNA, 16 nt, Streptococcus pneumoniae R6
agaugauuacucaaaa

SEQ ID NO: 4096313 - RNA, 12 nt, Streptococcus pneumoniae R6
agaugauuccug

SEQ ID NO: 4096314 - RNA, 22 nt, Streptococcus pneumoniae R6
agaugauuccugucauggcuga

SEQ ID NO: 4096315 - RNA, 14 nt, Streptococcus pneumoniae R6
agaugauuugcuca

SEQ ID NO: 4096316 - RNA, 15 nt, Streptococcus pneumoniae R6
agaugauuuucaaau

SEQ ID NO: 4096317 - RNA, 22 nt, Streptococcus pneumoniae R6
agaugauuuucaaauuuucuuu

SEQ ID NO: 4096318 - RNA, 21 nt, Streptococcus pneumoniae R6
agaugauuuuucuguuuucuu

SEQ ID NO: 4096319 - RNA, 21 nt, Streptococcus pneumoniae R6
agaugcaaaagucaggccugc

SEQ ID NO: 4096320 - RNA, 13 nt, Streptococcus pneumoniae R6
agauggaacugac

SEQ ID NO: 4096321 - RNA, 14 nt, Streptococcus pneumoniae R6
agauggaaguagug

SEQ ID NO: 4096322 - RNA, 19 nt, Streptococcus pneumoniae R6
agauggacuagaaugcuuu

SEQ ID NO: 4096323 - RNA, 15 nt, Streptococcus pneumoniae R6
agauggauuuuccuu

SEQ ID NO: 4096324 - RNA, 15 nt, Streptococcus pneumoniae R6
agaugggacuaaaga

SEQ ID NO: 4096325 - RNA, 20 nt, Streptococcus pneumoniae R6
agaugggucaagauuuccug

SEQ ID NO: 4096326 - RNA, 20 nt, Streptococcus pneumoniae R6
agaugguauccaaaacaacc

SEQ ID NO: 4096327 - RNA, 21 nt, Streptococcus pneumoniae R6
agaugguauugacugcccaga

SEQ ID NO: 4096328 - RNA, 21 nt, Streptococcus pneumoniae R6
agauggucaugauagcuagcg

SEQ ID NO: 4096329 - RNA, 22 nt, Streptococcus pneumoniae R6
agauguauaauggauugaaaua

SEQ ID NO: 4096330 - RNA, 20 nt, Streptococcus pneumoniae R6
agaugucggauugcccaaaa

SEQ ID NO: 4096331 - RNA, 19 nt, Streptococcus pneumoniae R6
agauguuauuuacuguuuu

SEQ ID NO: 4096332 - RNA, 13 nt, Streptococcus pneumoniae R6
agauguucaaaga

SEQ ID NO: 4096333 - RNA, 18 nt, Streptococcus pneumoniae R6
agauuaaaaaauaacucu

SEQ ID NO: 4096334 - RNA, 19 nt, Streptococcus pneumoniae R6
agauuaaaaaauaacucug

SEQ ID NO: 4096335 - RNA, 18 nt, Streptococcus pneumoniae R6
agauuaaaccuuccaaga

SEQ ID NO: 4096336 - RNA, 13 nt, Streptococcus pneumoniae R6
agauuacaaaaaa

SEQ ID NO: 4096337 - RNA, 22 nt, Streptococcus pneumoniae R6
agauuacaaaaaaaacuacguu

SEQ ID NO: 4096338 - RNA, 14 nt, Streptococcus pneumoniae R6
agauuacugauaaa

SEQ ID NO: 4096339 - RNA, 15 nt, Streptococcus pneumoniae R6
agauuacugauaaaa

SEQ ID NO: 4096340 - RNA, 16 nt, Streptococcus pneumoniae R6
agauuacugauaaaac

SEQ ID NO: 4096341 - RNA, 12 nt, Streptococcus pneumoniae R6
agauuagaauug

SEQ ID NO: 4096342 - RNA, 16 nt, Streptococcus pneumoniae R6
agauuauguaagauag

SEQ ID NO: 4096343 - RNA, 21 nt, Streptococcus pneumoniae R6
agauuauugcagccaauuucu

SEQ ID NO: 4096344 - RNA, 21 nt, Streptococcus pneumoniae R6
agauuauugguggcuuccagu

SEQ ID NO: 4096345 - RNA, 14 nt, Streptococcus pneumoniae R6
agauucaacaucac

SEQ ID NO: 4096346 - RNA, 14 nt, Streptococcus pneumoniae R6
agauucaauauacu

SEQ ID NO: 4096347 - RNA, 23 nt, Streptococcus pneumoniae R6
agauucacuagccccagcuagga

SEQ ID NO: 4096348 - RNA, 13 nt, Streptococcus pneumoniae R6
agauucagcuaaa

SEQ ID NO: 4096349 - RNA, 14 nt, Streptococcus pneumoniae R6
agauucagcuaaaa

SEQ ID NO: 4096350 - RNA, 13 nt, Streptococcus pneumoniae R6
agauucagucuac

SEQ ID NO: 4096351 - RNA, 21 nt, Streptococcus pneumoniae R6
agauucaucagggcaaaggua

SEQ ID NO: 4096352 - RNA, 14 nt, Streptococcus pneumoniae R6
agauucauucugcu

SEQ ID NO: 4096353 - RNA, 22 nt, Streptococcus pneumoniae R6
agauuccacguuucuaauaauu

SEQ ID NO: 4096354 - RNA, 17 nt, Streptococcus pneumoniae R6
agauuccugaaauaaaa

SEQ ID NO: 4096355 - RNA, 16 nt, Streptococcus pneumoniae R6
agauucuacucuguuu

SEQ ID NO: 4096356 - RNA, 21 nt, Streptococcus pneumoniae R6
agcaggaguuuucccuguugu

SEQ ID NO: 4096357 - RNA, 15 nt, Streptococcus pneumoniae R6
agcaguaacuucugu

SEQ ID NO: 4096358 - RNA, 21 nt, Streptococcus pneumoniae R6
agcaguaacuucugucuauuu

SEQ ID NO: 4096359 - RNA, 14 nt, Streptococcus pneumoniae R6
agcaguaaucacug

SEQ ID NO: 4096360 - RNA, 15 nt, Streptococcus pneumoniae R6
agcaguaaucacugc

SEQ ID NO: 4096361 - RNA, 19 nt, Streptococcus pneumoniae R6
agcaguaaucacugcagca

SEQ ID NO: 4096362 - RNA, 11 nt, Streptococcus pneumoniae R6
agcagucugcg

SEQ ID NO: 4096363 - RNA, 13 nt, Streptococcus pneumoniae R6
agcagugguuuag

SEQ ID NO: 4096364 - RNA, 16 nt, Streptococcus pneumoniae R6
agcauaacgacagaag

SEQ ID NO: 4096365 - RNA, 17 nt, Streptococcus pneumoniae R6
agcauaacgacagaaga

SEQ ID NO: 4096366 - RNA, 19 nt, Streptococcus pneumoniae R6
agcauaacgacagaagaag

SEQ ID NO: 4096367 - RNA, 23 nt, Streptococcus pneumoniae R6
agcauaacgacagaagaagugac

SEQ ID NO: 4096368 - RNA, 15 nt, Streptococcus pneumoniae R6
agcauaauagcagaa

SEQ ID NO: 4096369 - RNA, 13 nt, Streptococcus pneumoniae R6
agcauagaaguuu

SEQ ID NO: 4096370 - RNA, 21 nt, Streptococcus pneumoniae R6
agcauagcgugcccaaaaauu

SEQ ID NO: 4096371 - RNA, 13 nt, Streptococcus pneumoniae R6
agcauaggggaau

SEQ ID NO: 4096372 - RNA, 17 nt, Streptococcus pneumoniae R6
agcauaggggaauaucg

SEQ ID NO: 4096373 - RNA, 18 nt, Streptococcus pneumoniae R6
agcauaggggaauaucga

SEQ ID NO: 4096374 - RNA, 13 nt, Streptococcus pneumoniae R6
agcauauuuuuag

SEQ ID NO: 4096375 - RNA, 21 nt, Streptococcus pneumoniae R6
agcaucccauggaacuaagau

SEQ ID NO: 4096376 - RNA, 19 nt, Streptococcus pneumoniae R6
agcaucgagaauuucuggu

SEQ ID NO: 4096377 - RNA, 17 nt, Streptococcus pneumoniae R6
agcaucuaaaugaucca

SEQ ID NO: 4096378 - RNA, 15 nt, Streptococcus pneumoniae R6
agcaucugguuucgu

SEQ ID NO: 4096379 - RNA, 22 nt, Streptococcus pneumoniae R6
agcaucugguuucguagcagaa

SEQ ID NO: 4096380 - RNA, 21 nt, Streptococcus pneumoniae R6
agcaucuuaucagaaaauaaa

SEQ ID NO: 4096381 - RNA, 17 nt, Streptococcus pneumoniae R6
agcaucuucuucuggug

SEQ ID NO: 4096382 - RNA, 13 nt, Streptococcus pneumoniae R6
agcaucuuguguu

SEQ ID NO: 4096383 - RNA, 18 nt, Streptococcus pneumoniae R6
agcaucuuguguuuuuug

SEQ ID NO: 4096384 - RNA, 22 nt, Streptococcus pneumoniae R6
agcaugcgcucgcuuuucaccu

SEQ ID NO: 4096385 - RNA, 21 nt, Streptococcus pneumoniae R6
agcauggaaccaaaguuccuc

SEQ ID NO: 4096386 - RNA, 14 nt, Streptococcus pneumoniae R6
agcauggucaggcu

SEQ ID NO: 4096387 - RNA, 14 nt, Streptococcus pneumoniae R6
agcauuauagcucg

SEQ ID NO: 4096388 - RNA, 17 nt, Streptococcus pneumoniae R6
agcauuuucaaagaaga

SEQ ID NO: 4096389 - RNA, 14 nt, Streptococcus pneumoniae R6
agcauuuucuuuuu

SEQ ID NO: 4096390 - RNA, 18 nt, Streptococcus pneumoniae R6
agccaaaaaagaaaggac

SEQ ID NO: 4096391 - RNA, 12 nt, Streptococcus pneumoniae R6
agccaaaucaau

SEQ ID NO: 4096392 - RNA, 14 nt, Streptococcus pneumoniae R6
agccaacaacugau

SEQ ID NO: 4096393 - RNA, 22 nt, Streptococcus pneumoniae R6
agccaacucauacuuucuaucu

SEQ ID NO: 4096394 - RNA, 23 nt, Streptococcus pneumoniae R6
agccaagauaggaaucccuggag

SEQ ID NO: 4096395 - RNA, 12 nt, Streptococcus pneumoniae R6
agccaauacugc

SEQ ID NO: 4096396 - RNA, 15 nt, Streptococcus pneumoniae R6
agccaauauuagucg

SEQ ID NO: 4096397 - RNA, 18 nt, Streptococcus pneumoniae R6
agccaauggguugaagua

SEQ ID NO: 4096398 - RNA, 21 nt, Streptococcus pneumoniae R6
agccaccgccagaacuuccac

SEQ ID NO: 4096399 - RNA, 17 nt, Streptococcus pneumoniae R6
agccacugcaucugguu

SEQ ID NO: 4096400 - RNA, 19 nt, Streptococcus pneumoniae R6
agccacugcaucugguucu

SEQ ID NO: 4096401 - RNA, 20 nt, Streptococcus pneumoniae R6
agccacuguacguccaacug

SEQ ID NO: 4096402 - RNA, 16 nt, Streptococcus pneumoniae R6
agccagaaaaaucccu

SEQ ID NO: 4096403 - RNA, 21 nt, Streptococcus pneumoniae R6
agccagaaaaaucccuuguuu

SEQ ID NO: 4096404 - RNA, 17 nt, Streptococcus pneumoniae R6
agccagagcaccaacca

SEQ ID NO: 4096405 - RNA, 18 nt, Streptococcus pneumoniae R6
agccagcgccuaaagacg

SEQ ID NO: 4096406 - RNA, 15 nt, Streptococcus pneumoniae R6
agccauaaaacauuu

SEQ ID NO: 4096407 - RNA, 18 nt, Streptococcus pneumoniae R6
agccauaaaacauuuccg

SEQ ID NO: 4096408 - RNA, 18 nt, Streptococcus pneumoniae R6
agcccaaccagcuguauc

SEQ ID NO: 4096409 - RNA, 16 nt, Streptococcus pneumoniae R6
agcccacugugauuuc

SEQ ID NO: 4096410 - RNA, 14 nt, Streptococcus pneumoniae R6
agcccauaaagaga

SEQ ID NO: 4096411 - RNA, 23 nt, Streptococcus pneumoniae R6
agcccaugauaucuuugauuuua

SEQ ID NO: 4096412 - RNA, 22 nt, Streptococcus pneumoniae R6
agccgacccaggcaaagagucc

SEQ ID NO: 4096413 - RNA, 14 nt, Streptococcus pneumoniae R6
agccgacuauacuc

SEQ ID NO: 4096414 - RNA, 17 nt, Streptococcus pneumoniae R6
agccgaugaccuugagc

SEQ ID NO: 4096415 - RNA, 21 nt, Streptococcus pneumoniae R6
agccgaugaccuugagcucuu

SEQ ID NO: 4096416 - RNA, 19 nt, Streptococcus pneumoniae R6
agccgcugagucauucaau

SEQ ID NO: 4096417 - RNA, 17 nt, Streptococcus pneumoniae R6
agccggaaauugucuga

SEQ ID NO: 4096418 - RNA, 17 nt, Streptococcus pneumoniae R6
agccggcuugucuuuga

SEQ ID NO: 4096419 - RNA, 16 nt, Streptococcus pneumoniae R6
agccguugaguuuuuu

SEQ ID NO: 4096420 - RNA, 16 nt, Streptococcus pneumoniae R6
agccuaagacaaccaa

SEQ ID NO: 4096421 - RNA, 15 nt, Streptococcus pneumoniae R6
agccuacacagacug

SEQ ID NO: 4096422 - RNA, 17 nt, Streptococcus pneumoniae R6
agccuaccugcggauaa

SEQ ID NO: 4096423 - RNA, 22 nt, Streptococcus pneumoniae R6
agccuaccugcggauaaaagag

SEQ ID NO: 4096424 - RNA, 14 nt, Streptococcus pneumoniae R6
agccuagucuucug

SEQ ID NO: 4096425 - RNA, 15 nt, Streptococcus pneumoniae R6
agccuauaaaaagaa

SEQ ID NO: 4096426 - RNA, 17 nt, Streptococcus pneumoniae R6
agccuaucguagcuuuu

SEQ ID NO: 4096427 - RNA, 17 nt, Streptococcus pneumoniae R6
agccucaaugauaccau

SEQ ID NO: 4096428 - RNA, 22 nt, Streptococcus pneumoniae R6
agccucaaugauaccaucuuua

SEQ ID NO: 4096429 - RNA, 14 nt, Streptococcus pneumoniae R6
agccuccaauagca

SEQ ID NO: 4096430 - RNA, 23 nt, Streptococcus pneumoniae R6
agccucuacaccauaaauauuug

SEQ ID NO: 4096431 - RNA, 20 nt, Streptococcus pneumoniae R6
agccucuuucauagcaaaau

SEQ ID NO: 4096432 - RNA, 16 nt, Streptococcus pneumoniae R6
agccugcuaucuuuuu

SEQ ID NO: 4096433 - RNA, 17 nt, Streptococcus pneumoniae R6
agccuguaaaaagugaa

SEQ ID NO: 4096434 - RNA, 22 nt, Streptococcus pneumoniae R6
agccuguaaaaagugaaaggaa

SEQ ID NO: 4096435 - RNA, 19 nt, Streptococcus pneumoniae R6
agccuguggugauugugaa

SEQ ID NO: 4096436 - RNA, 15 nt, Streptococcus pneumoniae R6
agccuucauuuuaca

SEQ ID NO: 4096437 - RNA, 21 nt, Streptococcus pneumoniae R6
agccuucuccuaggauuucau

SEQ ID NO: 4096438 - RNA, 20 nt, Streptococcus pneumoniae R6
agccuucuggucugauuuuc

SEQ ID NO: 4096439 - RNA, 22 nt, Streptococcus pneumoniae R6
agccuucuggucugauuuucau

SEQ ID NO: 4096440 - RNA, 19 nt, Streptococcus pneumoniae R6
agccuugaguggauuuuua

SEQ ID NO: 4096441 - RNA, 13 nt, Streptococcus pneumoniae R6
agccuuuccuuaa

SEQ ID NO: 4096442 - RNA, 17 nt, Streptococcus pneumoniae R6
agccuuuccuuaaguga

SEQ ID NO: 4096443 - RNA, 19 nt, Streptococcus pneumoniae R6
agcgaaaggagaaaaaaua

SEQ ID NO: 4096444 - RNA, 17 nt, Streptococcus pneumoniae R6
agcgaaaucaacacguu

SEQ ID NO: 4096445 - RNA, 15 nt, Streptococcus pneumoniae R6
agcgaacaucuccaa

SEQ ID NO: 4096446 - RNA, 15 nt, Streptococcus pneumoniae R6
agcgacuuuuucuga

SEQ ID NO: 4096447 - RNA, 18 nt, Streptococcus pneumoniae R6
agcgaguagagagucaca

SEQ ID NO: 4096448 - RNA, 14 nt, Streptococcus pneumoniae R6
agcgaugaagagag

SEQ ID NO: 4096449 - RNA, 18 nt, Streptococcus pneumoniae R6
agcgauugaaacagcugc

SEQ ID NO: 4096450 - RNA, 19 nt, Streptococcus pneumoniae R6
agcgauugaaacagcugcg

SEQ ID NO: 4096451 - RNA, 15 nt, Streptococcus pneumoniae R6
agcgauuuccuugag

SEQ ID NO: 4096452 - RNA, 19 nt, Streptococcus pneumoniae R6
agcgauuuccuugagcgaa

SEQ ID NO: 4096453 - RNA, 22 nt, Streptococcus pneumoniae R6
agcgcacaagcgcuauuaaaau

SEQ ID NO: 4096454 - RNA, 19 nt, Streptococcus pneumoniae R6
agcgcaggaagaaagagga

SEQ ID NO: 4096455 - RNA, 22 nt, Streptococcus pneumoniae R6
agcgcaggaagaaagaggagua

SEQ ID NO: 4096456 - RNA, 16 nt, Streptococcus pneumoniae R6
agcgcguuugagcuca

SEQ ID NO: 4096457 - RNA, 13 nt, Streptococcus pneumoniae R6
agcgcuugauagc

SEQ ID NO: 4096458 - RNA, 13 nt, Streptococcus pneumoniae R6
agcuugcaaugag

SEQ ID NO: 4096459 - RNA, 18 nt, Streptococcus pneumoniae R6
agcuugcucaaaguacag

SEQ ID NO: 4096460 - RNA, 16 nt, Streptococcus pneumoniae R6
agcuugcuccauucuu

SEQ ID NO: 4096461 - RNA, 17 nt, Streptococcus pneumoniae R6
agcuugcuccauucuuu

SEQ ID NO: 4096462 - RNA, 20 nt, Streptococcus pneumoniae R6
agcuuggcuuugauucaucu

SEQ ID NO: 4096463 - RNA, 22 nt, Streptococcus pneumoniae R6
agcuugguaaugcuccaauaca

SEQ ID NO: 4096464 - RNA, 16 nt, Streptococcus pneumoniae R6
agcuuguucuucugcu

SEQ ID NO: 4096465 - RNA, 14 nt, Streptococcus pneumoniae R6
agcuuguuguuaaa

SEQ ID NO: 4096466 - RNA, 17 nt, Streptococcus pneumoniae R6
agcuuguuguuaaacaa

SEQ ID NO: 4096467 - RNA, 19 nt, Streptococcus pneumoniae R6
agcuuguuguuaaacaagg

SEQ ID NO: 4096468 - RNA, 18 nt, Streptococcus pneumoniae R6
agcuuguuuaaaaucucu

SEQ ID NO: 4096469 - RNA, 20 nt, Streptococcus pneumoniae R6
agcuuuaauagaaagugaca

SEQ ID NO: 4096470 - RNA, 16 nt, Streptococcus pneumoniae R6
agcuuuaaugcuauga

SEQ ID NO: 4096471 - RNA, 19 nt, Streptococcus pneumoniae R6
agcuuuaucugcaaccuca

SEQ ID NO: 4096472 - RNA, 14 nt, Streptococcus pneumoniae R6
agcuuucagcagcu

SEQ ID NO: 4096473 - RNA, 18 nt, Streptococcus pneumoniae R6
agcuuugaaaauuccauu

SEQ ID NO: 4096474 - RNA, 19 nt, Streptococcus pneumoniae R6
agcuuuuauaaauuuucca

SEQ ID NO: 4096475 - RNA, 23 nt, Streptococcus pneumoniae R6
agcuuuucaauacggucaaucaa

SEQ ID NO: 4096476 - RNA, 21 nt, Streptococcus pneumoniae R6
agcuuuugugauaaaggccuu

SEQ ID NO: 4096477 - RNA, 14 nt, Streptococcus pneumoniae R6
agcuuuuuccucau

SEQ ID NO: 4096478 - RNA, 22 nt, Streptococcus pneumoniae R6
aggaaaacaugaaguaaauauu

SEQ ID NO: 4096479 - RNA, 20 nt, Streptococcus pneumoniae R6
aggaaaauacugauaaaaac

SEQ ID NO: 4096480 - RNA, 17 nt, Streptococcus pneumoniae R6
aggaaacucuuacaaaa

SEQ ID NO: 4096481 - RNA, 23 nt, Streptococcus pneumoniae R6
aggaaacucuuacaaaaaaucaa

SEQ ID NO: 4096482 - RNA, 19 nt, Streptococcus pneumoniae R6
aggaaagaggguauaaaac

SEQ ID NO: 4096483 - RNA, 16 nt, Streptococcus pneumoniae R6
aggaaaggaaaauuga

SEQ ID NO: 4096484 - RNA, 12 nt, Streptococcus pneumoniae R6
aggaaagucaaa

SEQ ID NO: 4096485 - RNA, 18 nt, Streptococcus pneumoniae R6
aggaaagucggaaggcau

SEQ ID NO: 4096486 - RNA, 15 nt, Streptococcus pneumoniae R6
aggaaaguucuuccc

SEQ ID NO: 4096487 - RNA, 20 nt, Streptococcus pneumoniae R6
aggaaaucccuacaaggaag

SEQ ID NO: 4096488 - RNA, 18 nt, Streptococcus pneumoniae R6
aggaaaucccucggcuuu

SEQ ID NO: 4096489 - RNA, 19 nt, Streptococcus pneumoniae R6
aggaaaucccucggcuuuu

SEQ ID NO: 4096490 - RNA, 14 nt, Streptococcus pneumoniae R6
aggaacaauaaaac

SEQ ID NO: 4096491 - RNA, 14 nt, Streptococcus pneumoniae R6
aggaaccaaaugau

SEQ ID NO: 4096492 - RNA, 18 nt, Streptococcus pneumoniae R6
aggaaccccaacuuacau

SEQ ID NO: 4096493 - RNA, 22 nt, Streptococcus pneumoniae R6
aggaacggcuaguuuuuaggau

SEQ ID NO: 4096494 - RNA, 14 nt, Streptococcus pneumoniae R6
aggaagaaagagga

SEQ ID NO: 4096495 - RNA, 15 nt, Streptococcus pneumoniae R6
aggaagaaagaggag

SEQ ID NO: 4096496 - RNA, 20 nt, Streptococcus pneumoniae R6
aggaagcaguccaaggagaa

SEQ ID NO: 4096497 - RNA, 16 nt, Streptococcus pneumoniae R6
aggaagcccuuuauga

SEQ ID NO: 4096498 - RNA, 19 nt, Streptococcus pneumoniae R6
aggaagccuucuuuuccac

SEQ ID NO: 4096499 - RNA, 18 nt, Streptococcus pneumoniae R6
aggaagcgaugauaagaa

SEQ ID NO: 4096500 - RNA, 19 nt, Streptococcus pneumoniae R6
aggaagcuagucucagcuu

SEQ ID NO: 4096501 - RNA, 20 nt, Streptococcus pneumoniae R6
aggaaggggacaagguguuu

SEQ ID NO: 4096502 - RNA, 14 nt, Streptococcus pneumoniae R6
aggaagguuauuug

SEQ ID NO: 4096503 - RNA, 14 nt, Streptococcus pneumoniae R6
aggaagguuuuaaa

SEQ ID NO: 4096504 - RNA, 15 nt, Streptococcus pneumoniae R6
aggaagguuuuaaag

SEQ ID NO: 4096505 - RNA, 16 nt, Streptococcus pneumoniae R6
aggaagguuuuaaaga

SEQ ID NO: 4096506 - RNA, 17 nt, Streptococcus pneumoniae R6
aggaaguaccaaggaag

SEQ ID NO: 4096507 - RNA, 17 nt, Streptococcus pneumoniae R6
aggaagucuuguuugag

SEQ ID NO: 4096508 - RNA, 19 nt, Streptococcus pneumoniae R6
aggaauaaauccagcugag

SEQ ID NO: 4096509 - RNA, 20 nt, Streptococcus pneumoniae R6
aggaauacuaaaauauuucu

SEQ ID NO: 4096510 - RNA, 16 nt, Streptococcus pneumoniae R6
aggaauaucaaaguuu

SEQ ID NO: 4096511 - RNA, 23 nt, Streptococcus pneumoniae R6
aggaaucaacauauccaaguuuu

SEQ ID NO: 4096512 - RNA, 22 nt, Streptococcus pneumoniae R6
aggaauuaauggcagugcuuuu

SEQ ID NO: 4096513 - RNA, 19 nt, Streptococcus pneumoniae R6
aggaauucaagcaaaacaa

SEQ ID NO: 4096514 - RNA, 17 nt, Streptococcus pneumoniae R6
aggacaaaagauaagau

SEQ ID NO: 4096515 - RNA, 19 nt, Streptococcus pneumoniae R6
aggacaaaucgaucaggac

SEQ ID NO: 4096516 - RNA, 17 nt, Streptococcus pneumoniae R6
aggacaaguuaaauaau

SEQ ID NO: 4096517 - RNA, 18 nt, Streptococcus pneumoniae R6
aggacaaguuaaauaaua

SEQ ID NO: 4096518 - RNA, 13 nt, Streptococcus pneumoniae R6
aggacagcaagaa

SEQ ID NO: 4096519 - RNA, 17 nt, Streptococcus pneumoniae R6
aggacagucaaaucgau

SEQ ID NO: 4096520 - RNA, 14 nt, Streptococcus pneumoniae R6
aggacauaaauaug

SEQ ID NO: 4096521 - RNA, 11 nt, Streptococcus pneumoniae R6
aggacauagaa

SEQ ID NO: 4096522 - RNA, 15 nt, Streptococcus pneumoniae R6
aggacaucauaaauc

SEQ ID NO: 4096523 - RNA, 14 nt, Streptococcus pneumoniae R6
aggacaucauaacu

SEQ ID NO: 4096524 - RNA, 14 nt, Streptococcus pneumoniae R6
aggacgaacgcugg

SEQ ID NO: 4096525 - RNA, 20 nt, Streptococcus pneumoniae R6
aggacgaaucguucaggaca

SEQ ID NO: 4096526 - RNA, 22 nt, Streptococcus pneumoniae R6
aggacguuuugugauaaucaua

SEQ ID NO: 4096527 - RNA, 13 nt, Streptococcus pneumoniae R6
aggacuaaaucca

SEQ ID NO: 4096528 - RNA, 22 nt, Streptococcus pneumoniae R6
aggacuugaguaaugaacucag

SEQ ID NO: 4096529 - RNA, 13 nt, Streptococcus pneumoniae R6
aggagaaaaaaua

SEQ ID NO: 4096530 - RNA, 15 nt, Streptococcus pneumoniae R6
aggagaaaaugaaau

SEQ ID NO: 4096531 - RNA, 17 nt, Streptococcus pneumoniae R6
aggagaaagaagagggc

SEQ ID NO: 4096532 - RNA, 16 nt, Streptococcus pneumoniae R6
aggagaaccaggaaac

SEQ ID NO: 4096533 - RNA, 16 nt, Streptococcus pneumoniae R6
aggagaaucaacauga

SEQ ID NO: 4096534 - RNA, 21 nt, Streptococcus pneumoniae R6
aggagaaucaacaugagaaua

SEQ ID NO: 4096535 - RNA, 13 nt, Streptococcus pneumoniae R6
aggagaauuuuug

SEQ ID NO: 4096536 - RNA, 11 nt, Streptococcus pneumoniae R6
aggagauaaaa

SEQ ID NO: 4096537 - RNA, 19 nt, Streptococcus pneumoniae R6
aggagauucuuauaaauau

SEQ ID NO: 4096538 - RNA, 16 nt, Streptococcus pneumoniae R6
aggagauuggaaacca

SEQ ID NO: 4096539 - RNA, 19 nt, Streptococcus pneumoniae R6
aggagcacaguagauuccu

SEQ ID NO: 4096540 - RNA, 13 nt, Streptococcus pneumoniae R6
aggagccaagaua

SEQ ID NO: 4096541 - RNA, 14 nt, Streptococcus pneumoniae R6
aggagccaagauag

SEQ ID NO: 4096542 - RNA, 14 nt, Streptococcus pneumoniae R6
aggagccagcugaa

SEQ ID NO: 4096543 - RNA, 20 nt, Streptococcus pneumoniae R6
aggagcuaacggaauuaaua

SEQ ID NO: 4096544 - RNA, 18 nt, Streptococcus pneumoniae R6
aggaggcaaagaaaaaag

SEQ ID NO: 4096545 - RNA, 16 nt, Streptococcus pneumoniae R6
aggaggcuagccgcac

SEQ ID NO: 4096546 - RNA, 20 nt, Streptococcus pneumoniae R6
aggaguaggaguaguaaaac

SEQ ID NO: 4096547 - RNA, 21 nt, Streptococcus pneumoniae R6
aggaguuaaccucgagaaagg

SEQ ID NO: 4096548 - RNA, 20 nt, Streptococcus pneumoniae R6
aggaguuucaccuugccauc

SEQ ID NO: 4096549 - RNA, 19 nt, Streptococcus pneumoniae R6
aggauaaaaaagaaggagc

SEQ ID NO: 4096550 - RNA, 16 nt, Streptococcus pneumoniae R6
aggauaaaaaguccau

SEQ ID NO: 4096551 - RNA, 16 nt, Streptococcus pneumoniae R6
aggauaaagcaaaacg

SEQ ID NO: 4096552 - RNA, 14 nt, Streptococcus pneumoniae R6
aggauacugucuca

SEQ ID NO: 4096553 - RNA, 19 nt, Streptococcus pneumoniae R6
aggauaugaggagaaagaa

SEQ ID NO: 4096554 - RNA, 16 nt, Streptococcus pneumoniae R6
aggaugacaauagcua

SEQ ID NO: 4096555 - RNA, 20 nt, Streptococcus pneumoniae R6
aggaugacaauagcuaauag

SEQ ID NO: 4096556 - RNA, 22 nt, Streptococcus pneumoniae R6
aggaugacaauagcuaauagaa

SEQ ID NO: 4096557 - RNA, 21 nt, Streptococcus pneumoniae R6
aggaugccuuuuauaauagaa

SEQ ID NO: 4096558 - RNA, 22 nt, Streptococcus pneumoniae R6
aggaugccuuuuauaauagaaa

SEQ ID NO: 4096559 - RNA, 21 nt, Streptococcus pneumoniae R6
aggauggcuccagaaauaaua

SEQ ID NO: 4096560 - RNA, 16 nt, Streptococcus pneumoniae R6
agguagcuuagaaaua

SEQ ID NO: 4096561 - RNA, 14 nt, Streptococcus pneumoniae R6
agguauaaaccacg

SEQ ID NO: 4096562 - RNA, 19 nt, Streptococcus pneumoniae R6
agguauggccgauaacagc

SEQ ID NO: 4096563 - RNA, 23 nt, Streptococcus pneumoniae R6
agguauggccgauaacagccaaa

SEQ ID NO: 4096564 - RNA, 19 nt, Streptococcus pneumoniae R6
agguaugguuacugacuuc

SEQ ID NO: 4096565 - RNA, 15 nt, Streptococcus pneumoniae R6
agguauucauaaaau

SEQ ID NO: 4096566 - RNA, 22 nt, Streptococcus pneumoniae R6
agguauugaaaaaacuugauac

SEQ ID NO: 4096567 - RNA, 13 nt, Streptococcus pneumoniae R6
aggucaaaaugau

SEQ ID NO: 4096568 - RNA, 22 nt, Streptococcus pneumoniae R6
aggucaaacuuuuucucucuga

SEQ ID NO: 4096569 - RNA, 21 nt, Streptococcus pneumoniae R6
aggucaaccaacuuuuccuug

SEQ ID NO: 4096570 - RNA, 20 nt, Streptococcus pneumoniae R6
aggucacgaggaggagaaaa

SEQ ID NO: 4096571 - RNA, 16 nt, Streptococcus pneumoniae R6
aggucagugacuugug

SEQ ID NO: 4096572 - RNA, 19 nt, Streptococcus pneumoniae R6
aggucaguugcaagaagca

SEQ ID NO: 4096573 - RNA, 18 nt, Streptococcus pneumoniae R6
aggucauaaaccucgaua

SEQ ID NO: 4096574 - RNA, 15 nt, Streptococcus pneumoniae R6
aggucauaaagaggu

SEQ ID NO: 4096575 - RNA, 18 nt, Streptococcus pneumoniae R6
aggucaucagcagagaaa

SEQ ID NO: 4096576 - RNA, 21 nt, Streptococcus pneumoniae R6
aggucgaagccauccuuggua

SEQ ID NO: 4096577 - RNA, 18 nt, Streptococcus pneumoniae R6
aggucgcugugauaaugg

SEQ ID NO: 4096578 - RNA, 21 nt, Streptococcus pneumoniae R6
aggucugacaggcuauugaag

SEQ ID NO: 4096579 - RNA, 17 nt, Streptococcus pneumoniae R6
aggugaacuugaccuaa

SEQ ID NO: 4096580 - RNA, 16 nt, Streptococcus pneumoniae R6
aggugagauuggauuu

SEQ ID NO: 4096581 - RNA, 18 nt, Streptococcus pneumoniae R6
aggugagggcugagaagg

SEQ ID NO: 4096582 - RNA, 17 nt, Streptococcus pneumoniae R6
aggugauaucugguugc

SEQ ID NO: 4096583 - RNA, 13 nt, Streptococcus pneumoniae R6
aggugauuuacca

SEQ ID NO: 4096584 - RNA, 18 nt, Streptococcus pneumoniae R6
aggugcagagagauaaau

SEQ ID NO: 4096585 - RNA, 16 nt, Streptococcus pneumoniae R6
aggugccaguacaaua

SEQ ID NO: 4096586 - RNA, 20 nt, Streptococcus pneumoniae R6
aggugcgagccucuuuuuug

SEQ ID NO: 4096587 - RNA, 15 nt, Streptococcus pneumoniae R6
aggugcuuauuucac

SEQ ID NO: 4096588 - RNA, 14 nt, Streptococcus pneumoniae R6
agguggggcaaaaa

SEQ ID NO: 4096589 - RNA, 17 nt, Streptococcus pneumoniae R6
agguggguggguauaaa

SEQ ID NO: 4096590 - RNA, 16 nt, Streptococcus pneumoniae R6
aggugguuugaaaaug

SEQ ID NO: 4096591 - RNA, 19 nt, Streptococcus pneumoniae R6
agguguacuauucuaguuu

SEQ ID NO: 4096592 - RNA, 21 nt, Streptococcus pneumoniae R6
agguguacuguuauagauuca

SEQ ID NO: 4096593 - RNA, 13 nt, Streptococcus pneumoniae R6
agguguucaaaaa

SEQ ID NO: 4096594 - RNA, 18 nt, Streptococcus pneumoniae R6
agguuaaaaucuuuuacu

SEQ ID NO: 4096595 - RNA, 14 nt, Streptococcus pneumoniae R6
agguuaaaggaaac

SEQ ID NO: 4096596 - RNA, 18 nt, Streptococcus pneumoniae R6
agguuaacgucaaaugac

SEQ ID NO: 4096597 - RNA, 15 nt, Streptococcus pneumoniae R6
agguucaaaaaaugc

SEQ ID NO: 4096598 - RNA, 14 nt, Streptococcus pneumoniae R6
agguucaaucccca

SEQ ID NO: 4096599 - RNA, 22 nt, Streptococcus pneumoniae R6
agguucuucaaucaaagcuccc

SEQ ID NO: 4096600 - RNA, 20 nt, Streptococcus pneumoniae R6
agguugaugaguaaguuuuu

SEQ ID NO: 4096601 - RNA, 14 nt, Streptococcus pneumoniae R6
agguugcagauaaa

SEQ ID NO: 4096602 - RNA, 15 nt, Streptococcus pneumoniae R6
agguugcagaugaaa

SEQ ID NO: 4096603 - RNA, 17 nt, Streptococcus pneumoniae R6
agguugcauagaccaag

SEQ ID NO: 4096604 - RNA, 21 nt, Streptococcus pneumoniae R6
agguugcucaaaacacuguuu

SEQ ID NO: 4096605 - RNA, 18 nt, Streptococcus pneumoniae R6
agguugcucaaagcacug

SEQ ID NO: 4096606 - RNA, 17 nt, Streptococcus pneumoniae R6
agguugcucaaaguacu

SEQ ID NO: 4096607 - RNA, 19 nt, Streptococcus pneumoniae R6
agguugcucaaaguacugc

SEQ ID NO: 4096608 - RNA, 15 nt, Streptococcus pneumoniae R6
agguugguugcuucc

SEQ ID NO: 4096609 - RNA, 18 nt, Streptococcus pneumoniae R6
agguuguagauagaacug

SEQ ID NO: 4096610 - RNA, 19 nt, Streptococcus pneumoniae R6
agguuguggauagaacuga

SEQ ID NO: 4096611 - RNA, 14 nt, Streptococcus pneumoniae R6
agguuguggaugaa

SEQ ID NO: 4096612 - RNA, 19 nt, Streptococcus pneumoniae R6
agguuguggaugaaacuga

SEQ ID NO: 4096613 - RNA, 19 nt, Streptococcus pneumoniae R6
agguuguggauggaacuga

SEQ ID NO: 4096614 - RNA, 13 nt, Streptococcus pneumoniae R6
agguuucaaaacg

SEQ ID NO: 4096615 - RNA, 14 nt, Streptococcus pneumoniae R6
agguuucacagaau

SEQ ID NO: 4096616 - RNA, 18 nt, Streptococcus pneumoniae R6
agguuuccugcaugaagg

SEQ ID NO: 4096617 - RNA, 23 nt, Streptococcus pneumoniae R6
agguuuuaucugagaugaggcgc

SEQ ID NO: 4096618 - RNA, 23 nt, Streptococcus pneumoniae R6
agguuuuugaacaccugauagga

SEQ ID NO: 4096619 - RNA, 20 nt, Streptococcus pneumoniae R6
agguuuuugcaccuuacauu

SEQ ID NO: 4096620 - RNA, 14 nt, Streptococcus pneumoniae R6
aguaaaaaaagaag

SEQ ID NO: 4096621 - RNA, 13 nt, Streptococcus pneumoniae R6
aguaaaaaaagag

SEQ ID NO: 4096622 - RNA, 17 nt, Streptococcus pneumoniae R6
aguaaaaacguuuuuca

SEQ ID NO: 4096623 - RNA, 19 nt, Streptococcus pneumoniae R6
aguaaaacgcauaauauca

SEQ ID NO: 4096624 - RNA, 20 nt, Streptococcus pneumoniae R6
aguaaaacuguaugagaaac

SEQ ID NO: 4096625 - RNA, 13 nt, Streptococcus pneumoniae R6
aguaaaaugaaau

SEQ ID NO: 4096626 - RNA, 16 nt, Streptococcus pneumoniae R6
aguaaaaugaaauaag

SEQ ID NO: 4096627 - RNA, 17 nt, Streptococcus pneumoniae R6
aguaaaaugaaauaaga

SEQ ID NO: 4096628 - RNA, 22 nt, Streptococcus pneumoniae R6
aguaaacaaaggauuuugugaa

SEQ ID NO: 4096629 - RNA, 22 nt, Streptococcus pneumoniae R6
aguaaacacacuauguggcuug

SEQ ID NO: 4096630 - RNA, 16 nt, Streptococcus pneumoniae R6
aguaaaccuucccaca

SEQ ID NO: 4096631 - RNA, 15 nt, Streptococcus pneumoniae R6
aguaaacuucuucuu

SEQ ID NO: 4096632 - RNA, 18 nt, Streptococcus pneumoniae R6
aguaaacuucuucuucca

SEQ ID NO: 4096633 - RNA, 19 nt, Streptococcus pneumoniae R6
aguaaagacuagacuugcc

SEQ ID NO: 4096634 - RNA, 16 nt, Streptococcus pneumoniae R6
aguaaagggcuuuaaa

SEQ ID NO: 4096635 - RNA, 14 nt, Streptococcus pneumoniae R6
aguaaauaaaacaa

SEQ ID NO: 4096636 - RNA, 18 nt, Streptococcus pneumoniae R6
aguaaauaaaacaaaaaa

SEQ ID NO: 4096637 - RNA, 20 nt, Streptococcus pneumoniae R6
aguaaaugugagcuuugguu

SEQ ID NO: 4096638 - RNA, 21 nt, Streptococcus pneumoniae R6
aguaaaugugagcuuugguuu

SEQ ID NO: 4096639 - RNA, 14 nt, Streptococcus pneumoniae R6
aguaacaccucuuc

SEQ ID NO: 4096640 - RNA, 11 nt, Streptococcus pneumoniae R6
aguaacaucaa

SEQ ID NO: 4096641 - RNA, 16 nt, Streptococcus pneumoniae R6
aguaacaucaauaacc

SEQ ID NO: 4096642 - RNA, 17 nt, Streptococcus pneumoniae R6
aguaacaucaauaacca

SEQ ID NO: 4096643 - RNA, 14 nt, Streptococcus pneumoniae R6
aguaaccaccuacu

SEQ ID NO: 4096644 - RNA, 15 nt, Streptococcus pneumoniae R6
aguaaccaguugugg

SEQ ID NO: 4096645 - RNA, 16 nt, Streptococcus pneumoniae R6
aguaacggcuuccugu

SEQ ID NO: 4096646 - RNA, 18 nt, Streptococcus pneumoniae R6
aguaacggcuuccugugc

SEQ ID NO: 4096647 - RNA, 17 nt, Streptococcus pneumoniae R6
aguaacuaacgccaaau

SEQ ID NO: 4096648 - RNA, 21 nt, Streptococcus pneumoniae R6
aguaacuaacgccaaauccua

SEQ ID NO: 4096649 - RNA, 18 nt, Streptococcus pneumoniae R6
aguaacuucugucuauuu

SEQ ID NO: 4096650 - RNA, 22 nt, Streptococcus pneumoniae R6
aguaacuucugucuauuugcuu

SEQ ID NO: 4096651 - RNA, 23 nt, Streptococcus pneumoniae R6
aguaacuuuaccaaaaccuucuu

SEQ ID NO: 4096652 - RNA, 14 nt, Streptococcus pneumoniae R6
aguaaguagcaucu

SEQ ID NO: 4096653 - RNA, 22 nt, Streptococcus pneumoniae R6
aguaaguuuaauguccaugcuu

SEQ ID NO: 4096654 - RNA, 16 nt, Streptococcus pneumoniae R6
aguaaucauuauccaa

SEQ ID NO: 4096655 - RNA, 22 nt, Streptococcus pneumoniae R6
aguaaucauuauccaacagaga

SEQ ID NO: 4096656 - RNA, 17 nt, Streptococcus pneumoniae R6
aguaaucucaaaacagu

SEQ ID NO: 4096657 - RNA, 20 nt, Streptococcus pneumoniae R6
aguaaucugcaccugauuuc

SEQ ID NO: 4096658 - RNA, 13 nt, Streptococcus pneumoniae R6
aguaaugacuugu

SEQ ID NO: 4096659 - RNA, 23 nt, Streptococcus pneumoniae R6
aguaaugacuuguguuuuuccuu

SEQ ID NO: 4096660 - RNA, 12 nt, Streptococcus pneumoniae R6
aguaaugccagg

SEQ ID NO: 4096661 - RNA, 21 nt, Streptococcus pneumoniae R6
aguaaugggcgcauuuuccuu

SEQ ID NO: 4096662 - RNA, 15 nt, Streptococcus pneumoniae R6
agucaaagccaauca

SEQ ID NO: 4096663 - RNA, 18 nt, Streptococcus pneumoniae R6
agucaaaucaauuuuuaa

SEQ ID NO: 4096664 - RNA, 20 nt, Streptococcus pneumoniae R6
agucaaaucgauuucuaaaa

SEQ ID NO: 4096665 - RNA, 20 nt, Streptococcus pneumoniae R6
agucaaaucgauuucuaaca

SEQ ID NO: 4096666 - RNA, 12 nt, Streptococcus pneumoniae R6
agucaaauuaau

SEQ ID NO: 4096667 - RNA, 22 nt, Streptococcus pneumoniae R6
agucaaauuaauuuauagaaau

SEQ ID NO: 4096668 - RNA, 21 nt, Streptococcus pneumoniae R6
agucaagacaaggauaaaaag

SEQ ID NO: 4096669 - RNA, 22 nt, Streptococcus pneumoniae R6
agucaagacaaggauaaaaagu

SEQ ID NO: 4096670 - RNA, 14 nt, Streptococcus pneumoniae R6
agucaagaguuggg

SEQ ID NO: 4096671 - RNA, 21 nt, Streptococcus pneumoniae R6
agucaagguucuuaaccucuu

SEQ ID NO: 4096672 - RNA, 13 nt, Streptococcus pneumoniae R6
agucaagucaacu

SEQ ID NO: 4096673 - RNA, 15 nt, Streptococcus pneumoniae R6
agucaauaauccuaa

SEQ ID NO: 4096674 - RNA, 17 nt, Streptococcus pneumoniae R6
agucaaucuacuuguuc

SEQ ID NO: 4096675 - RNA, 15 nt, Streptococcus pneumoniae R6
agucaauugaaacaa

SEQ ID NO: 4096676 - RNA, 16 nt, Streptococcus pneumoniae R6
agucaauugaaacaag

SEQ ID NO: 4096677 - RNA, 18 nt, Streptococcus pneumoniae R6
agucaauuucucuacaaa

SEQ ID NO: 4096678 - RNA, 23 nt, Streptococcus pneumoniae R6
agucaauuucucuacaaauaaga

SEQ ID NO: 4096679 - RNA, 14 nt, Streptococcus pneumoniae R6
agucacauauauaa

SEQ ID NO: 4096680 - RNA, 20 nt, Streptococcus pneumoniae R6
agucagacuuggaacagucc

SEQ ID NO: 4096681 - RNA, 15 nt, Streptococcus pneumoniae R6
agucagcucaaaaca

SEQ ID NO: 4096682 - RNA, 16 nt, Streptococcus pneumoniae R6
agucagcucuuuuuug

SEQ ID NO: 4096683 - RNA, 24 nt, Streptococcus pneumoniae R6
agucagcucuuuuuugauaucuuc

SEQ ID NO: 4096684 - RNA, 19 nt, Streptococcus pneumoniae R6
agucagcugucuuuucaaa

SEQ ID NO: 4096685 - RNA, 21 nt, Streptococcus pneumoniae R6
agucagcugucuuuucaaagu

SEQ ID NO: 4096686 - RNA, 21 nt, Streptococcus pneumoniae R6
agucagugguucacuggcauu

SEQ ID NO: 4096687 - RNA, 17 nt, Streptococcus pneumoniae R6
agucauaacauucuaca

SEQ ID NO: 4096688 - RNA, 19 nt, Streptococcus pneumoniae R6
agucauaacauucuacauc

SEQ ID NO: 4096689 - RNA, 23 nt, Streptococcus pneumoniae R6
agucauagacacgguaaguggua

SEQ ID NO: 4096690 - RNA, 15 nt, Streptococcus pneumoniae R6
agucaucaauauuag

SEQ ID NO: 4096691 - RNA, 23 nt, Streptococcus pneumoniae R6
agucaucagaaaaaaggcaucca

SEQ ID NO: 4096692 - RNA, 17 nt, Streptococcus pneumoniae R6
agucaucuauaaucaau

SEQ ID NO: 4096693 - RNA, 17 nt, Streptococcus pneumoniae R6
agucaugaccccuaaau

SEQ ID NO: 4096694 - RNA, 20 nt, Streptococcus pneumoniae R6
agucaugaccccuaaauaua

SEQ ID NO: 4096695 - RNA, 23 nt, Streptococcus pneumoniae R6
agucaugaccccuaaauauaauc

SEQ ID NO: 4096696 - RNA, 22 nt, Streptococcus pneumoniae R6
agucaugagaguuuuuggcauu

SEQ ID NO: 4096697 - RNA, 19 nt, Streptococcus pneumoniae R6
agucaugcaaaaaaaauga

SEQ ID NO: 4096698 - RNA, 13 nt, Streptococcus pneumoniae R6
agucauucaaucc

SEQ ID NO: 4096699 - RNA, 17 nt, Streptococcus pneumoniae R6
agucauuccauggcuga

SEQ ID NO: 4096700 - RNA, 23 nt, Streptococcus pneumoniae R6
agucauucgaaugauuucucuug

SEQ ID NO: 4096701 - RNA, 22 nt, Streptococcus pneumoniae R6
agucauuguucuuguuuugaca

SEQ ID NO: 4096702 - RNA, 19 nt, Streptococcus pneumoniae R6
aguccaaacguccagccuu

SEQ ID NO: 4096703 - RNA, 23 nt, Streptococcus pneumoniae R6
aguccaacuguaaagacauuaua

SEQ ID NO: 4096704 - RNA, 20 nt, Streptococcus pneumoniae R6
aguccaagauucaacaucac

SEQ ID NO: 4096705 - RNA, 16 nt, Streptococcus pneumoniae R6
aguccacguuuuucca

SEQ ID NO: 4096706 - RNA, 19 nt, Streptococcus pneumoniae R6
aguccauagcgucaaagaa

SEQ ID NO: 4096707 - RNA, 23 nt, Streptococcus pneumoniae R6
aguccauauuagggcaaauaaaa

SEQ ID NO: 4096708 - RNA, 16 nt, Streptococcus pneumoniae R6
aguccauuuggcaccg

SEQ ID NO: 4096709 - RNA, 20 nt, Streptococcus pneumoniae R6
agucccauaaaacuauaauc

SEQ ID NO: 4096710 - RNA, 13 nt, Streptococcus pneumoniae R6
agucccauuuuca

SEQ ID NO: 4096711 - RNA, 14 nt, Streptococcus pneumoniae R6
agucccauuuucag

SEQ ID NO: 4096712 - RNA, 15 nt, Streptococcus pneumoniae R6
agucccauuuucaga

SEQ ID NO: 4096713 - RNA, 20 nt, Streptococcus pneumoniae R6
agucccugguaaaagagcaa

SEQ ID NO: 4096714 - RNA, 17 nt, Streptococcus pneumoniae R6
agucccuuuuaagaguu

SEQ ID NO: 4096715 - RNA, 16 nt, Streptococcus pneumoniae R6
aguccgaaaaauuucu

SEQ ID NO: 4096716 - RNA, 13 nt, Streptococcus pneumoniae R6
aguccguuuucac

SEQ ID NO: 4096717 - RNA, 13 nt, Streptococcus pneumoniae R6
aguccuaugauug

SEQ ID NO: 4096718 - RNA, 22 nt, Streptococcus pneumoniae R6
aguccucaauuugaaccugcuu

SEQ ID NO: 4096719 - RNA, 16 nt, Streptococcus pneumoniae R6
aguccucauuucaaua

SEQ ID NO: 4096720 - RNA, 17 nt, Streptococcus pneumoniae R6
aguccucccuucuuucu

SEQ ID NO: 4096721 - RNA, 22 nt, Streptococcus pneumoniae R6
aguccucguagcggauuuucaa

SEQ ID NO: 4096722 - RNA, 12 nt, Streptococcus pneumoniae R6
aguccucuuucc

SEQ ID NO: 4096723 - RNA, 19 nt, Streptococcus pneumoniae R6
aguccugcgacuacuaguu

SEQ ID NO: 4096724 - RNA, 23 nt, Streptococcus pneumoniae R6
aguccuggaaaaacguggacugg

SEQ ID NO: 4096725 - RNA, 18 nt, Streptococcus pneumoniae R6
aguccuuguaugacaucu

SEQ ID NO: 4096726 - RNA, 16 nt, Streptococcus pneumoniae R6
agucgaggaaaucccu

SEQ ID NO: 4096727 - RNA, 13 nt, Streptococcus pneumoniae R6
agucgauaaaaag

SEQ ID NO: 4096728 - RNA, 19 nt, Streptococcus pneumoniae R6
agucgcaggcgaaaucauu

SEQ ID NO: 4096729 - RNA, 13 nt, Streptococcus pneumoniae R6
agucggaaucuuu

SEQ ID NO: 4096730 - RNA, 21 nt, Streptococcus pneumoniae R6
agucguaaauaauauuauucu

SEQ ID NO: 4096731 - RNA, 16 nt, Streptococcus pneumoniae R6
agucguuaaaagcaaa

SEQ ID NO: 4096732 - RNA, 19 nt, Streptococcus pneumoniae R6
agucguucggcuucaucug

SEQ ID NO: 4096733 - RNA, 16 nt, Streptococcus pneumoniae R6
agucguucucuuauug

SEQ ID NO: 4096734 - RNA, 16 nt, Streptococcus pneumoniae R6
agucguuucaagauaa

SEQ ID NO: 4096735 - RNA, 14 nt, Streptococcus pneumoniae R6
agucuacaaauuca

SEQ ID NO: 4096736 - RNA, 19 nt, Streptococcus pneumoniae R6
agucuagcaauucuugguu

SEQ ID NO: 4096737 - RNA, 16 nt, Streptococcus pneumoniae R6
agucuauuauauauau

SEQ ID NO: 4096738 - RNA, 13 nt, Streptococcus pneumoniae R6
agucuauucuuuc

SEQ ID NO: 4096739 - RNA, 22 nt, Streptococcus pneumoniae R6
agucucuccagcgagcaaacga

SEQ ID NO: 4096740 - RNA, 22 nt, Streptococcus pneumoniae R6
agucucugucccaucauuucuu

SEQ ID NO: 4096741 - RNA, 14 nt, Streptococcus pneumoniae R6
agucugaaaaagag

SEQ ID NO: 4096742 - RNA, 17 nt, Streptococcus pneumoniae R6
agucugaaacagaggug

SEQ ID NO: 4096743 - RNA, 23 nt, Streptococcus pneumoniae R6
agucugcgccuagcuuucuaguu

SEQ ID NO: 4096744 - RNA, 15 nt, Streptococcus pneumoniae R6
agucugcuuuauagu

SEQ ID NO: 4096745 - RNA, 23 nt, Streptococcus pneumoniae R6
agucugggaaaaauuuucaaaau

SEQ ID NO: 4096746 - RNA, 15 nt, Streptococcus pneumoniae R6
agucugggugcugaa

SEQ ID NO: 4096747 - RNA, 15 nt, Streptococcus pneumoniae R6
agucuuauaguaacg

SEQ ID NO: 4096748 - RNA, 22 nt, Streptococcus pneumoniae R6
agucuuaucugcaaccucaaaa

SEQ ID NO: 4096749 - RNA, 18 nt, Streptococcus pneumoniae R6
agucuucaauacgaacac

SEQ ID NO: 4096750 - RNA, 13 nt, Streptococcus pneumoniae R6
agucuucacaauc

SEQ ID NO: 4096751 - RNA, 21 nt, Streptococcus pneumoniae R6
agucuucauguggcuaucugu

SEQ ID NO: 4096752 - RNA, 18 nt, Streptococcus pneumoniae R6
agucuuccgaauagcuca

SEQ ID NO: 4096753 - RNA, 21 nt, Streptococcus pneumoniae R6
agucuucuguacauuagaauu

SEQ ID NO: 4096754 - RNA, 19 nt, Streptococcus pneumoniae R6
agucuugacaaagaaaaaa

SEQ ID NO: 4096755 - RNA, 22 nt, Streptococcus pneumoniae R6
agucuugacaaagaaaaaacaa

SEQ ID NO: 4096756 - RNA, 16 nt, Streptococcus pneumoniae R6
agucuugcgaagugau

SEQ ID NO: 4096757 - RNA, 14 nt, Streptococcus pneumoniae R6
agucuugcucuuca

SEQ ID NO: 4096758 - RNA, 22 nt, Streptococcus pneumoniae R6
agucuuguuugagaauugcuuu

SEQ ID NO: 4096759 - RNA, 13 nt, Streptococcus pneumoniae R6
agucuuuaaaauu

SEQ ID NO: 4096760 - RNA, 20 nt, Streptococcus pneumoniae R6
agucuuucuucguuuuuacu

SEQ ID NO: 4096761 - RNA, 13 nt, Streptococcus pneumoniae R6
agucuuugauuuu

SEQ ID NO: 4096762 - RNA, 16 nt, Streptococcus pneumoniae R6
agucuuugauuuugag

SEQ ID NO: 4096763 - RNA, 19 nt, Streptococcus pneumoniae R6
agucuuuucggauggcuag

SEQ ID NO: 4096764 - RNA, 19 nt, Streptococcus pneumoniae R6
aguucaucuggaguagcau

SEQ ID NO: 4096765 - RNA, 18 nt, Streptococcus pneumoniae R6
aguucaucuucaaaauca

SEQ ID NO: 4096766 - RNA, 22 nt, Streptococcus pneumoniae R6
aguucauuuucuuuacuucuga

SEQ ID NO: 4096767 - RNA, 13 nt, Streptococcus pneumoniae R6
aguucauuuuucc

SEQ ID NO: 4096768 - RNA, 18 nt, Streptococcus pneumoniae R6
aguuccagugauuuggaa

SEQ ID NO: 4096769 - RNA, 22 nt, Streptococcus pneumoniae R6
aguuccauccacaaccuuaaaa

SEQ ID NO: 4096770 - RNA, 14 nt, Streptococcus pneumoniae R6
aguuccaucuacaa

SEQ ID NO: 4096771 - RNA, 17 nt, Streptococcus pneumoniae R6
aguuccaucuacaaccu

SEQ ID NO: 4096772 - RNA, 22 nt, Streptococcus pneumoniae R6
aguuccaucuacaaccuuaaaa

SEQ ID NO: 4096773 - RNA, 20 nt, Streptococcus pneumoniae R6
aguucccugcauuucuuuua

SEQ ID NO: 4096774 - RNA, 21 nt, Streptococcus pneumoniae R6
aguuccggaaaccaaaggcuu

SEQ ID NO: 4096775 - RNA, 23 nt, Streptococcus pneumoniae R6
aguuccuguuucaggaaguuuuu

SEQ ID NO: 4096776 - RNA, 22 nt, Streptococcus pneumoniae R6
aguucgaaaucacgcuuuucuu

SEQ ID NO: 4096777 - RNA, 15 nt, Streptococcus pneumoniae R6
aguucgaagauaucu

SEQ ID NO: 4096778 - RNA, 20 nt, Streptococcus pneumoniae R6
aguucgaugucaccaaacaa

SEQ ID NO: 4096779 - RNA, 14 nt, Streptococcus pneumoniae R6
aguucgugccaauc

SEQ ID NO: 4096780 - RNA, 20 nt, Streptococcus pneumoniae R6
aguucuauccacaaccucaa

SEQ ID NO: 4096781 - RNA, 22 nt, Streptococcus pneumoniae R6
aguucuauccacaaccucaaaa

SEQ ID NO: 4096782 - RNA, 20 nt, Streptococcus pneumoniae R6
aguucuauccacaaccuuaa

SEQ ID NO: 4096783 - RNA, 22 nt, Streptococcus pneumoniae R6
aguucuauccacaaccuuaaaa

SEQ ID NO: 4096784 - RNA, 14 nt, Streptococcus pneumoniae R6
aguucuaucuacaa

SEQ ID NO: 4096785 - RNA, 18 nt, Streptococcus pneumoniae R6
aguucuaucuacaaccuc

SEQ ID NO: 4096786 - RNA, 12 nt, Streptococcus pneumoniae R6
aguucuaucugc

SEQ ID NO: 4096787 - RNA, 14 nt, Streptococcus pneumoniae R6
aguucuaucugcaa

SEQ ID NO: 4096788 - RNA, 15 nt, Streptococcus pneumoniae R6
aguucuaucugcaac

SEQ ID NO: 4096789 - RNA, 16 nt, Streptococcus pneumoniae R6
aguucuaucugcaacc

SEQ ID NO: 4096790 - RNA, 20 nt, Streptococcus pneumoniae R6
aguucuaucugcaaccucaa

SEQ ID NO: 4096791 - RNA, 20 nt, Streptococcus pneumoniae R6
aguucuaucugcaaccuuaa

SEQ ID NO: 4096792 - RNA, 22 nt, Streptococcus pneumoniae R6
aguucuaucugcaaccuuaaaa

SEQ ID NO: 4096793 - RNA, 22 nt, Streptococcus pneumoniae R6
aguucuaucugccaccucaaaa

SEQ ID NO: 4096794 - RNA, 15 nt, Streptococcus pneumoniae R6
aguucucaaccacaa

SEQ ID NO: 4096795 - RNA, 15 nt, Streptococcus pneumoniae R6
aguucucaggaauua

SEQ ID NO: 4096796 - RNA, 12 nt, Streptococcus pneumoniae R6
aguucucuuucu

SEQ ID NO: 4096797 - RNA, 17 nt, Streptococcus pneumoniae R6
aguucucuuucuaaaau

SEQ ID NO: 4096798 - RNA, 19 nt, Streptococcus pneumoniae R6
aguucuggaugccauugga

SEQ ID NO: 4096799 - RNA, 12 nt, Streptococcus pneumoniae R6
aguucuucagaa

SEQ ID NO: 4096800 - RNA, 20 nt, Streptococcus pneumoniae R6
aguucuucauacauuucgau

SEQ ID NO: 4096801 - RNA, 21 nt, Streptococcus pneumoniae R6
aguucuucccaccauccucca

SEQ ID NO: 4096802 - RNA, 18 nt, Streptococcus pneumoniae R6
aguucuucuaguugguuu

SEQ ID NO: 4096803 - RNA, 17 nt, Streptococcus pneumoniae R6
aguucuugaaaugaagu

SEQ ID NO: 4096804 - RNA, 16 nt, Streptococcus pneumoniae R6
aguucuuuucauuguu

SEQ ID NO: 4096805 - RNA, 14 nt, Streptococcus pneumoniae R6
aguucuuuuguaaa

SEQ ID NO: 4096806 - RNA, 17 nt, Streptococcus pneumoniae R6
aguucuuuuugcugguu

SEQ ID NO: 4096807 - RNA, 12 nt, Streptococcus pneumoniae R6
aguugaaaugac

SEQ ID NO: 4096808 - RNA, 22 nt, Streptococcus pneumoniae R6
aguugaaugccuccaagaaaga

SEQ ID NO: 4096809 - RNA, 14 nt, Streptococcus pneumoniae R6
aguugacaaagagc

SEQ ID NO: 4096810 - RNA, 23 nt, Streptococcus pneumoniae R6
aguugacaaagagccauaaaaau

SEQ ID NO: 4096811 - RNA, 12 nt, Streptococcus pneumoniae R6
aguugacaaagu

SEQ ID NO: 4096812 - RNA, 21 nt, Streptococcus pneumoniae R6
aguugacgauaaauugcugga

SEQ ID NO: 4096813 - RNA, 17 nt, Streptococcus pneumoniae R6
aguugacuguguuugag

SEQ ID NO: 4096814 - RNA, 15 nt, Streptococcus pneumoniae R6
aguugauagaaagca

SEQ ID NO: 4096815 - RNA, 20 nt, Streptococcus pneumoniae R6
aguugauagaaagcaaggcu

SEQ ID NO: 4096816 - RNA, 21 nt, Streptococcus pneumoniae R6
aguugaugggauauauauaau

SEQ ID NO: 4096817 - RNA, 23 nt, Streptococcus pneumoniae R6
aguugcauugucagagucuugau

SEQ ID NO: 4096818 - RNA, 14 nt, Streptococcus pneumoniae R6
aguugcccaccugc

SEQ ID NO: 4096819 - RNA, 22 nt, Streptococcus pneumoniae R6
aguugccucagauucugacaau

SEQ ID NO: 4096820 - RNA, 18 nt, Streptococcus pneumoniae R6
aguugcuugauuacauga

SEQ ID NO: 4096821 - RNA, 17 nt, Streptococcus pneumoniae R6
aguuggagcaucugguu

SEQ ID NO: 4096822 - RNA, 15 nt, Streptococcus pneumoniae R6
aguuggcuugucuuu

SEQ ID NO: 4096823 - RNA, 23 nt, Streptococcus pneumoniae R6
aguugggauaaacguaaaaguca

SEQ ID NO: 4096824 - RNA, 21 nt, Streptococcus pneumoniae R6
aguugggugaugaguucaucu

SEQ ID NO: 4096825 - RNA, 14 nt, Streptococcus pneumoniae R6
aguugguagguaua

SEQ ID NO: 4096826 - RNA, 20 nt, Streptococcus pneumoniae R6
aguugguagguauauucuga

SEQ ID NO: 4096827 - RNA, 19 nt, Streptococcus pneumoniae R6
aguuggucauauuaaagag

SEQ ID NO: 4096828 - RNA, 17 nt, Streptococcus pneumoniae R6
aguuggugacugacuaa

SEQ ID NO: 4096829 - RNA, 14 nt, Streptococcus pneumoniae R6
aguugguuguucag

SEQ ID NO: 4096830 - RNA, 18 nt, Streptococcus pneumoniae R6
aguuguaaucuuagcaaa

SEQ ID NO: 4096831 - RNA, 19 nt, Streptococcus pneumoniae R6
aguuguaaucuuagcaaag

SEQ ID NO: 4096832 - RNA, 21 nt, Streptococcus pneumoniae R6
aguuguaaucuuagcaaagau

SEQ ID NO: 4096833 - RNA, 14 nt, Streptococcus pneumoniae R6
aguuguacaagaaa

SEQ ID NO: 4096834 - RNA, 17 nt, Streptococcus pneumoniae R6
aguugugaauuucauua

SEQ ID NO: 4096835 - RNA, 23 nt, Streptococcus pneumoniae R6
aguuguguucauuguuagcaaag

SEQ ID NO: 4096836 - RNA, 20 nt, Streptococcus pneumoniae R6
aguuguuaguucuugaaaug

SEQ ID NO: 4096837 - RNA, 18 nt, Streptococcus pneumoniae R6
aguuguuugacgucugua

SEQ ID NO: 4096838 - RNA, 22 nt, Streptococcus pneumoniae R6
aguuguuuugucgcuuuucauu

SEQ ID NO: 4096839 - RNA, 12 nt, Streptococcus pneumoniae R6
aguuuaaaacau

SEQ ID NO: 4096840 - RNA, 22 nt, Streptococcus pneumoniae R6
aguuuaaacucagguuucucua

SEQ ID NO: 4096841 - RNA, 23 nt, Streptococcus pneumoniae R6
aguuuaaacucagguuucucuac

SEQ ID NO: 4096842 - RNA, 20 nt, Streptococcus pneumoniae R6
aguuuaagagcgaugccaug

SEQ ID NO: 4096843 - RNA, 18 nt, Streptococcus pneumoniae R6
aguuuaauguccaugcuu

SEQ ID NO: 4096844 - RNA, 19 nt, Streptococcus pneumoniae R6
aguuuacaauuagccuuca

SEQ ID NO: 4096845 - RNA, 16 nt, Streptococcus pneumoniae R6
aguuuagauaaaacua

SEQ ID NO: 4096846 - RNA, 13 nt, Streptococcus pneumoniae R6
aguuuaucuagaa

SEQ ID NO: 4096847 - RNA, 13 nt, Streptococcus pneumoniae R6
aguuuaucucuug

SEQ ID NO: 4096848 - RNA, 23 nt, Streptococcus pneumoniae R6
aguuuaucucuugccuagcgauu

SEQ ID NO: 4096849 - RNA, 21 nt, Streptococcus pneumoniae R6
aguuucaauauacuauaguag

SEQ ID NO: 4096850 - RNA, 15 nt, Streptococcus pneumoniae R6
aguuucaauuugaua

SEQ ID NO: 4096851 - RNA, 22 nt, Streptococcus pneumoniae R6
aguuucagcgauuuccuugagc

SEQ ID NO: 4096852 - RNA, 17 nt, Streptococcus pneumoniae R6
aguuucauccacaaccu

SEQ ID NO: 4096853 - RNA, 22 nt, Streptococcus pneumoniae R6
aguuucauccacaaccucaaaa

SEQ ID NO: 4096854 - RNA, 22 nt, Streptococcus pneumoniae R6
aguuucaucuacaaccucaaaa

SEQ ID NO: 4096855 - RNA, 17 nt, Streptococcus pneumoniae R6
aguuuccagucaucuga

SEQ ID NO: 4096856 - RNA, 15 nt, Streptococcus pneumoniae R6
aguuuccccugccaa

SEQ ID NO: 4096857 - RNA, 15 nt, Streptococcus pneumoniae R6
aguuuccgaauaccu

SEQ ID NO: 4096858 - RNA, 23 nt, Streptococcus pneumoniae R6
aguuuccgaauaccugaaaccau

SEQ ID NO: 4096859 - RNA, 23 nt, Streptococcus pneumoniae R6
aguuucgaaaagaauuaggaaaa

SEQ ID NO: 4096860 - RNA, 19 nt, Streptococcus pneumoniae R6
aguuucgcccaaccacuuc

SEQ ID NO: 4096861 - RNA, 18 nt, Streptococcus pneumoniae R6
aguuucggcaccaauaca

SEQ ID NO: 4096862 - RNA, 16 nt, Streptococcus pneumoniae R6
aguuucggcuguucuu

SEQ ID NO: 4096863 - RNA, 15 nt, Streptococcus pneumoniae R6
aguuucuauuucauu

SEQ ID NO: 4096864 - RNA, 17 nt, Streptococcus pneumoniae R6
aguuucuauuucauuuu

SEQ ID NO: 4096865 - RNA, 11 nt, Streptococcus pneumoniae R6
aguuucuucuu

SEQ ID NO: 4096866 - RNA, 16 nt, Streptococcus pneumoniae R6
auaaagcuaaagauga

SEQ ID NO: 4096867 - RNA, 14 nt, Streptococcus pneumoniae R6
auaaaggacaaaau

SEQ ID NO: 4096868 - RNA, 16 nt, Streptococcus pneumoniae R6
auaaaggccuuggccu

SEQ ID NO: 4096869 - RNA, 16 nt, Streptococcus pneumoniae R6
auaaagguaaaaccaa

SEQ ID NO: 4096870 - RNA, 16 nt, Streptococcus pneumoniae R6
auaaaguuaugaaaaa

SEQ ID NO: 4096871 - RNA, 18 nt, Streptococcus pneumoniae R6
auaaaguuaugaaaaaga

SEQ ID NO: 4096872 - RNA, 16 nt, Streptococcus pneumoniae R6
auaaaguuucuguaau

SEQ ID NO: 4096873 - RNA, 14 nt, Streptococcus pneumoniae R6
auaaauaauuauag

SEQ ID NO: 4096874 - RNA, 11 nt, Streptococcus pneumoniae R6
auaaauacaac

SEQ ID NO: 4096875 - RNA, 13 nt, Streptococcus pneumoniae R6
auaaauacaacag

SEQ ID NO: 4096876 - RNA, 14 nt, Streptococcus pneumoniae R6
auaaauacaacagg

SEQ ID NO: 4096877 - RNA, 17 nt, Streptococcus pneumoniae R6
auaaauacuaucaauaa

SEQ ID NO: 4096878 - RNA, 15 nt, Streptococcus pneumoniae R6
auaaauauaguaaaa

SEQ ID NO: 4096879 - RNA, 18 nt, Streptococcus pneumoniae R6
auaaauauaguaaaauga

SEQ ID NO: 4096880 - RNA, 11 nt, Streptococcus pneumoniae R6
auaaaucaauu

SEQ ID NO: 4096881 - RNA, 15 nt, Streptococcus pneumoniae R6
auaaaucuucuaaau

SEQ ID NO: 4096882 - RNA, 14 nt, Streptococcus pneumoniae R6
auaaaucuugaugu

SEQ ID NO: 4096883 - RNA, 16 nt, Streptococcus pneumoniae R6
auaaaugacaggcugc

SEQ ID NO: 4096884 - RNA, 14 nt, Streptococcus pneumoniae R6
auaaaugcaaagcc

SEQ ID NO: 4096885 - RNA, 19 nt, Streptococcus pneumoniae R6
auaaauggacaaucuuaaa

SEQ ID NO: 4096886 - RNA, 17 nt, Streptococcus pneumoniae R6
auaaauguuuuagcaau

SEQ ID NO: 4096887 - RNA, 13 nt, Streptococcus pneumoniae R6
auaaauuauuucu

SEQ ID NO: 4096888 - RNA, 13 nt, Streptococcus pneumoniae R6
auaaauucauuug

SEQ ID NO: 4096889 - RNA, 16 nt, Streptococcus pneumoniae R6
auaaauugcuggagaa

SEQ ID NO: 4096890 - RNA, 22 nt, Streptococcus pneumoniae R6
auaaauugcuggagaaucauca

SEQ ID NO: 4096891 - RNA, 21 nt, Streptococcus pneumoniae R6
auaaauuucgaaaaaugcucu

SEQ ID NO: 4096892 - RNA, 16 nt, Streptococcus pneumoniae R6
auaaauuuuccagcua

SEQ ID NO: 4096893 - RNA, 18 nt, Streptococcus pneumoniae R6
auaacaagguuagucuua

SEQ ID NO: 4096894 - RNA, 22 nt, Streptococcus pneumoniae R6
auaacacccugcaugagcuguu

SEQ ID NO: 4096895 - RNA, 18 nt, Streptococcus pneumoniae R6
auaacacgagaaacaaua

SEQ ID NO: 4096896 - RNA, 15 nt, Streptococcus pneumoniae R6
auaacagagaagaaa

SEQ ID NO: 4096897 - RNA, 16 nt, Streptococcus pneumoniae R6
auaacagagaagaaau

SEQ ID NO: 4096898 - RNA, 19 nt, Streptococcus pneumoniae R6
auaacagagaagaaauucc

SEQ ID NO: 4096899 - RNA, 14 nt, Streptococcus pneumoniae R6
auaacagcauuucc

SEQ ID NO: 4096900 - RNA, 22 nt, Streptococcus pneumoniae R6
auaacagcugcgauuuuagcac

SEQ ID NO: 4096901 - RNA, 21 nt, Streptococcus pneumoniae R6
auaacaggaauuucgcuauuu

SEQ ID NO: 4096902 - RNA, 20 nt, Streptococcus pneumoniae R6
auaacaucugcuauaauagu

SEQ ID NO: 4096903 - RNA, 19 nt, Streptococcus pneumoniae R6
auaacauugacaucuguga

SEQ ID NO: 4096904 - RNA, 22 nt, Streptococcus pneumoniae R6
auaaccaaaacgccaucuucca

SEQ ID NO: 4096905 - RNA, 16 nt, Streptococcus pneumoniae R6
auaaccaaguucuaaa

SEQ ID NO: 4096906 - RNA, 17 nt, Streptococcus pneumoniae R6
auaaccaucauuuuuag

SEQ ID NO: 4096907 - RNA, 20 nt, Streptococcus pneumoniae R6
auaacccaccaagucaucaa

SEQ ID NO: 4096908 - RNA, 20 nt, Streptococcus pneumoniae R6
auaaccuuccacccagaaau

SEQ ID NO: 4096909 - RNA, 23 nt, Streptococcus pneumoniae R6
auaacgauaauccuugucgucau

SEQ ID NO: 4096910 - RNA, 16 nt, Streptococcus pneumoniae R6
auaacuaguuaauacu

SEQ ID NO: 4096911 - RNA, 14 nt, Streptococcus pneumoniae R6
auaacucaaaagcu

SEQ ID NO: 4096912 - RNA, 15 nt, Streptococcus pneumoniae R6
auaacucauaauagu

SEQ ID NO: 4096913 - RNA, 13 nt, Streptococcus pneumoniae R6
auaacuccgaacu

SEQ ID NO: 4096914 - RNA, 16 nt, Streptococcus pneumoniae R6
auaacucgaucaacaa

SEQ ID NO: 4096915 - RNA, 21 nt, Streptococcus pneumoniae R6
auaacugcgauacgaucugaa

SEQ ID NO: 4096916 - RNA, 22 nt, Streptococcus pneumoniae R6
auaacugcuaaaagauuucuau

SEQ ID NO: 4096917 - RNA, 17 nt, Streptococcus pneumoniae R6
auaacuucaauaucuuu

SEQ ID NO: 4096918 - RNA, 23 nt, Streptococcus pneumoniae R6
auaacuucacuaguauucaucuu

SEQ ID NO: 4096919 - RNA, 21 nt, Streptococcus pneumoniae R6
auaacuuguuuacguuuuaaa

SEQ ID NO: 4096920 - RNA, 13 nt, Streptococcus pneumoniae R6
auaacuuuaucca

SEQ ID NO: 4096921 - RNA, 14 nt, Streptococcus pneumoniae R6
auaacuuuauccag

SEQ ID NO: 4096922 - RNA, 12 nt, Streptococcus pneumoniae R6
auaacuuuucug

SEQ ID NO: 4096923 - RNA, 17 nt, Streptococcus pneumoniae R6
auaagaaaccgucauca

SEQ ID NO: 4096924 - RNA, 18 nt, Streptococcus pneumoniae R6
auaagaaaccgucaucag

SEQ ID NO: 4096925 - RNA, 18 nt, Streptococcus pneumoniae R6
auaagaaaggauauaaau

SEQ ID NO: 4096926 - RNA, 19 nt, Streptococcus pneumoniae R6
auaagaaauaguuuagaua

SEQ ID NO: 4096927 - RNA, 22 nt, Streptococcus pneumoniae R6
auaagaaccaauauguaggcua

SEQ ID NO: 4096928 - RNA, 14 nt, Streptococcus pneumoniae R6
auaagacaauuggu

SEQ ID NO: 4096929 - RNA, 16 nt, Streptococcus pneumoniae R6
auaagaccaaaagucg

SEQ ID NO: 4096930 - RNA, 16 nt, Streptococcus pneumoniae R6
auaagacuccucuuua

SEQ ID NO: 4096931 - RNA, 19 nt, Streptococcus pneumoniae R6
auaagacugacgaagucag

SEQ ID NO: 4096932 - RNA, 13 nt, Streptococcus pneumoniae R6
auaagacuuuucc

SEQ ID NO: 4096933 - RNA, 16 nt, Streptococcus pneumoniae R6
auaagagaagagagca

SEQ ID NO: 4096934 - RNA, 17 nt, Streptococcus pneumoniae R6
auaagagaauuaagaua

SEQ ID NO: 4096935 - RNA, 13 nt, Streptococcus pneumoniae R6
auaagagcaacaa

SEQ ID NO: 4096936 - RNA, 17 nt, Streptococcus pneumoniae R6
auaagagcaacaaauau

SEQ ID NO: 4096937 - RNA, 18 nt, Streptococcus pneumoniae R6
auaagagcaacaaauaug

SEQ ID NO: 4096938 - RNA, 18 nt, Streptococcus pneumoniae R6
auaagaggucugaaacua

SEQ ID NO: 4096939 - RNA, 16 nt, Streptococcus pneumoniae R6
auaagauaucacucau

SEQ ID NO: 4096940 - RNA, 22 nt, Streptococcus pneumoniae R6
auaagaugacaucuaaauaaua

SEQ ID NO: 4096941 - RNA, 17 nt, Streptococcus pneumoniae R6
auaagaugagaacaaau

SEQ ID NO: 4096942 - RNA, 13 nt, Streptococcus pneumoniae R6
auaagauuuuugg

SEQ ID NO: 4096943 - RNA, 19 nt, Streptococcus pneumoniae R6
auaagauuuuuggaaaaaa

SEQ ID NO: 4096944 - RNA, 20 nt, Streptococcus pneumoniae R6
auaagauuuuuggaaaaaau

SEQ ID NO: 4096945 - RNA, 22 nt, Streptococcus pneumoniae R6
auaagauuuuuggaaaaaauaa

SEQ ID NO: 4096946 - RNA, 18 nt, Streptococcus pneumoniae R6
auaagcccaaaucaucag

SEQ ID NO: 4096947 - RNA, 17 nt, Streptococcus pneumoniae R6
auaagccggcuugucuu

SEQ ID NO: 4096948 - RNA, 15 nt, Streptococcus pneumoniae R6
auaagcgauugagaa

SEQ ID NO: 4096949 - RNA, 19 nt, Streptococcus pneumoniae R6
auaagcuacauagagauug

SEQ ID NO: 4096950 - RNA, 17 nt, Streptococcus pneumoniae R6
auaagcuugugaaagcu

SEQ ID NO: 4096951 - RNA, 18 nt, Streptococcus pneumoniae R6
auaagcuuguuaccugau

SEQ ID NO: 4096952 - RNA, 20 nt, Streptococcus pneumoniae R6
auaagcuuguuaccugauaa

SEQ ID NO: 4096953 - RNA, 19 nt, Streptococcus pneumoniae R6
auaagcuuugaaaauucca

SEQ ID NO: 4096954 - RNA, 17 nt, Streptococcus pneumoniae R6
auaaggaagucuguuau

SEQ ID NO: 4096955 - RNA, 23 nt, Streptococcus pneumoniae R6
auaaggaagucuguuauuucuug

SEQ ID NO: 4096956 - RNA, 17 nt, Streptococcus pneumoniae R6
auaaggaauuuuagaag

SEQ ID NO: 4096957 - RNA, 16 nt, Streptococcus pneumoniae R6
auaaggacaggugcuu

SEQ ID NO: 4096958 - RNA, 21 nt, Streptococcus pneumoniae R6
auaaggcaucuuaacauucuc

SEQ ID NO: 4096959 - RNA, 17 nt, Streptococcus pneumoniae R6
auaagguaauugaagag

SEQ ID NO: 4096960 - RNA, 19 nt, Streptococcus pneumoniae R6
auaagguacagacgauuaa

SEQ ID NO: 4096961 - RNA, 19 nt, Streptococcus pneumoniae R6
auaagguaccuccuaaucc

SEQ ID NO: 4096962 - RNA, 13 nt, Streptococcus pneumoniae R6
auaagguuacuuu

SEQ ID NO: 4096963 - RNA, 17 nt, Streptococcus pneumoniae R6
auaaguaccaaucccau

SEQ ID NO: 4096964 - RNA, 14 nt, Streptococcus pneumoniae R6
auaagucagcucac

SEQ ID NO: 4096965 - RNA, 18 nt, Streptococcus pneumoniae R6
auaagucauaacauucua

SEQ ID NO: 4096966 - RNA, 16 nt, Streptococcus pneumoniae R6
auaagucucagcaguc

SEQ ID NO: 4096967 - RNA, 18 nt, Streptococcus pneumoniae R6
auaaguuagaauauguaa

SEQ ID NO: 4096968 - RNA, 13 nt, Streptococcus pneumoniae R6
auaaguuuagaau

SEQ ID NO: 4096969 - RNA, 16 nt, Streptococcus pneumoniae R6
auacauuuuuucugaa

SEQ ID NO: 4096970 - RNA, 18 nt, Streptococcus pneumoniae R6
auacauuuuuucugaaga

SEQ ID NO: 4096971 - RNA, 14 nt, Streptococcus pneumoniae R6
auaccaaaaaaacu

SEQ ID NO: 4096972 - RNA, 13 nt, Streptococcus pneumoniae R6
auaccaaagaagu

SEQ ID NO: 4096973 - RNA, 15 nt, Streptococcus pneumoniae R6
auaccaaagaaguca

SEQ ID NO: 4096974 - RNA, 12 nt, Streptococcus pneumoniae R6
auaccaaccagu

SEQ ID NO: 4096975 - RNA, 20 nt, Streptococcus pneumoniae R6
auaccaagcucagcauuuuu

SEQ ID NO: 4096976 - RNA, 22 nt, Streptococcus pneumoniae R6
auaccaaggauugucugaacug

SEQ ID NO: 4096977 - RNA, 20 nt, Streptococcus pneumoniae R6
auaccaccagacauaucuuu

SEQ ID NO: 4096978 - RNA, 13 nt, Streptococcus pneumoniae R6
auaccagagcgac

SEQ ID NO: 4096979 - RNA, 23 nt, Streptococcus pneumoniae R6
auaccagagguagcuuagaaaua

SEQ ID NO: 4096980 - RNA, 21 nt, Streptococcus pneumoniae R6
auaccagaugagacgagcagu

SEQ ID NO: 4096981 - RNA, 13 nt, Streptococcus pneumoniae R6
auaccagcaauca

SEQ ID NO: 4096982 - RNA, 22 nt, Streptococcus pneumoniae R6
auaccagucguuucaagauaag

SEQ ID NO: 4096983 - RNA, 13 nt, Streptococcus pneumoniae R6
auaccaguuuuug

SEQ ID NO: 4096984 - RNA, 16 nt, Streptococcus pneumoniae R6
auaccauagagcggac

SEQ ID NO: 4096985 - RNA, 16 nt, Streptococcus pneumoniae R6
auaccauauccuuuca

SEQ ID NO: 4096986 - RNA, 22 nt, Streptococcus pneumoniae R6
auaccaucuaacucauagcaga

SEQ ID NO: 4096987 - RNA, 12 nt, Streptococcus pneumoniae R6
auaccauuuucc

SEQ ID NO: 4096988 - RNA, 14 nt, Streptococcus pneumoniae R6
auaccauuuuccaa

SEQ ID NO: 4096989 - RNA, 14 nt, Streptococcus pneumoniae R6
auacccaaaacaca

SEQ ID NO: 4096990 - RNA, 14 nt, Streptococcus pneumoniae R6
auaccuaaucuuuc

SEQ ID NO: 4096991 - RNA, 23 nt, Streptococcus pneumoniae R6
auaccugaaaccauuagauuuca

SEQ ID NO: 4096992 - RNA, 16 nt, Streptococcus pneumoniae R6
auaccuucuuuaucau

SEQ ID NO: 4096993 - RNA, 13 nt, Streptococcus pneumoniae R6
auacgaaaaguag

SEQ ID NO: 4096994 - RNA, 18 nt, Streptococcus pneumoniae R6
auacgaaaucauaagagg

SEQ ID NO: 4096995 - RNA, 20 nt, Streptococcus pneumoniae R6
auacgacgauuccguuugag

SEQ ID NO: 4096996 - RNA, 16 nt, Streptococcus pneumoniae R6
auacgaucugaaauaa

SEQ ID NO: 4096997 - RNA, 15 nt, Streptococcus pneumoniae R6
auacgaugaccaaga

SEQ ID NO: 4096998 - RNA, 17 nt, Streptococcus pneumoniae R6
auacgaugaccaagaug

SEQ ID NO: 4096999 - RNA, 15 nt, Streptococcus pneumoniae R6
auacgcucagcugau

SEQ ID NO: 4097000 - RNA, 20 nt, Streptococcus pneumoniae R6
auacggucaaucaacuucca

SEQ ID NO: 4097001 - RNA, 12 nt, Streptococcus pneumoniae R6
auacuaaaaaaa

SEQ ID NO: 4097002 - RNA, 18 nt, Streptococcus pneumoniae R6
auacuaauacauuuugua

SEQ ID NO: 4097003 - RNA, 19 nt, Streptococcus pneumoniae R6
auacuaauacauuuuguaa

SEQ ID NO: 4097004 - RNA, 22 nt, Streptococcus pneumoniae R6
auacuagauggcuaacuucauu

SEQ ID NO: 4097005 - RNA, 17 nt, Streptococcus pneumoniae R6
auacuagauucuauuuu

SEQ ID NO: 4097006 - RNA, 19 nt, Streptococcus pneumoniae R6
auacuagauucuauuuuuu

SEQ ID NO: 4097007 - RNA, 13 nt, Streptococcus pneumoniae R6
auacuauaaaaca

SEQ ID NO: 4097008 - RNA, 15 nt, Streptococcus pneumoniae R6
auacuaucaauaaaa

SEQ ID NO: 4097009 - RNA, 19 nt, Streptococcus pneumoniae R6
auacuaugcguuuucuaau

SEQ ID NO: 4097010 - RNA, 15 nt, Streptococcus pneumoniae R6
auacuaugcuuuuuu

SEQ ID NO: 4097011 - RNA, 21 nt, Streptococcus pneumoniae R6
auacuauggcaucuaguaaau

SEQ ID NO: 4097012 - RNA, 21 nt, Streptococcus pneumoniae R6
auacucaaucccauauuuuuc

SEQ ID NO: 4097013 - RNA, 14 nt, Streptococcus pneumoniae R6
auacucaaugaaaa

SEQ ID NO: 4097014 - RNA, 21 nt, Streptococcus pneumoniae R6
auacucaaugaaaaucaaagu

SEQ ID NO: 4097015 - RNA, 16 nt, Streptococcus pneumoniae R6
auacucauaaagucuu

SEQ ID NO: 4097016 - RNA, 12 nt, Streptococcus pneumoniae R6
auacucaucugc

SEQ ID NO: 4097017 - RNA, 21 nt, Streptococcus pneumoniae R6
auacucaucuguuuucaaaaa

SEQ ID NO: 4097018 - RNA, 13 nt, Streptococcus pneumoniae R6
auacuccauaaaa

SEQ ID NO: 4097019 - RNA, 18 nt, Streptococcus pneumoniae R6
auacucugugaaaaucau

SEQ ID NO: 4097020 - RNA, 20 nt, Streptococcus pneumoniae R6
auacucuucaaaaaucucuu

SEQ ID NO: 4097021 - RNA, 21 nt, Streptococcus pneumoniae R6
auacucuucgaaaaucucuuc

SEQ ID NO: 4097022 - RNA, 13 nt, Streptococcus pneumoniae R6
auacucuuuacuu

SEQ ID NO: 4097023 - RNA, 15 nt, Streptococcus pneumoniae R6
auacugaaacaacau

SEQ ID NO: 4097024 - RNA, 22 nt, Streptococcus pneumoniae R6
auacugaaacaacaucuuucca

SEQ ID NO: 4097025 - RNA, 15 nt, Streptococcus pneumoniae R6
auacugaauuuagaa

SEQ ID NO: 4097026 - RNA, 15 nt, Streptococcus pneumoniae R6
auacugacuuccugu

SEQ ID NO: 4097027 - RNA, 13 nt, Streptococcus pneumoniae R6
auacugauaaaaa

SEQ ID NO: 4097028 - RNA, 22 nt, Streptococcus pneumoniae R6
auacugaucaaaaaauuucauu

SEQ ID NO: 4097029 - RNA, 15 nt, Streptococcus pneumoniae R6
auacugccaagauag

SEQ ID NO: 4097030 - RNA, 17 nt, Streptococcus pneumoniae R6
auacugcccugaaaucc

SEQ ID NO: 4097031 - RNA, 21 nt, Streptococcus pneumoniae R6
auacugcccugaaaucccaua

SEQ ID NO: 4097032 - RNA, 17 nt, Streptococcus pneumoniae R6
auacugcucgguaaaac

SEQ ID NO: 4097033 - RNA, 21 nt, Streptococcus pneumoniae R6
auacugggcacggugauuuuu

SEQ ID NO: 4097034 - RNA, 16 nt, Streptococcus pneumoniae R6
auacuguacguuuuau

SEQ ID NO: 4097035 - RNA, 21 nt, Streptococcus pneumoniae R6
auacuguauuuuuuuugguuu

SEQ ID NO: 4097036 - RNA, 15 nt, Streptococcus pneumoniae R6
auacuuagauuuucu

SEQ ID NO: 4097037 - RNA, 14 nt, Streptococcus pneumoniae R6
auacuuauccuuuu

SEQ ID NO: 4097038 - RNA, 20 nt, Streptococcus pneumoniae R6
auacuuauccuuuuuuacuu

SEQ ID NO: 4097039 - RNA, 19 nt, Streptococcus pneumoniae R6
auacuugauuuuugccaua

SEQ ID NO: 4097040 - RNA, 21 nt, Streptococcus pneumoniae R6
auacuugauuuuugccauaua

SEQ ID NO: 4097041 - RNA, 24 nt, Streptococcus pneumoniae R6
auacuugauuuuugccauauagca

SEQ ID NO: 4097042 - RNA, 15 nt, Streptococcus pneumoniae R6
auacuugcaaacuuu

SEQ ID NO: 4097043 - RNA, 13 nt, Streptococcus pneumoniae R6
auacuuggagaac

SEQ ID NO: 4097044 - RNA, 21 nt, Streptococcus pneumoniae R6
auacuuucucugacuuuucca

SEQ ID NO: 4097045 - RNA, 16 nt, Streptococcus pneumoniae R6
auacuuuuaauauuuc

SEQ ID NO: 4097046 - RNA, 13 nt, Streptococcus pneumoniae R6
auacuuuucucuu

SEQ ID NO: 4097047 - RNA, 18 nt, Streptococcus pneumoniae R6
auacuuuuucaguuuuag

SEQ ID NO: 4097048 - RNA, 24 nt, Streptococcus pneumoniae R6
auacuuuuucaguuuuagauugcu

SEQ ID NO: 4097049 - RNA, 13 nt, Streptococcus pneumoniae R6
auacuuuuuccug

SEQ ID NO: 4097050 - RNA, 23 nt, Streptococcus pneumoniae R6
auacuuuuucguuugguaagagu

SEQ ID NO: 4097051 - RNA, 20 nt, Streptococcus pneumoniae R6
auacuuuuucuuccuuucuc

SEQ ID NO: 4097052 - RNA, 22 nt, Streptococcus pneumoniae R6
auacuuuuucuuccuuucucug

SEQ ID NO: 4097053 - RNA, 22 nt, Streptococcus pneumoniae R6
auagaaaaaucccccaagcauu

SEQ ID NO: 4097054 - RNA, 14 nt, Streptococcus pneumoniae R6
auagaaaacaacuu

SEQ ID NO: 4097055 - RNA, 22 nt, Streptococcus pneumoniae R6
auagaaaacaacuuauaaaaaa

SEQ ID NO: 4097056 - RNA, 16 nt, Streptococcus pneumoniae R6
auagaaaaggaguaga

SEQ ID NO: 4097057 - RNA, 21 nt, Streptococcus pneumoniae R6
auagaaaaggaguagaaaaug

SEQ ID NO: 4097058 - RNA, 20 nt, Streptococcus pneumoniae R6
auagaaaaugguuccaaaag

SEQ ID NO: 4097059 - RNA, 18 nt, Streptococcus pneumoniae R6
auagaaagauuugcugga

SEQ ID NO: 4097060 - RNA, 14 nt, Streptococcus pneumoniae R6
auagaaagcuuaca

SEQ ID NO: 4097061 - RNA, 15 nt, Streptococcus pneumoniae R6
auagaaauauuuuag

SEQ ID NO: 4097062 - RNA, 19 nt, Streptococcus pneumoniae R6
auagaaaucacgacuuucu

SEQ ID NO: 4097063 - RNA, 23 nt, Streptococcus pneumoniae R6
auagaaauuaauuuuacuuuccc

SEQ ID NO: 4097064 - RNA, 17 nt, Streptococcus pneumoniae R6
auagaaccgauacgaug

SEQ ID NO: 4097065 - RNA, 11 nt, Streptococcus pneumoniae R6
auagaacugac

SEQ ID NO: 4097066 - RNA, 21 nt, Streptococcus pneumoniae R6
auagaacugacgaagucaguc

SEQ ID NO: 4097067 - RNA, 21 nt, Streptococcus pneumoniae R6
auagaaggucaagagaaaacc

SEQ ID NO: 4097068 - RNA, 15 nt, Streptococcus pneumoniae R6
auagaaguacuaaug

SEQ ID NO: 4097069 - RNA, 14 nt, Streptococcus pneumoniae R6
auagaauaauuugg

SEQ ID NO: 4097070 - RNA, 13 nt, Streptococcus pneumoniae R6
auagaauagcaga

SEQ ID NO: 4097071 - RNA, 16 nt, Streptococcus pneumoniae R6
auagaauccauuuguu

SEQ ID NO: 4097072 - RNA, 17 nt, Streptococcus pneumoniae R6
auaguaucaaaugacua

SEQ ID NO: 4097073 - RNA, 21 nt, Streptococcus pneumoniae R6
auaguaucaagguuuuucugu

SEQ ID NO: 4097074 - RNA, 13 nt, Streptococcus pneumoniae R6
auaguaucaaguu

SEQ ID NO: 4097075 - RNA, 17 nt, Streptococcus pneumoniae R6
auaguaucugaugcuga

SEQ ID NO: 4097076 - RNA, 19 nt, Streptococcus pneumoniae R6
auaguaucugaugcugaca

SEQ ID NO: 4097077 - RNA, 14 nt, Streptococcus pneumoniae R6
auagucaagcucuu

SEQ ID NO: 4097078 - RNA, 22 nt, Streptococcus pneumoniae R6
auagucaauugaaacaagaaca

SEQ ID NO: 4097079 - RNA, 21 nt, Streptococcus pneumoniae R6
auagucauguagcgcuugaaa

SEQ ID NO: 4097080 - RNA, 23 nt, Streptococcus pneumoniae R6
auagucauuccauggcugacaac

SEQ ID NO: 4097081 - RNA, 19 nt, Streptococcus pneumoniae R6
auagucgauaaaaagguug

SEQ ID NO: 4097082 - RNA, 21 nt, Streptococcus pneumoniae R6
auagucuaauagauaguuaaa

SEQ ID NO: 4097083 - RNA, 22 nt, Streptococcus pneumoniae R6
auaguggaccgaaucugaaaua

SEQ ID NO: 4097084 - RNA, 14 nt, Streptococcus pneumoniae R6
auagugguguuuca

SEQ ID NO: 4097085 - RNA, 19 nt, Streptococcus pneumoniae R6
auagugugggacuccuaca

SEQ ID NO: 4097086 - RNA, 14 nt, Streptococcus pneumoniae R6
auaguguuucucug

SEQ ID NO: 4097087 - RNA, 15 nt, Streptococcus pneumoniae R6
auaguuaaaaaagau

SEQ ID NO: 4097088 - RNA, 22 nt, Streptococcus pneumoniae R6
auaguuaaauguaguuggauuu

SEQ ID NO: 4097089 - RNA, 22 nt, Streptococcus pneumoniae R6
auaguuacuccuuuuuugacuc

SEQ ID NO: 4097090 - RNA, 12 nt, Streptococcus pneumoniae R6
auaguucguuga

SEQ ID NO: 4097091 - RNA, 20 nt, Streptococcus pneumoniae R6
auaguucucaaccacaaaaa

SEQ ID NO: 4097092 - RNA, 17 nt, Streptococcus pneumoniae R6
auaguuugcaaauuauu

SEQ ID NO: 4097093 - RNA, 13 nt, Streptococcus pneumoniae R6
auaguuuugauua

SEQ ID NO: 4097094 - RNA, 19 nt, Streptococcus pneumoniae R6
auauaaaaaagcaagacca

SEQ ID NO: 4097095 - RNA, 14 nt, Streptococcus pneumoniae R6
auauaaaaagaccg

SEQ ID NO: 4097096 - RNA, 23 nt, Streptococcus pneumoniae R6
auauaaagagcacugcuagcauc

SEQ ID NO: 4097097 - RNA, 13 nt, Streptococcus pneumoniae R6
auauaaauacaac

SEQ ID NO: 4097098 - RNA, 16 nt, Streptococcus pneumoniae R6
auauaaauacaacagg

SEQ ID NO: 4097099 - RNA, 18 nt, Streptococcus pneumoniae R6
auauaaauacaacaggaa

SEQ ID NO: 4097100 - RNA, 21 nt, Streptococcus pneumoniae R6
auauaaauacaacaggaaaag

SEQ ID NO: 4097101 - RNA, 13 nt, Streptococcus pneumoniae R6
auauaaaugaaaa

SEQ ID NO: 4097102 - RNA, 13 nt, Streptococcus pneumoniae R6
auauaagaauauc

SEQ ID NO: 4097103 - RNA, 16 nt, Streptococcus pneumoniae R6
auauaaggaccaaaua

SEQ ID NO: 4097104 - RNA, 15 nt, Streptococcus pneumoniae R6
auauaauagauugaa

SEQ ID NO: 4097105 - RNA, 18 nt, Streptococcus pneumoniae R6
auauaauagauugaaacu

SEQ ID NO: 4097106 - RNA, 15 nt, Streptococcus pneumoniae R6
auauaauaucucuuu

SEQ ID NO: 4097107 - RNA, 14 nt, Streptococcus pneumoniae R6
auauaaucagguug

SEQ ID NO: 4097108 - RNA, 18 nt, Streptococcus pneumoniae R6
auauaauggcuucauuau

SEQ ID NO: 4097109 - RNA, 19 nt, Streptococcus pneumoniae R6
auauaauuguaggaaagaa

SEQ ID NO: 4097110 - RNA, 15 nt, Streptococcus pneumoniae R6
auauacacacuuaaa

SEQ ID NO: 4097111 - RNA, 20 nt, Streptococcus pneumoniae R6
auauacaggggauugauuau

SEQ ID NO: 4097112 - RNA, 20 nt, Streptococcus pneumoniae R6
auauacguuuucuugugaga

SEQ ID NO: 4097113 - RNA, 22 nt, Streptococcus pneumoniae R6
auauacuugauauaguuaaaaa

SEQ ID NO: 4097114 - RNA, 14 nt, Streptococcus pneumoniae R6
auauagaauuuuag

SEQ ID NO: 4097115 - RNA, 14 nt, Streptococcus pneumoniae R6
auauagaguauuuc

SEQ ID NO: 4097116 - RNA, 14 nt, Streptococcus pneumoniae R6
auauagauaaaaaa

SEQ ID NO: 4097117 - RNA, 16 nt, Streptococcus pneumoniae R6
auauagauaaaaaaca

SEQ ID NO: 4097118 - RNA, 20 nt, Streptococcus pneumoniae R6
auauagauggucaaaauauu

SEQ ID NO: 4097119 - RNA, 19 nt, Streptococcus pneumoniae R6
auauagcauacugaauuua

SEQ ID NO: 4097120 - RNA, 21 nt, Streptococcus pneumoniae R6
auauagccuguaaaaagugaa

SEQ ID NO: 4097121 - RNA, 17 nt, Streptococcus pneumoniae R6
auauaggcauaucugau

SEQ ID NO: 4097122 - RNA, 15 nt, Streptococcus pneumoniae R6
auauaguaaaaugaa

SEQ ID NO: 4097123 - RNA, 18 nt, Streptococcus pneumoniae R6
auauaguagauugaaaua

SEQ ID NO: 4097124 - RNA, 22 nt, Streptococcus pneumoniae R6
auauaguagauugaaauaagau

SEQ ID NO: 4097125 - RNA, 14 nt, Streptococcus pneumoniae R6
auauagucuauuga

SEQ ID NO: 4097126 - RNA, 15 nt, Streptococcus pneumoniae R6
auauaguuaaaaaag

SEQ ID NO: 4097127 - RNA, 12 nt, Streptococcus pneumoniae R6
auauauaaaaag

SEQ ID NO: 4097128 - RNA, 14 nt, Streptococcus pneumoniae R6
auauauaaaugaaa

SEQ ID NO: 4097129 - RNA, 15 nt, Streptococcus pneumoniae R6
auauauaaaugaaaa

SEQ ID NO: 4097130 - RNA, 21 nt, Streptococcus pneumoniae R6
auauauaaggauauucagaaa

SEQ ID NO: 4097131 - RNA, 15 nt, Streptococcus pneumoniae R6
auauauaauuauaua

SEQ ID NO: 4097132 - RNA, 17 nt, Streptococcus pneumoniae R6
auauauccauucuuaaa

SEQ ID NO: 4097133 - RNA, 19 nt, Streptococcus pneumoniae R6
auauaucugcagaauacuc

SEQ ID NO: 4097134 - RNA, 13 nt, Streptococcus pneumoniae R6
auauaugagaagu

SEQ ID NO: 4097135 - RNA, 15 nt, Streptococcus pneumoniae R6
auauaugcacagaca

SEQ ID NO: 4097136 - RNA, 20 nt, Streptococcus pneumoniae R6
auauaugcacagacauauga

SEQ ID NO: 4097137 - RNA, 13 nt, Streptococcus pneumoniae R6
auauauuauauau

SEQ ID NO: 4097138 - RNA, 15 nt, Streptococcus pneumoniae R6
auauauucuccagcu

SEQ ID NO: 4097139 - RNA, 22 nt, Streptococcus pneumoniae R6
auauauuggguaaagauauuuu

SEQ ID NO: 4097140 - RNA, 16 nt, Streptococcus pneumoniae R6
auaucaaaaaaagaag

SEQ ID NO: 4097141 - RNA, 19 nt, Streptococcus pneumoniae R6
auaucaaaaccaaacucac

SEQ ID NO: 4097142 - RNA, 18 nt, Streptococcus pneumoniae R6
auaucaaaaccaguccuu

SEQ ID NO: 4097143 - RNA, 15 nt, Streptococcus pneumoniae R6
auaucaagguuuuug

SEQ ID NO: 4097144 - RNA, 13 nt, Streptococcus pneumoniae R6
auaucaaguuuuc

SEQ ID NO: 4097145 - RNA, 14 nt, Streptococcus pneumoniae R6
auaucaaguuuuca

SEQ ID NO: 4097146 - RNA, 13 nt, Streptococcus pneumoniae R6
auaucaaucucug

SEQ ID NO: 4097147 - RNA, 14 nt, Streptococcus pneumoniae R6
auaucaaucucugc

SEQ ID NO: 4097148 - RNA, 21 nt, Streptococcus pneumoniae R6
auaucaccaaacucgaucuga

SEQ ID NO: 4097149 - RNA, 13 nt, Streptococcus pneumoniae R6
auaucaccaucaa

SEQ ID NO: 4097150 - RNA, 23 nt, Streptococcus pneumoniae R6
auaucacgauacuguaguuuuuc

SEQ ID NO: 4097151 - RNA, 18 nt, Streptococcus pneumoniae R6
auaucacggcauuucugc

SEQ ID NO: 4097152 - RNA, 19 nt, Streptococcus pneumoniae R6
auaucacuuuauaguuuuc

SEQ ID NO: 4097153 - RNA, 18 nt, Streptococcus pneumoniae R6
auaucagauauucuaaaa

SEQ ID NO: 4097154 - RNA, 20 nt, Streptococcus pneumoniae R6
auaucagccagagcaccaac

SEQ ID NO: 4097155 - RNA, 19 nt, Streptococcus pneumoniae R6
auaucauaacacuauuaaa

SEQ ID NO: 4097156 - RNA, 17 nt, Streptococcus pneumoniae R6
auaucauaaugagcucc

SEQ ID NO: 4097157 - RNA, 17 nt, Streptococcus pneumoniae R6
auaucauauagauaaaa

SEQ ID NO: 4097158 - RNA, 21 nt, Streptococcus pneumoniae R6
auaucauauagauaaaaaaca

SEQ ID NO: 4097159 - RNA, 22 nt, Streptococcus pneumoniae R6
auaucaucgcuuggaaguuuuc

SEQ ID NO: 4097160 - RNA, 16 nt, Streptococcus pneumoniae R6
auaucaugcuuuacua

SEQ ID NO: 4097161 - RNA, 21 nt, Streptococcus pneumoniae R6
auaucauguuucaacauguca

SEQ ID NO: 4097162 - RNA, 14 nt, Streptococcus pneumoniae R6
auaucauuaaguaa

SEQ ID NO: 4097163 - RNA, 15 nt, Streptococcus pneumoniae R6
auaucauuaaguaau

SEQ ID NO: 4097164 - RNA, 22 nt, Streptococcus pneumoniae R6
auaucauuaaguaaucucugau

SEQ ID NO: 4097165 - RNA, 17 nt, Streptococcus pneumoniae R6
auauccagcuuucuagc

SEQ ID NO: 4097166 - RNA, 16 nt, Streptococcus pneumoniae R6
auauccuccuucacca

SEQ ID NO: 4097167 - RNA, 20 nt, Streptococcus pneumoniae R6
auauccuccuucaccaauca

SEQ ID NO: 4097168 - RNA, 16 nt, Streptococcus pneumoniae R6
auauccucuucacugu

SEQ ID NO: 4097169 - RNA, 16 nt, Streptococcus pneumoniae R6
auauccugucuauaca

SEQ ID NO: 4097170 - RNA, 17 nt, Streptococcus pneumoniae R6
auauccuuauauaucca

SEQ ID NO: 4097171 - RNA, 14 nt, Streptococcus pneumoniae R6
auauccuuguucau

SEQ ID NO: 4097172 - RNA, 22 nt, Streptococcus pneumoniae R6
auauccuuuuccaagaccuuaa

SEQ ID NO: 4097173 - RNA, 15 nt, Streptococcus pneumoniae R6
auaucguuauuagca

SEQ ID NO: 4097174 - RNA, 14 nt, Streptococcus pneumoniae R6
auaucuaauaauuu

SEQ ID NO: 4097175 - RNA, 12 nt, Streptococcus pneumoniae R6
aucaaagagcaa

SEQ ID NO: 4097176 - RNA, 13 nt, Streptococcus pneumoniae R6
aucaaagagcaaa

SEQ ID NO: 4097177 - RNA, 17 nt, Streptococcus pneumoniae R6
aucaaagagcaaacuag

SEQ ID NO: 4097178 - RNA, 20 nt, Streptococcus pneumoniae R6
aucaaagagcaaacuagaaa

SEQ ID NO: 4097179 - RNA, 16 nt, Streptococcus pneumoniae R6
aucaaaggucucuucu

SEQ ID NO: 4097180 - RNA, 20 nt, Streptococcus pneumoniae R6
aucaaaguuggucauauuaa

SEQ ID NO: 4097181 - RNA, 21 nt, Streptococcus pneumoniae R6
aucaaaguuggucauauuaaa

SEQ ID NO: 4097182 - RNA, 16 nt, Streptococcus pneumoniae R6
aucaaaucccuagcuc

SEQ ID NO: 4097183 - RNA, 22 nt, Streptococcus pneumoniae R6
aucaaauccugccucaauccuu

SEQ ID NO: 4097184 - RNA, 17 nt, Streptococcus pneumoniae R6
aucaaauccuucagcuu

SEQ ID NO: 4097185 - RNA, 18 nt, Streptococcus pneumoniae R6
aucaaaucgauaaagaag

SEQ ID NO: 4097186 - RNA, 21 nt, Streptococcus pneumoniae R6
aucaaauugugcaguuuucau

SEQ ID NO: 4097187 - RNA, 17 nt, Streptococcus pneumoniae R6
aucaaauuuauucagac

SEQ ID NO: 4097188 - RNA, 20 nt, Streptococcus pneumoniae R6
aucaacagcuccauaacaau

SEQ ID NO: 4097189 - RNA, 22 nt, Streptococcus pneumoniae R6
aucaacagcuccauaacaauag

SEQ ID NO: 4097190 - RNA, 13 nt, Streptococcus pneumoniae R6
aucaacaguaacg

SEQ ID NO: 4097191 - RNA, 22 nt, Streptococcus pneumoniae R6
aucaacaugagaauacaaaaau

SEQ ID NO: 4097192 - RNA, 17 nt, Streptococcus pneumoniae R6
aucaaccacuuaacaac

SEQ ID NO: 4097193 - RNA, 22 nt, Streptococcus pneumoniae R6
aucaaccgugcagucuuuuugc

SEQ ID NO: 4097194 - RNA, 19 nt, Streptococcus pneumoniae R6
aucaaccuuucucagauaa

SEQ ID NO: 4097195 - RNA, 13 nt, Streptococcus pneumoniae R6
aucaacuauucuu

SEQ ID NO: 4097196 - RNA, 16 nt, Streptococcus pneumoniae R6
aucaacuauucuuuuu

SEQ ID NO: 4097197 - RNA, 12 nt, Streptococcus pneumoniae R6
aucaacugccug

SEQ ID NO: 4097198 - RNA, 18 nt, Streptococcus pneumoniae R6
aucaacugcuguuuucau

SEQ ID NO: 4097199 - RNA, 15 nt, Streptococcus pneumoniae R6
aucaagacagauuug

SEQ ID NO: 4097200 - RNA, 19 nt, Streptococcus pneumoniae R6
aucaagacagauuugacgu

SEQ ID NO: 4097201 - RNA, 14 nt, Streptococcus pneumoniae R6
aucaagacccaagu

SEQ ID NO: 4097202 - RNA, 20 nt, Streptococcus pneumoniae R6
aucaagacccaagucggcag

SEQ ID NO: 4097203 - RNA, 20 nt, Streptococcus pneumoniae R6
aucaagauagcugugaagcg

SEQ ID NO: 4097204 - RNA, 23 nt, Streptococcus pneumoniae R6
aucaagaugagacuugcaagaaa

SEQ ID NO: 4097205 - RNA, 15 nt, Streptococcus pneumoniae R6
aucaagcaaaucaaa

SEQ ID NO: 4097206 - RNA, 18 nt, Streptococcus pneumoniae R6
aucaagcaaaucaaagcu

SEQ ID NO: 4097207 - RNA, 18 nt, Streptococcus pneumoniae R6
aucaagcuggcuacagau

SEQ ID NO: 4097208 - RNA, 16 nt, Streptococcus pneumoniae R6
aucaagguuuuucaaa

SEQ ID NO: 4097209 - RNA, 19 nt, Streptococcus pneumoniae R6
aucaagguuuuucuguacu

SEQ ID NO: 4097210 - RNA, 13 nt, Streptococcus pneumoniae R6
aucaaguaacuuu

SEQ ID NO: 4097211 - RNA, 16 nt, Streptococcus pneumoniae R6
aucaagugaguuagga

SEQ ID NO: 4097212 - RNA, 23 nt, Streptococcus pneumoniae R6
aucaagugaguuaggagccaagu

SEQ ID NO: 4097213 - RNA, 20 nt, Streptococcus pneumoniae R6
aucaauaaccaucauuuuua

SEQ ID NO: 4097214 - RNA, 19 nt, Streptococcus pneumoniae R6
aucaauacccccuuaaaac

SEQ ID NO: 4097215 - RNA, 22 nt, Streptococcus pneumoniae R6
aucaauacccccuuaaaaccau

SEQ ID NO: 4097216 - RNA, 23 nt, Streptococcus pneumoniae R6
aucaauagaaguggauuuucuuc

SEQ ID NO: 4097217 - RNA, 16 nt, Streptococcus pneumoniae R6
aucaauagugagacaa

SEQ ID NO: 4097218 - RNA, 14 nt, Streptococcus pneumoniae R6
aucaauaucaaaac

SEQ ID NO: 4097219 - RNA, 23 nt, Streptococcus pneumoniae R6
aucaauauuagaugauuuuucug

SEQ ID NO: 4097220 - RNA, 14 nt, Streptococcus pneumoniae R6
aucaauccaaagaa

SEQ ID NO: 4097221 - RNA, 22 nt, Streptococcus pneumoniae R6
aucaaucguccuugauuuagaa

SEQ ID NO: 4097222 - RNA, 22 nt, Streptococcus pneumoniae R6
aucaaucucugcaauuucuaau

SEQ ID NO: 4097223 - RNA, 19 nt, Streptococcus pneumoniae R6
aucaaucuucaaaaucuca

SEQ ID NO: 4097224 - RNA, 15 nt, Streptococcus pneumoniae R6
aucaaugacaaucuc

SEQ ID NO: 4097225 - RNA, 18 nt, Streptococcus pneumoniae R6
aucaaugagucagggaaa

SEQ ID NO: 4097226 - RNA, 19 nt, Streptococcus pneumoniae R6
aucaaugauuuauuuguuu

SEQ ID NO: 4097227 - RNA, 22 nt, Streptococcus pneumoniae R6
aucaauugcugcaccuucaacu

SEQ ID NO: 4097228 - RNA, 22 nt, Streptococcus pneumoniae R6
aucaauuguucacgcauaagca

SEQ ID NO: 4097229 - RNA, 17 nt, Streptococcus pneumoniae R6
aucaauuuguaucacca

SEQ ID NO: 4097230 - RNA, 23 nt, Streptococcus pneumoniae R6
aucaauuuguucguauccuauuu

SEQ ID NO: 4097231 - RNA, 23 nt, Streptococcus pneumoniae R6
aucaauuuuccuuuccuaaucga

SEQ ID NO: 4097232 - RNA, 13 nt, Streptococcus pneumoniae R6
aucaauuuuuaac

SEQ ID NO: 4097233 - RNA, 11 nt, Streptococcus pneumoniae R6
aucaauuuuuc

SEQ ID NO: 4097234 - RNA, 20 nt, Streptococcus pneumoniae R6
aucacagaccgacacaccau

SEQ ID NO: 4097235 - RNA, 18 nt, Streptococcus pneumoniae R6
aucacagugggcuauucc

SEQ ID NO: 4097236 - RNA, 18 nt, Streptococcus pneumoniae R6
aucacaguuuacaauuag

SEQ ID NO: 4097237 - RNA, 13 nt, Streptococcus pneumoniae R6
aucaccaaucuua

SEQ ID NO: 4097238 - RNA, 13 nt, Streptococcus pneumoniae R6
aucaccagcaugg

SEQ ID NO: 4097239 - RNA, 12 nt, Streptococcus pneumoniae R6
aucacccaaaac

SEQ ID NO: 4097240 - RNA, 19 nt, Streptococcus pneumoniae R6
aucaccguccccaaaaaua

SEQ ID NO: 4097241 - RNA, 20 nt, Streptococcus pneumoniae R6
aucaccuaguccaagacguu

SEQ ID NO: 4097242 - RNA, 17 nt, Streptococcus pneumoniae R6
aucaccuccuucuccaa

SEQ ID NO: 4097243 - RNA, 18 nt, Streptococcus pneumoniae R6
aucacgaaccuaauuaug

SEQ ID NO: 4097244 - RNA, 16 nt, Streptococcus pneumoniae R6
aucacgacuaauuuca

SEQ ID NO: 4097245 - RNA, 15 nt, Streptococcus pneumoniae R6
aucacgacuuucuga

SEQ ID NO: 4097246 - RNA, 20 nt, Streptococcus pneumoniae R6
aucacgacuuucugauagau

SEQ ID NO: 4097247 - RNA, 13 nt, Streptococcus pneumoniae R6
aucacgauuaucu

SEQ ID NO: 4097248 - RNA, 20 nt, Streptococcus pneumoniae R6
aucacgcuaaguagaaaguu

SEQ ID NO: 4097249 - RNA, 14 nt, Streptococcus pneumoniae R6
aucacgcuuuucuu

SEQ ID NO: 4097250 - RNA, 15 nt, Streptococcus pneumoniae R6
aucacgcuuuucuug

SEQ ID NO: 4097251 - RNA, 16 nt, Streptococcus pneumoniae R6
aucacguacaacagcu

SEQ ID NO: 4097252 - RNA, 17 nt, Streptococcus pneumoniae R6
aucacgugugaaaaccu

SEQ ID NO: 4097253 - RNA, 21 nt, Streptococcus pneumoniae R6
aucacguugcuuauacucaau

SEQ ID NO: 4097254 - RNA, 23 nt, Streptococcus pneumoniae R6
aucacuaguaauaauuucaaaau

SEQ ID NO: 4097255 - RNA, 12 nt, Streptococcus pneumoniae R6
aucacucaucug

SEQ ID NO: 4097256 - RNA, 15 nt, Streptococcus pneumoniae R6
aucacuccaaaaaua

SEQ ID NO: 4097257 - RNA, 13 nt, Streptococcus pneumoniae R6
aucacuccagcac

SEQ ID NO: 4097258 - RNA, 17 nt, Streptococcus pneumoniae R6
aucacuccagcacuggu

SEQ ID NO: 4097259 - RNA, 12 nt, Streptococcus pneumoniae R6
aucacucuaacu

SEQ ID NO: 4097260 - RNA, 18 nt, Streptococcus pneumoniae R6
aucacuguuuuuuauccc

SEQ ID NO: 4097261 - RNA, 17 nt, Streptococcus pneumoniae R6
aucacuucgucugcgac

SEQ ID NO: 4097262 - RNA, 12 nt, Streptococcus pneumoniae R6
aucacuuucugc

SEQ ID NO: 4097263 - RNA, 13 nt, Streptococcus pneumoniae R6
aucacuuucugca

SEQ ID NO: 4097264 - RNA, 17 nt, Streptococcus pneumoniae R6
aucagaaaaaaggcauc

SEQ ID NO: 4097265 - RNA, 22 nt, Streptococcus pneumoniae R6
aucagaaaaaaggcauccaauc

SEQ ID NO: 4097266 - RNA, 22 nt, Streptococcus pneumoniae R6
aucagaaaaacgcauaaaauca

SEQ ID NO: 4097267 - RNA, 12 nt, Streptococcus pneumoniae R6
aucagaaaagua

SEQ ID NO: 4097268 - RNA, 13 nt, Streptococcus pneumoniae R6
aucagaaaaguaa

SEQ ID NO: 4097269 - RNA, 13 nt, Streptococcus pneumoniae R6
aucagaaaauaaa

SEQ ID NO: 4097270 - RNA, 24 nt, Streptococcus pneumoniae R6
aucagaccaguuucuucuuucacu

SEQ ID NO: 4097271 - RNA, 15 nt, Streptococcus pneumoniae R6
aucagacuguuuuuc

SEQ ID NO: 4097272 - RNA, 15 nt, Streptococcus pneumoniae R6
aucagauaagcaccu

SEQ ID NO: 4097273 - RNA, 13 nt, Streptococcus pneumoniae R6
aucagauggguca

SEQ ID NO: 4097274 - RNA, 19 nt, Streptococcus pneumoniae R6
aucagaugggucaagauuu

SEQ ID NO: 4097275 - RNA, 15 nt, Streptococcus pneumoniae R6
aucagauuuuagaac

SEQ ID NO: 4097276 - RNA, 15 nt, Streptococcus pneumoniae R6
aucagcauaaucugc

SEQ ID NO: 4097277 - RNA, 18 nt, Streptococcus pneumoniae R6
aucagcuaaaaauaacua

SEQ ID NO: 4097278 - RNA, 12 nt, Streptococcus pneumoniae R6
auccagaaaugg

SEQ ID NO: 4097279 - RNA, 23 nt, Streptococcus pneumoniae R6
auccagaaauggaaguuucaaaa

SEQ ID NO: 4097280 - RNA, 20 nt, Streptococcus pneumoniae R6
auccagagcauucuuuuguu

SEQ ID NO: 4097281 - RNA, 13 nt, Streptococcus pneumoniae R6
auccagauuuuuc

SEQ ID NO: 4097282 - RNA, 18 nt, Streptococcus pneumoniae R6
auccagcaggagaaaguu

SEQ ID NO: 4097283 - RNA, 19 nt, Streptococcus pneumoniae R6
auccagccuucauaaaagu

SEQ ID NO: 4097284 - RNA, 20 nt, Streptococcus pneumoniae R6
auccaguacauugauugcuu

SEQ ID NO: 4097285 - RNA, 14 nt, Streptococcus pneumoniae R6
auccagucgugcaa

SEQ ID NO: 4097286 - RNA, 20 nt, Streptococcus pneumoniae R6
auccauaccgccaaucacuu

SEQ ID NO: 4097287 - RNA, 21 nt, Streptococcus pneumoniae R6
auccaucaaguuuaccauuca

SEQ ID NO: 4097288 - RNA, 17 nt, Streptococcus pneumoniae R6
auccaucacaguuuaca

SEQ ID NO: 4097289 - RNA, 20 nt, Streptococcus pneumoniae R6
auccaugaaaaaugcaugag

SEQ ID NO: 4097290 - RNA, 12 nt, Streptococcus pneumoniae R6
auccauucuuuu

SEQ ID NO: 4097291 - RNA, 13 nt, Streptococcus pneumoniae R6
auccauucuuuuu

SEQ ID NO: 4097292 - RNA, 21 nt, Streptococcus pneumoniae R6
auccauuuggguaggucuuuu

SEQ ID NO: 4097293 - RNA, 20 nt, Streptococcus pneumoniae R6
auccauuuguuuaaagacga

SEQ ID NO: 4097294 - RNA, 15 nt, Streptococcus pneumoniae R6
auccauuuuucaaau

SEQ ID NO: 4097295 - RNA, 23 nt, Streptococcus pneumoniae R6
aucccaagcccugcaaacuggag

SEQ ID NO: 4097296 - RNA, 17 nt, Streptococcus pneumoniae R6
aucccagauaaagcuga

SEQ ID NO: 4097297 - RNA, 16 nt, Streptococcus pneumoniae R6
aucccaguaaaggacu

SEQ ID NO: 4097298 - RNA, 13 nt, Streptococcus pneumoniae R6
aucccaguggcua

SEQ ID NO: 4097299 - RNA, 15 nt, Streptococcus pneumoniae R6
aucccauauuuuucc

SEQ ID NO: 4097300 - RNA, 19 nt, Streptococcus pneumoniae R6
aucccaugacaaucauuuc

SEQ ID NO: 4097301 - RNA, 20 nt, Streptococcus pneumoniae R6
aucccaugacaaucauuuca

SEQ ID NO: 4097302 - RNA, 21 nt, Streptococcus pneumoniae R6
aucccaugacaaucauuucag

SEQ ID NO: 4097303 - RNA, 23 nt, Streptococcus pneumoniae R6
aucccaugacaaucauuucaguu

SEQ ID NO: 4097304 - RNA, 17 nt, Streptococcus pneumoniae R6
aucccaugucaauucuc

SEQ ID NO: 4097305 - RNA, 18 nt, Streptococcus pneumoniae R6
aucccaugucuuuuaaau

SEQ ID NO: 4097306 - RNA, 13 nt, Streptococcus pneumoniae R6
aucccauucuuca

SEQ ID NO: 4097307 - RNA, 22 nt, Streptococcus pneumoniae R6
aucccuacaaggaagccuucuu

SEQ ID NO: 4097308 - RNA, 17 nt, Streptococcus pneumoniae R6
aucccuagcuuuuuccu

SEQ ID NO: 4097309 - RNA, 14 nt, Streptococcus pneumoniae R6
aucccuccauuuca

SEQ ID NO: 4097310 - RNA, 15 nt, Streptococcus pneumoniae R6
aucccuccauuucau

SEQ ID NO: 4097311 - RNA, 16 nt, Streptococcus pneumoniae R6
aucccuccauuucaua

SEQ ID NO: 4097312 - RNA, 18 nt, Streptococcus pneumoniae R6
aucccuuguuccaagaug

SEQ ID NO: 4097313 - RNA, 20 nt, Streptococcus pneumoniae R6
aucccuuguuuaguaaacaa

SEQ ID NO: 4097314 - RNA, 18 nt, Streptococcus pneumoniae R6
auccgcuugggaaaccaa

SEQ ID NO: 4097315 - RNA, 22 nt, Streptococcus pneumoniae R6
auccgcuugggaaaccaaacgg

SEQ ID NO: 4097316 - RNA, 15 nt, Streptococcus pneumoniae R6
auccgucgcauauuu

SEQ ID NO: 4097317 - RNA, 15 nt, Streptococcus pneumoniae R6
auccguuuuucuccu

SEQ ID NO: 4097318 - RNA, 14 nt, Streptococcus pneumoniae R6
auccguuuuuuaaa

SEQ ID NO: 4097319 - RNA, 15 nt, Streptococcus pneumoniae R6
auccguuuuuuaaaa

SEQ ID NO: 4097320 - RNA, 21 nt, Streptococcus pneumoniae R6
auccguuuuuugaaguuuuca

SEQ ID NO: 4097321 - RNA, 11 nt, Streptococcus pneumoniae R6
auccuaaaaaa

SEQ ID NO: 4097322 - RNA, 17 nt, Streptococcus pneumoniae R6
auccuaaauccucuauc

SEQ ID NO: 4097323 - RNA, 16 nt, Streptococcus pneumoniae R6
auccuaucuucuagaa

SEQ ID NO: 4097324 - RNA, 16 nt, Streptococcus pneumoniae R6
auccuauuuauuacuu

SEQ ID NO: 4097325 - RNA, 14 nt, Streptococcus pneumoniae R6
auccuauuucacuc

SEQ ID NO: 4097326 - RNA, 23 nt, Streptococcus pneumoniae R6
auccuauuucacuccacuauaaa

SEQ ID NO: 4097327 - RNA, 14 nt, Streptococcus pneumoniae R6
auccucauauucuu

SEQ ID NO: 4097328 - RNA, 21 nt, Streptococcus pneumoniae R6
auccucugaguauuuagcaac

SEQ ID NO: 4097329 - RNA, 23 nt, Streptococcus pneumoniae R6
auccucugaguauuuagcaacca

SEQ ID NO: 4097330 - RNA, 16 nt, Streptococcus pneumoniae R6
auccucugucacaaag

SEQ ID NO: 4097331 - RNA, 18 nt, Streptococcus pneumoniae R6
auccucugucacaaagag

SEQ ID NO: 4097332 - RNA, 15 nt, Streptococcus pneumoniae R6
auccugaaaagccac

SEQ ID NO: 4097333 - RNA, 17 nt, Streptococcus pneumoniae R6
auccugaaaagccacgu

SEQ ID NO: 4097334 - RNA, 18 nt, Streptococcus pneumoniae R6
auccugaagaaugggaua

SEQ ID NO: 4097335 - RNA, 19 nt, Streptococcus pneumoniae R6
auccugagucuaucuaaga

SEQ ID NO: 4097336 - RNA, 16 nt, Streptococcus pneumoniae R6
auccugcaaggcauaa

SEQ ID NO: 4097337 - RNA, 14 nt, Streptococcus pneumoniae R6
auccugcauuguga

SEQ ID NO: 4097338 - RNA, 18 nt, Streptococcus pneumoniae R6
auccugccccugaugagc

SEQ ID NO: 4097339 - RNA, 20 nt, Streptococcus pneumoniae R6
auccugccucaauccuuuuc

SEQ ID NO: 4097340 - RNA, 21 nt, Streptococcus pneumoniae R6
auccugcgaaaucuuugauuu

SEQ ID NO: 4097341 - RNA, 12 nt, Streptococcus pneumoniae R6
auccuuaaccca

SEQ ID NO: 4097342 - RNA, 14 nt, Streptococcus pneumoniae R6
auccuuauuuugca

SEQ ID NO: 4097343 - RNA, 18 nt, Streptococcus pneumoniae R6
auccuuuacuuguuuuag

SEQ ID NO: 4097344 - RNA, 23 nt, Streptococcus pneumoniae R6
auccuuuacuuguuuuagaugau

SEQ ID NO: 4097345 - RNA, 14 nt, Streptococcus pneumoniae R6
auccuuuauuuuca

SEQ ID NO: 4097346 - RNA, 15 nt, Streptococcus pneumoniae R6
auccuuuauuuucaa

SEQ ID NO: 4097347 - RNA, 14 nt, Streptococcus pneumoniae R6
auccuuucaguaga

SEQ ID NO: 4097348 - RNA, 21 nt, Streptococcus pneumoniae R6
auccuuuuaaucgauuauuuu

SEQ ID NO: 4097349 - RNA, 21 nt, Streptococcus pneumoniae R6
auccuuuuccaagaccuuaaa

SEQ ID NO: 4097350 - RNA, 23 nt, Streptococcus pneumoniae R6
auccuuuuccaagaccuuaaacu

SEQ ID NO: 4097351 - RNA, 11 nt, Streptococcus pneumoniae R6
auccuuuucug

SEQ ID NO: 4097352 - RNA, 14 nt, Streptococcus pneumoniae R6
auccuuuuuucuuu

SEQ ID NO: 4097353 - RNA, 21 nt, Streptococcus pneumoniae R6
auccuuuuuuugaaguuuuca

SEQ ID NO: 4097354 - RNA, 14 nt, Streptococcus pneumoniae R6
aucgaaaaguggag

SEQ ID NO: 4097355 - RNA, 20 nt, Streptococcus pneumoniae R6
aucgacaagauacccacaaa

SEQ ID NO: 4097356 - RNA, 13 nt, Streptococcus pneumoniae R6
aucgacuacuaaa

SEQ ID NO: 4097357 - RNA, 17 nt, Streptococcus pneumoniae R6
aucgacuuguuuuuuga

SEQ ID NO: 4097358 - RNA, 23 nt, Streptococcus pneumoniae R6
aucgagaagauuuccugauuuug

SEQ ID NO: 4097359 - RNA, 16 nt, Streptococcus pneumoniae R6
aucgagaauuucuggu

SEQ ID NO: 4097360 - RNA, 19 nt, Streptococcus pneumoniae R6
aucgaguaggggauaaucu

SEQ ID NO: 4097361 - RNA, 14 nt, Streptococcus pneumoniae R6
aucgauaccuucag

SEQ ID NO: 4097362 - RNA, 14 nt, Streptococcus pneumoniae R6
aucgauagauuuuu

SEQ ID NO: 4097363 - RNA, 15 nt, Streptococcus pneumoniae R6
aucgaucauauuuau

SEQ ID NO: 4097364 - RNA, 16 nt, Streptococcus pneumoniae R6
aucgaucauauuuaug

SEQ ID NO: 4097365 - RNA, 19 nt, Streptococcus pneumoniae R6
aucgaugacccaagcuuua

SEQ ID NO: 4097366 - RNA, 17 nt, Streptococcus pneumoniae R6
aucgauuaggaaaggaa

SEQ ID NO: 4097367 - RNA, 16 nt, Streptococcus pneumoniae R6
aucgauuucuaaaaau

SEQ ID NO: 4097368 - RNA, 14 nt, Streptococcus pneumoniae R6
aucgauuuguccug

SEQ ID NO: 4097369 - RNA, 15 nt, Streptococcus pneumoniae R6
aucgcaagguagaga

SEQ ID NO: 4097370 - RNA, 16 nt, Streptococcus pneumoniae R6
aucgcaaguuuuuccc

SEQ ID NO: 4097371 - RNA, 20 nt, Streptococcus pneumoniae R6
aucgcagcaucgagaauuuc

SEQ ID NO: 4097372 - RNA, 14 nt, Streptococcus pneumoniae R6
aucgcuaagagggu

SEQ ID NO: 4097373 - RNA, 20 nt, Streptococcus pneumoniae R6
aucgcuauaaauaaggggau

SEQ ID NO: 4097374 - RNA, 15 nt, Streptococcus pneumoniae R6
aucgcuaucaauggu

SEQ ID NO: 4097375 - RNA, 21 nt, Streptococcus pneumoniae R6
aucgcuauuaucguuuuccua

SEQ ID NO: 4097376 - RNA, 22 nt, Streptococcus pneumoniae R6
aucgguaagaaagcaacuaaaa

SEQ ID NO: 4097377 - RNA, 15 nt, Streptococcus pneumoniae R6
aucguaaaaaagucu

SEQ ID NO: 4097378 - RNA, 15 nt, Streptococcus pneumoniae R6
aucguagcuuuucuu

SEQ ID NO: 4097379 - RNA, 18 nt, Streptococcus pneumoniae R6
aucguagcuuuucuuauu

SEQ ID NO: 4097380 - RNA, 23 nt, Streptococcus pneumoniae R6
aucgucaagcaguaauauaggag

SEQ ID NO: 4097381 - RNA, 17 nt, Streptococcus pneumoniae R6
aucugucuuaccacaaa

SEQ ID NO: 4097382 - RNA, 19 nt, Streptococcus pneumoniae R6
aucugucuuaccacaaaca

SEQ ID NO: 4097383 - RNA, 15 nt, Streptococcus pneumoniae R6
aucuguguagcacuu

SEQ ID NO: 4097384 - RNA, 22 nt, Streptococcus pneumoniae R6
aucuguuaaaaaauaaucaaaa

SEQ ID NO: 4097385 - RNA, 18 nt, Streptococcus pneumoniae R6
aucuuaaauuuucgagau

SEQ ID NO: 4097386 - RNA, 13 nt, Streptococcus pneumoniae R6
aucuuaagacuaa

SEQ ID NO: 4097387 - RNA, 17 nt, Streptococcus pneumoniae R6
aucuuaauucucuuauu

SEQ ID NO: 4097388 - RNA, 15 nt, Streptococcus pneumoniae R6
aucuuaguuaaaaua

SEQ ID NO: 4097389 - RNA, 17 nt, Streptococcus pneumoniae R6
aucuuaucacccaaaac

SEQ ID NO: 4097390 - RNA, 14 nt, Streptococcus pneumoniae R6
aucuuauugauuuu

SEQ ID NO: 4097391 - RNA, 15 nt, Streptococcus pneumoniae R6
aucuuauugauuuuu

SEQ ID NO: 4097392 - RNA, 17 nt, Streptococcus pneumoniae R6
aucuuauugauuuuucu

SEQ ID NO: 4097393 - RNA, 19 nt, Streptococcus pneumoniae R6
aucuuauuucaauucacua

SEQ ID NO: 4097394 - RNA, 13 nt, Streptococcus pneumoniae R6
aucuuauuuuucu

SEQ ID NO: 4097395 - RNA, 16 nt, Streptococcus pneumoniae R6
aucuucaaaaaagugu

SEQ ID NO: 4097396 - RNA, 15 nt, Streptococcus pneumoniae R6
aucuucaaaaucaaa

SEQ ID NO: 4097397 - RNA, 15 nt, Streptococcus pneumoniae R6
aucuucaaauuuuuc

SEQ ID NO: 4097398 - RNA, 16 nt, Streptococcus pneumoniae R6
aucuucaaauuuuuca

SEQ ID NO: 4097399 - RNA, 16 nt, Streptococcus pneumoniae R6
aucuucagacacacca

SEQ ID NO: 4097400 - RNA, 14 nt, Streptococcus pneumoniae R6
aucuucauuuugca

SEQ ID NO: 4097401 - RNA, 20 nt, Streptococcus pneumoniae R6
aucuucccacaauaaaacgc

SEQ ID NO: 4097402 - RNA, 18 nt, Streptococcus pneumoniae R6
aucuuccuacauauguaa

SEQ ID NO: 4097403 - RNA, 22 nt, Streptococcus pneumoniae R6
aucuuccuugaaagaccaguuc

SEQ ID NO: 4097404 - RNA, 16 nt, Streptococcus pneumoniae R6
aucuucggauaaauua

SEQ ID NO: 4097405 - RNA, 20 nt, Streptococcus pneumoniae R6
aucuucucaggcuuuuucug

SEQ ID NO: 4097406 - RNA, 21 nt, Streptococcus pneumoniae R6
aucuucuccaguuuuaaucuu

SEQ ID NO: 4097407 - RNA, 17 nt, Streptococcus pneumoniae R6
aucuucuggcacagaaa

SEQ ID NO: 4097408 - RNA, 19 nt, Streptococcus pneumoniae R6
aucuucuggcacagaaaca

SEQ ID NO: 4097409 - RNA, 13 nt, Streptococcus pneumoniae R6
aucuucuuacaua

SEQ ID NO: 4097410 - RNA, 15 nt, Streptococcus pneumoniae R6
aucuucuugauacug

SEQ ID NO: 4097411 - RNA, 21 nt, Streptococcus pneumoniae R6
aucuucuugauacugaucaaa

SEQ ID NO: 4097412 - RNA, 13 nt, Streptococcus pneumoniae R6
aucuugaaguuga

SEQ ID NO: 4097413 - RNA, 12 nt, Streptococcus pneumoniae R6
aucuugacaauc

SEQ ID NO: 4097414 - RNA, 16 nt, Streptococcus pneumoniae R6
aucuugacgauaggug

SEQ ID NO: 4097415 - RNA, 16 nt, Streptococcus pneumoniae R6
aucuugacuauauuuc

SEQ ID NO: 4097416 - RNA, 13 nt, Streptococcus pneumoniae R6
aucuugauuuucu

SEQ ID NO: 4097417 - RNA, 21 nt, Streptococcus pneumoniae R6
aucuugauuuucuuuaaaaaa

SEQ ID NO: 4097418 - RNA, 21 nt, Streptococcus pneumoniae R6
aucuuggauauucaauucuuu

SEQ ID NO: 4097419 - RNA, 14 nt, Streptococcus pneumoniae R6
aucuuggauuauau

SEQ ID NO: 4097420 - RNA, 22 nt, Streptococcus pneumoniae R6
aucuuggcgaauauagacaaaa

SEQ ID NO: 4097421 - RNA, 21 nt, Streptococcus pneumoniae R6
aucuuggcuaauuucaagaag

SEQ ID NO: 4097422 - RNA, 21 nt, Streptococcus pneumoniae R6
aucuuguccacucgaaacaag

SEQ ID NO: 4097423 - RNA, 16 nt, Streptococcus pneumoniae R6
aucuugucuaaaaaua

SEQ ID NO: 4097424 - RNA, 17 nt, Streptococcus pneumoniae R6
aucuugucuaaaaauag

SEQ ID NO: 4097425 - RNA, 20 nt, Streptococcus pneumoniae R6
aucuuguguuuuuugagcaa

SEQ ID NO: 4097426 - RNA, 23 nt, Streptococcus pneumoniae R6
aucuuguugaaugagcuuccagu

SEQ ID NO: 4097427 - RNA, 16 nt, Streptococcus pneumoniae R6
aucuuuaaaaguugua

SEQ ID NO: 4097428 - RNA, 17 nt, Streptococcus pneumoniae R6
aucuuuaaaaguuguau

SEQ ID NO: 4097429 - RNA, 18 nt, Streptococcus pneumoniae R6
aucuuuaaggcacuagcu

SEQ ID NO: 4097430 - RNA, 17 nt, Streptococcus pneumoniae R6
aucuuuaagguacuuga

SEQ ID NO: 4097431 - RNA, 17 nt, Streptococcus pneumoniae R6
aucuuuagaaagauuac

SEQ ID NO: 4097432 - RNA, 20 nt, Streptococcus pneumoniae R6
aucuuuagcaccaccuuuga

SEQ ID NO: 4097433 - RNA, 23 nt, Streptococcus pneumoniae R6
aucuuuagccgcuugacugacua

SEQ ID NO: 4097434 - RNA, 12 nt, Streptococcus pneumoniae R6
aucuuugaaaua

SEQ ID NO: 4097435 - RNA, 14 nt, Streptococcus pneumoniae R6
aucuuugaaauaau

SEQ ID NO: 4097436 - RNA, 21 nt, Streptococcus pneumoniae R6
aucuuugaaauaaucaaaaua

SEQ ID NO: 4097437 - RNA, 20 nt, Streptococcus pneumoniae R6
aucuuugaggaagguuuuaa

SEQ ID NO: 4097438 - RNA, 17 nt, Streptococcus pneumoniae R6
aucuuugauuucuugug

SEQ ID NO: 4097439 - RNA, 13 nt, Streptococcus pneumoniae R6
aucuuugauuuua

SEQ ID NO: 4097440 - RNA, 14 nt, Streptococcus pneumoniae R6
aucuuugauuuuac

SEQ ID NO: 4097441 - RNA, 19 nt, Streptococcus pneumoniae R6
aucuuuggacauagccaau

SEQ ID NO: 4097442 - RNA, 20 nt, Streptococcus pneumoniae R6
aucuuuggacauagccaaua

SEQ ID NO: 4097443 - RNA, 13 nt, Streptococcus pneumoniae R6
aucuuuggcaauu

SEQ ID NO: 4097444 - RNA, 19 nt, Streptococcus pneumoniae R6
aucuuuguaaguuucuucu

SEQ ID NO: 4097445 - RNA, 20 nt, Streptococcus pneumoniae R6
aucuuuguaaguuucuucuu

SEQ ID NO: 4097446 - RNA, 20 nt, Streptococcus pneumoniae R6
aucuuuuacuucugaaguua

SEQ ID NO: 4097447 - RNA, 16 nt, Streptococcus pneumoniae R6
aucuuuuauuugagua

SEQ ID NO: 4097448 - RNA, 17 nt, Streptococcus pneumoniae R6
aucuuuuauuugaguaa

SEQ ID NO: 4097449 - RNA, 18 nt, Streptococcus pneumoniae R6
aucuuuuauuuuuauaac

SEQ ID NO: 4097450 - RNA, 20 nt, Streptococcus pneumoniae R6
aucuuuuggacucacuaaaa

SEQ ID NO: 4097451 - RNA, 21 nt, Streptococcus pneumoniae R6
aucuuuuuuugaugacauuca

SEQ ID NO: 4097452 - RNA, 22 nt, Streptococcus pneumoniae R6
augaaaaggcagauucucuauc

SEQ ID NO: 4097453 - RNA, 15 nt, Streptococcus pneumoniae R6
augaaaccccaagaa

SEQ ID NO: 4097454 - RNA, 23 nt, Streptococcus pneumoniae R6
augaaacuauguacgaaaagcac

SEQ ID NO: 4097455 - RNA, 14 nt, Streptococcus pneumoniae R6
augaaagauauuuu

SEQ ID NO: 4097456 - RNA, 22 nt, Streptococcus pneumoniae R6
augaaauaaaauuugaacaaau

SEQ ID NO: 4097457 - RNA, 22 nt, Streptococcus pneumoniae R6
augaaauaauaacaggacaaau

SEQ ID NO: 4097458 - RNA, 17 nt, Streptococcus pneumoniae R6
augaaauaauacucaau

SEQ ID NO: 4097459 - RNA, 15 nt, Streptococcus pneumoniae R6
augaaauacugaugu

SEQ ID NO: 4097460 - RNA, 15 nt, Streptococcus pneumoniae R6
augaaauauuuuuua

SEQ ID NO: 4097461 - RNA, 22 nt, Streptococcus pneumoniae R6
augaaauauuuuuuacuuuugc

SEQ ID NO: 4097462 - RNA, 15 nt, Streptococcus pneumoniae R6
augaaauuaaauaug

SEQ ID NO: 4097463 - RNA, 14 nt, Streptococcus pneumoniae R6
augaaauuuaaaaa

SEQ ID NO: 4097464 - RNA, 19 nt, Streptococcus pneumoniae R6
augaaauuuuucugcuucu

SEQ ID NO: 4097465 - RNA, 14 nt, Streptococcus pneumoniae R6
augaacaaaucaau

SEQ ID NO: 4097466 - RNA, 18 nt, Streptococcus pneumoniae R6
augaacaaaucaauugcu

SEQ ID NO: 4097467 - RNA, 17 nt, Streptococcus pneumoniae R6
augaaccugcuuaagau

SEQ ID NO: 4097468 - RNA, 17 nt, Streptococcus pneumoniae R6
augaaccugcuucagau

SEQ ID NO: 4097469 - RNA, 18 nt, Streptococcus pneumoniae R6
augaaccugcuucagauu

SEQ ID NO: 4097470 - RNA, 21 nt, Streptococcus pneumoniae R6
augaaccuucaucaaaugacu

SEQ ID NO: 4097471 - RNA, 14 nt, Streptococcus pneumoniae R6
augaacuugaaaau

SEQ ID NO: 4097472 - RNA, 16 nt, Streptococcus pneumoniae R6
augaagauugauaaag

SEQ ID NO: 4097473 - RNA, 20 nt, Streptococcus pneumoniae R6
augaagauugauaaaggcag

SEQ ID NO: 4097474 - RNA, 21 nt, Streptococcus pneumoniae R6
augaagauugauaaaggcaga

SEQ ID NO: 4097475 - RNA, 20 nt, Streptococcus pneumoniae R6
augaaggaguugcuccaugc

SEQ ID NO: 4097476 - RNA, 20 nt, Streptococcus pneumoniae R6
augaagggcuuuucuaucac

SEQ ID NO: 4097477 - RNA, 23 nt, Streptococcus pneumoniae R6
augaaggucuuuugucuugcuug

SEQ ID NO: 4097478 - RNA, 14 nt, Streptococcus pneumoniae R6
augaaguaaauauu

SEQ ID NO: 4097479 - RNA, 15 nt, Streptococcus pneumoniae R6
augaaguaaauguga

SEQ ID NO: 4097480 - RNA, 16 nt, Streptococcus pneumoniae R6
augaaguaaaugugag

SEQ ID NO: 4097481 - RNA, 22 nt, Streptococcus pneumoniae R6
augaaguggggcaccauuuuca

SEQ ID NO: 4097482 - RNA, 14 nt, Streptococcus pneumoniae R6
augaaguguuguaa

SEQ ID NO: 4097483 - RNA, 17 nt, Streptococcus pneumoniae R6
augcauaauuuccauac

SEQ ID NO: 4097484 - RNA, 16 nt, Streptococcus pneumoniae R6
augcauacgaaaagua

SEQ ID NO: 4097485 - RNA, 12 nt, Streptococcus pneumoniae R6
augcaucaagug

SEQ ID NO: 4097486 - RNA, 22 nt, Streptococcus pneumoniae R6
augccaaucgacccuggauuga

SEQ ID NO: 4097487 - RNA, 18 nt, Streptococcus pneumoniae R6
augccaugagcgucuuuc

SEQ ID NO: 4097488 - RNA, 16 nt, Streptococcus pneumoniae R6
augcccaugaaaagau

SEQ ID NO: 4097489 - RNA, 15 nt, Streptococcus pneumoniae R6
augcccuugauaaua

SEQ ID NO: 4097490 - RNA, 22 nt, Streptococcus pneumoniae R6
augcccuugauaauaaagaaga

SEQ ID NO: 4097491 - RNA, 18 nt, Streptococcus pneumoniae R6
augccuccaagaaagaga

SEQ ID NO: 4097492 - RNA, 17 nt, Streptococcus pneumoniae R6
augccuguuccaacauu

SEQ ID NO: 4097493 - RNA, 18 nt, Streptococcus pneumoniae R6
augcgaaucaauuuuucg

SEQ ID NO: 4097494 - RNA, 23 nt, Streptococcus pneumoniae R6
augcgauagaugaucgagcagau

SEQ ID NO: 4097495 - RNA, 15 nt, Streptococcus pneumoniae R6
augcgcaaaauaauu

SEQ ID NO: 4097496 - RNA, 23 nt, Streptococcus pneumoniae R6
augcggauaaaccaccagagugg

SEQ ID NO: 4097497 - RNA, 19 nt, Streptococcus pneumoniae R6
augcggucccaguuuucuu

SEQ ID NO: 4097498 - RNA, 23 nt, Streptococcus pneumoniae R6
augcguacuguuauagauucaac

SEQ ID NO: 4097499 - RNA, 15 nt, Streptococcus pneumoniae R6
augcguuuuaucaua

SEQ ID NO: 4097500 - RNA, 23 nt, Streptococcus pneumoniae R6
augcguuuucuaauuguaaagac

SEQ ID NO: 4097501 - RNA, 15 nt, Streptococcus pneumoniae R6
augcguuuuucagau

SEQ ID NO: 4097502 - RNA, 21 nt, Streptococcus pneumoniae R6
augcguuuuucugauuuugaa

SEQ ID NO: 4097503 - RNA, 17 nt, Streptococcus pneumoniae R6
augcuaauuuagaaaua

SEQ ID NO: 4097504 - RNA, 17 nt, Streptococcus pneumoniae R6
augcuccaauacaaauu

SEQ ID NO: 4097505 - RNA, 21 nt, Streptococcus pneumoniae R6
augcuccaauacaaauuguaa

SEQ ID NO: 4097506 - RNA, 14 nt, Streptococcus pneumoniae R6
augcucccuucuuu

SEQ ID NO: 4097507 - RNA, 16 nt, Streptococcus pneumoniae R6
augcuccucuguauca

SEQ ID NO: 4097508 - RNA, 16 nt, Streptococcus pneumoniae R6
augcucgugauguuaa

SEQ ID NO: 4097509 - RNA, 15 nt, Streptococcus pneumoniae R6
augcucugaaacacu

SEQ ID NO: 4097510 - RNA, 15 nt, Streptococcus pneumoniae R6
augcugacaaagaga

SEQ ID NO: 4097511 - RNA, 20 nt, Streptococcus pneumoniae R6
augcugacaagucauccaug

SEQ ID NO: 4097512 - RNA, 21 nt, Streptococcus pneumoniae R6
augcuggcggaaguuggucuc

SEQ ID NO: 4097513 - RNA, 17 nt, Streptococcus pneumoniae R6
augcugguuguccaggc

SEQ ID NO: 4097514 - RNA, 20 nt, Streptococcus pneumoniae R6
augcugguuguccaggcaaa

SEQ ID NO: 4097515 - RNA, 15 nt, Streptococcus pneumoniae R6
augcuugcaaaucau

SEQ ID NO: 4097516 - RNA, 16 nt, Streptococcus pneumoniae R6
augcuuggugagaaag

SEQ ID NO: 4097517 - RNA, 20 nt, Streptococcus pneumoniae R6
augcuuuccaacgauuuuau

SEQ ID NO: 4097518 - RNA, 17 nt, Streptococcus pneumoniae R6
augcuuuuuucuaugau

SEQ ID NO: 4097519 - RNA, 22 nt, Streptococcus pneumoniae R6
augcuuuuuucuaugauuuuca

SEQ ID NO: 4097520 - RNA, 18 nt, Streptococcus pneumoniae R6
auggaaaaacuuacuaca

SEQ ID NO: 4097521 - RNA, 13 nt, Streptococcus pneumoniae R6
auggaaaaugaua

SEQ ID NO: 4097522 - RNA, 16 nt, Streptococcus pneumoniae R6
auggaacuaagauuug

SEQ ID NO: 4097523 - RNA, 17 nt, Streptococcus pneumoniae R6
auggaagagaagcuguc

SEQ ID NO: 4097524 - RNA, 21 nt, Streptococcus pneumoniae R6
auggaagguugaguuuuugaa

SEQ ID NO: 4097525 - RNA, 15 nt, Streptococcus pneumoniae R6
auggaaguaauuuga

SEQ ID NO: 4097526 - RNA, 15 nt, Streptococcus pneumoniae R6
auggaauaccaauau

SEQ ID NO: 4097527 - RNA, 14 nt, Streptococcus pneumoniae R6
auggaaucuugcau

SEQ ID NO: 4097528 - RNA, 19 nt, Streptococcus pneumoniae R6
auggacaacaaugagaaau

SEQ ID NO: 4097529 - RNA, 23 nt, Streptococcus pneumoniae R6
auggacacgauaaucugggcuaa

SEQ ID NO: 4097530 - RNA, 16 nt, Streptococcus pneumoniae R6
auggacuguuauagau

SEQ ID NO: 4097531 - RNA, 20 nt, Streptococcus pneumoniae R6
auggaguguucuaaaauaag

SEQ ID NO: 4097532 - RNA, 20 nt, Streptococcus pneumoniae R6
auggaguuccuccauugcaa

SEQ ID NO: 4097533 - RNA, 13 nt, Streptococcus pneumoniae R6
auggaguuuucaa

SEQ ID NO: 4097534 - RNA, 21 nt, Streptococcus pneumoniae R6
auggaugauaccaucuaacuc

SEQ ID NO: 4097535 - RNA, 13 nt, Streptococcus pneumoniae R6
auggauugaaaua

SEQ ID NO: 4097536 - RNA, 17 nt, Streptococcus pneumoniae R6
auggauuuuauugucuu

SEQ ID NO: 4097537 - RNA, 21 nt, Streptococcus pneumoniae R6
auggcaaaaaauugagaaaga

SEQ ID NO: 4097538 - RNA, 19 nt, Streptococcus pneumoniae R6
auggcaacguuaaagaguu

SEQ ID NO: 4097539 - RNA, 20 nt, Streptococcus pneumoniae R6
auggcaacuuuuccaauaga

SEQ ID NO: 4097540 - RNA, 15 nt, Streptococcus pneumoniae R6
auggcaagaucaagu

SEQ ID NO: 4097541 - RNA, 17 nt, Streptococcus pneumoniae R6
auggcaagaucaaguuc

SEQ ID NO: 4097542 - RNA, 19 nt, Streptococcus pneumoniae R6
auggcaagaucaaguucaa

SEQ ID NO: 4097543 - RNA, 20 nt, Streptococcus pneumoniae R6
auggcaccgccgaggacgga

SEQ ID NO: 4097544 - RNA, 22 nt, Streptococcus pneumoniae R6
auggcacgccagucauuaccag

SEQ ID NO: 4097545 - RNA, 19 nt, Streptococcus pneumoniae R6
auggcacgggggaaaucau

SEQ ID NO: 4097546 - RNA, 14 nt, Streptococcus pneumoniae R6
auggcaugaggaga

SEQ ID NO: 4097547 - RNA, 13 nt, Streptococcus pneumoniae R6
auggcauuagcug

SEQ ID NO: 4097548 - RNA, 16 nt, Streptococcus pneumoniae R6
auggccauaaucucug

SEQ ID NO: 4097549 - RNA, 18 nt, Streptococcus pneumoniae R6
auggccgauaacagccaa

SEQ ID NO: 4097550 - RNA, 17 nt, Streptococcus pneumoniae R6
auggcuaacuucauuau

SEQ ID NO: 4097551 - RNA, 23 nt, Streptococcus pneumoniae R6
auggcugaacgacgaauuugcuc

SEQ ID NO: 4097552 - RNA, 21 nt, Streptococcus pneumoniae R6
auggcuuucuuucaaaccagc

SEQ ID NO: 4097553 - RNA, 19 nt, Streptococcus pneumoniae R6
augggagcuaacucaaguu

SEQ ID NO: 4097554 - RNA, 20 nt, Streptococcus pneumoniae R6
augggauuuucauauaauaa

SEQ ID NO: 4097555 - RNA, 20 nt, Streptococcus pneumoniae R6
augggcaucaacagcuccau

SEQ ID NO: 4097556 - RNA, 16 nt, Streptococcus pneumoniae R6
augggcuuacaucaaa

SEQ ID NO: 4097557 - RNA, 19 nt, Streptococcus pneumoniae R6
auggguucgcccugucuuu

SEQ ID NO: 4097558 - RNA, 23 nt, Streptococcus pneumoniae R6
auggguucuuugccaguucuuca

SEQ ID NO: 4097559 - RNA, 18 nt, Streptococcus pneumoniae R6
auggguugaaguaacucu

SEQ ID NO: 4097560 - RNA, 22 nt, Streptococcus pneumoniae R6
augguaaugccgugauuuccaa

SEQ ID NO: 4097561 - RNA, 12 nt, Streptococcus pneumoniae R6
augguaauguuc

SEQ ID NO: 4097562 - RNA, 16 nt, Streptococcus pneumoniae R6
augguaucaaaggcaa

SEQ ID NO: 4097563 - RNA, 13 nt, Streptococcus pneumoniae R6
augguauucauua

SEQ ID NO: 4097564 - RNA, 22 nt, Streptococcus pneumoniae R6
augguauucauuaagucaacau

SEQ ID NO: 4097565 - RNA, 20 nt, Streptococcus pneumoniae R6
augguauuuaaaaccuccaa

SEQ ID NO: 4097566 - RNA, 21 nt, Streptococcus pneumoniae R6
augguauuuaaaaccuccaaa

SEQ ID NO: 4097567 - RNA, 17 nt, Streptococcus pneumoniae R6
augguauuuguaaaauu

SEQ ID NO: 4097568 - RNA, 16 nt, Streptococcus pneumoniae R6
auggucaaaauauuug

SEQ ID NO: 4097569 - RNA, 15 nt, Streptococcus pneumoniae R6
auggucacagaacca

SEQ ID NO: 4097570 - RNA, 19 nt, Streptococcus pneumoniae R6
auggucacagaaccaucuu

SEQ ID NO: 4097571 - RNA, 15 nt, Streptococcus pneumoniae R6
auggucuucaugcug

SEQ ID NO: 4097572 - RNA, 21 nt, Streptococcus pneumoniae R6
auggugacgaugucuugguau

SEQ ID NO: 4097573 - RNA, 15 nt, Streptococcus pneumoniae R6
augguuacugacuuc

SEQ ID NO: 4097574 - RNA, 23 nt, Streptococcus pneumoniae R6
augguuacugacuucgucaguuc

SEQ ID NO: 4097575 - RNA, 17 nt, Streptococcus pneumoniae R6
augguucgggauaaaau

SEQ ID NO: 4097576 - RNA, 18 nt, Streptococcus pneumoniae R6
augguucgggauaaaaua

SEQ ID NO: 4097577 - RNA, 19 nt, Streptococcus pneumoniae R6
augguucgggauaaaauag

SEQ ID NO: 4097578 - RNA, 17 nt, Streptococcus pneumoniae R6
augguugucccugggac

SEQ ID NO: 4097579 - RNA, 16 nt, Streptococcus pneumoniae R6
augguuucagucaaua

SEQ ID NO: 4097580 - RNA, 19 nt, Streptococcus pneumoniae R6
augguuuuuagcgccuuaa

SEQ ID NO: 4097581 - RNA, 22 nt, Streptococcus pneumoniae R6
auguaaacaaguugcuugaaaa

SEQ ID NO: 4097582 - RNA, 15 nt, Streptococcus pneumoniae R6
auguaaauaaauauc

SEQ ID NO: 4097583 - RNA, 12 nt, Streptococcus pneumoniae R6
auguaagaguuc

SEQ ID NO: 4097584 - RNA, 14 nt, Streptococcus pneumoniae R6
auguaaucaaaagg

SEQ ID NO: 4097585 - RNA, 17 nt, Streptococcus pneumoniae R6
auuagaaauugaaguaa

SEQ ID NO: 4097586 - RNA, 19 nt, Streptococcus pneumoniae R6
auuagaauucagcuuuguu

SEQ ID NO: 4097587 - RNA, 18 nt, Streptococcus pneumoniae R6
auuagaccugccaugcug

SEQ ID NO: 4097588 - RNA, 15 nt, Streptococcus pneumoniae R6
auuagagguuugcuu

SEQ ID NO: 4097589 - RNA, 13 nt, Streptococcus pneumoniae R6
auuagauaagagu

SEQ ID NO: 4097590 - RNA, 19 nt, Streptococcus pneumoniae R6
auuagauaguuuugcaaga

SEQ ID NO: 4097591 - RNA, 16 nt, Streptococcus pneumoniae R6
auuaggaaagaauguu

SEQ ID NO: 4097592 - RNA, 23 nt, Streptococcus pneumoniae R6
auuaggaaaggaaaauugauuua

SEQ ID NO: 4097593 - RNA, 12 nt, Streptococcus pneumoniae R6
auuaggauagau

SEQ ID NO: 4097594 - RNA, 15 nt, Streptococcus pneumoniae R6
auuaggcucuuuguc

SEQ ID NO: 4097595 - RNA, 21 nt, Streptococcus pneumoniae R6
auuaggcucuuugucaacugu

SEQ ID NO: 4097596 - RNA, 20 nt, Streptococcus pneumoniae R6
auuaggggggcuauucuucg

SEQ ID NO: 4097597 - RNA, 14 nt, Streptococcus pneumoniae R6
auuagguugaccau

SEQ ID NO: 4097598 - RNA, 16 nt, Streptococcus pneumoniae R6
auuaguaaucuggucu

SEQ ID NO: 4097599 - RNA, 17 nt, Streptococcus pneumoniae R6
auuaguaaucuggucuu

SEQ ID NO: 4097600 - RNA, 17 nt, Streptococcus pneumoniae R6
auuaguaugagcacuau

SEQ ID NO: 4097601 - RNA, 14 nt, Streptococcus pneumoniae R6
auuagucaagugca

SEQ ID NO: 4097602 - RNA, 17 nt, Streptococcus pneumoniae R6
auuaguccguauuuuaa

SEQ ID NO: 4097603 - RNA, 22 nt, Streptococcus pneumoniae R6
auuaguccguauuuuaaaauau

SEQ ID NO: 4097604 - RNA, 22 nt, Streptococcus pneumoniae R6
auuagugaaguguuuaggcaag

SEQ ID NO: 4097605 - RNA, 15 nt, Streptococcus pneumoniae R6
auuaguuuuuagaag

SEQ ID NO: 4097606 - RNA, 18 nt, Streptococcus pneumoniae R6
auuaguuuuuagaagcuu

SEQ ID NO: 4097607 - RNA, 20 nt, Streptococcus pneumoniae R6
auuauaaaagcucauuuccu

SEQ ID NO: 4097608 - RNA, 15 nt, Streptococcus pneumoniae R6
auuauaaaauuuaau

SEQ ID NO: 4097609 - RNA, 14 nt, Streptococcus pneumoniae R6
auuauaaauuauuu

SEQ ID NO: 4097610 - RNA, 20 nt, Streptococcus pneumoniae R6
auuauaaauuucgaaaaaug

SEQ ID NO: 4097611 - RNA, 21 nt, Streptococcus pneumoniae R6
auuauaaucguuuaaaacacc

SEQ ID NO: 4097612 - RNA, 14 nt, Streptococcus pneumoniae R6
auuauacaccauuu

SEQ ID NO: 4097613 - RNA, 15 nt, Streptococcus pneumoniae R6
auuauacaucuuccc

SEQ ID NO: 4097614 - RNA, 23 nt, Streptococcus pneumoniae R6
auuauacguuuuuugauuuuaau

SEQ ID NO: 4097615 - RNA, 17 nt, Streptococcus pneumoniae R6
auuauacuauaaaacaa

SEQ ID NO: 4097616 - RNA, 21 nt, Streptococcus pneumoniae R6
auuauagugguguuucaaguc

SEQ ID NO: 4097617 - RNA, 20 nt, Streptococcus pneumoniae R6
auuauauaaaccaaaggaag

SEQ ID NO: 4097618 - RNA, 14 nt, Streptococcus pneumoniae R6
auuauauauaaaaa

SEQ ID NO: 4097619 - RNA, 22 nt, Streptococcus pneumoniae R6
auuauaugcaauuucuuuauau

SEQ ID NO: 4097620 - RNA, 17 nt, Streptococcus pneumoniae R6
auuauauuuauagaauu

SEQ ID NO: 4097621 - RNA, 22 nt, Streptococcus pneumoniae R6
auuaucagcguaauagucuaau

SEQ ID NO: 4097622 - RNA, 22 nt, Streptococcus pneumoniae R6
auuauccaugaaaaaugcauga

SEQ ID NO: 4097623 - RNA, 22 nt, Streptococcus pneumoniae R6
auuauccccuacucgauuuuaa

SEQ ID NO: 4097624 - RNA, 17 nt, Streptococcus pneumoniae R6
auuaucguguugaaauu

SEQ ID NO: 4097625 - RNA, 14 nt, Streptococcus pneumoniae R6
auuaucuaacaaua

SEQ ID NO: 4097626 - RNA, 14 nt, Streptococcus pneumoniae R6
auuaucuuuccauu

SEQ ID NO: 4097627 - RNA, 17 nt, Streptococcus pneumoniae R6
auuaucuuuccauucaa

SEQ ID NO: 4097628 - RNA, 22 nt, Streptococcus pneumoniae R6
auuaucuuuccauucaaauuua

SEQ ID NO: 4097629 - RNA, 19 nt, Streptococcus pneumoniae R6
auuaugaaauuuaaaaaga

SEQ ID NO: 4097630 - RNA, 22 nt, Streptococcus pneumoniae R6
auuaugcguuuuugugauuuua

SEQ ID NO: 4097631 - RNA, 14 nt, Streptococcus pneumoniae R6
auuaugguauacga

SEQ ID NO: 4097632 - RNA, 13 nt, Streptococcus pneumoniae R6
auuauguaaacaa

SEQ ID NO: 4097633 - RNA, 17 nt, Streptococcus pneumoniae R6
auuauguaaauaaauau

SEQ ID NO: 4097634 - RNA, 14 nt, Streptococcus pneumoniae R6
auuauguuuuaaau

SEQ ID NO: 4097635 - RNA, 18 nt, Streptococcus pneumoniae R6
auuauguuuuaaauaaac

SEQ ID NO: 4097636 - RNA, 14 nt, Streptococcus pneumoniae R6
auuauuaauauaua

SEQ ID NO: 4097637 - RNA, 13 nt, Streptococcus pneumoniae R6
auuauuaccuuga

SEQ ID NO: 4097638 - RNA, 17 nt, Streptococcus pneumoniae R6
auuauuagggaaacaaa

SEQ ID NO: 4097639 - RNA, 20 nt, Streptococcus pneumoniae R6
auuauuagggaaacaaaagu

SEQ ID NO: 4097640 - RNA, 13 nt, Streptococcus pneumoniae R6
auuauuaugaaaa

SEQ ID NO: 4097641 - RNA, 17 nt, Streptococcus pneumoniae R6
auuauugauuccgucau

SEQ ID NO: 4097642 - RNA, 13 nt, Streptococcus pneumoniae R6
auuauuuauuuac

SEQ ID NO: 4097643 - RNA, 13 nt, Streptococcus pneumoniae R6
auuauuuccuuga

SEQ ID NO: 4097644 - RNA, 22 nt, Streptococcus pneumoniae R6
auuauuuccuugaccaaguccu

SEQ ID NO: 4097645 - RNA, 13 nt, Streptococcus pneumoniae R6
auuauuucuuuug

SEQ ID NO: 4097646 - RNA, 18 nt, Streptococcus pneumoniae R6
auuauuugccuaugaaau

SEQ ID NO: 4097647 - RNA, 20 nt, Streptococcus pneumoniae R6
auuauuugccuaugaaauga

SEQ ID NO: 4097648 - RNA, 23 nt, Streptococcus pneumoniae R6
auuauuugguuaggugaauuagu

SEQ ID NO: 4097649 - RNA, 13 nt, Streptococcus pneumoniae R6
auucaaaauacaa

SEQ ID NO: 4097650 - RNA, 17 nt, Streptococcus pneumoniae R6
auucaaacucaaauuua

SEQ ID NO: 4097651 - RNA, 16 nt, Streptococcus pneumoniae R6
auucaaagaaccugca

SEQ ID NO: 4097652 - RNA, 19 nt, Streptococcus pneumoniae R6
auucaaagucauaaacauc

SEQ ID NO: 4097653 - RNA, 17 nt, Streptococcus pneumoniae R6
auucaaaguggguuuua

SEQ ID NO: 4097654 - RNA, 22 nt, Streptococcus pneumoniae R6
auucaaauuuagcuguaucauu

SEQ ID NO: 4097655 - RNA, 14 nt, Streptococcus pneumoniae R6
auucaacagcuuuu

SEQ ID NO: 4097656 - RNA, 18 nt, Streptococcus pneumoniae R6
auucaacaucacuuggua

SEQ ID NO: 4097657 - RNA, 19 nt, Streptococcus pneumoniae R6
auucaacauuuaucuauaa

SEQ ID NO: 4097658 - RNA, 15 nt, Streptococcus pneumoniae R6
auucaauauauuaug

SEQ ID NO: 4097659 - RNA, 14 nt, Streptococcus pneumoniae R6
auucaauccaucuc

SEQ ID NO: 4097660 - RNA, 15 nt, Streptococcus pneumoniae R6
auucaaucgcuauua

SEQ ID NO: 4097661 - RNA, 21 nt, Streptococcus pneumoniae R6
auucaaugugggaaacagauu

SEQ ID NO: 4097662 - RNA, 16 nt, Streptococcus pneumoniae R6
auucaauguuuacuca

SEQ ID NO: 4097663 - RNA, 20 nt, Streptococcus pneumoniae R6
auucaauguuuacucaguau

SEQ ID NO: 4097664 - RNA, 16 nt, Streptococcus pneumoniae R6
auucaauucuuuaaca

SEQ ID NO: 4097665 - RNA, 16 nt, Streptococcus pneumoniae R6
auucaccaacuacagu

SEQ ID NO: 4097666 - RNA, 14 nt, Streptococcus pneumoniae R6
auucaccuaaccaa

SEQ ID NO: 4097667 - RNA, 17 nt, Streptococcus pneumoniae R6
auucaccuaaccaaaua

SEQ ID NO: 4097668 - RNA, 18 nt, Streptococcus pneumoniae R6
auucaccuauuaacaaua

SEQ ID NO: 4097669 - RNA, 17 nt, Streptococcus pneumoniae R6
auucacuagccccagcu

SEQ ID NO: 4097670 - RNA, 16 nt, Streptococcus pneumoniae R6
auucacugagaucuuc

SEQ ID NO: 4097671 - RNA, 20 nt, Streptococcus pneumoniae R6
auucacugagaucuucuucu

SEQ ID NO: 4097672 - RNA, 13 nt, Streptococcus pneumoniae R6
auucagauuuuau

SEQ ID NO: 4097673 - RNA, 20 nt, Streptococcus pneumoniae R6
auucaggugauuuaccauag

SEQ ID NO: 4097674 - RNA, 19 nt, Streptococcus pneumoniae R6
auucauaguuacuccuuuu

SEQ ID NO: 4097675 - RNA, 13 nt, Streptococcus pneumoniae R6
auucauaucccca

SEQ ID NO: 4097676 - RNA, 19 nt, Streptococcus pneumoniae R6
auucauauccccagacaua

SEQ ID NO: 4097677 - RNA, 13 nt, Streptococcus pneumoniae R6
auucaucaagaga

SEQ ID NO: 4097678 - RNA, 22 nt, Streptococcus pneumoniae R6
auucaucauuuauaguuuugau

SEQ ID NO: 4097679 - RNA, 17 nt, Streptococcus pneumoniae R6
auucaugacaucuucca

SEQ ID NO: 4097680 - RNA, 19 nt, Streptococcus pneumoniae R6
auucaugacaucuuccaaa

SEQ ID NO: 4097681 - RNA, 16 nt, Streptococcus pneumoniae R6
auucaugauuggucaa

SEQ ID NO: 4097682 - RNA, 18 nt, Streptococcus pneumoniae R6
auucaugggauuucggau

SEQ ID NO: 4097683 - RNA, 15 nt, Streptococcus pneumoniae R6
auucauuuacucucc

SEQ ID NO: 4097684 - RNA, 14 nt, Streptococcus pneumoniae R6
auucauuugauuuu

SEQ ID NO: 4097685 - RNA, 16 nt, Streptococcus pneumoniae R6
auucauuugauuuucc

SEQ ID NO: 4097686 - RNA, 13 nt, Streptococcus pneumoniae R6
auucauuuucuua

SEQ ID NO: 4097687 - RNA, 19 nt, Streptococcus pneumoniae R6
auuccaaacaacaauacuu

SEQ ID NO: 4097688 - RNA, 14 nt, Streptococcus pneumoniae R6
auugacauuuaagc

SEQ ID NO: 4097689 - RNA, 17 nt, Streptococcus pneumoniae R6
auugacgcccuuaguaa

SEQ ID NO: 4097690 - RNA, 17 nt, Streptococcus pneumoniae R6
auugacucuaacuguau

SEQ ID NO: 4097691 - RNA, 12 nt, Streptococcus pneumoniae R6
auugacugccca

SEQ ID NO: 4097692 - RNA, 19 nt, Streptococcus pneumoniae R6
auugacugcccagacacuu

SEQ ID NO: 4097693 - RNA, 12 nt, Streptococcus pneumoniae R6
auugacugucaa

SEQ ID NO: 4097694 - RNA, 15 nt, Streptococcus pneumoniae R6
auugacuuuugaaaa

SEQ ID NO: 4097695 - RNA, 20 nt, Streptococcus pneumoniae R6
auugagaaaguuaaaaaaac

SEQ ID NO: 4097696 - RNA, 20 nt, Streptococcus pneumoniae R6
auugagaaaucguuucuaau

SEQ ID NO: 4097697 - RNA, 13 nt, Streptococcus pneumoniae R6
auugagaagccaa

SEQ ID NO: 4097698 - RNA, 14 nt, Streptococcus pneumoniae R6
auugagaagccaaa

SEQ ID NO: 4097699 - RNA, 16 nt, Streptococcus pneumoniae R6
auugagaagccaaaau

SEQ ID NO: 4097700 - RNA, 19 nt, Streptococcus pneumoniae R6
auugagagcgacuuuuucu

SEQ ID NO: 4097701 - RNA, 17 nt, Streptococcus pneumoniae R6
auugagcgcaggaagaa

SEQ ID NO: 4097702 - RNA, 21 nt, Streptococcus pneumoniae R6
auugaggaaguaccaaggaag

SEQ ID NO: 4097703 - RNA, 23 nt, Streptococcus pneumoniae R6
auugaggguaguaauuuucgaua

SEQ ID NO: 4097704 - RNA, 23 nt, Streptococcus pneumoniae R6
auugaguauaaacgaauagaaaa

SEQ ID NO: 4097705 - RNA, 16 nt, Streptococcus pneumoniae R6
auugaguauaaaugga

SEQ ID NO: 4097706 - RNA, 19 nt, Streptococcus pneumoniae R6
auugaguuuuaaucucaaa

SEQ ID NO: 4097707 - RNA, 23 nt, Streptococcus pneumoniae R6
auugaguuuuuugacuucaauca

SEQ ID NO: 4097708 - RNA, 23 nt, Streptococcus pneumoniae R6
auugauaaaauuuaaaaauagau

SEQ ID NO: 4097709 - RNA, 19 nt, Streptococcus pneumoniae R6
auugauaagaggauuuuaa

SEQ ID NO: 4097710 - RNA, 21 nt, Streptococcus pneumoniae R6
auugauaagaggauuuuaaag

SEQ ID NO: 4097711 - RNA, 22 nt, Streptococcus pneumoniae R6
auugauaggauauugacaacuc

SEQ ID NO: 4097712 - RNA, 19 nt, Streptococcus pneumoniae R6
auugauauuuauagaaaau

SEQ ID NO: 4097713 - RNA, 16 nt, Streptococcus pneumoniae R6
auugaugaacugcuug

SEQ ID NO: 4097714 - RNA, 13 nt, Streptococcus pneumoniae R6
auugaugcaaauc

SEQ ID NO: 4097715 - RNA, 18 nt, Streptococcus pneumoniae R6
auugaugcaaaucucauu

SEQ ID NO: 4097716 - RNA, 14 nt, Streptococcus pneumoniae R6
auugauuaggaaau

SEQ ID NO: 4097717 - RNA, 14 nt, Streptococcus pneumoniae R6
auugauuauccuuu

SEQ ID NO: 4097718 - RNA, 23 nt, Streptococcus pneumoniae R6
auugauuccgucauguucauuug

SEQ ID NO: 4097719 - RNA, 14 nt, Streptococcus pneumoniae R6
auugauugagaaau

SEQ ID NO: 4097720 - RNA, 15 nt, Streptococcus pneumoniae R6
auugauugagaaauc

SEQ ID NO: 4097721 - RNA, 16 nt, Streptococcus pneumoniae R6
auugauuuauagaaau

SEQ ID NO: 4097722 - RNA, 13 nt, Streptococcus pneumoniae R6
auugauuuccuga

SEQ ID NO: 4097723 - RNA, 16 nt, Streptococcus pneumoniae R6
auugauuugacuucca

SEQ ID NO: 4097724 - RNA, 15 nt, Streptococcus pneumoniae R6
auugauuuuucugag

SEQ ID NO: 4097725 - RNA, 22 nt, Streptococcus pneumoniae R6
auugauuuuucugagucuguga

SEQ ID NO: 4097726 - RNA, 17 nt, Streptococcus pneumoniae R6
auugcaaaggagaggag

SEQ ID NO: 4097727 - RNA, 17 nt, Streptococcus pneumoniae R6
auugcaagagggcuuca

SEQ ID NO: 4097728 - RNA, 21 nt, Streptococcus pneumoniae R6
auugcaagcccuuauuuccau

SEQ ID NO: 4097729 - RNA, 14 nt, Streptococcus pneumoniae R6
auugcaauuuauca

SEQ ID NO: 4097730 - RNA, 22 nt, Streptococcus pneumoniae R6
auugcagccaauuucuuuagca

SEQ ID NO: 4097731 - RNA, 21 nt, Streptococcus pneumoniae R6
auugcaggagaaaaugaaaua

SEQ ID NO: 4097732 - RNA, 15 nt, Streptococcus pneumoniae R6
auugccaacaaacau

SEQ ID NO: 4097733 - RNA, 18 nt, Streptococcus pneumoniae R6
auugccgacucaaguaca

SEQ ID NO: 4097734 - RNA, 17 nt, Streptococcus pneumoniae R6
auugccgauaucaccaa

SEQ ID NO: 4097735 - RNA, 14 nt, Streptococcus pneumoniae R6
auugcgcacuuguu

SEQ ID NO: 4097736 - RNA, 20 nt, Streptococcus pneumoniae R6
auugcgcggguucaauacaa

SEQ ID NO: 4097737 - RNA, 22 nt, Streptococcus pneumoniae R6
auugcggcugauuuugguguuc

SEQ ID NO: 4097738 - RNA, 19 nt, Streptococcus pneumoniae R6
auugcuagcaaugguuuag

SEQ ID NO: 4097739 - RNA, 20 nt, Streptococcus pneumoniae R6
auugcuaucuaggcugacaa

SEQ ID NO: 4097740 - RNA, 17 nt, Streptococcus pneumoniae R6
auugcuccgaucuuuca

SEQ ID NO: 4097741 - RNA, 18 nt, Streptococcus pneumoniae R6
auugcucuugacucguca

SEQ ID NO: 4097742 - RNA, 16 nt, Streptococcus pneumoniae R6
auugcuucaucuuuca

SEQ ID NO: 4097743 - RNA, 16 nt, Streptococcus pneumoniae R6
auugcuuuaaucugcu

SEQ ID NO: 4097744 - RNA, 19 nt, Streptococcus pneumoniae R6
auugcuuuuagagauuuuc

SEQ ID NO: 4097745 - RNA, 14 nt, Streptococcus pneumoniae R6
auuggaaaauaaau

SEQ ID NO: 4097746 - RNA, 22 nt, Streptococcus pneumoniae R6
auuggaaauaacaaaccaagaa

SEQ ID NO: 4097747 - RNA, 14 nt, Streptococcus pneumoniae R6
auuggaaauucaag

SEQ ID NO: 4097748 - RNA, 21 nt, Streptococcus pneumoniae R6
auuggaacuaaaguuccuaau

SEQ ID NO: 4097749 - RNA, 21 nt, Streptococcus pneumoniae R6
auuggacaaguuagccacaac

SEQ ID NO: 4097750 - RNA, 18 nt, Streptococcus pneumoniae R6
auuggauuuucugaaguu

SEQ ID NO: 4097751 - RNA, 13 nt, Streptococcus pneumoniae R6
auuggcaagagcu

SEQ ID NO: 4097752 - RNA, 19 nt, Streptococcus pneumoniae R6
auuggcaggcguuuuuuga

SEQ ID NO: 4097753 - RNA, 22 nt, Streptococcus pneumoniae R6
auuggcguguuugucaaacauc

SEQ ID NO: 4097754 - RNA, 15 nt, Streptococcus pneumoniae R6
auuggcucaaucaau

SEQ ID NO: 4097755 - RNA, 13 nt, Streptococcus pneumoniae R6
auuggggauugau

SEQ ID NO: 4097756 - RNA, 16 nt, Streptococcus pneumoniae R6
auugguaaauucuuca

SEQ ID NO: 4097757 - RNA, 23 nt, Streptococcus pneumoniae R6
auugguaaauucuucauacucaa

SEQ ID NO: 4097758 - RNA, 16 nt, Streptococcus pneumoniae R6
auuggucgcuucaagu

SEQ ID NO: 4097759 - RNA, 17 nt, Streptococcus pneumoniae R6
auuggucgcuucaaguu

SEQ ID NO: 4097760 - RNA, 15 nt, Streptococcus pneumoniae R6
auuggucgcuuccaa

SEQ ID NO: 4097761 - RNA, 13 nt, Streptococcus pneumoniae R6
auugguuuaaaua

SEQ ID NO: 4097762 - RNA, 13 nt, Streptococcus pneumoniae R6
auuguaaaaagag

SEQ ID NO: 4097763 - RNA, 17 nt, Streptococcus pneumoniae R6
auuguaaaaagagggau

SEQ ID NO: 4097764 - RNA, 22 nt, Streptococcus pneumoniae R6
auuguaaaaagagggauucuua

SEQ ID NO: 4097765 - RNA, 18 nt, Streptococcus pneumoniae R6
auuguaaggauuuacuug

SEQ ID NO: 4097766 - RNA, 15 nt, Streptococcus pneumoniae R6
auuguagaggaggau

SEQ ID NO: 4097767 - RNA, 13 nt, Streptococcus pneumoniae R6
auuguagauguuc

SEQ ID NO: 4097768 - RNA, 15 nt, Streptococcus pneumoniae R6
auuguaggaaagaag

SEQ ID NO: 4097769 - RNA, 21 nt, Streptococcus pneumoniae R6
auuguaggaaagaagguguuu

SEQ ID NO: 4097770 - RNA, 23 nt, Streptococcus pneumoniae R6
auuguaggacuuccuuuucuuau

SEQ ID NO: 4097771 - RNA, 12 nt, Streptococcus pneumoniae R6
auuguaggugua

SEQ ID NO: 4097772 - RNA, 18 nt, Streptococcus pneumoniae R6
auuguauacguuuuuacu

SEQ ID NO: 4097773 - RNA, 21 nt, Streptococcus pneumoniae R6
auuguauagugaauugaaaua

SEQ ID NO: 4097774 - RNA, 20 nt, Streptococcus pneumoniae R6
auuguaucugucguuagcac

SEQ ID NO: 4097775 - RNA, 20 nt, Streptococcus pneumoniae R6
auugucaaacaagaccucaa

SEQ ID NO: 4097776 - RNA, 19 nt, Streptococcus pneumoniae R6
auugucaguugaaaaggca

SEQ ID NO: 4097777 - RNA, 21 nt, Streptococcus pneumoniae R6
auugucaguugaaaaggcauc

SEQ ID NO: 4097778 - RNA, 22 nt, Streptococcus pneumoniae R6
auugucaugucauguuagaaaa

SEQ ID NO: 4097779 - RNA, 14 nt, Streptococcus pneumoniae R6
auugucauuuaugu

SEQ ID NO: 4097780 - RNA, 17 nt, Streptococcus pneumoniae R6
auugucauuuuucugcu

SEQ ID NO: 4097781 - RNA, 14 nt, Streptococcus pneumoniae R6
auugucuaaaauuu

SEQ ID NO: 4097782 - RNA, 16 nt, Streptococcus pneumoniae R6
auugucuaaaauuuca

SEQ ID NO: 4097783 - RNA, 18 nt, Streptococcus pneumoniae R6
auugucuaacuuuuuugg

SEQ ID NO: 4097784 - RNA, 19 nt, Streptococcus pneumoniae R6
auugucuaagcgaaacaac

SEQ ID NO: 4097785 - RNA, 17 nt, Streptococcus pneumoniae R6
auugucucuaaaaauaa

SEQ ID NO: 4097786 - RNA, 21 nt, Streptococcus pneumoniae R6
auugucucuaaaaauaaaaaa

SEQ ID NO: 4097787 - RNA, 22 nt, Streptococcus pneumoniae R6
auugucucuaaaaauaaaaaag

SEQ ID NO: 4097788 - RNA, 20 nt, Streptococcus pneumoniae R6
auugucuuacguucauccau

SEQ ID NO: 4097789 - RNA, 17 nt, Streptococcus pneumoniae R6
auugugcaguuuucauu

SEQ ID NO: 4097790 - RNA, 13 nt, Streptococcus pneumoniae R6
auuucacuuguau

SEQ ID NO: 4097791 - RNA, 19 nt, Streptococcus pneumoniae R6
auuucacuuguauccuccu

SEQ ID NO: 4097792 - RNA, 21 nt, Streptococcus pneumoniae R6
auuucagaaaucuucucuuga

SEQ ID NO: 4097793 - RNA, 21 nt, Streptococcus pneumoniae R6
auuucaguuccccaaaaagua

SEQ ID NO: 4097794 - RNA, 22 nt, Streptococcus pneumoniae R6
auuucaguuccccaaaaaguag

SEQ ID NO: 4097795 - RNA, 17 nt, Streptococcus pneumoniae R6
auuucauacgauaaaaa

SEQ ID NO: 4097796 - RNA, 18 nt, Streptococcus pneumoniae R6
auuucauacgauaaaaau

SEQ ID NO: 4097797 - RNA, 12 nt, Streptococcus pneumoniae R6
auuucaucccca

SEQ ID NO: 4097798 - RNA, 18 nt, Streptococcus pneumoniae R6
auuucaucgauuucuucu

SEQ ID NO: 4097799 - RNA, 15 nt, Streptococcus pneumoniae R6
auuucaugacagauu

SEQ ID NO: 4097800 - RNA, 22 nt, Streptococcus pneumoniae R6
auuucauuccaucauaaaaaua

SEQ ID NO: 4097801 - RNA, 21 nt, Streptococcus pneumoniae R6
auuucauuuggcuauaaaaaa

SEQ ID NO: 4097802 - RNA, 18 nt, Streptococcus pneumoniae R6
auuucauuuuaauauaua

SEQ ID NO: 4097803 - RNA, 14 nt, Streptococcus pneumoniae R6
auuucauuuucuac

SEQ ID NO: 4097804 - RNA, 22 nt, Streptococcus pneumoniae R6
auuucauuuucuacuaaaauua

SEQ ID NO: 4097805 - RNA, 22 nt, Streptococcus pneumoniae R6
auuucauuuugcgauauaguga

SEQ ID NO: 4097806 - RNA, 12 nt, Streptococcus pneumoniae R6
auuuccaaaaag

SEQ ID NO: 4097807 - RNA, 17 nt, Streptococcus pneumoniae R6
auuuccaccugcagcaa

SEQ ID NO: 4097808 - RNA, 12 nt, Streptococcus pneumoniae R6
auuuccaucaac

SEQ ID NO: 4097809 - RNA, 21 nt, Streptococcus pneumoniae R6
auuuccaucucggucaucauc

SEQ ID NO: 4097810 - RNA, 17 nt, Streptococcus pneumoniae R6
auuuccauguaaaauua

SEQ ID NO: 4097811 - RNA, 13 nt, Streptococcus pneumoniae R6
auuuccauuuucc

SEQ ID NO: 4097812 - RNA, 21 nt, Streptococcus pneumoniae R6
auuucccauugcaaucccaag

SEQ ID NO: 4097813 - RNA, 14 nt, Streptococcus pneumoniae R6
auuucccauuugua

SEQ ID NO: 4097814 - RNA, 21 nt, Streptococcus pneumoniae R6
auuucccauuuuuugcaucaa

SEQ ID NO: 4097815 - RNA, 18 nt, Streptococcus pneumoniae R6
auuuccgauuucagaauc

SEQ ID NO: 4097816 - RNA, 20 nt, Streptococcus pneumoniae R6
auuuccuagccuauuuuuua

SEQ ID NO: 4097817 - RNA, 15 nt, Streptococcus pneumoniae R6
auuuccuucguuuuc

SEQ ID NO: 4097818 - RNA, 12 nt, Streptococcus pneumoniae R6
auuucgauaaag

SEQ ID NO: 4097819 - RNA, 17 nt, Streptococcus pneumoniae R6
auuucgauugucaucau

SEQ ID NO: 4097820 - RNA, 18 nt, Streptococcus pneumoniae R6
auuucgcuauuuaaacug

SEQ ID NO: 4097821 - RNA, 15 nt, Streptococcus pneumoniae R6
auuucguaagaaauu

SEQ ID NO: 4097822 - RNA, 14 nt, Streptococcus pneumoniae R6
auuucgucaguucu

SEQ ID NO: 4097823 - RNA, 22 nt, Streptococcus pneumoniae R6
auuucguccuuucuuuuuugaa

SEQ ID NO: 4097824 - RNA, 19 nt, Streptococcus pneumoniae R6
auuucuaaaaauguuuuaa

SEQ ID NO: 4097825 - RNA, 17 nt, Streptococcus pneumoniae R6
auuucuaaaacauuguu

SEQ ID NO: 4097826 - RNA, 17 nt, Streptococcus pneumoniae R6
auuucuaacaauauuuu

SEQ ID NO: 4097827 - RNA, 19 nt, Streptococcus pneumoniae R6
auuucuaacaauguuuuag

SEQ ID NO: 4097828 - RNA, 18 nt, Streptococcus pneumoniae R6
auuucuaacauauuucua

SEQ ID NO: 4097829 - RNA, 13 nt, Streptococcus pneumoniae R6
auuucuacaaaug

SEQ ID NO: 4097830 - RNA, 22 nt, Streptococcus pneumoniae R6
auuucuacuguauacuuuuuca

SEQ ID NO: 4097831 - RNA, 13 nt, Streptococcus pneumoniae R6
auuucuagaaauu

SEQ ID NO: 4097832 - RNA, 14 nt, Streptococcus pneumoniae R6
auuucuagaaauua

SEQ ID NO: 4097833 - RNA, 23 nt, Streptococcus pneumoniae R6
auuucuaguuuugguuuuucuuc

SEQ ID NO: 4097834 - RNA, 14 nt, Streptococcus pneumoniae R6
auuucuauaaauca

SEQ ID NO: 4097835 - RNA, 18 nt, Streptococcus pneumoniae R6
auuucuauaaauucauuu

SEQ ID NO: 4097836 - RNA, 17 nt, Streptococcus pneumoniae R6
auuucuauacuuuuucu

SEQ ID NO: 4097837 - RNA, 22 nt, Streptococcus pneumoniae R6
auuucuauaggucguguauaga

SEQ ID NO: 4097838 - RNA, 15 nt, Streptococcus pneumoniae R6
auuucuaugauaaaa

SEQ ID NO: 4097839 - RNA, 16 nt, Streptococcus pneumoniae R6
auuucuauugaaauga

SEQ ID NO: 4097840 - RNA, 17 nt, Streptococcus pneumoniae R6
auuucuauuuuaaaaau

SEQ ID NO: 4097841 - RNA, 21 nt, Streptococcus pneumoniae R6
auuucucagggucuuuguucu

SEQ ID NO: 4097842 - RNA, 24 nt, Streptococcus pneumoniae R6
auuucucagggucuuuguucugaa

SEQ ID NO: 4097843 - RNA, 18 nt, Streptococcus pneumoniae R6
auuucuccuguuucaaag

SEQ ID NO: 4097844 - RNA, 19 nt, Streptococcus pneumoniae R6
auuucuccuguuucaaagu

SEQ ID NO: 4097845 - RNA, 14 nt, Streptococcus pneumoniae R6
auuucucuacaaau

SEQ ID NO: 4097846 - RNA, 15 nt, Streptococcus pneumoniae R6
auuucucuacaaaua

SEQ ID NO: 4097847 - RNA, 16 nt, Streptococcus pneumoniae R6
auuucucuacaaauaa

SEQ ID NO: 4097848 - RNA, 21 nt, Streptococcus pneumoniae R6
auuucucuacaaauaagaaac

SEQ ID NO: 4097849 - RNA, 15 nt, Streptococcus pneumoniae R6
auuucucuauucuuu

SEQ ID NO: 4097850 - RNA, 23 nt, Streptococcus pneumoniae R6
auuucugaaaucaacacaggauu

SEQ ID NO: 4097851 - RNA, 22 nt, Streptococcus pneumoniae R6
auuucugccauauguccuucau

SEQ ID NO: 4097852 - RNA, 23 nt, Streptococcus pneumoniae R6
auuucuggauaacugaaauugag

SEQ ID NO: 4097853 - RNA, 12 nt, Streptococcus pneumoniae R6
auuucuggauga

SEQ ID NO: 4097854 - RNA, 20 nt, Streptococcus pneumoniae R6
auuucuggaugauucuuuuc

SEQ ID NO: 4097855 - RNA, 15 nt, Streptococcus pneumoniae R6
auuucuguaaaaaua

SEQ ID NO: 4097856 - RNA, 17 nt, Streptococcus pneumoniae R6
auuucuguaaaaauaca

SEQ ID NO: 4097857 - RNA, 15 nt, Streptococcus pneumoniae R6
auuucuguguuucau

SEQ ID NO: 4097858 - RNA, 21 nt, Streptococcus pneumoniae R6
auuucuguguuucauagauuu

SEQ ID NO: 4097859 - RNA, 16 nt, Streptococcus pneumoniae R6
auuucuuaguuacagc

SEQ ID NO: 4097860 - RNA, 22 nt, Streptococcus pneumoniae R6
auuucuucaguauaaacuguaa

SEQ ID NO: 4097861 - RNA, 14 nt, Streptococcus pneumoniae R6
auuucuucuggaag

SEQ ID NO: 4097862 - RNA, 12 nt, Streptococcus pneumoniae R6
auuucuucuugg

SEQ ID NO: 4097863 - RNA, 22 nt, Streptococcus pneumoniae R6
auuucuugacauacaacuuaaa

SEQ ID NO: 4097864 - RNA, 16 nt, Streptococcus pneumoniae R6
auuucuuguucaacca

SEQ ID NO: 4097865 - RNA, 14 nt, Streptococcus pneumoniae R6
auuucuuuagcaua

SEQ ID NO: 4097866 - RNA, 21 nt, Streptococcus pneumoniae R6
auuucuuuagucccauuuuca

SEQ ID NO: 4097867 - RNA, 15 nt, Streptococcus pneumoniae R6
auuucuuuauauaaa

SEQ ID NO: 4097868 - RNA, 14 nt, Streptococcus pneumoniae R6
auuucuuugaaauc

SEQ ID NO: 4097869 - RNA, 19 nt, Streptococcus pneumoniae R6
auuugaaaaaaauuuuauu

SEQ ID NO: 4097870 - RNA, 11 nt, Streptococcus pneumoniae R6
auuugaaacaa

SEQ ID NO: 4097871 - RNA, 14 nt, Streptococcus pneumoniae R6
auuugaacauuacu

SEQ ID NO: 4097872 - RNA, 17 nt, Streptococcus pneumoniae R6
auuugaauagaaaguau

SEQ ID NO: 4097873 - RNA, 17 nt, Streptococcus pneumoniae R6
auuugacauaaucgcug

SEQ ID NO: 4097874 - RNA, 16 nt, Streptococcus pneumoniae R6
auuugaccauuucaac

SEQ ID NO: 4097875 - RNA, 17 nt, Streptococcus pneumoniae R6
auuugacguuuccuucu

SEQ ID NO: 4097876 - RNA, 18 nt, Streptococcus pneumoniae R6
auuugacguuuccuucua

SEQ ID NO: 4097877 - RNA, 21 nt, Streptococcus pneumoniae R6
auuugacuggagaguugugaa

SEQ ID NO: 4097878 - RNA, 12 nt, Streptococcus pneumoniae R6
auuugacugucc

SEQ ID NO: 4097879 - RNA, 15 nt, Streptococcus pneumoniae R6
auuugacuuccaaaa

SEQ ID NO: 4097880 - RNA, 14 nt, Streptococcus pneumoniae R6
auuugagugagcac

SEQ ID NO: 4097881 - RNA, 22 nt, Streptococcus pneumoniae R6
auuugauaagaauaucaagaua

SEQ ID NO: 4097882 - RNA, 19 nt, Streptococcus pneumoniae R6
auuugauauauaaaugaaa

SEQ ID NO: 4097883 - RNA, 17 nt, Streptococcus pneumoniae R6
auuugaugagaaaauaa

SEQ ID NO: 4097884 - RNA, 18 nt, Streptococcus pneumoniae R6
auuugaugcugcauuucu

SEQ ID NO: 4097885 - RNA, 22 nt, Streptococcus pneumoniae R6
auuugaugcugcauuucuggau

SEQ ID NO: 4097886 - RNA, 21 nt, Streptococcus pneumoniae R6
auuugauuaggagauucuuau

SEQ ID NO: 4097887 - RNA, 19 nt, Streptococcus pneumoniae R6
auuugcagacgaaauacaa

SEQ ID NO: 4097888 - RNA, 18 nt, Streptococcus pneumoniae R6
auuugcaucccuugaaua

SEQ ID NO: 4097889 - RNA, 14 nt, Streptococcus pneumoniae R6
auuugccagaaaaa

SEQ ID NO: 4097890 - RNA, 17 nt, Streptococcus pneumoniae R6
auuugccuaugaaauga

SEQ ID NO: 4097891 - RNA, 21 nt, Streptococcus pneumoniae R6
auuugccuaugaaaugagaaa

SEQ ID NO: 4097892 - RNA, 15 nt, Streptococcus pneumoniae R6
auuuuguucuuuuuc

SEQ ID NO: 4097893 - RNA, 16 nt, Streptococcus pneumoniae R6
auuuuguucuuuuuca

SEQ ID NO: 4097894 - RNA, 16 nt, Streptococcus pneumoniae R6
auuuuuaaauucuucc

SEQ ID NO: 4097895 - RNA, 18 nt, Streptococcus pneumoniae R6
auuuuuaaauuuuaucaa

SEQ ID NO: 4097896 - RNA, 20 nt, Streptococcus pneumoniae R6
auuuuuaaauuuuaucaauc

SEQ ID NO: 4097897 - RNA, 12 nt, Streptococcus pneumoniae R6
auuuuuaagaaa

SEQ ID NO: 4097898 - RNA, 15 nt, Streptococcus pneumoniae R6
auuuuuacaguauuu

SEQ ID NO: 4097899 - RNA, 20 nt, Streptococcus pneumoniae R6
auuuuuacaguauuuauaaa

SEQ ID NO: 4097900 - RNA, 20 nt, Streptococcus pneumoniae R6
auuuuuacuuuauuuucuca

SEQ ID NO: 4097901 - RNA, 22 nt, Streptococcus pneumoniae R6
auuuuuagaaggauaaauuuua

SEQ ID NO: 4097902 - RNA, 12 nt, Streptococcus pneumoniae R6
auuuuuaguuga

SEQ ID NO: 4097903 - RNA, 22 nt, Streptococcus pneumoniae R6
auuuuuaugauucgcuauucuu

SEQ ID NO: 4097904 - RNA, 14 nt, Streptococcus pneumoniae R6
auuuuuauugagua

SEQ ID NO: 4097905 - RNA, 18 nt, Streptococcus pneumoniae R6
auuuuuauugaguauuag

SEQ ID NO: 4097906 - RNA, 14 nt, Streptococcus pneumoniae R6
auuuuucaaauaac

SEQ ID NO: 4097907 - RNA, 19 nt, Streptococcus pneumoniae R6
auuuuucauuuaauauauu

SEQ ID NO: 4097908 - RNA, 16 nt, Streptococcus pneumoniae R6
auuuuuccuucaucaa

SEQ ID NO: 4097909 - RNA, 18 nt, Streptococcus pneumoniae R6
auuuuucgacugugauuu

SEQ ID NO: 4097910 - RNA, 20 nt, Streptococcus pneumoniae R6
auuuuucgacugugauuuuu

SEQ ID NO: 4097911 - RNA, 19 nt, Streptococcus pneumoniae R6
auuuuucgguucuuuguca

SEQ ID NO: 4097912 - RNA, 22 nt, Streptococcus pneumoniae R6
auuuuucguauaccauaauaaa

SEQ ID NO: 4097913 - RNA, 22 nt, Streptococcus pneumoniae R6
auuuuucugagucugugauuga

SEQ ID NO: 4097914 - RNA, 17 nt, Streptococcus pneumoniae R6
auuuuucuguuuucuuc

SEQ ID NO: 4097915 - RNA, 23 nt, Streptococcus pneumoniae R6
auuuuucuucuuuucuuuuaugu

SEQ ID NO: 4097916 - RNA, 16 nt, Streptococcus pneumoniae R6
auuuuucuuuuuucgu

SEQ ID NO: 4097917 - RNA, 15 nt, Streptococcus pneumoniae R6
auuuuugaaaguacu

SEQ ID NO: 4097918 - RNA, 19 nt, Streptococcus pneumoniae R6
auuuuugaauauuaguaaa

SEQ ID NO: 4097919 - RNA, 16 nt, Streptococcus pneumoniae R6
auuuuugagcagaaca

SEQ ID NO: 4097920 - RNA, 20 nt, Streptococcus pneumoniae R6
auuuuugagccguuucuuug

SEQ ID NO: 4097921 - RNA, 21 nt, Streptococcus pneumoniae R6
auuuuuggaaaaaauaaaaaa

SEQ ID NO: 4097922 - RNA, 19 nt, Streptococcus pneumoniae R6
auuuuuggaguuugauuuc

SEQ ID NO: 4097923 - RNA, 19 nt, Streptococcus pneumoniae R6
auuuuuguguuuuuucuug

SEQ ID NO: 4097924 - RNA, 14 nt, Streptococcus pneumoniae R6
auuuuuuaacagau

SEQ ID NO: 4097925 - RNA, 23 nt, Streptococcus pneumoniae R6
auuuuuuaacauacuguuuuccu

SEQ ID NO: 4097926 - RNA, 17 nt, Streptococcus pneumoniae R6
auuuuuuaauuaaucac

SEQ ID NO: 4097927 - RNA, 14 nt, Streptococcus pneumoniae R6
auuuuuuagcuucu

SEQ ID NO: 4097928 - RNA, 18 nt, Streptococcus pneumoniae R6
auuuuuuaguucagaaug

SEQ ID NO: 4097929 - RNA, 19 nt, Streptococcus pneumoniae R6
auuuuuuaucuaguauacu

SEQ ID NO: 4097930 - RNA, 21 nt, Streptococcus pneumoniae R6
auuuuuuauuaagccucuuuc

SEQ ID NO: 4097931 - RNA, 20 nt, Streptococcus pneumoniae R6
auuuuuucaaucgcagcauc

SEQ ID NO: 4097932 - RNA, 14 nt, Streptococcus pneumoniae R6
auuuuuucaccaaa

SEQ ID NO: 4097933 - RNA, 15 nt, Streptococcus pneumoniae R6
auuuuuuccaauucu

SEQ ID NO: 4097934 - RNA, 23 nt, Streptococcus pneumoniae R6
auuuuuucugaagacaaaucauu

SEQ ID NO: 4097935 - RNA, 18 nt, Streptococcus pneumoniae R6
auuuuuucuguaaaauca

SEQ ID NO: 4097936 - RNA, 19 nt, Streptococcus pneumoniae R6
auuuuuugaaauaagaaua

SEQ ID NO: 4097937 - RNA, 16 nt, Streptococcus pneumoniae R6
auuuuuugcaucaacu

SEQ ID NO: 4097938 - RNA, 12 nt, Streptococcus pneumoniae R6
auuuuuuuacuu

SEQ ID NO: 4097939 - RNA, 13 nt, Streptococcus pneumoniae R6
auuuuuuuacuua

SEQ ID NO: 4097940 - RNA, 22 nt, Streptococcus pneumoniae R6
auuuuuuuauccauuuuucaaa

SEQ ID NO: 4097941 - RNA, 21 nt, Streptococcus pneumoniae R6
auuuuuuucuaauuaaaucau

SEQ ID NO: 4097942 - RNA, 14 nt, Streptococcus pneumoniae R6
auuuuuuuuaaaaa

SEQ ID NO: 4097943 - RNA, 21 nt, Streptococcus pneumoniae R6
caaaaaaaacuacguuuugcu

SEQ ID NO: 4097944 - RNA, 20 nt, Streptococcus pneumoniae R6
caaaaaaaauacaguaucca

SEQ ID NO: 4097945 - RNA, 14 nt, Streptococcus pneumoniae R6
caaaaaaacuccaa

SEQ ID NO: 4097946 - RNA, 14 nt, Streptococcus pneumoniae R6
caaaaaaagaaguu

SEQ ID NO: 4097947 - RNA, 16 nt, Streptococcus pneumoniae R6
caaaaaaauucuucac

SEQ ID NO: 4097948 - RNA, 17 nt, Streptococcus pneumoniae R6
caaaaaaauucuucaca

SEQ ID NO: 4097949 - RNA, 19 nt, Streptococcus pneumoniae R6
caaaaaacgcauaguauca

SEQ ID NO: 4097950 - RNA, 12 nt, Streptococcus pneumoniae R6
caaaaaagaaac

SEQ ID NO: 4097951 - RNA, 16 nt, Streptococcus pneumoniae R6
caaaaaagaaaccaau

SEQ ID NO: 4097952 - RNA, 22 nt, Streptococcus pneumoniae R6
caaaaaagagguugucuguaac

SEQ ID NO: 4097953 - RNA, 23 nt, Streptococcus pneumoniae R6
caaaaaaggaguaacuaugaauc

SEQ ID NO: 4097954 - RNA, 23 nt, Streptococcus pneumoniae R6
caaaaaaggucaucagcagagaa

SEQ ID NO: 4097955 - RNA, 22 nt, Streptococcus pneumoniae R6
caaaaaauaugauggaagacug

SEQ ID NO: 4097956 - RNA, 13 nt, Streptococcus pneumoniae R6
caaaaaaucuucc

SEQ ID NO: 4097957 - RNA, 14 nt, Streptococcus pneumoniae R6
caaaaacaaagaga

SEQ ID NO: 4097958 - RNA, 18 nt, Streptococcus pneumoniae R6
caaaaacaaagagauugc

SEQ ID NO: 4097959 - RNA, 19 nt, Streptococcus pneumoniae R6
caaaaacacaauuuuagga

SEQ ID NO: 4097960 - RNA, 18 nt, Streptococcus pneumoniae R6
caaaaacgcauaguauca

SEQ ID NO: 4097961 - RNA, 23 nt, Streptococcus pneumoniae R6
caaaaagaaaaaacgcuacuccu

SEQ ID NO: 4097962 - RNA, 20 nt, Streptococcus pneumoniae R6
caaaaaggaguuaccuuucu

SEQ ID NO: 4097963 - RNA, 14 nt, Streptococcus pneumoniae R6
caaaaaguccucuu

SEQ ID NO: 4097964 - RNA, 19 nt, Streptococcus pneumoniae R6
caaaaagucguuaaaagca

SEQ ID NO: 4097965 - RNA, 19 nt, Streptococcus pneumoniae R6
caaaaagugaacaaagcug

SEQ ID NO: 4097966 - RNA, 15 nt, Streptococcus pneumoniae R6
caaaaaguggaaaga

SEQ ID NO: 4097967 - RNA, 19 nt, Streptococcus pneumoniae R6
caaaaaguggaaagagcag

SEQ ID NO: 4097968 - RNA, 20 nt, Streptococcus pneumoniae R6
caaaaauagaaauaaaaauc

SEQ ID NO: 4097969 - RNA, 16 nt, Streptococcus pneumoniae R6
caaaaauaucauuaag

SEQ ID NO: 4097970 - RNA, 13 nt, Streptococcus pneumoniae R6
caaaaauuugauc

SEQ ID NO: 4097971 - RNA, 14 nt, Streptococcus pneumoniae R6
caaaaauuugauca

SEQ ID NO: 4097972 - RNA, 14 nt, Streptococcus pneumoniae R6
caaaacacaaaaag

SEQ ID NO: 4097973 - RNA, 16 nt, Streptococcus pneumoniae R6
caaaacacaaaaaguc

SEQ ID NO: 4097974 - RNA, 14 nt, Streptococcus pneumoniae R6
caaaacacuaccaa

SEQ ID NO: 4097975 - RNA, 15 nt, Streptococcus pneumoniae R6
caaaacacuguuuua

SEQ ID NO: 4097976 - RNA, 17 nt, Streptococcus pneumoniae R6
caaaacacuguuuuaag

SEQ ID NO: 4097977 - RNA, 19 nt, Streptococcus pneumoniae R6
caaaacacuguuuuaaggu

SEQ ID NO: 4097978 - RNA, 22 nt, Streptococcus pneumoniae R6
caaaacacuguuuugagcugac

SEQ ID NO: 4097979 - RNA, 22 nt, Streptococcus pneumoniae R6
caaaacaguguuuuaagcugac

SEQ ID NO: 4097980 - RNA, 21 nt, Streptococcus pneumoniae R6
caaaacaguguuuugagcagc

SEQ ID NO: 4097981 - RNA, 14 nt, Streptococcus pneumoniae R6
caaaaccaaacauc

SEQ ID NO: 4097982 - RNA, 19 nt, Streptococcus pneumoniae R6
caaaaccauucaaaauacu

SEQ ID NO: 4097983 - RNA, 19 nt, Streptococcus pneumoniae R6
caaaacgcugcucaaaauc

SEQ ID NO: 4097984 - RNA, 17 nt, Streptococcus pneumoniae R6
caaaacuaacccuagaa

SEQ ID NO: 4097985 - RNA, 19 nt, Streptococcus pneumoniae R6
caaaacuaacccuagaaaa

SEQ ID NO: 4097986 - RNA, 22 nt, Streptococcus pneumoniae R6
caaaacuaauucacgaacauga

SEQ ID NO: 4097987 - RNA, 14 nt, Streptococcus pneumoniae R6
caaaacuauaaaug

SEQ ID NO: 4097988 - RNA, 19 nt, Streptococcus pneumoniae R6
caaaacuauaaaugaugaa

SEQ ID NO: 4097989 - RNA, 17 nt, Streptococcus pneumoniae R6
caaaacugguccagaga

SEQ ID NO: 4097990 - RNA, 19 nt, Streptococcus pneumoniae R6
caaaacugguccagagaua

SEQ ID NO: 4097991 - RNA, 16 nt, Streptococcus pneumoniae R6
caaaacuguaaaguag

SEQ ID NO: 4097992 - RNA, 21 nt, Streptococcus pneumoniae R6
caaaacuguaaaguagcaaaa

SEQ ID NO: 4097993 - RNA, 13 nt, Streptococcus pneumoniae R6
caaaacuuucaua

SEQ ID NO: 4097994 - RNA, 14 nt, Streptococcus pneumoniae R6
caaagcuaaauccu

SEQ ID NO: 4097995 - RNA, 22 nt, Streptococcus pneumoniae R6
caaagcuaagaaaguaagaauc

SEQ ID NO: 4097996 - RNA, 16 nt, Streptococcus pneumoniae R6
caaagcucccaaauua

SEQ ID NO: 4097997 - RNA, 14 nt, Streptococcus pneumoniae R6
caaagcucuucagc

SEQ ID NO: 4097998 - RNA, 18 nt, Streptococcus pneumoniae R6
caaaggaaccaaaugauu

SEQ ID NO: 4097999 - RNA, 22 nt, Streptococcus pneumoniae R6
caaaggagaggagaauuuuuga

SEQ ID NO: 4098000 - RNA, 24 nt, Streptococcus pneumoniae R6
caaaggauuguagguguaaacuuu

SEQ ID NO: 4098001 - RNA, 16 nt, Streptococcus pneumoniae R6
caaaggauuuaguucu

SEQ ID NO: 4098002 - RNA, 17 nt, Streptococcus pneumoniae R6
caaaggauuuaguucug

SEQ ID NO: 4098003 - RNA, 23 nt, Streptococcus pneumoniae R6
caaaggauuucugcuuuuuauac

SEQ ID NO: 4098004 - RNA, 20 nt, Streptococcus pneumoniae R6
caaaggcuuuuucuucuucg

SEQ ID NO: 4098005 - RNA, 18 nt, Streptococcus pneumoniae R6
caaagggaaaucugaaaa

SEQ ID NO: 4098006 - RNA, 19 nt, Streptococcus pneumoniae R6
caaagggagguaaagauag

SEQ ID NO: 4098007 - RNA, 15 nt, Streptococcus pneumoniae R6
caaagggcaaaucuu

SEQ ID NO: 4098008 - RNA, 16 nt, Streptococcus pneumoniae R6
caaagggcaaaucuuu

SEQ ID NO: 4098009 - RNA, 22 nt, Streptococcus pneumoniae R6
caaagguaauccaauugaggaa

SEQ ID NO: 4098010 - RNA, 14 nt, Streptococcus pneumoniae R6
caaagguugcuuga

SEQ ID NO: 4098011 - RNA, 16 nt, Streptococcus pneumoniae R6
caaagguuugauuagu

SEQ ID NO: 4098012 - RNA, 18 nt, Streptococcus pneumoniae R6
caaagguuugauuagucc

SEQ ID NO: 4098013 - RNA, 13 nt, Streptococcus pneumoniae R6
caaaguaaaauac

SEQ ID NO: 4098014 - RNA, 18 nt, Streptococcus pneumoniae R6
caaaguaauuugaguaaa

SEQ ID NO: 4098015 - RNA, 13 nt, Streptococcus pneumoniae R6
caaaguagucauu

SEQ ID NO: 4098016 - RNA, 23 nt, Streptococcus pneumoniae R6
caaaguagugaaugauucugaaa

SEQ ID NO: 4098017 - RNA, 17 nt, Streptococcus pneumoniae R6
caaaguauuaaaauaag

SEQ ID NO: 4098018 - RNA, 22 nt, Streptococcus pneumoniae R6
caaaguccucccaccaaacuuu

SEQ ID NO: 4098019 - RNA, 15 nt, Streptococcus pneumoniae R6
caaaguccuuacuca

SEQ ID NO: 4098020 - RNA, 16 nt, Streptococcus pneumoniae R6
caaaguccuuacucaa

SEQ ID NO: 4098021 - RNA, 14 nt, Streptococcus pneumoniae R6
caaagugcaaacua

SEQ ID NO: 4098022 - RNA, 18 nt, Streptococcus pneumoniae R6
caaaguggguuuuaacua

SEQ ID NO: 4098023 - RNA, 18 nt, Streptococcus pneumoniae R6
caaaguuaaguauccauc

SEQ ID NO: 4098024 - RNA, 19 nt, Streptococcus pneumoniae R6
caaaguuccacccauggca

SEQ ID NO: 4098025 - RNA, 14 nt, Streptococcus pneumoniae R6
caaaguuccgaaaa

SEQ ID NO: 4098026 - RNA, 15 nt, Streptococcus pneumoniae R6
caaaguuuuugguaa

SEQ ID NO: 4098027 - RNA, 22 nt, Streptococcus pneumoniae R6
caaauaaaaagcuuuaagacag

SEQ ID NO: 4098028 - RNA, 23 nt, Streptococcus pneumoniae R6
caaauaaaaagcuuuaagacaga

SEQ ID NO: 4098029 - RNA, 17 nt, Streptococcus pneumoniae R6
caaauaaacggacaaaa

SEQ ID NO: 4098030 - RNA, 21 nt, Streptococcus pneumoniae R6
caaauaaacggacaaaacugu

SEQ ID NO: 4098031 - RNA, 13 nt, Streptococcus pneumoniae R6
caaauaaaucauu

SEQ ID NO: 4098032 - RNA, 21 nt, Streptococcus pneumoniae R6
caaauaagaaaccgucaucag

SEQ ID NO: 4098033 - RNA, 16 nt, Streptococcus pneumoniae R6
caaauaagaaagacca

SEQ ID NO: 4098034 - RNA, 13 nt, Streptococcus pneumoniae R6
caaauaauaugua

SEQ ID NO: 4098035 - RNA, 21 nt, Streptococcus pneumoniae R6
caaauaauuuauccaaaggau

SEQ ID NO: 4098036 - RNA, 15 nt, Streptococcus pneumoniae R6
caaauaccauaaacu

SEQ ID NO: 4098037 - RNA, 17 nt, Streptococcus pneumoniae R6
caaauaccauaaacuaa

SEQ ID NO: 4098038 - RNA, 19 nt, Streptococcus pneumoniae R6
caaauaccauauccuuuca

SEQ ID NO: 4098039 - RNA, 12 nt, Streptococcus pneumoniae R6
caaauacuugua

SEQ ID NO: 4098040 - RNA, 18 nt, Streptococcus pneumoniae R6
caaauagcaguaacuucu

SEQ ID NO: 4098041 - RNA, 15 nt, Streptococcus pneumoniae R6
caaauauaccaacua

SEQ ID NO: 4098042 - RNA, 20 nt, Streptococcus pneumoniae R6
caaauauaccaacuacuaaa

SEQ ID NO: 4098043 - RNA, 21 nt, Streptococcus pneumoniae R6
caaauaucuucggauuuuucu

SEQ ID NO: 4098044 - RNA, 19 nt, Streptococcus pneumoniae R6
caaauauucaccacaugac

SEQ ID NO: 4098045 - RNA, 11 nt, Streptococcus pneumoniae R6
caaaucaaauu

SEQ ID NO: 4098046 - RNA, 22 nt, Streptococcus pneumoniae R6
caaaucaacuggcauccccagc

SEQ ID NO: 4098047 - RNA, 20 nt, Streptococcus pneumoniae R6
caaaucagaaaaguaacuau

SEQ ID NO: 4098048 - RNA, 22 nt, Streptococcus pneumoniae R6
caaaucagccauugaaaauccu

SEQ ID NO: 4098049 - RNA, 22 nt, Streptococcus pneumoniae R6
caaaucagguaggauuucuccu

SEQ ID NO: 4098050 - RNA, 14 nt, Streptococcus pneumoniae R6
caaaucaucagcca

SEQ ID NO: 4098051 - RNA, 18 nt, Streptococcus pneumoniae R6
caaaucaucauaaaaaua

SEQ ID NO: 4098052 - RNA, 14 nt, Streptococcus pneumoniae R6
caaaucauccgaag

SEQ ID NO: 4098053 - RNA, 16 nt, Streptococcus pneumoniae R6
caaauccaaucuucua

SEQ ID NO: 4098054 - RNA, 12 nt, Streptococcus pneumoniae R6
caaauccauagu

SEQ ID NO: 4098055 - RNA, 14 nt, Streptococcus pneumoniae R6
caaauccauaguaa

SEQ ID NO: 4098056 - RNA, 16 nt, Streptococcus pneumoniae R6
caaaucccaugacaau

SEQ ID NO: 4098057 - RNA, 16 nt, Streptococcus pneumoniae R6
caaauccgacuucaau

SEQ ID NO: 4098058 - RNA, 21 nt, Streptococcus pneumoniae R6
caaauccugccucaauccuuu

SEQ ID NO: 4098059 - RNA, 14 nt, Streptococcus pneumoniae R6
caaaucgaucagga

SEQ ID NO: 4098060 - RNA, 17 nt, Streptococcus pneumoniae R6
caaaucgauuucuaaca

SEQ ID NO: 4098061 - RNA, 22 nt, Streptococcus pneumoniae R6
caaaucuacuggcaaauuuucu

SEQ ID NO: 4098062 - RNA, 23 nt, Streptococcus pneumoniae R6
caaaugaauuucuacaaauguuu

SEQ ID NO: 4098063 - RNA, 18 nt, Streptococcus pneumoniae R6
caaaugacuaaccuuguc

SEQ ID NO: 4098064 - RNA, 15 nt, Streptococcus pneumoniae R6
caaauggcaugagga

SEQ ID NO: 4098065 - RNA, 13 nt, Streptococcus pneumoniae R6
caaauuaauuuau

SEQ ID NO: 4098066 - RNA, 16 nt, Streptococcus pneumoniae R6
caaauuaauuuauaga

SEQ ID NO: 4098067 - RNA, 16 nt, Streptococcus pneumoniae R6
caaauuagaaaaagac

SEQ ID NO: 4098068 - RNA, 21 nt, Streptococcus pneumoniae R6
caaauuagaaaaagacuugaa

SEQ ID NO: 4098069 - RNA, 22 nt, Streptococcus pneumoniae R6
caaauuauuuacagaaagaaca

SEQ ID NO: 4098070 - RNA, 23 nt, Streptococcus pneumoniae R6
caaauucaccaacuacaguugca

SEQ ID NO: 4098071 - RNA, 18 nt, Streptococcus pneumoniae R6
caaauucaccaauuuuac

SEQ ID NO: 4098072 - RNA, 15 nt, Streptococcus pneumoniae R6
caaauugaaauaaga

SEQ ID NO: 4098073 - RNA, 19 nt, Streptococcus pneumoniae R6
caaauugaaauaagaaaua

SEQ ID NO: 4098074 - RNA, 21 nt, Streptococcus pneumoniae R6
caaauugugcaguuuucauuc

SEQ ID NO: 4098075 - RNA, 14 nt, Streptococcus pneumoniae R6
caaauuuauaaauc

SEQ ID NO: 4098076 - RNA, 15 nt, Streptococcus pneumoniae R6
caaauuuauaaaucu

SEQ ID NO: 4098077 - RNA, 16 nt, Streptococcus pneumoniae R6
caaauuuauacuaaua

SEQ ID NO: 4098078 - RNA, 15 nt, Streptococcus pneumoniae R6
caaauuucauauuuu

SEQ ID NO: 4098079 - RNA, 13 nt, Streptococcus pneumoniae R6
caaauuucaugac

SEQ ID NO: 4098080 - RNA, 15 nt, Streptococcus pneumoniae R6
caaauuugacuaaaa

SEQ ID NO: 4098081 - RNA, 22 nt, Streptococcus pneumoniae R6
caaauuuucuuuacuauaguag

SEQ ID NO: 4098082 - RNA, 21 nt, Streptococcus pneumoniae R6
caacaaaaaaggucaucagca

SEQ ID NO: 4098083 - RNA, 23 nt, Streptococcus pneumoniae R6
caacaaaaaaggucaucagcaga

SEQ ID NO: 4098084 - RNA, 16 nt, Streptococcus pneumoniae R6
caacaaaguaaccauc

SEQ ID NO: 4098085 - RNA, 11 nt, Streptococcus pneumoniae R6
caacaaaucuu

SEQ ID NO: 4098086 - RNA, 19 nt, Streptococcus pneumoniae R6
caacaaaucuuccuagaau

SEQ ID NO: 4098087 - RNA, 22 nt, Streptococcus pneumoniae R6
caacaacagcugucgcaccuga

SEQ ID NO: 4098088 - RNA, 16 nt, Streptococcus pneumoniae R6
caacaauaagagaauu

SEQ ID NO: 4098089 - RNA, 21 nt, Streptococcus pneumoniae R6
caacaccgacuugguaguuga

SEQ ID NO: 4098090 - RNA, 21 nt, Streptococcus pneumoniae R6
caacacgaccuucaauuccuu

SEQ ID NO: 4098091 - RNA, 12 nt, Streptococcus pneumoniae R6
caacacuuaagu

SEQ ID NO: 4098092 - RNA, 22 nt, Streptococcus pneumoniae R6
caacagaugagcgaauaguaua

SEQ ID NO: 4098093 - RNA, 13 nt, Streptococcus pneumoniae R6
caacagcuuuuuu

SEQ ID NO: 4098094 - RNA, 18 nt, Streptococcus pneumoniae R6
caacaggauuuuguucuu

SEQ ID NO: 4098095 - RNA, 14 nt, Streptococcus pneumoniae R6
caacauaaguugua

SEQ ID NO: 4098096 - RNA, 18 nt, Streptococcus pneumoniae R6
caagauagagagcuccaa

SEQ ID NO: 4098097 - RNA, 12 nt, Streptococcus pneumoniae R6
caagauaggaga

SEQ ID NO: 4098098 - RNA, 19 nt, Streptococcus pneumoniae R6
caagauaguaaagagcugc

SEQ ID NO: 4098099 - RNA, 16 nt, Streptococcus pneumoniae R6
caagauccaauccuuu

SEQ ID NO: 4098100 - RNA, 23 nt, Streptococcus pneumoniae R6
caagauccaauccuuuucuuuua

SEQ ID NO: 4098101 - RNA, 18 nt, Streptococcus pneumoniae R6
caagaucuugucugcaug

SEQ ID NO: 4098102 - RNA, 24 nt, Streptococcus pneumoniae R6
caagaucuuuuuauacucaaugaa

SEQ ID NO: 4098103 - RNA, 19 nt, Streptococcus pneumoniae R6
caagauggacuguuauaga

SEQ ID NO: 4098104 - RNA, 14 nt, Streptococcus pneumoniae R6
caagcaacaaaaac

SEQ ID NO: 4098105 - RNA, 15 nt, Streptococcus pneumoniae R6
caagcaacaaaaacg

SEQ ID NO: 4098106 - RNA, 16 nt, Streptococcus pneumoniae R6
caagcaagucuagacu

SEQ ID NO: 4098107 - RNA, 19 nt, Streptococcus pneumoniae R6
caagcaaucucuuccaaag

SEQ ID NO: 4098108 - RNA, 18 nt, Streptococcus pneumoniae R6
caagcauaacagcauuuc

SEQ ID NO: 4098109 - RNA, 12 nt, Streptococcus pneumoniae R6
caagcauuuuca

SEQ ID NO: 4098110 - RNA, 13 nt, Streptococcus pneumoniae R6
caagcauuuucau

SEQ ID NO: 4098111 - RNA, 21 nt, Streptococcus pneumoniae R6
caagcauuuucauaaggaagu

SEQ ID NO: 4098112 - RNA, 20 nt, Streptococcus pneumoniae R6
caagcauuuuuuugauaaga

SEQ ID NO: 4098113 - RNA, 15 nt, Streptococcus pneumoniae R6
caagccuagucuucu

SEQ ID NO: 4098114 - RNA, 14 nt, Streptococcus pneumoniae R6
caagccuuacucuu

SEQ ID NO: 4098115 - RNA, 17 nt, Streptococcus pneumoniae R6
caagcgaacaucuccaa

SEQ ID NO: 4098116 - RNA, 18 nt, Streptococcus pneumoniae R6
caagcgaacaucuccaac

SEQ ID NO: 4098117 - RNA, 19 nt, Streptococcus pneumoniae R6
caagcgaagggcuucuuug

SEQ ID NO: 4098118 - RNA, 17 nt, Streptococcus pneumoniae R6
caagcgcuauuaaaauu

SEQ ID NO: 4098119 - RNA, 19 nt, Streptococcus pneumoniae R6
caagcguuuuucuucugua

SEQ ID NO: 4098120 - RNA, 13 nt, Streptococcus pneumoniae R6
caagcuaucagag

SEQ ID NO: 4098121 - RNA, 17 nt, Streptococcus pneumoniae R6
caagcuaucagagaugg

SEQ ID NO: 4098122 - RNA, 18 nt, Streptococcus pneumoniae R6
caagcucgauauucuuuu

SEQ ID NO: 4098123 - RNA, 14 nt, Streptococcus pneumoniae R6
caagcucugaaugg

SEQ ID NO: 4098124 - RNA, 19 nt, Streptococcus pneumoniae R6
caagcugucaagaaauuac

SEQ ID NO: 4098125 - RNA, 17 nt, Streptococcus pneumoniae R6
caagcugugaguucauu

SEQ ID NO: 4098126 - RNA, 18 nt, Streptococcus pneumoniae R6
caagcuugaaacaaauaa

SEQ ID NO: 4098127 - RNA, 14 nt, Streptococcus pneumoniae R6
caaggaagaagcug

SEQ ID NO: 4098128 - RNA, 21 nt, Streptococcus pneumoniae R6
caaggacggcuuuuaguaaaa

SEQ ID NO: 4098129 - RNA, 17 nt, Streptococcus pneumoniae R6
caaggacuggagaagga

SEQ ID NO: 4098130 - RNA, 23 nt, Streptococcus pneumoniae R6
caaggagaaccaggaaaccagcu

SEQ ID NO: 4098131 - RNA, 18 nt, Streptococcus pneumoniae R6
caaggaguaccguucaua

SEQ ID NO: 4098132 - RNA, 13 nt, Streptococcus pneumoniae R6
caaggcaaagcug

SEQ ID NO: 4098133 - RNA, 19 nt, Streptococcus pneumoniae R6
caagguaguagucagugau

SEQ ID NO: 4098134 - RNA, 16 nt, Streptococcus pneumoniae R6
caaggucaaaaugaug

SEQ ID NO: 4098135 - RNA, 21 nt, Streptococcus pneumoniae R6
caaggucgcauaggcaauuuc

SEQ ID NO: 4098136 - RNA, 17 nt, Streptococcus pneumoniae R6
caaggucugacaggcua

SEQ ID NO: 4098137 - RNA, 18 nt, Streptococcus pneumoniae R6
caaggucugacaggcuau

SEQ ID NO: 4098138 - RNA, 18 nt, Streptococcus pneumoniae R6
caaggugaacuugaccua

SEQ ID NO: 4098139 - RNA, 14 nt, Streptococcus pneumoniae R6
caagguucauuucu

SEQ ID NO: 4098140 - RNA, 16 nt, Streptococcus pneumoniae R6
caagguucauuucuuc

SEQ ID NO: 4098141 - RNA, 17 nt, Streptococcus pneumoniae R6
caagguuuccaaaccaa

SEQ ID NO: 4098142 - RNA, 16 nt, Streptococcus pneumoniae R6
caagguuuccugcaug

SEQ ID NO: 4098143 - RNA, 17 nt, Streptococcus pneumoniae R6
caaguaaguagcaucuu

SEQ ID NO: 4098144 - RNA, 14 nt, Streptococcus pneumoniae R6
caaguauuggcaaa

SEQ ID NO: 4098145 - RNA, 14 nt, Streptococcus pneumoniae R6
caaguauuguaaga

SEQ ID NO: 4098146 - RNA, 16 nt, Streptococcus pneumoniae R6
caagucaacaccuguc

SEQ ID NO: 4098147 - RNA, 22 nt, Streptococcus pneumoniae R6
caagucaucaaaaauagaaaua

SEQ ID NO: 4098148 - RNA, 14 nt, Streptococcus pneumoniae R6
caaguccaagccuu

SEQ ID NO: 4098149 - RNA, 14 nt, Streptococcus pneumoniae R6
caaguccagaaccg

SEQ ID NO: 4098150 - RNA, 18 nt, Streptococcus pneumoniae R6
caagucguaagucuucgu

SEQ ID NO: 4098151 - RNA, 14 nt, Streptococcus pneumoniae R6
caagucuagacuga

SEQ ID NO: 4098152 - RNA, 21 nt, Streptococcus pneumoniae R6
caagucugacgcuggaaauaa

SEQ ID NO: 4098153 - RNA, 12 nt, Streptococcus pneumoniae R6
caagucugcaug

SEQ ID NO: 4098154 - RNA, 23 nt, Streptococcus pneumoniae R6
caagucuguauagaccugaucaa

SEQ ID NO: 4098155 - RNA, 22 nt, Streptococcus pneumoniae R6
caagucuuaaaaucacaaaaac

SEQ ID NO: 4098156 - RNA, 16 nt, Streptococcus pneumoniae R6
caagucuucuugguau

SEQ ID NO: 4098157 - RNA, 18 nt, Streptococcus pneumoniae R6
caagucuugugaauagcu

SEQ ID NO: 4098158 - RNA, 19 nt, Streptococcus pneumoniae R6
caagugccaagaagguuuc

SEQ ID NO: 4098159 - RNA, 15 nt, Streptococcus pneumoniae R6
caagugcuaagauaa

SEQ ID NO: 4098160 - RNA, 18 nt, Streptococcus pneumoniae R6
caaguggaauucauuuuc

SEQ ID NO: 4098161 - RNA, 23 nt, Streptococcus pneumoniae R6
caaguggaauucauuuucuuaaa

SEQ ID NO: 4098162 - RNA, 15 nt, Streptococcus pneumoniae R6
caagugguucuccaa

SEQ ID NO: 4098163 - RNA, 16 nt, Streptococcus pneumoniae R6
caaguguuuucacuuc

SEQ ID NO: 4098164 - RNA, 18 nt, Streptococcus pneumoniae R6
caaguguuuucacuuccu

SEQ ID NO: 4098165 - RNA, 12 nt, Streptococcus pneumoniae R6
caaguuaaauaa

SEQ ID NO: 4098166 - RNA, 13 nt, Streptococcus pneumoniae R6
caaguuaaauaau

SEQ ID NO: 4098167 - RNA, 22 nt, Streptococcus pneumoniae R6
caaguuaaauaauagaaauuuu

SEQ ID NO: 4098168 - RNA, 13 nt, Streptococcus pneumoniae R6
caaguucacucau

SEQ ID NO: 4098169 - RNA, 23 nt, Streptococcus pneumoniae R6
caaguucugucuugcugucucca

SEQ ID NO: 4098170 - RNA, 13 nt, Streptococcus pneumoniae R6
caaguucuucucu

SEQ ID NO: 4098171 - RNA, 19 nt, Streptococcus pneumoniae R6
caaguucuuuucauaaaga

SEQ ID NO: 4098172 - RNA, 22 nt, Streptococcus pneumoniae R6
caaguucuuuucauaaagagaa

SEQ ID NO: 4098173 - RNA, 13 nt, Streptococcus pneumoniae R6
caaguucuuuucu

SEQ ID NO: 4098174 - RNA, 16 nt, Streptococcus pneumoniae R6
caaguugcuugaaaac

SEQ ID NO: 4098175 - RNA, 14 nt, Streptococcus pneumoniae R6
caaguugugcagug

SEQ ID NO: 4098176 - RNA, 13 nt, Streptococcus pneumoniae R6
caaguuguuugac

SEQ ID NO: 4098177 - RNA, 15 nt, Streptococcus pneumoniae R6
caaguuucuuuauuc

SEQ ID NO: 4098178 - RNA, 17 nt, Streptococcus pneumoniae R6
caaguuuguaucuuccu

SEQ ID NO: 4098179 - RNA, 16 nt, Streptococcus pneumoniae R6
caaguuuuagaugaga

SEQ ID NO: 4098180 - RNA, 22 nt, Streptococcus pneumoniae R6
caaguuuuagaugagaaagauu

SEQ ID NO: 4098181 - RNA, 15 nt, Streptococcus pneumoniae R6
caaguuuucacaccu

SEQ ID NO: 4098182 - RNA, 21 nt, Streptococcus pneumoniae R6
caaguuuuugaauaaugaaaa

SEQ ID NO: 4098183 - RNA, 21 nt, Streptococcus pneumoniae R6
caauaaaacgcaucauaucaa

SEQ ID NO: 4098184 - RNA, 11 nt, Streptococcus pneumoniae R6
caauaaaauau

SEQ ID NO: 4098185 - RNA, 23 nt, Streptococcus pneumoniae R6
caauaaaauaugaucuauuguug

SEQ ID NO: 4098186 - RNA, 13 nt, Streptococcus pneumoniae R6
caauaaaaucaaa

SEQ ID NO: 4098187 - RNA, 15 nt, Streptococcus pneumoniae R6
caauaaaaucaaaca

SEQ ID NO: 4098188 - RNA, 16 nt, Streptococcus pneumoniae R6
caauaaaaucaaacaa

SEQ ID NO: 4098189 - RNA, 18 nt, Streptococcus pneumoniae R6
caauaaaaucaaacaaaa

SEQ ID NO: 4098190 - RNA, 21 nt, Streptococcus pneumoniae R6
caauaaaaucaaacaaaagcg

SEQ ID NO: 4098191 - RNA, 12 nt, Streptococcus pneumoniae R6
caauaaagauaa

SEQ ID NO: 4098192 - RNA, 16 nt, Streptococcus pneumoniae R6
caauaaagguguucaa

SEQ ID NO: 4098193 - RNA, 19 nt, Streptococcus pneumoniae R6
caauaacacgagaaacaau

SEQ ID NO: 4098194 - RNA, 20 nt, Streptococcus pneumoniae R6
caauaacacgagaaacaaua

SEQ ID NO: 4098195 - RNA, 20 nt, Streptococcus pneumoniae R6
caauaagcccgaaaaauuuc

SEQ ID NO: 4098196 - RNA, 21 nt, Streptococcus pneumoniae R6
caauaagcccgaaaaauuucu

SEQ ID NO: 4098197 - RNA, 18 nt, Streptococcus pneumoniae R6
caauaaguccgaaaaauu

SEQ ID NO: 4098198 - RNA, 18 nt, Streptococcus pneumoniae R6
caauaauaaaacuuuuaa

SEQ ID NO: 4098199 - RNA, 23 nt, Streptococcus pneumoniae R6
caauguuuugaucugacuucguc

SEQ ID NO: 4098200 - RNA, 21 nt, Streptococcus pneumoniae R6
caauguuuuugggaaggaaua

SEQ ID NO: 4098201 - RNA, 23 nt, Streptococcus pneumoniae R6
caauuaagguuuuaccuucaagu

SEQ ID NO: 4098202 - RNA, 14 nt, Streptococcus pneumoniae R6
caauuaauuuaucc

SEQ ID NO: 4098203 - RNA, 15 nt, Streptococcus pneumoniae R6
caauuaauuuauccg

SEQ ID NO: 4098204 - RNA, 21 nt, Streptococcus pneumoniae R6
caauuaauuuauccgaaggau

SEQ ID NO: 4098205 - RNA, 16 nt, Streptococcus pneumoniae R6
caauuacguuuaaaga

SEQ ID NO: 4098206 - RNA, 22 nt, Streptococcus pneumoniae R6
caauuauaauaaaaugaaauaa

SEQ ID NO: 4098207 - RNA, 14 nt, Streptococcus pneumoniae R6
caauuauccauauu

SEQ ID NO: 4098208 - RNA, 20 nt, Streptococcus pneumoniae R6
caauucaauuuuauacucau

SEQ ID NO: 4098209 - RNA, 15 nt, Streptococcus pneumoniae R6
caauucagccuuauc

SEQ ID NO: 4098210 - RNA, 20 nt, Streptococcus pneumoniae R6
caauucccguuaaaggugug

SEQ ID NO: 4098211 - RNA, 20 nt, Streptococcus pneumoniae R6
caauuccuuauccugaugau

SEQ ID NO: 4098212 - RNA, 14 nt, Streptococcus pneumoniae R6
caauucuaaaaaca

SEQ ID NO: 4098213 - RNA, 16 nt, Streptococcus pneumoniae R6
caauucuaaaaacaga

SEQ ID NO: 4098214 - RNA, 23 nt, Streptococcus pneumoniae R6
caauucuucguaagauucuucug

SEQ ID NO: 4098215 - RNA, 23 nt, Streptococcus pneumoniae R6
caauucuugguugccuuuuugaa

SEQ ID NO: 4098216 - RNA, 19 nt, Streptococcus pneumoniae R6
caauucuuuagcagaugcu

SEQ ID NO: 4098217 - RNA, 19 nt, Streptococcus pneumoniae R6
caauugacuauagcagauu

SEQ ID NO: 4098218 - RNA, 11 nt, Streptococcus pneumoniae R6
caauugaggaa

SEQ ID NO: 4098219 - RNA, 18 nt, Streptococcus pneumoniae R6
caauugauuugaaugcca

SEQ ID NO: 4098220 - RNA, 22 nt, Streptococcus pneumoniae R6
caauugcuaaaacauuuauaga

SEQ ID NO: 4098221 - RNA, 17 nt, Streptococcus pneumoniae R6
caauugcucaacuucuu

SEQ ID NO: 4098222 - RNA, 18 nt, Streptococcus pneumoniae R6
caauugcucaacuucuuu

SEQ ID NO: 4098223 - RNA, 17 nt, Streptococcus pneumoniae R6
caauuggaaauaacaaa

SEQ ID NO: 4098224 - RNA, 14 nt, Streptococcus pneumoniae R6
caauuguaaaaaga

SEQ ID NO: 4098225 - RNA, 15 nt, Streptococcus pneumoniae R6
caauuguaaaaagag

SEQ ID NO: 4098226 - RNA, 16 nt, Streptococcus pneumoniae R6
caauugugcauaagaa

SEQ ID NO: 4098227 - RNA, 17 nt, Streptococcus pneumoniae R6
caauugugcauaagaaa

SEQ ID NO: 4098228 - RNA, 19 nt, Streptococcus pneumoniae R6
caauugugcauaagaaacu

SEQ ID NO: 4098229 - RNA, 14 nt, Streptococcus pneumoniae R6
caauuuaucuccua

SEQ ID NO: 4098230 - RNA, 14 nt, Streptococcus pneumoniae R6
caauuucgauaaua

SEQ ID NO: 4098231 - RNA, 18 nt, Streptococcus pneumoniae R6
caauuucgauaauaccua

SEQ ID NO: 4098232 - RNA, 20 nt, Streptococcus pneumoniae R6
caauuucuaacauauuucua

SEQ ID NO: 4098233 - RNA, 20 nt, Streptococcus pneumoniae R6
caauuucuauuuuaaaaaua

SEQ ID NO: 4098234 - RNA, 16 nt, Streptococcus pneumoniae R6
caauuucucguguaau

SEQ ID NO: 4098235 - RNA, 18 nt, Streptococcus pneumoniae R6
caauuucucuacaaauaa

SEQ ID NO: 4098236 - RNA, 13 nt, Streptococcus pneumoniae R6
caauuucuuaaua

SEQ ID NO: 4098237 - RNA, 18 nt, Streptococcus pneumoniae R6
caauuucuuuucauucca

SEQ ID NO: 4098238 - RNA, 21 nt, Streptococcus pneumoniae R6
caauuugauauauaaaugaaa

SEQ ID NO: 4098239 - RNA, 22 nt, Streptococcus pneumoniae R6
caauuugauauauaaaugaaaa

SEQ ID NO: 4098240 - RNA, 17 nt, Streptococcus pneumoniae R6
caauuuuaggagaaaaa

SEQ ID NO: 4098241 - RNA, 19 nt, Streptococcus pneumoniae R6
caauuuuaggagaaaaaga

SEQ ID NO: 4098242 - RNA, 19 nt, Streptococcus pneumoniae R6
caauuuuauacucaucugu

SEQ ID NO: 4098243 - RNA, 13 nt, Streptococcus pneumoniae R6
caauuuugaaaga

SEQ ID NO: 4098244 - RNA, 16 nt, Streptococcus pneumoniae R6
caauuuugaaagauuc

SEQ ID NO: 4098245 - RNA, 12 nt, Streptococcus pneumoniae R6
caauuuuuccag

SEQ ID NO: 4098246 - RNA, 13 nt, Streptococcus pneumoniae R6
caauuuuugaaag

SEQ ID NO: 4098247 - RNA, 13 nt, Streptococcus pneumoniae R6
cacaaaaaagcua

SEQ ID NO: 4098248 - RNA, 21 nt, Streptococcus pneumoniae R6
cacaaaaaguggauuuuucuu

SEQ ID NO: 4098249 - RNA, 21 nt, Streptococcus pneumoniae R6
cacaaaaagugucagauagga

SEQ ID NO: 4098250 - RNA, 20 nt, Streptococcus pneumoniae R6
cacaaaagagaaagacuuga

SEQ ID NO: 4098251 - RNA, 12 nt, Streptococcus pneumoniae R6
cacaaaaggagg

SEQ ID NO: 4098252 - RNA, 15 nt, Streptococcus pneumoniae R6
cacaaaaucaggaaa

SEQ ID NO: 4098253 - RNA, 16 nt, Streptococcus pneumoniae R6
cacaaaaucaggaaau

SEQ ID NO: 4098254 - RNA, 12 nt, Streptococcus pneumoniae R6
cacaaaauccuu

SEQ ID NO: 4098255 - RNA, 16 nt, Streptococcus pneumoniae R6
cacaaagaacaugaaa

SEQ ID NO: 4098256 - RNA, 20 nt, Streptococcus pneumoniae R6
cacaaaguggagguguucua

SEQ ID NO: 4098257 - RNA, 17 nt, Streptococcus pneumoniae R6
cacaaauucuggcauuu

SEQ ID NO: 4098258 - RNA, 14 nt, Streptococcus pneumoniae R6
cacaaccucaaaac

SEQ ID NO: 4098259 - RNA, 14 nt, Streptococcus pneumoniae R6
cacaaccuuaaaac

SEQ ID NO: 4098260 - RNA, 14 nt, Streptococcus pneumoniae R6
cacaacuuuuaaau

SEQ ID NO: 4098261 - RNA, 20 nt, Streptococcus pneumoniae R6
cacaauaaaacgcaucauau

SEQ ID NO: 4098262 - RNA, 13 nt, Streptococcus pneumoniae R6
cacaaucgucuca

SEQ ID NO: 4098263 - RNA, 15 nt, Streptococcus pneumoniae R6
cacacggaaacagcu

SEQ ID NO: 4098264 - RNA, 17 nt, Streptococcus pneumoniae R6
cacacuagcaauuuuuu

SEQ ID NO: 4098265 - RNA, 15 nt, Streptococcus pneumoniae R6
cacagaaagcauccc

SEQ ID NO: 4098266 - RNA, 18 nt, Streptococcus pneumoniae R6
cacagcguuucuauauuu

SEQ ID NO: 4098267 - RNA, 20 nt, Streptococcus pneumoniae R6
cacagcuugguaaugcucca

SEQ ID NO: 4098268 - RNA, 22 nt, Streptococcus pneumoniae R6
cacaggagcuggaucuugagga

SEQ ID NO: 4098269 - RNA, 21 nt, Streptococcus pneumoniae R6
cacagugggcuauuccauauu

SEQ ID NO: 4098270 - RNA, 20 nt, Streptococcus pneumoniae R6
cacaguuuacaauuagccuu

SEQ ID NO: 4098271 - RNA, 20 nt, Streptococcus pneumoniae R6
cacauauacacuuaaauuca

SEQ ID NO: 4098272 - RNA, 17 nt, Streptococcus pneumoniae R6
cacauauugauauuuau

SEQ ID NO: 4098273 - RNA, 18 nt, Streptococcus pneumoniae R6
cacauauugauauuuaua

SEQ ID NO: 4098274 - RNA, 14 nt, Streptococcus pneumoniae R6
cacaucacuuucug

SEQ ID NO: 4098275 - RNA, 18 nt, Streptococcus pneumoniae R6
cacauccaguguauggag

SEQ ID NO: 4098276 - RNA, 14 nt, Streptococcus pneumoniae R6
cacaucgucaagca

SEQ ID NO: 4098277 - RNA, 13 nt, Streptococcus pneumoniae R6
cacaucuacuucu

SEQ ID NO: 4098278 - RNA, 22 nt, Streptococcus pneumoniae R6
cacaucuguguagcacuuuucc

SEQ ID NO: 4098279 - RNA, 22 nt, Streptococcus pneumoniae R6
cacaugacaaauucuccacaga

SEQ ID NO: 4098280 - RNA, 16 nt, Streptococcus pneumoniae R6
cacauucccauucccu

SEQ ID NO: 4098281 - RNA, 20 nt, Streptococcus pneumoniae R6
cacauucguuccuuuaaaau

SEQ ID NO: 4098282 - RNA, 22 nt, Streptococcus pneumoniae R6
cacauucguuccuuuaaaauga

SEQ ID NO: 4098283 - RNA, 17 nt, Streptococcus pneumoniae R6
cacauugaaaaugugaa

SEQ ID NO: 4098284 - RNA, 22 nt, Streptococcus pneumoniae R6
cacauuggcaagagcuguucca

SEQ ID NO: 4098285 - RNA, 18 nt, Streptococcus pneumoniae R6
cacauuuccauguaaaau

SEQ ID NO: 4098286 - RNA, 12 nt, Streptococcus pneumoniae R6
cacauuuucaau

SEQ ID NO: 4098287 - RNA, 16 nt, Streptococcus pneumoniae R6
cacauuuucaauguga

SEQ ID NO: 4098288 - RNA, 17 nt, Streptococcus pneumoniae R6
cacauuuugaaauguuc

SEQ ID NO: 4098289 - RNA, 20 nt, Streptococcus pneumoniae R6
cacauuuugaaauguuccaa

SEQ ID NO: 4098290 - RNA, 13 nt, Streptococcus pneumoniae R6
caccaaacaaauc

SEQ ID NO: 4098291 - RNA, 15 nt, Streptococcus pneumoniae R6
caccaaacuuaggaa

SEQ ID NO: 4098292 - RNA, 19 nt, Streptococcus pneumoniae R6
caccaaauuucauauuuuc

SEQ ID NO: 4098293 - RNA, 19 nt, Streptococcus pneumoniae R6
caccaagaauaauuaccau

SEQ ID NO: 4098294 - RNA, 21 nt, Streptococcus pneumoniae R6
caccaauacagcuuuuuucuu

SEQ ID NO: 4098295 - RNA, 14 nt, Streptococcus pneumoniae R6
caccaaucaaauca

SEQ ID NO: 4098296 - RNA, 17 nt, Streptococcus pneumoniae R6
caccaaucaguaauuua

SEQ ID NO: 4098297 - RNA, 22 nt, Streptococcus pneumoniae R6
caccaaucaguaauuuaguucu

SEQ ID NO: 4098298 - RNA, 13 nt, Streptococcus pneumoniae R6
caccaaucugccc

SEQ ID NO: 4098299 - RNA, 14 nt, Streptococcus pneumoniae R6
caccacaugacauu

SEQ ID NO: 4098300 - RNA, 18 nt, Streptococcus pneumoniae R6
caccaccgauagagugcc

SEQ ID NO: 4098301 - RNA, 19 nt, Streptococcus pneumoniae R6
caccagcuauuaagaaaaa

SEQ ID NO: 4098302 - RNA, 18 nt, Streptococcus pneumoniae R6
cacucucauucaucacca

SEQ ID NO: 4098303 - RNA, 21 nt, Streptococcus pneumoniae R6
cacucuugcauuucuuuugau

SEQ ID NO: 4098304 - RNA, 23 nt, Streptococcus pneumoniae R6
cacugaguuuuucccagccuuca

SEQ ID NO: 4098305 - RNA, 16 nt, Streptococcus pneumoniae R6
cacugaugaaacuaau

SEQ ID NO: 4098306 - RNA, 18 nt, Streptococcus pneumoniae R6
cacugcaauuucuaaaaa

SEQ ID NO: 4098307 - RNA, 17 nt, Streptococcus pneumoniae R6
cacugugauuucuaaaa

SEQ ID NO: 4098308 - RNA, 20 nt, Streptococcus pneumoniae R6
cacuguuuugagcugacuuc

SEQ ID NO: 4098309 - RNA, 16 nt, Streptococcus pneumoniae R6
cacuguuuuuuauccc

SEQ ID NO: 4098310 - RNA, 14 nt, Streptococcus pneumoniae R6
cacuuaagugugaa

SEQ ID NO: 4098311 - RNA, 16 nt, Streptococcus pneumoniae R6
cacuuaauucuucaua

SEQ ID NO: 4098312 - RNA, 16 nt, Streptococcus pneumoniae R6
cacuuacggaucuagc

SEQ ID NO: 4098313 - RNA, 19 nt, Streptococcus pneumoniae R6
cacuuaguugaauuaucau

SEQ ID NO: 4098314 - RNA, 22 nt, Streptococcus pneumoniae R6
cacuuaguugaauuaucauagu

SEQ ID NO: 4098315 - RNA, 14 nt, Streptococcus pneumoniae R6
cacuuauaguacua

SEQ ID NO: 4098316 - RNA, 16 nt, Streptococcus pneumoniae R6
cacuuaugaagaaauu

SEQ ID NO: 4098317 - RNA, 14 nt, Streptococcus pneumoniae R6
cacuucacuaauuc

SEQ ID NO: 4098318 - RNA, 12 nt, Streptococcus pneumoniae R6
cacuucuacuau

SEQ ID NO: 4098319 - RNA, 22 nt, Streptococcus pneumoniae R6
cacuucugcuucuaaaacauug

SEQ ID NO: 4098320 - RNA, 14 nt, Streptococcus pneumoniae R6
cacuugaugaaaaa

SEQ ID NO: 4098321 - RNA, 19 nt, Streptococcus pneumoniae R6
cacuugcuuuugauggguu

SEQ ID NO: 4098322 - RNA, 21 nt, Streptococcus pneumoniae R6
cacuuggcauucaaaacgcca

SEQ ID NO: 4098323 - RNA, 21 nt, Streptococcus pneumoniae R6
cacuugguguugagaaagcac

SEQ ID NO: 4098324 - RNA, 22 nt, Streptococcus pneumoniae R6
cacuugguguugagaaagcacu

SEQ ID NO: 4098325 - RNA, 15 nt, Streptococcus pneumoniae R6
cacuuguauccuccu

SEQ ID NO: 4098326 - RNA, 16 nt, Streptococcus pneumoniae R6
cacuuuauuuuuucug

SEQ ID NO: 4098327 - RNA, 22 nt, Streptococcus pneumoniae R6
cacuuuauuuuuucuguaaaau

SEQ ID NO: 4098328 - RNA, 16 nt, Streptococcus pneumoniae R6
cacuuuuauuauggua

SEQ ID NO: 4098329 - RNA, 16 nt, Streptococcus pneumoniae R6
cacuuuuuauccguca

SEQ ID NO: 4098330 - RNA, 20 nt, Streptococcus pneumoniae R6
cagaaaaaccuuguuuuuuc

SEQ ID NO: 4098331 - RNA, 19 nt, Streptococcus pneumoniae R6
cagaaaaacgcauaaaauc

SEQ ID NO: 4098332 - RNA, 16 nt, Streptococcus pneumoniae R6
cagaaaaaucccuugu

SEQ ID NO: 4098333 - RNA, 17 nt, Streptococcus pneumoniae R6
cagaaaaaucccuuguu

SEQ ID NO: 4098334 - RNA, 13 nt, Streptococcus pneumoniae R6
cagaaaaaucugu

SEQ ID NO: 4098335 - RNA, 18 nt, Streptococcus pneumoniae R6
cagaaaaaugacaauaaa

SEQ ID NO: 4098336 - RNA, 21 nt, Streptococcus pneumoniae R6
cagaaaaaugacaauaaaaua

SEQ ID NO: 4098337 - RNA, 19 nt, Streptococcus pneumoniae R6
cagaaaacgcauaguauca

SEQ ID NO: 4098338 - RNA, 19 nt, Streptococcus pneumoniae R6
cagaaaauaaaauuccuuu

SEQ ID NO: 4098339 - RNA, 17 nt, Streptococcus pneumoniae R6
cagaaaaucauugcuau

SEQ ID NO: 4098340 - RNA, 22 nt, Streptococcus pneumoniae R6
cagaaacgaaccuuggcuugcu

SEQ ID NO: 4098341 - RNA, 11 nt, Streptococcus pneumoniae R6
cagaaacuguc

SEQ ID NO: 4098342 - RNA, 17 nt, Streptococcus pneumoniae R6
cagaaagaacaaaaaau

SEQ ID NO: 4098343 - RNA, 16 nt, Streptococcus pneumoniae R6
cagaaaucuaguuggu

SEQ ID NO: 4098344 - RNA, 16 nt, Streptococcus pneumoniae R6
cagaaaugaguaagaa

SEQ ID NO: 4098345 - RNA, 16 nt, Streptococcus pneumoniae R6
cagaaauggaaguuuc

SEQ ID NO: 4098346 - RNA, 15 nt, Streptococcus pneumoniae R6
cagaaauuuucuuag

SEQ ID NO: 4098347 - RNA, 18 nt, Streptococcus pneumoniae R6
cagaacaaugacucccau

SEQ ID NO: 4098348 - RNA, 19 nt, Streptococcus pneumoniae R6
cagaacaaugacucccaua

SEQ ID NO: 4098349 - RNA, 13 nt, Streptococcus pneumoniae R6
cagaacacuucca

SEQ ID NO: 4098350 - RNA, 20 nt, Streptococcus pneumoniae R6
cagaacauuuuaauuuugga

SEQ ID NO: 4098351 - RNA, 23 nt, Streptococcus pneumoniae R6
cagaacccuuauuuccugcuuua

SEQ ID NO: 4098352 - RNA, 21 nt, Streptococcus pneumoniae R6
cagaaccuuaaaaugaaauuc

SEQ ID NO: 4098353 - RNA, 21 nt, Streptococcus pneumoniae R6
cagaacgucgcuguaaaaucu

SEQ ID NO: 4098354 - RNA, 20 nt, Streptococcus pneumoniae R6
cagaacuaagggaaccugaa

SEQ ID NO: 4098355 - RNA, 23 nt, Streptococcus pneumoniae R6
cagaacucccuguuccaaagaag

SEQ ID NO: 4098356 - RNA, 23 nt, Streptococcus pneumoniae R6
cagaacuggcguuuuauuuuuua

SEQ ID NO: 4098357 - RNA, 17 nt, Streptococcus pneumoniae R6
cagaacuuccacuucca

SEQ ID NO: 4098358 - RNA, 18 nt, Streptococcus pneumoniae R6
cagaagcugccccaccug

SEQ ID NO: 4098359 - RNA, 12 nt, Streptococcus pneumoniae R6
cagaauacucuu

SEQ ID NO: 4098360 - RNA, 16 nt, Streptococcus pneumoniae R6
cagaaucccaaagaag

SEQ ID NO: 4098361 - RNA, 17 nt, Streptococcus pneumoniae R6
cagaaucccaaagaagg

SEQ ID NO: 4098362 - RNA, 18 nt, Streptococcus pneumoniae R6
cagaaucccaaagaagga

SEQ ID NO: 4098363 - RNA, 16 nt, Streptococcus pneumoniae R6
cagaaucccagauaaa

SEQ ID NO: 4098364 - RNA, 20 nt, Streptococcus pneumoniae R6
cagaaucccagauaaagcug

SEQ ID NO: 4098365 - RNA, 18 nt, Streptococcus pneumoniae R6
cagaaucuuuuaauuggu

SEQ ID NO: 4098366 - RNA, 16 nt, Streptococcus pneumoniae R6
cagaauuggcuaaaga

SEQ ID NO: 4098367 - RNA, 17 nt, Streptococcus pneumoniae R6
cagaauuuucuuacuuc

SEQ ID NO: 4098368 - RNA, 12 nt, Streptococcus pneumoniae R6
cagacaaaacua

SEQ ID NO: 4098369 - RNA, 17 nt, Streptococcus pneumoniae R6
cagacaaaacuaacccu

SEQ ID NO: 4098370 - RNA, 14 nt, Streptococcus pneumoniae R6
cagacagcugagug

SEQ ID NO: 4098371 - RNA, 17 nt, Streptococcus pneumoniae R6
cagacagcugaguggau

SEQ ID NO: 4098372 - RNA, 20 nt, Streptococcus pneumoniae R6
cagacauaacacccugcaug

SEQ ID NO: 4098373 - RNA, 22 nt, Streptococcus pneumoniae R6
cagacauaacacccugcaugag

SEQ ID NO: 4098374 - RNA, 14 nt, Streptococcus pneumoniae R6
cagaccaccuuccu

SEQ ID NO: 4098375 - RNA, 18 nt, Streptococcus pneumoniae R6
cagaccaguuucuucuuu

SEQ ID NO: 4098376 - RNA, 19 nt, Streptococcus pneumoniae R6
cagacuauaauauaauaaa

SEQ ID NO: 4098377 - RNA, 15 nt, Streptococcus pneumoniae R6
cagacugcaaggcaa

SEQ ID NO: 4098378 - RNA, 22 nt, Streptococcus pneumoniae R6
cagacugcaaggcaagacugac

SEQ ID NO: 4098379 - RNA, 19 nt, Streptococcus pneumoniae R6
cagacuggugucguugaau

SEQ ID NO: 4098380 - RNA, 20 nt, Streptococcus pneumoniae R6
cagacuggugucguugaaug

SEQ ID NO: 4098381 - RNA, 21 nt, Streptococcus pneumoniae R6
cagacuggugucguugaauga

SEQ ID NO: 4098382 - RNA, 15 nt, Streptococcus pneumoniae R6
cagacugguucucuc

SEQ ID NO: 4098383 - RNA, 19 nt, Streptococcus pneumoniae R6
cagacuuggaacaguccuu

SEQ ID NO: 4098384 - RNA, 19 nt, Streptococcus pneumoniae R6
cagacuuuuuuauacuuuu

SEQ ID NO: 4098385 - RNA, 16 nt, Streptococcus pneumoniae R6
cagagaaaauucuaaa

SEQ ID NO: 4098386 - RNA, 15 nt, Streptococcus pneumoniae R6
cagagaaagaaaaca

SEQ ID NO: 4098387 - RNA, 21 nt, Streptococcus pneumoniae R6
cagagacgcagagguggaaug

SEQ ID NO: 4098388 - RNA, 17 nt, Streptococcus pneumoniae R6
cagagagauaaauauug

SEQ ID NO: 4098389 - RNA, 23 nt, Streptococcus pneumoniae R6
cagagauugcgauacuguuauag

SEQ ID NO: 4098390 - RNA, 14 nt, Streptococcus pneumoniae R6
cagagcaaugauag

SEQ ID NO: 4098391 - RNA, 19 nt, Streptococcus pneumoniae R6
cagagccuugaguggauuu

SEQ ID NO: 4098392 - RNA, 16 nt, Streptococcus pneumoniae R6
cagagcgauaaaaauc

SEQ ID NO: 4098393 - RNA, 20 nt, Streptococcus pneumoniae R6
cagagcgauaaaaauccuuu

SEQ ID NO: 4098394 - RNA, 18 nt, Streptococcus pneumoniae R6
cagaggcuggacaaaaac

SEQ ID NO: 4098395 - RNA, 15 nt, Streptococcus pneumoniae R6
cagaguacuaaauau

SEQ ID NO: 4098396 - RNA, 16 nt, Streptococcus pneumoniae R6
cagaguagucuuuuug

SEQ ID NO: 4098397 - RNA, 20 nt, Streptococcus pneumoniae R6
cagaguagucuuuuuguuuc

SEQ ID NO: 4098398 - RNA, 14 nt, Streptococcus pneumoniae R6
cagaguuuugaaaa

SEQ ID NO: 4098399 - RNA, 11 nt, Streptococcus pneumoniae R6
cagauaagacu

SEQ ID NO: 4098400 - RNA, 24 nt, Streptococcus pneumoniae R6
cagauaagcaccuaguacaaagaa

SEQ ID NO: 4098401 - RNA, 15 nt, Streptococcus pneumoniae R6
cagauaaggagcgaa

SEQ ID NO: 4098402 - RNA, 21 nt, Streptococcus pneumoniae R6
cagauagagcuaacuuuuccu

SEQ ID NO: 4098403 - RNA, 23 nt, Streptococcus pneumoniae R6
cagauagggcuaggcuaacacuu

SEQ ID NO: 4098404 - RNA, 16 nt, Streptococcus pneumoniae R6
caggaguucuuuuaca

SEQ ID NO: 4098405 - RNA, 15 nt, Streptococcus pneumoniae R6
caggauauuucucca

SEQ ID NO: 4098406 - RNA, 20 nt, Streptococcus pneumoniae R6
caggauuaccuuugaaaaaa

SEQ ID NO: 4098407 - RNA, 19 nt, Streptococcus pneumoniae R6
caggauuuuguucuuuuuc

SEQ ID NO: 4098408 - RNA, 14 nt, Streptococcus pneumoniae R6
caggcaugggcagg

SEQ ID NO: 4098409 - RNA, 17 nt, Streptococcus pneumoniae R6
caggccuacaauuggaa

SEQ ID NO: 4098410 - RNA, 18 nt, Streptococcus pneumoniae R6
caggcugauuccagcuuc

SEQ ID NO: 4098411 - RNA, 15 nt, Streptococcus pneumoniae R6
caggcuguuuuggau

SEQ ID NO: 4098412 - RNA, 17 nt, Streptococcus pneumoniae R6
caggcuuggucauuaaa

SEQ ID NO: 4098413 - RNA, 15 nt, Streptococcus pneumoniae R6
caggcuuucucccuu

SEQ ID NO: 4098414 - RNA, 16 nt, Streptococcus pneumoniae R6
caggcuuucucccuuu

SEQ ID NO: 4098415 - RNA, 22 nt, Streptococcus pneumoniae R6
caggcuuuuucuguacuauaaa

SEQ ID NO: 4098416 - RNA, 16 nt, Streptococcus pneumoniae R6
cagggucuuuguucug

SEQ ID NO: 4098417 - RNA, 20 nt, Streptococcus pneumoniae R6
cagguccaguuacuacugga

SEQ ID NO: 4098418 - RNA, 22 nt, Streptococcus pneumoniae R6
caggucgguuuuauuaaguaga

SEQ ID NO: 4098419 - RNA, 21 nt, Streptococcus pneumoniae R6
caggucuuauagaaacaucuu

SEQ ID NO: 4098420 - RNA, 14 nt, Streptococcus pneumoniae R6
caggugcuuaaaua

SEQ ID NO: 4098421 - RNA, 15 nt, Streptococcus pneumoniae R6
caggugcuuaaauag

SEQ ID NO: 4098422 - RNA, 14 nt, Streptococcus pneumoniae R6
caggugugaaaacu

SEQ ID NO: 4098423 - RNA, 16 nt, Streptococcus pneumoniae R6
cagguguuucuggucu

SEQ ID NO: 4098424 - RNA, 14 nt, Streptococcus pneumoniae R6
cagguucgauuccu

SEQ ID NO: 4098425 - RNA, 16 nt, Streptococcus pneumoniae R6
cagguucgauuccugc

SEQ ID NO: 4098426 - RNA, 14 nt, Streptococcus pneumoniae R6
cagguugcucaaaa

SEQ ID NO: 4098427 - RNA, 23 nt, Streptococcus pneumoniae R6
cagguugcucaaaguacugccuu

SEQ ID NO: 4098428 - RNA, 13 nt, Streptococcus pneumoniae R6
cagguuucacauc

SEQ ID NO: 4098429 - RNA, 22 nt, Streptococcus pneumoniae R6
cagguuuugaagcacuuauaga

SEQ ID NO: 4098430 - RNA, 15 nt, Streptococcus pneumoniae R6
cagguuuuucaccag

SEQ ID NO: 4098431 - RNA, 19 nt, Streptococcus pneumoniae R6
caguaaaaaaaacauauau

SEQ ID NO: 4098432 - RNA, 12 nt, Streptococcus pneumoniae R6
caguaaaaaauc

SEQ ID NO: 4098433 - RNA, 14 nt, Streptococcus pneumoniae R6
caguaaaaacuguu

SEQ ID NO: 4098434 - RNA, 23 nt, Streptococcus pneumoniae R6
caguaaaauagauaaauacucug

SEQ ID NO: 4098435 - RNA, 16 nt, Streptococcus pneumoniae R6
caguaaaucuuccuug

SEQ ID NO: 4098436 - RNA, 13 nt, Streptococcus pneumoniae R6
caguaaccauaca

SEQ ID NO: 4098437 - RNA, 16 nt, Streptococcus pneumoniae R6
caguaacuucugucua

SEQ ID NO: 4098438 - RNA, 19 nt, Streptococcus pneumoniae R6
caguaacuucugucuauuu

SEQ ID NO: 4098439 - RNA, 17 nt, Streptococcus pneumoniae R6
caguaacuuuaccaaaa

SEQ ID NO: 4098440 - RNA, 11 nt, Streptococcus pneumoniae R6
caguacaaaag

SEQ ID NO: 4098441 - RNA, 11 nt, Streptococcus pneumoniae R6
caguacaaacc

SEQ ID NO: 4098442 - RNA, 19 nt, Streptococcus pneumoniae R6
caguacacaggaauacuaa

SEQ ID NO: 4098443 - RNA, 23 nt, Streptococcus pneumoniae R6
caguacgcaucgacuacuaaaac

SEQ ID NO: 4098444 - RNA, 15 nt, Streptococcus pneumoniae R6
caguacuuucaacuc

SEQ ID NO: 4098445 - RNA, 13 nt, Streptococcus pneumoniae R6
caguacuuuuucu

SEQ ID NO: 4098446 - RNA, 17 nt, Streptococcus pneumoniae R6
caguagaaaaagucuga

SEQ ID NO: 4098447 - RNA, 18 nt, Streptococcus pneumoniae R6
caguagacuugaccgcag

SEQ ID NO: 4098448 - RNA, 14 nt, Streptococcus pneumoniae R6
caguagaucacuga

SEQ ID NO: 4098449 - RNA, 16 nt, Streptococcus pneumoniae R6
caguauauugaaauga

SEQ ID NO: 4098450 - RNA, 14 nt, Streptococcus pneumoniae R6
caguauuacaucca

SEQ ID NO: 4098451 - RNA, 14 nt, Streptococcus pneumoniae R6
caguauucuuuuua

SEQ ID NO: 4098452 - RNA, 15 nt, Streptococcus pneumoniae R6
caguauuucauuaca

SEQ ID NO: 4098453 - RNA, 14 nt, Streptococcus pneumoniae R6
cagucaaaucgauu

SEQ ID NO: 4098454 - RNA, 13 nt, Streptococcus pneumoniae R6
cagucacugucuu

SEQ ID NO: 4098455 - RNA, 21 nt, Streptococcus pneumoniae R6
caguccuuguaugacaucuug

SEQ ID NO: 4098456 - RNA, 23 nt, Streptococcus pneumoniae R6
caguccuuguaugacaucuugaa

SEQ ID NO: 4098457 - RNA, 18 nt, Streptococcus pneumoniae R6
cagucgcaaagaggaaga

SEQ ID NO: 4098458 - RNA, 23 nt, Streptococcus pneumoniae R6
cagucguuucaagauaaggaauu

SEQ ID NO: 4098459 - RNA, 16 nt, Streptococcus pneumoniae R6
cagucuccuagucuac

SEQ ID NO: 4098460 - RNA, 17 nt, Streptococcus pneumoniae R6
cagucuccuagucuaca

SEQ ID NO: 4098461 - RNA, 13 nt, Streptococcus pneumoniae R6
cagucugaaaaag

SEQ ID NO: 4098462 - RNA, 13 nt, Streptococcus pneumoniae R6
cagucugaaaaau

SEQ ID NO: 4098463 - RNA, 20 nt, Streptococcus pneumoniae R6
cagucugaaaaauaggauga

SEQ ID NO: 4098464 - RNA, 15 nt, Streptococcus pneumoniae R6
cagucugaccaccau

SEQ ID NO: 4098465 - RNA, 22 nt, Streptococcus pneumoniae R6
cagucuucaugacggcucauaa

SEQ ID NO: 4098466 - RNA, 18 nt, Streptococcus pneumoniae R6
cagugaaaacaggaguuc

SEQ ID NO: 4098467 - RNA, 17 nt, Streptococcus pneumoniae R6
cagugaaggcuuuaaau

SEQ ID NO: 4098468 - RNA, 20 nt, Streptococcus pneumoniae R6
cagugaagguauuuugacgu

SEQ ID NO: 4098469 - RNA, 16 nt, Streptococcus pneumoniae R6
cagugagaagaagggc

SEQ ID NO: 4098470 - RNA, 15 nt, Streptococcus pneumoniae R6
cagugauguuaagug

SEQ ID NO: 4098471 - RNA, 22 nt, Streptococcus pneumoniae R6
cagugauguuaagugcuucuuu

SEQ ID NO: 4098472 - RNA, 15 nt, Streptococcus pneumoniae R6
cagugauuaaaacug

SEQ ID NO: 4098473 - RNA, 15 nt, Streptococcus pneumoniae R6
caguguacauacuuu

SEQ ID NO: 4098474 - RNA, 16 nt, Streptococcus pneumoniae R6
caguguacauacuuua

SEQ ID NO: 4098475 - RNA, 22 nt, Streptococcus pneumoniae R6
caguguacauacuuuaucuucu

SEQ ID NO: 4098476 - RNA, 23 nt, Streptococcus pneumoniae R6
caguguauggagcuuuuuuauaa

SEQ ID NO: 4098477 - RNA, 20 nt, Streptococcus pneumoniae R6
caguguuuuaagcugacuuc

SEQ ID NO: 4098478 - RNA, 23 nt, Streptococcus pneumoniae R6
caguguuuuaagcugacuucguc

SEQ ID NO: 4098479 - RNA, 16 nt, Streptococcus pneumoniae R6
caguguuuugagcagc

SEQ ID NO: 4098480 - RNA, 20 nt, Streptococcus pneumoniae R6
caguguuuugaucugacuuc

SEQ ID NO: 4098481 - RNA, 22 nt, Streptococcus pneumoniae R6
caguguuuugaucugacuucgu

SEQ ID NO: 4098482 - RNA, 19 nt, Streptococcus pneumoniae R6
caguuauauugacagaaga

SEQ ID NO: 4098483 - RNA, 19 nt, Streptococcus pneumoniae R6
caguuauucuuaaaugaca

SEQ ID NO: 4098484 - RNA, 15 nt, Streptococcus pneumoniae R6
caguucauaguucua

SEQ ID NO: 4098485 - RNA, 17 nt, Streptococcus pneumoniae R6
caguucaucaugauaga

SEQ ID NO: 4098486 - RNA, 16 nt, Streptococcus pneumoniae R6
caguucauuuuuccuu

SEQ ID NO: 4098487 - RNA, 13 nt, Streptococcus pneumoniae R6
caguuccagcaaa

SEQ ID NO: 4098488 - RNA, 14 nt, Streptococcus pneumoniae R6
caguuccagcaaac

SEQ ID NO: 4098489 - RNA, 22 nt, Streptococcus pneumoniae R6
caguuccauccacaaccuuaaa

SEQ ID NO: 4098490 - RNA, 22 nt, Streptococcus pneumoniae R6
caguuccaucuacaaccuuaaa

SEQ ID NO: 4098491 - RNA, 20 nt, Streptococcus pneumoniae R6
caguucccugcauuucuuuu

SEQ ID NO: 4098492 - RNA, 15 nt, Streptococcus pneumoniae R6
caguucuaucuacaa

SEQ ID NO: 4098493 - RNA, 17 nt, Streptococcus pneumoniae R6
caguucuaucuacaacc

SEQ ID NO: 4098494 - RNA, 22 nt, Streptococcus pneumoniae R6
caguucuaucugcaaccuuaaa

SEQ ID NO: 4098495 - RNA, 22 nt, Streptococcus pneumoniae R6
caguucuucauggacuuuuuug

SEQ ID NO: 4098496 - RNA, 14 nt, Streptococcus pneumoniae R6
caguugacaaagag

SEQ ID NO: 4098497 - RNA, 16 nt, Streptococcus pneumoniae R6
caguugacaaagagcc

SEQ ID NO: 4098498 - RNA, 17 nt, Streptococcus pneumoniae R6
caguugauggagcuggu

SEQ ID NO: 4098499 - RNA, 20 nt, Streptococcus pneumoniae R6
caguugcaucuuaguuaaaa

SEQ ID NO: 4098500 - RNA, 21 nt, Streptococcus pneumoniae R6
caguugcugcguuaaauccua

SEQ ID NO: 4098501 - RNA, 23 nt, Streptococcus pneumoniae R6
caguugcugcguuaaauccuaua

SEQ ID NO: 4098502 - RNA, 16 nt, Streptococcus pneumoniae R6
caguugguuauacaua

SEQ ID NO: 4098503 - RNA, 20 nt, Streptococcus pneumoniae R6
caguuucuauuucauuuuac

SEQ ID NO: 4098504 - RNA, 12 nt, Streptococcus pneumoniae R6
caguuucucuac

SEQ ID NO: 4098505 - RNA, 20 nt, Streptococcus pneumoniae R6
caguuucugugcuuuuucaa

SEQ ID NO: 4098506 - RNA, 15 nt, Streptococcus pneumoniae R6
caguuuggcguugga

SEQ ID NO: 4098507 - RNA, 23 nt, Streptococcus pneumoniae R6
cauauacagucccuuuugaggga

SEQ ID NO: 4098508 - RNA, 11 nt, Streptococcus pneumoniae R6
cauauacuuua

SEQ ID NO: 4098509 - RNA, 18 nt, Streptococcus pneumoniae R6
cauauacuuuaucacaua

SEQ ID NO: 4098510 - RNA, 15 nt, Streptococcus pneumoniae R6
cauauagaccaacua

SEQ ID NO: 4098511 - RNA, 20 nt, Streptococcus pneumoniae R6
cauauagaccaacuauuuuc

SEQ ID NO: 4098512 - RNA, 21 nt, Streptococcus pneumoniae R6
cauauagaccaacuauuuuca

SEQ ID NO: 4098513 - RNA, 14 nt, Streptococcus pneumoniae R6
cauauagauaaaaa

SEQ ID NO: 4098514 - RNA, 19 nt, Streptococcus pneumoniae R6
cauauagauaaaaaacaac

SEQ ID NO: 4098515 - RNA, 18 nt, Streptococcus pneumoniae R6
cauauauucaacgaaaau

SEQ ID NO: 4098516 - RNA, 18 nt, Streptococcus pneumoniae R6
cauaucaagguuuuucaa

SEQ ID NO: 4098517 - RNA, 11 nt, Streptococcus pneumoniae R6
cauauccccag

SEQ ID NO: 4098518 - RNA, 23 nt, Streptococcus pneumoniae R6
cauauccuccuucaccaaucaaa

SEQ ID NO: 4098519 - RNA, 17 nt, Streptococcus pneumoniae R6
cauaucuccauuacuug

SEQ ID NO: 4098520 - RNA, 21 nt, Streptococcus pneumoniae R6
cauaucuccauuacuugcauu

SEQ ID NO: 4098521 - RNA, 19 nt, Streptococcus pneumoniae R6
cauaucugauauagauacc

SEQ ID NO: 4098522 - RNA, 12 nt, Streptococcus pneumoniae R6
cauaucuuauuu

SEQ ID NO: 4098523 - RNA, 20 nt, Streptococcus pneumoniae R6
cauaucuuuagggaaauuau

SEQ ID NO: 4098524 - RNA, 17 nt, Streptococcus pneumoniae R6
cauaugauugucuccuu

SEQ ID NO: 4098525 - RNA, 18 nt, Streptococcus pneumoniae R6
cauauuagggcaaauaaa

SEQ ID NO: 4098526 - RNA, 15 nt, Streptococcus pneumoniae R6
cauauuccacauuca

SEQ ID NO: 4098527 - RNA, 21 nt, Streptococcus pneumoniae R6
cauauucuaacuuauuuuaac

SEQ ID NO: 4098528 - RNA, 15 nt, Streptococcus pneumoniae R6
cauauugauauuuau

SEQ ID NO: 4098529 - RNA, 22 nt, Streptococcus pneumoniae R6
cauauuggaugaguuuacuauc

SEQ ID NO: 4098530 - RNA, 13 nt, Streptococcus pneumoniae R6
cauauuuggcaua

SEQ ID NO: 4098531 - RNA, 20 nt, Streptococcus pneumoniae R6
cauauuuguugcucuuaucu

SEQ ID NO: 4098532 - RNA, 13 nt, Streptococcus pneumoniae R6
cauauuuucaaaa

SEQ ID NO: 4098533 - RNA, 18 nt, Streptococcus pneumoniae R6
caucaaaaacaucucaga

SEQ ID NO: 4098534 - RNA, 22 nt, Streptococcus pneumoniae R6
caucaaaaaccgcucagcugag

SEQ ID NO: 4098535 - RNA, 20 nt, Streptococcus pneumoniae R6
caucaaaaauagaaauaaaa

SEQ ID NO: 4098536 - RNA, 21 nt, Streptococcus pneumoniae R6
caucaaaucacguacaacagc

SEQ ID NO: 4098537 - RNA, 14 nt, Streptococcus pneumoniae R6
caucaaaugagauu

SEQ ID NO: 4098538 - RNA, 12 nt, Streptococcus pneumoniae R6
caucaacagcuc

SEQ ID NO: 4098539 - RNA, 13 nt, Streptococcus pneumoniae R6
caucaacaguaac

SEQ ID NO: 4098540 - RNA, 18 nt, Streptococcus pneumoniae R6
caucaacuauucuuuuuc

SEQ ID NO: 4098541 - RNA, 14 nt, Streptococcus pneumoniae R6
caucaauaaccauc

SEQ ID NO: 4098542 - RNA, 17 nt, Streptococcus pneumoniae R6
caucaauaaccaucauu

SEQ ID NO: 4098543 - RNA, 22 nt, Streptococcus pneumoniae R6
caucaauauuagaugauuuuuc

SEQ ID NO: 4098544 - RNA, 16 nt, Streptococcus pneumoniae R6
caucaaucucuugucu

SEQ ID NO: 4098545 - RNA, 18 nt, Streptococcus pneumoniae R6
caucaaucucuugucuua

SEQ ID NO: 4098546 - RNA, 22 nt, Streptococcus pneumoniae R6
caucaaucuugcguugagcgaa

SEQ ID NO: 4098547 - RNA, 15 nt, Streptococcus pneumoniae R6
caucacgaucaaagu

SEQ ID NO: 4098548 - RNA, 14 nt, Streptococcus pneumoniae R6
caucacuagcuugg

SEQ ID NO: 4098549 - RNA, 16 nt, Streptococcus pneumoniae R6
caucacuaguaauaau

SEQ ID NO: 4098550 - RNA, 13 nt, Streptococcus pneumoniae R6
caucacuguuuuu

SEQ ID NO: 4098551 - RNA, 20 nt, Streptococcus pneumoniae R6
caucagggaguuguuuuuua

SEQ ID NO: 4098552 - RNA, 19 nt, Streptococcus pneumoniae R6
caucagguuucaagucugu

SEQ ID NO: 4098553 - RNA, 13 nt, Streptococcus pneumoniae R6
caucauaaaaaua

SEQ ID NO: 4098554 - RNA, 15 nt, Streptococcus pneumoniae R6
caucauauaaauaau

SEQ ID NO: 4098555 - RNA, 13 nt, Streptococcus pneumoniae R6
caucauccaccuu

SEQ ID NO: 4098556 - RNA, 21 nt, Streptococcus pneumoniae R6
caucaucguggucuucaucgc

SEQ ID NO: 4098557 - RNA, 14 nt, Streptococcus pneumoniae R6
caucaugaaaccac

SEQ ID NO: 4098558 - RNA, 20 nt, Streptococcus pneumoniae R6
caucauuccugauaaaagau

SEQ ID NO: 4098559 - RNA, 13 nt, Streptococcus pneumoniae R6
caucauuccuuca

SEQ ID NO: 4098560 - RNA, 21 nt, Streptococcus pneumoniae R6
cauccaaucacgugugaaaac

SEQ ID NO: 4098561 - RNA, 18 nt, Streptococcus pneumoniae R6
cauccacaaccucaaaac

SEQ ID NO: 4098562 - RNA, 19 nt, Streptococcus pneumoniae R6
cauccacaaccucaaaaca

SEQ ID NO: 4098563 - RNA, 21 nt, Streptococcus pneumoniae R6
cauccacaaccucaaaacagu

SEQ ID NO: 4098564 - RNA, 19 nt, Streptococcus pneumoniae R6
cauccaccuugcaaaaaaa

SEQ ID NO: 4098565 - RNA, 23 nt, Streptococcus pneumoniae R6
cauccacgagaaagaucauuaac

SEQ ID NO: 4098566 - RNA, 19 nt, Streptococcus pneumoniae R6
cauccacuggauaauuucu

SEQ ID NO: 4098567 - RNA, 16 nt, Streptococcus pneumoniae R6
cauccagauuuuucug

SEQ ID NO: 4098568 - RNA, 13 nt, Streptococcus pneumoniae R6
cauccagcaggag

SEQ ID NO: 4098569 - RNA, 21 nt, Streptococcus pneumoniae R6
cauccagcaggagaaaguuug

SEQ ID NO: 4098570 - RNA, 17 nt, Streptococcus pneumoniae R6
cauccaguaccaugggu

SEQ ID NO: 4098571 - RNA, 21 nt, Streptococcus pneumoniae R6
cauccauauaaaucuccagac

SEQ ID NO: 4098572 - RNA, 13 nt, Streptococcus pneumoniae R6
cauccauucuuuu

SEQ ID NO: 4098573 - RNA, 14 nt, Streptococcus pneumoniae R6
cauccccagugauu

SEQ ID NO: 4098574 - RNA, 18 nt, Streptococcus pneumoniae R6
cauccccucaaccugaau

SEQ ID NO: 4098575 - RNA, 18 nt, Streptococcus pneumoniae R6
cauccguuuuucuccucu

SEQ ID NO: 4098576 - RNA, 21 nt, Streptococcus pneumoniae R6
cauccuaucauucgacuaauu

SEQ ID NO: 4098577 - RNA, 11 nt, Streptococcus pneumoniae R6
cauccuauuua

SEQ ID NO: 4098578 - RNA, 20 nt, Streptococcus pneumoniae R6
cauccugaauagugaagaua

SEQ ID NO: 4098579 - RNA, 18 nt, Streptococcus pneumoniae R6
cauccuuacggucaaagu

SEQ ID NO: 4098580 - RNA, 21 nt, Streptococcus pneumoniae R6
cauccuuugcauccacaucca

SEQ ID NO: 4098581 - RNA, 18 nt, Streptococcus pneumoniae R6
cauccuuuucuguacuua

SEQ ID NO: 4098582 - RNA, 20 nt, Streptococcus pneumoniae R6
cauccuuuucuguacuuagc

SEQ ID NO: 4098583 - RNA, 22 nt, Streptococcus pneumoniae R6
cauccuuuucuguacuuagcca

SEQ ID NO: 4098584 - RNA, 15 nt, Streptococcus pneumoniae R6
caucgacuacuaaaa

SEQ ID NO: 4098585 - RNA, 18 nt, Streptococcus pneumoniae R6
caucgagauggaguuccu

SEQ ID NO: 4098586 - RNA, 18 nt, Streptococcus pneumoniae R6
caucgauuuuuucaccaa

SEQ ID NO: 4098587 - RNA, 14 nt, Streptococcus pneumoniae R6
caucgcuuggaagu

SEQ ID NO: 4098588 - RNA, 20 nt, Streptococcus pneumoniae R6
caucgcuuggaaguuuuccu

SEQ ID NO: 4098589 - RNA, 15 nt, Streptococcus pneumoniae R6
caucgguugcaaguu

SEQ ID NO: 4098590 - RNA, 13 nt, Streptococcus pneumoniae R6
caucuaaaacugg

SEQ ID NO: 4098591 - RNA, 22 nt, Streptococcus pneumoniae R6
caucuaaaacuggugauaagua

SEQ ID NO: 4098592 - RNA, 16 nt, Streptococcus pneumoniae R6
caucuaauguuuuuau

SEQ ID NO: 4098593 - RNA, 14 nt, Streptococcus pneumoniae R6
caucuacaaccuca

SEQ ID NO: 4098594 - RNA, 18 nt, Streptococcus pneumoniae R6
caucuacaaccucaaaaa

SEQ ID NO: 4098595 - RNA, 19 nt, Streptococcus pneumoniae R6
caucuacaaccucaaaaac

SEQ ID NO: 4098596 - RNA, 16 nt, Streptococcus pneumoniae R6
caucuacaaccuuaaa

SEQ ID NO: 4098597 - RNA, 19 nt, Streptococcus pneumoniae R6
caucuaucaaaagauguua

SEQ ID NO: 4098598 - RNA, 13 nt, Streptococcus pneumoniae R6
caucuauuuuuac

SEQ ID NO: 4098599 - RNA, 16 nt, Streptococcus pneumoniae R6
caucucagaauaauau

SEQ ID NO: 4098600 - RNA, 14 nt, Streptococcus pneumoniae R6
caucuccaacugca

SEQ ID NO: 4098601 - RNA, 14 nt, Streptococcus pneumoniae R6
caucuccauccuca

SEQ ID NO: 4098602 - RNA, 21 nt, Streptococcus pneumoniae R6
caucucccgucaagacuaggu

SEQ ID NO: 4098603 - RNA, 14 nt, Streptococcus pneumoniae R6
caucucgacuggca

SEQ ID NO: 4098604 - RNA, 22 nt, Streptococcus pneumoniae R6
caucucgugcauuucaucccca

SEQ ID NO: 4098605 - RNA, 23 nt, Streptococcus pneumoniae R6
caucucgugcauuucauccccau

SEQ ID NO: 4098606 - RNA, 19 nt, Streptococcus pneumoniae R6
caucucuuguaacccaaac

SEQ ID NO: 4098607 - RNA, 21 nt, Streptococcus pneumoniae R6
caucugaaaucccuuguucca

SEQ ID NO: 4098608 - RNA, 20 nt, Streptococcus pneumoniae R6
caucugcagccucaaaacac

SEQ ID NO: 4098609 - RNA, 19 nt, Streptococcus pneumoniae R6
cauuccucccauauuuggc

SEQ ID NO: 4098610 - RNA, 19 nt, Streptococcus pneumoniae R6
cauuccugauaaaagauag

SEQ ID NO: 4098611 - RNA, 23 nt, Streptococcus pneumoniae R6
cauucgaaugacuacauuuuuug

SEQ ID NO: 4098612 - RNA, 19 nt, Streptococcus pneumoniae R6
cauucgaaugauauuuuca

SEQ ID NO: 4098613 - RNA, 19 nt, Streptococcus pneumoniae R6
cauucgaaugauuucucuu

SEQ ID NO: 4098614 - RNA, 23 nt, Streptococcus pneumoniae R6
cauucuacaucauugucaaacaa

SEQ ID NO: 4098615 - RNA, 16 nt, Streptococcus pneumoniae R6
cauucuaggcuaucga

SEQ ID NO: 4098616 - RNA, 15 nt, Streptococcus pneumoniae R6
cauucuaguccaucu

SEQ ID NO: 4098617 - RNA, 18 nt, Streptococcus pneumoniae R6
cauucuccaguagaucac

SEQ ID NO: 4098618 - RNA, 21 nt, Streptococcus pneumoniae R6
cauucuccaguagaucacuga

SEQ ID NO: 4098619 - RNA, 22 nt, Streptococcus pneumoniae R6
cauucuccaguagaucacugaa

SEQ ID NO: 4098620 - RNA, 22 nt, Streptococcus pneumoniae R6
cauucucccgcccuuuuuucuc

SEQ ID NO: 4098621 - RNA, 21 nt, Streptococcus pneumoniae R6
cauucucgugaaauuuuagaa

SEQ ID NO: 4098622 - RNA, 21 nt, Streptococcus pneumoniae R6
cauucugcuagacuaacuucu

SEQ ID NO: 4098623 - RNA, 20 nt, Streptococcus pneumoniae R6
cauucuuagaaaucgauuug

SEQ ID NO: 4098624 - RNA, 19 nt, Streptococcus pneumoniae R6
cauucuuauuuggcaauuc

SEQ ID NO: 4098625 - RNA, 23 nt, Streptococcus pneumoniae R6
cauucuucucuugaaaaugaaag

SEQ ID NO: 4098626 - RNA, 18 nt, Streptococcus pneumoniae R6
cauucuucuuuuccaaac

SEQ ID NO: 4098627 - RNA, 19 nt, Streptococcus pneumoniae R6
cauucuuuuguucaucauu

SEQ ID NO: 4098628 - RNA, 23 nt, Streptococcus pneumoniae R6
cauucuuuuuuaauucuuuuuca

SEQ ID NO: 4098629 - RNA, 15 nt, Streptococcus pneumoniae R6
cauugaaaaaauauc

SEQ ID NO: 4098630 - RNA, 18 nt, Streptococcus pneumoniae R6
cauugaaaaugugaaaua

SEQ ID NO: 4098631 - RNA, 15 nt, Streptococcus pneumoniae R6
cauugacagauugca

SEQ ID NO: 4098632 - RNA, 15 nt, Streptococcus pneumoniae R6
cauugacaucuguga

SEQ ID NO: 4098633 - RNA, 20 nt, Streptococcus pneumoniae R6
cauugacuugcuguuuucuu

SEQ ID NO: 4098634 - RNA, 23 nt, Streptococcus pneumoniae R6
cauugagguccaaguuugcaaag

SEQ ID NO: 4098635 - RNA, 17 nt, Streptococcus pneumoniae R6
cauugaguauaagauau

SEQ ID NO: 4098636 - RNA, 20 nt, Streptococcus pneumoniae R6
cauugaguauuaauuaggaa

SEQ ID NO: 4098637 - RNA, 14 nt, Streptococcus pneumoniae R6
cauugauauaaaga

SEQ ID NO: 4098638 - RNA, 18 nt, Streptococcus pneumoniae R6
cauugauauaaagagcac

SEQ ID NO: 4098639 - RNA, 12 nt, Streptococcus pneumoniae R6
cauugauauggu

SEQ ID NO: 4098640 - RNA, 17 nt, Streptococcus pneumoniae R6
cauugauaugguaaugu

SEQ ID NO: 4098641 - RNA, 20 nt, Streptococcus pneumoniae R6
cauugauuuucaucaucaca

SEQ ID NO: 4098642 - RNA, 18 nt, Streptococcus pneumoniae R6
cauugcguuugauaaguu

SEQ ID NO: 4098643 - RNA, 16 nt, Streptococcus pneumoniae R6
cauuggaaguucuuuu

SEQ ID NO: 4098644 - RNA, 21 nt, Streptococcus pneumoniae R6
cauugguguuugguugaccag

SEQ ID NO: 4098645 - RNA, 19 nt, Streptococcus pneumoniae R6
cauuguagaggaggauaga

SEQ ID NO: 4098646 - RNA, 16 nt, Streptococcus pneumoniae R6
cauugugaugaagauu

SEQ ID NO: 4098647 - RNA, 16 nt, Streptococcus pneumoniae R6
cauuguucuuguuuug

SEQ ID NO: 4098648 - RNA, 21 nt, Streptococcus pneumoniae R6
cauuguucuuguuuugacauu

SEQ ID NO: 4098649 - RNA, 21 nt, Streptococcus pneumoniae R6
cauuguuucguuucuucgucc

SEQ ID NO: 4098650 - RNA, 14 nt, Streptococcus pneumoniae R6
cauuuaaaauuaaa

SEQ ID NO: 4098651 - RNA, 16 nt, Streptococcus pneumoniae R6
cauuuaauaaugaaga

SEQ ID NO: 4098652 - RNA, 16 nt, Streptococcus pneumoniae R6
cauuuaauauauuuau

SEQ ID NO: 4098653 - RNA, 19 nt, Streptococcus pneumoniae R6
cauuuaauccaaaguaaaa

SEQ ID NO: 4098654 - RNA, 20 nt, Streptococcus pneumoniae R6
cauuuacucuccuccauaaa

SEQ ID NO: 4098655 - RNA, 22 nt, Streptococcus pneumoniae R6
cauuuacucuccuccauaaaaa

SEQ ID NO: 4098656 - RNA, 18 nt, Streptococcus pneumoniae R6
cauuuauauaaaaagaaa

SEQ ID NO: 4098657 - RNA, 22 nt, Streptococcus pneumoniae R6
cauuuaucauccagauuuuucu

SEQ ID NO: 4098658 - RNA, 14 nt, Streptococcus pneumoniae R6
cauuuaucuucuua

SEQ ID NO: 4098659 - RNA, 17 nt, Streptococcus pneumoniae R6
cauuuauggaaaaaaug

SEQ ID NO: 4098660 - RNA, 13 nt, Streptococcus pneumoniae R6
cauuucaaagccu

SEQ ID NO: 4098661 - RNA, 17 nt, Streptococcus pneumoniae R6
cauuucaauagcuccuu

SEQ ID NO: 4098662 - RNA, 20 nt, Streptococcus pneumoniae R6
cauuucaguugccucagauu

SEQ ID NO: 4098663 - RNA, 13 nt, Streptococcus pneumoniae R6
cauuucaucccca

SEQ ID NO: 4098664 - RNA, 12 nt, Streptococcus pneumoniae R6
cauuuccaauga

SEQ ID NO: 4098665 - RNA, 21 nt, Streptococcus pneumoniae R6
cauuuccauuguuguuucuug

SEQ ID NO: 4098666 - RNA, 20 nt, Streptococcus pneumoniae R6
cauuucgacugaaaauauuu

SEQ ID NO: 4098667 - RNA, 17 nt, Streptococcus pneumoniae R6
cauuucggauuuuaaaa

SEQ ID NO: 4098668 - RNA, 15 nt, Streptococcus pneumoniae R6
cauuucugcauaagc

SEQ ID NO: 4098669 - RNA, 15 nt, Streptococcus pneumoniae R6
cauuucuggauaacu

SEQ ID NO: 4098670 - RNA, 16 nt, Streptococcus pneumoniae R6
cauuucuggauaacug

SEQ ID NO: 4098671 - RNA, 14 nt, Streptococcus pneumoniae R6
cauuucuucaacaa

SEQ ID NO: 4098672 - RNA, 18 nt, Streptococcus pneumoniae R6
cauuucuucaacaaaccu

SEQ ID NO: 4098673 - RNA, 15 nt, Streptococcus pneumoniae R6
cauuugaaucaaaaa

SEQ ID NO: 4098674 - RNA, 21 nt, Streptococcus pneumoniae R6
cauuugaugagaaaauaaagu

SEQ ID NO: 4098675 - RNA, 14 nt, Streptococcus pneumoniae R6
cauuugauuuuccu

SEQ ID NO: 4098676 - RNA, 22 nt, Streptococcus pneumoniae R6
cauuugauuuuccuaaucaauu

SEQ ID NO: 4098677 - RNA, 18 nt, Streptococcus pneumoniae R6
cauuugauuuuguaaaaa

SEQ ID NO: 4098678 - RNA, 21 nt, Streptococcus pneumoniae R6
cauuugcgcgcuugaaugaua

SEQ ID NO: 4098679 - RNA, 14 nt, Streptococcus pneumoniae R6
cauuugcuucauca

SEQ ID NO: 4098680 - RNA, 19 nt, Streptococcus pneumoniae R6
cauuuggcccuaccugcuc

SEQ ID NO: 4098681 - RNA, 19 nt, Streptococcus pneumoniae R6
cauuugggcaaucgccaau

SEQ ID NO: 4098682 - RNA, 13 nt, Streptococcus pneumoniae R6
cauuuguaaacug

SEQ ID NO: 4098683 - RNA, 13 nt, Streptococcus pneumoniae R6
cauuuguaaaucu

SEQ ID NO: 4098684 - RNA, 17 nt, Streptococcus pneumoniae R6
cauuuguaugagaggca

SEQ ID NO: 4098685 - RNA, 20 nt, Streptococcus pneumoniae R6
cauuuuacaucuguuuuaaa

SEQ ID NO: 4098686 - RNA, 15 nt, Streptococcus pneumoniae R6
cauuuuacuauaaaa

SEQ ID NO: 4098687 - RNA, 13 nt, Streptococcus pneumoniae R6
cauuuuacuauau

SEQ ID NO: 4098688 - RNA, 16 nt, Streptococcus pneumoniae R6
cauuuuauucauaucc

SEQ ID NO: 4098689 - RNA, 17 nt, Streptococcus pneumoniae R6
cauuuuauucauauccc

SEQ ID NO: 4098690 - RNA, 14 nt, Streptococcus pneumoniae R6
cauuuugaccuguu

SEQ ID NO: 4098691 - RNA, 17 nt, Streptococcus pneumoniae R6
cauuuuggauauaagaa

SEQ ID NO: 4098692 - RNA, 18 nt, Streptococcus pneumoniae R6
cauuuuuccauauaaaaa

SEQ ID NO: 4098693 - RNA, 23 nt, Streptococcus pneumoniae R6
ccaaaaaaaauacaguauccaca

SEQ ID NO: 4098694 - RNA, 15 nt, Streptococcus pneumoniae R6
ccaaaaaaacuccaa

SEQ ID NO: 4098695 - RNA, 21 nt, Streptococcus pneumoniae R6
ccaaaaaaguuagacaauuaa

SEQ ID NO: 4098696 - RNA, 23 nt, Streptococcus pneumoniae R6
ccaaaaaaguuagacaauuaauu

SEQ ID NO: 4098697 - RNA, 16 nt, Streptococcus pneumoniae R6
ccaaaaagugcaugag

SEQ ID NO: 4098698 - RNA, 19 nt, Streptococcus pneumoniae R6
ccaaaaagugcaugaguua

SEQ ID NO: 4098699 - RNA, 18 nt, Streptococcus pneumoniae R6
ccaaaaauaaaucuauca

SEQ ID NO: 4098700 - RNA, 21 nt, Streptococcus pneumoniae R6
ccaaaaauacuuggauuacaa

SEQ ID NO: 4098701 - RNA, 15 nt, Streptococcus pneumoniae R6
ccaaaacacaaaaag

SEQ ID NO: 4098702 - RNA, 15 nt, Streptococcus pneumoniae R6
ccaaaaguccaaaga

SEQ ID NO: 4098703 - RNA, 18 nt, Streptococcus pneumoniae R6
ccaaaagucgaguucaug

SEQ ID NO: 4098704 - RNA, 23 nt, Streptococcus pneumoniae R6
ccaaaaucaugacaaucaagacc

SEQ ID NO: 4098705 - RNA, 17 nt, Streptococcus pneumoniae R6
ccaaaauuaaaauguuc

SEQ ID NO: 4098706 - RNA, 12 nt, Streptococcus pneumoniae R6
ccaaaauuccau

SEQ ID NO: 4098707 - RNA, 17 nt, Streptococcus pneumoniae R6
ccaaacacgaaaccagu

SEQ ID NO: 4098708 - RNA, 12 nt, Streptococcus pneumoniae R6
ccaaacagucuc

SEQ ID NO: 4098709 - RNA, 19 nt, Streptococcus pneumoniae R6
ccaaacaucaccagcaugg

SEQ ID NO: 4098710 - RNA, 18 nt, Streptococcus pneumoniae R6
ccaaaccaaacagucuca

SEQ ID NO: 4098711 - RNA, 15 nt, Streptococcus pneumoniae R6
ccaaaccauuuuugg

SEQ ID NO: 4098712 - RNA, 17 nt, Streptococcus pneumoniae R6
ccaaaccauuuuuggcu

SEQ ID NO: 4098713 - RNA, 18 nt, Streptococcus pneumoniae R6
ccaaacgauuaucuaaca

SEQ ID NO: 4098714 - RNA, 20 nt, Streptococcus pneumoniae R6
ccaaacguccagccuugucu

SEQ ID NO: 4098715 - RNA, 23 nt, Streptococcus pneumoniae R6
ccaaacgucugcggcggaaacaa

SEQ ID NO: 4098716 - RNA, 19 nt, Streptococcus pneumoniae R6
ccaaacguggaaacucucg

SEQ ID NO: 4098717 - RNA, 15 nt, Streptococcus pneumoniae R6
ccaaacuagauagca

SEQ ID NO: 4098718 - RNA, 12 nt, Streptococcus pneumoniae R6
ccaaacuugaaa

SEQ ID NO: 4098719 - RNA, 15 nt, Streptococcus pneumoniae R6
ccaaagaaauuauuc

SEQ ID NO: 4098720 - RNA, 19 nt, Streptococcus pneumoniae R6
ccaaagaaauuauucuuau

SEQ ID NO: 4098721 - RNA, 14 nt, Streptococcus pneumoniae R6
ccaaagaaguagau

SEQ ID NO: 4098722 - RNA, 22 nt, Streptococcus pneumoniae R6
ccaaagacagguuucacaucaa

SEQ ID NO: 4098723 - RNA, 21 nt, Streptococcus pneumoniae R6
ccaaagcacggagaacaauau

SEQ ID NO: 4098724 - RNA, 14 nt, Streptococcus pneumoniae R6
ccaaaggauuuagu

SEQ ID NO: 4098725 - RNA, 22 nt, Streptococcus pneumoniae R6
ccaaaggauuuaguucuguacu

SEQ ID NO: 4098726 - RNA, 23 nt, Streptococcus pneumoniae R6
ccaaagguaauccaauugaggaa

SEQ ID NO: 4098727 - RNA, 23 nt, Streptococcus pneumoniae R6
ccaaaguaaaauacaaaccaaac

SEQ ID NO: 4098728 - RNA, 16 nt, Streptococcus pneumoniae R6
ccaaaguauauuuagu

SEQ ID NO: 4098729 - RNA, 23 nt, Streptococcus pneumoniae R6
ccaaauaaguaguguuagauuag

SEQ ID NO: 4098730 - RNA, 21 nt, Streptococcus pneumoniae R6
ccaaauaauagacuuccugca

SEQ ID NO: 4098731 - RNA, 22 nt, Streptococcus pneumoniae R6
ccaaauacuuguagcaaucuuc

SEQ ID NO: 4098732 - RNA, 21 nt, Streptococcus pneumoniae R6
ccaaauauugcucauaacgca

SEQ ID NO: 4098733 - RNA, 21 nt, Streptococcus pneumoniae R6
ccaaauauuguaaauucuuaa

SEQ ID NO: 4098734 - RNA, 20 nt, Streptococcus pneumoniae R6
ccaaauccccaucuuuagcu

SEQ ID NO: 4098735 - RNA, 16 nt, Streptococcus pneumoniae R6
ccaacaauucuuggau

SEQ ID NO: 4098736 - RNA, 20 nt, Streptococcus pneumoniae R6
ccaacauagauaaagacacc

SEQ ID NO: 4098737 - RNA, 15 nt, Streptococcus pneumoniae R6
ccaaccagcuguauc

SEQ ID NO: 4098738 - RNA, 14 nt, Streptococcus pneumoniae R6
ccaaccaucaaaau

SEQ ID NO: 4098739 - RNA, 22 nt, Streptococcus pneumoniae R6
ccaacgugaguagucauaccaa

SEQ ID NO: 4098740 - RNA, 20 nt, Streptococcus pneumoniae R6
ccaacuaaccaacuucuuuu

SEQ ID NO: 4098741 - RNA, 22 nt, Streptococcus pneumoniae R6
ccaacuacuaaaccaauaauaa

SEQ ID NO: 4098742 - RNA, 17 nt, Streptococcus pneumoniae R6
ccaacugaucccuccau

SEQ ID NO: 4098743 - RNA, 15 nt, Streptococcus pneumoniae R6
ccaacugcaaagaua

SEQ ID NO: 4098744 - RNA, 18 nt, Streptococcus pneumoniae R6
ccaacugcaaguccagaa

SEQ ID NO: 4098745 - RNA, 15 nt, Streptococcus pneumoniae R6
ccaacuucuuuuuga

SEQ ID NO: 4098746 - RNA, 17 nt, Streptococcus pneumoniae R6
ccaacuucuuuuuuuga

SEQ ID NO: 4098747 - RNA, 13 nt, Streptococcus pneumoniae R6
ccaagaccuuaaa

SEQ ID NO: 4098748 - RNA, 21 nt, Streptococcus pneumoniae R6
ccaagaguagagagaaaggag

SEQ ID NO: 4098749 - RNA, 21 nt, Streptococcus pneumoniae R6
ccaagauagaagguaaauucu

SEQ ID NO: 4098750 - RNA, 23 nt, Streptococcus pneumoniae R6
ccaagauagaagguaaauucugu

SEQ ID NO: 4098751 - RNA, 20 nt, Streptococcus pneumoniae R6
ccaagaucuugucugcaugg

SEQ ID NO: 4098752 - RNA, 16 nt, Streptococcus pneumoniae R6
ccaagauucaacauca

SEQ ID NO: 4098753 - RNA, 17 nt, Streptococcus pneumoniae R6
ccaagcauuuucauaag

SEQ ID NO: 4098754 - RNA, 23 nt, Streptococcus pneumoniae R6
ccaagccagcauuuucaaagaag

SEQ ID NO: 4098755 - RNA, 17 nt, Streptococcus pneumoniae R6
ccaagcccaucaauacc

SEQ ID NO: 4098756 - RNA, 18 nt, Streptococcus pneumoniae R6
ccaagcgcccugcaauca

SEQ ID NO: 4098757 - RNA, 22 nt, Streptococcus pneumoniae R6
ccaagcgcucgaugucuuggau

SEQ ID NO: 4098758 - RNA, 14 nt, Streptococcus pneumoniae R6
ccaagcucugaaug

SEQ ID NO: 4098759 - RNA, 20 nt, Streptococcus pneumoniae R6
ccaaggaaaguucuuccccu

SEQ ID NO: 4098760 - RNA, 23 nt, Streptococcus pneumoniae R6
ccaaggaagaagcuguaaaucua

SEQ ID NO: 4098761 - RNA, 19 nt, Streptococcus pneumoniae R6
ccaaggaagucuuguuuga

SEQ ID NO: 4098762 - RNA, 16 nt, Streptococcus pneumoniae R6
ccaaggaauucauuua

SEQ ID NO: 4098763 - RNA, 17 nt, Streptococcus pneumoniae R6
ccaaguaguaguuucag

SEQ ID NO: 4098764 - RNA, 15 nt, Streptococcus pneumoniae R6
ccaaguccucaauuu

SEQ ID NO: 4098765 - RNA, 19 nt, Streptococcus pneumoniae R6
ccaagucgaaccuuccuga

SEQ ID NO: 4098766 - RNA, 16 nt, Streptococcus pneumoniae R6
ccaagucggcaggcug

SEQ ID NO: 4098767 - RNA, 14 nt, Streptococcus pneumoniae R6
ccaagucugcaugc

SEQ ID NO: 4098768 - RNA, 20 nt, Streptococcus pneumoniae R6
ccaaguggaagucugucacc

SEQ ID NO: 4098769 - RNA, 13 nt, Streptococcus pneumoniae R6
ccaaguuaaaaaa

SEQ ID NO: 4098770 - RNA, 22 nt, Streptococcus pneumoniae R6
ccaauaaauguuucauuuuuga

SEQ ID NO: 4098771 - RNA, 20 nt, Streptococcus pneumoniae R6
ccaauaauagaaaacagaca

SEQ ID NO: 4098772 - RNA, 23 nt, Streptococcus pneumoniae R6
ccaauaauguuaaccacaaaaag

SEQ ID NO: 4098773 - RNA, 13 nt, Streptococcus pneumoniae R6
ccaauacaggaaa

SEQ ID NO: 4098774 - RNA, 13 nt, Streptococcus pneumoniae R6
ccaauagccgcaa

SEQ ID NO: 4098775 - RNA, 12 nt, Streptococcus pneumoniae R6
ccaauagcgauu

SEQ ID NO: 4098776 - RNA, 22 nt, Streptococcus pneumoniae R6
ccaauagcgauucccaagucug

SEQ ID NO: 4098777 - RNA, 23 nt, Streptococcus pneumoniae R6
ccaauaggacgcuccaaaucacc

SEQ ID NO: 4098778 - RNA, 20 nt, Streptococcus pneumoniae R6
ccaauauuagucggaaucuu

SEQ ID NO: 4098779 - RNA, 22 nt, Streptococcus pneumoniae R6
ccaaucaaucguccuugauuua

SEQ ID NO: 4098780 - RNA, 14 nt, Streptococcus pneumoniae R6
ccaaucauggcugg

SEQ ID NO: 4098781 - RNA, 19 nt, Streptococcus pneumoniae R6
ccaaucauggcugggaugc

SEQ ID NO: 4098782 - RNA, 21 nt, Streptococcus pneumoniae R6
ccaaucccaugucaauucuca

SEQ ID NO: 4098783 - RNA, 22 nt, Streptococcus pneumoniae R6
ccaauccuaugauacccaaaau

SEQ ID NO: 4098784 - RNA, 22 nt, Streptococcus pneumoniae R6
ccaauccuuguaugacaucuug

SEQ ID NO: 4098785 - RNA, 14 nt, Streptococcus pneumoniae R6
ccaaucucuugaac

SEQ ID NO: 4098786 - RNA, 21 nt, Streptococcus pneumoniae R6
ccaaucuggaggcuuuuucuc

SEQ ID NO: 4098787 - RNA, 19 nt, Streptococcus pneumoniae R6
ccaauggguugaaguaacu

SEQ ID NO: 4098788 - RNA, 16 nt, Streptococcus pneumoniae R6
ccaauuccuugauaua

SEQ ID NO: 4098789 - RNA, 20 nt, Streptococcus pneumoniae R6
ccaauucugcuuuuaaauag

SEQ ID NO: 4098790 - RNA, 11 nt, Streptococcus pneumoniae R6
ccaauucuucg

SEQ ID NO: 4098791 - RNA, 13 nt, Streptococcus pneumoniae R6
ccaauucuucuuc

SEQ ID NO: 4098792 - RNA, 15 nt, Streptococcus pneumoniae R6
ccaauucuucuucug

SEQ ID NO: 4098793 - RNA, 21 nt, Streptococcus pneumoniae R6
ccaauucuuucaagcgcucca

SEQ ID NO: 4098794 - RNA, 13 nt, Streptococcus pneumoniae R6
ccaauugauuaag

SEQ ID NO: 4098795 - RNA, 16 nt, Streptococcus pneumoniae R6
ccaauugauuaugaau

SEQ ID NO: 4098796 - RNA, 15 nt, Streptococcus pneumoniae R6
ccaauuuauguaauc

SEQ ID NO: 4098797 - RNA, 12 nt, Streptococcus pneumoniae R6
ccaauuucuaac

SEQ ID NO: 4098798 - RNA, 23 nt, Streptococcus pneumoniae R6
ccaauuucuaacauauuucuaga

SEQ ID NO: 4098799 - RNA, 23 nt, Streptococcus pneumoniae R6
ccacaaaaaguggauuuuucuuc

SEQ ID NO: 4098800 - RNA, 14 nt, Streptococcus pneumoniae R6
ccacaaaagagaaa

SEQ ID NO: 4098801 - RNA, 18 nt, Streptococcus pneumoniae R6
ccacaaccucaaaacaau

SEQ ID NO: 4098802 - RNA, 12 nt, Streptococcus pneumoniae R6
ccacaauaaaac

SEQ ID NO: 4098803 - RNA, 13 nt, Streptococcus pneumoniae R6
ccacaauuuucau

SEQ ID NO: 4098804 - RNA, 14 nt, Streptococcus pneumoniae R6
ccacacagaaagca

SEQ ID NO: 4098805 - RNA, 13 nt, Streptococcus pneumoniae R6
ccacacauauaga

SEQ ID NO: 4098806 - RNA, 14 nt, Streptococcus pneumoniae R6
ccacacuuccaagu

SEQ ID NO: 4098807 - RNA, 20 nt, Streptococcus pneumoniae R6
ccacagaccuguccaacaga

SEQ ID NO: 4098808 - RNA, 18 nt, Streptococcus pneumoniae R6
ccacagcguuucuauauu

SEQ ID NO: 4098809 - RNA, 13 nt, Streptococcus pneumoniae R6
ccacaggagcugg

SEQ ID NO: 4098810 - RNA, 14 nt, Streptococcus pneumoniae R6
ccacaggagcugga

SEQ ID NO: 4098811 - RNA, 11 nt, Streptococcus pneumoniae R6
ccaccacaaaa

SEQ ID NO: 4098812 - RNA, 15 nt, Streptococcus pneumoniae R6
ccaccaccugcaaca

SEQ ID NO: 4098813 - RNA, 14 nt, Streptococcus pneumoniae R6
ccaucauuuuuaga

SEQ ID NO: 4098814 - RNA, 13 nt, Streptococcus pneumoniae R6
ccaucauuuuuga

SEQ ID NO: 4098815 - RNA, 11 nt, Streptococcus pneumoniae R6
ccauccaagcg

SEQ ID NO: 4098816 - RNA, 19 nt, Streptococcus pneumoniae R6
ccaucccauuuauauaaaa

SEQ ID NO: 4098817 - RNA, 21 nt, Streptococcus pneumoniae R6
ccaucccauuuauauaaaaag

SEQ ID NO: 4098818 - RNA, 19 nt, Streptococcus pneumoniae R6
ccauccugaauagugaaga

SEQ ID NO: 4098819 - RNA, 14 nt, Streptococcus pneumoniae R6
ccaucuacaaccuu

SEQ ID NO: 4098820 - RNA, 13 nt, Streptococcus pneumoniae R6
ccaucuagaauca

SEQ ID NO: 4098821 - RNA, 21 nt, Streptococcus pneumoniae R6
ccaucuagaaucaauagaagu

SEQ ID NO: 4098822 - RNA, 16 nt, Streptococcus pneumoniae R6
ccaucucgacuggcaa

SEQ ID NO: 4098823 - RNA, 18 nt, Streptococcus pneumoniae R6
ccaucucggucaucauca

SEQ ID NO: 4098824 - RNA, 13 nt, Streptococcus pneumoniae R6
ccaucugcagccu

SEQ ID NO: 4098825 - RNA, 16 nt, Streptococcus pneumoniae R6
ccaucugggucggcuu

SEQ ID NO: 4098826 - RNA, 16 nt, Streptococcus pneumoniae R6
ccaucuucauuuuggu

SEQ ID NO: 4098827 - RNA, 13 nt, Streptococcus pneumoniae R6
ccaucuucucacg

SEQ ID NO: 4098828 - RNA, 17 nt, Streptococcus pneumoniae R6
ccaucuuuaggaucaug

SEQ ID NO: 4098829 - RNA, 21 nt, Streptococcus pneumoniae R6
ccaucuuuugacagucuucau

SEQ ID NO: 4098830 - RNA, 22 nt, Streptococcus pneumoniae R6
ccaugaaaagaucgccaucaua

SEQ ID NO: 4098831 - RNA, 19 nt, Streptococcus pneumoniae R6
ccaugaacgucuaaacugu

SEQ ID NO: 4098832 - RNA, 23 nt, Streptococcus pneumoniae R6
ccaugaacgucuaaacuguacaa

SEQ ID NO: 4098833 - RNA, 19 nt, Streptococcus pneumoniae R6
ccaugacgcauaguugcau

SEQ ID NO: 4098834 - RNA, 19 nt, Streptococcus pneumoniae R6
ccaugacgucguaaccaga

SEQ ID NO: 4098835 - RNA, 20 nt, Streptococcus pneumoniae R6
ccaugagcgucuuucuuauc

SEQ ID NO: 4098836 - RNA, 17 nt, Streptococcus pneumoniae R6
ccaugaugcugguuguc

SEQ ID NO: 4098837 - RNA, 15 nt, Streptococcus pneumoniae R6
ccaugguaucaaagg

SEQ ID NO: 4098838 - RNA, 18 nt, Streptococcus pneumoniae R6
ccaugucaauucucacuu

SEQ ID NO: 4098839 - RNA, 22 nt, Streptococcus pneumoniae R6
ccaugucgcaucgucaucacga

SEQ ID NO: 4098840 - RNA, 15 nt, Streptococcus pneumoniae R6
ccaugucguuuccuu

SEQ ID NO: 4098841 - RNA, 11 nt, Streptococcus pneumoniae R6
ccauguuauga

SEQ ID NO: 4098842 - RNA, 20 nt, Streptococcus pneumoniae R6
ccauguuuuucaauagccug

SEQ ID NO: 4098843 - RNA, 23 nt, Streptococcus pneumoniae R6
ccauguuuuucuccuauuuucuu

SEQ ID NO: 4098844 - RNA, 14 nt, Streptococcus pneumoniae R6
ccauucacaacauc

SEQ ID NO: 4098845 - RNA, 15 nt, Streptococcus pneumoniae R6
ccauucacaacaucu

SEQ ID NO: 4098846 - RNA, 17 nt, Streptococcus pneumoniae R6
ccauucccaucaauauc

SEQ ID NO: 4098847 - RNA, 16 nt, Streptococcus pneumoniae R6
ccauuccucccauauu

SEQ ID NO: 4098848 - RNA, 20 nt, Streptococcus pneumoniae R6
ccauuccucccauauuuggc

SEQ ID NO: 4098849 - RNA, 14 nt, Streptococcus pneumoniae R6
ccauucgcagucac

SEQ ID NO: 4098850 - RNA, 18 nt, Streptococcus pneumoniae R6
ccauucuucuuuuccaaa

SEQ ID NO: 4098851 - RNA, 13 nt, Streptococcus pneumoniae R6
ccauugacagauu

SEQ ID NO: 4098852 - RNA, 22 nt, Streptococcus pneumoniae R6
ccauugguguuugguugaccag

SEQ ID NO: 4098853 - RNA, 22 nt, Streptococcus pneumoniae R6
ccauugucaugucauguuagaa

SEQ ID NO: 4098854 - RNA, 13 nt, Streptococcus pneumoniae R6
ccauuuauauaaa

SEQ ID NO: 4098855 - RNA, 19 nt, Streptococcus pneumoniae R6
ccauuuauggaaaaaauga

SEQ ID NO: 4098856 - RNA, 14 nt, Streptococcus pneumoniae R6
ccauuucuuuucug

SEQ ID NO: 4098857 - RNA, 12 nt, Streptococcus pneumoniae R6
ccauuuuaaagg

SEQ ID NO: 4098858 - RNA, 21 nt, Streptococcus pneumoniae R6
ccauuuuaaaggucaauuccu

SEQ ID NO: 4098859 - RNA, 19 nt, Streptococcus pneumoniae R6
ccauuuucagaaagaaggg

SEQ ID NO: 4098860 - RNA, 20 nt, Streptococcus pneumoniae R6
ccauuuucagcccagagcuu

SEQ ID NO: 4098861 - RNA, 12 nt, Streptococcus pneumoniae R6
ccauuuuuuaaa

SEQ ID NO: 4098862 - RNA, 19 nt, Streptococcus pneumoniae R6
ccauuuuuugcaucaacua

SEQ ID NO: 4098863 - RNA, 12 nt, Streptococcus pneumoniae R6
cccaaaaaaguu

SEQ ID NO: 4098864 - RNA, 22 nt, Streptococcus pneumoniae R6
cccaaaagauagaugauuuagu

SEQ ID NO: 4098865 - RNA, 20 nt, Streptococcus pneumoniae R6
cccaaaaguuagauuuuuuc

SEQ ID NO: 4098866 - RNA, 16 nt, Streptococcus pneumoniae R6
cccaaaaugagggucc

SEQ ID NO: 4098867 - RNA, 13 nt, Streptococcus pneumoniae R6
cccaaacaaaaaa

SEQ ID NO: 4098868 - RNA, 23 nt, Streptococcus pneumoniae R6
cccaaacaagccuuuaucugccc

SEQ ID NO: 4098869 - RNA, 22 nt, Streptococcus pneumoniae R6
cccaaagaauccaucugauaaa

SEQ ID NO: 4098870 - RNA, 12 nt, Streptococcus pneumoniae R6
cccaaaucauca

SEQ ID NO: 4098871 - RNA, 12 nt, Streptococcus pneumoniae R6
cccaaccacuuc

SEQ ID NO: 4098872 - RNA, 16 nt, Streptococcus pneumoniae R6
cccaacuuacauuuga

SEQ ID NO: 4098873 - RNA, 15 nt, Streptococcus pneumoniae R6
cccaagcccugcaaa

SEQ ID NO: 4098874 - RNA, 17 nt, Streptococcus pneumoniae R6
cccaaguuaaaaaacuu

SEQ ID NO: 4098875 - RNA, 17 nt, Streptococcus pneumoniae R6
cccaauaacgaagucua

SEQ ID NO: 4098876 - RNA, 19 nt, Streptococcus pneumoniae R6
cccaaucgauuuguucuca

SEQ ID NO: 4098877 - RNA, 13 nt, Streptococcus pneumoniae R6
cccaccucauucc

SEQ ID NO: 4098878 - RNA, 21 nt, Streptococcus pneumoniae R6
cccacggauuaagaguccgcu

SEQ ID NO: 4098879 - RNA, 14 nt, Streptococcus pneumoniae R6
cccacuaaaaauau

SEQ ID NO: 4098880 - RNA, 20 nt, Streptococcus pneumoniae R6
cccacuacacuugacaaaga

SEQ ID NO: 4098881 - RNA, 22 nt, Streptococcus pneumoniae R6
cccacuacaguugacaaagagc

SEQ ID NO: 4098882 - RNA, 23 nt, Streptococcus pneumoniae R6
cccacugcgaagagggcaaggau

SEQ ID NO: 4098883 - RNA, 21 nt, Streptococcus pneumoniae R6
cccagacuuuuuuauacuuuu

SEQ ID NO: 4098884 - RNA, 14 nt, Streptococcus pneumoniae R6
cccagcauggucag

SEQ ID NO: 4098885 - RNA, 18 nt, Streptococcus pneumoniae R6
cccagcauggucaggcua

SEQ ID NO: 4098886 - RNA, 20 nt, Streptococcus pneumoniae R6
cccagccaacaacugauucu

SEQ ID NO: 4098887 - RNA, 19 nt, Streptococcus pneumoniae R6
cccaguacuagacaauuuu

SEQ ID NO: 4098888 - RNA, 21 nt, Streptococcus pneumoniae R6
cccauaaaaauugacauggaa

SEQ ID NO: 4098889 - RNA, 24 nt, Streptococcus pneumoniae R6
cccauaaaaauugacauggaaauu

SEQ ID NO: 4098890 - RNA, 13 nt, Streptococcus pneumoniae R6
cccauaaaacuau

SEQ ID NO: 4098891 - RNA, 15 nt, Streptococcus pneumoniae R6
cccauagauuuuuau

SEQ ID NO: 4098892 - RNA, 22 nt, Streptococcus pneumoniae R6
cccauagauuuuuauuauuucc

SEQ ID NO: 4098893 - RNA, 20 nt, Streptococcus pneumoniae R6
cccauauuuggcauauuuuu

SEQ ID NO: 4098894 - RNA, 17 nt, Streptococcus pneumoniae R6
cccaucaauacccccuu

SEQ ID NO: 4098895 - RNA, 14 nt, Streptococcus pneumoniae R6
cccaucauuccuga

SEQ ID NO: 4098896 - RNA, 20 nt, Streptococcus pneumoniae R6
cccaucauuucuucaacaaa

SEQ ID NO: 4098897 - RNA, 23 nt, Streptococcus pneumoniae R6
cccaucgcgaccaagagcaaaaa

SEQ ID NO: 4098898 - RNA, 19 nt, Streptococcus pneumoniae R6
cccaucguuccguucuuau

SEQ ID NO: 4098899 - RNA, 14 nt, Streptococcus pneumoniae R6
cccaucucgugaau

SEQ ID NO: 4098900 - RNA, 14 nt, Streptococcus pneumoniae R6
cccaucugucuuua

SEQ ID NO: 4098901 - RNA, 18 nt, Streptococcus pneumoniae R6
cccaucugucuuuauuaa

SEQ ID NO: 4098902 - RNA, 16 nt, Streptococcus pneumoniae R6
cccaucuuuagcucca

SEQ ID NO: 4098903 - RNA, 19 nt, Streptococcus pneumoniae R6
cccaugucaauucucacuu

SEQ ID NO: 4098904 - RNA, 21 nt, Streptococcus pneumoniae R6
cccaugucaauucucacuuga

SEQ ID NO: 4098905 - RNA, 18 nt, Streptococcus pneumoniae R6
cccauuuauggaaaaaau

SEQ ID NO: 4098906 - RNA, 14 nt, Streptococcus pneumoniae R6
cccauuucuucagu

SEQ ID NO: 4098907 - RNA, 19 nt, Streptococcus pneumoniae R6
ccccaagaaugggcuccca

SEQ ID NO: 4098908 - RNA, 16 nt, Streptococcus pneumoniae R6
ccccaugaguuuucaa

SEQ ID NO: 4098909 - RNA, 16 nt, Streptococcus pneumoniae R6
ccccauuuaccaagcu

SEQ ID NO: 4098910 - RNA, 21 nt, Streptococcus pneumoniae R6
ccccauuuguaugagaggcaa

SEQ ID NO: 4098911 - RNA, 20 nt, Streptococcus pneumoniae R6
cccccaagaaugggcuccca

SEQ ID NO: 4098912 - RNA, 18 nt, Streptococcus pneumoniae R6
ccccuuaaaaccauguuu

SEQ ID NO: 4098913 - RNA, 14 nt, Streptococcus pneumoniae R6
ccccuucuugauuu

SEQ ID NO: 4098914 - RNA, 18 nt, Streptococcus pneumoniae R6
ccccuucuugauuucguu

SEQ ID NO: 4098915 - RNA, 16 nt, Streptococcus pneumoniae R6
ccuaugauacccaaaa

SEQ ID NO: 4098916 - RNA, 19 nt, Streptococcus pneumoniae R6
ccuaugauuaaucaaauga

SEQ ID NO: 4098917 - RNA, 12 nt, Streptococcus pneumoniae R6
ccuauuccuuuu

SEQ ID NO: 4098918 - RNA, 16 nt, Streptococcus pneumoniae R6
ccuauuuauuacuuca

SEQ ID NO: 4098919 - RNA, 19 nt, Streptococcus pneumoniae R6
ccuauuuuuuauuucaaau

SEQ ID NO: 4098920 - RNA, 12 nt, Streptococcus pneumoniae R6
ccucaaaaacag

SEQ ID NO: 4098921 - RNA, 15 nt, Streptococcus pneumoniae R6
ccucaaaaacauguu

SEQ ID NO: 4098922 - RNA, 16 nt, Streptococcus pneumoniae R6
ccucaaaacaguguuu

SEQ ID NO: 4098923 - RNA, 13 nt, Streptococcus pneumoniae R6
ccucaaaaugaaa

SEQ ID NO: 4098924 - RNA, 14 nt, Streptococcus pneumoniae R6
ccucaaaauucugu

SEQ ID NO: 4098925 - RNA, 13 nt, Streptococcus pneumoniae R6
ccucaagaagugg

SEQ ID NO: 4098926 - RNA, 12 nt, Streptococcus pneumoniae R6
ccucaauaagcc

SEQ ID NO: 4098927 - RNA, 22 nt, Streptococcus pneumoniae R6
ccucagcaaaggacuaugauca

SEQ ID NO: 4098928 - RNA, 19 nt, Streptococcus pneumoniae R6
ccucagccaguucagcaua

SEQ ID NO: 4098929 - RNA, 16 nt, Streptococcus pneumoniae R6
ccucauuucaauagaa

SEQ ID NO: 4098930 - RNA, 13 nt, Streptococcus pneumoniae R6
ccucauuuucuag

SEQ ID NO: 4098931 - RNA, 19 nt, Streptococcus pneumoniae R6
ccuccaccuugaucuucca

SEQ ID NO: 4098932 - RNA, 22 nt, Streptococcus pneumoniae R6
ccuccagagaagccaccgccag

SEQ ID NO: 4098933 - RNA, 23 nt, Streptococcus pneumoniae R6
ccuccagagaagccaccgccaga

SEQ ID NO: 4098934 - RNA, 18 nt, Streptococcus pneumoniae R6
ccuccauaaacgcaagca

SEQ ID NO: 4098935 - RNA, 20 nt, Streptococcus pneumoniae R6
ccucccacuaucuaaaaaaa

SEQ ID NO: 4098936 - RNA, 14 nt, Streptococcus pneumoniae R6
ccucccauuuugug

SEQ ID NO: 4098937 - RNA, 20 nt, Streptococcus pneumoniae R6
ccuccgagaaguaccgccaa

SEQ ID NO: 4098938 - RNA, 17 nt, Streptococcus pneumoniae R6
ccuccgauaauuauuuu

SEQ ID NO: 4098939 - RNA, 23 nt, Streptococcus pneumoniae R6
ccuccguaccaacacauucaagu

SEQ ID NO: 4098940 - RNA, 12 nt, Streptococcus pneumoniae R6
ccuccuaguuug

SEQ ID NO: 4098941 - RNA, 16 nt, Streptococcus pneumoniae R6
ccuccuucuccaaucc

SEQ ID NO: 4098942 - RNA, 21 nt, Streptococcus pneumoniae R6
ccucgagcaguuccaucaauc

SEQ ID NO: 4098943 - RNA, 16 nt, Streptococcus pneumoniae R6
ccucgauaccuguuaa

SEQ ID NO: 4098944 - RNA, 16 nt, Streptococcus pneumoniae R6
ccucggauuuuauccg

SEQ ID NO: 4098945 - RNA, 13 nt, Streptococcus pneumoniae R6
ccucggcauuccc

SEQ ID NO: 4098946 - RNA, 16 nt, Streptococcus pneumoniae R6
ccucuaaauacaaaaa

SEQ ID NO: 4098947 - RNA, 18 nt, Streptococcus pneumoniae R6
ccucuacaauaacacccu

SEQ ID NO: 4098948 - RNA, 22 nt, Streptococcus pneumoniae R6
ccucuacaccauaaauauuugc

SEQ ID NO: 4098949 - RNA, 22 nt, Streptococcus pneumoniae R6
ccucuacauacccaugcuuuuc

SEQ ID NO: 4098950 - RNA, 18 nt, Streptococcus pneumoniae R6
ccucucuucaaauuugac

SEQ ID NO: 4098951 - RNA, 21 nt, Streptococcus pneumoniae R6
ccucugguaugaucuauuccu

SEQ ID NO: 4098952 - RNA, 21 nt, Streptococcus pneumoniae R6
ccucuucacugugacuagcaa

SEQ ID NO: 4098953 - RNA, 16 nt, Streptococcus pneumoniae R6
ccucuucauucaaaga

SEQ ID NO: 4098954 - RNA, 22 nt, Streptococcus pneumoniae R6
ccucuucuuugauggaguuuuc

SEQ ID NO: 4098955 - RNA, 13 nt, Streptococcus pneumoniae R6
ccucuuuuuacaa

SEQ ID NO: 4098956 - RNA, 13 nt, Streptococcus pneumoniae R6
ccucuuuuucccc

SEQ ID NO: 4098957 - RNA, 17 nt, Streptococcus pneumoniae R6
ccugaaaaucaucugca

SEQ ID NO: 4098958 - RNA, 22 nt, Streptococcus pneumoniae R6
ccugaaaccauuagauuucagg

SEQ ID NO: 4098959 - RNA, 14 nt, Streptococcus pneumoniae R6
ccugaaagugagaa

SEQ ID NO: 4098960 - RNA, 23 nt, Streptococcus pneumoniae R6
ccugaaauauacucauaaagucu

SEQ ID NO: 4098961 - RNA, 18 nt, Streptococcus pneumoniae R6
ccugaaugaauugccuga

SEQ ID NO: 4098962 - RNA, 15 nt, Streptococcus pneumoniae R6
ccugaaugauuucuu

SEQ ID NO: 4098963 - RNA, 22 nt, Streptococcus pneumoniae R6
ccugaauuagcaaucacucuaa

SEQ ID NO: 4098964 - RNA, 21 nt, Streptococcus pneumoniae R6
ccugacaauuuaaccaaacca

SEQ ID NO: 4098965 - RNA, 21 nt, Streptococcus pneumoniae R6
ccugacauucuuuagcuuuca

SEQ ID NO: 4098966 - RNA, 16 nt, Streptococcus pneumoniae R6
ccugaguguaaacuga

SEQ ID NO: 4098967 - RNA, 14 nt, Streptococcus pneumoniae R6
ccugauaaaagaua

SEQ ID NO: 4098968 - RNA, 21 nt, Streptococcus pneumoniae R6
ccugauaacgaagagcuggcu

SEQ ID NO: 4098969 - RNA, 17 nt, Streptococcus pneumoniae R6
ccugauaagauuuuugg

SEQ ID NO: 4098970 - RNA, 18 nt, Streptococcus pneumoniae R6
ccugauacuaugcuuuuu

SEQ ID NO: 4098971 - RNA, 22 nt, Streptococcus pneumoniae R6
ccugauacuaugcuuuuuucua

SEQ ID NO: 4098972 - RNA, 23 nt, Streptococcus pneumoniae R6
ccugauaggaugccuuuuuauga

SEQ ID NO: 4098973 - RNA, 12 nt, Streptococcus pneumoniae R6
ccugaucaaagg

SEQ ID NO: 4098974 - RNA, 13 nt, Streptococcus pneumoniae R6
ccugaucgauuug

SEQ ID NO: 4098975 - RNA, 22 nt, Streptococcus pneumoniae R6
ccugaucgauuuguccuguucu

SEQ ID NO: 4098976 - RNA, 14 nt, Streptococcus pneumoniae R6
ccugcaaaacuaga

SEQ ID NO: 4098977 - RNA, 20 nt, Streptococcus pneumoniae R6
ccugcaaaacuagaauccua

SEQ ID NO: 4098978 - RNA, 13 nt, Streptococcus pneumoniae R6
ccugcaaucauug

SEQ ID NO: 4098979 - RNA, 14 nt, Streptococcus pneumoniae R6
ccugcauacguuca

SEQ ID NO: 4098980 - RNA, 14 nt, Streptococcus pneumoniae R6
ccugcaugagcugu

SEQ ID NO: 4098981 - RNA, 18 nt, Streptococcus pneumoniae R6
ccugccucgauaccuggg

SEQ ID NO: 4098982 - RNA, 14 nt, Streptococcus pneumoniae R6
ccugccugaucuug

SEQ ID NO: 4098983 - RNA, 22 nt, Streptococcus pneumoniae R6
ccugcuaccguugaaaucaaua

SEQ ID NO: 4098984 - RNA, 22 nt, Streptococcus pneumoniae R6
ccugcuccaaauauugcucaua

SEQ ID NO: 4098985 - RNA, 12 nt, Streptococcus pneumoniae R6
ccugcugcuaag

SEQ ID NO: 4098986 - RNA, 17 nt, Streptococcus pneumoniae R6
ccugcugcuaaggauuu

SEQ ID NO: 4098987 - RNA, 18 nt, Streptococcus pneumoniae R6
ccugcuuuuucaagcauu

SEQ ID NO: 4098988 - RNA, 20 nt, Streptococcus pneumoniae R6
ccuggaaucagaacacuucc

SEQ ID NO: 4098989 - RNA, 21 nt, Streptococcus pneumoniae R6
ccuggcauaagucauaacauu

SEQ ID NO: 4098990 - RNA, 15 nt, Streptococcus pneumoniae R6
ccugggaaauuccag

SEQ ID NO: 4098991 - RNA, 14 nt, Streptococcus pneumoniae R6
ccugggaagaugaa

SEQ ID NO: 4098992 - RNA, 12 nt, Streptococcus pneumoniae R6
ccugggacaucu

SEQ ID NO: 4098993 - RNA, 21 nt, Streptococcus pneumoniae R6
ccuguaaaaagugaaaggaag

SEQ ID NO: 4098994 - RNA, 20 nt, Streptococcus pneumoniae R6
ccuguaagaacuuuuuaaag

SEQ ID NO: 4098995 - RNA, 20 nt, Streptococcus pneumoniae R6
ccuguagggggcauauaaau

SEQ ID NO: 4098996 - RNA, 23 nt, Streptococcus pneumoniae R6
ccuguagggggcauauaaauaca

SEQ ID NO: 4098997 - RNA, 20 nt, Streptococcus pneumoniae R6
ccugucuuuagcuugcaaug

SEQ ID NO: 4098998 - RNA, 23 nt, Streptococcus pneumoniae R6
ccugucuuuagcuugcaaugagc

SEQ ID NO: 4098999 - RNA, 12 nt, Streptococcus pneumoniae R6
ccugugcuccau

SEQ ID NO: 4099000 - RNA, 17 nt, Streptococcus pneumoniae R6
ccuguuccucaaaagga

SEQ ID NO: 4099001 - RNA, 21 nt, Streptococcus pneumoniae R6
ccuguucuaagguuucaaaac

SEQ ID NO: 4099002 - RNA, 21 nt, Streptococcus pneumoniae R6
ccuguucuauagcagccuccg

SEQ ID NO: 4099003 - RNA, 22 nt, Streptococcus pneumoniae R6
ccuguucuauagcagccuccgu

SEQ ID NO: 4099004 - RNA, 23 nt, Streptococcus pneumoniae R6
ccuguucuauagcagccuccgua

SEQ ID NO: 4099005 - RNA, 13 nt, Streptococcus pneumoniae R6
ccuguucuuauuu

SEQ ID NO: 4099006 - RNA, 17 nt, Streptococcus pneumoniae R6
ccuguucuuguuucaau

SEQ ID NO: 4099007 - RNA, 12 nt, Streptococcus pneumoniae R6
ccuguuguauuu

SEQ ID NO: 4099008 - RNA, 19 nt, Streptococcus pneumoniae R6
ccuguuguauuuauaugcc

SEQ ID NO: 4099009 - RNA, 18 nt, Streptococcus pneumoniae R6
ccuguuugaaucaauucu

SEQ ID NO: 4099010 - RNA, 22 nt, Streptococcus pneumoniae R6
ccuguuugaaucaauucuucac

SEQ ID NO: 4099011 - RNA, 14 nt, Streptococcus pneumoniae R6
ccuguuuggucaga

SEQ ID NO: 4099012 - RNA, 16 nt, Streptococcus pneumoniae R6
ccuguuuggucagacu

SEQ ID NO: 4099013 - RNA, 14 nt, Streptococcus pneumoniae R6
ccuguuuucacauu

SEQ ID NO: 4099014 - RNA, 10 nt, Streptococcus pneumoniae R6
ccuuaaaaaa

SEQ ID NO: 4099015 - RNA, 18 nt, Streptococcus pneumoniae R6
ccuuaaaacaguguuuug

SEQ ID NO: 4099016 - RNA, 11 nt, Streptococcus pneumoniae R6
ccuuaaaacca

SEQ ID NO: 4099017 - RNA, 21 nt, Streptococcus pneumoniae R6
cgcaacacacuguuuugaggu

SEQ ID NO: 4099018 - RNA, 16 nt, Streptococcus pneumoniae R6
cgcaagcaacaaaaac

SEQ ID NO: 4099019 - RNA, 18 nt, Streptococcus pneumoniae R6
cgcaagcagcuaaaagca

SEQ ID NO: 4099020 - RNA, 22 nt, Streptococcus pneumoniae R6
cgcaagguuguuagauuaugua

SEQ ID NO: 4099021 - RNA, 14 nt, Streptococcus pneumoniae R6
cgcaaguuuuuccc

SEQ ID NO: 4099022 - RNA, 13 nt, Streptococcus pneumoniae R6
cgcaauuccugcc

SEQ ID NO: 4099023 - RNA, 16 nt, Streptococcus pneumoniae R6
cgcaauuuaauacucu

SEQ ID NO: 4099024 - RNA, 24 nt, Streptococcus pneumoniae R6
cgcacaaacuucaucccaguggcu

SEQ ID NO: 4099025 - RNA, 14 nt, Streptococcus pneumoniae R6
cgcacaccuuacag

SEQ ID NO: 4099026 - RNA, 14 nt, Streptococcus pneumoniae R6
cgcacgaagggcuu

SEQ ID NO: 4099027 - RNA, 16 nt, Streptococcus pneumoniae R6
cgcaggacuaaaucca

SEQ ID NO: 4099028 - RNA, 18 nt, Streptococcus pneumoniae R6
cgcauaagcaauuuuuua

SEQ ID NO: 4099029 - RNA, 19 nt, Streptococcus pneumoniae R6
cgcauacuaauagcaccaa

SEQ ID NO: 4099030 - RNA, 21 nt, Streptococcus pneumoniae R6
cgcauacuuggugcccaaaua

SEQ ID NO: 4099031 - RNA, 14 nt, Streptococcus pneumoniae R6
cgcaucaacauggu

SEQ ID NO: 4099032 - RNA, 16 nt, Streptococcus pneumoniae R6
cgcaucuuauuucaau

SEQ ID NO: 4099033 - RNA, 16 nt, Streptococcus pneumoniae R6
cgcaugauaucaaacu

SEQ ID NO: 4099034 - RNA, 12 nt, Streptococcus pneumoniae R6
cgcauuuuccuu

SEQ ID NO: 4099035 - RNA, 22 nt, Streptococcus pneumoniae R6
cgccaguugcugcguuaaaucc

SEQ ID NO: 4099036 - RNA, 22 nt, Streptococcus pneumoniae R6
cgcccaaacauagugaccugga

SEQ ID NO: 4099037 - RNA, 12 nt, Streptococcus pneumoniae R6
cgcccugucuuu

SEQ ID NO: 4099038 - RNA, 13 nt, Streptococcus pneumoniae R6
cgcccugucuuua

SEQ ID NO: 4099039 - RNA, 21 nt, Streptococcus pneumoniae R6
cgcccugucuuuagcuugcaa

SEQ ID NO: 4099040 - RNA, 17 nt, Streptococcus pneumoniae R6
cgcccuuguucuccaaa

SEQ ID NO: 4099041 - RNA, 17 nt, Streptococcus pneumoniae R6
cgccugcggcugcagcu

SEQ ID NO: 4099042 - RNA, 19 nt, Streptococcus pneumoniae R6
cgccugcucaccaucuucc

SEQ ID NO: 4099043 - RNA, 22 nt, Streptococcus pneumoniae R6
cgccuguaugggcaucaacagc

SEQ ID NO: 4099044 - RNA, 15 nt, Streptococcus pneumoniae R6
cgcgaaacggcagcu

SEQ ID NO: 4099045 - RNA, 12 nt, Streptococcus pneumoniae R6
cgcgaccuggau

SEQ ID NO: 4099046 - RNA, 18 nt, Streptococcus pneumoniae R6
cgcgauugauuuccaaaa

SEQ ID NO: 4099047 - RNA, 11 nt, Streptococcus pneumoniae R6
cgcguucugca

SEQ ID NO: 4099048 - RNA, 14 nt, Streptococcus pneumoniae R6
cgcuaccauuaucu

SEQ ID NO: 4099049 - RNA, 22 nt, Streptococcus pneumoniae R6
cgcuaucucuaggaauaucaaa

SEQ ID NO: 4099050 - RNA, 12 nt, Streptococcus pneumoniae R6
cgcuauuuaaac

SEQ ID NO: 4099051 - RNA, 13 nt, Streptococcus pneumoniae R6
cgcuccacuuccc

SEQ ID NO: 4099052 - RNA, 13 nt, Streptococcus pneumoniae R6
cgcucuucaaucu

SEQ ID NO: 4099053 - RNA, 11 nt, Streptococcus pneumoniae R6
cgcuggcauuu

SEQ ID NO: 4099054 - RNA, 19 nt, Streptococcus pneumoniae R6
cgcuucagcgauuucuuca

SEQ ID NO: 4099055 - RNA, 19 nt, Streptococcus pneumoniae R6
cgcuucguagucgccaucu

SEQ ID NO: 4099056 - RNA, 21 nt, Streptococcus pneumoniae R6
cgcuugaaugauaaaacauac

SEQ ID NO: 4099057 - RNA, 23 nt, Streptococcus pneumoniae R6
cgcuugaaugauaaaacauacug

SEQ ID NO: 4099058 - RNA, 14 nt, Streptococcus pneumoniae R6
cgcuugggaaacca

SEQ ID NO: 4099059 - RNA, 16 nt, Streptococcus pneumoniae R6
cgcuuguccugaauga

SEQ ID NO: 4099060 - RNA, 17 nt, Streptococcus pneumoniae R6
cgcuuguccugaaugau

SEQ ID NO: 4099061 - RNA, 12 nt, Streptococcus pneumoniae R6
cgcuuucuaagg

SEQ ID NO: 4099062 - RNA, 13 nt, Streptococcus pneumoniae R6
cggaacaucuuuu

SEQ ID NO: 4099063 - RNA, 15 nt, Streptococcus pneumoniae R6
cggaauagcucaaaa

SEQ ID NO: 4099064 - RNA, 22 nt, Streptococcus pneumoniae R6
cggacgauuaaaaguaagagaa

SEQ ID NO: 4099065 - RNA, 12 nt, Streptococcus pneumoniae R6
cggacuauuuua

SEQ ID NO: 4099066 - RNA, 23 nt, Streptococcus pneumoniae R6
cggagaaagaauccaauucaaag

SEQ ID NO: 4099067 - RNA, 13 nt, Streptococcus pneumoniae R6
cggagaagaaaac

SEQ ID NO: 4099068 - RNA, 23 nt, Streptococcus pneumoniae R6
cggagacggacuagaaugcuuuu

SEQ ID NO: 4099069 - RNA, 16 nt, Streptococcus pneumoniae R6
cggagauaguaccauu

SEQ ID NO: 4099070 - RNA, 10 nt, Streptococcus pneumoniae R6
cggagaugga

SEQ ID NO: 4099071 - RNA, 12 nt, Streptococcus pneumoniae R6
cggauaaaagag

SEQ ID NO: 4099072 - RNA, 21 nt, Streptococcus pneumoniae R6
cggauaaaccaccagagugga

SEQ ID NO: 4099073 - RNA, 12 nt, Streptococcus pneumoniae R6
cggcaggcuggu

SEQ ID NO: 4099074 - RNA, 17 nt, Streptococcus pneumoniae R6
cggcaguuuuuucuuuc

SEQ ID NO: 4099075 - RNA, 13 nt, Streptococcus pneumoniae R6
cggcauugaggac

SEQ ID NO: 4099076 - RNA, 23 nt, Streptococcus pneumoniae R6
cggcauuguuggcaaccaagucu

SEQ ID NO: 4099077 - RNA, 16 nt, Streptococcus pneumoniae R6
cggccaauucuucuuc

SEQ ID NO: 4099078 - RNA, 14 nt, Streptococcus pneumoniae R6
cggccguugauuua

SEQ ID NO: 4099079 - RNA, 12 nt, Streptococcus pneumoniae R6
cggccuucuuuu

SEQ ID NO: 4099080 - RNA, 17 nt, Streptococcus pneumoniae R6
cggcggaaacaaaauua

SEQ ID NO: 4099081 - RNA, 17 nt, Streptococcus pneumoniae R6
cggcucuuugucaacug

SEQ ID NO: 4099082 - RNA, 18 nt, Streptococcus pneumoniae R6
cggcugguuaaaggcugc

SEQ ID NO: 4099083 - RNA, 19 nt, Streptococcus pneumoniae R6
cggcugguuaaaggcugcg

SEQ ID NO: 4099084 - RNA, 21 nt, Streptococcus pneumoniae R6
cggcuucaucuggauuuucag

SEQ ID NO: 4099085 - RNA, 12 nt, Streptococcus pneumoniae R6
cggcuuucacaa

SEQ ID NO: 4099086 - RNA, 13 nt, Streptococcus pneumoniae R6
cggcuuucaguuu

SEQ ID NO: 4099087 - RNA, 12 nt, Streptococcus pneumoniae R6
cgggauaaaaua

SEQ ID NO: 4099088 - RNA, 17 nt, Streptococcus pneumoniae R6
cgggcaaauuucaugac

SEQ ID NO: 4099089 - RNA, 15 nt, Streptococcus pneumoniae R6
cgggcaauuggaacg

SEQ ID NO: 4099090 - RNA, 15 nt, Streptococcus pneumoniae R6
cgggcugacaaccac

SEQ ID NO: 4099091 - RNA, 19 nt, Streptococcus pneumoniae R6
cgguaagaaagcaacuaaa

SEQ ID NO: 4099092 - RNA, 18 nt, Streptococcus pneumoniae R6
cgguaucuugaauauuuu

SEQ ID NO: 4099093 - RNA, 20 nt, Streptococcus pneumoniae R6
cggucaaucgcuuaauuucu

SEQ ID NO: 4099094 - RNA, 19 nt, Streptococcus pneumoniae R6
cggucaccgacaacuucaa

SEQ ID NO: 4099095 - RNA, 16 nt, Streptococcus pneumoniae R6
cggucgccguuuacgu

SEQ ID NO: 4099096 - RNA, 20 nt, Streptococcus pneumoniae R6
cgguuugaagagauuuuuga

SEQ ID NO: 4099097 - RNA, 12 nt, Streptococcus pneumoniae R6
cgguuuguauug

SEQ ID NO: 4099098 - RNA, 20 nt, Streptococcus pneumoniae R6
cguaaaaaagucuugacaaa

SEQ ID NO: 4099099 - RNA, 13 nt, Streptococcus pneumoniae R6
cguaaauugcccu

SEQ ID NO: 4099100 - RNA, 14 nt, Streptococcus pneumoniae R6
cguaaccaaaucag

SEQ ID NO: 4099101 - RNA, 19 nt, Streptococcus pneumoniae R6
cguaacugguaagaaguaa

SEQ ID NO: 4099102 - RNA, 15 nt, Streptococcus pneumoniae R6
cguaacuuguaacua

SEQ ID NO: 4099103 - RNA, 20 nt, Streptococcus pneumoniae R6
cguaaucauaagcaacuuua

SEQ ID NO: 4099104 - RNA, 18 nt, Streptococcus pneumoniae R6
cguacagaaacguccaag

SEQ ID NO: 4099105 - RNA, 12 nt, Streptococcus pneumoniae R6
cguaguaaaccu

SEQ ID NO: 4099106 - RNA, 19 nt, Streptococcus pneumoniae R6
cguauucagucaucucugg

SEQ ID NO: 4099107 - RNA, 17 nt, Streptococcus pneumoniae R6
cguauuccauuggaagu

SEQ ID NO: 4099108 - RNA, 15 nt, Streptococcus pneumoniae R6
cgucaagaagagcuu

SEQ ID NO: 4099109 - RNA, 12 nt, Streptococcus pneumoniae R6
cgucacaaagaa

SEQ ID NO: 4099110 - RNA, 23 nt, Streptococcus pneumoniae R6
cgucacgacgcaguucuucauac

SEQ ID NO: 4099111 - RNA, 22 nt, Streptococcus pneumoniae R6
cgucaguuccauccacaaccuu

SEQ ID NO: 4099112 - RNA, 11 nt, Streptococcus pneumoniae R6
cgucaguucua

SEQ ID NO: 4099113 - RNA, 16 nt, Streptococcus pneumoniae R6
cgucaguucuaucugc

SEQ ID NO: 4099114 - RNA, 17 nt, Streptococcus pneumoniae R6
cgucaucgucucuucgu

SEQ ID NO: 4099115 - RNA, 13 nt, Streptococcus pneumoniae R6
cgucauuuaaaga

SEQ ID NO: 4099116 - RNA, 14 nt, Streptococcus pneumoniae R6
cguccaccacaaaa

SEQ ID NO: 4099117 - RNA, 22 nt, Streptococcus pneumoniae R6
cguccaccacaaaagagaaaga

SEQ ID NO: 4099118 - RNA, 16 nt, Streptococcus pneumoniae R6
cguccagcagcuaaga

SEQ ID NO: 4099119 - RNA, 15 nt, Streptococcus pneumoniae R6
cguccagccuugucu

SEQ ID NO: 4099120 - RNA, 17 nt, Streptococcus pneumoniae R6
cguccgagugcaagagc

SEQ ID NO: 4099121 - RNA, 15 nt, Streptococcus pneumoniae R6
cuaaauuccaaauua

SEQ ID NO: 4099122 - RNA, 19 nt, Streptococcus pneumoniae R6
cuaaauuccaaauuagaaa

SEQ ID NO: 4099123 - RNA, 15 nt, Streptococcus pneumoniae R6
cuaaauuuaacauua

SEQ ID NO: 4099124 - RNA, 18 nt, Streptococcus pneumoniae R6
cuaacaagucuuaaaauc

SEQ ID NO: 4099125 - RNA, 15 nt, Streptococcus pneumoniae R6
cuaacaaugcuuuag

SEQ ID NO: 4099126 - RNA, 14 nt, Streptococcus pneumoniae R6
cuaacacuugcuag

SEQ ID NO: 4099127 - RNA, 15 nt, Streptococcus pneumoniae R6
cuaacccuagaaaac

SEQ ID NO: 4099128 - RNA, 17 nt, Streptococcus pneumoniae R6
cuaacccuagaaaacca

SEQ ID NO: 4099129 - RNA, 16 nt, Streptococcus pneumoniae R6
cuaacccuucuuuuua

SEQ ID NO: 4099130 - RNA, 12 nt, Streptococcus pneumoniae R6
cuaacugcugga

SEQ ID NO: 4099131 - RNA, 14 nt, Streptococcus pneumoniae R6
cuaacugcuucacu

SEQ ID NO: 4099132 - RNA, 16 nt, Streptococcus pneumoniae R6
cuaacuggaaagauaa

SEQ ID NO: 4099133 - RNA, 17 nt, Streptococcus pneumoniae R6
cuaacuguuugggggca

SEQ ID NO: 4099134 - RNA, 22 nt, Streptococcus pneumoniae R6
cuaacuuaaaagcucgauacuc

SEQ ID NO: 4099135 - RNA, 16 nt, Streptococcus pneumoniae R6
cuaacuucaauagacu

SEQ ID NO: 4099136 - RNA, 20 nt, Streptococcus pneumoniae R6
cuaacuucugcuaauugagc

SEQ ID NO: 4099137 - RNA, 23 nt, Streptococcus pneumoniae R6
cuaacuucugcuaauugagcgcc

SEQ ID NO: 4099138 - RNA, 14 nt, Streptococcus pneumoniae R6
cuaacuuuuccuua

SEQ ID NO: 4099139 - RNA, 13 nt, Streptococcus pneumoniae R6
cuaacuuuuuugg

SEQ ID NO: 4099140 - RNA, 17 nt, Streptococcus pneumoniae R6
cuaagaagacugaaaau

SEQ ID NO: 4099141 - RNA, 13 nt, Streptococcus pneumoniae R6
cuaagacaaccaa

SEQ ID NO: 4099142 - RNA, 17 nt, Streptococcus pneumoniae R6
cuaagaguauaaaaccu

SEQ ID NO: 4099143 - RNA, 21 nt, Streptococcus pneumoniae R6
cuaagaguauaaaaccuugaa

SEQ ID NO: 4099144 - RNA, 23 nt, Streptococcus pneumoniae R6
cuaagauauuaagaaucuuuucu

SEQ ID NO: 4099145 - RNA, 21 nt, Streptococcus pneumoniae R6
cuaagauauuauuucaaagaa

SEQ ID NO: 4099146 - RNA, 16 nt, Streptococcus pneumoniae R6
cuaagaugauuuuucu

SEQ ID NO: 4099147 - RNA, 22 nt, Streptococcus pneumoniae R6
cuaagaugauuuuucuaaauuu

SEQ ID NO: 4099148 - RNA, 16 nt, Streptococcus pneumoniae R6
cuaagauguucaaucu

SEQ ID NO: 4099149 - RNA, 20 nt, Streptococcus pneumoniae R6
cuaagauuacugucauauca

SEQ ID NO: 4099150 - RNA, 16 nt, Streptococcus pneumoniae R6
cuaagcccaaagauaa

SEQ ID NO: 4099151 - RNA, 17 nt, Streptococcus pneumoniae R6
cuaagcucgagaaagga

SEQ ID NO: 4099152 - RNA, 17 nt, Streptococcus pneumoniae R6
cuaagcucgagaaaggg

SEQ ID NO: 4099153 - RNA, 18 nt, Streptococcus pneumoniae R6
cuaagcucuuaaaagcaa

SEQ ID NO: 4099154 - RNA, 14 nt, Streptococcus pneumoniae R6
cuaaggaaaaaggc

SEQ ID NO: 4099155 - RNA, 17 nt, Streptococcus pneumoniae R6
cuaaggaggcaaagaaa

SEQ ID NO: 4099156 - RNA, 23 nt, Streptococcus pneumoniae R6
cuaaggaggcaaagaaaaaagcu

SEQ ID NO: 4099157 - RNA, 20 nt, Streptococcus pneumoniae R6
cuaaggcuguuucaaaugaa

SEQ ID NO: 4099158 - RNA, 21 nt, Streptococcus pneumoniae R6
cuaagguauauucaaaauaca

SEQ ID NO: 4099159 - RNA, 23 nt, Streptococcus pneumoniae R6
cuaagguuaacgucaaaugacua

SEQ ID NO: 4099160 - RNA, 14 nt, Streptococcus pneumoniae R6
cuaagucaaauaag

SEQ ID NO: 4099161 - RNA, 17 nt, Streptococcus pneumoniae R6
cuaagucaaauaagaaa

SEQ ID NO: 4099162 - RNA, 14 nt, Streptococcus pneumoniae R6
cuaaguccaucacu

SEQ ID NO: 4099163 - RNA, 17 nt, Streptococcus pneumoniae R6
cuaaguccuuuuaguuu

SEQ ID NO: 4099164 - RNA, 22 nt, Streptococcus pneumoniae R6
cuaaguccuuuuaguuuuaccu

SEQ ID NO: 4099165 - RNA, 22 nt, Streptococcus pneumoniae R6
cuaaguccuuuuaguuuuaucu

SEQ ID NO: 4099166 - RNA, 21 nt, Streptococcus pneumoniae R6
cuaaguucacuugagcaaacu

SEQ ID NO: 4099167 - RNA, 20 nt, Streptococcus pneumoniae R6
cuaaguuccuguuguaauuu

SEQ ID NO: 4099168 - RNA, 17 nt, Streptococcus pneumoniae R6
cuaauaauacaaaaaau

SEQ ID NO: 4099169 - RNA, 18 nt, Streptococcus pneumoniae R6
cuaauaauacaaaaaaua

SEQ ID NO: 4099170 - RNA, 13 nt, Streptococcus pneumoniae R6
cuaauaauuuuaa

SEQ ID NO: 4099171 - RNA, 18 nt, Streptococcus pneumoniae R6
cuaauaauuuuaacuguc

SEQ ID NO: 4099172 - RNA, 21 nt, Streptococcus pneumoniae R6
cuaauaauuuuucauuuaaua

SEQ ID NO: 4099173 - RNA, 21 nt, Streptococcus pneumoniae R6
cuaauacccauuuauggaaaa

SEQ ID NO: 4099174 - RNA, 14 nt, Streptococcus pneumoniae R6
cuaauagacuaucu

SEQ ID NO: 4099175 - RNA, 21 nt, Streptococcus pneumoniae R6
cuaaucaaaacgcaguuucag

SEQ ID NO: 4099176 - RNA, 15 nt, Streptococcus pneumoniae R6
cuaaucauucugaac

SEQ ID NO: 4099177 - RNA, 22 nt, Streptococcus pneumoniae R6
cuaaucauucugaacuaaaaaa

SEQ ID NO: 4099178 - RNA, 22 nt, Streptococcus pneumoniae R6
cuaaucuuucugcauccaccuu

SEQ ID NO: 4099179 - RNA, 14 nt, Streptococcus pneumoniae R6
cuaaucuuugccac

SEQ ID NO: 4099180 - RNA, 13 nt, Streptococcus pneumoniae R6
cuaauguaaaaaa

SEQ ID NO: 4099181 - RNA, 20 nt, Streptococcus pneumoniae R6
cuaaugucucugcuauuucu

SEQ ID NO: 4099182 - RNA, 13 nt, Streptococcus pneumoniae R6
cuaauuaaaucau

SEQ ID NO: 4099183 - RNA, 14 nt, Streptococcus pneumoniae R6
cuaauuaaaucauc

SEQ ID NO: 4099184 - RNA, 17 nt, Streptococcus pneumoniae R6
cuaauuauguacacauu

SEQ ID NO: 4099185 - RNA, 14 nt, Streptococcus pneumoniae R6
cuaauuauuucaau

SEQ ID NO: 4099186 - RNA, 21 nt, Streptococcus pneumoniae R6
cuaauucuuugacaagguuuc

SEQ ID NO: 4099187 - RNA, 12 nt, Streptococcus pneumoniae R6
cuaauuguaaag

SEQ ID NO: 4099188 - RNA, 13 nt, Streptococcus pneumoniae R6
cuaauuuagaaau

SEQ ID NO: 4099189 - RNA, 21 nt, Streptococcus pneumoniae R6
cuaauuucaaaggcuuuuucu

SEQ ID NO: 4099190 - RNA, 23 nt, Streptococcus pneumoniae R6
cuaauuuucuaccgaucucaucu

SEQ ID NO: 4099191 - RNA, 17 nt, Streptococcus pneumoniae R6
cuacaaauguuuuagca

SEQ ID NO: 4099192 - RNA, 16 nt, Streptococcus pneumoniae R6
cuacaaccucaaaaac

SEQ ID NO: 4099193 - RNA, 17 nt, Streptococcus pneumoniae R6
cuacaaccucaaaaaca

SEQ ID NO: 4099194 - RNA, 16 nt, Streptococcus pneumoniae R6
cuacaaccucaaaaca

SEQ ID NO: 4099195 - RNA, 18 nt, Streptococcus pneumoniae R6
cuacaaccucaaaacacu

SEQ ID NO: 4099196 - RNA, 18 nt, Streptococcus pneumoniae R6
cuacaaccuuaaaacagu

SEQ ID NO: 4099197 - RNA, 18 nt, Streptococcus pneumoniae R6
cuacaacgucuuuugccu

SEQ ID NO: 4099198 - RNA, 16 nt, Streptococcus pneumoniae R6
cuacaagaacagucuc

SEQ ID NO: 4099199 - RNA, 14 nt, Streptococcus pneumoniae R6
cuacaauaacaccc

SEQ ID NO: 4099200 - RNA, 21 nt, Streptococcus pneumoniae R6
cuacaauaauugguacauuuu

SEQ ID NO: 4099201 - RNA, 20 nt, Streptococcus pneumoniae R6
cuacaaugaucaagaugaga

SEQ ID NO: 4099202 - RNA, 18 nt, Streptococcus pneumoniae R6
cuacaauucgcuauuuuu

SEQ ID NO: 4099203 - RNA, 19 nt, Streptococcus pneumoniae R6
cuacaauucgcuauuuuuu

SEQ ID NO: 4099204 - RNA, 17 nt, Streptococcus pneumoniae R6
cuacaccauaaauauuu

SEQ ID NO: 4099205 - RNA, 22 nt, Streptococcus pneumoniae R6
cuacacuugacaaagagccacu

SEQ ID NO: 4099206 - RNA, 20 nt, Streptococcus pneumoniae R6
cuacagaagguguugauuuc

SEQ ID NO: 4099207 - RNA, 14 nt, Streptococcus pneumoniae R6
cuacaguugacaaa

SEQ ID NO: 4099208 - RNA, 16 nt, Streptococcus pneumoniae R6
cuacaguugacaaaga

SEQ ID NO: 4099209 - RNA, 20 nt, Streptococcus pneumoniae R6
cuacaguugacaaagagcca

SEQ ID NO: 4099210 - RNA, 18 nt, Streptococcus pneumoniae R6
cuacauacccaugcuuuu

SEQ ID NO: 4099211 - RNA, 19 nt, Streptococcus pneumoniae R6
cuacaucauugucaaacaa

SEQ ID NO: 4099212 - RNA, 16 nt, Streptococcus pneumoniae R6
cuacauccucaaccuc

SEQ ID NO: 4099213 - RNA, 18 nt, Streptococcus pneumoniae R6
cuacauucccaaacaaaa

SEQ ID NO: 4099214 - RNA, 19 nt, Streptococcus pneumoniae R6
cuacauucccaaacaaaaa

SEQ ID NO: 4099215 - RNA, 19 nt, Streptococcus pneumoniae R6
cuacauuuuuugaaauaag

SEQ ID NO: 4099216 - RNA, 21 nt, Streptococcus pneumoniae R6
cuaccaaguaaaucuacaaag

SEQ ID NO: 4099217 - RNA, 17 nt, Streptococcus pneumoniae R6
cuaccauuaucuagacc

SEQ ID NO: 4099218 - RNA, 12 nt, Streptococcus pneumoniae R6
cuaccuacuuua

SEQ ID NO: 4099219 - RNA, 16 nt, Streptococcus pneumoniae R6
cuaccuauucauauau

SEQ ID NO: 4099220 - RNA, 19 nt, Streptococcus pneumoniae R6
cuaccugcaccagauucga

SEQ ID NO: 4099221 - RNA, 22 nt, Streptococcus pneumoniae R6
cuaccugcggauaaaagagaau

SEQ ID NO: 4099222 - RNA, 23 nt, Streptococcus pneumoniae R6
cuaccugcuccaaauauugcuca

SEQ ID NO: 4099223 - RNA, 13 nt, Streptococcus pneumoniae R6
cuauaaaccucau

SEQ ID NO: 4099224 - RNA, 15 nt, Streptococcus pneumoniae R6
cuauaaaugaugaau

SEQ ID NO: 4099225 - RNA, 19 nt, Streptococcus pneumoniae R6
cuauaacaucugcuauaau

SEQ ID NO: 4099226 - RNA, 12 nt, Streptococcus pneumoniae R6
cuauaacuuguu

SEQ ID NO: 4099227 - RNA, 16 nt, Streptococcus pneumoniae R6
cuauaagacuccucuu

SEQ ID NO: 4099228 - RNA, 19 nt, Streptococcus pneumoniae R6
cuauaagcccaaaucauca

SEQ ID NO: 4099229 - RNA, 13 nt, Streptococcus pneumoniae R6
cuauaauaaaaug

SEQ ID NO: 4099230 - RNA, 21 nt, Streptococcus pneumoniae R6
cuauaauaauuuauaaaacca

SEQ ID NO: 4099231 - RNA, 17 nt, Streptococcus pneumoniae R6
cuauaauggcuuguucc

SEQ ID NO: 4099232 - RNA, 20 nt, Streptococcus pneumoniae R6
cuauaauuauucugcaauca

SEQ ID NO: 4099233 - RNA, 21 nt, Streptococcus pneumoniae R6
cuauaauuauucugcaaucaa

SEQ ID NO: 4099234 - RNA, 14 nt, Streptococcus pneumoniae R6
cuauacuuacucuu

SEQ ID NO: 4099235 - RNA, 23 nt, Streptococcus pneumoniae R6
cuauacuuacucuuauuauucuc

SEQ ID NO: 4099236 - RNA, 13 nt, Streptococcus pneumoniae R6
cuauacuuuuucu

SEQ ID NO: 4099237 - RNA, 22 nt, Streptococcus pneumoniae R6
cuauagaaaaaagucuuuaaaa

SEQ ID NO: 4099238 - RNA, 22 nt, Streptococcus pneumoniae R6
cuauagaaaaggaguagaaaau

SEQ ID NO: 4099239 - RNA, 15 nt, Streptococcus pneumoniae R6
cuauagaacuaguaa

SEQ ID NO: 4099240 - RNA, 21 nt, Streptococcus pneumoniae R6
cuauagauaaggucaucuuau

SEQ ID NO: 4099241 - RNA, 14 nt, Streptococcus pneumoniae R6
cuauagcagccucc

SEQ ID NO: 4099242 - RNA, 20 nt, Streptococcus pneumoniae R6
cuauagccaucucuacuccu

SEQ ID NO: 4099243 - RNA, 11 nt, Streptococcus pneumoniae R6
cuauaguagau

SEQ ID NO: 4099244 - RNA, 14 nt, Streptococcus pneumoniae R6
cuauaguagauuga

SEQ ID NO: 4099245 - RNA, 16 nt, Streptococcus pneumoniae R6
cuauaguagcucagaa

SEQ ID NO: 4099246 - RNA, 18 nt, Streptococcus pneumoniae R6
cuauaguagguugcaguu

SEQ ID NO: 4099247 - RNA, 22 nt, Streptococcus pneumoniae R6
cuauaguagguugcaguugaaa

SEQ ID NO: 4099248 - RNA, 22 nt, Streptococcus pneumoniae R6
cuauagucaaagggaaaucuga

SEQ ID NO: 4099249 - RNA, 17 nt, Streptococcus pneumoniae R6
cuauauaucaugcuuua

SEQ ID NO: 4099250 - RNA, 22 nt, Streptococcus pneumoniae R6
cuauaucaaaaccaguccugga

SEQ ID NO: 4099251 - RNA, 15 nt, Streptococcus pneumoniae R6
cuauauuauaagacu

SEQ ID NO: 4099252 - RNA, 15 nt, Streptococcus pneumoniae R6
cuauauucucucuua

SEQ ID NO: 4099253 - RNA, 15 nt, Streptococcus pneumoniae R6
cuauauucuuugaga

SEQ ID NO: 4099254 - RNA, 11 nt, Streptococcus pneumoniae R6
cuauauugauu

SEQ ID NO: 4099255 - RNA, 12 nt, Streptococcus pneumoniae R6
cuauauuuauau

SEQ ID NO: 4099256 - RNA, 18 nt, Streptococcus pneumoniae R6
cuauauuucuauacuuuu

SEQ ID NO: 4099257 - RNA, 22 nt, Streptococcus pneumoniae R6
cuaucaaaagauguuagaaaaa

SEQ ID NO: 4099258 - RNA, 11 nt, Streptococcus pneumoniae R6
cuaucaaacag

SEQ ID NO: 4099259 - RNA, 13 nt, Streptococcus pneumoniae R6
cuaucaacuagau

SEQ ID NO: 4099260 - RNA, 17 nt, Streptococcus pneumoniae R6
cuaucaacuagaucaac

SEQ ID NO: 4099261 - RNA, 12 nt, Streptococcus pneumoniae R6
cuaucacuccaa

SEQ ID NO: 4099262 - RNA, 16 nt, Streptococcus pneumoniae R6
cuaucaggaaagucaa

SEQ ID NO: 4099263 - RNA, 14 nt, Streptococcus pneumoniae R6
cuauccacaaccuc

SEQ ID NO: 4099264 - RNA, 16 nt, Streptococcus pneumoniae R6
cuauccacaaccucaa

SEQ ID NO: 4099265 - RNA, 23 nt, Streptococcus pneumoniae R6
cuauccacaaccucaaaacagug

SEQ ID NO: 4099266 - RNA, 16 nt, Streptococcus pneumoniae R6
cuauccaguuauucuu

SEQ ID NO: 4099267 - RNA, 18 nt, Streptococcus pneumoniae R6
cuauccuggcguaguaaa

SEQ ID NO: 4099268 - RNA, 19 nt, Streptococcus pneumoniae R6
cuaucgauaucaauuccac

SEQ ID NO: 4099269 - RNA, 13 nt, Streptococcus pneumoniae R6
cuaucuaaaaaaa

SEQ ID NO: 4099270 - RNA, 15 nt, Streptococcus pneumoniae R6
cuaucuaaaaaaaug

SEQ ID NO: 4099271 - RNA, 20 nt, Streptococcus pneumoniae R6
cuaucuaaaaaaaugauaau

SEQ ID NO: 4099272 - RNA, 14 nt, Streptococcus pneumoniae R6
cuaucuacaaccuc

SEQ ID NO: 4099273 - RNA, 21 nt, Streptococcus pneumoniae R6
cuaucuacaaccucaaagcag

SEQ ID NO: 4099274 - RNA, 13 nt, Streptococcus pneumoniae R6
cuaucucaacaaa

SEQ ID NO: 4099275 - RNA, 20 nt, Streptococcus pneumoniae R6
cuaucucaacaaaucuuccu

SEQ ID NO: 4099276 - RNA, 14 nt, Streptococcus pneumoniae R6
cuaucugcaaccuc

SEQ ID NO: 4099277 - RNA, 15 nt, Streptococcus pneumoniae R6
cuaucugcaaccuca

SEQ ID NO: 4099278 - RNA, 16 nt, Streptococcus pneumoniae R6
cuaucugcaaccucaa

SEQ ID NO: 4099279 - RNA, 16 nt, Streptococcus pneumoniae R6
cuaucugcaaccuuaa

SEQ ID NO: 4099280 - RNA, 15 nt, Streptococcus pneumoniae R6
cuaucugccaccuca

SEQ ID NO: 4099281 - RNA, 17 nt, Streptococcus pneumoniae R6
cuaucugucacaaucca

SEQ ID NO: 4099282 - RNA, 20 nt, Streptococcus pneumoniae R6
cuaucuuauugauuuuucug

SEQ ID NO: 4099283 - RNA, 17 nt, Streptococcus pneumoniae R6
cuaucuucauuuugcac

SEQ ID NO: 4099284 - RNA, 19 nt, Streptococcus pneumoniae R6
cuaucuugagcaagucucu

SEQ ID NO: 4099285 - RNA, 16 nt, Streptococcus pneumoniae R6
cuaucuuggucuagca

SEQ ID NO: 4099286 - RNA, 13 nt, Streptococcus pneumoniae R6
cuaugaaaugaga

SEQ ID NO: 4099287 - RNA, 15 nt, Streptococcus pneumoniae R6
cuaugaaaugagaaa

SEQ ID NO: 4099288 - RNA, 16 nt, Streptococcus pneumoniae R6
cuaugaaaugagaaau

SEQ ID NO: 4099289 - RNA, 18 nt, Streptococcus pneumoniae R6
cuaugaauaugaguucuu

SEQ ID NO: 4099290 - RNA, 15 nt, Streptococcus pneumoniae R6
cuaugaucagcauuu

SEQ ID NO: 4099291 - RNA, 11 nt, Streptococcus pneumoniae R6
cuaugauuuuc

SEQ ID NO: 4099292 - RNA, 14 nt, Streptococcus pneumoniae R6
cuaugcguuuuaau

SEQ ID NO: 4099293 - RNA, 17 nt, Streptococcus pneumoniae R6
cuaugcguuuuaaugug

SEQ ID NO: 4099294 - RNA, 18 nt, Streptococcus pneumoniae R6
cuaugcguuuuauugugg

SEQ ID NO: 4099295 - RNA, 17 nt, Streptococcus pneumoniae R6
cuaugcuuuuuauugug

SEQ ID NO: 4099296 - RNA, 17 nt, Streptococcus pneumoniae R6
cuauuaacgauugaaau

SEQ ID NO: 4099297 - RNA, 21 nt, Streptococcus pneumoniae R6
cuauuaacgauugaaauaacc

SEQ ID NO: 4099298 - RNA, 22 nt, Streptococcus pneumoniae R6
cuauuauagagagggucuccca

SEQ ID NO: 4099299 - RNA, 15 nt, Streptococcus pneumoniae R6
cuauuaucguuuucc

SEQ ID NO: 4099300 - RNA, 18 nt, Streptococcus pneumoniae R6
cuauuccauauucaauua

SEQ ID NO: 4099301 - RNA, 15 nt, Streptococcus pneumoniae R6
cuauucccuaccuca

SEQ ID NO: 4099302 - RNA, 23 nt, Streptococcus pneumoniae R6
cuauuccuuuuuuuacaucaagc

SEQ ID NO: 4099303 - RNA, 20 nt, Streptococcus pneumoniae R6
cuauucuaaauucaauucac

SEQ ID NO: 4099304 - RNA, 16 nt, Streptococcus pneumoniae R6
cuauucugacuaggaa

SEQ ID NO: 4099305 - RNA, 19 nt, Streptococcus pneumoniae R6
cuauucuucgaccuacauu

SEQ ID NO: 4099306 - RNA, 15 nt, Streptococcus pneumoniae R6
cuauucuuguuucag

SEQ ID NO: 4099307 - RNA, 14 nt, Streptococcus pneumoniae R6
cuauugaguucaca

SEQ ID NO: 4099308 - RNA, 20 nt, Streptococcus pneumoniae R6
cuauugaugaaguaaaugug

SEQ ID NO: 4099309 - RNA, 21 nt, Streptococcus pneumoniae R6
cuauuguuauuuuucuuuuuu

SEQ ID NO: 4099310 - RNA, 12 nt, Streptococcus pneumoniae R6
cuauuguugcau

SEQ ID NO: 4099311 - RNA, 19 nt, Streptococcus pneumoniae R6
cuauuguugcauuaaaaag

SEQ ID NO: 4099312 - RNA, 20 nt, Streptococcus pneumoniae R6
cuauuuaaaccaauuuuaag

SEQ ID NO: 4099313 - RNA, 17 nt, Streptococcus pneumoniae R6
cuauuuaugaaaaaguu

SEQ ID NO: 4099314 - RNA, 13 nt, Streptococcus pneumoniae R6
cuauuuauuuaau

SEQ ID NO: 4099315 - RNA, 21 nt, Streptococcus pneumoniae R6
cuauuucacuccacuauaaaa

SEQ ID NO: 4099316 - RNA, 12 nt, Streptococcus pneumoniae R6
cuauuucauuuu

SEQ ID NO: 4099317 - RNA, 21 nt, Streptococcus pneumoniae R6
cuauuucuuuaaaaucaaagu

SEQ ID NO: 4099318 - RNA, 23 nt, Streptococcus pneumoniae R6
cuauuuggcuuaucugacuagca

SEQ ID NO: 4099319 - RNA, 14 nt, Streptococcus pneumoniae R6
cuauuuuaaaaaua

SEQ ID NO: 4099320 - RNA, 12 nt, Streptococcus pneumoniae R6
cuauuuuauccc

SEQ ID NO: 4099321 - RNA, 19 nt, Streptococcus pneumoniae R6
cuauuuucuucuuuauaau

SEQ ID NO: 4099322 - RNA, 19 nt, Streptococcus pneumoniae R6
cuauuuuuacucaaggacu

SEQ ID NO: 4099323 - RNA, 17 nt, Streptococcus pneumoniae R6
cuauuuuuguauuuaga

SEQ ID NO: 4099324 - RNA, 23 nt, Streptococcus pneumoniae R6
cuauuuuuugaaucaauuuucaa

SEQ ID NO: 4099325 - RNA, 20 nt, Streptococcus pneumoniae R6
cuauuuuuuguauuauuagg

SEQ ID NO: 4099326 - RNA, 14 nt, Streptococcus pneumoniae R6
cucaugaaaggauu

SEQ ID NO: 4099327 - RNA, 17 nt, Streptococcus pneumoniae R6
cucaugacagccucaau

SEQ ID NO: 4099328 - RNA, 14 nt, Streptococcus pneumoniae R6
cucauucaucacca

SEQ ID NO: 4099329 - RNA, 13 nt, Streptococcus pneumoniae R6
cucauucuuaagu

SEQ ID NO: 4099330 - RNA, 20 nt, Streptococcus pneumoniae R6
cucauugauuuucaucauca

SEQ ID NO: 4099331 - RNA, 17 nt, Streptococcus pneumoniae R6
cucauuucaauagaaau

SEQ ID NO: 4099332 - RNA, 20 nt, Streptococcus pneumoniae R6
cucauuucaauagaaaucac

SEQ ID NO: 4099333 - RNA, 21 nt, Streptococcus pneumoniae R6
cucauuugcgcgcuugaauga

SEQ ID NO: 4099334 - RNA, 21 nt, Streptococcus pneumoniae R6
cuccaaaaauaaaucuaucag

SEQ ID NO: 4099335 - RNA, 15 nt, Streptococcus pneumoniae R6
cuccaaaccauuuuu

SEQ ID NO: 4099336 - RNA, 16 nt, Streptococcus pneumoniae R6
cuccaaaccauuuuug

SEQ ID NO: 4099337 - RNA, 19 nt, Streptococcus pneumoniae R6
cuccaaacgcgauacaaua

SEQ ID NO: 4099338 - RNA, 18 nt, Streptococcus pneumoniae R6
cuccaagcgcccugcaau

SEQ ID NO: 4099339 - RNA, 15 nt, Streptococcus pneumoniae R6
cuccaaguccaagaa

SEQ ID NO: 4099340 - RNA, 17 nt, Streptococcus pneumoniae R6
cuccaaguccaagaacc

SEQ ID NO: 4099341 - RNA, 21 nt, Streptococcus pneumoniae R6
cuccaaucaaauugugcaguu

SEQ ID NO: 4099342 - RNA, 15 nt, Streptococcus pneumoniae R6
cuccacgcuccacuu

SEQ ID NO: 4099343 - RNA, 20 nt, Streptococcus pneumoniae R6
cuccacgcuccacuucccca

SEQ ID NO: 4099344 - RNA, 13 nt, Streptococcus pneumoniae R6
cuccacuauaaaa

SEQ ID NO: 4099345 - RNA, 19 nt, Streptococcus pneumoniae R6
cuccagauuaucuuccuua

SEQ ID NO: 4099346 - RNA, 14 nt, Streptococcus pneumoniae R6
cuccagugaaaaca

SEQ ID NO: 4099347 - RNA, 17 nt, Streptococcus pneumoniae R6
cuccaguuuuaaucuua

SEQ ID NO: 4099348 - RNA, 18 nt, Streptococcus pneumoniae R6
cuccauaaacgcaagcaa

SEQ ID NO: 4099349 - RNA, 22 nt, Streptococcus pneumoniae R6
cuccauagccaucuuuugacag

SEQ ID NO: 4099350 - RNA, 16 nt, Streptococcus pneumoniae R6
cucccauauuuggcau

SEQ ID NO: 4099351 - RNA, 17 nt, Streptococcus pneumoniae R6
cucccaucgcgaccaag

SEQ ID NO: 4099352 - RNA, 23 nt, Streptococcus pneumoniae R6
cucccaucgcgaccaagagcaaa

SEQ ID NO: 4099353 - RNA, 20 nt, Streptococcus pneumoniae R6
cucccauuggaucccauggu

SEQ ID NO: 4099354 - RNA, 22 nt, Streptococcus pneumoniae R6
cuccccuuuagaacuugcucca

SEQ ID NO: 4099355 - RNA, 15 nt, Streptococcus pneumoniae R6
cucccuguuccaaag

SEQ ID NO: 4099356 - RNA, 14 nt, Streptococcus pneumoniae R6
cucccuucuuucuc

SEQ ID NO: 4099357 - RNA, 21 nt, Streptococcus pneumoniae R6
cucccuucuuucucaaacauu

SEQ ID NO: 4099358 - RNA, 19 nt, Streptococcus pneumoniae R6
cuccgauaauuauuuuuua

SEQ ID NO: 4099359 - RNA, 18 nt, Streptococcus pneumoniae R6
cuccgauguauuugaggu

SEQ ID NO: 4099360 - RNA, 15 nt, Streptococcus pneumoniae R6
cuccgcuuccagagc

SEQ ID NO: 4099361 - RNA, 15 nt, Streptococcus pneumoniae R6
cuccgcuuuuaucaa

SEQ ID NO: 4099362 - RNA, 13 nt, Streptococcus pneumoniae R6
cuccguaccaaca

SEQ ID NO: 4099363 - RNA, 18 nt, Streptococcus pneumoniae R6
cuccgugaagugaaagga

SEQ ID NO: 4099364 - RNA, 19 nt, Streptococcus pneumoniae R6
cuccguuuuuaaucauaca

SEQ ID NO: 4099365 - RNA, 23 nt, Streptococcus pneumoniae R6
cuccuaguuugcucuuugauuuu

SEQ ID NO: 4099366 - RNA, 23 nt, Streptococcus pneumoniae R6
cuccuauagaaaaaucccccaag

SEQ ID NO: 4099367 - RNA, 14 nt, Streptococcus pneumoniae R6
cuccuauuuucuuc

SEQ ID NO: 4099368 - RNA, 22 nt, Streptococcus pneumoniae R6
cuccucgagcaguuccaucaau

SEQ ID NO: 4099369 - RNA, 13 nt, Streptococcus pneumoniae R6
cuccucuccagca

SEQ ID NO: 4099370 - RNA, 16 nt, Streptococcus pneumoniae R6
cuccugaauuagcaau

SEQ ID NO: 4099371 - RNA, 12 nt, Streptococcus pneumoniae R6
cuccugcaauug

SEQ ID NO: 4099372 - RNA, 16 nt, Streptococcus pneumoniae R6
cuccuguuucaaagua

SEQ ID NO: 4099373 - RNA, 16 nt, Streptococcus pneumoniae R6
cuccuuagcucagcug

SEQ ID NO: 4099374 - RNA, 15 nt, Streptococcus pneumoniae R6
cuccuuaucaaaauc

SEQ ID NO: 4099375 - RNA, 12 nt, Streptococcus pneumoniae R6
cuccuucaaguu

SEQ ID NO: 4099376 - RNA, 16 nt, Streptococcus pneumoniae R6
cuccuucuccaguccu

SEQ ID NO: 4099377 - RNA, 18 nt, Streptococcus pneumoniae R6
cuccuucuuuuuuauccu

SEQ ID NO: 4099378 - RNA, 19 nt, Streptococcus pneumoniae R6
cuccuugccgauugauuua

SEQ ID NO: 4099379 - RNA, 20 nt, Streptococcus pneumoniae R6
cuccuuuagugauaucuuga

SEQ ID NO: 4099380 - RNA, 21 nt, Streptococcus pneumoniae R6
cucgacugguaaagaauggau

SEQ ID NO: 4099381 - RNA, 14 nt, Streptococcus pneumoniae R6
cucgagaaaggaca

SEQ ID NO: 4099382 - RNA, 19 nt, Streptococcus pneumoniae R6
cucgagcuuagcuuuucuu

SEQ ID NO: 4099383 - RNA, 17 nt, Streptococcus pneumoniae R6
cucgagguuaacuccuu

SEQ ID NO: 4099384 - RNA, 18 nt, Streptococcus pneumoniae R6
cucgauaaaggacaaaau

SEQ ID NO: 4099385 - RNA, 13 nt, Streptococcus pneumoniae R6
cucgaucugaaug

SEQ ID NO: 4099386 - RNA, 19 nt, Streptococcus pneumoniae R6
cucgcgacaacagcuugga

SEQ ID NO: 4099387 - RNA, 14 nt, Streptococcus pneumoniae R6
cucggacuuuuucc

SEQ ID NO: 4099388 - RNA, 15 nt, Streptococcus pneumoniae R6
cucggacuuuuucca

SEQ ID NO: 4099389 - RNA, 13 nt, Streptococcus pneumoniae R6
cucggcauuguga

SEQ ID NO: 4099390 - RNA, 14 nt, Streptococcus pneumoniae R6
cucggccuucuuuu

SEQ ID NO: 4099391 - RNA, 23 nt, Streptococcus pneumoniae R6
cucgggcugaauauauucuccag

SEQ ID NO: 4099392 - RNA, 16 nt, Streptococcus pneumoniae R6
cucggucaucaucacu

SEQ ID NO: 4099393 - RNA, 19 nt, Streptococcus pneumoniae R6
cucggucuuggaccaggau

SEQ ID NO: 4099394 - RNA, 20 nt, Streptococcus pneumoniae R6
cucguagcggauuuucaaaa

SEQ ID NO: 4099395 - RNA, 15 nt, Streptococcus pneumoniae R6
cucgucacuugccuc

SEQ ID NO: 4099396 - RNA, 16 nt, Streptococcus pneumoniae R6
cucgugaagaaaucau

SEQ ID NO: 4099397 - RNA, 19 nt, Streptococcus pneumoniae R6
cucgugauguuaaaaugag

SEQ ID NO: 4099398 - RNA, 22 nt, Streptococcus pneumoniae R6
cucgugauuauagguuccuucu

SEQ ID NO: 4099399 - RNA, 19 nt, Streptococcus pneumoniae R6
cucgugcauuucaucccca

SEQ ID NO: 4099400 - RNA, 12 nt, Streptococcus pneumoniae R6
cucuaaaaauaa

SEQ ID NO: 4099401 - RNA, 14 nt, Streptococcus pneumoniae R6
cucuaaaaucaucg

SEQ ID NO: 4099402 - RNA, 22 nt, Streptococcus pneumoniae R6
cucuaaaaucaucgccaaauca

SEQ ID NO: 4099403 - RNA, 16 nt, Streptococcus pneumoniae R6
cucuaaauaaaucuua

SEQ ID NO: 4099404 - RNA, 17 nt, Streptococcus pneumoniae R6
cucuaaauacaaaaaua

SEQ ID NO: 4099405 - RNA, 12 nt, Streptococcus pneumoniae R6
cucuaaccaccu

SEQ ID NO: 4099406 - RNA, 12 nt, Streptococcus pneumoniae R6
cucuaacuucug

SEQ ID NO: 4099407 - RNA, 21 nt, Streptococcus pneumoniae R6
cucuaagcacaaaaucuuaaa

SEQ ID NO: 4099408 - RNA, 18 nt, Streptococcus pneumoniae R6
cucuacaccauaaauauu

SEQ ID NO: 4099409 - RNA, 18 nt, Streptococcus pneumoniae R6
cucuacauucccaaacaa

SEQ ID NO: 4099410 - RNA, 20 nt, Streptococcus pneumoniae R6
cucuaccaagcccucagcca

SEQ ID NO: 4099411 - RNA, 23 nt, Streptococcus pneumoniae R6
cucuagcuuuuuaauuuugaguc

SEQ ID NO: 4099412 - RNA, 22 nt, Streptococcus pneumoniae R6
cucuaggaagcgaugauaagaa

SEQ ID NO: 4099413 - RNA, 16 nt, Streptococcus pneumoniae R6
cucuaggaauaucaaa

SEQ ID NO: 4099414 - RNA, 15 nt, Streptococcus pneumoniae R6
cucuaguuuaugaac

SEQ ID NO: 4099415 - RNA, 16 nt, Streptococcus pneumoniae R6
cucuaguuuuuauaau

SEQ ID NO: 4099416 - RNA, 17 nt, Streptococcus pneumoniae R6
cucuaucaggaaaguca

SEQ ID NO: 4099417 - RNA, 20 nt, Streptococcus pneumoniae R6
cucuaucaggaaagucaaau

SEQ ID NO: 4099418 - RNA, 15 nt, Streptococcus pneumoniae R6
cucuauucuuuuuug

SEQ ID NO: 4099419 - RNA, 20 nt, Streptococcus pneumoniae R6
cucucagaaccuggucauga

SEQ ID NO: 4099420 - RNA, 17 nt, Streptococcus pneumoniae R6
cucucauucaucaccac

SEQ ID NO: 4099421 - RNA, 21 nt, Streptococcus pneumoniae R6
cucuccaaauccccaagugac

SEQ ID NO: 4099422 - RNA, 20 nt, Streptococcus pneumoniae R6
cucuccaaccgucaaucugu

SEQ ID NO: 4099423 - RNA, 14 nt, Streptococcus pneumoniae R6
cucuccuccauaaa

SEQ ID NO: 4099424 - RNA, 16 nt, Streptococcus pneumoniae R6
cucuccuccauaaaaa

SEQ ID NO: 4099425 - RNA, 14 nt, Streptococcus pneumoniae R6
cucuccuccccuuu

SEQ ID NO: 4099426 - RNA, 13 nt, Streptococcus pneumoniae R6
cucucuauaauaa

SEQ ID NO: 4099427 - RNA, 18 nt, Streptococcus pneumoniae R6
cucucugcggauaucuga

SEQ ID NO: 4099428 - RNA, 23 nt, Streptococcus pneumoniae R6
cucucuucaaauuugacuaaaaa

SEQ ID NO: 4099429 - RNA, 18 nt, Streptococcus pneumoniae R6
cugacuucgucaguucua

SEQ ID NO: 4099430 - RNA, 21 nt, Streptococcus pneumoniae R6
cugacuucgucaguucuaucu

SEQ ID NO: 4099431 - RNA, 17 nt, Streptococcus pneumoniae R6
cugacuucgucaguuuc

SEQ ID NO: 4099432 - RNA, 21 nt, Streptococcus pneumoniae R6
cugagaagacaucuucucagg

SEQ ID NO: 4099433 - RNA, 22 nt, Streptococcus pneumoniae R6
cugagaagacaucuucucaggc

SEQ ID NO: 4099434 - RNA, 14 nt, Streptococcus pneumoniae R6
cugagaaggagaac

SEQ ID NO: 4099435 - RNA, 14 nt, Streptococcus pneumoniae R6
cugagaaggcuggu

SEQ ID NO: 4099436 - RNA, 21 nt, Streptococcus pneumoniae R6
cugagacucauuuaaaauuaa

SEQ ID NO: 4099437 - RNA, 13 nt, Streptococcus pneumoniae R6
cugagauacucca

SEQ ID NO: 4099438 - RNA, 21 nt, Streptococcus pneumoniae R6
cugagauacuccaaaacaucu

SEQ ID NO: 4099439 - RNA, 14 nt, Streptococcus pneumoniae R6
cugagaucuucuuc

SEQ ID NO: 4099440 - RNA, 16 nt, Streptococcus pneumoniae R6
cugagaucuucuucua

SEQ ID NO: 4099441 - RNA, 17 nt, Streptococcus pneumoniae R6
cugagauggauuuuccu

SEQ ID NO: 4099442 - RNA, 18 nt, Streptococcus pneumoniae R6
cugagauggauuuuccuu

SEQ ID NO: 4099443 - RNA, 19 nt, Streptococcus pneumoniae R6
cugagauggauuuuccuuu

SEQ ID NO: 4099444 - RNA, 20 nt, Streptococcus pneumoniae R6
cugagcucuuuagucccagc

SEQ ID NO: 4099445 - RNA, 12 nt, Streptococcus pneumoniae R6
cugaggaccaaa

SEQ ID NO: 4099446 - RNA, 19 nt, Streptococcus pneumoniae R6
cugagguaggaguccucug

SEQ ID NO: 4099447 - RNA, 20 nt, Streptococcus pneumoniae R6
cugagguuaaaaucuuuuac

SEQ ID NO: 4099448 - RNA, 13 nt, Streptococcus pneumoniae R6
cugagucacguuu

SEQ ID NO: 4099449 - RNA, 16 nt, Streptococcus pneumoniae R6
cugaguuuucuugugu

SEQ ID NO: 4099450 - RNA, 12 nt, Streptococcus pneumoniae R6
cugauaaaagau

SEQ ID NO: 4099451 - RNA, 21 nt, Streptococcus pneumoniae R6
cugauaacgaagagcuggcug

SEQ ID NO: 4099452 - RNA, 23 nt, Streptococcus pneumoniae R6
cugauaacgaagagcuggcugca

SEQ ID NO: 4099453 - RNA, 22 nt, Streptococcus pneumoniae R6
cugauaagaugacaucuaaaua

SEQ ID NO: 4099454 - RNA, 15 nt, Streptococcus pneumoniae R6
cugauaauauuuucu

SEQ ID NO: 4099455 - RNA, 22 nt, Streptococcus pneumoniae R6
cugauaccaaccaguugccaua

SEQ ID NO: 4099456 - RNA, 14 nt, Streptococcus pneumoniae R6
cugauagaagaguc

SEQ ID NO: 4099457 - RNA, 24 nt, Streptococcus pneumoniae R6
cugauagagauuauagugguguuu

SEQ ID NO: 4099458 - RNA, 17 nt, Streptococcus pneumoniae R6
cugauagauuuauuuuu

SEQ ID NO: 4099459 - RNA, 22 nt, Streptococcus pneumoniae R6
cugauauuguuaauggucuuca

SEQ ID NO: 4099460 - RNA, 20 nt, Streptococcus pneumoniae R6
cugaucaagcguuuuucuuc

SEQ ID NO: 4099461 - RNA, 23 nt, Streptococcus pneumoniae R6
cugaucaauauucuccgaaguca

SEQ ID NO: 4099462 - RNA, 16 nt, Streptococcus pneumoniae R6
cugaucccuccauuuc

SEQ ID NO: 4099463 - RNA, 16 nt, Streptococcus pneumoniae R6
cugaucgauuuguccu

SEQ ID NO: 4099464 - RNA, 21 nt, Streptococcus pneumoniae R6
cugaucuuggauauucaauuc

SEQ ID NO: 4099465 - RNA, 19 nt, Streptococcus pneumoniae R6
cugaugaaccuucaucaaa

SEQ ID NO: 4099466 - RNA, 23 nt, Streptococcus pneumoniae R6
cugaugaagggcuuuucuaucac

SEQ ID NO: 4099467 - RNA, 17 nt, Streptococcus pneumoniae R6
cugaugagagaucuaga

SEQ ID NO: 4099468 - RNA, 18 nt, Streptococcus pneumoniae R6
cugaugagagaucuagau

SEQ ID NO: 4099469 - RNA, 14 nt, Streptococcus pneumoniae R6
cugaugagccagcu

SEQ ID NO: 4099470 - RNA, 15 nt, Streptococcus pneumoniae R6
cugaugagccagcuc

SEQ ID NO: 4099471 - RNA, 20 nt, Streptococcus pneumoniae R6
cugaugauucaaggaguugu

SEQ ID NO: 4099472 - RNA, 19 nt, Streptococcus pneumoniae R6
cugaugccaucuucguaac

SEQ ID NO: 4099473 - RNA, 14 nt, Streptococcus pneumoniae R6
cugauuaccaacua

SEQ ID NO: 4099474 - RNA, 17 nt, Streptococcus pneumoniae R6
cugauuauguuuuaaau

SEQ ID NO: 4099475 - RNA, 16 nt, Streptococcus pneumoniae R6
cugauucuacuuuuuc

SEQ ID NO: 4099476 - RNA, 18 nt, Streptococcus pneumoniae R6
cugauucuacuuuuucaa

SEQ ID NO: 4099477 - RNA, 15 nt, Streptococcus pneumoniae R6
cugauuuacaaauau

SEQ ID NO: 4099478 - RNA, 15 nt, Streptococcus pneumoniae R6
cugauuuugaaaauu

SEQ ID NO: 4099479 - RNA, 12 nt, Streptococcus pneumoniae R6
cugauuuugugc

SEQ ID NO: 4099480 - RNA, 13 nt, Streptococcus pneumoniae R6
cugauuuuuucau

SEQ ID NO: 4099481 - RNA, 15 nt, Streptococcus pneumoniae R6
cugauuuuuucauuc

SEQ ID NO: 4099482 - RNA, 15 nt, Streptococcus pneumoniae R6
cugcaaaauuuugag

SEQ ID NO: 4099483 - RNA, 13 nt, Streptococcus pneumoniae R6
cugcaaccucaaa

SEQ ID NO: 4099484 - RNA, 21 nt, Streptococcus pneumoniae R6
cugcaaccucaaaacaguguu

SEQ ID NO: 4099485 - RNA, 12 nt, Streptococcus pneumoniae R6
cugcaaccucua

SEQ ID NO: 4099486 - RNA, 13 nt, Streptococcus pneumoniae R6
cugcaaccuuaaa

SEQ ID NO: 4099487 - RNA, 17 nt, Streptococcus pneumoniae R6
cugcaaccuuaaaacag

SEQ ID NO: 4099488 - RNA, 19 nt, Streptococcus pneumoniae R6
cugcaaguccagaaccguu

SEQ ID NO: 4099489 - RNA, 19 nt, Streptococcus pneumoniae R6
cugcaaucaagguuuccaa

SEQ ID NO: 4099490 - RNA, 20 nt, Streptococcus pneumoniae R6
cugcaaucaagguuuccaaa

SEQ ID NO: 4099491 - RNA, 23 nt, Streptococcus pneumoniae R6
cugcacaggacuaaguccuuuua

SEQ ID NO: 4099492 - RNA, 23 nt, Streptococcus pneumoniae R6
cugcaccacaguaacccauacca

SEQ ID NO: 4099493 - RNA, 21 nt, Streptococcus pneumoniae R6
cugcaccaccgauauggccug

SEQ ID NO: 4099494 - RNA, 10 nt, Streptococcus pneumoniae R6
cugcaccaga

SEQ ID NO: 4099495 - RNA, 23 nt, Streptococcus pneumoniae R6
cugcaccugauuucuccgcuucc

SEQ ID NO: 4099496 - RNA, 21 nt, Streptococcus pneumoniae R6
cugcagaaucgugaguuccug

SEQ ID NO: 4099497 - RNA, 23 nt, Streptococcus pneumoniae R6
cugcagaaucgugaguuccuguu

SEQ ID NO: 4099498 - RNA, 21 nt, Streptococcus pneumoniae R6
cugcagccucaaaacacuguu

SEQ ID NO: 4099499 - RNA, 19 nt, Streptococcus pneumoniae R6
cugcagcugcggcuuuuuc

SEQ ID NO: 4099500 - RNA, 21 nt, Streptococcus pneumoniae R6
cugcagcugcggcuuuuucuu

SEQ ID NO: 4099501 - RNA, 22 nt, Streptococcus pneumoniae R6
cugcaguucccacacgaaucaa

SEQ ID NO: 4099502 - RNA, 21 nt, Streptococcus pneumoniae R6
cugcauaagcuggucuuuuuu

SEQ ID NO: 4099503 - RNA, 22 nt, Streptococcus pneumoniae R6
cugcaucagaugggucaagauu

SEQ ID NO: 4099504 - RNA, 16 nt, Streptococcus pneumoniae R6
cugcauuucuuuuauc

SEQ ID NO: 4099505 - RNA, 21 nt, Streptococcus pneumoniae R6
cugccaacuuacgagcacgag

SEQ ID NO: 4099506 - RNA, 20 nt, Streptococcus pneumoniae R6
cugccaacuuaucagcuagc

SEQ ID NO: 4099507 - RNA, 18 nt, Streptococcus pneumoniae R6
cugccaauugcucaacuu

SEQ ID NO: 4099508 - RNA, 15 nt, Streptococcus pneumoniae R6
cugccacaccaccug

SEQ ID NO: 4099509 - RNA, 18 nt, Streptococcus pneumoniae R6
cugccacaccaccugcca

SEQ ID NO: 4099510 - RNA, 22 nt, Streptococcus pneumoniae R6
cugccagugcggacggucuuug

SEQ ID NO: 4099511 - RNA, 14 nt, Streptococcus pneumoniae R6
cugccauuaauucc

SEQ ID NO: 4099512 - RNA, 17 nt, Streptococcus pneumoniae R6
cugccucaauccuuuuc

SEQ ID NO: 4099513 - RNA, 19 nt, Streptococcus pneumoniae R6
cugccucaauccuuuucug

SEQ ID NO: 4099514 - RNA, 16 nt, Streptococcus pneumoniae R6
cugccugguaaagacu

SEQ ID NO: 4099515 - RNA, 18 nt, Streptococcus pneumoniae R6
cugccugguaaagacucu

SEQ ID NO: 4099516 - RNA, 17 nt, Streptococcus pneumoniae R6
cugccuuccaagauaau

SEQ ID NO: 4099517 - RNA, 13 nt, Streptococcus pneumoniae R6
cugccuuucucuc

SEQ ID NO: 4099518 - RNA, 15 nt, Streptococcus pneumoniae R6
cugcgccaaaacuaa

SEQ ID NO: 4099519 - RNA, 21 nt, Streptococcus pneumoniae R6
cugcguggaggaguuuuuccu

SEQ ID NO: 4099520 - RNA, 14 nt, Streptococcus pneumoniae R6
cugcguuaacuuca

SEQ ID NO: 4099521 - RNA, 21 nt, Streptococcus pneumoniae R6
cugcguuauaugcuauaauua

SEQ ID NO: 4099522 - RNA, 23 nt, Streptococcus pneumoniae R6
cugcuaaaacaaaauucuuccua

SEQ ID NO: 4099523 - RNA, 21 nt, Streptococcus pneumoniae R6
cugcuaaaagauuucuauaaa

SEQ ID NO: 4099524 - RNA, 20 nt, Streptococcus pneumoniae R6
cugcuaaggauuuaggacua

SEQ ID NO: 4099525 - RNA, 17 nt, Streptococcus pneumoniae R6
cugcuaccguugaaauc

SEQ ID NO: 4099526 - RNA, 19 nt, Streptococcus pneumoniae R6
cugcuaccguugaaaucaa

SEQ ID NO: 4099527 - RNA, 15 nt, Streptococcus pneumoniae R6
cugcuagacgaccau

SEQ ID NO: 4099528 - RNA, 15 nt, Streptococcus pneumoniae R6
cugcuagcaucaucg

SEQ ID NO: 4099529 - RNA, 12 nt, Streptococcus pneumoniae R6
cugcuauuucua

SEQ ID NO: 4099530 - RNA, 13 nt, Streptococcus pneumoniae R6
cugcuauuucuaa

SEQ ID NO: 4099531 - RNA, 15 nt, Streptococcus pneumoniae R6
cuguaccgaccuugu

SEQ ID NO: 4099532 - RNA, 15 nt, Streptococcus pneumoniae R6
cuguacguuuuauca

SEQ ID NO: 4099533 - RNA, 20 nt, Streptococcus pneumoniae R6
cuguacuagggcauuuugac

SEQ ID NO: 4099534 - RNA, 19 nt, Streptococcus pneumoniae R6
cuguagaauugcugucaaa

SEQ ID NO: 4099535 - RNA, 20 nt, Streptococcus pneumoniae R6
cuguagucagcugucuuuuc

SEQ ID NO: 4099536 - RNA, 15 nt, Streptococcus pneumoniae R6
cuguaguggguugaa

SEQ ID NO: 4099537 - RNA, 18 nt, Streptococcus pneumoniae R6
cuguaguggguugaaaaa

SEQ ID NO: 4099538 - RNA, 19 nt, Streptococcus pneumoniae R6
cuguaguggguugaaaaaa

SEQ ID NO: 4099539 - RNA, 23 nt, Streptococcus pneumoniae R6
cuguaguggguugaaaaaaagcu

SEQ ID NO: 4099540 - RNA, 18 nt, Streptococcus pneumoniae R6
cuguaguggguugaaguc

SEQ ID NO: 4099541 - RNA, 17 nt, Streptococcus pneumoniae R6
cuguaguuaugaaacua

SEQ ID NO: 4099542 - RNA, 18 nt, Streptococcus pneumoniae R6
cuguauacuuugcaacug

SEQ ID NO: 4099543 - RNA, 16 nt, Streptococcus pneumoniae R6
cuguauacuuuuucag

SEQ ID NO: 4099544 - RNA, 16 nt, Streptococcus pneumoniae R6
cuguaucaagauagug

SEQ ID NO: 4099545 - RNA, 15 nt, Streptococcus pneumoniae R6
cuguaucgaaacauu

SEQ ID NO: 4099546 - RNA, 21 nt, Streptococcus pneumoniae R6
cuguaucgaaacauucaaauc

SEQ ID NO: 4099547 - RNA, 16 nt, Streptococcus pneumoniae R6
cuguaucuguuuuuuc

SEQ ID NO: 4099548 - RNA, 12 nt, Streptococcus pneumoniae R6
cuguaugagaaa

SEQ ID NO: 4099549 - RNA, 23 nt, Streptococcus pneumoniae R6
cuguaugaugggcucuuuuuuug

SEQ ID NO: 4099550 - RNA, 14 nt, Streptococcus pneumoniae R6
cuguauuuuuuuug

SEQ ID NO: 4099551 - RNA, 16 nt, Streptococcus pneumoniae R6
cugucaagaccauggc

SEQ ID NO: 4099552 - RNA, 15 nt, Streptococcus pneumoniae R6
cugucauaucauaac

SEQ ID NO: 4099553 - RNA, 13 nt, Streptococcus pneumoniae R6
cugucauuuuuuc

SEQ ID NO: 4099554 - RNA, 16 nt, Streptococcus pneumoniae R6
cugucauuuuuuccaa

SEQ ID NO: 4099555 - RNA, 22 nt, Streptococcus pneumoniae R6
cugucccaucauuucuucaaca

SEQ ID NO: 4099556 - RNA, 18 nt, Streptococcus pneumoniae R6
cuguccucaaaaugaaaa

SEQ ID NO: 4099557 - RNA, 21 nt, Streptococcus pneumoniae R6
cuguccuuaucgauuuguccu

SEQ ID NO: 4099558 - RNA, 14 nt, Streptococcus pneumoniae R6
cuguccuucuuuua

SEQ ID NO: 4099559 - RNA, 20 nt, Streptococcus pneumoniae R6
cuguccuucuuuuacuucuu

SEQ ID NO: 4099560 - RNA, 18 nt, Streptococcus pneumoniae R6
cugucgcaccugacucca

SEQ ID NO: 4099561 - RNA, 19 nt, Streptococcus pneumoniae R6
cugucggcaugcugacaaa

SEQ ID NO: 4099562 - RNA, 16 nt, Streptococcus pneumoniae R6
cugucguaccuaaaaa

SEQ ID NO: 4099563 - RNA, 14 nt, Streptococcus pneumoniae R6
cugucguagucuag

SEQ ID NO: 4099564 - RNA, 16 nt, Streptococcus pneumoniae R6
cugucuaguguuguca

SEQ ID NO: 4099565 - RNA, 19 nt, Streptococcus pneumoniae R6
cugucuauuugcuuuucuu

SEQ ID NO: 4099566 - RNA, 15 nt, Streptococcus pneumoniae R6
cugucucaggucuag

SEQ ID NO: 4099567 - RNA, 17 nt, Streptococcus pneumoniae R6
cugucucaggucuagca

SEQ ID NO: 4099568 - RNA, 19 nt, Streptococcus pneumoniae R6
cugucugcugacugauuua

SEQ ID NO: 4099569 - RNA, 16 nt, Streptococcus pneumoniae R6
cugucuuauccaaacu

SEQ ID NO: 4099570 - RNA, 12 nt, Streptococcus pneumoniae R6
cugucuuuauua

SEQ ID NO: 4099571 - RNA, 14 nt, Streptococcus pneumoniae R6
cugugacuagcaau

SEQ ID NO: 4099572 - RNA, 13 nt, Streptococcus pneumoniae R6
cugugaguucauu

SEQ ID NO: 4099573 - RNA, 21 nt, Streptococcus pneumoniae R6
cugugauaaugguugggaagg

SEQ ID NO: 4099574 - RNA, 17 nt, Streptococcus pneumoniae R6
cugugcaauacagaacu

SEQ ID NO: 4099575 - RNA, 14 nt, Streptococcus pneumoniae R6
cugugccagccaua

SEQ ID NO: 4099576 - RNA, 15 nt, Streptococcus pneumoniae R6
cugugcuugugauca

SEQ ID NO: 4099577 - RNA, 15 nt, Streptococcus pneumoniae R6
cugugcuuuuucaau

SEQ ID NO: 4099578 - RNA, 19 nt, Streptococcus pneumoniae R6
cuguggauacuugcuugua

SEQ ID NO: 4099579 - RNA, 20 nt, Streptococcus pneumoniae R6
cuguguacuguucuaaauuc

SEQ ID NO: 4099580 - RNA, 21 nt, Streptococcus pneumoniae R6
cugugucaaauugacucucac

SEQ ID NO: 4099581 - RNA, 19 nt, Streptococcus pneumoniae R6
cugugugugggcuuuuuuc

SEQ ID NO: 4099582 - RNA, 17 nt, Streptococcus pneumoniae R6
cuguguuccucuuuuug

SEQ ID NO: 4099583 - RNA, 12 nt, Streptococcus pneumoniae R6
cuguuaaaaaau

SEQ ID NO: 4099584 - RNA, 15 nt, Streptococcus pneumoniae R6
cuguuaaaaacucag

SEQ ID NO: 4099585 - RNA, 14 nt, Streptococcus pneumoniae R6
cuguuaauaacucu

SEQ ID NO: 4099586 - RNA, 17 nt, Streptococcus pneumoniae R6
cuguuaauaacucucau

SEQ ID NO: 4099587 - RNA, 15 nt, Streptococcus pneumoniae R6
cuguuccaaagaagu

SEQ ID NO: 4099588 - RNA, 14 nt, Streptococcus pneumoniae R6
cuguuccaccaccu

SEQ ID NO: 4099589 - RNA, 21 nt, Streptococcus pneumoniae R6
cuguucgcaagauagaaccca

SEQ ID NO: 4099590 - RNA, 16 nt, Streptococcus pneumoniae R6
cuguucuuguuucaau

SEQ ID NO: 4099591 - RNA, 18 nt, Streptococcus pneumoniae R6
cuguuggauauaaggauu

SEQ ID NO: 4099592 - RNA, 11 nt, Streptococcus pneumoniae R6
cuguuguauuu

SEQ ID NO: 4099593 - RNA, 16 nt, Streptococcus pneumoniae R6
cuguuucaaaugaaau

SEQ ID NO: 4099594 - RNA, 20 nt, Streptococcus pneumoniae R6
cuguuucaaaugaaauauuu

SEQ ID NO: 4099595 - RNA, 12 nt, Streptococcus pneumoniae R6
cuguuucagaga

SEQ ID NO: 4099596 - RNA, 17 nt, Streptococcus pneumoniae R6
cuguuuggucagacugg

SEQ ID NO: 4099597 - RNA, 15 nt, Streptococcus pneumoniae R6
cuguuuguguuucug

SEQ ID NO: 4099598 - RNA, 16 nt, Streptococcus pneumoniae R6
cuguuuucaaaaagca

SEQ ID NO: 4099599 - RNA, 17 nt, Streptococcus pneumoniae R6
cuguuuucaaaaagcau

SEQ ID NO: 4099600 - RNA, 12 nt, Streptococcus pneumoniae R6
cuguuuuccuuu

SEQ ID NO: 4099601 - RNA, 20 nt, Streptococcus pneumoniae R6
cuguuuuggcaacgacagga

SEQ ID NO: 4099602 - RNA, 17 nt, Streptococcus pneumoniae R6
cuguuuuguugacuugu

SEQ ID NO: 4099603 - RNA, 18 nt, Streptococcus pneumoniae R6
cuguuuuuggauuuuguu

SEQ ID NO: 4099604 - RNA, 12 nt, Streptococcus pneumoniae R6
cuguuuuuucaa

SEQ ID NO: 4099605 - RNA, 15 nt, Streptococcus pneumoniae R6
cuguuuuuucuuauc

SEQ ID NO: 4099606 - RNA, 14 nt, Streptococcus pneumoniae R6
cuuaaaaaaccaau

SEQ ID NO: 4099607 - RNA, 15 nt, Streptococcus pneumoniae R6
cuuaaaaaaguccaa

SEQ ID NO: 4099608 - RNA, 14 nt, Streptococcus pneumoniae R6
cuuaaaacaguguu

SEQ ID NO: 4099609 - RNA, 20 nt, Streptococcus pneumoniae R6
cuuaaaacaguguuuugagc

SEQ ID NO: 4099610 - RNA, 12 nt, Streptococcus pneumoniae R6
cuuaaaaccaug

SEQ ID NO: 4099611 - RNA, 17 nt, Streptococcus pneumoniae R6
cuuaaaagcaaaagaac

SEQ ID NO: 4099612 - RNA, 20 nt, Streptococcus pneumoniae R6
cuuaaaagcucgauacucua

SEQ ID NO: 4099613 - RNA, 23 nt, Streptococcus pneumoniae R6
cuuaaaauaauuuuuuucagaaa

SEQ ID NO: 4099614 - RNA, 20 nt, Streptococcus pneumoniae R6
cuuaaaauccagucccuuuu

SEQ ID NO: 4099615 - RNA, 17 nt, Streptococcus pneumoniae R6
cuuaaagccacuauaau

SEQ ID NO: 4099616 - RNA, 19 nt, Streptococcus pneumoniae R6
cuuaaagugggaacuagag

SEQ ID NO: 4099617 - RNA, 12 nt, Streptococcus pneumoniae R6
cuuaaaguuauu

SEQ ID NO: 4099618 - RNA, 13 nt, Streptococcus pneumoniae R6
cuuaaauaaaauu

SEQ ID NO: 4099619 - RNA, 18 nt, Streptococcus pneumoniae R6
cuuaaauaaaauuuuuuu

SEQ ID NO: 4099620 - RNA, 21 nt, Streptococcus pneumoniae R6
cuuaaauaaaauuuuuuucaa

SEQ ID NO: 4099621 - RNA, 20 nt, Streptococcus pneumoniae R6
cuuaaauaggccucuucaaa

SEQ ID NO: 4099622 - RNA, 22 nt, Streptococcus pneumoniae R6
cuuaaauugguguuguuuauua

SEQ ID NO: 4099623 - RNA, 12 nt, Streptococcus pneumoniae R6
cuuaacaaaagc

SEQ ID NO: 4099624 - RNA, 21 nt, Streptococcus pneumoniae R6
cuuaacaaaauuauuaaaauc

SEQ ID NO: 4099625 - RNA, 22 nt, Streptococcus pneumoniae R6
cuuaacaaaauuauuaaaauca

SEQ ID NO: 4099626 - RNA, 18 nt, Streptococcus pneumoniae R6
cuuaagugcguugauaau

SEQ ID NO: 4099627 - RNA, 22 nt, Streptococcus pneumoniae R6
cuuaauagugggaauuuguaaa

SEQ ID NO: 4099628 - RNA, 18 nt, Streptococcus pneumoniae R6
cuuaauucucuuguuguu

SEQ ID NO: 4099629 - RNA, 23 nt, Streptococcus pneumoniae R6
cuuaauucucuuguuguuguaau

SEQ ID NO: 4099630 - RNA, 14 nt, Streptococcus pneumoniae R6
cuuaauucuucaua

SEQ ID NO: 4099631 - RNA, 23 nt, Streptococcus pneumoniae R6
cuuaauucuucauagaguugcag

SEQ ID NO: 4099632 - RNA, 16 nt, Streptococcus pneumoniae R6
cuuaauuguagcuuua

SEQ ID NO: 4099633 - RNA, 20 nt, Streptococcus pneumoniae R6
cuuaauuuaaugcaguaaau

SEQ ID NO: 4099634 - RNA, 15 nt, Streptococcus pneumoniae R6
cuucauagucaaaac

SEQ ID NO: 4099635 - RNA, 22 nt, Streptococcus pneumoniae R6
cuucauauacacuaaacaaaug

SEQ ID NO: 4099636 - RNA, 20 nt, Streptococcus pneumoniae R6
cuucauaucaaucucugcaa

SEQ ID NO: 4099637 - RNA, 18 nt, Streptococcus pneumoniae R6
cuucaucaaaugacuaac

SEQ ID NO: 4099638 - RNA, 17 nt, Streptococcus pneumoniae R6
cuucaucauuuuauuca

SEQ ID NO: 4099639 - RNA, 20 nt, Streptococcus pneumoniae R6
cuucaucauuuuauucauau

SEQ ID NO: 4099640 - RNA, 18 nt, Streptococcus pneumoniae R6
cuucaucccaguggcuaa

SEQ ID NO: 4099641 - RNA, 22 nt, Streptococcus pneumoniae R6
cuucaucgcccaauuuauguaa

SEQ ID NO: 4099642 - RNA, 14 nt, Streptococcus pneumoniae R6
cuucaucuccuguc

SEQ ID NO: 4099643 - RNA, 17 nt, Streptococcus pneumoniae R6
cuucaucuccugucaau

SEQ ID NO: 4099644 - RNA, 20 nt, Streptococcus pneumoniae R6
cuucaucuccugucaauucc

SEQ ID NO: 4099645 - RNA, 18 nt, Streptococcus pneumoniae R6
cuucaucucuuacaguuu

SEQ ID NO: 4099646 - RNA, 15 nt, Streptococcus pneumoniae R6
cuucaucugguguga

SEQ ID NO: 4099647 - RNA, 16 nt, Streptococcus pneumoniae R6
cuucaugaaauuauuu

SEQ ID NO: 4099648 - RNA, 19 nt, Streptococcus pneumoniae R6
cuucaugaaauuauuucac

SEQ ID NO: 4099649 - RNA, 14 nt, Streptococcus pneumoniae R6
cuucaugcuggcag

SEQ ID NO: 4099650 - RNA, 21 nt, Streptococcus pneumoniae R6
cuucaugcuggcagaaacugu

SEQ ID NO: 4099651 - RNA, 16 nt, Streptococcus pneumoniae R6
cuucauggaucauuuc

SEQ ID NO: 4099652 - RNA, 14 nt, Streptococcus pneumoniae R6
cuucauguuuuccu

SEQ ID NO: 4099653 - RNA, 16 nt, Streptococcus pneumoniae R6
cuucauuauagaccuu

SEQ ID NO: 4099654 - RNA, 13 nt, Streptococcus pneumoniae R6
cuucauuauguga

SEQ ID NO: 4099655 - RNA, 15 nt, Streptococcus pneumoniae R6
cuucauuuagaacac

SEQ ID NO: 4099656 - RNA, 23 nt, Streptococcus pneumoniae R6
cuucauuuugcacaauauagccu

SEQ ID NO: 4099657 - RNA, 17 nt, Streptococcus pneumoniae R6
cuucauuuugguaauuu

SEQ ID NO: 4099658 - RNA, 12 nt, Streptococcus pneumoniae R6
cuucauuuuguu

SEQ ID NO: 4099659 - RNA, 11 nt, Streptococcus pneumoniae R6
cuucauuuuug

SEQ ID NO: 4099660 - RNA, 14 nt, Streptococcus pneumoniae R6
cuucauuuuugccu

SEQ ID NO: 4099661 - RNA, 22 nt, Streptococcus pneumoniae R6
cuuccaaaauuaaaauguucug

SEQ ID NO: 4099662 - RNA, 22 nt, Streptococcus pneumoniae R6
cuuccaaagguugcuugauagu

SEQ ID NO: 4099663 - RNA, 12 nt, Streptococcus pneumoniae R6
cuuccaagaccu

SEQ ID NO: 4099664 - RNA, 14 nt, Streptococcus pneumoniae R6
cuuccaagagaccu

SEQ ID NO: 4099665 - RNA, 17 nt, Streptococcus pneumoniae R6
cuuccaagagaccuuuc

SEQ ID NO: 4099666 - RNA, 21 nt, Streptococcus pneumoniae R6
cuuccaagucguaagucuucg

SEQ ID NO: 4099667 - RNA, 12 nt, Streptococcus pneumoniae R6
cuuccaaucuca

SEQ ID NO: 4099668 - RNA, 16 nt, Streptococcus pneumoniae R6
cuuccaauuucuuuuc

SEQ ID NO: 4099669 - RNA, 18 nt, Streptococcus pneumoniae R6
cuuccaauuuuugcguug

SEQ ID NO: 4099670 - RNA, 13 nt, Streptococcus pneumoniae R6
cuuccacuuccag

SEQ ID NO: 4099671 - RNA, 17 nt, Streptococcus pneumoniae R6
cuuccaggaauguccuu

SEQ ID NO: 4099672 - RNA, 14 nt, Streptococcus pneumoniae R6
cuuccaucuucuca

SEQ ID NO: 4099673 - RNA, 15 nt, Streptococcus pneumoniae R6
cuuccauuucuuuug

SEQ ID NO: 4099674 - RNA, 20 nt, Streptococcus pneumoniae R6
cuucccaaguaguaguuuca

SEQ ID NO: 4099675 - RNA, 16 nt, Streptococcus pneumoniae R6
cuucccacaauaaaaa

SEQ ID NO: 4099676 - RNA, 16 nt, Streptococcus pneumoniae R6
cuucccauuuaggcua

SEQ ID NO: 4099677 - RNA, 15 nt, Streptococcus pneumoniae R6
cuucccucucagauu

SEQ ID NO: 4099678 - RNA, 23 nt, Streptococcus pneumoniae R6
cuuccgaaacuagcauccauccc

SEQ ID NO: 4099679 - RNA, 19 nt, Streptococcus pneumoniae R6
cuuccgaauaacucaaaag

SEQ ID NO: 4099680 - RNA, 19 nt, Streptococcus pneumoniae R6
cuuccgaauagcucaaaag

SEQ ID NO: 4099681 - RNA, 18 nt, Streptococcus pneumoniae R6
cuuccgaggucaucauua

SEQ ID NO: 4099682 - RNA, 14 nt, Streptococcus pneumoniae R6
cuuccgcaauccac

SEQ ID NO: 4099683 - RNA, 21 nt, Streptococcus pneumoniae R6
cuuccgcaauccacccccaag

SEQ ID NO: 4099684 - RNA, 14 nt, Streptococcus pneumoniae R6
cuuccgccaucuug

SEQ ID NO: 4099685 - RNA, 16 nt, Streptococcus pneumoniae R6
cuuccuaccuauucac

SEQ ID NO: 4099686 - RNA, 17 nt, Streptococcus pneumoniae R6
cuuccucaacaaaaugu

SEQ ID NO: 4099687 - RNA, 13 nt, Streptococcus pneumoniae R6
cuuccuccugcca

SEQ ID NO: 4099688 - RNA, 14 nt, Streptococcus pneumoniae R6
cuuccugcaaaacu

SEQ ID NO: 4099689 - RNA, 16 nt, Streptococcus pneumoniae R6
cuuccugcaaaacuag

SEQ ID NO: 4099690 - RNA, 22 nt, Streptococcus pneumoniae R6
cuuccuugccuucaaucuuuug

SEQ ID NO: 4099691 - RNA, 15 nt, Streptococcus pneumoniae R6
cuuccuuuucuacug

SEQ ID NO: 4099692 - RNA, 23 nt, Streptococcus pneumoniae R6
cuucgaaaaucucuucaaaccac

SEQ ID NO: 4099693 - RNA, 16 nt, Streptococcus pneumoniae R6
cuucgcuuucuucauu

SEQ ID NO: 4099694 - RNA, 18 nt, Streptococcus pneumoniae R6
cuucgcuuucuucauuuu

SEQ ID NO: 4099695 - RNA, 16 nt, Streptococcus pneumoniae R6
cuucgguuaggaugua

SEQ ID NO: 4099696 - RNA, 17 nt, Streptococcus pneumoniae R6
cuucguaagauucuucu

SEQ ID NO: 4099697 - RNA, 13 nt, Streptococcus pneumoniae R6
cuucgucaauaau

SEQ ID NO: 4099698 - RNA, 23 nt, Streptococcus pneumoniae R6
cuucgucaauaauagcuugcaau

SEQ ID NO: 4099699 - RNA, 20 nt, Streptococcus pneumoniae R6
cuucgucaguuccaucuaca

SEQ ID NO: 4099700 - RNA, 16 nt, Streptococcus pneumoniae R6
cuucgucaguucuauc

SEQ ID NO: 4099701 - RNA, 18 nt, Streptococcus pneumoniae R6
cuucgucaguucuaucca

SEQ ID NO: 4099702 - RNA, 19 nt, Streptococcus pneumoniae R6
cuucgucaguucuauccac

SEQ ID NO: 4099703 - RNA, 15 nt, Streptococcus pneumoniae R6
cuucgucaguuucau

SEQ ID NO: 4099704 - RNA, 19 nt, Streptococcus pneumoniae R6
cuucgucaguuucauccac

SEQ ID NO: 4099705 - RNA, 20 nt, Streptococcus pneumoniae R6
cuucgucaguuucauccaca

SEQ ID NO: 4099706 - RNA, 20 nt, Streptococcus pneumoniae R6
cuucgucauuuaaagauguc

SEQ ID NO: 4099707 - RNA, 20 nt, Streptococcus pneumoniae R6
cuucgucguaaccuucuucu

SEQ ID NO: 4099708 - RNA, 22 nt, Streptococcus pneumoniae R6
cuucgucuggauugaccaagcu

SEQ ID NO: 4099709 - RNA, 18 nt, Streptococcus pneumoniae R6
cuucguguuccaaagcca

SEQ ID NO: 4099710 - RNA, 15 nt, Streptococcus pneumoniae R6
cuucguucacccuug

SEQ ID NO: 4099711 - RNA, 15 nt, Streptococcus pneumoniae R6
cuucguuuucacaau

SEQ ID NO: 4099712 - RNA, 13 nt, Streptococcus pneumoniae R6
cuucuaaaacauu

SEQ ID NO: 4099713 - RNA, 19 nt, Streptococcus pneumoniae R6
cuucuaaaacauucuuaca

SEQ ID NO: 4099714 - RNA, 16 nt, Streptococcus pneumoniae R6
cuucuaaaacauuguu

SEQ ID NO: 4099715 - RNA, 16 nt, Streptococcus pneumoniae R6
cuucuaaauuaacuag

SEQ ID NO: 4099716 - RNA, 15 nt, Streptococcus pneumoniae R6
cuucuaaggaaaaag

SEQ ID NO: 4099717 - RNA, 21 nt, Streptococcus pneumoniae R6
cuucuacaacgucuuuugccu

SEQ ID NO: 4099718 - RNA, 20 nt, Streptococcus pneumoniae R6
cuucuacagcaccuuuugcg

SEQ ID NO: 4099719 - RNA, 15 nt, Streptococcus pneumoniae R6
cuucuagcuucauau

SEQ ID NO: 4099720 - RNA, 22 nt, Streptococcus pneumoniae R6
cuucuagcuucauaucaaucuc

SEQ ID NO: 4099721 - RNA, 14 nt, Streptococcus pneumoniae R6
cuucuaucuucuug

SEQ ID NO: 4099722 - RNA, 18 nt, Streptococcus pneumoniae R6
cuucucaggcuuuuucug

SEQ ID NO: 4099723 - RNA, 22 nt, Streptococcus pneumoniae R6
cuucucaggcuuuuucuguacu

SEQ ID NO: 4099724 - RNA, 23 nt, Streptococcus pneumoniae R6
cuucuccuaaaauugacuuucuu

SEQ ID NO: 4099725 - RNA, 16 nt, Streptococcus pneumoniae R6
cuucucggacuuuuuc

SEQ ID NO: 4099726 - RNA, 23 nt, Streptococcus pneumoniae R6
cuucucggacuuuuuccaaaucu

SEQ ID NO: 4099727 - RNA, 22 nt, Streptococcus pneumoniae R6
cuucugcaguugugucuucguc

SEQ ID NO: 4099728 - RNA, 21 nt, Streptococcus pneumoniae R6
cuucugcuugcaucaaaucac

SEQ ID NO: 4099729 - RNA, 13 nt, Streptococcus pneumoniae R6
cuucugggagaaa

SEQ ID NO: 4099730 - RNA, 16 nt, Streptococcus pneumoniae R6
cuucuguaagucauuu

SEQ ID NO: 4099731 - RNA, 23 nt, Streptococcus pneumoniae R6
cuucuguaagucauuuucuuuua

SEQ ID NO: 4099732 - RNA, 17 nt, Streptococcus pneumoniae R6
cuucuguacauuagaau

SEQ ID NO: 4099733 - RNA, 19 nt, Streptococcus pneumoniae R6
cuucugucuauuugcuuuu

SEQ ID NO: 4099734 - RNA, 20 nt, Streptococcus pneumoniae R6
cuucugucuauuugcuuuuc

SEQ ID NO: 4099735 - RNA, 20 nt, Streptococcus pneumoniae R6
cuucugugauauaaucuuua

SEQ ID NO: 4099736 - RNA, 18 nt, Streptococcus pneumoniae R6
cuuggcagaaagguaagg

SEQ ID NO: 4099737 - RNA, 22 nt, Streptococcus pneumoniae R6
cuuggcauccaguaaaaacugu

SEQ ID NO: 4099738 - RNA, 15 nt, Streptococcus pneumoniae R6
cuuggccaauucuaa

SEQ ID NO: 4099739 - RNA, 16 nt, Streptococcus pneumoniae R6
cuuggccacuucccaa

SEQ ID NO: 4099740 - RNA, 13 nt, Streptococcus pneumoniae R6
cuuggcuaauuuc

SEQ ID NO: 4099741 - RNA, 15 nt, Streptococcus pneumoniae R6
cuuggcuaguucagc

SEQ ID NO: 4099742 - RNA, 23 nt, Streptococcus pneumoniae R6
cuuggggaacauuugaaacgaua

SEQ ID NO: 4099743 - RNA, 13 nt, Streptococcus pneumoniae R6
cuuggucaacaua

SEQ ID NO: 4099744 - RNA, 13 nt, Streptococcus pneumoniae R6
cuuggugagaaag

SEQ ID NO: 4099745 - RNA, 16 nt, Streptococcus pneumoniae R6
cuugguguugagaaag

SEQ ID NO: 4099746 - RNA, 17 nt, Streptococcus pneumoniae R6
cuuguaaagacuagaaa

SEQ ID NO: 4099747 - RNA, 20 nt, Streptococcus pneumoniae R6
cuuguaaagcgaaaggagaa

SEQ ID NO: 4099748 - RNA, 21 nt, Streptococcus pneumoniae R6
cuuguaaccgauauuuccugc

SEQ ID NO: 4099749 - RNA, 15 nt, Streptococcus pneumoniae R6
cuuguaagucaaguc

SEQ ID NO: 4099750 - RNA, 22 nt, Streptococcus pneumoniae R6
cuuguaaugacaauuauauaaa

SEQ ID NO: 4099751 - RNA, 13 nt, Streptococcus pneumoniae R6
cuuguaggcuucu

SEQ ID NO: 4099752 - RNA, 23 nt, Streptococcus pneumoniae R6
cuuguauccaaucucuugaacau

SEQ ID NO: 4099753 - RNA, 17 nt, Streptococcus pneumoniae R6
cuuguaugacaucuugg

SEQ ID NO: 4099754 - RNA, 21 nt, Streptococcus pneumoniae R6
cuugucaucuuccaagaccug

SEQ ID NO: 4099755 - RNA, 16 nt, Streptococcus pneumoniae R6
cuuguccguuuucauc

SEQ ID NO: 4099756 - RNA, 16 nt, Streptococcus pneumoniae R6
cuugucgauauaagaa

SEQ ID NO: 4099757 - RNA, 22 nt, Streptococcus pneumoniae R6
cuugucgucauaccaguuuuug

SEQ ID NO: 4099758 - RNA, 19 nt, Streptococcus pneumoniae R6
cuugucguugaaaaaguga

SEQ ID NO: 4099759 - RNA, 14 nt, Streptococcus pneumoniae R6
cuugucuaaaaaua

SEQ ID NO: 4099760 - RNA, 17 nt, Streptococcus pneumoniae R6
cuugucuacauucuuuu

SEQ ID NO: 4099761 - RNA, 22 nt, Streptococcus pneumoniae R6
cuugucuuuuucaucuuuuucg

SEQ ID NO: 4099762 - RNA, 17 nt, Streptococcus pneumoniae R6
cuuguguuuuuccuuug

SEQ ID NO: 4099763 - RNA, 18 nt, Streptococcus pneumoniae R6
cuuguuccaagaugaguu

SEQ ID NO: 4099764 - RNA, 19 nt, Streptococcus pneumoniae R6
cuuguuccaauuuguuuuc

SEQ ID NO: 4099765 - RNA, 20 nt, Streptococcus pneumoniae R6
cuuguucugccuauuuuuuc

SEQ ID NO: 4099766 - RNA, 15 nt, Streptococcus pneumoniae R6
cuuguucuucugcug

SEQ ID NO: 4099767 - RNA, 20 nt, Streptococcus pneumoniae R6
cuuguugaaugagcuuccag

SEQ ID NO: 4099768 - RNA, 20 nt, Streptococcus pneumoniae R6
cuuguugagcauacugcccu

SEQ ID NO: 4099769 - RNA, 18 nt, Streptococcus pneumoniae R6
cuuguuuaaaaucucuuu

SEQ ID NO: 4099770 - RNA, 18 nt, Streptococcus pneumoniae R6
cuuguuuaagagcacaaa

SEQ ID NO: 4099771 - RNA, 14 nt, Streptococcus pneumoniae R6
cuuguuucaauuga

SEQ ID NO: 4099772 - RNA, 16 nt, Streptococcus pneumoniae R6
cuuguuuccaaggaaa

SEQ ID NO: 4099773 - RNA, 18 nt, Streptococcus pneumoniae R6
cuuguuucuaaaacauug

SEQ ID NO: 4099774 - RNA, 22 nt, Streptococcus pneumoniae R6
cuuguuucuaaaacauugugag

SEQ ID NO: 4099775 - RNA, 16 nt, Streptococcus pneumoniae R6
cuuguuuucuuaucuu

SEQ ID NO: 4099776 - RNA, 15 nt, Streptococcus pneumoniae R6
cuuguuuuuauauga

SEQ ID NO: 4099777 - RNA, 11 nt, Streptococcus pneumoniae R6
cuuguuuuuua

SEQ ID NO: 4099778 - RNA, 21 nt, Streptococcus pneumoniae R6
cuuuaaaacuaaagcuuuuuu

SEQ ID NO: 4099779 - RNA, 16 nt, Streptococcus pneumoniae R6
cuuuaaaaucugaaaa

SEQ ID NO: 4099780 - RNA, 16 nt, Streptococcus pneumoniae R6
cuuuaaaaugaauucu

SEQ ID NO: 4099781 - RNA, 16 nt, Streptococcus pneumoniae R6
cuuuaaaauuauaaaa

SEQ ID NO: 4099782 - RNA, 23 nt, Streptococcus pneumoniae R6
cuuuaaacauacugaacucaacu

SEQ ID NO: 4099783 - RNA, 20 nt, Streptococcus pneumoniae R6
cuuuaaacuuuucuaagaug

SEQ ID NO: 4099784 - RNA, 16 nt, Streptococcus pneumoniae R6
cuuuaacaucagaaaa

SEQ ID NO: 4099785 - RNA, 20 nt, Streptococcus pneumoniae R6
cuuuaagagaguuacggguu

SEQ ID NO: 4099786 - RNA, 16 nt, Streptococcus pneumoniae R6
cuuuaaggcacuagcu

SEQ ID NO: 4099787 - RNA, 16 nt, Streptococcus pneumoniae R6
cuuuaagguacuugau

SEQ ID NO: 4099788 - RNA, 13 nt, Streptococcus pneumoniae R6
cuuuaaucuugac

SEQ ID NO: 4099789 - RNA, 18 nt, Streptococcus pneumoniae R6
cuuuaaucuugacuauau

SEQ ID NO: 4099790 - RNA, 22 nt, Streptococcus pneumoniae R6
cuuuaccagggauauagauacc

SEQ ID NO: 4099791 - RNA, 14 nt, Streptococcus pneumoniae R6
cuuuaccauccuga

SEQ ID NO: 4099792 - RNA, 19 nt, Streptococcus pneumoniae R6
cuuuacuaguucucaaauu

SEQ ID NO: 4099793 - RNA, 11 nt, Streptococcus pneumoniae R6
cuuuacuucug

SEQ ID NO: 4099794 - RNA, 13 nt, Streptococcus pneumoniae R6
cuuuacuuguuuu

SEQ ID NO: 4099795 - RNA, 20 nt, Streptococcus pneumoniae R6
cuuuagaaaacuaguuuaaa

SEQ ID NO: 4099796 - RNA, 18 nt, Streptococcus pneumoniae R6
cuuuagaaagguuuuaaa

SEQ ID NO: 4099797 - RNA, 20 nt, Streptococcus pneumoniae R6
cuuuagaaagguuuuaaaga

SEQ ID NO: 4099798 - RNA, 22 nt, Streptococcus pneumoniae R6
cuuuagaaagguuuuaaagaca

SEQ ID NO: 4099799 - RNA, 21 nt, Streptococcus pneumoniae R6
cuuuagaacuugcuccaaagg

SEQ ID NO: 4099800 - RNA, 16 nt, Streptococcus pneumoniae R6
cuuuagauacaccauc

SEQ ID NO: 4099801 - RNA, 18 nt, Streptococcus pneumoniae R6
cuuuagauuguccucaau

SEQ ID NO: 4099802 - RNA, 17 nt, Streptococcus pneumoniae R6
cuuuagcaaucuuaucc

SEQ ID NO: 4099803 - RNA, 15 nt, Streptococcus pneumoniae R6
cuuuagcagcuuuca

SEQ ID NO: 4099804 - RNA, 18 nt, Streptococcus pneumoniae R6
cuuuagggaaauuauuua

SEQ ID NO: 4099805 - RNA, 19 nt, Streptococcus pneumoniae R6
cuuuagggaaauuauuuau

SEQ ID NO: 4099806 - RNA, 13 nt, Streptococcus pneumoniae R6
cuuuauauaaaaa

SEQ ID NO: 4099807 - RNA, 20 nt, Streptococcus pneumoniae R6
cuuuauauaaaaagaccgga

SEQ ID NO: 4099808 - RNA, 18 nt, Streptococcus pneumoniae R6
cuuuaucaagcaaaucaa

SEQ ID NO: 4099809 - RNA, 23 nt, Streptococcus pneumoniae R6
cuuuauguucaucuucuuucucc

SEQ ID NO: 4099810 - RNA, 18 nt, Streptococcus pneumoniae R6
cuuuauuggcugccacac

SEQ ID NO: 4099811 - RNA, 16 nt, Streptococcus pneumoniae R6
cuuuauuuucucauca

SEQ ID NO: 4099812 - RNA, 14 nt, Streptococcus pneumoniae R6
cuuuauuuuuucug

SEQ ID NO: 4099813 - RNA, 15 nt, Streptococcus pneumoniae R6
cuuucaaaccagcac

SEQ ID NO: 4099814 - RNA, 19 nt, Streptococcus pneumoniae R6
cuuucaaaccagcaccaga

SEQ ID NO: 4099815 - RNA, 14 nt, Streptococcus pneumoniae R6
cuuucaaaccgcca

SEQ ID NO: 4099816 - RNA, 11 nt, Streptococcus pneumoniae R6
cuuucaacugc

SEQ ID NO: 4099817 - RNA, 20 nt, Streptococcus pneumoniae R6
cuuucaagcgaacaucucca

SEQ ID NO: 4099818 - RNA, 21 nt, Streptococcus pneumoniae R6
cuuucaagcgaacaucuccaa

SEQ ID NO: 4099819 - RNA, 15 nt, Streptococcus pneumoniae R6
cuuucaauucuucac

SEQ ID NO: 4099820 - RNA, 18 nt, Streptococcus pneumoniae R6
cuuucaauuguuuauaaa

SEQ ID NO: 4099821 - RNA, 19 nt, Streptococcus pneumoniae R6
cuuucaauuguuuauaaaa

SEQ ID NO: 4099822 - RNA, 16 nt, Streptococcus pneumoniae R6
cuuucacaaauuugaa

SEQ ID NO: 4099823 - RNA, 16 nt, Streptococcus pneumoniae R6
cuuucaccgccugcuc

SEQ ID NO: 4099824 - RNA, 15 nt, Streptococcus pneumoniae R6
cuuucauaaaguuuu

SEQ ID NO: 4099825 - RNA, 14 nt, Streptococcus pneumoniae R6
cuuuccaagaaucc

SEQ ID NO: 4099826 - RNA, 19 nt, Streptococcus pneumoniae R6
cuuuccaauauguucuaaa

SEQ ID NO: 4099827 - RNA, 16 nt, Streptococcus pneumoniae R6
cuuuccuccgauaauu

SEQ ID NO: 4099828 - RNA, 18 nt, Streptococcus pneumoniae R6
cuuuccuccgauaauuau

SEQ ID NO: 4099829 - RNA, 19 nt, Streptococcus pneumoniae R6
cuuuccuccgauaauuauu

SEQ ID NO: 4099830 - RNA, 15 nt, Streptococcus pneumoniae R6
cuuucgaagucugau

SEQ ID NO: 4099831 - RNA, 16 nt, Streptococcus pneumoniae R6
cuuucguuccagacuc

SEQ ID NO: 4099832 - RNA, 16 nt, Streptococcus pneumoniae R6
cuuucuaaugaguugu

SEQ ID NO: 4099833 - RNA, 19 nt, Streptococcus pneumoniae R6
cuuucuaguuugcuuuuug

SEQ ID NO: 4099834 - RNA, 17 nt, Streptococcus pneumoniae R6
cuuucuaucuucauuuu

SEQ ID NO: 4099835 - RNA, 15 nt, Streptococcus pneumoniae R6
cuuucucaaacauug

SEQ ID NO: 4099836 - RNA, 14 nt, Streptococcus pneumoniae R6
cuuucucgagcuua

SEQ ID NO: 4099837 - RNA, 22 nt, Streptococcus pneumoniae R6
cuuucucgagcuuagcuuuucu

SEQ ID NO: 4099838 - RNA, 19 nt, Streptococcus pneumoniae R6
cuuucucgagguuaacucc

SEQ ID NO: 4099839 - RNA, 13 nt, Streptococcus pneumoniae R6
cuuuuuagccacu

SEQ ID NO: 4099840 - RNA, 15 nt, Streptococcus pneumoniae R6
cuuuuuauaggcucu

SEQ ID NO: 4099841 - RNA, 13 nt, Streptococcus pneumoniae R6
cuuuuuauauaua

SEQ ID NO: 4099842 - RNA, 14 nt, Streptococcus pneumoniae R6
cuuuuuauccaaaa

SEQ ID NO: 4099843 - RNA, 23 nt, Streptococcus pneumoniae R6
cuuuuuauccaaaauaugcucca

SEQ ID NO: 4099844 - RNA, 13 nt, Streptococcus pneumoniae R6
cuuuuucaaaagc

SEQ ID NO: 4099845 - RNA, 16 nt, Streptococcus pneumoniae R6
cuuuuuccaaaucuuu

SEQ ID NO: 4099846 - RNA, 17 nt, Streptococcus pneumoniae R6
cuuuuucucucugaaua

SEQ ID NO: 4099847 - RNA, 20 nt, Streptococcus pneumoniae R6
cuuuuucugauagaagaguc

SEQ ID NO: 4099848 - RNA, 23 nt, Streptococcus pneumoniae R6
cuuuuucuucuucgucaaaucca

SEQ ID NO: 4099849 - RNA, 12 nt, Streptococcus pneumoniae R6
cuuuuucuuuca

SEQ ID NO: 4099850 - RNA, 23 nt, Streptococcus pneumoniae R6
cuuuuugauaacgugcuaauucg

SEQ ID NO: 4099851 - RNA, 21 nt, Streptococcus pneumoniae R6
cuuuuugauaagauaauaaau

SEQ ID NO: 4099852 - RNA, 15 nt, Streptococcus pneumoniae R6
cuuuuugauuuuaaa

SEQ ID NO: 4099853 - RNA, 16 nt, Streptococcus pneumoniae R6
cuuuuugauuuuaaau

SEQ ID NO: 4099854 - RNA, 11 nt, Streptococcus pneumoniae R6
cuuuuugcaac

SEQ ID NO: 4099855 - RNA, 19 nt, Streptococcus pneumoniae R6
cuuuuugcccuuuuugaaa

SEQ ID NO: 4099856 - RNA, 15 nt, Streptococcus pneumoniae R6
cuuuuugcucauaua

SEQ ID NO: 4099857 - RNA, 22 nt, Streptococcus pneumoniae R6
cuuuuuguauuucuucuucuga

SEQ ID NO: 4099858 - RNA, 19 nt, Streptococcus pneumoniae R6
cuuuuuguccuucuucuug

SEQ ID NO: 4099859 - RNA, 16 nt, Streptococcus pneumoniae R6
cuuuuuguuagauuua

SEQ ID NO: 4099860 - RNA, 18 nt, Streptococcus pneumoniae R6
cuuuuuguuuucuauuuc

SEQ ID NO: 4099861 - RNA, 13 nt, Streptococcus pneumoniae R6
cuuuuuuaaaugc

SEQ ID NO: 4099862 - RNA, 23 nt, Streptococcus pneumoniae R6
cuuuuuucuaaagcaauuuugaa

SEQ ID NO: 4099863 - RNA, 19 nt, Streptococcus pneumoniae R6
cuuuuuugauauucagagc

SEQ ID NO: 4099864 - RNA, 19 nt, Streptococcus pneumoniae R6
cuuuuuugauguucaaagu

SEQ ID NO: 4099865 - RNA, 19 nt, Streptococcus pneumoniae R6
cuuuuuuugcuuaaauaaa

SEQ ID NO: 4099866 - RNA, 14 nt, Streptococcus pneumoniae R6
gaaaaaaaguaaau

SEQ ID NO: 4099867 - RNA, 16 nt, Streptococcus pneumoniae R6
gaaaaaaaguuuaaaa

SEQ ID NO: 4099868 - RNA, 20 nt, Streptococcus pneumoniae R6
gaaaaaaauuagaaaaagua

SEQ ID NO: 4099869 - RNA, 22 nt, Streptococcus pneumoniae R6
gaaaaaaauuuuauuuaagcaa

SEQ ID NO: 4099870 - RNA, 18 nt, Streptococcus pneumoniae R6
gaaaaaagcauaguauca

SEQ ID NO: 4099871 - RNA, 19 nt, Streptococcus pneumoniae R6
gaaaaaagucuuuaaaauu

SEQ ID NO: 4099872 - RNA, 12 nt, Streptococcus pneumoniae R6
gaaaaaaucuaa

SEQ ID NO: 4099873 - RNA, 13 nt, Streptococcus pneumoniae R6
gaaaaaaucuaac

SEQ ID NO: 4099874 - RNA, 13 nt, Streptococcus pneumoniae R6
gaaaaacuuacua

SEQ ID NO: 4099875 - RNA, 15 nt, Streptococcus pneumoniae R6
gaaaaacuuacuaca

SEQ ID NO: 4099876 - RNA, 19 nt, Streptococcus pneumoniae R6
gaaaaagaaggauugagaa

SEQ ID NO: 4099877 - RNA, 18 nt, Streptococcus pneumoniae R6
gaaaaagauuuuuuaaaa

SEQ ID NO: 4099878 - RNA, 18 nt, Streptococcus pneumoniae R6
gaaaaagucugaaucaaa

SEQ ID NO: 4099879 - RNA, 21 nt, Streptococcus pneumoniae R6
gaaaaauaggaugaaccugcu

SEQ ID NO: 4099880 - RNA, 13 nt, Streptococcus pneumoniae R6
gaaaaaucuccag

SEQ ID NO: 4099881 - RNA, 19 nt, Streptococcus pneumoniae R6
gaaaaaugacaauaaaaua

SEQ ID NO: 4099882 - RNA, 14 nt, Streptococcus pneumoniae R6
gaaaaauggucacu

SEQ ID NO: 4099883 - RNA, 22 nt, Streptococcus pneumoniae R6
gaaaaauuaacaaucccuucaa

SEQ ID NO: 4099884 - RNA, 14 nt, Streptococcus pneumoniae R6
gaaaaauuucauuu

SEQ ID NO: 4099885 - RNA, 16 nt, Streptococcus pneumoniae R6
gaaaacaacuuauaaa

SEQ ID NO: 4099886 - RNA, 11 nt, Streptococcus pneumoniae R6
gaaaacaauau

SEQ ID NO: 4099887 - RNA, 21 nt, Streptococcus pneumoniae R6
gaaaacaauauuuuugagccu

SEQ ID NO: 4099888 - RNA, 14 nt, Streptococcus pneumoniae R6
gaaaacagaaaaau

SEQ ID NO: 4099889 - RNA, 13 nt, Streptococcus pneumoniae R6
gaaaaccaaaacu

SEQ ID NO: 4099890 - RNA, 11 nt, Streptococcus pneumoniae R6
gaaaaccaaga

SEQ ID NO: 4099891 - RNA, 17 nt, Streptococcus pneumoniae R6
gaaaaccuuguuuuaaa

SEQ ID NO: 4099892 - RNA, 14 nt, Streptococcus pneumoniae R6
gaaaacgauaauag

SEQ ID NO: 4099893 - RNA, 19 nt, Streptococcus pneumoniae R6
gaaaacgccugcuuuuugc

SEQ ID NO: 4099894 - RNA, 21 nt, Streptococcus pneumoniae R6
gaaaacgccugcuuuuugcaa

SEQ ID NO: 4099895 - RNA, 15 nt, Streptococcus pneumoniae R6
gaaaacgguaacaaa

SEQ ID NO: 4099896 - RNA, 21 nt, Streptococcus pneumoniae R6
gaaaacugaugaagucaaguc

SEQ ID NO: 4099897 - RNA, 19 nt, Streptococcus pneumoniae R6
gaaaacuucguacaugaga

SEQ ID NO: 4099898 - RNA, 17 nt, Streptococcus pneumoniae R6
gaaaacuugauauuaug

SEQ ID NO: 4099899 - RNA, 14 nt, Streptococcus pneumoniae R6
gaaaagauggagug

SEQ ID NO: 4099900 - RNA, 21 nt, Streptococcus pneumoniae R6
gaaaagauggaguguucuaaa

SEQ ID NO: 4099901 - RNA, 15 nt, Streptococcus pneumoniae R6
gaaaagcaagagcug

SEQ ID NO: 4099902 - RNA, 16 nt, Streptococcus pneumoniae R6
gaaaagcccuucauaa

SEQ ID NO: 4099903 - RNA, 20 nt, Streptococcus pneumoniae R6
gaaaagcuacaaucuggaga

SEQ ID NO: 4099904 - RNA, 14 nt, Streptococcus pneumoniae R6
gaaaaggaguagaa

SEQ ID NO: 4099905 - RNA, 16 nt, Streptococcus pneumoniae R6
gaaaagucaucuauaa

SEQ ID NO: 4099906 - RNA, 23 nt, Streptococcus pneumoniae R6
gaaaagucaucuauaaucaauau

SEQ ID NO: 4099907 - RNA, 19 nt, Streptococcus pneumoniae R6
gaaaaguuguccgagcagg

SEQ ID NO: 4099908 - RNA, 20 nt, Streptococcus pneumoniae R6
gaaaaguuuuagcuucugua

SEQ ID NO: 4099909 - RNA, 21 nt, Streptococcus pneumoniae R6
gaaaauaaaauuccuuuaaaa

SEQ ID NO: 4099910 - RNA, 16 nt, Streptococcus pneumoniae R6
gaaaauaccaaguuca

SEQ ID NO: 4099911 - RNA, 17 nt, Streptococcus pneumoniae R6
gaaaauacugauaaaaa

SEQ ID NO: 4099912 - RNA, 20 nt, Streptococcus pneumoniae R6
gaaaauauuucgcuuauaaa

SEQ ID NO: 4099913 - RNA, 21 nt, Streptococcus pneumoniae R6
gaaaauauuucgcuuauaaac

SEQ ID NO: 4099914 - RNA, 15 nt, Streptococcus pneumoniae R6
gaaaaucaaagagca

SEQ ID NO: 4099915 - RNA, 13 nt, Streptococcus pneumoniae R6
gaaaaucaaguag

SEQ ID NO: 4099916 - RNA, 13 nt, Streptococcus pneumoniae R6
gaaaaucacucca

SEQ ID NO: 4099917 - RNA, 14 nt, Streptococcus pneumoniae R6
gaaaaucccuccca

SEQ ID NO: 4099918 - RNA, 20 nt, Streptococcus pneumoniae R6
gaaaauccuaguggaaaaga

SEQ ID NO: 4099919 - RNA, 14 nt, Streptococcus pneumoniae R6
gaaaaucguacugu

SEQ ID NO: 4099920 - RNA, 14 nt, Streptococcus pneumoniae R6
gaaaaucucuucaa

SEQ ID NO: 4099921 - RNA, 13 nt, Streptococcus pneumoniae R6
gaaaaugaaagag

SEQ ID NO: 4099922 - RNA, 15 nt, Streptococcus pneumoniae R6
gaaaaugaauuugaa

SEQ ID NO: 4099923 - RNA, 20 nt, Streptococcus pneumoniae R6
gaaaaugaauuugaaacaau

SEQ ID NO: 4099924 - RNA, 18 nt, Streptococcus pneumoniae R6
gaaaaugaggaaaaucuu

SEQ ID NO: 4099925 - RNA, 13 nt, Streptococcus pneumoniae R6
gaaaauggaguaa

SEQ ID NO: 4099926 - RNA, 13 nt, Streptococcus pneumoniae R6
gaaaaugugaaau

SEQ ID NO: 4099927 - RNA, 14 nt, Streptococcus pneumoniae R6
gaaaauucaaauua

SEQ ID NO: 4099928 - RNA, 19 nt, Streptococcus pneumoniae R6
gaaaauucuaaaggcuuaa

SEQ ID NO: 4099929 - RNA, 18 nt, Streptococcus pneumoniae R6
gaaaauugauuuauagaa

SEQ ID NO: 4099930 - RNA, 20 nt, Streptococcus pneumoniae R6
gaaacaaauaaaucauugau

SEQ ID NO: 4099931 - RNA, 17 nt, Streptococcus pneumoniae R6
gaaacaauaaaaucaaa

SEQ ID NO: 4099932 - RNA, 15 nt, Streptococcus pneumoniae R6
gaaacaauugcuaaa

SEQ ID NO: 4099933 - RNA, 19 nt, Streptococcus pneumoniae R6
gaaacaauugcuaaaacau

SEQ ID NO: 4099934 - RNA, 21 nt, Streptococcus pneumoniae R6
gaaacacauuuuuagaaggau

SEQ ID NO: 4099935 - RNA, 20 nt, Streptococcus pneumoniae R6
gaaacaccaccgauagagug

SEQ ID NO: 4099936 - RNA, 20 nt, Streptococcus pneumoniae R6
gaaacagagguggaaaagca

SEQ ID NO: 4099937 - RNA, 23 nt, Streptococcus pneumoniae R6
gaaacagcaagagcugauagugg

SEQ ID NO: 4099938 - RNA, 14 nt, Streptococcus pneumoniae R6
gaaacagcuucagu

SEQ ID NO: 4099939 - RNA, 22 nt, Streptococcus pneumoniae R6
gaaacaugagguugacuggccu

SEQ ID NO: 4099940 - RNA, 14 nt, Streptococcus pneumoniae R6
gaaaccaaucucaa

SEQ ID NO: 4099941 - RNA, 19 nt, Streptococcus pneumoniae R6
gaaaccaaucucaaauccu

SEQ ID NO: 4099942 - RNA, 17 nt, Streptococcus pneumoniae R6
gaaccacaacaaaaaag

SEQ ID NO: 4099943 - RNA, 19 nt, Streptococcus pneumoniae R6
gaaccacaacaaaaaaggu

SEQ ID NO: 4099944 - RNA, 22 nt, Streptococcus pneumoniae R6
gaaccacaacaaaaaaggucau

SEQ ID NO: 4099945 - RNA, 17 nt, Streptococcus pneumoniae R6
gaaccacacuuucauug

SEQ ID NO: 4099946 - RNA, 17 nt, Streptococcus pneumoniae R6
gaaccaggaaaccagcu

SEQ ID NO: 4099947 - RNA, 12 nt, Streptococcus pneumoniae R6
gaaccaucuuca

SEQ ID NO: 4099948 - RNA, 17 nt, Streptococcus pneumoniae R6
gaaccauguccuggaua

SEQ ID NO: 4099949 - RNA, 16 nt, Streptococcus pneumoniae R6
gaaccccaacuuacau

SEQ ID NO: 4099950 - RNA, 20 nt, Streptococcus pneumoniae R6
gaacccgcgcaauuaagcag

SEQ ID NO: 4099951 - RNA, 21 nt, Streptococcus pneumoniae R6
gaacccuuuuuggauaaguuu

SEQ ID NO: 4099952 - RNA, 18 nt, Streptococcus pneumoniae R6
gaaccgccguaugccgaa

SEQ ID NO: 4099953 - RNA, 15 nt, Streptococcus pneumoniae R6
gaaccuacuguuaga

SEQ ID NO: 4099954 - RNA, 15 nt, Streptococcus pneumoniae R6
gaaccucuucauuca

SEQ ID NO: 4099955 - RNA, 19 nt, Streptococcus pneumoniae R6
gaaccucuucauucaaaga

SEQ ID NO: 4099956 - RNA, 16 nt, Streptococcus pneumoniae R6
gaaccugaaaaaauaa

SEQ ID NO: 4099957 - RNA, 12 nt, Streptococcus pneumoniae R6
gaaccuuucuuc

SEQ ID NO: 4099958 - RNA, 17 nt, Streptococcus pneumoniae R6
gaacgaacuccacugaa

SEQ ID NO: 4099959 - RNA, 15 nt, Streptococcus pneumoniae R6
gaacgcugaaggagg

SEQ ID NO: 4099960 - RNA, 23 nt, Streptococcus pneumoniae R6
gaacgugguccacauuaaagaua

SEQ ID NO: 4099961 - RNA, 16 nt, Streptococcus pneumoniae R6
gaacguguucaauagc

SEQ ID NO: 4099962 - RNA, 15 nt, Streptococcus pneumoniae R6
gaacguuuuuaaauc

SEQ ID NO: 4099963 - RNA, 15 nt, Streptococcus pneumoniae R6
gaacuaacgaacaaa

SEQ ID NO: 4099964 - RNA, 13 nt, Streptococcus pneumoniae R6
gaacuaacucauc

SEQ ID NO: 4099965 - RNA, 14 nt, Streptococcus pneumoniae R6
gaacuagagaagcc

SEQ ID NO: 4099966 - RNA, 15 nt, Streptococcus pneumoniae R6
gaacuagagaagcca

SEQ ID NO: 4099967 - RNA, 18 nt, Streptococcus pneumoniae R6
gaacuagagaagccaaga

SEQ ID NO: 4099968 - RNA, 16 nt, Streptococcus pneumoniae R6
gaacuauaaaaucuga

SEQ ID NO: 4099969 - RNA, 18 nt, Streptococcus pneumoniae R6
gaacuauaaaaucugaag

SEQ ID NO: 4099970 - RNA, 15 nt, Streptococcus pneumoniae R6
gaacuauuuuauccc

SEQ ID NO: 4099971 - RNA, 17 nt, Streptococcus pneumoniae R6
gaacuauuuuauuuuuu

SEQ ID NO: 4099972 - RNA, 18 nt, Streptococcus pneumoniae R6
gaacucucggucuuguuu

SEQ ID NO: 4099973 - RNA, 18 nt, Streptococcus pneumoniae R6
gaacucuuuccaacucug

SEQ ID NO: 4099974 - RNA, 20 nt, Streptococcus pneumoniae R6
gaacugcgacguuuucuccu

SEQ ID NO: 4099975 - RNA, 20 nt, Streptococcus pneumoniae R6
gaacuggcguuuuauuuuuu

SEQ ID NO: 4099976 - RNA, 15 nt, Streptococcus pneumoniae R6
gaacuguaaauuuau

SEQ ID NO: 4099977 - RNA, 17 nt, Streptococcus pneumoniae R6
gaacuguaaauuuauug

SEQ ID NO: 4099978 - RNA, 22 nt, Streptococcus pneumoniae R6
gaacuucaauaauuucuuuuug

SEQ ID NO: 4099979 - RNA, 18 nt, Streptococcus pneumoniae R6
gaacuucacguucuucca

SEQ ID NO: 4099980 - RNA, 14 nt, Streptococcus pneumoniae R6
gaacuuccacuucc

SEQ ID NO: 4099981 - RNA, 22 nt, Streptococcus pneumoniae R6
gaacuuccacuuccagaagaua

SEQ ID NO: 4099982 - RNA, 20 nt, Streptococcus pneumoniae R6
gaacuugaccuaaaucacuu

SEQ ID NO: 4099983 - RNA, 13 nt, Streptococcus pneumoniae R6
gaacuuuuucuaa

SEQ ID NO: 4099984 - RNA, 14 nt, Streptococcus pneumoniae R6
gaagaaaagcuaag

SEQ ID NO: 4099985 - RNA, 10 nt, Streptococcus pneumoniae R6
gaagaaagcg

SEQ ID NO: 4099986 - RNA, 21 nt, Streptococcus pneumoniae R6
gaagaaagcgaagaucuagaa

SEQ ID NO: 4099987 - RNA, 14 nt, Streptococcus pneumoniae R6
gaagaaggaagagu

SEQ ID NO: 4099988 - RNA, 19 nt, Streptococcus pneumoniae R6
gaagaaugggauacuaucu

SEQ ID NO: 4099989 - RNA, 18 nt, Streptococcus pneumoniae R6
gaagaauguuuucagcgu

SEQ ID NO: 4099990 - RNA, 18 nt, Streptococcus pneumoniae R6
gaagaauuuaaaaaucua

SEQ ID NO: 4099991 - RNA, 14 nt, Streptococcus pneumoniae R6
gaagacugucaagu

SEQ ID NO: 4099992 - RNA, 16 nt, Streptococcus pneumoniae R6
gaagagcauaggaagu

SEQ ID NO: 4099993 - RNA, 21 nt, Streptococcus pneumoniae R6
gaagagcauaggaaguugagc

SEQ ID NO: 4099994 - RNA, 12 nt, Streptococcus pneumoniae R6
gaagagcuucuu

SEQ ID NO: 4099995 - RNA, 16 nt, Streptococcus pneumoniae R6
gaagagcuucuuucau

SEQ ID NO: 4099996 - RNA, 21 nt, Streptococcus pneumoniae R6
gaagagggcuucuucaacagc

SEQ ID NO: 4099997 - RNA, 22 nt, Streptococcus pneumoniae R6
gaagagggcuucuucaacagcu

SEQ ID NO: 4099998 - RNA, 15 nt, Streptococcus pneumoniae R6
gaagaguauaaaauu

SEQ ID NO: 4099999 - RNA, 22 nt, Streptococcus pneumoniae R6
gaagauaaucgcaagguagaga

SEQ ID NO: 4100000 - RNA, 21 nt, Streptococcus pneumoniae R6
gaagauacugaaucaaaaaga

SEQ ID NO: 4100001 - RNA, 19 nt, Streptococcus pneumoniae R6
gaagauugauaaaggcaga

SEQ ID NO: 4100002 - RNA, 17 nt, Streptococcus pneumoniae R6
gaagauuggucaaucuu

SEQ ID NO: 4100003 - RNA, 15 nt, Streptococcus pneumoniae R6
gaagauuuaguucug

SEQ ID NO: 4100004 - RNA, 16 nt, Streptococcus pneumoniae R6
gaagauuucagaaaua

SEQ ID NO: 4100005 - RNA, 17 nt, Streptococcus pneumoniae R6
gaagcaaacauucccac

SEQ ID NO: 4100006 - RNA, 15 nt, Streptococcus pneumoniae R6
gaagcaagugacaaa

SEQ ID NO: 4100007 - RNA, 21 nt, Streptococcus pneumoniae R6
gaagcacacaaaucuucugua

SEQ ID NO: 4100008 - RNA, 16 nt, Streptococcus pneumoniae R6
gaagcacaugccuucu

SEQ ID NO: 4100009 - RNA, 21 nt, Streptococcus pneumoniae R6
gaagcacaugccuucuucgau

SEQ ID NO: 4100010 - RNA, 18 nt, Streptococcus pneumoniae R6
gaagcagaaaaauuucau

SEQ ID NO: 4100011 - RNA, 21 nt, Streptococcus pneumoniae R6
gaagccaaaaucaugacaauc

SEQ ID NO: 4100012 - RNA, 13 nt, Streptococcus pneumoniae R6
gaagccaccgcca

SEQ ID NO: 4100013 - RNA, 22 nt, Streptococcus pneumoniae R6
gaagccuuguuuccaaggaaag

SEQ ID NO: 4100014 - RNA, 19 nt, Streptococcus pneumoniae R6
gaagcguuuacgaugauuu

SEQ ID NO: 4100015 - RNA, 20 nt, Streptococcus pneumoniae R6
gaagcuguaaaucuaggaca

SEQ ID NO: 4100016 - RNA, 22 nt, Streptococcus pneumoniae R6
gaagcuuccaauaauagaaaac

SEQ ID NO: 4100017 - RNA, 18 nt, Streptococcus pneumoniae R6
gaagcuugcuuccaaaaa

SEQ ID NO: 4100018 - RNA, 14 nt, Streptococcus pneumoniae R6
gaagcuuuaccauc

SEQ ID NO: 4100019 - RNA, 18 nt, Streptococcus pneumoniae R6
gaaggagccagcugaaaa

SEQ ID NO: 4100020 - RNA, 20 nt, Streptococcus pneumoniae R6
gaaggagccagcugaaaaaa

SEQ ID NO: 4100021 - RNA, 13 nt, Streptococcus pneumoniae R6
gaaggaguugagc

SEQ ID NO: 4100022 - RNA, 22 nt, Streptococcus pneumoniae R6
gaagggcuuuucuaucacucca

SEQ ID NO: 4100023 - RNA, 14 nt, Streptococcus pneumoniae R6
gaaggggcaacucu

SEQ ID NO: 4100024 - RNA, 21 nt, Streptococcus pneumoniae R6
gaagguauggccgauaacagc

SEQ ID NO: 4100025 - RNA, 17 nt, Streptococcus pneumoniae R6
gaaggugguuugaaaau

SEQ ID NO: 4100026 - RNA, 19 nt, Streptococcus pneumoniae R6
gaagguuauaccaaaaaaa

SEQ ID NO: 4100027 - RNA, 12 nt, Streptococcus pneumoniae R6
gaagguuuuuga

SEQ ID NO: 4100028 - RNA, 18 nt, Streptococcus pneumoniae R6
gaaguaaaugugagcuuu

SEQ ID NO: 4100029 - RNA, 21 nt, Streptococcus pneumoniae R6
gaaguaauuccuacuucaaau

SEQ ID NO: 4100030 - RNA, 18 nt, Streptococcus pneumoniae R6
gaaguaccaaggaagaag

SEQ ID NO: 4100031 - RNA, 20 nt, Streptococcus pneumoniae R6
gaaguagugacuucagaguc

SEQ ID NO: 4100032 - RNA, 14 nt, Streptococcus pneumoniae R6
gaaguauucaagag

SEQ ID NO: 4100033 - RNA, 21 nt, Streptococcus pneumoniae R6
gaagucagcucaaaacacugu

SEQ ID NO: 4100034 - RNA, 22 nt, Streptococcus pneumoniae R6
gaagucagcucaaaacacuguu

SEQ ID NO: 4100035 - RNA, 21 nt, Streptococcus pneumoniae R6
gaaguccauagcgucaaagaa

SEQ ID NO: 4100036 - RNA, 21 nt, Streptococcus pneumoniae R6
gaaguccuuguuugagcucuu

SEQ ID NO: 4100037 - RNA, 18 nt, Streptococcus pneumoniae R6
gaagucgaaaauaaacuu

SEQ ID NO: 4100038 - RNA, 16 nt, Streptococcus pneumoniae R6
gaagucgaguuuuuuc

SEQ ID NO: 4100039 - RNA, 15 nt, Streptococcus pneumoniae R6
gaagucuagcaauuc

SEQ ID NO: 4100040 - RNA, 16 nt, Streptococcus pneumoniae R6
gaagucucagugggcu

SEQ ID NO: 4100041 - RNA, 16 nt, Streptococcus pneumoniae R6
gaagucuguuauuucu

SEQ ID NO: 4100042 - RNA, 17 nt, Streptococcus pneumoniae R6
gaagucuuguuugagaa

SEQ ID NO: 4100043 - RNA, 14 nt, Streptococcus pneumoniae R6
gaagugaaaaagca

SEQ ID NO: 4100044 - RNA, 16 nt, Streptococcus pneumoniae R6
gacaaaauugauaaua

SEQ ID NO: 4100045 - RNA, 21 nt, Streptococcus pneumoniae R6
gacaaagaaaaaacaaaguau

SEQ ID NO: 4100046 - RNA, 18 nt, Streptococcus pneumoniae R6
gacaaagaccuuugaaaa

SEQ ID NO: 4100047 - RNA, 12 nt, Streptococcus pneumoniae R6
gacaaagagcca

SEQ ID NO: 4100048 - RNA, 12 nt, Streptococcus pneumoniae R6
gacaaagagccc

SEQ ID NO: 4100049 - RNA, 18 nt, Streptococcus pneumoniae R6
gacaaagagccgaaaaaa

SEQ ID NO: 4100050 - RNA, 22 nt, Streptococcus pneumoniae R6
gacaaauaauuuauccaaagga

SEQ ID NO: 4100051 - RNA, 23 nt, Streptococcus pneumoniae R6
gacaaaucgaucaggacagucaa

SEQ ID NO: 4100052 - RNA, 18 nt, Streptococcus pneumoniae R6
gacaaaucuaagucaaau

SEQ ID NO: 4100053 - RNA, 21 nt, Streptococcus pneumoniae R6
gacaaaucuaagucaaauaag

SEQ ID NO: 4100054 - RNA, 15 nt, Streptococcus pneumoniae R6
gacaaauucuccaca

SEQ ID NO: 4100055 - RNA, 19 nt, Streptococcus pneumoniae R6
gacaaauucuccacagacc

SEQ ID NO: 4100056 - RNA, 18 nt, Streptococcus pneumoniae R6
gacaaauuucguccuuuc

SEQ ID NO: 4100057 - RNA, 18 nt, Streptococcus pneumoniae R6
gacaaauuuuguccuuuc

SEQ ID NO: 4100058 - RNA, 22 nt, Streptococcus pneumoniae R6
gacaacauaaggcagugacuac

SEQ ID NO: 4100059 - RNA, 19 nt, Streptococcus pneumoniae R6
gacaaccaaacuguccaca

SEQ ID NO: 4100060 - RNA, 14 nt, Streptococcus pneumoniae R6
gacaacccaguaaa

SEQ ID NO: 4100061 - RNA, 15 nt, Streptococcus pneumoniae R6
gacaacuucaacccu

SEQ ID NO: 4100062 - RNA, 23 nt, Streptococcus pneumoniae R6
gacaacuucaacccuaaacugac

SEQ ID NO: 4100063 - RNA, 22 nt, Streptococcus pneumoniae R6
gacaaggcugcggcuacaccgu

SEQ ID NO: 4100064 - RNA, 16 nt, Streptococcus pneumoniae R6
gacaagucaugggcga

SEQ ID NO: 4100065 - RNA, 21 nt, Streptococcus pneumoniae R6
gacaaguuagccacaacuagg

SEQ ID NO: 4100066 - RNA, 15 nt, Streptococcus pneumoniae R6
gacaauaaagauaag

SEQ ID NO: 4100067 - RNA, 14 nt, Streptococcus pneumoniae R6
gacaaucauuucag

SEQ ID NO: 4100068 - RNA, 12 nt, Streptococcus pneumoniae R6
gacaaucuuuuc

SEQ ID NO: 4100069 - RNA, 14 nt, Streptococcus pneumoniae R6
gacaauuauauaaa

SEQ ID NO: 4100070 - RNA, 17 nt, Streptococcus pneumoniae R6
gacaauuauauaaacca

SEQ ID NO: 4100071 - RNA, 16 nt, Streptococcus pneumoniae R6
gacaauuuaaccaaac

SEQ ID NO: 4100072 - RNA, 18 nt, Streptococcus pneumoniae R6
gacaauuuaaccaaacca

SEQ ID NO: 4100073 - RNA, 23 nt, Streptococcus pneumoniae R6
gacaauuuuuccagcuuuuucuu

SEQ ID NO: 4100074 - RNA, 17 nt, Streptococcus pneumoniae R6
gacacaaugguuagaaa

SEQ ID NO: 4100075 - RNA, 12 nt, Streptococcus pneumoniae R6
gacacauaguag

SEQ ID NO: 4100076 - RNA, 20 nt, Streptococcus pneumoniae R6
gacacauaguaguaaacaca

SEQ ID NO: 4100077 - RNA, 21 nt, Streptococcus pneumoniae R6
gacacauucguuccuuuaaaa

SEQ ID NO: 4100078 - RNA, 16 nt, Streptococcus pneumoniae R6
gacaccaaaaagugca

SEQ ID NO: 4100079 - RNA, 17 nt, Streptococcus pneumoniae R6
gacaccaccgaaggcuu

SEQ ID NO: 4100080 - RNA, 21 nt, Streptococcus pneumoniae R6
gacaccacuuuuggucagagg

SEQ ID NO: 4100081 - RNA, 14 nt, Streptococcus pneumoniae R6
gacaccguaagaua

SEQ ID NO: 4100082 - RNA, 13 nt, Streptococcus pneumoniae R6
gacacuagacagu

SEQ ID NO: 4100083 - RNA, 18 nt, Streptococcus pneumoniae R6
gacacuagacagugaaau

SEQ ID NO: 4100084 - RNA, 22 nt, Streptococcus pneumoniae R6
gacacuagaugcaucugccaga

SEQ ID NO: 4100085 - RNA, 19 nt, Streptococcus pneumoniae R6
gacagaaaaaaucuaacuu

SEQ ID NO: 4100086 - RNA, 17 nt, Streptococcus pneumoniae R6
gacagaaaugaguaaga

SEQ ID NO: 4100087 - RNA, 14 nt, Streptococcus pneumoniae R6
gacagaagaaguga

SEQ ID NO: 4100088 - RNA, 16 nt, Streptococcus pneumoniae R6
gacagaagaagugaca

SEQ ID NO: 4100089 - RNA, 13 nt, Streptococcus pneumoniae R6
gacagaagauuga

SEQ ID NO: 4100090 - RNA, 19 nt, Streptococcus pneumoniae R6
gacagauucaucagggcaa

SEQ ID NO: 4100091 - RNA, 20 nt, Streptococcus pneumoniae R6
gacagcaguuaugauauauu

SEQ ID NO: 4100092 - RNA, 17 nt, Streptococcus pneumoniae R6
gacagccuuaccaccuu

SEQ ID NO: 4100093 - RNA, 15 nt, Streptococcus pneumoniae R6
gacaggcuuucuccc

SEQ ID NO: 4100094 - RNA, 21 nt, Streptococcus pneumoniae R6
gacaggucaauggcaaaaaau

SEQ ID NO: 4100095 - RNA, 18 nt, Streptococcus pneumoniae R6
gacaggugcuuaaauagg

SEQ ID NO: 4100096 - RNA, 13 nt, Streptococcus pneumoniae R6
gacagucaaaucg

SEQ ID NO: 4100097 - RNA, 20 nt, Streptococcus pneumoniae R6
gacagucaaaucgauuucua

SEQ ID NO: 4100098 - RNA, 14 nt, Streptococcus pneumoniae R6
gacagucugaaaaa

SEQ ID NO: 4100099 - RNA, 21 nt, Streptococcus pneumoniae R6
gacauaaucgcuggcauuucc

SEQ ID NO: 4100100 - RNA, 17 nt, Streptococcus pneumoniae R6
gacauaccauuuuccaa

SEQ ID NO: 4100101 - RNA, 20 nt, Streptococcus pneumoniae R6
gacauagccaauaaauguuu

SEQ ID NO: 4100102 - RNA, 21 nt, Streptococcus pneumoniae R6
gacauaggucacgaggaggag

SEQ ID NO: 4100103 - RNA, 22 nt, Streptococcus pneumoniae R6
gacauaggucacgaggaggaga

SEQ ID NO: 4100104 - RNA, 18 nt, Streptococcus pneumoniae R6
gacauagucaagcucuug

SEQ ID NO: 4100105 - RNA, 16 nt, Streptococcus pneumoniae R6
gacauccuuuucugua

SEQ ID NO: 4100106 - RNA, 23 nt, Streptococcus pneumoniae R6
gacaucgguaucaaagacgccaa

SEQ ID NO: 4100107 - RNA, 13 nt, Streptococcus pneumoniae R6
gacaucugugauu

SEQ ID NO: 4100108 - RNA, 17 nt, Streptococcus pneumoniae R6
gacaucugugauuucag

SEQ ID NO: 4100109 - RNA, 22 nt, Streptococcus pneumoniae R6
gacaucuucucaggcuuuuucu

SEQ ID NO: 4100110 - RNA, 23 nt, Streptococcus pneumoniae R6
gacaucuucucaggcuuuuucug

SEQ ID NO: 4100111 - RNA, 17 nt, Streptococcus pneumoniae R6
gacauugacuuugucac

SEQ ID NO: 4100112 - RNA, 17 nt, Streptococcus pneumoniae R6
gaccaaagcaucaauca

SEQ ID NO: 4100113 - RNA, 18 nt, Streptococcus pneumoniae R6
gaccaacuuuaagagcuu

SEQ ID NO: 4100114 - RNA, 17 nt, Streptococcus pneumoniae R6
gaccaagagcaaaaaca

SEQ ID NO: 4100115 - RNA, 14 nt, Streptococcus pneumoniae R6
gaccaagcuaucag

SEQ ID NO: 4100116 - RNA, 15 nt, Streptococcus pneumoniae R6
gaccaaguccucaau

SEQ ID NO: 4100117 - RNA, 18 nt, Streptococcus pneumoniae R6
gaccacggaaauccucua

SEQ ID NO: 4100118 - RNA, 23 nt, Streptococcus pneumoniae R6
gaccacguucugcaacaacagcu

SEQ ID NO: 4100119 - RNA, 19 nt, Streptococcus pneumoniae R6
gaccagaaaaucauugcua

SEQ ID NO: 4100120 - RNA, 19 nt, Streptococcus pneumoniae R6
gaccagcuacaaaggcuau

SEQ ID NO: 4100121 - RNA, 20 nt, Streptococcus pneumoniae R6
gaccaguuucuucuuucacu

SEQ ID NO: 4100122 - RNA, 22 nt, Streptococcus pneumoniae R6
gacccaagucggcaggcugguu

SEQ ID NO: 4100123 - RNA, 15 nt, Streptococcus pneumoniae R6
gacccaggcaaagag

SEQ ID NO: 4100124 - RNA, 19 nt, Streptococcus pneumoniae R6
gacccugcgccagagcaau

SEQ ID NO: 4100125 - RNA, 13 nt, Streptococcus pneumoniae R6
gaccgacacacca

SEQ ID NO: 4100126 - RNA, 15 nt, Streptococcus pneumoniae R6
gaccgacuauuuuuu

SEQ ID NO: 4100127 - RNA, 14 nt, Streptococcus pneumoniae R6
gaccgaugauuaca

SEQ ID NO: 4100128 - RNA, 17 nt, Streptococcus pneumoniae R6
gaccgauucgucugagu

SEQ ID NO: 4100129 - RNA, 13 nt, Streptococcus pneumoniae R6
gaccggagaaaga

SEQ ID NO: 4100130 - RNA, 17 nt, Streptococcus pneumoniae R6
gaccggcuuccuaauuu

SEQ ID NO: 4100131 - RNA, 20 nt, Streptococcus pneumoniae R6
gaccugccaugcugacgaug

SEQ ID NO: 4100132 - RNA, 16 nt, Streptococcus pneumoniae R6
gaccuguauucauuga

SEQ ID NO: 4100133 - RNA, 21 nt, Streptococcus pneumoniae R6
gaccuguauucauugaaaaaa

SEQ ID NO: 4100134 - RNA, 19 nt, Streptococcus pneumoniae R6
gaccuguuuggucagacug

SEQ ID NO: 4100135 - RNA, 21 nt, Streptococcus pneumoniae R6
gaccuuaaacuuguaagucaa

SEQ ID NO: 4100136 - RNA, 22 nt, Streptococcus pneumoniae R6
gaccuugaccagccaagacacu

SEQ ID NO: 4100137 - RNA, 15 nt, Streptococcus pneumoniae R6
gaccuugagcucuuu

SEQ ID NO: 4100138 - RNA, 23 nt, Streptococcus pneumoniae R6
gaccuuucauaaaguuuucugag

SEQ ID NO: 4100139 - RNA, 13 nt, Streptococcus pneumoniae R6
gaccuuugaaaac

SEQ ID NO: 4100140 - RNA, 17 nt, Streptococcus pneumoniae R6
gacgaagcugacaugau

SEQ ID NO: 4100141 - RNA, 22 nt, Streptococcus pneumoniae R6
gacgaagucagcucaaaacacu

SEQ ID NO: 4100142 - RNA, 19 nt, Streptococcus pneumoniae R6
gacgaagucagucacauau

SEQ ID NO: 4100143 - RNA, 18 nt, Streptococcus pneumoniae R6
gacgaagugcuucuggga

SEQ ID NO: 4100144 - RNA, 18 nt, Streptococcus pneumoniae R6
gacgaccauugucacaau

SEQ ID NO: 4100145 - RNA, 14 nt, Streptococcus pneumoniae R6
gacgacuacuuccu

SEQ ID NO: 4100146 - RNA, 19 nt, Streptococcus pneumoniae R6
gagaagaaaacagaaaaau

SEQ ID NO: 4100147 - RNA, 11 nt, Streptococcus pneumoniae R6
gagaagagcuu

SEQ ID NO: 4100148 - RNA, 17 nt, Streptococcus pneumoniae R6
gagaagccaagaguaga

SEQ ID NO: 4100149 - RNA, 22 nt, Streptococcus pneumoniae R6
gagaagccaccgccagaacuuc

SEQ ID NO: 4100150 - RNA, 19 nt, Streptococcus pneumoniae R6
gagaagcccauaucuccag

SEQ ID NO: 4100151 - RNA, 18 nt, Streptococcus pneumoniae R6
gagaaggcugguugaaaa

SEQ ID NO: 4100152 - RNA, 20 nt, Streptococcus pneumoniae R6
gagaaucaucaugaaaccac

SEQ ID NO: 4100153 - RNA, 22 nt, Streptococcus pneumoniae R6
gagaaugcuugcgacaaaaaga

SEQ ID NO: 4100154 - RNA, 14 nt, Streptococcus pneumoniae R6
gagaauucuaguag

SEQ ID NO: 4100155 - RNA, 14 nt, Streptococcus pneumoniae R6
gagacaaaaaaaac

SEQ ID NO: 4100156 - RNA, 16 nt, Streptococcus pneumoniae R6
gagacaaaaaaaacac

SEQ ID NO: 4100157 - RNA, 20 nt, Streptococcus pneumoniae R6
gagacaacgcacaccagaga

SEQ ID NO: 4100158 - RNA, 15 nt, Streptococcus pneumoniae R6
gagaccgacaccugc

SEQ ID NO: 4100159 - RNA, 14 nt, Streptococcus pneumoniae R6
gagacuaaggagag

SEQ ID NO: 4100160 - RNA, 14 nt, Streptococcus pneumoniae R6
gagacuaucugcua

SEQ ID NO: 4100161 - RNA, 20 nt, Streptococcus pneumoniae R6
gagacuggcuaggugagauu

SEQ ID NO: 4100162 - RNA, 14 nt, Streptococcus pneumoniae R6
gagacuugcaagaa

SEQ ID NO: 4100163 - RNA, 16 nt, Streptococcus pneumoniae R6
gagagcuccaaagaag

SEQ ID NO: 4100164 - RNA, 16 nt, Streptococcus pneumoniae R6
gagaguucuuguuucu

SEQ ID NO: 4100165 - RNA, 19 nt, Streptococcus pneumoniae R6
gagauacuccaaaacaucu

SEQ ID NO: 4100166 - RNA, 15 nt, Streptococcus pneumoniae R6
gagauaguaucaaau

SEQ ID NO: 4100167 - RNA, 22 nt, Streptococcus pneumoniae R6
gagauaguaucccauucuucag

SEQ ID NO: 4100168 - RNA, 21 nt, Streptococcus pneumoniae R6
gagauaguauuuuaaaacgaa

SEQ ID NO: 4100169 - RNA, 17 nt, Streptococcus pneumoniae R6
gagauggacuagaaugc

SEQ ID NO: 4100170 - RNA, 16 nt, Streptococcus pneumoniae R6
gagauggauuuuccuu

SEQ ID NO: 4100171 - RNA, 19 nt, Streptococcus pneumoniae R6
gagaugggacuaaagauug

SEQ ID NO: 4100172 - RNA, 20 nt, Streptococcus pneumoniae R6
gagauuauugguggcuucca

SEQ ID NO: 4100173 - RNA, 16 nt, Streptococcus pneumoniae R6
gagauucauucugcua

SEQ ID NO: 4100174 - RNA, 13 nt, Streptococcus pneumoniae R6
gagauugaagcuc

SEQ ID NO: 4100175 - RNA, 15 nt, Streptococcus pneumoniae R6
gagauuggaaaccaa

SEQ ID NO: 4100176 - RNA, 21 nt, Streptococcus pneumoniae R6
gagauuugaaggacugagcca

SEQ ID NO: 4100177 - RNA, 15 nt, Streptococcus pneumoniae R6
gagauuuucaaagag

SEQ ID NO: 4100178 - RNA, 18 nt, Streptococcus pneumoniae R6
gagcaaacugaauccgca

SEQ ID NO: 4100179 - RNA, 15 nt, Streptococcus pneumoniae R6
gagcaagaauucaau

SEQ ID NO: 4100180 - RNA, 14 nt, Streptococcus pneumoniae R6
gagcaauacuuuuu

SEQ ID NO: 4100181 - RNA, 22 nt, Streptococcus pneumoniae R6
gagcacccucguuaucauucca

SEQ ID NO: 4100182 - RNA, 21 nt, Streptococcus pneumoniae R6
gagcagauuucuuuuaagaaa

SEQ ID NO: 4100183 - RNA, 22 nt, Streptococcus pneumoniae R6
gagcaguuccacgauauuguug

SEQ ID NO: 4100184 - RNA, 14 nt, Streptococcus pneumoniae R6
gagcauacugcccu

SEQ ID NO: 4100185 - RNA, 22 nt, Streptococcus pneumoniae R6
gagcauucuuuuguucaucauu

SEQ ID NO: 4100186 - RNA, 15 nt, Streptococcus pneumoniae R6
gagcauuuuucgaaa

SEQ ID NO: 4100187 - RNA, 13 nt, Streptococcus pneumoniae R6
gagccaaaaaaga

SEQ ID NO: 4100188 - RNA, 17 nt, Streptococcus pneumoniae R6
gagccacucuuuauucc

SEQ ID NO: 4100189 - RNA, 20 nt, Streptococcus pneumoniae R6
gagccagcugaaaaaaacug

SEQ ID NO: 4100190 - RNA, 16 nt, Streptococcus pneumoniae R6
gagcccaauauucucu

SEQ ID NO: 4100191 - RNA, 14 nt, Streptococcus pneumoniae R6
gagccgcaagguga

SEQ ID NO: 4100192 - RNA, 14 nt, Streptococcus pneumoniae R6
gagccgcugaguca

SEQ ID NO: 4100193 - RNA, 13 nt, Streptococcus pneumoniae R6
gagcgaaaucaac

SEQ ID NO: 4100194 - RNA, 18 nt, Streptococcus pneumoniae R6
gagcgaauccuugauaac

SEQ ID NO: 4100195 - RNA, 19 nt, Streptococcus pneumoniae R6
gagcgacguuuucauaagc

SEQ ID NO: 4100196 - RNA, 15 nt, Streptococcus pneumoniae R6
gagcgacuuuuucug

SEQ ID NO: 4100197 - RNA, 17 nt, Streptococcus pneumoniae R6
gagcgacuuuuucugau

SEQ ID NO: 4100198 - RNA, 23 nt, Streptococcus pneumoniae R6
gagcgaggucgcugugauaaugg

SEQ ID NO: 4100199 - RNA, 17 nt, Streptococcus pneumoniae R6
gagcuacguucugucaa

SEQ ID NO: 4100200 - RNA, 20 nt, Streptococcus pneumoniae R6
gagcucauccuuugcaucca

SEQ ID NO: 4100201 - RNA, 18 nt, Streptococcus pneumoniae R6
gagcugacuucgucaguu

SEQ ID NO: 4100202 - RNA, 13 nt, Streptococcus pneumoniae R6
gagcugaggaaau

SEQ ID NO: 4100203 - RNA, 15 nt, Streptococcus pneumoniae R6
gagcugauagugaug

SEQ ID NO: 4100204 - RNA, 16 nt, Streptococcus pneumoniae R6
gagcugcugcuuccau

SEQ ID NO: 4100205 - RNA, 17 nt, Streptococcus pneumoniae R6
gagcugcugugaugagg

SEQ ID NO: 4100206 - RNA, 13 nt, Streptococcus pneumoniae R6
gagcuuauuuuug

SEQ ID NO: 4100207 - RNA, 16 nt, Streptococcus pneumoniae R6
gagcuuauuuuugcaa

SEQ ID NO: 4100208 - RNA, 22 nt, Streptococcus pneumoniae R6
gagcuuccaguagcgcuugaua

SEQ ID NO: 4100209 - RNA, 20 nt, Streptococcus pneumoniae R6
gagcuucuuucaugagugga

SEQ ID NO: 4100210 - RNA, 12 nt, Streptococcus pneumoniae R6
gagcuucuuuug

SEQ ID NO: 4100211 - RNA, 21 nt, Streptococcus pneumoniae R6
gagcuucuuuuggauuuucaa

SEQ ID NO: 4100212 - RNA, 19 nt, Streptococcus pneumoniae R6
gagcuuugacauccuuuuc

SEQ ID NO: 4100213 - RNA, 23 nt, Streptococcus pneumoniae R6
gaggaaaucccucggcuuuuuua

SEQ ID NO: 4100214 - RNA, 12 nt, Streptococcus pneumoniae R6
gaggaaggggcg

SEQ ID NO: 4100215 - RNA, 19 nt, Streptococcus pneumoniae R6
gaggaauaaugcccaugaa

SEQ ID NO: 4100216 - RNA, 14 nt, Streptococcus pneumoniae R6
gaggagaaaaagcg

SEQ ID NO: 4100217 - RNA, 15 nt, Streptococcus pneumoniae R6
gaggaggagaaaaag

SEQ ID NO: 4100218 - RNA, 15 nt, Streptococcus pneumoniae R6
gaggagguaaauccc

SEQ ID NO: 4100219 - RNA, 18 nt, Streptococcus pneumoniae R6
gaggaucagacugguucu

SEQ ID NO: 4100220 - RNA, 17 nt, Streptococcus pneumoniae R6
gaggauuuuaaaguaau

SEQ ID NO: 4100221 - RNA, 22 nt, Streptococcus pneumoniae R6
gaggauuuuaaaguaaucucua

SEQ ID NO: 4100222 - RNA, 14 nt, Streptococcus pneumoniae R6
gaggcaaagaaaaa

SEQ ID NO: 4100223 - RNA, 15 nt, Streptococcus pneumoniae R6
gaggcaaagaaaaaa

SEQ ID NO: 4100224 - RNA, 18 nt, Streptococcus pneumoniae R6
gaggcacuugaugugacu

SEQ ID NO: 4100225 - RNA, 22 nt, Streptococcus pneumoniae R6
gaggcacuuuuguccuauucuu

SEQ ID NO: 4100226 - RNA, 19 nt, Streptococcus pneumoniae R6
gaggccuauuuaccaugga

SEQ ID NO: 4100227 - RNA, 14 nt, Streptococcus pneumoniae R6
gaggcgaugaucuc

SEQ ID NO: 4100228 - RNA, 21 nt, Streptococcus pneumoniae R6
gaggcuggacaaaaacucaau

SEQ ID NO: 4100229 - RNA, 18 nt, Streptococcus pneumoniae R6
gagggaaagauccaguac

SEQ ID NO: 4100230 - RNA, 17 nt, Streptococcus pneumoniae R6
gagggagaccggagaga

SEQ ID NO: 4100231 - RNA, 14 nt, Streptococcus pneumoniae R6
gagggauuuuguau

SEQ ID NO: 4100232 - RNA, 16 nt, Streptococcus pneumoniae R6
gagggcaaaaaaggga

SEQ ID NO: 4100233 - RNA, 20 nt, Streptococcus pneumoniae R6
gagggcacggagggcaccga

SEQ ID NO: 4100234 - RNA, 19 nt, Streptococcus pneumoniae R6
gaggguccaaaccaacaua

SEQ ID NO: 4100235 - RNA, 15 nt, Streptococcus pneumoniae R6
gaggguggaaagacu

SEQ ID NO: 4100236 - RNA, 22 nt, Streptococcus pneumoniae R6
gagguagaggcgccugcugcua

SEQ ID NO: 4100237 - RNA, 18 nt, Streptococcus pneumoniae R6
gaggucagugacuugugu

SEQ ID NO: 4100238 - RNA, 17 nt, Streptococcus pneumoniae R6
gaggucccaugcuucca

SEQ ID NO: 4100239 - RNA, 16 nt, Streptococcus pneumoniae R6
gaggugauaaagucca

SEQ ID NO: 4100240 - RNA, 15 nt, Streptococcus pneumoniae R6
gagguguucuaucac

SEQ ID NO: 4100241 - RNA, 20 nt, Streptococcus pneumoniae R6
gagguugcugucguagucua

SEQ ID NO: 4100242 - RNA, 18 nt, Streptococcus pneumoniae R6
gagguuguagauagaacu

SEQ ID NO: 4100243 - RNA, 23 nt, Streptococcus pneumoniae R6
gagguuguagauagaacugacga

SEQ ID NO: 4100244 - RNA, 19 nt, Streptococcus pneumoniae R6
gagguuguagaugaaacug

SEQ ID NO: 4100245 - RNA, 18 nt, Streptococcus pneumoniae R6
gagguuguggauagaacu

SEQ ID NO: 4100246 - RNA, 23 nt, Streptococcus pneumoniae R6
gagguuguggauagaacugacga

SEQ ID NO: 4100247 - RNA, 19 nt, Streptococcus pneumoniae R6
gagguuguggaugaaacug

SEQ ID NO: 4100248 - RNA, 23 nt, Streptococcus pneumoniae R6
gagguuguggaugaaacugacga

SEQ ID NO: 4100249 - RNA, 20 nt, Streptococcus pneumoniae R6
gauacguguaugugcauagu

SEQ ID NO: 4100250 - RNA, 22 nt, Streptococcus pneumoniae R6
gauacugguacuauuuaauguu

SEQ ID NO: 4100251 - RNA, 17 nt, Streptococcus pneumoniae R6
gauacuguaguuuuucc

SEQ ID NO: 4100252 - RNA, 18 nt, Streptococcus pneumoniae R6
gauacuguuauagaagua

SEQ ID NO: 4100253 - RNA, 23 nt, Streptococcus pneumoniae R6
gauacuuaacuuuguauaauagg

SEQ ID NO: 4100254 - RNA, 20 nt, Streptococcus pneumoniae R6
gauagaaagcaaggcuuugu

SEQ ID NO: 4100255 - RNA, 20 nt, Streptococcus pneumoniae R6
gauagaagagucagcucuuu

SEQ ID NO: 4100256 - RNA, 22 nt, Streptococcus pneumoniae R6
gauagaagguaaauucugucac

SEQ ID NO: 4100257 - RNA, 16 nt, Streptococcus pneumoniae R6
gauagaaggucaagag

SEQ ID NO: 4100258 - RNA, 20 nt, Streptococcus pneumoniae R6
gauagaaggucaagagaaaa

SEQ ID NO: 4100259 - RNA, 21 nt, Streptococcus pneumoniae R6
gauagaaggucaagagaaaac

SEQ ID NO: 4100260 - RNA, 21 nt, Streptococcus pneumoniae R6
gauagaagguccguuggucaa

SEQ ID NO: 4100261 - RNA, 15 nt, Streptococcus pneumoniae R6
gauagaaguagagag

SEQ ID NO: 4100262 - RNA, 15 nt, Streptococcus pneumoniae R6
gauagaaucguuucu

SEQ ID NO: 4100263 - RNA, 20 nt, Streptococcus pneumoniae R6
gauagaccuguuuggucaga

SEQ ID NO: 4100264 - RNA, 15 nt, Streptococcus pneumoniae R6
gauagagaaagaaaa

SEQ ID NO: 4100265 - RNA, 17 nt, Streptococcus pneumoniae R6
gauagagauuauagugg

SEQ ID NO: 4100266 - RNA, 20 nt, Streptococcus pneumoniae R6
gauagagcuaacuuuuccuu

SEQ ID NO: 4100267 - RNA, 20 nt, Streptococcus pneumoniae R6
gauagauccuucaaauccug

SEQ ID NO: 4100268 - RNA, 14 nt, Streptococcus pneumoniae R6
gauagaucuuuacu

SEQ ID NO: 4100269 - RNA, 21 nt, Streptococcus pneumoniae R6
gauagaugacuucuuaaucaa

SEQ ID NO: 4100270 - RNA, 16 nt, Streptococcus pneumoniae R6
gauagauuuauuuuug

SEQ ID NO: 4100271 - RNA, 14 nt, Streptococcus pneumoniae R6
gauagcauuuggaa

SEQ ID NO: 4100272 - RNA, 22 nt, Streptococcus pneumoniae R6
gauagccaugaacgucuaaacu

SEQ ID NO: 4100273 - RNA, 13 nt, Streptococcus pneumoniae R6
gauagcggcaacu

SEQ ID NO: 4100274 - RNA, 16 nt, Streptococcus pneumoniae R6
gauagcugcagcugag

SEQ ID NO: 4100275 - RNA, 21 nt, Streptococcus pneumoniae R6
gauagcugcagcugaggaaau

SEQ ID NO: 4100276 - RNA, 13 nt, Streptococcus pneumoniae R6
gauagcuugaauu

SEQ ID NO: 4100277 - RNA, 13 nt, Streptococcus pneumoniae R6
gauaggauugaca

SEQ ID NO: 4100278 - RNA, 15 nt, Streptococcus pneumoniae R6
gauaggauugacaaa

SEQ ID NO: 4100279 - RNA, 23 nt, Streptococcus pneumoniae R6
gauagguggguggguauaaaaga

SEQ ID NO: 4100280 - RNA, 17 nt, Streptococcus pneumoniae R6
gauaguaucaaaugacu

SEQ ID NO: 4100281 - RNA, 15 nt, Streptococcus pneumoniae R6
gauagugacuuuaug

SEQ ID NO: 4100282 - RNA, 19 nt, Streptococcus pneumoniae R6
gauagugauguuucaaguc

SEQ ID NO: 4100283 - RNA, 19 nt, Streptococcus pneumoniae R6
gauagugguguuucaaguc

SEQ ID NO: 4100284 - RNA, 20 nt, Streptococcus pneumoniae R6
gauaguuucgcggaauagag

SEQ ID NO: 4100285 - RNA, 21 nt, Streptococcus pneumoniae R6
gauaguuuugcaagagcgguu

SEQ ID NO: 4100286 - RNA, 14 nt, Streptococcus pneumoniae R6
gauauaagaagcau

SEQ ID NO: 4100287 - RNA, 20 nt, Streptococcus pneumoniae R6
gauauaagguaggagugaaa

SEQ ID NO: 4100288 - RNA, 18 nt, Streptococcus pneumoniae R6
gauauaauuguaaacaaa

SEQ ID NO: 4100289 - RNA, 21 nt, Streptococcus pneumoniae R6
gauauacuuaccgagaauccc

SEQ ID NO: 4100290 - RNA, 14 nt, Streptococcus pneumoniae R6
gauauaguuaaaaa

SEQ ID NO: 4100291 - RNA, 16 nt, Streptococcus pneumoniae R6
gauauauaaaugaaaa

SEQ ID NO: 4100292 - RNA, 18 nt, Streptococcus pneumoniae R6
gauaucacggcauuucug

SEQ ID NO: 4100293 - RNA, 19 nt, Streptococcus pneumoniae R6
gauaucauguuucaacaug

SEQ ID NO: 4100294 - RNA, 20 nt, Streptococcus pneumoniae R6
gauaucgguuuaucucccau

SEQ ID NO: 4100295 - RNA, 15 nt, Streptococcus pneumoniae R6
gauaucuaucaaaca

SEQ ID NO: 4100296 - RNA, 20 nt, Streptococcus pneumoniae R6
gauaucugaaaguuuaucuc

SEQ ID NO: 4100297 - RNA, 15 nt, Streptococcus pneumoniae R6
gauaucugauagagu

SEQ ID NO: 4100298 - RNA, 15 nt, Streptococcus pneumoniae R6
gauaugaaacaugaa

SEQ ID NO: 4100299 - RNA, 21 nt, Streptococcus pneumoniae R6
gauaugaugcguuuuauaauu

SEQ ID NO: 4100300 - RNA, 14 nt, Streptococcus pneumoniae R6
gauaugguaauguu

SEQ ID NO: 4100301 - RNA, 18 nt, Streptococcus pneumoniae R6
gauaugguaauguucuuc

SEQ ID NO: 4100302 - RNA, 18 nt, Streptococcus pneumoniae R6
gauauggugcguuuuuug

SEQ ID NO: 4100303 - RNA, 17 nt, Streptococcus pneumoniae R6
gauauuaugcguuuuuc

SEQ ID NO: 4100304 - RNA, 23 nt, Streptococcus pneumoniae R6
gauauucaauucuuuaacaaaau

SEQ ID NO: 4100305 - RNA, 14 nt, Streptococcus pneumoniae R6
gauauucuuaucaa

SEQ ID NO: 4100306 - RNA, 17 nt, Streptococcus pneumoniae R6
gauauucuuuucaaagu

SEQ ID NO: 4100307 - RNA, 15 nt, Streptococcus pneumoniae R6
gauauugcaguauau

SEQ ID NO: 4100308 - RNA, 17 nt, Streptococcus pneumoniae R6
gauauugcaguauaucu

SEQ ID NO: 4100309 - RNA, 23 nt, Streptococcus pneumoniae R6
gauauuguccguagcaggaccag

SEQ ID NO: 4100310 - RNA, 12 nt, Streptococcus pneumoniae R6
gauauuucucca

SEQ ID NO: 4100311 - RNA, 17 nt, Streptococcus pneumoniae R6
gaucaagaugagacuug

SEQ ID NO: 4100312 - RNA, 14 nt, Streptococcus pneumoniae R6
gaucaauucaacag

SEQ ID NO: 4100313 - RNA, 19 nt, Streptococcus pneumoniae R6
gaucagaccaguuucuucu

SEQ ID NO: 4100314 - RNA, 22 nt, Streptococcus pneumoniae R6
gaucagaguuuugaaaacuuac

SEQ ID NO: 4100315 - RNA, 21 nt, Streptococcus pneumoniae R6
gaucagcguuuuuucuuuuug

SEQ ID NO: 4100316 - RNA, 14 nt, Streptococcus pneumoniae R6
gaucauauuuucug

SEQ ID NO: 4100317 - RNA, 14 nt, Streptococcus pneumoniae R6
gaucaucaaccuca

SEQ ID NO: 4100318 - RNA, 13 nt, Streptococcus pneumoniae R6
gauccuucauucg

SEQ ID NO: 4100319 - RNA, 21 nt, Streptococcus pneumoniae R6
gaucgagcagauuucuuuuaa

SEQ ID NO: 4100320 - RNA, 23 nt, Streptococcus pneumoniae R6
gaucgaguuauuaacaaaagagc

SEQ ID NO: 4100321 - RNA, 16 nt, Streptococcus pneumoniae R6
gaucgauuuguccugu

SEQ ID NO: 4100322 - RNA, 19 nt, Streptococcus pneumoniae R6
gaucgauuuguccuguucu

SEQ ID NO: 4100323 - RNA, 17 nt, Streptococcus pneumoniae R6
gaucuacuucuuuaacu

SEQ ID NO: 4100324 - RNA, 15 nt, Streptococcus pneumoniae R6
gaucuacuuuuuucu

SEQ ID NO: 4100325 - RNA, 23 nt, Streptococcus pneumoniae R6
gaucuagauuuggaaacucagga

SEQ ID NO: 4100326 - RNA, 21 nt, Streptococcus pneumoniae R6
gaucuagcucucucugauuuc

SEQ ID NO: 4100327 - RNA, 22 nt, Streptococcus pneumoniae R6
gaucuauuguugcauuaaaaag

SEQ ID NO: 4100328 - RNA, 11 nt, Streptococcus pneumoniae R6
gaucugacuuc

SEQ ID NO: 4100329 - RNA, 19 nt, Streptococcus pneumoniae R6
gaucugacuucgucaguuc

SEQ ID NO: 4100330 - RNA, 23 nt, Streptococcus pneumoniae R6
gaucugacuucgucaguucuauc

SEQ ID NO: 4100331 - RNA, 20 nt, Streptococcus pneumoniae R6
gaucugauauauuuucgauu

SEQ ID NO: 4100332 - RNA, 23 nt, Streptococcus pneumoniae R6
gaucuucaucuugucuucaaagg

SEQ ID NO: 4100333 - RNA, 23 nt, Streptococcus pneumoniae R6
gaucuugaggaagagcuuugcuu

SEQ ID NO: 4100334 - RNA, 12 nt, Streptococcus pneumoniae R6
gaugaaaaaaag

SEQ ID NO: 4100335 - RNA, 15 nt, Streptococcus pneumoniae R6
gaugaaacuaauagg

SEQ ID NO: 4100336 - RNA, 13 nt, Streptococcus pneumoniae R6
gaugaaacugacg

SEQ ID NO: 4100337 - RNA, 15 nt, Streptococcus pneumoniae R6
gaugaaacugacgaa

SEQ ID NO: 4100338 - RNA, 19 nt, Streptococcus pneumoniae R6
gaugaagggcuuuucuauc

SEQ ID NO: 4100339 - RNA, 21 nt, Streptococcus pneumoniae R6
gaugaagggcuuuucuaucac

SEQ ID NO: 4100340 - RNA, 22 nt, Streptococcus pneumoniae R6
gaugaagucuagcaauucuugg

SEQ ID NO: 4100341 - RNA, 19 nt, Streptococcus pneumoniae R6
gaugaaucugaaucaaaau

SEQ ID NO: 4100342 - RNA, 20 nt, Streptococcus pneumoniae R6
gaugacaaaucuaagucaaa

SEQ ID NO: 4100343 - RNA, 15 nt, Streptococcus pneumoniae R6
gaugacauucaggcu

SEQ ID NO: 4100344 - RNA, 23 nt, Streptococcus pneumoniae R6
gaugaccaugucguuuccuucca

SEQ ID NO: 4100345 - RNA, 17 nt, Streptococcus pneumoniae R6
gaugacuucagcuccac

SEQ ID NO: 4100346 - RNA, 19 nt, Streptococcus pneumoniae R6
gaugagacuugcaagaaag

SEQ ID NO: 4100347 - RNA, 22 nt, Streptococcus pneumoniae R6
gaugagauuauugguggcuucc

SEQ ID NO: 4100348 - RNA, 14 nt, Streptococcus pneumoniae R6
gaugagauuuugga

SEQ ID NO: 4100349 - RNA, 17 nt, Streptococcus pneumoniae R6
gaugagggccaguucga

SEQ ID NO: 4100350 - RNA, 19 nt, Streptococcus pneumoniae R6
gaugaguguaaaaagaaag

SEQ ID NO: 4100351 - RNA, 14 nt, Streptococcus pneumoniae R6
gauuuaaaacugug

SEQ ID NO: 4100352 - RNA, 21 nt, Streptococcus pneumoniae R6
gauuuaaaacugugauauaau

SEQ ID NO: 4100353 - RNA, 21 nt, Streptococcus pneumoniae R6
gauuuaaacuaguuuucuaaa

SEQ ID NO: 4100354 - RNA, 17 nt, Streptococcus pneumoniae R6
gauuuaaauguuuucuc

SEQ ID NO: 4100355 - RNA, 16 nt, Streptococcus pneumoniae R6
gauuuaacaaucuauc

SEQ ID NO: 4100356 - RNA, 23 nt, Streptococcus pneumoniae R6
gauuuaacaaucuaucuuuuaau

SEQ ID NO: 4100357 - RNA, 11 nt, Streptococcus pneumoniae R6
gauuuaaucau

SEQ ID NO: 4100358 - RNA, 19 nt, Streptococcus pneumoniae R6
gauuuaaucugaauguuuc

SEQ ID NO: 4100359 - RNA, 14 nt, Streptococcus pneumoniae R6
gauuuaauuagaaa

SEQ ID NO: 4100360 - RNA, 19 nt, Streptococcus pneumoniae R6
gauuuaauuagaaaaaaau

SEQ ID NO: 4100361 - RNA, 18 nt, Streptococcus pneumoniae R6
gauuuacaucuucucugg

SEQ ID NO: 4100362 - RNA, 20 nt, Streptococcus pneumoniae R6
gauuuaccauuuucguccaa

SEQ ID NO: 4100363 - RNA, 16 nt, Streptococcus pneumoniae R6
gauuuacuuccuuuuc

SEQ ID NO: 4100364 - RNA, 20 nt, Streptococcus pneumoniae R6
gauuuacuucuuuuucuccu

SEQ ID NO: 4100365 - RNA, 15 nt, Streptococcus pneumoniae R6
gauuuagaaccaaga

SEQ ID NO: 4100366 - RNA, 21 nt, Streptococcus pneumoniae R6
gauuuaggacuaaauacaaaa

SEQ ID NO: 4100367 - RNA, 19 nt, Streptococcus pneumoniae R6
gauuuaguagcaucauaga

SEQ ID NO: 4100368 - RNA, 12 nt, Streptococcus pneumoniae R6
gauuuaguucug

SEQ ID NO: 4100369 - RNA, 16 nt, Streptococcus pneumoniae R6
gauuuaguucuguacu

SEQ ID NO: 4100370 - RNA, 17 nt, Streptococcus pneumoniae R6
gauuuaguucuguacug

SEQ ID NO: 4100371 - RNA, 21 nt, Streptococcus pneumoniae R6
gauuuauagcgcuagagacua

SEQ ID NO: 4100372 - RNA, 13 nt, Streptococcus pneumoniae R6
gauuuauccaacu

SEQ ID NO: 4100373 - RNA, 13 nt, Streptococcus pneumoniae R6
gauuuauuuuucu

SEQ ID NO: 4100374 - RNA, 22 nt, Streptococcus pneumoniae R6
gauuuauuuuucuuuuucagaa

SEQ ID NO: 4100375 - RNA, 20 nt, Streptococcus pneumoniae R6
gauuucaagaccauuuccau

SEQ ID NO: 4100376 - RNA, 22 nt, Streptococcus pneumoniae R6
gauuucaagaccauuuccaucu

SEQ ID NO: 4100377 - RNA, 12 nt, Streptococcus pneumoniae R6
gauuucagaaau

SEQ ID NO: 4100378 - RNA, 17 nt, Streptococcus pneumoniae R6
gauuucagcguuuucua

SEQ ID NO: 4100379 - RNA, 18 nt, Streptococcus pneumoniae R6
gauuuccaaucuucucca

SEQ ID NO: 4100380 - RNA, 19 nt, Streptococcus pneumoniae R6
gauuuccaaucuucuccag

SEQ ID NO: 4100381 - RNA, 16 nt, Streptococcus pneumoniae R6
gauuuccacuaaaggu

SEQ ID NO: 4100382 - RNA, 23 nt, Streptococcus pneumoniae R6
gauuuccauuggaguaugcucgu

SEQ ID NO: 4100383 - RNA, 13 nt, Streptococcus pneumoniae R6
gauuuccauuucu

SEQ ID NO: 4100384 - RNA, 16 nt, Streptococcus pneumoniae R6
gauuucuaccauagau

SEQ ID NO: 4100385 - RNA, 17 nt, Streptococcus pneumoniae R6
gauuucuauugaaauga

SEQ ID NO: 4100386 - RNA, 22 nt, Streptococcus pneumoniae R6
gauuucuccauagauuucuugg

SEQ ID NO: 4100387 - RNA, 22 nt, Streptococcus pneumoniae R6
gauuucuccgaggauuucccaa

SEQ ID NO: 4100388 - RNA, 12 nt, Streptococcus pneumoniae R6
gauuucuccugu

SEQ ID NO: 4100389 - RNA, 21 nt, Streptococcus pneumoniae R6
gauuucucuauucuuuuuugg

SEQ ID NO: 4100390 - RNA, 19 nt, Streptococcus pneumoniae R6
gauuucuggauuuccauuu

SEQ ID NO: 4100391 - RNA, 17 nt, Streptococcus pneumoniae R6
gauuucuguaaaaauac

SEQ ID NO: 4100392 - RNA, 13 nt, Streptococcus pneumoniae R6
gauuucuucuugg

SEQ ID NO: 4100393 - RNA, 23 nt, Streptococcus pneumoniae R6
gauuugaaugccaaaauuccauc

SEQ ID NO: 4100394 - RNA, 18 nt, Streptococcus pneumoniae R6
gauuugguugaagaggua

SEQ ID NO: 4100395 - RNA, 14 nt, Streptococcus pneumoniae R6
gauuuguaaauccg

SEQ ID NO: 4100396 - RNA, 23 nt, Streptococcus pneumoniae R6
gauuuguccuauucuuauuucau

SEQ ID NO: 4100397 - RNA, 16 nt, Streptococcus pneumoniae R6
gauuuguccuggucuu

SEQ ID NO: 4100398 - RNA, 23 nt, Streptococcus pneumoniae R6
gauuuguccuguucuuauuucau

SEQ ID NO: 4100399 - RNA, 16 nt, Streptococcus pneumoniae R6
gauuuguucagguguu

SEQ ID NO: 4100400 - RNA, 18 nt, Streptococcus pneumoniae R6
gauuuguucauaucuuau

SEQ ID NO: 4100401 - RNA, 13 nt, Streptococcus pneumoniae R6
gauuuguuuuugg

SEQ ID NO: 4100402 - RNA, 15 nt, Streptococcus pneumoniae R6
gauuuuaaagaaaua

SEQ ID NO: 4100403 - RNA, 21 nt, Streptococcus pneumoniae R6
gauuuuaaauuuacuuaaaau

SEQ ID NO: 4100404 - RNA, 22 nt, Streptococcus pneumoniae R6
gauuuuaaauuuacuuaaaauu

SEQ ID NO: 4100405 - RNA, 13 nt, Streptococcus pneumoniae R6
gauuuuaauaauu

SEQ ID NO: 4100406 - RNA, 11 nt, Streptococcus pneumoniae R6
gauuuuaucca

SEQ ID NO: 4100407 - RNA, 13 nt, Streptococcus pneumoniae R6
gauuuuauuucau

SEQ ID NO: 4100408 - RNA, 19 nt, Streptococcus pneumoniae R6
gauuuuauuucauuccauc

SEQ ID NO: 4100409 - RNA, 23 nt, Streptococcus pneumoniae R6
gauuuucaaagaguauuaaacaa

SEQ ID NO: 4100410 - RNA, 17 nt, Streptococcus pneumoniae R6
gauuuucaaauuuucuu

SEQ ID NO: 4100411 - RNA, 22 nt, Streptococcus pneumoniae R6
gauuuucagccucuauacuuac

SEQ ID NO: 4100412 - RNA, 22 nt, Streptococcus pneumoniae R6
gauuuucauauaauaaauugua

SEQ ID NO: 4100413 - RNA, 14 nt, Streptococcus pneumoniae R6
gauuuucaucauca

SEQ ID NO: 4100414 - RNA, 15 nt, Streptococcus pneumoniae R6
gauuuucaucaucac

SEQ ID NO: 4100415 - RNA, 20 nt, Streptococcus pneumoniae R6
gauuuucauugaguauaagc

SEQ ID NO: 4100416 - RNA, 22 nt, Streptococcus pneumoniae R6
gauuuucauugaguaugaaaua

SEQ ID NO: 4100417 - RNA, 22 nt, Streptococcus pneumoniae R6
gauuuucccuuuuguauuccac

SEQ ID NO: 4100418 - RNA, 20 nt, Streptococcus pneumoniae R6
gauuuucgaaaauucuuugg

SEQ ID NO: 4100419 - RNA, 21 nt, Streptococcus pneumoniae R6
gauuuucucccguugucuucu

SEQ ID NO: 4100420 - RNA, 15 nt, Streptococcus pneumoniae R6
gauuuucucuuuguu

SEQ ID NO: 4100421 - RNA, 20 nt, Streptococcus pneumoniae R6
gauuuucuuuaaaaaauuuu

SEQ ID NO: 4100422 - RNA, 22 nt, Streptococcus pneumoniae R6
gauuuugagacuaaggagaguc

SEQ ID NO: 4100423 - RNA, 21 nt, Streptococcus pneumoniae R6
gauuuuggcagguaguauuua

SEQ ID NO: 4100424 - RNA, 17 nt, Streptococcus pneumoniae R6
gauuuuguauuuuaucu

SEQ ID NO: 4100425 - RNA, 18 nt, Streptococcus pneumoniae R6
gauuuugugaauuuucaa

SEQ ID NO: 4100426 - RNA, 15 nt, Streptococcus pneumoniae R6
gauuuuguucuuuuu

SEQ ID NO: 4100427 - RNA, 15 nt, Streptococcus pneumoniae R6
gauuuuuaaauucuu

SEQ ID NO: 4100428 - RNA, 23 nt, Streptococcus pneumoniae R6
gauuuuucuaaauuuaacauuaa

SEQ ID NO: 4100429 - RNA, 22 nt, Streptococcus pneumoniae R6
gauuuuucuggcucuuugucaa

SEQ ID NO: 4100430 - RNA, 15 nt, Streptococcus pneumoniae R6
gauuuuugaagagua

SEQ ID NO: 4100431 - RNA, 22 nt, Streptococcus pneumoniae R6
gauuuuuggaaaaaauaaaaaa

SEQ ID NO: 4100432 - RNA, 13 nt, Streptococcus pneumoniae R6
gauuuuuucauuc

SEQ ID NO: 4100433 - RNA, 20 nt, Streptococcus pneumoniae R6
gauuuuuucugucuaacuuu

SEQ ID NO: 4100434 - RNA, 15 nt, Streptococcus pneumoniae R6
gauuuuuucuuuguu

SEQ ID NO: 4100435 - RNA, 17 nt, Streptococcus pneumoniae R6
gauuuuuucuuuguucu

SEQ ID NO: 4100436 - RNA, 20 nt, Streptococcus pneumoniae R6
gauuuuuuucaaacaauuga

SEQ ID NO: 4100437 - RNA, 19 nt, Streptococcus pneumoniae R6
gauuuuuuuuaaaaaagug

SEQ ID NO: 4100438 - RNA, 20 nt, Streptococcus pneumoniae R6
gauuuuuuuuaaaaaagugg

SEQ ID NO: 4100439 - RNA, 22 nt, Streptococcus pneumoniae R6
gauuuuuuuuaaaaaaguggua

SEQ ID NO: 4100440 - RNA, 16 nt, Streptococcus pneumoniae R6
gcaaaaaaaaugaaaa

SEQ ID NO: 4100441 - RNA, 20 nt, Streptococcus pneumoniae R6
gcaaaaaaaaugaaaaaaau

SEQ ID NO: 4100442 - RNA, 18 nt, Streptococcus pneumoniae R6
gcaaaaaauugagaaaga

SEQ ID NO: 4100443 - RNA, 20 nt, Streptococcus pneumoniae R6
gcaaaaacacaauuuuagga

SEQ ID NO: 4100444 - RNA, 21 nt, Streptococcus pneumoniae R6
gcaaaaagacuuagcaaauca

SEQ ID NO: 4100445 - RNA, 18 nt, Streptococcus pneumoniae R6
gcaaaaccaucaucagca

SEQ ID NO: 4100446 - RNA, 18 nt, Streptococcus pneumoniae R6
gcaaaacggaugcagacu

SEQ ID NO: 4100447 - RNA, 13 nt, Streptococcus pneumoniae R6
gcaaaagaacaag

SEQ ID NO: 4100448 - RNA, 20 nt, Streptococcus pneumoniae R6
gcaaaagaacaaguaaagag

SEQ ID NO: 4100449 - RNA, 13 nt, Streptococcus pneumoniae R6
gcaaaaucauaaa

SEQ ID NO: 4100450 - RNA, 21 nt, Streptococcus pneumoniae R6
gcaaaaucauaaacuauccag

SEQ ID NO: 4100451 - RNA, 19 nt, Streptococcus pneumoniae R6
gcaaacauucccacaauaa

SEQ ID NO: 4100452 - RNA, 20 nt, Streptococcus pneumoniae R6
gcaaacgaacgccuuaaaaa

SEQ ID NO: 4100453 - RNA, 16 nt, Streptococcus pneumoniae R6
gcagcaacgucuucaa

SEQ ID NO: 4100454 - RNA, 16 nt, Streptococcus pneumoniae R6
gcagccacuuuuuauc

SEQ ID NO: 4100455 - RNA, 22 nt, Streptococcus pneumoniae R6
gcagccuccguaccaacacauu

SEQ ID NO: 4100456 - RNA, 20 nt, Streptococcus pneumoniae R6
gcagcuuguuguuaaacaag

SEQ ID NO: 4100457 - RNA, 13 nt, Streptococcus pneumoniae R6
gcaggaagaaaga

SEQ ID NO: 4100458 - RNA, 14 nt, Streptococcus pneumoniae R6
gcaggaagaaagag

SEQ ID NO: 4100459 - RNA, 19 nt, Streptococcus pneumoniae R6
gcaggaagaaagaggagua

SEQ ID NO: 4100460 - RNA, 13 nt, Streptococcus pneumoniae R6
gcaggaaggaaau

SEQ ID NO: 4100461 - RNA, 15 nt, Streptococcus pneumoniae R6
gcaggaccagaaaga

SEQ ID NO: 4100462 - RNA, 15 nt, Streptococcus pneumoniae R6
gcaggacucuuguuc

SEQ ID NO: 4100463 - RNA, 15 nt, Streptococcus pneumoniae R6
gcaggaguuuucccu

SEQ ID NO: 4100464 - RNA, 18 nt, Streptococcus pneumoniae R6
gcaggauuuuugcuucug

SEQ ID NO: 4100465 - RNA, 17 nt, Streptococcus pneumoniae R6
gcaggcugguuccuccu

SEQ ID NO: 4100466 - RNA, 23 nt, Streptococcus pneumoniae R6
gcagggcuauuuggcuuaucuga

SEQ ID NO: 4100467 - RNA, 14 nt, Streptococcus pneumoniae R6
gcaguaucaaucau

SEQ ID NO: 4100468 - RNA, 17 nt, Streptococcus pneumoniae R6
gcagucaagauggacug

SEQ ID NO: 4100469 - RNA, 21 nt, Streptococcus pneumoniae R6
gcagucagugguucacuggca

SEQ ID NO: 4100470 - RNA, 14 nt, Streptococcus pneumoniae R6
gcagucuucaauac

SEQ ID NO: 4100471 - RNA, 15 nt, Streptococcus pneumoniae R6
gcagucuuuuugcug

SEQ ID NO: 4100472 - RNA, 20 nt, Streptococcus pneumoniae R6
gcagugguuuagaagucuca

SEQ ID NO: 4100473 - RNA, 18 nt, Streptococcus pneumoniae R6
gcaguucauauucaacac

SEQ ID NO: 4100474 - RNA, 19 nt, Streptococcus pneumoniae R6
gcaguucuugcucaaucaa

SEQ ID NO: 4100475 - RNA, 20 nt, Streptococcus pneumoniae R6
gcaguucuugcucaaucaau

SEQ ID NO: 4100476 - RNA, 11 nt, Streptococcus pneumoniae R6
gcauaaauacu

SEQ ID NO: 4100477 - RNA, 14 nt, Streptococcus pneumoniae R6
gcauaagaaacucu

SEQ ID NO: 4100478 - RNA, 20 nt, Streptococcus pneumoniae R6
gcauaagucauaacauucua

SEQ ID NO: 4100479 - RNA, 21 nt, Streptococcus pneumoniae R6
gcauaauaccaaggauugucu

SEQ ID NO: 4100480 - RNA, 14 nt, Streptococcus pneumoniae R6
gcauaauagcagaa

SEQ ID NO: 4100481 - RNA, 20 nt, Streptococcus pneumoniae R6
gcauaauagcagaaaaauga

SEQ ID NO: 4100482 - RNA, 20 nt, Streptococcus pneumoniae R6
gcauaauaucaaguuuucac

SEQ ID NO: 4100483 - RNA, 20 nt, Streptococcus pneumoniae R6
gcauaaucuuggucaacaua

SEQ ID NO: 4100484 - RNA, 14 nt, Streptococcus pneumoniae R6
gcauagacuucaac

SEQ ID NO: 4100485 - RNA, 16 nt, Streptococcus pneumoniae R6
gcauaguaucaaguuu

SEQ ID NO: 4100486 - RNA, 23 nt, Streptococcus pneumoniae R6
gcauaguaucagguauugaaaaa

SEQ ID NO: 4100487 - RNA, 17 nt, Streptococcus pneumoniae R6
gcauaguauuuguuaaa

SEQ ID NO: 4100488 - RNA, 19 nt, Streptococcus pneumoniae R6
gcauagucgccacauugag

SEQ ID NO: 4100489 - RNA, 14 nt, Streptococcus pneumoniae R6
gcauauaaugguuu

SEQ ID NO: 4100490 - RNA, 15 nt, Streptococcus pneumoniae R6
gcauauaaugguuuc

SEQ ID NO: 4100491 - RNA, 12 nt, Streptococcus pneumoniae R6
gcauaucagaca

SEQ ID NO: 4100492 - RNA, 15 nt, Streptococcus pneumoniae R6
gcauauuucaugcuu

SEQ ID NO: 4100493 - RNA, 18 nt, Streptococcus pneumoniae R6
gcauccaccuucaucucu

SEQ ID NO: 4100494 - RNA, 21 nt, Streptococcus pneumoniae R6
gcauccaccuucaucucucua

SEQ ID NO: 4100495 - RNA, 18 nt, Streptococcus pneumoniae R6
gcauccccagugauuucu

SEQ ID NO: 4100496 - RNA, 23 nt, Streptococcus pneumoniae R6
gcauccuaucaaguucacucaaa

SEQ ID NO: 4100497 - RNA, 17 nt, Streptococcus pneumoniae R6
gcaucgacuacuaaaac

SEQ ID NO: 4100498 - RNA, 15 nt, Streptococcus pneumoniae R6
gcaucgcccauggcc

SEQ ID NO: 4100499 - RNA, 17 nt, Streptococcus pneumoniae R6
gcaucuuaguuaaaaua

SEQ ID NO: 4100500 - RNA, 21 nt, Streptococcus pneumoniae R6
gcaucuuaucagaaaauaaaa

SEQ ID NO: 4100501 - RNA, 14 nt, Streptococcus pneumoniae R6
gcaucuuauuucaa

SEQ ID NO: 4100502 - RNA, 22 nt, Streptococcus pneumoniae R6
gcaucuuuguaaguuucuucuu

SEQ ID NO: 4100503 - RNA, 17 nt, Streptococcus pneumoniae R6
gcaugaaggucuuuugu

SEQ ID NO: 4100504 - RNA, 14 nt, Streptococcus pneumoniae R6
gcaugggccccagc

SEQ ID NO: 4100505 - RNA, 15 nt, Streptococcus pneumoniae R6
gcaugguuauaggcu

SEQ ID NO: 4100506 - RNA, 22 nt, Streptococcus pneumoniae R6
gcaugucguauaguagaagugu

SEQ ID NO: 4100507 - RNA, 17 nt, Streptococcus pneumoniae R6
gcauuaaucauucccug

SEQ ID NO: 4100508 - RNA, 17 nt, Streptococcus pneumoniae R6
gcauuauccauaauaau

SEQ ID NO: 4100509 - RNA, 23 nt, Streptococcus pneumoniae R6
gcauucaaaacgccauucaucac

SEQ ID NO: 4100510 - RNA, 16 nt, Streptococcus pneumoniae R6
gcauucuaguccaucu

SEQ ID NO: 4100511 - RNA, 18 nt, Streptococcus pneumoniae R6
gcauucuaguccaucucc

SEQ ID NO: 4100512 - RNA, 16 nt, Streptococcus pneumoniae R6
gcauucuauuccaucu

SEQ ID NO: 4100513 - RNA, 23 nt, Streptococcus pneumoniae R6
gcauucuucucuugaaaaugaaa

SEQ ID NO: 4100514 - RNA, 14 nt, Streptococcus pneumoniae R6
gcauugaggacaau

SEQ ID NO: 4100515 - RNA, 14 nt, Streptococcus pneumoniae R6
gcauugucacaaag

SEQ ID NO: 4100516 - RNA, 14 nt, Streptococcus pneumoniae R6
gcauuuguaaaucu

SEQ ID NO: 4100517 - RNA, 14 nt, Streptococcus pneumoniae R6
gcauuuuuucauug

SEQ ID NO: 4100518 - RNA, 19 nt, Streptococcus pneumoniae R6
gcauuuuuuguuaguuuaa

SEQ ID NO: 4100519 - RNA, 12 nt, Streptococcus pneumoniae R6
gccaaaauccuu

SEQ ID NO: 4100520 - RNA, 16 nt, Streptococcus pneumoniae R6
gccaaacuugaaauga

SEQ ID NO: 4100521 - RNA, 23 nt, Streptococcus pneumoniae R6
gccaaauaucuucggauuuuucu

SEQ ID NO: 4100522 - RNA, 11 nt, Streptococcus pneumoniae R6
gccaaaucaau

SEQ ID NO: 4100523 - RNA, 14 nt, Streptococcus pneumoniae R6
gccaaaucaucaua

SEQ ID NO: 4100524 - RNA, 23 nt, Streptococcus pneumoniae R6
gccaaauccuauucggacuuugg

SEQ ID NO: 4100525 - RNA, 17 nt, Streptococcus pneumoniae R6
gccaacaacugauucua

SEQ ID NO: 4100526 - RNA, 19 nt, Streptococcus pneumoniae R6
gccaacaacugauucuacu

SEQ ID NO: 4100527 - RNA, 23 nt, Streptococcus pneumoniae R6
gccaacaacugauucuacuuuuu

SEQ ID NO: 4100528 - RNA, 20 nt, Streptococcus pneumoniae R6
gccaacuucuuuuugauuua

SEQ ID NO: 4100529 - RNA, 19 nt, Streptococcus pneumoniae R6
gccaagaguagagagaaag

SEQ ID NO: 4100530 - RNA, 18 nt, Streptococcus pneumoniae R6
gccaagauauugccgaua

SEQ ID NO: 4100531 - RNA, 15 nt, Streptococcus pneumoniae R6
gccaagguucauuuc

SEQ ID NO: 4100532 - RNA, 16 nt, Streptococcus pneumoniae R6
gccaauacugcucggu

SEQ ID NO: 4100533 - RNA, 21 nt, Streptococcus pneumoniae R6
gccaaucacuugaccaaagac

SEQ ID NO: 4100534 - RNA, 19 nt, Streptococcus pneumoniae R6
gccaauguauuaagaacuc

SEQ ID NO: 4100535 - RNA, 13 nt, Streptococcus pneumoniae R6
gccaauuaaauaa

SEQ ID NO: 4100536 - RNA, 15 nt, Streptococcus pneumoniae R6
gccaauucuucuucu

SEQ ID NO: 4100537 - RNA, 14 nt, Streptococcus pneumoniae R6
gccacaauacccac

SEQ ID NO: 4100538 - RNA, 16 nt, Streptococcus pneumoniae R6
gccaccaacugcacca

SEQ ID NO: 4100539 - RNA, 21 nt, Streptococcus pneumoniae R6
gccaccgccagaacuuccacu

SEQ ID NO: 4100540 - RNA, 20 nt, Streptococcus pneumoniae R6
gccaccuuuucgaguaacau

SEQ ID NO: 4100541 - RNA, 13 nt, Streptococcus pneumoniae R6
gccagaaaaaguc

SEQ ID NO: 4100542 - RNA, 15 nt, Streptococcus pneumoniae R6
gccagaaaaaucccu

SEQ ID NO: 4100543 - RNA, 15 nt, Streptococcus pneumoniae R6
gccagaaauucccuc

SEQ ID NO: 4100544 - RNA, 19 nt, Streptococcus pneumoniae R6
gccagaacuuccacuucca

SEQ ID NO: 4100545 - RNA, 22 nt, Streptococcus pneumoniae R6
gccagaauaauuaaaucauaaa

SEQ ID NO: 4100546 - RNA, 10 nt, Streptococcus pneumoniae R6
gccagacugg

SEQ ID NO: 4100547 - RNA, 12 nt, Streptococcus pneumoniae R6
gccagagcacca

SEQ ID NO: 4100548 - RNA, 14 nt, Streptococcus pneumoniae R6
gccagauacuggua

SEQ ID NO: 4100549 - RNA, 20 nt, Streptococcus pneumoniae R6
gccagauuccugaaauaaaa

SEQ ID NO: 4100550 - RNA, 15 nt, Streptococcus pneumoniae R6
gccagccuaucguag

SEQ ID NO: 4100551 - RNA, 17 nt, Streptococcus pneumoniae R6
gccagcucgucaaucuc

SEQ ID NO: 4100552 - RNA, 23 nt, Streptococcus pneumoniae R6
gccagguuucguggcgacgccag

SEQ ID NO: 4100553 - RNA, 22 nt, Streptococcus pneumoniae R6
gccaguagcuauuagaccugcc

SEQ ID NO: 4100554 - RNA, 14 nt, Streptococcus pneumoniae R6
gccagucauuacca

SEQ ID NO: 4100555 - RNA, 22 nt, Streptococcus pneumoniae R6
gccaguugcugcguuaaauccu

SEQ ID NO: 4100556 - RNA, 20 nt, Streptococcus pneumoniae R6
gcgcuggucacgaccagaaa

SEQ ID NO: 4100557 - RNA, 21 nt, Streptococcus pneumoniae R6
gcgcuugauaaccuuaaucaa

SEQ ID NO: 4100558 - RNA, 19 nt, Streptococcus pneumoniae R6
gcgguucaacuaacuuuua

SEQ ID NO: 4100559 - RNA, 14 nt, Streptococcus pneumoniae R6
gcgguuugaagaga

SEQ ID NO: 4100560 - RNA, 21 nt, Streptococcus pneumoniae R6
gcguauuccauuggaaguucu

SEQ ID NO: 4100561 - RNA, 15 nt, Streptococcus pneumoniae R6
gcgucagcuuuaucu

SEQ ID NO: 4100562 - RNA, 19 nt, Streptococcus pneumoniae R6
gcguccucuaguaaagugu

SEQ ID NO: 4100563 - RNA, 18 nt, Streptococcus pneumoniae R6
gcguucaaagacuugccc

SEQ ID NO: 4100564 - RNA, 15 nt, Streptococcus pneumoniae R6
gcguucaccaggagc

SEQ ID NO: 4100565 - RNA, 19 nt, Streptococcus pneumoniae R6
gcguucaccaggagccaag

SEQ ID NO: 4100566 - RNA, 21 nt, Streptococcus pneumoniae R6
gcguucaccaggagccaagau

SEQ ID NO: 4100567 - RNA, 14 nt, Streptococcus pneumoniae R6
gcguugacaaucuu

SEQ ID NO: 4100568 - RNA, 20 nt, Streptococcus pneumoniae R6
gcguugacgauuuucucuuu

SEQ ID NO: 4100569 - RNA, 22 nt, Streptococcus pneumoniae R6
gcguuggaauaaggcagcuuaa

SEQ ID NO: 4100570 - RNA, 17 nt, Streptococcus pneumoniae R6
gcguuugacaaguaagu

SEQ ID NO: 4100571 - RNA, 14 nt, Streptococcus pneumoniae R6
gcguuuugaaacua

SEQ ID NO: 4100572 - RNA, 16 nt, Streptococcus pneumoniae R6
gcguuuugaaacuaga

SEQ ID NO: 4100573 - RNA, 16 nt, Streptococcus pneumoniae R6
gcguuuugaguuaacu

SEQ ID NO: 4100574 - RNA, 13 nt, Streptococcus pneumoniae R6
gcguuuuugugau

SEQ ID NO: 4100575 - RNA, 13 nt, Streptococcus pneumoniae R6
gcuaaaaaaaggg

SEQ ID NO: 4100576 - RNA, 22 nt, Streptococcus pneumoniae R6
gcuaaaaaaagggauugaaggc

SEQ ID NO: 4100577 - RNA, 20 nt, Streptococcus pneumoniae R6
gcuaaaacauuuauagaaau

SEQ ID NO: 4100578 - RNA, 23 nt, Streptococcus pneumoniae R6
gcuaaaagauuucuauaaauuca

SEQ ID NO: 4100579 - RNA, 19 nt, Streptococcus pneumoniae R6
gcuaaaauguuuuucgucu

SEQ ID NO: 4100580 - RNA, 17 nt, Streptococcus pneumoniae R6
gcuaaagaugaugguua

SEQ ID NO: 4100581 - RNA, 16 nt, Streptococcus pneumoniae R6
gcuaacugcuucacua

SEQ ID NO: 4100582 - RNA, 15 nt, Streptococcus pneumoniae R6
gcuaagagagaagcc

SEQ ID NO: 4100583 - RNA, 22 nt, Streptococcus pneumoniae R6
gcuaagagagaagccuucuguu

SEQ ID NO: 4100584 - RNA, 15 nt, Streptococcus pneumoniae R6
gcuaagccuuuuucu

SEQ ID NO: 4100585 - RNA, 20 nt, Streptococcus pneumoniae R6
gcuaagcucgauaaaggaca

SEQ ID NO: 4100586 - RNA, 21 nt, Streptococcus pneumoniae R6
gcuaaggaggcaaagaaaaaa

SEQ ID NO: 4100587 - RNA, 23 nt, Streptococcus pneumoniae R6
gcuaaguccuuuuaguuuuaucu

SEQ ID NO: 4100588 - RNA, 14 nt, Streptococcus pneumoniae R6
gcuaauagagcuga

SEQ ID NO: 4100589 - RNA, 21 nt, Streptococcus pneumoniae R6
gcuaauuucaagaaguugucu

SEQ ID NO: 4100590 - RNA, 13 nt, Streptococcus pneumoniae R6
gcuaauuuugcca

SEQ ID NO: 4100591 - RNA, 20 nt, Streptococcus pneumoniae R6
gcuaauuuuuugagcaauaa

SEQ ID NO: 4100592 - RNA, 11 nt, Streptococcus pneumoniae R6
gcuacaagaac

SEQ ID NO: 4100593 - RNA, 23 nt, Streptococcus pneumoniae R6
gcuacaccagcuaugccagugcc

SEQ ID NO: 4100594 - RNA, 14 nt, Streptococcus pneumoniae R6
gcuacagaugcugc

SEQ ID NO: 4100595 - RNA, 15 nt, Streptococcus pneumoniae R6
gcuacaggcaugggc

SEQ ID NO: 4100596 - RNA, 14 nt, Streptococcus pneumoniae R6
gcuacgacuuucaa

SEQ ID NO: 4100597 - RNA, 22 nt, Streptococcus pneumoniae R6
gcuagaaacguuguuaaaucaa

SEQ ID NO: 4100598 - RNA, 13 nt, Streptococcus pneumoniae R6
gcuagauuuaaaa

SEQ ID NO: 4100599 - RNA, 14 nt, Streptococcus pneumoniae R6
gcuagauuuaaaac

SEQ ID NO: 4100600 - RNA, 23 nt, Streptococcus pneumoniae R6
gcuagccgcagguugcucaaaac

SEQ ID NO: 4100601 - RNA, 17 nt, Streptococcus pneumoniae R6
gcuagcuguagaagacg

SEQ ID NO: 4100602 - RNA, 16 nt, Streptococcus pneumoniae R6
gcuaggcgcuucacua

SEQ ID NO: 4100603 - RNA, 22 nt, Streptococcus pneumoniae R6
gcuaggugagauuggauuuucu

SEQ ID NO: 4100604 - RNA, 14 nt, Streptococcus pneumoniae R6
gcuaguacauucuu

SEQ ID NO: 4100605 - RNA, 14 nt, Streptococcus pneumoniae R6
gcuaguuuuuagga

SEQ ID NO: 4100606 - RNA, 21 nt, Streptococcus pneumoniae R6
gcuauaauuauucugcaauca

SEQ ID NO: 4100607 - RNA, 21 nt, Streptococcus pneumoniae R6
gcuauacuguaguuaugaaac

SEQ ID NO: 4100608 - RNA, 17 nt, Streptococcus pneumoniae R6
gcuauccagauagacau

SEQ ID NO: 4100609 - RNA, 15 nt, Streptococcus pneumoniae R6
gcuaucgauaucaau

SEQ ID NO: 4100610 - RNA, 23 nt, Streptococcus pneumoniae R6
gcuaucuaggcugacaauaaaga

SEQ ID NO: 4100611 - RNA, 18 nt, Streptococcus pneumoniae R6
gcuaucuuauugauuuuu

SEQ ID NO: 4100612 - RNA, 17 nt, Streptococcus pneumoniae R6
gcuaugaauaugaguuc

SEQ ID NO: 4100613 - RNA, 20 nt, Streptococcus pneumoniae R6
gcuauuaagaaaaaugauuc

SEQ ID NO: 4100614 - RNA, 15 nt, Streptococcus pneumoniae R6
gcuauuagaccugcc

SEQ ID NO: 4100615 - RNA, 15 nt, Streptococcus pneumoniae R6
gcuauuauuaauguu

SEQ ID NO: 4100616 - RNA, 13 nt, Streptococcus pneumoniae R6
gcuauucuucucu

SEQ ID NO: 4100617 - RNA, 20 nt, Streptococcus pneumoniae R6
gcuauuuguuguaagcuagc

SEQ ID NO: 4100618 - RNA, 12 nt, Streptococcus pneumoniae R6
gcucaaaacacu

SEQ ID NO: 4100619 - RNA, 19 nt, Streptococcus pneumoniae R6
gcucaaaacacuguuuuga

SEQ ID NO: 4100620 - RNA, 19 nt, Streptococcus pneumoniae R6
gcucaaaacaugguuuuga

SEQ ID NO: 4100621 - RNA, 15 nt, Streptococcus pneumoniae R6
gcucaaaagcuuguu

SEQ ID NO: 4100622 - RNA, 14 nt, Streptococcus pneumoniae R6
gcucaaaaguuuau

SEQ ID NO: 4100623 - RNA, 22 nt, Streptococcus pneumoniae R6
gcucaaaaguuuaucuagaauu

SEQ ID NO: 4100624 - RNA, 21 nt, Streptococcus pneumoniae R6
gcucaaaguacagauuugaaa

SEQ ID NO: 4100625 - RNA, 17 nt, Streptococcus pneumoniae R6
gcucaagaccuugauua

SEQ ID NO: 4100626 - RNA, 22 nt, Streptococcus pneumoniae R6
gcucaaugaaaaucaaagagca

SEQ ID NO: 4100627 - RNA, 15 nt, Streptococcus pneumoniae R6
gcucauaguuuaucu

SEQ ID NO: 4100628 - RNA, 14 nt, Streptococcus pneumoniae R6
gcucaucaucugaa

SEQ ID NO: 4100629 - RNA, 15 nt, Streptococcus pneumoniae R6
gcucaucaucugaau

SEQ ID NO: 4100630 - RNA, 18 nt, Streptococcus pneumoniae R6
gcucauccccucaaccug

SEQ ID NO: 4100631 - RNA, 19 nt, Streptococcus pneumoniae R6
gcucauggcaagcaagucu

SEQ ID NO: 4100632 - RNA, 21 nt, Streptococcus pneumoniae R6
gcucauguaaaucauuuucuu

SEQ ID NO: 4100633 - RNA, 13 nt, Streptococcus pneumoniae R6
gcuccaaucccuu

SEQ ID NO: 4100634 - RNA, 12 nt, Streptococcus pneumoniae R6
gcuccacccaug

SEQ ID NO: 4100635 - RNA, 13 nt, Streptococcus pneumoniae R6
gcuccagaaauaa

SEQ ID NO: 4100636 - RNA, 13 nt, Streptococcus pneumoniae R6
gcuccaucuccaa

SEQ ID NO: 4100637 - RNA, 14 nt, Streptococcus pneumoniae R6
gcuccaucuccaac

SEQ ID NO: 4100638 - RNA, 21 nt, Streptococcus pneumoniae R6
gcucccauuggaucccauggu

SEQ ID NO: 4100639 - RNA, 14 nt, Streptococcus pneumoniae R6
gcucccauuuuugg

SEQ ID NO: 4100640 - RNA, 14 nt, Streptococcus pneumoniae R6
gcucccuucuuuag

SEQ ID NO: 4100641 - RNA, 17 nt, Streptococcus pneumoniae R6
gcuccguacgcuccuga

SEQ ID NO: 4100642 - RNA, 22 nt, Streptococcus pneumoniae R6
gcuccguuaggugcgagacaaa

SEQ ID NO: 4100643 - RNA, 15 nt, Streptococcus pneumoniae R6
gcuccuaaaucaacu

SEQ ID NO: 4100644 - RNA, 18 nt, Streptococcus pneumoniae R6
gcuccuauuacuaucaag

SEQ ID NO: 4100645 - RNA, 16 nt, Streptococcus pneumoniae R6
gcuccuccgagagcug

SEQ ID NO: 4100646 - RNA, 19 nt, Streptococcus pneumoniae R6
gcuccuccgagagcugaua

SEQ ID NO: 4100647 - RNA, 24 nt, Streptococcus pneumoniae R6
gcuccugaauuagcaaucacucua

SEQ ID NO: 4100648 - RNA, 12 nt, Streptococcus pneumoniae R6
gcucgcuggaga

SEQ ID NO: 4100649 - RNA, 18 nt, Streptococcus pneumoniae R6
gcucgcuguuuauuuuuu

SEQ ID NO: 4100650 - RNA, 13 nt, Streptococcus pneumoniae R6
gcucguucaaccg

SEQ ID NO: 4100651 - RNA, 17 nt, Streptococcus pneumoniae R6
gcucuauacacauccag

SEQ ID NO: 4100652 - RNA, 16 nt, Streptococcus pneumoniae R6
gcucuaugauuuucac

SEQ ID NO: 4100653 - RNA, 24 nt, Streptococcus pneumoniae R6
gcucucaagaacaguuaugauauu

SEQ ID NO: 4100654 - RNA, 15 nt, Streptococcus pneumoniae R6
gcucuuaaaagcaaa

SEQ ID NO: 4100655 - RNA, 12 nt, Streptococcus pneumoniae R6
gcucuuaaacaa

SEQ ID NO: 4100656 - RNA, 15 nt, Streptococcus pneumoniae R6
gcucuuaaacaagag

SEQ ID NO: 4100657 - RNA, 13 nt, Streptococcus pneumoniae R6
gcucuuaucuguc

SEQ ID NO: 4100658 - RNA, 18 nt, Streptococcus pneumoniae R6
gcucuucuggcagauaga

SEQ ID NO: 4100659 - RNA, 18 nt, Streptococcus pneumoniae R6
gcuuucacuauaguccaa

SEQ ID NO: 4100660 - RNA, 21 nt, Streptococcus pneumoniae R6
gcuuuccaauaauucaccuau

SEQ ID NO: 4100661 - RNA, 23 nt, Streptococcus pneumoniae R6
gcuuuccauuaauucgauuucug

SEQ ID NO: 4100662 - RNA, 21 nt, Streptococcus pneumoniae R6
gcuuucuauagaaaacaacuu

SEQ ID NO: 4100663 - RNA, 20 nt, Streptococcus pneumoniae R6
gcuuucugcaguuucucuac

SEQ ID NO: 4100664 - RNA, 19 nt, Streptococcus pneumoniae R6
gcuuucuguaaucuuacca

SEQ ID NO: 4100665 - RNA, 22 nt, Streptococcus pneumoniae R6
gcuuucuucacaucacuuucug

SEQ ID NO: 4100666 - RNA, 15 nt, Streptococcus pneumoniae R6
gcuuucuucagauuu

SEQ ID NO: 4100667 - RNA, 17 nt, Streptococcus pneumoniae R6
gcuuugaaaauuccauu

SEQ ID NO: 4100668 - RNA, 18 nt, Streptococcus pneumoniae R6
gcuuugacauccuuuucu

SEQ ID NO: 4100669 - RNA, 22 nt, Streptococcus pneumoniae R6
gcuuugagaucuuuuucgcuug

SEQ ID NO: 4100670 - RNA, 17 nt, Streptococcus pneumoniae R6
gcuuugagcaaccugcg

SEQ ID NO: 4100671 - RNA, 23 nt, Streptococcus pneumoniae R6
gcuuugagggcugcaaaauuuug

SEQ ID NO: 4100672 - RNA, 17 nt, Streptococcus pneumoniae R6
gcuuugaguaaccugcg

SEQ ID NO: 4100673 - RNA, 17 nt, Streptococcus pneumoniae R6
gcuuugcgcuagauccu

SEQ ID NO: 4100674 - RNA, 19 nt, Streptococcus pneumoniae R6
gcuuugugaagacagauga

SEQ ID NO: 4100675 - RNA, 11 nt, Streptococcus pneumoniae R6
gcuuuuauaaa

SEQ ID NO: 4100676 - RNA, 18 nt, Streptococcus pneumoniae R6
gcuuuuauucagccaagg

SEQ ID NO: 4100677 - RNA, 13 nt, Streptococcus pneumoniae R6
gcuuuuauuucuu

SEQ ID NO: 4100678 - RNA, 20 nt, Streptococcus pneumoniae R6
gcuuuucuaucacuccaaaa

SEQ ID NO: 4100679 - RNA, 19 nt, Streptococcus pneumoniae R6
gcuuuugauggguucuuug

SEQ ID NO: 4100680 - RNA, 12 nt, Streptococcus pneumoniae R6
gcuuuugcagca

SEQ ID NO: 4100681 - RNA, 17 nt, Streptococcus pneumoniae R6
gcuuuugcagcaccagu

SEQ ID NO: 4100682 - RNA, 23 nt, Streptococcus pneumoniae R6
gcuuuuuccucauaccuagcgaa

SEQ ID NO: 4100683 - RNA, 16 nt, Streptococcus pneumoniae R6
gcuuuuucucaucuau

SEQ ID NO: 4100684 - RNA, 20 nt, Streptococcus pneumoniae R6
gcuuuuuuguauucacaaaa

SEQ ID NO: 4100685 - RNA, 20 nt, Streptococcus pneumoniae R6
gcuuuuuuugcuuaaauaaa

SEQ ID NO: 4100686 - RNA, 16 nt, Streptococcus pneumoniae R6
ggaaaaaagucuuuaa

SEQ ID NO: 4100687 - RNA, 20 nt, Streptococcus pneumoniae R6
ggaaaaaauaaaaaaauuug

SEQ ID NO: 4100688 - RNA, 15 nt, Streptococcus pneumoniae R6
ggaaaaaaugaagca

SEQ ID NO: 4100689 - RNA, 19 nt, Streptococcus pneumoniae R6
ggaaaaaggcaacgaagcu

SEQ ID NO: 4100690 - RNA, 15 nt, Streptococcus pneumoniae R6
ggaaaaccaguucau

SEQ ID NO: 4100691 - RNA, 13 nt, Streptococcus pneumoniae R6
ggaaaagauagag

SEQ ID NO: 4100692 - RNA, 15 nt, Streptococcus pneumoniae R6
ggaaaagauagagac

SEQ ID NO: 4100693 - RNA, 15 nt, Streptococcus pneumoniae R6
ggaaaagucuuauaa

SEQ ID NO: 4100694 - RNA, 18 nt, Streptococcus pneumoniae R6
ggaaaauacugauaaaaa

SEQ ID NO: 4100695 - RNA, 22 nt, Streptococcus pneumoniae R6
ggaaaaucuucccacaauaaaa

SEQ ID NO: 4100696 - RNA, 18 nt, Streptococcus pneumoniae R6
ggaaaauucucuuuucau

SEQ ID NO: 4100697 - RNA, 19 nt, Streptococcus pneumoniae R6
ggaaacaaaagucuucuaa

SEQ ID NO: 4100698 - RNA, 20 nt, Streptococcus pneumoniae R6
ggaaacaaaagucuucuaac

SEQ ID NO: 4100699 - RNA, 18 nt, Streptococcus pneumoniae R6
ggaaacaaaauuaccauc

SEQ ID NO: 4100700 - RNA, 18 nt, Streptococcus pneumoniae R6
ggaaacagauuucuuaga

SEQ ID NO: 4100701 - RNA, 14 nt, Streptococcus pneumoniae R6
ggaaaccaagaagu

SEQ ID NO: 4100702 - RNA, 19 nt, Streptococcus pneumoniae R6
ggaaaccaaucucaaaucc

SEQ ID NO: 4100703 - RNA, 18 nt, Streptococcus pneumoniae R6
ggaaaccuaaucauagug

SEQ ID NO: 4100704 - RNA, 13 nt, Streptococcus pneumoniae R6
ggaaacgcucggu

SEQ ID NO: 4100705 - RNA, 21 nt, Streptococcus pneumoniae R6
ggaaacuagccgcagauugcu

SEQ ID NO: 4100706 - RNA, 16 nt, Streptococcus pneumoniae R6
ggaaacucaaaagaag

SEQ ID NO: 4100707 - RNA, 22 nt, Streptococcus pneumoniae R6
ggaaacucucguaaacaaagag

SEQ ID NO: 4100708 - RNA, 15 nt, Streptococcus pneumoniae R6
ggaaacucuuacaaa

SEQ ID NO: 4100709 - RNA, 22 nt, Streptococcus pneumoniae R6
ggaaagacuggugagauaaaac

SEQ ID NO: 4100710 - RNA, 14 nt, Streptococcus pneumoniae R6
ggaaagauaacugc

SEQ ID NO: 4100711 - RNA, 21 nt, Streptococcus pneumoniae R6
ggaaagauaucgguuuaucuc

SEQ ID NO: 4100712 - RNA, 20 nt, Streptococcus pneumoniae R6
ggaaaggcuagguaaguccu

SEQ ID NO: 4100713 - RNA, 14 nt, Streptococcus pneumoniae R6
ggaaagucaaauua

SEQ ID NO: 4100714 - RNA, 23 nt, Streptococcus pneumoniae R6
ggaaagucaaauuaauuuauaga

SEQ ID NO: 4100715 - RNA, 17 nt, Streptococcus pneumoniae R6
ggaaaugaucagaccag

SEQ ID NO: 4100716 - RNA, 20 nt, Streptococcus pneumoniae R6
ggaaaugaucagaccaguuu

SEQ ID NO: 4100717 - RNA, 18 nt, Streptococcus pneumoniae R6
ggaacaagucagcucaaa

SEQ ID NO: 4100718 - RNA, 20 nt, Streptococcus pneumoniae R6
ggaacaagucagcucaaagc

SEQ ID NO: 4100719 - RNA, 21 nt, Streptococcus pneumoniae R6
ggaacacguaaauuauacucu

SEQ ID NO: 4100720 - RNA, 21 nt, Streptococcus pneumoniae R6
ggaaccagguucuaaaaucug

SEQ ID NO: 4100721 - RNA, 17 nt, Streptococcus pneumoniae R6
ggaaccugaaaaaauaa

SEQ ID NO: 4100722 - RNA, 22 nt, Streptococcus pneumoniae R6
ggaacgauguuugcagcaccag

SEQ ID NO: 4100723 - RNA, 17 nt, Streptococcus pneumoniae R6
ggaacgcguugugcaga

SEQ ID NO: 4100724 - RNA, 15 nt, Streptococcus pneumoniae R6
ggaacuaagauuugu

SEQ ID NO: 4100725 - RNA, 15 nt, Streptococcus pneumoniae R6
ggaagaaagaggagu

SEQ ID NO: 4100726 - RNA, 23 nt, Streptococcus pneumoniae R6
ggaagacugaguauuuuauagua

SEQ ID NO: 4100727 - RNA, 17 nt, Streptococcus pneumoniae R6
ggaagagaagcugucuu

SEQ ID NO: 4100728 - RNA, 14 nt, Streptococcus pneumoniae R6
ggaagauuuauacu

SEQ ID NO: 4100729 - RNA, 17 nt, Streptococcus pneumoniae R6
ggaagcacacaaaucuu

SEQ ID NO: 4100730 - RNA, 18 nt, Streptococcus pneumoniae R6
ggaagccuucuuuuccac

SEQ ID NO: 4100731 - RNA, 17 nt, Streptococcus pneumoniae R6
ggaagcgaugauaagaa

SEQ ID NO: 4100732 - RNA, 21 nt, Streptococcus pneumoniae R6
ggaagguauggccgauaacag

SEQ ID NO: 4100733 - RNA, 15 nt, Streptococcus pneumoniae R6
ggaaggugagggcug

SEQ ID NO: 4100734 - RNA, 13 nt, Streptococcus pneumoniae R6
ggaaguaccaagg

SEQ ID NO: 4100735 - RNA, 18 nt, Streptococcus pneumoniae R6
ggaagucuguuauuucuu

SEQ ID NO: 4100736 - RNA, 15 nt, Streptococcus pneumoniae R6
ggaagugaaacagca

SEQ ID NO: 4100737 - RNA, 16 nt, Streptococcus pneumoniae R6
ggaauaaagguaaaac

SEQ ID NO: 4100738 - RNA, 18 nt, Streptococcus pneumoniae R6
ggaauaaauccagcugag

SEQ ID NO: 4100739 - RNA, 20 nt, Streptococcus pneumoniae R6
ggaauacuaaaauauuucua

SEQ ID NO: 4100740 - RNA, 18 nt, Streptococcus pneumoniae R6
ggaauaguugaaaucaag

SEQ ID NO: 4100741 - RNA, 19 nt, Streptococcus pneumoniae R6
ggaauauugaguucuucac

SEQ ID NO: 4100742 - RNA, 15 nt, Streptococcus pneumoniae R6
ggaaucaacauaucc

SEQ ID NO: 4100743 - RNA, 14 nt, Streptococcus pneumoniae R6
ggaaucaaucuuca

SEQ ID NO: 4100744 - RNA, 19 nt, Streptococcus pneumoniae R6
ggaaugacgaaacgaagaa

SEQ ID NO: 4100745 - RNA, 14 nt, Streptococcus pneumoniae R6
ggaaugccaaagac

SEQ ID NO: 4100746 - RNA, 13 nt, Streptococcus pneumoniae R6
ggaauuuguaaag

SEQ ID NO: 4100747 - RNA, 16 nt, Streptococcus pneumoniae R6
ggaauuuguaaaguua

SEQ ID NO: 4100748 - RNA, 19 nt, Streptococcus pneumoniae R6
ggaauuuuucgacugugau

SEQ ID NO: 4100749 - RNA, 21 nt, Streptococcus pneumoniae R6
ggacaaaacuguaaaguagca

SEQ ID NO: 4100750 - RNA, 18 nt, Streptococcus pneumoniae R6
ggacaaaacuuuuuaaaa

SEQ ID NO: 4100751 - RNA, 19 nt, Streptococcus pneumoniae R6
ggacaaaacuuuuuaaaaa

SEQ ID NO: 4100752 - RNA, 20 nt, Streptococcus pneumoniae R6
ggacaaaucgaucaggacag

SEQ ID NO: 4100753 - RNA, 20 nt, Streptococcus pneumoniae R6
ggacaaaucguucaggacag

SEQ ID NO: 4100754 - RNA, 20 nt, Streptococcus pneumoniae R6
ggacaccgagaaaggcgaca

SEQ ID NO: 4100755 - RNA, 16 nt, Streptococcus pneumoniae R6
ggacaccucuuucuuu

SEQ ID NO: 4100756 - RNA, 18 nt, Streptococcus pneumoniae R6
ggacacgguaaugauuga

SEQ ID NO: 4100757 - RNA, 20 nt, Streptococcus pneumoniae R6
ggacagaaaugcccaauucu

SEQ ID NO: 4100758 - RNA, 14 nt, Streptococcus pneumoniae R6
ggacagauaagagc

SEQ ID NO: 4100759 - RNA, 20 nt, Streptococcus pneumoniae R6
ggacaggugcuuaaauaggc

SEQ ID NO: 4100760 - RNA, 14 nt, Streptococcus pneumoniae R6
ggacagucaaaucg

SEQ ID NO: 4100761 - RNA, 13 nt, Streptococcus pneumoniae R6
ggcgagggagacc

SEQ ID NO: 4100762 - RNA, 12 nt, Streptococcus pneumoniae R6
ggcgaugaagac

SEQ ID NO: 4100763 - RNA, 14 nt, Streptococcus pneumoniae R6
ggcgaugaagacca

SEQ ID NO: 4100764 - RNA, 13 nt, Streptococcus pneumoniae R6
ggcgcauuuuccu

SEQ ID NO: 4100765 - RNA, 21 nt, Streptococcus pneumoniae R6
ggcggugcuuugagcaaccug

SEQ ID NO: 4100766 - RNA, 17 nt, Streptococcus pneumoniae R6
ggcguuucguuugauaa

SEQ ID NO: 4100767 - RNA, 15 nt, Streptococcus pneumoniae R6
ggcuaaagauaagac

SEQ ID NO: 4100768 - RNA, 22 nt, Streptococcus pneumoniae R6
ggcuaacacuugcuaggaagag

SEQ ID NO: 4100769 - RNA, 23 nt, Streptococcus pneumoniae R6
ggcuacuguaggcuugugugcca

SEQ ID NO: 4100770 - RNA, 19 nt, Streptococcus pneumoniae R6
ggcuagcaacaaccugcac

SEQ ID NO: 4100771 - RNA, 22 nt, Streptococcus pneumoniae R6
ggcuagccuccuaguuugcucu

SEQ ID NO: 4100772 - RNA, 17 nt, Streptococcus pneumoniae R6
ggcuaggugagauugga

SEQ ID NO: 4100773 - RNA, 21 nt, Streptococcus pneumoniae R6
ggcuaguaaauaucauuucca

SEQ ID NO: 4100774 - RNA, 23 nt, Streptococcus pneumoniae R6
ggcuauaauuauucugcaaucaa

SEQ ID NO: 4100775 - RNA, 15 nt, Streptococcus pneumoniae R6
ggcuaucugucacaa

SEQ ID NO: 4100776 - RNA, 15 nt, Streptococcus pneumoniae R6
ggcuauuauuaaugu

SEQ ID NO: 4100777 - RNA, 23 nt, Streptococcus pneumoniae R6
ggcuauuuuaggaaacucuuaca

SEQ ID NO: 4100778 - RNA, 18 nt, Streptococcus pneumoniae R6
ggcugaauauauucucca

SEQ ID NO: 4100779 - RNA, 15 nt, Streptococcus pneumoniae R6
ggcugacaauaaaga

SEQ ID NO: 4100780 - RNA, 21 nt, Streptococcus pneumoniae R6
ggcugacgcgaucuggcaggc

SEQ ID NO: 4100781 - RNA, 15 nt, Streptococcus pneumoniae R6
ggcugagaaggcugg

SEQ ID NO: 4100782 - RNA, 22 nt, Streptococcus pneumoniae R6
ggcugcuaguguggacaugagu

SEQ ID NO: 4100783 - RNA, 14 nt, Streptococcus pneumoniae R6
ggcugcucaaaaca

SEQ ID NO: 4100784 - RNA, 18 nt, Streptococcus pneumoniae R6
ggcugcucaaaacacugu

SEQ ID NO: 4100785 - RNA, 17 nt, Streptococcus pneumoniae R6
ggcuggacguucuucaa

SEQ ID NO: 4100786 - RNA, 11 nt, Streptococcus pneumoniae R6
ggcuguaaugc

SEQ ID NO: 4100787 - RNA, 12 nt, Streptococcus pneumoniae R6
ggcuguguagau

SEQ ID NO: 4100788 - RNA, 19 nt, Streptococcus pneumoniae R6
ggcuguuucaaaugaaaua

SEQ ID NO: 4100789 - RNA, 21 nt, Streptococcus pneumoniae R6
ggcuuccaguuuggcguugga

SEQ ID NO: 4100790 - RNA, 14 nt, Streptococcus pneumoniae R6
ggcuuccugugcua

SEQ ID NO: 4100791 - RNA, 16 nt, Streptococcus pneumoniae R6
ggcuucuucaacagcu

SEQ ID NO: 4100792 - RNA, 21 nt, Streptococcus pneumoniae R6
ggcuugaggucccaugcuucc

SEQ ID NO: 4100793 - RNA, 22 nt, Streptococcus pneumoniae R6
ggcuugguucuucacuauugau

SEQ ID NO: 4100794 - RNA, 12 nt, Streptococcus pneumoniae R6
ggcuuguguucu

SEQ ID NO: 4100795 - RNA, 18 nt, Streptococcus pneumoniae R6
ggcuuucacguuguucaa

SEQ ID NO: 4100796 - RNA, 19 nt, Streptococcus pneumoniae R6
ggcuuuuuguuuucuauuu

SEQ ID NO: 4100797 - RNA, 11 nt, Streptococcus pneumoniae R6
gggaaauucca

SEQ ID NO: 4100798 - RNA, 22 nt, Streptococcus pneumoniae R6
gggaaauucuaauuaaauaaaa

SEQ ID NO: 4100799 - RNA, 15 nt, Streptococcus pneumoniae R6
gggacauaaaaaaau

SEQ ID NO: 4100800 - RNA, 13 nt, Streptococcus pneumoniae R6
gggagaaaaguca

SEQ ID NO: 4100801 - RNA, 13 nt, Streptococcus pneumoniae R6
gggauaaugagga

SEQ ID NO: 4100802 - RNA, 14 nt, Streptococcus pneumoniae R6
gggaucgguuagac

SEQ ID NO: 4100803 - RNA, 23 nt, Streptococcus pneumoniae R6
gggauuggagcuuaaaauccagu

SEQ ID NO: 4100804 - RNA, 17 nt, Streptococcus pneumoniae R6
gggcaaaaaagaaacca

SEQ ID NO: 4100805 - RNA, 13 nt, Streptococcus pneumoniae R6
gggcaaagaaaag

SEQ ID NO: 4100806 - RNA, 17 nt, Streptococcus pneumoniae R6
gggcaccaaacuuagga

SEQ ID NO: 4100807 - RNA, 16 nt, Streptococcus pneumoniae R6
gggcaccugucuugac

SEQ ID NO: 4100808 - RNA, 13 nt, Streptococcus pneumoniae R6
gggccaaaucauc

SEQ ID NO: 4100809 - RNA, 18 nt, Streptococcus pneumoniae R6
gggccuuagcagacuucu

SEQ ID NO: 4100810 - RNA, 22 nt, Streptococcus pneumoniae R6
gggccuuagcagacuucuuuuu

SEQ ID NO: 4100811 - RNA, 13 nt, Streptococcus pneumoniae R6
gggcgaugaagac

SEQ ID NO: 4100812 - RNA, 15 nt, Streptococcus pneumoniae R6
gggcgguacccacaa

SEQ ID NO: 4100813 - RNA, 14 nt, Streptococcus pneumoniae R6
gggcuaauucucug

SEQ ID NO: 4100814 - RNA, 20 nt, Streptococcus pneumoniae R6
gggcuauauaguuuaaucaa

SEQ ID NO: 4100815 - RNA, 16 nt, Streptococcus pneumoniae R6
gggcugagaaggcugg

SEQ ID NO: 4100816 - RNA, 20 nt, Streptococcus pneumoniae R6
gggcugcucaaaacacuguu

SEQ ID NO: 4100817 - RNA, 18 nt, Streptococcus pneumoniae R6
gggcuuuucuaucacucc

SEQ ID NO: 4100818 - RNA, 21 nt, Streptococcus pneumoniae R6
ggggacaagguguuuuaguua

SEQ ID NO: 4100819 - RNA, 12 nt, Streptococcus pneumoniae R6
ggggauagagau

SEQ ID NO: 4100820 - RNA, 22 nt, Streptococcus pneumoniae R6
ggggcuauauaguuuaaucaaa

SEQ ID NO: 4100821 - RNA, 16 nt, Streptococcus pneumoniae R6
gggggcaaaaaggggg

SEQ ID NO: 4100822 - RNA, 11 nt, Streptococcus pneumoniae R6
gggggcucuuu

SEQ ID NO: 4100823 - RNA, 18 nt, Streptococcus pneumoniae R6
gggguuuccaacgacuuc

SEQ ID NO: 4100824 - RNA, 20 nt, Streptococcus pneumoniae R6
ggguaaaggguuuggucaga

SEQ ID NO: 4100825 - RNA, 13 nt, Streptococcus pneumoniae R6
ggguaagagacuu

SEQ ID NO: 4100826 - RNA, 15 nt, Streptococcus pneumoniae R6
ggguaucuuuaucaa

SEQ ID NO: 4100827 - RNA, 24 nt, Streptococcus pneumoniae R6
gggucguaaaccuucaagaccuuc

SEQ ID NO: 4100828 - RNA, 14 nt, Streptococcus pneumoniae R6
ggguuaagacaccg

SEQ ID NO: 4100829 - RNA, 16 nt, Streptococcus pneumoniae R6
gguaaaagagcaagaa

SEQ ID NO: 4100830 - RNA, 11 nt, Streptococcus pneumoniae R6
gguaaaggaaa

SEQ ID NO: 4100831 - RNA, 20 nt, Streptococcus pneumoniae R6
gguaaccgaugacaaaaaua

SEQ ID NO: 4100832 - RNA, 21 nt, Streptococcus pneumoniae R6
gguaaccgaugacaaaaauag

SEQ ID NO: 4100833 - RNA, 17 nt, Streptococcus pneumoniae R6
gguaacggauuugggca

SEQ ID NO: 4100834 - RNA, 16 nt, Streptococcus pneumoniae R6
gguaccacggcagaca

SEQ ID NO: 4100835 - RNA, 21 nt, Streptococcus pneumoniae R6
gguacccacaaagauaaaauu

SEQ ID NO: 4100836 - RNA, 13 nt, Streptococcus pneumoniae R6
gguagaaaggagc

SEQ ID NO: 4100837 - RNA, 15 nt, Streptococcus pneumoniae R6
gguagcaacagcugg

SEQ ID NO: 4100838 - RNA, 15 nt, Streptococcus pneumoniae R6
gguaggauuucuccu

SEQ ID NO: 4100839 - RNA, 22 nt, Streptococcus pneumoniae R6
gguaggcauaaacaggcucggc

SEQ ID NO: 4100840 - RNA, 14 nt, Streptococcus pneumoniae R6
gguauaaaagaguu

SEQ ID NO: 4100841 - RNA, 13 nt, Streptococcus pneumoniae R6
gguaucaaaggca

SEQ ID NO: 4100842 - RNA, 15 nt, Streptococcus pneumoniae R6
gguaucugcuaaaac

SEQ ID NO: 4100843 - RNA, 21 nt, Streptococcus pneumoniae R6
gguauucauuaagucaacauc

SEQ ID NO: 4100844 - RNA, 20 nt, Streptococcus pneumoniae R6
gguauucuucgugaaagaca

SEQ ID NO: 4100845 - RNA, 15 nt, Streptococcus pneumoniae R6
gguauugacugccca

SEQ ID NO: 4100846 - RNA, 16 nt, Streptococcus pneumoniae R6
gguauuuaagauaacg

SEQ ID NO: 4100847 - RNA, 16 nt, Streptococcus pneumoniae R6
gguauuuaccaaaaag

SEQ ID NO: 4100848 - RNA, 16 nt, Streptococcus pneumoniae R6
gguauuuucauagagg

SEQ ID NO: 4100849 - RNA, 20 nt, Streptococcus pneumoniae R6
ggucaagcgagccaaacgau

SEQ ID NO: 4100850 - RNA, 20 nt, Streptococcus pneumoniae R6
ggucacgaggaggagaaaaa

SEQ ID NO: 4100851 - RNA, 14 nt, Streptococcus pneumoniae R6
ggucagauuguaaa

SEQ ID NO: 4100852 - RNA, 18 nt, Streptococcus pneumoniae R6
ggucaguugcaagaagca

SEQ ID NO: 4100853 - RNA, 22 nt, Streptococcus pneumoniae R6
ggucaucagcagagaaagaaaa

SEQ ID NO: 4100854 - RNA, 11 nt, Streptococcus pneumoniae R6
ggucaucauca

SEQ ID NO: 4100855 - RNA, 15 nt, Streptococcus pneumoniae R6
ggucaugcgaaacag

SEQ ID NO: 4100856 - RNA, 19 nt, Streptococcus pneumoniae R6
ggucauguagauugacauu

SEQ ID NO: 4100857 - RNA, 12 nt, Streptococcus pneumoniae R6
ggucauuuucca

SEQ ID NO: 4100858 - RNA, 15 nt, Streptococcus pneumoniae R6
gguccagauaaacag

SEQ ID NO: 4100859 - RNA, 20 nt, Streptococcus pneumoniae R6
gguccagcuucaaaucccau

SEQ ID NO: 4100860 - RNA, 18 nt, Streptococcus pneumoniae R6
ggucgauuggcagccucu

SEQ ID NO: 4100861 - RNA, 20 nt, Streptococcus pneumoniae R6
ggucgcuuccaauuuuugcg

SEQ ID NO: 4100862 - RNA, 17 nt, Streptococcus pneumoniae R6
ggucguaucugguguga

SEQ ID NO: 4100863 - RNA, 13 nt, Streptococcus pneumoniae R6
ggucuagcaagag

SEQ ID NO: 4100864 - RNA, 13 nt, Streptococcus pneumoniae R6
guaauaaucaaua

SEQ ID NO: 4100865 - RNA, 12 nt, Streptococcus pneumoniae R6
guaauaauccaa

SEQ ID NO: 4100866 - RNA, 12 nt, Streptococcus pneumoniae R6
guaaucaaaagg

SEQ ID NO: 4100867 - RNA, 19 nt, Streptococcus pneumoniae R6
guaaucaauauagucuaca

SEQ ID NO: 4100868 - RNA, 21 nt, Streptococcus pneumoniae R6
guaaucauaagcaacuuuacg

SEQ ID NO: 4100869 - RNA, 15 nt, Streptococcus pneumoniae R6
guaaucaugugacca

SEQ ID NO: 4100870 - RNA, 16 nt, Streptococcus pneumoniae R6
guaaucucaaaacagu

SEQ ID NO: 4100871 - RNA, 22 nt, Streptococcus pneumoniae R6
guaaucugcaccugauuucucc

SEQ ID NO: 4100872 - RNA, 23 nt, Streptococcus pneumoniae R6
guaaugacaauuauauaaaccaa

SEQ ID NO: 4100873 - RNA, 22 nt, Streptococcus pneumoniae R6
guaaugacuuguguuuuuccuu

SEQ ID NO: 4100874 - RNA, 17 nt, Streptococcus pneumoniae R6
guaaugccgugauuucc

SEQ ID NO: 4100875 - RNA, 17 nt, Streptococcus pneumoniae R6
guaaugcuccaauacaa

SEQ ID NO: 4100876 - RNA, 16 nt, Streptococcus pneumoniae R6
guaauuaugaaauuua

SEQ ID NO: 4100877 - RNA, 23 nt, Streptococcus pneumoniae R6
guaauuaugaaauuuaaaaagaa

SEQ ID NO: 4100878 - RNA, 13 nt, Streptococcus pneumoniae R6
guaauuuucaaga

SEQ ID NO: 4100879 - RNA, 13 nt, Streptococcus pneumoniae R6
guacaaaccuugu

SEQ ID NO: 4100880 - RNA, 21 nt, Streptococcus pneumoniae R6
guacacaggaauacuaaaaua

SEQ ID NO: 4100881 - RNA, 22 nt, Streptococcus pneumoniae R6
guacacuucugcuucuaaaaca

SEQ ID NO: 4100882 - RNA, 23 nt, Streptococcus pneumoniae R6
guacacuucugcuucuaaaacau

SEQ ID NO: 4100883 - RNA, 19 nt, Streptococcus pneumoniae R6
guacagauuugaaaacuga

SEQ ID NO: 4100884 - RNA, 15 nt, Streptococcus pneumoniae R6
guacagcuugcauag

SEQ ID NO: 4100885 - RNA, 19 nt, Streptococcus pneumoniae R6
guacauaguuucauaacua

SEQ ID NO: 4100886 - RNA, 15 nt, Streptococcus pneumoniae R6
guacauuagaauuca

SEQ ID NO: 4100887 - RNA, 16 nt, Streptococcus pneumoniae R6
guacauucaacaccug

SEQ ID NO: 4100888 - RNA, 23 nt, Streptococcus pneumoniae R6
guaccacggcagacagagaaaau

SEQ ID NO: 4100889 - RNA, 14 nt, Streptococcus pneumoniae R6
guaccgacuucuga

SEQ ID NO: 4100890 - RNA, 14 nt, Streptococcus pneumoniae R6
guaccgccaaaccu

SEQ ID NO: 4100891 - RNA, 20 nt, Streptococcus pneumoniae R6
guaccugcuaccguugaaau

SEQ ID NO: 4100892 - RNA, 21 nt, Streptococcus pneumoniae R6
guacgguaaucaagugaguua

SEQ ID NO: 4100893 - RNA, 23 nt, Streptococcus pneumoniae R6
guacuaagcaugauaugaaguuu

SEQ ID NO: 4100894 - RNA, 17 nt, Streptococcus pneumoniae R6
guacuagggcauuuuga

SEQ ID NO: 4100895 - RNA, 17 nt, Streptococcus pneumoniae R6
guacuauucuaguuuca

SEQ ID NO: 4100896 - RNA, 13 nt, Streptococcus pneumoniae R6
guacuauuucaga

SEQ ID NO: 4100897 - RNA, 17 nt, Streptococcus pneumoniae R6
guacucaacagaagaau

SEQ ID NO: 4100898 - RNA, 15 nt, Streptococcus pneumoniae R6
guacucacuuacaua

SEQ ID NO: 4100899 - RNA, 17 nt, Streptococcus pneumoniae R6
guacucacuuacauauu

SEQ ID NO: 4100900 - RNA, 18 nt, Streptococcus pneumoniae R6
guacucaggugaguagga

SEQ ID NO: 4100901 - RNA, 15 nt, Streptococcus pneumoniae R6
guacugaacaaugaa

SEQ ID NO: 4100902 - RNA, 14 nt, Streptococcus pneumoniae R6
guacugcacaggac

SEQ ID NO: 4100903 - RNA, 19 nt, Streptococcus pneumoniae R6
guacugcacaggacuaagu

SEQ ID NO: 4100904 - RNA, 18 nt, Streptococcus pneumoniae R6
guacugcccccaaacagu

SEQ ID NO: 4100905 - RNA, 14 nt, Streptococcus pneumoniae R6
guacuguuauagau

SEQ ID NO: 4100906 - RNA, 15 nt, Streptococcus pneumoniae R6
guacuuaaacgugcu

SEQ ID NO: 4100907 - RNA, 22 nt, Streptococcus pneumoniae R6
guacuugagacuguuugagaug

SEQ ID NO: 4100908 - RNA, 15 nt, Streptococcus pneumoniae R6
guacuuucaacuccu

SEQ ID NO: 4100909 - RNA, 10 nt, Streptococcus pneumoniae R6
guagaaaagc

SEQ ID NO: 4100910 - RNA, 12 nt, Streptococcus pneumoniae R6
guagaaaagcaa

SEQ ID NO: 4100911 - RNA, 9 nt, Streptococcus pneumoniae R6
guagaaaau

SEQ ID NO: 4100912 - RNA, 15 nt, Streptococcus pneumoniae R6
guagaaaaugaaauu

SEQ ID NO: 4100913 - RNA, 21 nt, Streptococcus pneumoniae R6
guagaaaguuaaucucuccuu

SEQ ID NO: 4100914 - RNA, 23 nt, Streptococcus pneumoniae R6
guagacgaguugguccagcuuca

SEQ ID NO: 4100915 - RNA, 14 nt, Streptococcus pneumoniae R6
guagagagauaacg

SEQ ID NO: 4100916 - RNA, 16 nt, Streptococcus pneumoniae R6
guagaggcgccugcug

SEQ ID NO: 4100917 - RNA, 18 nt, Streptococcus pneumoniae R6
guagaggcgccugcugcu

SEQ ID NO: 4100918 - RNA, 17 nt, Streptococcus pneumoniae R6
guagaguccaaagacca

SEQ ID NO: 4100919 - RNA, 15 nt, Streptococcus pneumoniae R6
guagauagaacugac

SEQ ID NO: 4100920 - RNA, 17 nt, Streptococcus pneumoniae R6
guagaugaaacugacga

SEQ ID NO: 4100921 - RNA, 16 nt, Streptococcus pneumoniae R6
guagcaaauucaccaa

SEQ ID NO: 4100922 - RNA, 15 nt, Streptococcus pneumoniae R6
guagcaacuaucuga

SEQ ID NO: 4100923 - RNA, 16 nt, Streptococcus pneumoniae R6
guagcacuuuuccauu

SEQ ID NO: 4100924 - RNA, 15 nt, Streptococcus pneumoniae R6
guagccaaaauccuu

SEQ ID NO: 4100925 - RNA, 15 nt, Streptococcus pneumoniae R6
guagcucuuuuguua

SEQ ID NO: 4100926 - RNA, 17 nt, Streptococcus pneumoniae R6
guaggaguccucuguau

SEQ ID NO: 4100927 - RNA, 21 nt, Streptococcus pneumoniae R6
guaggauuucuccuguuucaa

SEQ ID NO: 4100928 - RNA, 17 nt, Streptococcus pneumoniae R6
guaggcuuuaucaagca

SEQ ID NO: 4100929 - RNA, 17 nt, Streptococcus pneumoniae R6
guaggcuuucaacugcu

SEQ ID NO: 4100930 - RNA, 16 nt, Streptococcus pneumoniae R6
guagggcgauaaaauc

SEQ ID NO: 4100931 - RNA, 18 nt, Streptococcus pneumoniae R6
guaggggauaaugaggaa

SEQ ID NO: 4100932 - RNA, 20 nt, Streptococcus pneumoniae R6
guagggggcauauaaauaca

SEQ ID NO: 4100933 - RNA, 16 nt, Streptococcus pneumoniae R6
guagguacuugcugua

SEQ ID NO: 4100934 - RNA, 19 nt, Streptococcus pneumoniae R6
guagguauaaaccacgagg

SEQ ID NO: 4100935 - RNA, 15 nt, Streptococcus pneumoniae R6
guagguugcucaaag

SEQ ID NO: 4100936 - RNA, 16 nt, Streptococcus pneumoniae R6
guaguaaaagaauuca

SEQ ID NO: 4100937 - RNA, 14 nt, Streptococcus pneumoniae R6
guaguaaaccugua

SEQ ID NO: 4100938 - RNA, 18 nt, Streptococcus pneumoniae R6
guaguaacuuuuucagga

SEQ ID NO: 4100939 - RNA, 17 nt, Streptococcus pneumoniae R6
guaguaguuagauaacu

SEQ ID NO: 4100940 - RNA, 13 nt, Streptococcus pneumoniae R6
guaguaguuucag

SEQ ID NO: 4100941 - RNA, 12 nt, Streptococcus pneumoniae R6
guaguucaaaac

SEQ ID NO: 4100942 - RNA, 16 nt, Streptococcus pneumoniae R6
guaguuguuaguucuu

SEQ ID NO: 4100943 - RNA, 19 nt, Streptococcus pneumoniae R6
guaguuuaccccaaauucc

SEQ ID NO: 4100944 - RNA, 22 nt, Streptococcus pneumoniae R6
guauaauagguggauaaaaguc

SEQ ID NO: 4100945 - RNA, 19 nt, Streptococcus pneumoniae R6
guauaauccgcauacuugg

SEQ ID NO: 4100946 - RNA, 12 nt, Streptococcus pneumoniae R6
guauacuuugca

SEQ ID NO: 4100947 - RNA, 15 nt, Streptococcus pneumoniae R6
guauagacaggauau

SEQ ID NO: 4100948 - RNA, 22 nt, Streptococcus pneumoniae R6
guauagaccaagaacucuucug

SEQ ID NO: 4100949 - RNA, 12 nt, Streptococcus pneumoniae R6
guauagagcaau

SEQ ID NO: 4100950 - RNA, 15 nt, Streptococcus pneumoniae R6
guauauaagcuuagu

SEQ ID NO: 4100951 - RNA, 23 nt, Streptococcus pneumoniae R6
guauaucacuuuauaguuuucac

SEQ ID NO: 4100952 - RNA, 22 nt, Streptococcus pneumoniae R6
guauaugaagauucuguauggu

SEQ ID NO: 4100953 - RNA, 17 nt, Streptococcus pneumoniae R6
guauauucaaaauacaa

SEQ ID NO: 4100954 - RNA, 22 nt, Streptococcus pneumoniae R6
guauauucugaaugcuuuccaa

SEQ ID NO: 4100955 - RNA, 18 nt, Streptococcus pneumoniae R6
guauauugaaaugaaaua

SEQ ID NO: 4100956 - RNA, 11 nt, Streptococcus pneumoniae R6
guauauuuuuc

SEQ ID NO: 4100957 - RNA, 14 nt, Streptococcus pneumoniae R6
guaucaaaggcaag

SEQ ID NO: 4100958 - RNA, 15 nt, Streptococcus pneumoniae R6
guaucaaaggcaaga

SEQ ID NO: 4100959 - RNA, 18 nt, Streptococcus pneumoniae R6
guaucaagguuuuucugu

SEQ ID NO: 4100960 - RNA, 19 nt, Streptococcus pneumoniae R6
guaucaccaagcauuuuca

SEQ ID NO: 4100961 - RNA, 19 nt, Streptococcus pneumoniae R6
guaucauauaaauauagaa

SEQ ID NO: 4100962 - RNA, 19 nt, Streptococcus pneumoniae R6
guauccaaaacaaccaauu

SEQ ID NO: 4100963 - RNA, 23 nt, Streptococcus pneumoniae R6
guauccaaaacaaccaauuucuu

SEQ ID NO: 4100964 - RNA, 18 nt, Streptococcus pneumoniae R6
guauccaaucucuugaac

SEQ ID NO: 4100965 - RNA, 15 nt, Streptococcus pneumoniae R6
guaucccauucuuca

SEQ ID NO: 4100966 - RNA, 16 nt, Streptococcus pneumoniae R6
guaucuggugugauga

SEQ ID NO: 4100967 - RNA, 15 nt, Streptococcus pneumoniae R6
guccaacuguaaaga

SEQ ID NO: 4100968 - RNA, 19 nt, Streptococcus pneumoniae R6
guccaagauucaacaucac

SEQ ID NO: 4100969 - RNA, 17 nt, Streptococcus pneumoniae R6
guccaagucaacaccug

SEQ ID NO: 4100970 - RNA, 16 nt, Streptococcus pneumoniae R6
guccaauuuugucucu

SEQ ID NO: 4100971 - RNA, 21 nt, Streptococcus pneumoniae R6
guccaccacaaaagagaaaga

SEQ ID NO: 4100972 - RNA, 16 nt, Streptococcus pneumoniae R6
guccacucgaaacaag

SEQ ID NO: 4100973 - RNA, 15 nt, Streptococcus pneumoniae R6
guccagcagcuaaga

SEQ ID NO: 4100974 - RNA, 20 nt, Streptococcus pneumoniae R6
guccagcagcuaagaccuug

SEQ ID NO: 4100975 - RNA, 17 nt, Streptococcus pneumoniae R6
guccaguuacuacugga

SEQ ID NO: 4100976 - RNA, 19 nt, Streptococcus pneumoniae R6
guccauagcgucaaagaag

SEQ ID NO: 4100977 - RNA, 21 nt, Streptococcus pneumoniae R6
guccauauuagggcaaauaaa

SEQ ID NO: 4100978 - RNA, 16 nt, Streptococcus pneumoniae R6
gucccagcuucuuuuu

SEQ ID NO: 4100979 - RNA, 14 nt, Streptococcus pneumoniae R6
gucccauaaaacua

SEQ ID NO: 4100980 - RNA, 15 nt, Streptococcus pneumoniae R6
gucccaucauuucuu

SEQ ID NO: 4100981 - RNA, 18 nt, Streptococcus pneumoniae R6
guccccucacaucuucag

SEQ ID NO: 4100982 - RNA, 22 nt, Streptococcus pneumoniae R6
gucccgaaccguguuguaugaa

SEQ ID NO: 4100983 - RNA, 14 nt, Streptococcus pneumoniae R6
guccgagugcaaga

SEQ ID NO: 4100984 - RNA, 19 nt, Streptococcus pneumoniae R6
guccgcauagccaaauaag

SEQ ID NO: 4100985 - RNA, 22 nt, Streptococcus pneumoniae R6
guccguagcaggaccagaaaga

SEQ ID NO: 4100986 - RNA, 16 nt, Streptococcus pneumoniae R6
guccucaauuugaacc

SEQ ID NO: 4100987 - RNA, 21 nt, Streptococcus pneumoniae R6
guccucauuucaauagaaauc

SEQ ID NO: 4100988 - RNA, 17 nt, Streptococcus pneumoniae R6
guccucuaguaaagugu

SEQ ID NO: 4100989 - RNA, 14 nt, Streptococcus pneumoniae R6
guccucuucagccu

SEQ ID NO: 4100990 - RNA, 15 nt, Streptococcus pneumoniae R6
guccugcccacuaaa

SEQ ID NO: 4100991 - RNA, 19 nt, Streptococcus pneumoniae R6
guccuggucuuauuucauu

SEQ ID NO: 4100992 - RNA, 19 nt, Streptococcus pneumoniae R6
guccuguugcuucaucucc

SEQ ID NO: 4100993 - RNA, 14 nt, Streptococcus pneumoniae R6
guccuuaaccuuga

SEQ ID NO: 4100994 - RNA, 16 nt, Streptococcus pneumoniae R6
guccuuacucaaauaa

SEQ ID NO: 4100995 - RNA, 13 nt, Streptococcus pneumoniae R6
guccuuguaaaga

SEQ ID NO: 4100996 - RNA, 14 nt, Streptococcus pneumoniae R6
guccuuguuugagc

SEQ ID NO: 4100997 - RNA, 19 nt, Streptococcus pneumoniae R6
guccuuguuugagcucuuu

SEQ ID NO: 4100998 - RNA, 12 nt, Streptococcus pneumoniae R6
guccuuuagaaa

SEQ ID NO: 4100999 - RNA, 19 nt, Streptococcus pneumoniae R6
guccuuucucgagcuuagc

SEQ ID NO: 4101000 - RNA, 13 nt, Streptococcus pneumoniae R6
guccuuucuuuuu

SEQ ID NO: 4101001 - RNA, 20 nt, Streptococcus pneumoniae R6
guccuuucuuuuuugaaguu

SEQ ID NO: 4101002 - RNA, 13 nt, Streptococcus pneumoniae R6
gucgaagcuucca

SEQ ID NO: 4101003 - RNA, 14 nt, Streptococcus pneumoniae R6
gucgaagcuuccaa

SEQ ID NO: 4101004 - RNA, 16 nt, Streptococcus pneumoniae R6
gucgaagcuuccaaua

SEQ ID NO: 4101005 - RNA, 14 nt, Streptococcus pneumoniae R6
gucgaaggcuugua

SEQ ID NO: 4101006 - RNA, 15 nt, Streptococcus pneumoniae R6
gucgaagguuauacc

SEQ ID NO: 4101007 - RNA, 18 nt, Streptococcus pneumoniae R6
gucgaagguuauaccaaa

SEQ ID NO: 4101008 - RNA, 21 nt, Streptococcus pneumoniae R6
gucgaagguuauaccaaaaaa

SEQ ID NO: 4101009 - RNA, 17 nt, Streptococcus pneumoniae R6
gucgacugcagucuuca

SEQ ID NO: 4101010 - RNA, 18 nt, Streptococcus pneumoniae R6
gucgagacauaccauuuu

SEQ ID NO: 4101011 - RNA, 20 nt, Streptococcus pneumoniae R6
gucgauguuuugguuuuuaa

SEQ ID NO: 4101012 - RNA, 20 nt, Streptococcus pneumoniae R6
gucgcaaagaggaagaggac

SEQ ID NO: 4101013 - RNA, 13 nt, Streptococcus pneumoniae R6
gucgcauauuuca

SEQ ID NO: 4101014 - RNA, 20 nt, Streptococcus pneumoniae R6
gucgcugaguaaagacuaga

SEQ ID NO: 4101015 - RNA, 17 nt, Streptococcus pneumoniae R6
gucgcuuuugugccaau

SEQ ID NO: 4101016 - RNA, 14 nt, Streptococcus pneumoniae R6
gucggcuagcacua

SEQ ID NO: 4101017 - RNA, 16 nt, Streptococcus pneumoniae R6
gucguaaccuucuucu

SEQ ID NO: 4101018 - RNA, 15 nt, Streptococcus pneumoniae R6
gucgugauuucuauu

SEQ ID NO: 4101019 - RNA, 12 nt, Streptococcus pneumoniae R6
gucguguauaga

SEQ ID NO: 4101020 - RNA, 17 nt, Streptococcus pneumoniae R6
gucguguugacuugggu

SEQ ID NO: 4101021 - RNA, 12 nt, Streptococcus pneumoniae R6
gucguuaaaagc

SEQ ID NO: 4101022 - RNA, 21 nt, Streptococcus pneumoniae R6
gucguuucaagauaaggaauu

SEQ ID NO: 4101023 - RNA, 13 nt, Streptococcus pneumoniae R6
gucuaaaaauuua

SEQ ID NO: 4101024 - RNA, 19 nt, Streptococcus pneumoniae R6
gucuaacuguuugggggca

SEQ ID NO: 4101025 - RNA, 20 nt, Streptococcus pneumoniae R6
gucuacaaauucaaacucaa

SEQ ID NO: 4101026 - RNA, 17 nt, Streptococcus pneumoniae R6
gucuacauucuuuuuaa

SEQ ID NO: 4101027 - RNA, 23 nt, Streptococcus pneumoniae R6
gucuaccuucaggagauaaaagc

SEQ ID NO: 4101028 - RNA, 19 nt, Streptococcus pneumoniae R6
gucuacuauauaucauaau

SEQ ID NO: 4101029 - RNA, 12 nt, Streptococcus pneumoniae R6
gucuagcaagag

SEQ ID NO: 4101030 - RNA, 17 nt, Streptococcus pneumoniae R6
gucuagccaguauuuuu

SEQ ID NO: 4101031 - RNA, 23 nt, Streptococcus pneumoniae R6
gucuauagaacuaguaaauuguc

SEQ ID NO: 4101032 - RNA, 15 nt, Streptococcus pneumoniae R6
gucuaucaaacagga

SEQ ID NO: 4101033 - RNA, 20 nt, Streptococcus pneumoniae R6
gucuauucuuuccuuuuaca

SEQ ID NO: 4101034 - RNA, 15 nt, Streptococcus pneumoniae R6
gucuauuugcuuuuc

SEQ ID NO: 4101035 - RNA, 17 nt, Streptococcus pneumoniae R6
gucucacacggaaacag

SEQ ID NO: 4101036 - RNA, 18 nt, Streptococcus pneumoniae R6
gucucagugggcuauucc

SEQ ID NO: 4101037 - RNA, 14 nt, Streptococcus pneumoniae R6
gucuccccaugagu

SEQ ID NO: 4101038 - RNA, 20 nt, Streptococcus pneumoniae R6
gucuccccaugaguuuucaa

SEQ ID NO: 4101039 - RNA, 18 nt, Streptococcus pneumoniae R6
gucucccuuuuuggauug

SEQ ID NO: 4101040 - RNA, 16 nt, Streptococcus pneumoniae R6
gucuccugugcuccau

SEQ ID NO: 4101041 - RNA, 23 nt, Streptococcus pneumoniae R6
gucuccugugcuccauuuuuuaa

SEQ ID NO: 4101042 - RNA, 21 nt, Streptococcus pneumoniae R6
gucucuaaaaauaaaaaagag

SEQ ID NO: 4101043 - RNA, 15 nt, Streptococcus pneumoniae R6
gucucuucuucuggg

SEQ ID NO: 4101044 - RNA, 21 nt, Streptococcus pneumoniae R6
gucucuucuucugggagaaau

SEQ ID NO: 4101045 - RNA, 19 nt, Streptococcus pneumoniae R6
gucugaagacuggaguuca

SEQ ID NO: 4101046 - RNA, 24 nt, Streptococcus pneumoniae R6
gucugaagacuggaguucaccagu

SEQ ID NO: 4101047 - RNA, 23 nt, Streptococcus pneumoniae R6
gucugaaucaaaaaugaaguucu

SEQ ID NO: 4101048 - RNA, 19 nt, Streptococcus pneumoniae R6
gucugagcauucuuuuauc

SEQ ID NO: 4101049 - RNA, 16 nt, Streptococcus pneumoniae R6
gucugaguuuucuugu

SEQ ID NO: 4101050 - RNA, 14 nt, Streptococcus pneumoniae R6
gucugauuuucauu

SEQ ID NO: 4101051 - RNA, 17 nt, Streptococcus pneumoniae R6
gucuggagauuuuucaa

SEQ ID NO: 4101052 - RNA, 13 nt, Streptococcus pneumoniae R6
gucuggauugacc

SEQ ID NO: 4101053 - RNA, 19 nt, Streptococcus pneumoniae R6
gucugggaaaaauuuucaa

SEQ ID NO: 4101054 - RNA, 22 nt, Streptococcus pneumoniae R6
gucugggaaaaauuuucaaaau

SEQ ID NO: 4101055 - RNA, 19 nt, Streptococcus pneumoniae R6
gucuguuaaacaugucuau

SEQ ID NO: 4101056 - RNA, 14 nt, Streptococcus pneumoniae R6
gucuuaaaaucaca

SEQ ID NO: 4101057 - RNA, 19 nt, Streptococcus pneumoniae R6
gucuuaaaaucacaaaaac

SEQ ID NO: 4101058 - RNA, 13 nt, Streptococcus pneumoniae R6
gucuuaccacaaa

SEQ ID NO: 4101059 - RNA, 22 nt, Streptococcus pneumoniae R6
gucuuacguucauccauaucuu

SEQ ID NO: 4101060 - RNA, 21 nt, Streptococcus pneumoniae R6
gucuuacuugcguuucuucuu

SEQ ID NO: 4101061 - RNA, 20 nt, Streptococcus pneumoniae R6
gucuuagacuuucucacgaa

SEQ ID NO: 4101062 - RNA, 23 nt, Streptococcus pneumoniae R6
gucuuaguacgugacucagcuuc

SEQ ID NO: 4101063 - RNA, 16 nt, Streptococcus pneumoniae R6
gucuuaucugcaaccu

SEQ ID NO: 4101064 - RNA, 19 nt, Streptococcus pneumoniae R6
gucuuaucugcaaccucaa

SEQ ID NO: 4101065 - RNA, 16 nt, Streptococcus pneumoniae R6
gucuuauuucauuugg

SEQ ID NO: 4101066 - RNA, 19 nt, Streptococcus pneumoniae R6
gucuucaauacgaacaccg

SEQ ID NO: 4101067 - RNA, 12 nt, Streptococcus pneumoniae R6
gucuucacaauc

SEQ ID NO: 4101068 - RNA, 13 nt, Streptococcus pneumoniae R6
gucuucaucucuu

SEQ ID NO: 4101069 - RNA, 16 nt, Streptococcus pneumoniae R6
gucuucaugacggcuc

SEQ ID NO: 4101070 - RNA, 20 nt, Streptococcus pneumoniae R6
guguucuaaaauaaguucug

SEQ ID NO: 4101071 - RNA, 13 nt, Streptococcus pneumoniae R6
guguucugucaug

SEQ ID NO: 4101072 - RNA, 20 nt, Streptococcus pneumoniae R6
guguucugucuuguaaaaaa

SEQ ID NO: 4101073 - RNA, 12 nt, Streptococcus pneumoniae R6
guguugacaagu

SEQ ID NO: 4101074 - RNA, 17 nt, Streptococcus pneumoniae R6
guguugacaagugaaag

SEQ ID NO: 4101075 - RNA, 15 nt, Streptococcus pneumoniae R6
guguuuugagcugac

SEQ ID NO: 4101076 - RNA, 12 nt, Streptococcus pneumoniae R6
guguuuuuucau

SEQ ID NO: 4101077 - RNA, 12 nt, Streptococcus pneumoniae R6
guuaaaaaauaa

SEQ ID NO: 4101078 - RNA, 19 nt, Streptococcus pneumoniae R6
guuaaaaauccugauuuca

SEQ ID NO: 4101079 - RNA, 19 nt, Streptococcus pneumoniae R6
guuaaaaauuggucauauu

SEQ ID NO: 4101080 - RNA, 18 nt, Streptococcus pneumoniae R6
guuaaaacaaagaaaaag

SEQ ID NO: 4101081 - RNA, 19 nt, Streptococcus pneumoniae R6
guuaaaacaaagaaaaaga

SEQ ID NO: 4101082 - RNA, 20 nt, Streptococcus pneumoniae R6
guuaaaaucuuuuacuucug

SEQ ID NO: 4101083 - RNA, 20 nt, Streptococcus pneumoniae R6
guuaaaggugugauuuucga

SEQ ID NO: 4101084 - RNA, 14 nt, Streptococcus pneumoniae R6
guuaaauuauaaau

SEQ ID NO: 4101085 - RNA, 13 nt, Streptococcus pneumoniae R6
guuaagaaauaaa

SEQ ID NO: 4101086 - RNA, 16 nt, Streptococcus pneumoniae R6
guuaauaacucucauc

SEQ ID NO: 4101087 - RNA, 21 nt, Streptococcus pneumoniae R6
guuaaucuacgcuuuaaaaau

SEQ ID NO: 4101088 - RNA, 14 nt, Streptococcus pneumoniae R6
guuaaucucuccuu

SEQ ID NO: 4101089 - RNA, 22 nt, Streptococcus pneumoniae R6
guuacaauucauaaagugcugu

SEQ ID NO: 4101090 - RNA, 20 nt, Streptococcus pneumoniae R6
guuacacguacuuuaaaauc

SEQ ID NO: 4101091 - RNA, 21 nt, Streptococcus pneumoniae R6
guuacaucaaaaucacagacc

SEQ ID NO: 4101092 - RNA, 15 nt, Streptococcus pneumoniae R6
guuaccacaggagcu

SEQ ID NO: 4101093 - RNA, 17 nt, Streptococcus pneumoniae R6
guuaccacaggagcugg

SEQ ID NO: 4101094 - RNA, 19 nt, Streptococcus pneumoniae R6
guuaccucauaucucuugu

SEQ ID NO: 4101095 - RNA, 16 nt, Streptococcus pneumoniae R6
guuacggguuuuaaac

SEQ ID NO: 4101096 - RNA, 19 nt, Streptococcus pneumoniae R6
guuacucaggauaaaacca

SEQ ID NO: 4101097 - RNA, 12 nt, Streptococcus pneumoniae R6
guuacugacuuc

SEQ ID NO: 4101098 - RNA, 23 nt, Streptococcus pneumoniae R6
guuacuuggcgaaggucuuucaa

SEQ ID NO: 4101099 - RNA, 14 nt, Streptococcus pneumoniae R6
guuagaaaaaugca

SEQ ID NO: 4101100 - RNA, 22 nt, Streptococcus pneumoniae R6
guuagaagcguagagguauuua

SEQ ID NO: 4101101 - RNA, 15 nt, Streptococcus pneumoniae R6
guuagacagaaaaaa

SEQ ID NO: 4101102 - RNA, 17 nt, Streptococcus pneumoniae R6
guuagauuauguaagau

SEQ ID NO: 4101103 - RNA, 18 nt, Streptococcus pneumoniae R6
guuagauuuauaauuuca

SEQ ID NO: 4101104 - RNA, 20 nt, Streptococcus pneumoniae R6
guuagauuuauaauuucaac

SEQ ID NO: 4101105 - RNA, 17 nt, Streptococcus pneumoniae R6
guuagauuuuuucuguc

SEQ ID NO: 4101106 - RNA, 14 nt, Streptococcus pneumoniae R6
guuagcugauuuuu

SEQ ID NO: 4101107 - RNA, 16 nt, Streptococcus pneumoniae R6
guuagucauucccucc

SEQ ID NO: 4101108 - RNA, 13 nt, Streptococcus pneumoniae R6
guuaguugaguug

SEQ ID NO: 4101109 - RNA, 18 nt, Streptococcus pneumoniae R6
guuauaccaaaaaaacuc

SEQ ID NO: 4101110 - RNA, 14 nt, Streptococcus pneumoniae R6
guuauagaguguua

SEQ ID NO: 4101111 - RNA, 20 nt, Streptococcus pneumoniae R6
guuauagauucaacgaacua

SEQ ID NO: 4101112 - RNA, 22 nt, Streptococcus pneumoniae R6
guuauagauucaacgaacuaua

SEQ ID NO: 4101113 - RNA, 15 nt, Streptococcus pneumoniae R6
guuauauugacagaa

SEQ ID NO: 4101114 - RNA, 19 nt, Streptococcus pneumoniae R6
guuaucaaaucgaucuguu

SEQ ID NO: 4101115 - RNA, 18 nt, Streptococcus pneumoniae R6
guuaugaaacuauguacg

SEQ ID NO: 4101116 - RNA, 16 nt, Streptococcus pneumoniae R6
guuaugaauaacuuca

SEQ ID NO: 4101117 - RNA, 19 nt, Streptococcus pneumoniae R6
guuaugaauaacuucaaua

SEQ ID NO: 4101118 - RNA, 14 nt, Streptococcus pneumoniae R6
guuauucaaaaaca

SEQ ID NO: 4101119 - RNA, 20 nt, Streptococcus pneumoniae R6
guuauuucuccuaaagaaaa

SEQ ID NO: 4101120 - RNA, 21 nt, Streptococcus pneumoniae R6
guucaacaugaccaccaggaa

SEQ ID NO: 4101121 - RNA, 20 nt, Streptococcus pneumoniae R6
guucaagccuuauugcucuu

SEQ ID NO: 4101122 - RNA, 17 nt, Streptococcus pneumoniae R6
guucaagguaauaaucc

SEQ ID NO: 4101123 - RNA, 20 nt, Streptococcus pneumoniae R6
guucaaugggguucaucucu

SEQ ID NO: 4101124 - RNA, 21 nt, Streptococcus pneumoniae R6
guucaaugggguucaucucug

SEQ ID NO: 4101125 - RNA, 17 nt, Streptococcus pneumoniae R6
guucaauggguucaucu

SEQ ID NO: 4101126 - RNA, 20 nt, Streptococcus pneumoniae R6
guucaauggguucaucucug

SEQ ID NO: 4101127 - RNA, 21 nt, Streptococcus pneumoniae R6
guucacaaaugagauaagcga

SEQ ID NO: 4101128 - RNA, 16 nt, Streptococcus pneumoniae R6
guucaccaauguucaa

SEQ ID NO: 4101129 - RNA, 17 nt, Streptococcus pneumoniae R6
guucacccuugcuuuuu

SEQ ID NO: 4101130 - RNA, 20 nt, Streptococcus pneumoniae R6
guucacguaaauugcccuug

SEQ ID NO: 4101131 - RNA, 14 nt, Streptococcus pneumoniae R6
guucacucaaaccu

SEQ ID NO: 4101132 - RNA, 15 nt, Streptococcus pneumoniae R6
guucacucaaaccug

SEQ ID NO: 4101133 - RNA, 17 nt, Streptococcus pneumoniae R6
guucacucaaaccugau

SEQ ID NO: 4101134 - RNA, 16 nt, Streptococcus pneumoniae R6
guucaguagauuaaag

SEQ ID NO: 4101135 - RNA, 23 nt, Streptococcus pneumoniae R6
guucaguagauuaaaggcauaau

SEQ ID NO: 4101136 - RNA, 20 nt, Streptococcus pneumoniae R6
guucagugaacuauuuuauc

SEQ ID NO: 4101137 - RNA, 14 nt, Streptococcus pneumoniae R6
guucaguuucuauu

SEQ ID NO: 4101138 - RNA, 16 nt, Streptococcus pneumoniae R6
guucauaguucuaucu

SEQ ID NO: 4101139 - RNA, 20 nt, Streptococcus pneumoniae R6
guucauaucuuauuucaauc

SEQ ID NO: 4101140 - RNA, 22 nt, Streptococcus pneumoniae R6
guucaucucugguguguaugga

SEQ ID NO: 4101141 - RNA, 23 nt, Streptococcus pneumoniae R6
guucaucuggaguagcaucccca

SEQ ID NO: 4101142 - RNA, 15 nt, Streptococcus pneumoniae R6
guucaucuucaaaau

SEQ ID NO: 4101143 - RNA, 19 nt, Streptococcus pneumoniae R6
guucaucuucaaaaucaaa

SEQ ID NO: 4101144 - RNA, 19 nt, Streptococcus pneumoniae R6
guucauggcauggaaagca

SEQ ID NO: 4101145 - RNA, 14 nt, Streptococcus pneumoniae R6
guucauuagaacac

SEQ ID NO: 4101146 - RNA, 22 nt, Streptococcus pneumoniae R6
guucauuuucuuuacuucugag

SEQ ID NO: 4101147 - RNA, 15 nt, Streptococcus pneumoniae R6
guucauuuuuccuuc

SEQ ID NO: 4101148 - RNA, 17 nt, Streptococcus pneumoniae R6
guuccaauagucauucc

SEQ ID NO: 4101149 - RNA, 17 nt, Streptococcus pneumoniae R6
guuccauccacaaccuu

SEQ ID NO: 4101150 - RNA, 22 nt, Streptococcus pneumoniae R6
guuccaucuacaaccuuaaaac

SEQ ID NO: 4101151 - RNA, 18 nt, Streptococcus pneumoniae R6
guucccagcauggucagg

SEQ ID NO: 4101152 - RNA, 16 nt, Streptococcus pneumoniae R6
guuccccaaaaaguag

SEQ ID NO: 4101153 - RNA, 21 nt, Streptococcus pneumoniae R6
guuccgcuaacguuuuuguuu

SEQ ID NO: 4101154 - RNA, 15 nt, Streptococcus pneumoniae R6
guuccucuuucaaaa

SEQ ID NO: 4101155 - RNA, 18 nt, Streptococcus pneumoniae R6
guuccucuuuuuccccag

SEQ ID NO: 4101156 - RNA, 14 nt, Streptococcus pneumoniae R6
guuccugucuuauu

SEQ ID NO: 4101157 - RNA, 16 nt, Streptococcus pneumoniae R6
guuccuuugucuuuag

SEQ ID NO: 4101158 - RNA, 15 nt, Streptococcus pneumoniae R6
guucgaagauaucuc

SEQ ID NO: 4101159 - RNA, 13 nt, Streptococcus pneumoniae R6
guucgaguccuac

SEQ ID NO: 4101160 - RNA, 19 nt, Streptococcus pneumoniae R6
guucgcaucuuauuucaau

SEQ ID NO: 4101161 - RNA, 20 nt, Streptococcus pneumoniae R6
guucgcaucuuauuucaauc

SEQ ID NO: 4101162 - RNA, 13 nt, Streptococcus pneumoniae R6
guucgggauaaaa

SEQ ID NO: 4101163 - RNA, 16 nt, Streptococcus pneumoniae R6
guucgggauaaaauag

SEQ ID NO: 4101164 - RNA, 15 nt, Streptococcus pneumoniae R6
guucgguaguuguua

SEQ ID NO: 4101165 - RNA, 17 nt, Streptococcus pneumoniae R6
guucgugccaaucucaa

SEQ ID NO: 4101166 - RNA, 20 nt, Streptococcus pneumoniae R6
guucuaaaauaaguucuguu

SEQ ID NO: 4101167 - RNA, 23 nt, Streptococcus pneumoniae R6
guucuacaaaucccaugacaauc

SEQ ID NO: 4101168 - RNA, 15 nt, Streptococcus pneumoniae R6
guucuauaaaauaua

SEQ ID NO: 4101169 - RNA, 21 nt, Streptococcus pneumoniae R6
guucuauaaaauauaguagau

SEQ ID NO: 4101170 - RNA, 16 nt, Streptococcus pneumoniae R6
guucuauccacaaccu

SEQ ID NO: 4101171 - RNA, 19 nt, Streptococcus pneumoniae R6
guucuauccacaaccucaa

SEQ ID NO: 4101172 - RNA, 22 nt, Streptococcus pneumoniae R6
guuuccaaggaaaguucuuccc

SEQ ID NO: 4101173 - RNA, 23 nt, Streptococcus pneumoniae R6
guuuccaaggaaaguucuucccc

SEQ ID NO: 4101174 - RNA, 14 nt, Streptococcus pneumoniae R6
guuucgcuaucucu

SEQ ID NO: 4101175 - RNA, 23 nt, Streptococcus pneumoniae R6
guuucguggcgacgccagauacu

SEQ ID NO: 4101176 - RNA, 13 nt, Streptococcus pneumoniae R6
guuucuaaaacau

SEQ ID NO: 4101177 - RNA, 19 nt, Streptococcus pneumoniae R6
guuucuauuucauuuuacu

SEQ ID NO: 4101178 - RNA, 20 nt, Streptococcus pneumoniae R6
guuucuggauuuucucccgu

SEQ ID NO: 4101179 - RNA, 18 nt, Streptococcus pneumoniae R6
guuucugugcuuuuucaa

SEQ ID NO: 4101180 - RNA, 14 nt, Streptococcus pneumoniae R6
guuucuucuagcuu

SEQ ID NO: 4101181 - RNA, 19 nt, Streptococcus pneumoniae R6
guuucuuggccacuuccca

SEQ ID NO: 4101182 - RNA, 17 nt, Streptococcus pneumoniae R6
guuugaagaguauuauu

SEQ ID NO: 4101183 - RNA, 20 nt, Streptococcus pneumoniae R6
guuugagaugauuugcucaa

SEQ ID NO: 4101184 - RNA, 15 nt, Streptococcus pneumoniae R6
guuugagcucuuuga

SEQ ID NO: 4101185 - RNA, 20 nt, Streptococcus pneumoniae R6
guuugauacuguuaauaaaa

SEQ ID NO: 4101186 - RNA, 12 nt, Streptococcus pneumoniae R6
guuugaugagau

SEQ ID NO: 4101187 - RNA, 12 nt, Streptococcus pneumoniae R6
guuugcagcacc

SEQ ID NO: 4101188 - RNA, 19 nt, Streptococcus pneumoniae R6
guuuggccaagguucauuu

SEQ ID NO: 4101189 - RNA, 22 nt, Streptococcus pneumoniae R6
guuugguaagaguugaaaaguc

SEQ ID NO: 4101190 - RNA, 11 nt, Streptococcus pneumoniae R6
guuugguuuau

SEQ ID NO: 4101191 - RNA, 12 nt, Streptococcus pneumoniae R6
guuuuaaaaugu

SEQ ID NO: 4101192 - RNA, 19 nt, Streptococcus pneumoniae R6
guuuuaaagacagucugaa

SEQ ID NO: 4101193 - RNA, 13 nt, Streptococcus pneumoniae R6
guuuuaaauaaac

SEQ ID NO: 4101194 - RNA, 14 nt, Streptococcus pneumoniae R6
guuuuaaucucaaa

SEQ ID NO: 4101195 - RNA, 20 nt, Streptococcus pneumoniae R6
guuuuaccacuaaacuacac

SEQ ID NO: 4101196 - RNA, 21 nt, Streptococcus pneumoniae R6
guuuuacuaugggaagauuua

SEQ ID NO: 4101197 - RNA, 20 nt, Streptococcus pneumoniae R6
guuuuagaacucuauucguu

SEQ ID NO: 4101198 - RNA, 22 nt, Streptococcus pneumoniae R6
guuuuagcaaucgcaaucuacu

SEQ ID NO: 4101199 - RNA, 18 nt, Streptococcus pneumoniae R6
guuuuagcaauuguuucg

SEQ ID NO: 4101200 - RNA, 20 nt, Streptococcus pneumoniae R6
guuuuagcguuuuuguguuc

SEQ ID NO: 4101201 - RNA, 19 nt, Streptococcus pneumoniae R6
guuuuagcuucuguauaga

SEQ ID NO: 4101202 - RNA, 18 nt, Streptococcus pneumoniae R6
guuuuaggaacaauaaaa

SEQ ID NO: 4101203 - RNA, 15 nt, Streptococcus pneumoniae R6
guuuuaggacauaaa

SEQ ID NO: 4101204 - RNA, 21 nt, Streptococcus pneumoniae R6
guuuuaucauagaaauauuua

SEQ ID NO: 4101205 - RNA, 14 nt, Streptococcus pneumoniae R6
guuuuauuacauaa

SEQ ID NO: 4101206 - RNA, 16 nt, Streptococcus pneumoniae R6
guuuucaaaaauucug

SEQ ID NO: 4101207 - RNA, 19 nt, Streptococcus pneumoniae R6
guuuucaaaaauucugcca

SEQ ID NO: 4101208 - RNA, 19 nt, Streptococcus pneumoniae R6
guuuucaaagcuacuuuuu

SEQ ID NO: 4101209 - RNA, 20 nt, Streptococcus pneumoniae R6
guuuucaaaguuccuaaaac

SEQ ID NO: 4101210 - RNA, 14 nt, Streptococcus pneumoniae R6
guuuucacuuccuu

SEQ ID NO: 4101211 - RNA, 13 nt, Streptococcus pneumoniae R6
guuuuccaccagu

SEQ ID NO: 4101212 - RNA, 13 nt, Streptococcus pneumoniae R6
guuuuccguucuc

SEQ ID NO: 4101213 - RNA, 23 nt, Streptococcus pneumoniae R6
guuuuccuugccuaauuuuucaa

SEQ ID NO: 4101214 - RNA, 19 nt, Streptococcus pneumoniae R6
guuuucuucuccgaagacu

SEQ ID NO: 4101215 - RNA, 19 nt, Streptococcus pneumoniae R6
guuuugaauucuccauuuu

SEQ ID NO: 4101216 - RNA, 19 nt, Streptococcus pneumoniae R6
guuuugagauuacugauaa

SEQ ID NO: 4101217 - RNA, 17 nt, Streptococcus pneumoniae R6
guuuugagcaaccugcg

SEQ ID NO: 4101218 - RNA, 12 nt, Streptococcus pneumoniae R6
guuuugagcuga

SEQ ID NO: 4101219 - RNA, 13 nt, Streptococcus pneumoniae R6
guuuugagcugac

SEQ ID NO: 4101220 - RNA, 23 nt, Streptococcus pneumoniae R6
guuuugagguugcagaugaaagc

SEQ ID NO: 4101221 - RNA, 22 nt, Streptococcus pneumoniae R6
guuuugagguuguagaugaaac

SEQ ID NO: 4101222 - RNA, 17 nt, Streptococcus pneumoniae R6
guuuugauuagcaaaac

SEQ ID NO: 4101223 - RNA, 14 nt, Streptococcus pneumoniae R6
guuuuguuggaaag

SEQ ID NO: 4101224 - RNA, 14 nt, Streptococcus pneumoniae R6
guuuuuaaauccaa

SEQ ID NO: 4101225 - RNA, 18 nt, Streptococcus pneumoniae R6
guuuuuaauuuuucuuug

SEQ ID NO: 4101226 - RNA, 12 nt, Streptococcus pneumoniae R6
guuuuuaucauu

SEQ ID NO: 4101227 - RNA, 23 nt, Streptococcus pneumoniae R6
guuuuucaaaaaccuugauauga

SEQ ID NO: 4101228 - RNA, 18 nt, Streptococcus pneumoniae R6
guuuuuccaucuuuuauu

SEQ ID NO: 4101229 - RNA, 17 nt, Streptococcus pneumoniae R6
guuuuucccaccuuuuc

SEQ ID NO: 4101230 - RNA, 21 nt, Streptococcus pneumoniae R6
guuuuuccuuugaguaagagu

SEQ ID NO: 4101231 - RNA, 15 nt, Streptococcus pneumoniae R6
guuuuucgucuuuuu

SEQ ID NO: 4101232 - RNA, 22 nt, Streptococcus pneumoniae R6
guuuuugaaagucauauuucuu

SEQ ID NO: 4101233 - RNA, 14 nt, Streptococcus pneumoniae R6
guuuuugagguugu

SEQ ID NO: 4101234 - RNA, 16 nt, Streptococcus pneumoniae R6
guuuuugauauggugc

SEQ ID NO: 4101235 - RNA, 18 nt, Streptococcus pneumoniae R6
guuuuugccucaauaucu

SEQ ID NO: 4101236 - RNA, 16 nt, Streptococcus pneumoniae R6
guuuuugcgauaagcu

SEQ ID NO: 4101237 - RNA, 20 nt, Streptococcus pneumoniae R6
guuuuuggauuuuguuucuu

SEQ ID NO: 4101238 - RNA, 18 nt, Streptococcus pneumoniae R6
guuuuuguaguaaaagaa

SEQ ID NO: 4101239 - RNA, 15 nt, Streptococcus pneumoniae R6
guuuuugugauuuua

SEQ ID NO: 4101240 - RNA, 17 nt, Streptococcus pneumoniae R6
guuuuuuauuuucccag

SEQ ID NO: 4101241 - RNA, 14 nt, Streptococcus pneumoniae R6
guuuuuugauuuua

SEQ ID NO: 4101242 - RNA, 13 nt, Streptococcus pneumoniae R6
uaaaaaaaaaaag

SEQ ID NO: 4101243 - RNA, 14 nt, Streptococcus pneumoniae R6
uaaaaaaaacauau

SEQ ID NO: 4101244 - RNA, 18 nt, Streptococcus pneumoniae R6
uaaaaaaaacauauauuc

SEQ ID NO: 4101245 - RNA, 10 nt, Streptococcus pneumoniae R6
uaaaaaaagg

SEQ ID NO: 4101246 - RNA, 17 nt, Streptococcus pneumoniae R6
uaaaaaaauuuggaaaa

SEQ ID NO: 4101247 - RNA, 21 nt, Streptococcus pneumoniae R6
uaaaaaaauuuggaaaauagu

SEQ ID NO: 4101248 - RNA, 16 nt, Streptococcus pneumoniae R6
uaaaaaaccaauuccc

SEQ ID NO: 4101249 - RNA, 16 nt, Streptococcus pneumoniae R6
uaaaaaauaacucugu

SEQ ID NO: 4101250 - RNA, 19 nt, Streptococcus pneumoniae R6
uaaaaaaucauuuuccuuu

SEQ ID NO: 4101251 - RNA, 23 nt, Streptococcus pneumoniae R6
uaaaaacagaggcuggacaaaaa

SEQ ID NO: 4101252 - RNA, 16 nt, Streptococcus pneumoniae R6
uaaaaacguuuuucaa

SEQ ID NO: 4101253 - RNA, 13 nt, Streptococcus pneumoniae R6
uaaaaacucagaa

SEQ ID NO: 4101254 - RNA, 21 nt, Streptococcus pneumoniae R6
uaaaaacucucuaauucccuu

SEQ ID NO: 4101255 - RNA, 13 nt, Streptococcus pneumoniae R6
uaaaaagaaauau

SEQ ID NO: 4101256 - RNA, 15 nt, Streptococcus pneumoniae R6
uaaaaagaaauauau

SEQ ID NO: 4101257 - RNA, 23 nt, Streptococcus pneumoniae R6
uaaaaagagguggaauauuuacu

SEQ ID NO: 4101258 - RNA, 14 nt, Streptococcus pneumoniae R6
uaaaaagaguagaa

SEQ ID NO: 4101259 - RNA, 17 nt, Streptococcus pneumoniae R6
uaaaaagcauaguauca

SEQ ID NO: 4101260 - RNA, 22 nt, Streptococcus pneumoniae R6
uaaaaagcuauagauaagguca

SEQ ID NO: 4101261 - RNA, 16 nt, Streptococcus pneumoniae R6
uaaaaagugaaaggaa

SEQ ID NO: 4101262 - RNA, 18 nt, Streptococcus pneumoniae R6
uaaaaaguuuugucccuu

SEQ ID NO: 4101263 - RNA, 15 nt, Streptococcus pneumoniae R6
uaaaaauaaaaaaga

SEQ ID NO: 4101264 - RNA, 17 nt, Streptococcus pneumoniae R6
uaaaaauaacuucagau

SEQ ID NO: 4101265 - RNA, 19 nt, Streptococcus pneumoniae R6
uaaaaauaacuucagauua

SEQ ID NO: 4101266 - RNA, 18 nt, Streptococcus pneumoniae R6
uaaaaauagggaaauccu

SEQ ID NO: 4101267 - RNA, 18 nt, Streptococcus pneumoniae R6
uaaaaauccacuugggaa

SEQ ID NO: 4101268 - RNA, 22 nt, Streptococcus pneumoniae R6
uaaaaauccacuugggaaacca

SEQ ID NO: 4101269 - RNA, 23 nt, Streptococcus pneumoniae R6
uaaaaauccacuugggaaaccaa

SEQ ID NO: 4101270 - RNA, 20 nt, Streptococcus pneumoniae R6
uaaaaauccuuuuuuugaag

SEQ ID NO: 4101271 - RNA, 18 nt, Streptococcus pneumoniae R6
uaaaaauuuuuuucuaau

SEQ ID NO: 4101272 - RNA, 22 nt, Streptococcus pneumoniae R6
uaaaaauuuuuuucuaauuaaa

SEQ ID NO: 4101273 - RNA, 11 nt, Streptococcus pneumoniae R6
uaaaacaaaaa

SEQ ID NO: 4101274 - RNA, 12 nt, Streptococcus pneumoniae R6
uaaaccuuccaa

SEQ ID NO: 4101275 - RNA, 17 nt, Streptococcus pneumoniae R6
uaaaccuuccaagagac

SEQ ID NO: 4101276 - RNA, 18 nt, Streptococcus pneumoniae R6
uaaaccuugcaaaacagg

SEQ ID NO: 4101277 - RNA, 18 nt, Streptococcus pneumoniae R6
uaaacgacuagauaaaag

SEQ ID NO: 4101278 - RNA, 18 nt, Streptococcus pneumoniae R6
uaaacguuuuuacuuugg

SEQ ID NO: 4101279 - RNA, 13 nt, Streptococcus pneumoniae R6
uaaacuaauugga

SEQ ID NO: 4101280 - RNA, 22 nt, Streptococcus pneumoniae R6
uaaacuauuaagccuucuccaa

SEQ ID NO: 4101281 - RNA, 23 nt, Streptococcus pneumoniae R6
uaaacuauuucuuauuucaauuu

SEQ ID NO: 4101282 - RNA, 12 nt, Streptococcus pneumoniae R6
uaaacucuccaa

SEQ ID NO: 4101283 - RNA, 17 nt, Streptococcus pneumoniae R6
uaaacugaaucuagacu

SEQ ID NO: 4101284 - RNA, 19 nt, Streptococcus pneumoniae R6
uaaacugagcaaaaccauc

SEQ ID NO: 4101285 - RNA, 22 nt, Streptococcus pneumoniae R6
uaaacugagcaaaaccaucauc

SEQ ID NO: 4101286 - RNA, 14 nt, Streptococcus pneumoniae R6
uaaacuucuucuuc

SEQ ID NO: 4101287 - RNA, 14 nt, Streptococcus pneumoniae R6
uaaacuuuauaucc

SEQ ID NO: 4101288 - RNA, 19 nt, Streptococcus pneumoniae R6
uaaacuuugguuauaaaaa

SEQ ID NO: 4101289 - RNA, 13 nt, Streptococcus pneumoniae R6
uaaacuuuuucau

SEQ ID NO: 4101290 - RNA, 15 nt, Streptococcus pneumoniae R6
uaaacuuuuucauaa

SEQ ID NO: 4101291 - RNA, 18 nt, Streptococcus pneumoniae R6
uaaacuuuuucauaaaua

SEQ ID NO: 4101292 - RNA, 21 nt, Streptococcus pneumoniae R6
uaaacuuuuucauaaauagau

SEQ ID NO: 4101293 - RNA, 11 nt, Streptococcus pneumoniae R6
uaaagaaaaag

SEQ ID NO: 4101294 - RNA, 19 nt, Streptococcus pneumoniae R6
uaaagaaaaaguucucuuu

SEQ ID NO: 4101295 - RNA, 21 nt, Streptococcus pneumoniae R6
uaaagaaaaaguucucuuucu

SEQ ID NO: 4101296 - RNA, 15 nt, Streptococcus pneumoniae R6
uaaagaaauagaaaa

SEQ ID NO: 4101297 - RNA, 17 nt, Streptococcus pneumoniae R6
uaaagaaauagaaaaca

SEQ ID NO: 4101298 - RNA, 19 nt, Streptococcus pneumoniae R6
uaaagaaauagaaaacaaa

SEQ ID NO: 4101299 - RNA, 20 nt, Streptococcus pneumoniae R6
uaaagacaauguucuuuucu

SEQ ID NO: 4101300 - RNA, 17 nt, Streptococcus pneumoniae R6
uaaagacacuaagaaga

SEQ ID NO: 4101301 - RNA, 18 nt, Streptococcus pneumoniae R6
uaaagaccaaagaaaaac

SEQ ID NO: 4101302 - RNA, 15 nt, Streptococcus pneumoniae R6
uaaagacuagaaaaa

SEQ ID NO: 4101303 - RNA, 20 nt, Streptococcus pneumoniae R6
uaaagacuuuuuuccagccu

SEQ ID NO: 4101304 - RNA, 20 nt, Streptococcus pneumoniae R6
uaaagagauugccuugcucu

SEQ ID NO: 4101305 - RNA, 16 nt, Streptococcus pneumoniae R6
uaaagagguugggcaa

SEQ ID NO: 4101306 - RNA, 16 nt, Streptococcus pneumoniae R6
uaaagagucaagacaa

SEQ ID NO: 4101307 - RNA, 13 nt, Streptococcus pneumoniae R6
uaaagaguuucau

SEQ ID NO: 4101308 - RNA, 16 nt, Streptococcus pneumoniae R6
uaaagauauagccugu

SEQ ID NO: 4101309 - RNA, 20 nt, Streptococcus pneumoniae R6
uaaagaugaugguuaggaua

SEQ ID NO: 4101310 - RNA, 16 nt, Streptococcus pneumoniae R6
uaaagauuuuuuccuu

SEQ ID NO: 4101311 - RNA, 15 nt, Streptococcus pneumoniae R6
uaaagcaauuuugaa

SEQ ID NO: 4101312 - RNA, 16 nt, Streptococcus pneumoniae R6
uaaagcaauuuugaaa

SEQ ID NO: 4101313 - RNA, 22 nt, Streptococcus pneumoniae R6
uaaagccuguaucgaaacauuc

SEQ ID NO: 4101314 - RNA, 20 nt, Streptococcus pneumoniae R6
uaaagcgaaaggagaaaaaa

SEQ ID NO: 4101315 - RNA, 14 nt, Streptococcus pneumoniae R6
uaaagcugauuuuu

SEQ ID NO: 4101316 - RNA, 19 nt, Streptococcus pneumoniae R6
uaaagcuuuuuguuagauu

SEQ ID NO: 4101317 - RNA, 19 nt, Streptococcus pneumoniae R6
uaaaggaaaccuaaucaua

SEQ ID NO: 4101318 - RNA, 14 nt, Streptococcus pneumoniae R6
uaaaggccuuggcc

SEQ ID NO: 4101319 - RNA, 17 nt, Streptococcus pneumoniae R6
uaaagguaaaaccaaua

SEQ ID NO: 4101320 - RNA, 22 nt, Streptococcus pneumoniae R6
uaaagguaucaacugggaagau

SEQ ID NO: 4101321 - RNA, 14 nt, Streptococcus pneumoniae R6
uaaaggugaaaagg

SEQ ID NO: 4101322 - RNA, 20 nt, Streptococcus pneumoniae R6
uaaagguuuuaucugagaug

SEQ ID NO: 4101323 - RNA, 16 nt, Streptococcus pneumoniae R6
uaaaguaaaaauuucu

SEQ ID NO: 4101324 - RNA, 22 nt, Streptococcus pneumoniae R6
uaaaguauuauaauauaauugu

SEQ ID NO: 4101325 - RNA, 14 nt, Streptococcus pneumoniae R6
uaaagucaacagag

SEQ ID NO: 4101326 - RNA, 15 nt, Streptococcus pneumoniae R6
uaaaguguaaugcua

SEQ ID NO: 4101327 - RNA, 15 nt, Streptococcus pneumoniae R6
uaaaguuacucuauu

SEQ ID NO: 4101328 - RNA, 17 nt, Streptococcus pneumoniae R6
uaaaguuacucuauugu

SEQ ID NO: 4101329 - RNA, 17 nt, Streptococcus pneumoniae R6
uaaaguuaugaaaaaga

SEQ ID NO: 4101330 - RNA, 12 nt, Streptococcus pneumoniae R6
uaaaguuccuaa

SEQ ID NO: 4101331 - RNA, 16 nt, Streptococcus pneumoniae R6
uaaaguuguacaagaa

SEQ ID NO: 4101332 - RNA, 13 nt, Streptococcus pneumoniae R6
uaaauaaaacaaa

SEQ ID NO: 4101333 - RNA, 14 nt, Streptococcus pneumoniae R6
uaaauaaaacaaaa

SEQ ID NO: 4101334 - RNA, 16 nt, Streptococcus pneumoniae R6
uaaauaaauaucaaaa

SEQ ID NO: 4101335 - RNA, 16 nt, Streptococcus pneumoniae R6
uaaauaaaucucugga

SEQ ID NO: 4101336 - RNA, 20 nt, Streptococcus pneumoniae R6
uaaauaaggggauagagaua

SEQ ID NO: 4101337 - RNA, 21 nt, Streptococcus pneumoniae R6
uaaauaaggggauagagauag

SEQ ID NO: 4101338 - RNA, 17 nt, Streptococcus pneumoniae R6
uaaauaagguuuagcaa

SEQ ID NO: 4101339 - RNA, 20 nt, Streptococcus pneumoniae R6
uaaauaagguuuagcaaaag

SEQ ID NO: 4101340 - RNA, 14 nt, Streptococcus pneumoniae R6
uaaauaauagaaau

SEQ ID NO: 4101341 - RNA, 16 nt, Streptococcus pneumoniae R6
uaaauaauauuauucu

SEQ ID NO: 4101342 - RNA, 17 nt, Streptococcus pneumoniae R6
uaaauaauauuauucua

SEQ ID NO: 4101343 - RNA, 12 nt, Streptococcus pneumoniae R6
uaaauaauuaua

SEQ ID NO: 4101344 - RNA, 20 nt, Streptococcus pneumoniae R6
uaaauaauuauagaaaugag

SEQ ID NO: 4101345 - RNA, 14 nt, Streptococcus pneumoniae R6
uaaauacaaaaaca

SEQ ID NO: 4101346 - RNA, 17 nt, Streptococcus pneumoniae R6
uaaauacaaaaauagcc

SEQ ID NO: 4101347 - RNA, 23 nt, Streptococcus pneumoniae R6
uaaauaccuuauccaauucuuca

SEQ ID NO: 4101348 - RNA, 18 nt, Streptococcus pneumoniae R6
uaaauacuagucuuucuu

SEQ ID NO: 4101349 - RNA, 21 nt, Streptococcus pneumoniae R6
uaaauacucugccuuccuugu

SEQ ID NO: 4101350 - RNA, 23 nt, Streptococcus pneumoniae R6
uaaauacucugccuuccuugucu

SEQ ID NO: 4101351 - RNA, 14 nt, Streptococcus pneumoniae R6
uaaauacuuuuucc

SEQ ID NO: 4101352 - RNA, 15 nt, Streptococcus pneumoniae R6
uaaauacuuuuuccu

SEQ ID NO: 4101353 - RNA, 15 nt, Streptococcus pneumoniae R6
uaaauagaaaccagc

SEQ ID NO: 4101354 - RNA, 21 nt, Streptococcus pneumoniae R6
uaaauagaaguucaaucagcu

SEQ ID NO: 4101355 - RNA, 18 nt, Streptococcus pneumoniae R6
uaaauagcuacagucauu

SEQ ID NO: 4101356 - RNA, 11 nt, Streptococcus pneumoniae R6
uaaauaucaaa

SEQ ID NO: 4101357 - RNA, 20 nt, Streptococcus pneumoniae R6
uaaauaucaaaaaaagaagu

SEQ ID NO: 4101358 - RNA, 19 nt, Streptococcus pneumoniae R6
uaaauaucauuuccaacaa

SEQ ID NO: 4101359 - RNA, 18 nt, Streptococcus pneumoniae R6
uaaauaugaacaaaucaa

SEQ ID NO: 4101360 - RNA, 13 nt, Streptococcus pneumoniae R6
uaaauauuucuau

SEQ ID NO: 4101361 - RNA, 17 nt, Streptococcus pneumoniae R6
uaaaucaauuuuccuuu

SEQ ID NO: 4101362 - RNA, 19 nt, Streptococcus pneumoniae R6
uaaaucauacgauugaaag

SEQ ID NO: 4101363 - RNA, 21 nt, Streptococcus pneumoniae R6
uaaaucauccauauaaggacc

SEQ ID NO: 4101364 - RNA, 19 nt, Streptococcus pneumoniae R6
uaaaucauugauaguaaca

SEQ ID NO: 4101365 - RNA, 18 nt, Streptococcus pneumoniae R6
uaaauccaaaagcaggag

SEQ ID NO: 4101366 - RNA, 23 nt, Streptococcus pneumoniae R6
uaaauccacauuuacgaaucucu

SEQ ID NO: 4101367 - RNA, 18 nt, Streptococcus pneumoniae R6
uaaauccaccuaauuaua

SEQ ID NO: 4101368 - RNA, 19 nt, Streptococcus pneumoniae R6
uaaauccaccuaauuauag

SEQ ID NO: 4101369 - RNA, 17 nt, Streptococcus pneumoniae R6
uaaauccacguuuacga

SEQ ID NO: 4101370 - RNA, 17 nt, Streptococcus pneumoniae R6
uaaaucccaaguaaauu

SEQ ID NO: 4101371 - RNA, 16 nt, Streptococcus pneumoniae R6
uaaauccgauauaucu

SEQ ID NO: 4101372 - RNA, 18 nt, Streptococcus pneumoniae R6
uaaauccugcaaagauag

SEQ ID NO: 4101373 - RNA, 22 nt, Streptococcus pneumoniae R6
uaaauccuuuuuucuuuacucu

SEQ ID NO: 4101374 - RNA, 14 nt, Streptococcus pneumoniae R6
uaaaucgaucauau

SEQ ID NO: 4101375 - RNA, 18 nt, Streptococcus pneumoniae R6
uaaaucgcuuuuguaaau

SEQ ID NO: 4101376 - RNA, 16 nt, Streptococcus pneumoniae R6
uaaaucuacuaucucu

SEQ ID NO: 4101377 - RNA, 13 nt, Streptococcus pneumoniae R6
uaacuucauuaua

SEQ ID NO: 4101378 - RNA, 16 nt, Streptococcus pneumoniae R6
uaacuucauuauagac

SEQ ID NO: 4101379 - RNA, 18 nt, Streptococcus pneumoniae R6
uaacuucugcuaauugag

SEQ ID NO: 4101380 - RNA, 18 nt, Streptococcus pneumoniae R6
uaacuucugucuauuugc

SEQ ID NO: 4101381 - RNA, 19 nt, Streptococcus pneumoniae R6
uaacuucugucuauuugcu

SEQ ID NO: 4101382 - RNA, 18 nt, Streptococcus pneumoniae R6
uaacuugccugcuuuuuc

SEQ ID NO: 4101383 - RNA, 20 nt, Streptococcus pneumoniae R6
uaacuuguuuacguuuuaaa

SEQ ID NO: 4101384 - RNA, 19 nt, Streptococcus pneumoniae R6
uaacuuuaccaaaaccuuc

SEQ ID NO: 4101385 - RNA, 22 nt, Streptococcus pneumoniae R6
uaacuuuaccaaaaccuucuuu

SEQ ID NO: 4101386 - RNA, 16 nt, Streptococcus pneumoniae R6
uaacuuuuccuuaaca

SEQ ID NO: 4101387 - RNA, 22 nt, Streptococcus pneumoniae R6
uaacuuuuggggggcaguacag

SEQ ID NO: 4101388 - RNA, 15 nt, Streptococcus pneumoniae R6
uaacuuuuuugagaa

SEQ ID NO: 4101389 - RNA, 18 nt, Streptococcus pneumoniae R6
uaagaaaccgucaucagc

SEQ ID NO: 4101390 - RNA, 21 nt, Streptococcus pneumoniae R6
uaagaaagaccauagcaaagg

SEQ ID NO: 4101391 - RNA, 16 nt, Streptococcus pneumoniae R6
uaagaaauaaaauaau

SEQ ID NO: 4101392 - RNA, 12 nt, Streptococcus pneumoniae R6
uaagaaaucaua

SEQ ID NO: 4101393 - RNA, 19 nt, Streptococcus pneumoniae R6
uaagaaaucuccagauuag

SEQ ID NO: 4101394 - RNA, 21 nt, Streptococcus pneumoniae R6
uaagaaauuuucuuuuuccua

SEQ ID NO: 4101395 - RNA, 21 nt, Streptococcus pneumoniae R6
uaagaaauuuuggauuucuuu

SEQ ID NO: 4101396 - RNA, 19 nt, Streptococcus pneumoniae R6
uaagaacaggacaaaucga

SEQ ID NO: 4101397 - RNA, 18 nt, Streptococcus pneumoniae R6
uaagaacuccuuaaauuu

SEQ ID NO: 4101398 - RNA, 15 nt, Streptococcus pneumoniae R6
uaagaacucuuucca

SEQ ID NO: 4101399 - RNA, 16 nt, Streptococcus pneumoniae R6
uaagaacucuuuccaa

SEQ ID NO: 4101400 - RNA, 17 nt, Streptococcus pneumoniae R6
uaagaacuuuuuaaagu

SEQ ID NO: 4101401 - RNA, 14 nt, Streptococcus pneumoniae R6
uaagaaguagaggu

SEQ ID NO: 4101402 - RNA, 23 nt, Streptococcus pneumoniae R6
uaagaagucaucuaucaaaagau

SEQ ID NO: 4101403 - RNA, 18 nt, Streptococcus pneumoniae R6
uaagaaucccucuuuuua

SEQ ID NO: 4101404 - RNA, 13 nt, Streptococcus pneumoniae R6
uaagaaucugcau

SEQ ID NO: 4101405 - RNA, 15 nt, Streptococcus pneumoniae R6
uaagaaucuuuucua

SEQ ID NO: 4101406 - RNA, 22 nt, Streptococcus pneumoniae R6
uaagaaucuuuucuauuuuaua

SEQ ID NO: 4101407 - RNA, 15 nt, Streptococcus pneumoniae R6
uaagaauuugauuau

SEQ ID NO: 4101408 - RNA, 21 nt, Streptococcus pneumoniae R6
uaagacagaugacaaaucuaa

SEQ ID NO: 4101409 - RNA, 20 nt, Streptococcus pneumoniae R6
uaagacauaccuacgauauc

SEQ ID NO: 4101410 - RNA, 13 nt, Streptococcus pneumoniae R6
uaagacuccucuu

SEQ ID NO: 4101411 - RNA, 13 nt, Streptococcus pneumoniae R6
uaagacuuuuccu

SEQ ID NO: 4101412 - RNA, 14 nt, Streptococcus pneumoniae R6
uaagagaaauuucu

SEQ ID NO: 4101413 - RNA, 18 nt, Streptococcus pneumoniae R6
uaagagaaauuucugaaa

SEQ ID NO: 4101414 - RNA, 19 nt, Streptococcus pneumoniae R6
uaagagaaauuucugaaac

SEQ ID NO: 4101415 - RNA, 11 nt, Streptococcus pneumoniae R6
uaagagacuuc

SEQ ID NO: 4101416 - RNA, 14 nt, Streptococcus pneumoniae R6
uaagagagaagccu

SEQ ID NO: 4101417 - RNA, 17 nt, Streptococcus pneumoniae R6
uaagagcgaugccauga

SEQ ID NO: 4101418 - RNA, 13 nt, Streptococcus pneumoniae R6
uaagagcuagucg

SEQ ID NO: 4101419 - RNA, 14 nt, Streptococcus pneumoniae R6
uaagagcuucuuuu

SEQ ID NO: 4101420 - RNA, 17 nt, Streptococcus pneumoniae R6
uaagagcuucuuuugga

SEQ ID NO: 4101421 - RNA, 15 nt, Streptococcus pneumoniae R6
uaagagguuuuacua

SEQ ID NO: 4101422 - RNA, 17 nt, Streptococcus pneumoniae R6
uaagaguaguauuuacu

SEQ ID NO: 4101423 - RNA, 19 nt, Streptococcus pneumoniae R6
uaagaguaguauuuacuaa

SEQ ID NO: 4101424 - RNA, 17 nt, Streptococcus pneumoniae R6
uaagaguauaaaaccuu

SEQ ID NO: 4101425 - RNA, 23 nt, Streptococcus pneumoniae R6
uaagaguuaauggccaccuucaa

SEQ ID NO: 4101426 - RNA, 15 nt, Streptococcus pneumoniae R6
uaagaguucuuccca

SEQ ID NO: 4101427 - RNA, 19 nt, Streptococcus pneumoniae R6
uaagauaaaacuaaaagga

SEQ ID NO: 4101428 - RNA, 22 nt, Streptococcus pneumoniae R6
uaagauaaaacuaaaaggacuu

SEQ ID NO: 4101429 - RNA, 21 nt, Streptococcus pneumoniae R6
uaagauaaggcaucuuaacau

SEQ ID NO: 4101430 - RNA, 22 nt, Streptococcus pneumoniae R6
uaagauaaggcaucuuaacauu

SEQ ID NO: 4101431 - RNA, 18 nt, Streptococcus pneumoniae R6
uaagauaaguuccaucug

SEQ ID NO: 4101432 - RNA, 16 nt, Streptococcus pneumoniae R6
uaagauaauaaauagu

SEQ ID NO: 4101433 - RNA, 18 nt, Streptococcus pneumoniae R6
uaagauaucacucaucug

SEQ ID NO: 4101434 - RNA, 20 nt, Streptococcus pneumoniae R6
uaagauaucacucaucugcu

SEQ ID NO: 4101435 - RNA, 20 nt, Streptococcus pneumoniae R6
uaagauaugaacaaaucgau

SEQ ID NO: 4101436 - RNA, 15 nt, Streptococcus pneumoniae R6
uaagauauuaagaau

SEQ ID NO: 4101437 - RNA, 19 nt, Streptococcus pneumoniae R6
uaagaucugguuaaaauug

SEQ ID NO: 4101438 - RNA, 22 nt, Streptococcus pneumoniae R6
uaagaugcgaacaaaucaauua

SEQ ID NO: 4101439 - RNA, 15 nt, Streptococcus pneumoniae R6
uaagauguucaaucu

SEQ ID NO: 4101440 - RNA, 14 nt, Streptococcus pneumoniae R6
uaagauuaauuuca

SEQ ID NO: 4101441 - RNA, 15 nt, Streptococcus pneumoniae R6
uaagauuaauuucag

SEQ ID NO: 4101442 - RNA, 15 nt, Streptococcus pneumoniae R6
uaagauuacagauca

SEQ ID NO: 4101443 - RNA, 23 nt, Streptococcus pneumoniae R6
uaagauuacgacguuuuaggaca

SEQ ID NO: 4101444 - RNA, 19 nt, Streptococcus pneumoniae R6
uaagauuacugucauauca

SEQ ID NO: 4101445 - RNA, 20 nt, Streptococcus pneumoniae R6
uaagauuacugucauaucau

SEQ ID NO: 4101446 - RNA, 21 nt, Streptococcus pneumoniae R6
uaagauuacugucauaucaua

SEQ ID NO: 4101447 - RNA, 23 nt, Streptococcus pneumoniae R6
uaagauucuucugguuuggcaaa

SEQ ID NO: 4101448 - RNA, 18 nt, Streptococcus pneumoniae R6
uaagauuuguuuuucaaa

SEQ ID NO: 4101449 - RNA, 12 nt, Streptococcus pneumoniae R6
uaagauuuuugg

SEQ ID NO: 4101450 - RNA, 15 nt, Streptococcus pneumoniae R6
uaagauuuuuggaaa

SEQ ID NO: 4101451 - RNA, 17 nt, Streptococcus pneumoniae R6
uaagauuuuuggaaaaa

SEQ ID NO: 4101452 - RNA, 14 nt, Streptococcus pneumoniae R6
uaagcaaaaaaagc

SEQ ID NO: 4101453 - RNA, 19 nt, Streptococcus pneumoniae R6
uaagcaacuuuacgaaauu

SEQ ID NO: 4101454 - RNA, 16 nt, Streptococcus pneumoniae R6
uaagcaauuuuuuaua

SEQ ID NO: 4101455 - RNA, 23 nt, Streptococcus pneumoniae R6
uaagcaauuuuuuauagacauug

SEQ ID NO: 4101456 - RNA, 21 nt, Streptococcus pneumoniae R6
uaagcaccuacaacauagacu

SEQ ID NO: 4101457 - RNA, 19 nt, Streptococcus pneumoniae R6
uaagcaccuaguacaaaga

SEQ ID NO: 4101458 - RNA, 22 nt, Streptococcus pneumoniae R6
uaagcaugauaugaaguuuauu

SEQ ID NO: 4101459 - RNA, 15 nt, Streptococcus pneumoniae R6
uaagcccaaagauaa

SEQ ID NO: 4101460 - RNA, 22 nt, Streptococcus pneumoniae R6
uaagcccaugauaucuuugauu

SEQ ID NO: 4101461 - RNA, 20 nt, Streptococcus pneumoniae R6
uaagcccgaaaaauuucucu

SEQ ID NO: 4101462 - RNA, 20 nt, Streptococcus pneumoniae R6
uaagccgaagccaaucaaac

SEQ ID NO: 4101463 - RNA, 15 nt, Streptococcus pneumoniae R6
uaagccggcuugucu

SEQ ID NO: 4101464 - RNA, 17 nt, Streptococcus pneumoniae R6
uaagccggcuugucuuu

SEQ ID NO: 4101465 - RNA, 16 nt, Streptococcus pneumoniae R6
uaagccuauucccuga

SEQ ID NO: 4101466 - RNA, 14 nt, Streptococcus pneumoniae R6
uaagccuuuuucuu

SEQ ID NO: 4101467 - RNA, 18 nt, Streptococcus pneumoniae R6
uaagcucgauaaaggaca

SEQ ID NO: 4101468 - RNA, 22 nt, Streptococcus pneumoniae R6
uaagcucgauaaaggacaaaau

SEQ ID NO: 4101469 - RNA, 23 nt, Streptococcus pneumoniae R6
uaagcuucuucguccucugucuc

SEQ ID NO: 4101470 - RNA, 13 nt, Streptococcus pneumoniae R6
uaaggaaaacauu

SEQ ID NO: 4101471 - RNA, 14 nt, Streptococcus pneumoniae R6
uaaggaaaacauua

SEQ ID NO: 4101472 - RNA, 20 nt, Streptococcus pneumoniae R6
uaaggaaaacauuacaaugu

SEQ ID NO: 4101473 - RNA, 20 nt, Streptococcus pneumoniae R6
uaaggaagucuguuauuucu

SEQ ID NO: 4101474 - RNA, 21 nt, Streptococcus pneumoniae R6
uaaggacaggugcuuaaauag

SEQ ID NO: 4101475 - RNA, 21 nt, Streptococcus pneumoniae R6
uaaggacuuccgccaucuugu

SEQ ID NO: 4101476 - RNA, 18 nt, Streptococcus pneumoniae R6
uaaggaggcaaagaaaaa

SEQ ID NO: 4101477 - RNA, 19 nt, Streptococcus pneumoniae R6
uaaggaggcaaagaaaaaa

SEQ ID NO: 4101478 - RNA, 18 nt, Streptococcus pneumoniae R6
uaaggcacuagcuccaaa

SEQ ID NO: 4101479 - RNA, 13 nt, Streptococcus pneumoniae R6
uaaucauuaucca

SEQ ID NO: 4101480 - RNA, 13 nt, Streptococcus pneumoniae R6
uaaucauucccug

SEQ ID NO: 4101481 - RNA, 18 nt, Streptococcus pneumoniae R6
uaauccacuauaauaaaa

SEQ ID NO: 4101482 - RNA, 15 nt, Streptococcus pneumoniae R6
uaauccacucagaca

SEQ ID NO: 4101483 - RNA, 14 nt, Streptococcus pneumoniae R6
uaauccaggaauca

SEQ ID NO: 4101484 - RNA, 14 nt, Streptococcus pneumoniae R6
uaauccuuaaccca

SEQ ID NO: 4101485 - RNA, 14 nt, Streptococcus pneumoniae R6
uaaucggagaugga

SEQ ID NO: 4101486 - RNA, 21 nt, Streptococcus pneumoniae R6
uaaucucaaaagaaagcauag

SEQ ID NO: 4101487 - RNA, 11 nt, Streptococcus pneumoniae R6
uaaucucuagc

SEQ ID NO: 4101488 - RNA, 22 nt, Streptococcus pneumoniae R6
uaaucugaauguuucccuugcu

SEQ ID NO: 4101489 - RNA, 18 nt, Streptococcus pneumoniae R6
uaaucugcaccugauuuc

SEQ ID NO: 4101490 - RNA, 22 nt, Streptococcus pneumoniae R6
uaaucugcaccugauuucuccg

SEQ ID NO: 4101491 - RNA, 15 nt, Streptococcus pneumoniae R6
uaaucuucaaauuuu

SEQ ID NO: 4101492 - RNA, 17 nt, Streptococcus pneumoniae R6
uaaucuugacaaucuuu

SEQ ID NO: 4101493 - RNA, 15 nt, Streptococcus pneumoniae R6
uaaucuugacuauau

SEQ ID NO: 4101494 - RNA, 19 nt, Streptococcus pneumoniae R6
uaaucuugacuauauuucu

SEQ ID NO: 4101495 - RNA, 18 nt, Streptococcus pneumoniae R6
uaaucuuggcaaaacgug

SEQ ID NO: 4101496 - RNA, 13 nt, Streptococcus pneumoniae R6
uaaugaagacauc

SEQ ID NO: 4101497 - RNA, 22 nt, Streptococcus pneumoniae R6
uaaugaagacaucauauaaaua

SEQ ID NO: 4101498 - RNA, 22 nt, Streptococcus pneumoniae R6
uaaugacaauuauauaaaccaa

SEQ ID NO: 4101499 - RNA, 14 nt, Streptococcus pneumoniae R6
uaaugacagugauu

SEQ ID NO: 4101500 - RNA, 22 nt, Streptococcus pneumoniae R6
uaaugacuuguguuuuuccuuu

SEQ ID NO: 4101501 - RNA, 17 nt, Streptococcus pneumoniae R6
uaaugauagcuugaauu

SEQ ID NO: 4101502 - RNA, 19 nt, Streptococcus pneumoniae R6
uaaugauaugguauuuaaa

SEQ ID NO: 4101503 - RNA, 16 nt, Streptococcus pneumoniae R6
uaaugauugauagcca

SEQ ID NO: 4101504 - RNA, 18 nt, Streptococcus pneumoniae R6
uaaugcaguaaaucauac

SEQ ID NO: 4101505 - RNA, 15 nt, Streptococcus pneumoniae R6
uaaugcccaagagac

SEQ ID NO: 4101506 - RNA, 23 nt, Streptococcus pneumoniae R6
uaaugcgauugguaucuuggcua

SEQ ID NO: 4101507 - RNA, 15 nt, Streptococcus pneumoniae R6
uaaugcuccaauaca

SEQ ID NO: 4101508 - RNA, 16 nt, Streptococcus pneumoniae R6
uaaugcuccaauacaa

SEQ ID NO: 4101509 - RNA, 16 nt, Streptococcus pneumoniae R6
uaauggauugaaauaa

SEQ ID NO: 4101510 - RNA, 16 nt, Streptococcus pneumoniae R6
uaauggauugauacuc

SEQ ID NO: 4101511 - RNA, 16 nt, Streptococcus pneumoniae R6
uaauggccaccuucaa

SEQ ID NO: 4101512 - RNA, 19 nt, Streptococcus pneumoniae R6
uaauggcuucauuaugagu

SEQ ID NO: 4101513 - RNA, 14 nt, Streptococcus pneumoniae R6
uaauggcuuguucc

SEQ ID NO: 4101514 - RNA, 15 nt, Streptococcus pneumoniae R6
uaaugggccaaauca

SEQ ID NO: 4101515 - RNA, 19 nt, Streptococcus pneumoniae R6
uaaugggcgcauuuuccuu

SEQ ID NO: 4101516 - RNA, 23 nt, Streptococcus pneumoniae R6
uaauggucuggauguucugucug

SEQ ID NO: 4101517 - RNA, 21 nt, Streptococcus pneumoniae R6
uaauguccaugcuugauucaa

SEQ ID NO: 4101518 - RNA, 18 nt, Streptococcus pneumoniae R6
uaaugucucugcuauuuc

SEQ ID NO: 4101519 - RNA, 23 nt, Streptococcus pneumoniae R6
uaauuaaaguuaauagaagaaca

SEQ ID NO: 4101520 - RNA, 21 nt, Streptococcus pneumoniae R6
uaauuaauuuauuuaaucauu

SEQ ID NO: 4101521 - RNA, 13 nt, Streptococcus pneumoniae R6
uaauuagaaaaaa

SEQ ID NO: 4101522 - RNA, 20 nt, Streptococcus pneumoniae R6
uaauuagaaagucauuuguu

SEQ ID NO: 4101523 - RNA, 21 nt, Streptococcus pneumoniae R6
uaauuagaaagucauuuguuu

SEQ ID NO: 4101524 - RNA, 18 nt, Streptococcus pneumoniae R6
uaauuagucguaaauaau

SEQ ID NO: 4101525 - RNA, 19 nt, Streptococcus pneumoniae R6
uaauuagucguaaauaaua

SEQ ID NO: 4101526 - RNA, 19 nt, Streptococcus pneumoniae R6
uaauuaugaaauuuaaaaa

SEQ ID NO: 4101527 - RNA, 23 nt, Streptococcus pneumoniae R6
uaauuaugaaauuuaaaaagaaa

SEQ ID NO: 4101528 - RNA, 16 nt, Streptococcus pneumoniae R6
uaauuauguacacauu

SEQ ID NO: 4101529 - RNA, 13 nt, Streptococcus pneumoniae R6
uaauuauuucaau

SEQ ID NO: 4101530 - RNA, 15 nt, Streptococcus pneumoniae R6
uaauuauuucaauua

SEQ ID NO: 4101531 - RNA, 16 nt, Streptococcus pneumoniae R6
uaauucaccuaaccaa

SEQ ID NO: 4101532 - RNA, 15 nt, Streptococcus pneumoniae R6
uaauucccuuaaagu

SEQ ID NO: 4101533 - RNA, 16 nt, Streptococcus pneumoniae R6
uaauucgauuucugcu

SEQ ID NO: 4101534 - RNA, 15 nt, Streptococcus pneumoniae R6
uaauucggaaagcca

SEQ ID NO: 4101535 - RNA, 21 nt, Streptococcus pneumoniae R6
uaauucggaaagccaaaucaa

SEQ ID NO: 4101536 - RNA, 20 nt, Streptococcus pneumoniae R6
uaauucggugguauuuagau

SEQ ID NO: 4101537 - RNA, 22 nt, Streptococcus pneumoniae R6
uaauucggugguauuuagauuc

SEQ ID NO: 4101538 - RNA, 16 nt, Streptococcus pneumoniae R6
uaauucuaacaccuuu

SEQ ID NO: 4101539 - RNA, 15 nt, Streptococcus pneumoniae R6
uaauucucuaaauaa

SEQ ID NO: 4101540 - RNA, 21 nt, Streptococcus pneumoniae R6
uaauucucuuguuguuguaau

SEQ ID NO: 4101541 - RNA, 14 nt, Streptococcus pneumoniae R6
uaauugacgaagaa

SEQ ID NO: 4101542 - RNA, 17 nt, Streptococcus pneumoniae R6
uaauugcaaauuuagca

SEQ ID NO: 4101543 - RNA, 21 nt, Streptococcus pneumoniae R6
uaauugcgcggguucaauaca

SEQ ID NO: 4101544 - RNA, 22 nt, Streptococcus pneumoniae R6
uaauugcgcggguucaauacaa

SEQ ID NO: 4101545 - RNA, 15 nt, Streptococcus pneumoniae R6
uaauuggaaaauaaa

SEQ ID NO: 4101546 - RNA, 16 nt, Streptococcus pneumoniae R6
uaauuggaaaauaaau

SEQ ID NO: 4101547 - RNA, 18 nt, Streptococcus pneumoniae R6
uaauugggccuuaguaaa

SEQ ID NO: 4101548 - RNA, 19 nt, Streptococcus pneumoniae R6
uaauugguacauuuugauu

SEQ ID NO: 4101549 - RNA, 13 nt, Streptococcus pneumoniae R6
uaauugguugaga

SEQ ID NO: 4101550 - RNA, 16 nt, Streptococcus pneumoniae R6
uaauuguaaacaaaaa

SEQ ID NO: 4101551 - RNA, 15 nt, Streptococcus pneumoniae R6
uaauuguaaagacuu

SEQ ID NO: 4101552 - RNA, 20 nt, Streptococcus pneumoniae R6
uaauuguagcuuuauuaagc

SEQ ID NO: 4101553 - RNA, 23 nt, Streptococcus pneumoniae R6
uaauuguagcuuuauuaagcccu

SEQ ID NO: 4101554 - RNA, 15 nt, Streptococcus pneumoniae R6
uaauuuaaagagauu

SEQ ID NO: 4101555 - RNA, 19 nt, Streptococcus pneumoniae R6
uaauuuaauccacuauaau

SEQ ID NO: 4101556 - RNA, 20 nt, Streptococcus pneumoniae R6
uaauuuagagaaugaaauau

SEQ ID NO: 4101557 - RNA, 21 nt, Streptococcus pneumoniae R6
uaauuuauagaaauauuuuag

SEQ ID NO: 4101558 - RNA, 20 nt, Streptococcus pneumoniae R6
uaauuuauccgaagauuuag

SEQ ID NO: 4101559 - RNA, 13 nt, Streptococcus pneumoniae R6
uaauuuauuuaau

SEQ ID NO: 4101560 - RNA, 21 nt, Streptococcus pneumoniae R6
uaauuuauuuaaucauuuaau

SEQ ID NO: 4101561 - RNA, 21 nt, Streptococcus pneumoniae R6
uaauuucaaaggcuuuuucuu

SEQ ID NO: 4101562 - RNA, 19 nt, Streptococcus pneumoniae R6
uaauuucaagaaguugucu

SEQ ID NO: 4101563 - RNA, 23 nt, Streptococcus pneumoniae R6
uaauuucagaaaucuucucuuga

SEQ ID NO: 4101564 - RNA, 14 nt, Streptococcus pneumoniae R6
uaauuucauuacua

SEQ ID NO: 4101565 - RNA, 16 nt, Streptococcus pneumoniae R6
uaauuuccauaccaaa

SEQ ID NO: 4101566 - RNA, 18 nt, Streptococcus pneumoniae R6
uaauuuccauaccaaagu

SEQ ID NO: 4101567 - RNA, 16 nt, Streptococcus pneumoniae R6
uaauuuccauaucuuu

SEQ ID NO: 4101568 - RNA, 15 nt, Streptococcus pneumoniae R6
uaauuuccucugaga

SEQ ID NO: 4101569 - RNA, 16 nt, Streptococcus pneumoniae R6
uaauuuccucugagaa

SEQ ID NO: 4101570 - RNA, 18 nt, Streptococcus pneumoniae R6
uaauuucuagaaauauuu

SEQ ID NO: 4101571 - RNA, 20 nt, Streptococcus pneumoniae R6
uaauuucuauaaauguuuua

SEQ ID NO: 4101572 - RNA, 21 nt, Streptococcus pneumoniae R6
uaauuucuauaaauguuuuag

SEQ ID NO: 4101573 - RNA, 23 nt, Streptococcus pneumoniae R6
uaauuucuuuuuguguuaaauca

SEQ ID NO: 4101574 - RNA, 11 nt, Streptococcus pneumoniae R6
uaauuuuaaaa

SEQ ID NO: 4101575 - RNA, 16 nt, Streptococcus pneumoniae R6
uaauuuuaguagaaaa

SEQ ID NO: 4101576 - RNA, 22 nt, Streptococcus pneumoniae R6
uaauuuucacaaacaaauccaa

SEQ ID NO: 4101577 - RNA, 12 nt, Streptococcus pneumoniae R6
uaauuuuccuua

SEQ ID NO: 4101578 - RNA, 14 nt, Streptococcus pneumoniae R6
uaauuuucuuuuug

SEQ ID NO: 4101579 - RNA, 17 nt, Streptococcus pneumoniae R6
uaauuuugccaguuuug

SEQ ID NO: 4101580 - RNA, 18 nt, Streptococcus pneumoniae R6
uaauuuugccaguuuugu

SEQ ID NO: 4101581 - RNA, 20 nt, Streptococcus pneumoniae R6
uaccacuuccuaccuauuca

SEQ ID NO: 4101582 - RNA, 20 nt, Streptococcus pneumoniae R6
uaccagaagccuuguuucca

SEQ ID NO: 4101583 - RNA, 13 nt, Streptococcus pneumoniae R6
uaccagaccaagu

SEQ ID NO: 4101584 - RNA, 16 nt, Streptococcus pneumoniae R6
uaccagccaauguauu

SEQ ID NO: 4101585 - RNA, 19 nt, Streptococcus pneumoniae R6
uaccaguuaccauugacuu

SEQ ID NO: 4101586 - RNA, 17 nt, Streptococcus pneumoniae R6
uaccauaaacuaagcuu

SEQ ID NO: 4101587 - RNA, 21 nt, Streptococcus pneumoniae R6
uaccauaauaaaagugucuua

SEQ ID NO: 4101588 - RNA, 22 nt, Streptococcus pneumoniae R6
uaccauauccuuucaguagaua

SEQ ID NO: 4101589 - RNA, 16 nt, Streptococcus pneumoniae R6
uaccaucauaggcuuu

SEQ ID NO: 4101590 - RNA, 17 nt, Streptococcus pneumoniae R6
uaccaucauaggcuuua

SEQ ID NO: 4101591 - RNA, 22 nt, Streptococcus pneumoniae R6
uaccauccugaauagugaagau

SEQ ID NO: 4101592 - RNA, 21 nt, Streptococcus pneumoniae R6
uaccaucuaacucauagcaga

SEQ ID NO: 4101593 - RNA, 20 nt, Streptococcus pneumoniae R6
uaccauugacuuggaaccag

SEQ ID NO: 4101594 - RNA, 15 nt, Streptococcus pneumoniae R6
uacccauguucggau

SEQ ID NO: 4101595 - RNA, 18 nt, Streptococcus pneumoniae R6
uacccauuuauggaaaaa

SEQ ID NO: 4101596 - RNA, 20 nt, Streptococcus pneumoniae R6
uaccccaaauuccuggcaua

SEQ ID NO: 4101597 - RNA, 23 nt, Streptococcus pneumoniae R6
uacccccuuaaaaccauguuuuu

SEQ ID NO: 4101598 - RNA, 21 nt, Streptococcus pneumoniae R6
uacccucggcuguuuuuucuu

SEQ ID NO: 4101599 - RNA, 16 nt, Streptococcus pneumoniae R6
uaccgaccuugucucc

SEQ ID NO: 4101600 - RNA, 16 nt, Streptococcus pneumoniae R6
uaccgaucucaucuuc

SEQ ID NO: 4101601 - RNA, 19 nt, Streptococcus pneumoniae R6
uaccgaugauguucauaac

SEQ ID NO: 4101602 - RNA, 20 nt, Streptococcus pneumoniae R6
uaccgcacuuaugaagaaau

SEQ ID NO: 4101603 - RNA, 17 nt, Streptococcus pneumoniae R6
uaccgucgacugcaguc

SEQ ID NO: 4101604 - RNA, 19 nt, Streptococcus pneumoniae R6
uaccuaaaaaggaaccagu

SEQ ID NO: 4101605 - RNA, 13 nt, Streptococcus pneumoniae R6
uaccuaagauuag

SEQ ID NO: 4101606 - RNA, 15 nt, Streptococcus pneumoniae R6
uaccuaccagaggau

SEQ ID NO: 4101607 - RNA, 21 nt, Streptococcus pneumoniae R6
uaccuacgauaucugaagaua

SEQ ID NO: 4101608 - RNA, 19 nt, Streptococcus pneumoniae R6
uaccuauucauauaugcua

SEQ ID NO: 4101609 - RNA, 14 nt, Streptococcus pneumoniae R6
uaccucauaucucu

SEQ ID NO: 4101610 - RNA, 19 nt, Streptococcus pneumoniae R6
uaccucauaucucuuguau

SEQ ID NO: 4101611 - RNA, 20 nt, Streptococcus pneumoniae R6
uaccugaaauauacucauaa

SEQ ID NO: 4101612 - RNA, 15 nt, Streptococcus pneumoniae R6
uaccugauaagauuu

SEQ ID NO: 4101613 - RNA, 23 nt, Streptococcus pneumoniae R6
uaccugauaagauuuuuggaaaa

SEQ ID NO: 4101614 - RNA, 14 nt, Streptococcus pneumoniae R6
uaccugccuuccaa

SEQ ID NO: 4101615 - RNA, 15 nt, Streptococcus pneumoniae R6
uaccugccuuccaag

SEQ ID NO: 4101616 - RNA, 23 nt, Streptococcus pneumoniae R6
uaccugcuaccguugaaaucaau

SEQ ID NO: 4101617 - RNA, 15 nt, Streptococcus pneumoniae R6
uaccugcuccaaaua

SEQ ID NO: 4101618 - RNA, 21 nt, Streptococcus pneumoniae R6
uaccugcucgccccauuucuu

SEQ ID NO: 4101619 - RNA, 22 nt, Streptococcus pneumoniae R6
uaccuggcaauacuucaacaaa

SEQ ID NO: 4101620 - RNA, 18 nt, Streptococcus pneumoniae R6
uaccuucaggagauaaaa

SEQ ID NO: 4101621 - RNA, 13 nt, Streptococcus pneumoniae R6
uaccuuucucgag

SEQ ID NO: 4101622 - RNA, 14 nt, Streptococcus pneumoniae R6
uaccuuucuuguaa

SEQ ID NO: 4101623 - RNA, 16 nt, Streptococcus pneumoniae R6
uaccuuucuuguaaua

SEQ ID NO: 4101624 - RNA, 15 nt, Streptococcus pneumoniae R6
uaccuuugaaaaaau

SEQ ID NO: 4101625 - RNA, 14 nt, Streptococcus pneumoniae R6
uaccuuuuccuuca

SEQ ID NO: 4101626 - RNA, 22 nt, Streptococcus pneumoniae R6
uacgaaacaauugcuaaaacau

SEQ ID NO: 4101627 - RNA, 20 nt, Streptococcus pneumoniae R6
uacgaaucaauacagaagaa

SEQ ID NO: 4101628 - RNA, 16 nt, Streptococcus pneumoniae R6
uacgaaucucuuucca

SEQ ID NO: 4101629 - RNA, 19 nt, Streptococcus pneumoniae R6
uacgaaugaguucaaagcu

SEQ ID NO: 4101630 - RNA, 18 nt, Streptococcus pneumoniae R6
uacgaauuauuuccuuga

SEQ ID NO: 4101631 - RNA, 15 nt, Streptococcus pneumoniae R6
uacgacaccugacaa

SEQ ID NO: 4101632 - RNA, 22 nt, Streptococcus pneumoniae R6
uacgauucauaguuacuccuuu

SEQ ID NO: 4101633 - RNA, 23 nt, Streptococcus pneumoniae R6
uacgauucauaguuacuccuuuu

SEQ ID NO: 4101634 - RNA, 19 nt, Streptococcus pneumoniae R6
uacgauugguucugcucca

SEQ ID NO: 4101635 - RNA, 16 nt, Streptococcus pneumoniae R6
uacgcccuccauuaug

SEQ ID NO: 4101636 - RNA, 18 nt, Streptococcus pneumoniae R6
uacggauaacgucuucag

SEQ ID NO: 4101637 - RNA, 14 nt, Streptococcus pneumoniae R6
uacgguaaggcgac

SEQ ID NO: 4101638 - RNA, 18 nt, Streptococcus pneumoniae R6
uacggucaaagucauaga

SEQ ID NO: 4101639 - RNA, 16 nt, Streptococcus pneumoniae R6
uacguccaccacaaaa

SEQ ID NO: 4101640 - RNA, 20 nt, Streptococcus pneumoniae R6
uacguccaccacaaaagaga

SEQ ID NO: 4101641 - RNA, 23 nt, Streptococcus pneumoniae R6
uacguccaccacaaaagagaaag

SEQ ID NO: 4101642 - RNA, 22 nt, Streptococcus pneumoniae R6
uacgucggaacaucuuuuccau

SEQ ID NO: 4101643 - RNA, 20 nt, Streptococcus pneumoniae R6
uacgucggcuagcacuagua

SEQ ID NO: 4101644 - RNA, 17 nt, Streptococcus pneumoniae R6
uacgugaacaaguccau

SEQ ID NO: 4101645 - RNA, 15 nt, Streptococcus pneumoniae R6
uacgugucaaagcau

SEQ ID NO: 4101646 - RNA, 13 nt, Streptococcus pneumoniae R6
uacguuuuuacua

SEQ ID NO: 4101647 - RNA, 13 nt, Streptococcus pneumoniae R6
uacuaaaacauuu

SEQ ID NO: 4101648 - RNA, 12 nt, Streptococcus pneumoniae R6
uacuaaaauaac

SEQ ID NO: 4101649 - RNA, 13 nt, Streptococcus pneumoniae R6
uacuaaaauaacu

SEQ ID NO: 4101650 - RNA, 16 nt, Streptococcus pneumoniae R6
uacuaaaauauuucua

SEQ ID NO: 4101651 - RNA, 20 nt, Streptococcus pneumoniae R6
uacuaaaauauuucuagaaa

SEQ ID NO: 4101652 - RNA, 13 nt, Streptococcus pneumoniae R6
uacuaaaauuaug

SEQ ID NO: 4101653 - RNA, 16 nt, Streptococcus pneumoniae R6
uacuaaaccaauaaua

SEQ ID NO: 4101654 - RNA, 20 nt, Streptococcus pneumoniae R6
uacuaaauacuagucuuucu

SEQ ID NO: 4101655 - RNA, 22 nt, Streptococcus pneumoniae R6
uacuaaauauaagauuuaacuu

SEQ ID NO: 4101656 - RNA, 15 nt, Streptococcus pneumoniae R6
uacuaaucuuugcca

SEQ ID NO: 4101657 - RNA, 15 nt, Streptococcus pneumoniae R6
uacuaauuaauuaac

SEQ ID NO: 4101658 - RNA, 21 nt, Streptococcus pneumoniae R6
uacuacuaucccuuuaccauu

SEQ ID NO: 4101659 - RNA, 14 nt, Streptococcus pneumoniae R6
uacuacuuuuguca

SEQ ID NO: 4101660 - RNA, 14 nt, Streptococcus pneumoniae R6
uacuagauucuauu

SEQ ID NO: 4101661 - RNA, 17 nt, Streptococcus pneumoniae R6
uacuauacgacaugccu

SEQ ID NO: 4101662 - RNA, 22 nt, Streptococcus pneumoniae R6
uacuauacuuuuuuaauuuaau

SEQ ID NO: 4101663 - RNA, 18 nt, Streptococcus pneumoniae R6
uacuauaguagccuugac

SEQ ID NO: 4101664 - RNA, 19 nt, Streptococcus pneumoniae R6
uacuauaguuugcaaauua

SEQ ID NO: 4101665 - RNA, 18 nt, Streptococcus pneumoniae R6
uacuaugcguuuuauugu

SEQ ID NO: 4101666 - RNA, 16 nt, Streptococcus pneumoniae R6
uacuaugcguuuucua

SEQ ID NO: 4101667 - RNA, 19 nt, Streptococcus pneumoniae R6
uacucaaggacuaaguuca

SEQ ID NO: 4101668 - RNA, 16 nt, Streptococcus pneumoniae R6
uacucaaguccuuuug

SEQ ID NO: 4101669 - RNA, 22 nt, Streptococcus pneumoniae R6
uacucaaucccauauuuuuccu

SEQ ID NO: 4101670 - RNA, 15 nt, Streptococcus pneumoniae R6
uacucaaugaaaauc

SEQ ID NO: 4101671 - RNA, 14 nt, Streptococcus pneumoniae R6
uacucaggauaaaa

SEQ ID NO: 4101672 - RNA, 23 nt, Streptococcus pneumoniae R6
uacucaguauuuggauuaugaaa

SEQ ID NO: 4101673 - RNA, 16 nt, Streptococcus pneumoniae R6
uacucauaaagucuuu

SEQ ID NO: 4101674 - RNA, 12 nt, Streptococcus pneumoniae R6
uacucaugacag

SEQ ID NO: 4101675 - RNA, 17 nt, Streptococcus pneumoniae R6
uacuccuuuuuugacuc

SEQ ID NO: 4101676 - RNA, 19 nt, Streptococcus pneumoniae R6
uacucgugaagaaaucauc

SEQ ID NO: 4101677 - RNA, 16 nt, Streptococcus pneumoniae R6
uacucucuaggaagcg

SEQ ID NO: 4101678 - RNA, 18 nt, Streptococcus pneumoniae R6
uacucugccuuccuuguc

SEQ ID NO: 4101679 - RNA, 18 nt, Streptococcus pneumoniae R6
uacucuuagaaaaucucu

SEQ ID NO: 4101680 - RNA, 17 nt, Streptococcus pneumoniae R6
uacucuuauuauucucu

SEQ ID NO: 4101681 - RNA, 14 nt, Streptococcus pneumoniae R6
uacucuucaaaaau

SEQ ID NO: 4101682 - RNA, 17 nt, Streptococcus pneumoniae R6
uacucuuuacuuugcuu

SEQ ID NO: 4101683 - RNA, 21 nt, Streptococcus pneumoniae R6
uagaauagaaacaaaauauau

SEQ ID NO: 4101684 - RNA, 14 nt, Streptococcus pneumoniae R6
uagaauaguacacu

SEQ ID NO: 4101685 - RNA, 15 nt, Streptococcus pneumoniae R6
uagaauaguacacuu

SEQ ID NO: 4101686 - RNA, 23 nt, Streptococcus pneumoniae R6
uagaauaguccacugcaauuucu

SEQ ID NO: 4101687 - RNA, 23 nt, Streptococcus pneumoniae R6
uagaaucgucuguacaaauccca

SEQ ID NO: 4101688 - RNA, 22 nt, Streptococcus pneumoniae R6
uagaaugcuuuuugaaagcaga

SEQ ID NO: 4101689 - RNA, 15 nt, Streptococcus pneumoniae R6
uagaaugucuuccaa

SEQ ID NO: 4101690 - RNA, 18 nt, Streptococcus pneumoniae R6
uagaauuggagaaugaua

SEQ ID NO: 4101691 - RNA, 15 nt, Streptococcus pneumoniae R6
uagaauuucuuuauu

SEQ ID NO: 4101692 - RNA, 17 nt, Streptococcus pneumoniae R6
uagacaaaaucaucagu

SEQ ID NO: 4101693 - RNA, 20 nt, Streptococcus pneumoniae R6
uagacaauuuucauccauga

SEQ ID NO: 4101694 - RNA, 21 nt, Streptococcus pneumoniae R6
uagacaggauaucaucgcuug

SEQ ID NO: 4101695 - RNA, 12 nt, Streptococcus pneumoniae R6
uagacauuuucu

SEQ ID NO: 4101696 - RNA, 13 nt, Streptococcus pneumoniae R6
uagaccaagagac

SEQ ID NO: 4101697 - RNA, 19 nt, Streptococcus pneumoniae R6
uagaccaaguucuuuucau

SEQ ID NO: 4101698 - RNA, 15 nt, Streptococcus pneumoniae R6
uagaccugaucaaag

SEQ ID NO: 4101699 - RNA, 17 nt, Streptococcus pneumoniae R6
uagaccugaucaaaggg

SEQ ID NO: 4101700 - RNA, 13 nt, Streptococcus pneumoniae R6
uagaccugccaug

SEQ ID NO: 4101701 - RNA, 13 nt, Streptococcus pneumoniae R6
uagacuaacuucu

SEQ ID NO: 4101702 - RNA, 17 nt, Streptococcus pneumoniae R6
uagacuaacuucuuauu

SEQ ID NO: 4101703 - RNA, 21 nt, Streptococcus pneumoniae R6
uagacuaacuucuuauuagca

SEQ ID NO: 4101704 - RNA, 15 nt, Streptococcus pneumoniae R6
uagacuauaacagag

SEQ ID NO: 4101705 - RNA, 16 nt, Streptococcus pneumoniae R6
uagacuauaacagaga

SEQ ID NO: 4101706 - RNA, 14 nt, Streptococcus pneumoniae R6
uagacuauauugau

SEQ ID NO: 4101707 - RNA, 17 nt, Streptococcus pneumoniae R6
uagacucuuauuucuca

SEQ ID NO: 4101708 - RNA, 12 nt, Streptococcus pneumoniae R6
uagacuucaaca

SEQ ID NO: 4101709 - RNA, 18 nt, Streptococcus pneumoniae R6
uagacuuccugcaaaacu

SEQ ID NO: 4101710 - RNA, 22 nt, Streptococcus pneumoniae R6
uagacuugaccgcagauuuaac

SEQ ID NO: 4101711 - RNA, 19 nt, Streptococcus pneumoniae R6
uagagaaagaaaaacugcu

SEQ ID NO: 4101712 - RNA, 20 nt, Streptococcus pneumoniae R6
uagagaaagaaaaacugcuu

SEQ ID NO: 4101713 - RNA, 11 nt, Streptococcus pneumoniae R6
uagagaagcca

SEQ ID NO: 4101714 - RNA, 21 nt, Streptococcus pneumoniae R6
uagagacauaaucaagaugaa

SEQ ID NO: 4101715 - RNA, 22 nt, Streptococcus pneumoniae R6
uagagaccaacuccucucuccu

SEQ ID NO: 4101716 - RNA, 20 nt, Streptococcus pneumoniae R6
uagagagaaaggagcacagu

SEQ ID NO: 4101717 - RNA, 11 nt, Streptococcus pneumoniae R6
uagagagacag

SEQ ID NO: 4101718 - RNA, 19 nt, Streptococcus pneumoniae R6
uagagagggucucccagga

SEQ ID NO: 4101719 - RNA, 17 nt, Streptococcus pneumoniae R6
uagagaguuaaaaaaag

SEQ ID NO: 4101720 - RNA, 15 nt, Streptococcus pneumoniae R6
uagagauaaguggca

SEQ ID NO: 4101721 - RNA, 22 nt, Streptococcus pneumoniae R6
uagagauaccuuuuccuucauu

SEQ ID NO: 4101722 - RNA, 21 nt, Streptococcus pneumoniae R6
uagagauuauccccuacucga

SEQ ID NO: 4101723 - RNA, 16 nt, Streptococcus pneumoniae R6
uagagccuucuuccau

SEQ ID NO: 4101724 - RNA, 17 nt, Streptococcus pneumoniae R6
uagagcuaacuuuuccu

SEQ ID NO: 4101725 - RNA, 23 nt, Streptococcus pneumoniae R6
uagagcugauagugauguuucaa

SEQ ID NO: 4101726 - RNA, 20 nt, Streptococcus pneumoniae R6
uagagguuauucaaaaacau

SEQ ID NO: 4101727 - RNA, 17 nt, Streptococcus pneumoniae R6
uagaguagucugggugc

SEQ ID NO: 4101728 - RNA, 16 nt, Streptococcus pneumoniae R6
uagaguccaaagacca

SEQ ID NO: 4101729 - RNA, 20 nt, Streptococcus pneumoniae R6
uagagucucuuaauaucagc

SEQ ID NO: 4101730 - RNA, 23 nt, Streptococcus pneumoniae R6
uagaguguuaucugaaaauuaau

SEQ ID NO: 4101731 - RNA, 16 nt, Streptococcus pneumoniae R6
uagaguucguaguaaa

SEQ ID NO: 4101732 - RNA, 20 nt, Streptococcus pneumoniae R6
uagauaaaacuauugacuuu

SEQ ID NO: 4101733 - RNA, 18 nt, Streptococcus pneumoniae R6
uagauaaaggccaagucc

SEQ ID NO: 4101734 - RNA, 20 nt, Streptococcus pneumoniae R6
uagauaaauguugaauaguu

SEQ ID NO: 4101735 - RNA, 20 nt, Streptococcus pneumoniae R6
uagauaacaccguucuaaau

SEQ ID NO: 4101736 - RNA, 21 nt, Streptococcus pneumoniae R6
uagauaacaccguucuaaauu

SEQ ID NO: 4101737 - RNA, 16 nt, Streptococcus pneumoniae R6
uagauacaccaucccu

SEQ ID NO: 4101738 - RNA, 13 nt, Streptococcus pneumoniae R6
uagauacauuuuu

SEQ ID NO: 4101739 - RNA, 18 nt, Streptococcus pneumoniae R6
uagauaccugguucagca

SEQ ID NO: 4101740 - RNA, 20 nt, Streptococcus pneumoniae R6
uagauaccugguucagcaga

SEQ ID NO: 4101741 - RNA, 15 nt, Streptococcus pneumoniae R6
uagauagaacugacg

SEQ ID NO: 4101742 - RNA, 15 nt, Streptococcus pneumoniae R6
uagauaguuaaaugu

SEQ ID NO: 4101743 - RNA, 16 nt, Streptococcus pneumoniae R6
uagauaguuaaaugua

SEQ ID NO: 4101744 - RNA, 15 nt, Streptococcus pneumoniae R6
uagauaguuuugcaa

SEQ ID NO: 4101745 - RNA, 19 nt, Streptococcus pneumoniae R6
uagaucaucugcuuugauu

SEQ ID NO: 4101746 - RNA, 23 nt, Streptococcus pneumoniae R6
uagaucugauagugguguuucaa

SEQ ID NO: 4101747 - RNA, 14 nt, Streptococcus pneumoniae R6
uagaucuuuacuug

SEQ ID NO: 4101748 - RNA, 22 nt, Streptococcus pneumoniae R6
uagaugagauuucgcuccagca

SEQ ID NO: 4101749 - RNA, 16 nt, Streptococcus pneumoniae R6
uagaugaucgagcaga

SEQ ID NO: 4101750 - RNA, 13 nt, Streptococcus pneumoniae R6
uagaugaugguuu

SEQ ID NO: 4101751 - RNA, 14 nt, Streptococcus pneumoniae R6
uagaugauuggaaa

SEQ ID NO: 4101752 - RNA, 22 nt, Streptococcus pneumoniae R6
uagaugauuuucaaauuuucuu

SEQ ID NO: 4101753 - RNA, 14 nt, Streptococcus pneumoniae R6
uagaugauuuuucu

SEQ ID NO: 4101754 - RNA, 15 nt, Streptococcus pneumoniae R6
uagaugauuuuucug

SEQ ID NO: 4101755 - RNA, 17 nt, Streptococcus pneumoniae R6
uagaugauuuuucuguu

SEQ ID NO: 4101756 - RNA, 18 nt, Streptococcus pneumoniae R6
uagauucaccaguagacu

SEQ ID NO: 4101757 - RNA, 19 nt, Streptococcus pneumoniae R6
uagauucaccaguagacuu

SEQ ID NO: 4101758 - RNA, 14 nt, Streptococcus pneumoniae R6
uagauugaaacuag

SEQ ID NO: 4101759 - RNA, 15 nt, Streptococcus pneumoniae R6
uagauugaaacuaga

SEQ ID NO: 4101760 - RNA, 17 nt, Streptococcus pneumoniae R6
uagauugaaacuggaau

SEQ ID NO: 4101761 - RNA, 16 nt, Streptococcus pneumoniae R6
uagauuggauaaaauc

SEQ ID NO: 4101762 - RNA, 23 nt, Streptococcus pneumoniae R6
uagauuggcaggcguuuuuugau

SEQ ID NO: 4101763 - RNA, 14 nt, Streptococcus pneumoniae R6
uagauuguccucaa

SEQ ID NO: 4101764 - RNA, 15 nt, Streptococcus pneumoniae R6
uagauuuaaaacugu

SEQ ID NO: 4101765 - RNA, 13 nt, Streptococcus pneumoniae R6
uagauuucugaau

SEQ ID NO: 4101766 - RNA, 18 nt, Streptococcus pneumoniae R6
uagauuuuuaaauucuuc

SEQ ID NO: 4101767 - RNA, 19 nt, Streptococcus pneumoniae R6
uagauuuuuauuauuuccu

SEQ ID NO: 4101768 - RNA, 21 nt, Streptococcus pneumoniae R6
uagauuuuucaaggugaaguu

SEQ ID NO: 4101769 - RNA, 17 nt, Streptococcus pneumoniae R6
uagcaaaaaagcaaaua

SEQ ID NO: 4101770 - RNA, 16 nt, Streptococcus pneumoniae R6
uagcaaaacacuacca

SEQ ID NO: 4101771 - RNA, 23 nt, Streptococcus pneumoniae R6
uagcaaagucaacucgggcgagg

SEQ ID NO: 4101772 - RNA, 14 nt, Streptococcus pneumoniae R6
uagcaaccuuuuuu

SEQ ID NO: 4101773 - RNA, 16 nt, Streptococcus pneumoniae R6
uagcaacuaucugaau

SEQ ID NO: 4101774 - RNA, 21 nt, Streptococcus pneumoniae R6
uagcaacuguuuuuucaacag

SEQ ID NO: 4101775 - RNA, 22 nt, Streptococcus pneumoniae R6
uagcaacuguuuuuucaacagc

SEQ ID NO: 4101776 - RNA, 12 nt, Streptococcus pneumoniae R6
uagcaagaguuu

SEQ ID NO: 4101777 - RNA, 18 nt, Streptococcus pneumoniae R6
uagcaagaguuuuucucg

SEQ ID NO: 4101778 - RNA, 13 nt, Streptococcus pneumoniae R6
uagcaaggaugag

SEQ ID NO: 4101779 - RNA, 20 nt, Streptococcus pneumoniae R6
uagcaaucacucuaacuucu

SEQ ID NO: 4101780 - RNA, 22 nt, Streptococcus pneumoniae R6
uagcaaucacucuaacuucugc

SEQ ID NO: 4101781 - RNA, 18 nt, Streptococcus pneumoniae R6
uagcaaugccaaagguaa

SEQ ID NO: 4101782 - RNA, 16 nt, Streptococcus pneumoniae R6
uagcaaugguuuagaa

SEQ ID NO: 4101783 - RNA, 13 nt, Streptococcus pneumoniae R6
uagcaauucuaaa

SEQ ID NO: 4101784 - RNA, 18 nt, Streptococcus pneumoniae R6
uagcaauucuugguugcc

SEQ ID NO: 4101785 - RNA, 17 nt, Streptococcus pneumoniae R6
uaggagugaaaaacuag

SEQ ID NO: 4101786 - RNA, 21 nt, Streptococcus pneumoniae R6
uaggauaauauuacuucuaaa

SEQ ID NO: 4101787 - RNA, 15 nt, Streptococcus pneumoniae R6
uaggauagauaccuu

SEQ ID NO: 4101788 - RNA, 18 nt, Streptococcus pneumoniae R6
uaggauauuuuuguaggc

SEQ ID NO: 4101789 - RNA, 19 nt, Streptococcus pneumoniae R6
uaggaugccuuuuuaugau

SEQ ID NO: 4101790 - RNA, 19 nt, Streptococcus pneumoniae R6
uaggauggcuccagaaaua

SEQ ID NO: 4101791 - RNA, 17 nt, Streptococcus pneumoniae R6
uaggauuuauuuuucuu

SEQ ID NO: 4101792 - RNA, 22 nt, Streptococcus pneumoniae R6
uaggauuuauuuuucuuuuuca

SEQ ID NO: 4101793 - RNA, 21 nt, Streptococcus pneumoniae R6
uaggauuucuccuguuucaaa

SEQ ID NO: 4101794 - RNA, 19 nt, Streptococcus pneumoniae R6
uaggauuuggcguuaguua

SEQ ID NO: 4101795 - RNA, 22 nt, Streptococcus pneumoniae R6
uaggauuuggcguuaguuacuu

SEQ ID NO: 4101796 - RNA, 17 nt, Streptococcus pneumoniae R6
uaggcaagcuugaaaca

SEQ ID NO: 4101797 - RNA, 22 nt, Streptococcus pneumoniae R6
uaggcaagcuugaaacaaauaa

SEQ ID NO: 4101798 - RNA, 15 nt, Streptococcus pneumoniae R6
uaggcagaacaagag

SEQ ID NO: 4101799 - RNA, 23 nt, Streptococcus pneumoniae R6
uaggccuuguggaagaaguuuuc

SEQ ID NO: 4101800 - RNA, 13 nt, Streptococcus pneumoniae R6
uaggcgcuucacu

SEQ ID NO: 4101801 - RNA, 20 nt, Streptococcus pneumoniae R6
uaggcgcuucacuaguuuua

SEQ ID NO: 4101802 - RNA, 17 nt, Streptococcus pneumoniae R6
uaggcuaaugagucuau

SEQ ID NO: 4101803 - RNA, 18 nt, Streptococcus pneumoniae R6
uaggcuagcaaauuuaau

SEQ ID NO: 4101804 - RNA, 14 nt, Streptococcus pneumoniae R6
uaggcuuuauuuuc

SEQ ID NO: 4101805 - RNA, 16 nt, Streptococcus pneumoniae R6
uaggcuuucaacugcu

SEQ ID NO: 4101806 - RNA, 11 nt, Streptococcus pneumoniae R6
uagggaaacaa

SEQ ID NO: 4101807 - RNA, 13 nt, Streptococcus pneumoniae R6
uagggaguuuaga

SEQ ID NO: 4101808 - RNA, 17 nt, Streptococcus pneumoniae R6
uagggcaugccaaucga

SEQ ID NO: 4101809 - RNA, 14 nt, Streptococcus pneumoniae R6
uaggggcuauuuua

SEQ ID NO: 4101810 - RNA, 16 nt, Streptococcus pneumoniae R6
uaggguacuuucucuu

SEQ ID NO: 4101811 - RNA, 19 nt, Streptococcus pneumoniae R6
uagggugacaguaaaaaau

SEQ ID NO: 4101812 - RNA, 14 nt, Streptococcus pneumoniae R6
uaggguguuuucaa

SEQ ID NO: 4101813 - RNA, 13 nt, Streptococcus pneumoniae R6
uaggucaacagga

SEQ ID NO: 4101814 - RNA, 21 nt, Streptococcus pneumoniae R6
uaggucaaccaacuuuuccuu

SEQ ID NO: 4101815 - RNA, 22 nt, Streptococcus pneumoniae R6
uaggucaaccaacuuuuccuug

SEQ ID NO: 4101816 - RNA, 23 nt, Streptococcus pneumoniae R6
uaggucacgaggaggagaaaaag

SEQ ID NO: 4101817 - RNA, 13 nt, Streptococcus pneumoniae R6
uaggucauauggg

SEQ ID NO: 4101818 - RNA, 19 nt, Streptococcus pneumoniae R6
uaggucuggcuauuuuuau

SEQ ID NO: 4101819 - RNA, 22 nt, Streptococcus pneumoniae R6
uaggugaaaugucuauuuucuu

SEQ ID NO: 4101820 - RNA, 16 nt, Streptococcus pneumoniae R6
uaggugagcaucagga

SEQ ID NO: 4101821 - RNA, 18 nt, Streptococcus pneumoniae R6
uaggugagcaucaggaaa

SEQ ID NO: 4101822 - RNA, 19 nt, Streptococcus pneumoniae R6
uaggugagcaucaggaaag

SEQ ID NO: 4101823 - RNA, 18 nt, Streptococcus pneumoniae R6
uagguguaaacuuuauau

SEQ ID NO: 4101824 - RNA, 17 nt, Streptococcus pneumoniae R6
uagguuagucaaaaaga

SEQ ID NO: 4101825 - RNA, 19 nt, Streptococcus pneumoniae R6
uagguuugcuauuguccaa

SEQ ID NO: 4101826 - RNA, 11 nt, Streptococcus pneumoniae R6
uagguuuuguu

SEQ ID NO: 4101827 - RNA, 19 nt, Streptococcus pneumoniae R6
uaguaaaaacguuuuucaa

SEQ ID NO: 4101828 - RNA, 23 nt, Streptococcus pneumoniae R6
uaguaaaacuguaugagaaacag

SEQ ID NO: 4101829 - RNA, 13 nt, Streptococcus pneumoniae R6
uaguaaaaugaaa

SEQ ID NO: 4101830 - RNA, 23 nt, Streptococcus pneumoniae R6
uaguaaacagucccauaaaacua

SEQ ID NO: 4101831 - RNA, 20 nt, Streptococcus pneumoniae R6
uaguaaagcuagauuuaaaa

SEQ ID NO: 4101832 - RNA, 11 nt, Streptococcus pneumoniae R6
uaguaaauaga

SEQ ID NO: 4101833 - RNA, 14 nt, Streptococcus pneumoniae R6
uaguaaccaccuac

SEQ ID NO: 4101834 - RNA, 13 nt, Streptococcus pneumoniae R6
uaguaacuuuuuc

SEQ ID NO: 4101835 - RNA, 18 nt, Streptococcus pneumoniae R6
uaguaaguuaaaaauccu

SEQ ID NO: 4101836 - RNA, 18 nt, Streptococcus pneumoniae R6
uaguaauaauuucaaaau

SEQ ID NO: 4101837 - RNA, 21 nt, Streptococcus pneumoniae R6
uaguaauucaauuaaguuuua

SEQ ID NO: 4101838 - RNA, 23 nt, Streptococcus pneumoniae R6
uaguaauuccacacagaaagcau

SEQ ID NO: 4101839 - RNA, 21 nt, Streptococcus pneumoniae R6
uaguaauucccuuccuaucaa

SEQ ID NO: 4101840 - RNA, 17 nt, Streptococcus pneumoniae R6
uaguaauuuccauaucu

SEQ ID NO: 4101841 - RNA, 23 nt, Streptococcus pneumoniae R6
uaguaauuuccauaucuuuaggg

SEQ ID NO: 4101842 - RNA, 20 nt, Streptococcus pneumoniae R6
uaguaauuuucgauaaagua

SEQ ID NO: 4101843 - RNA, 12 nt, Streptococcus pneumoniae R6
uaguacaaagaa

SEQ ID NO: 4101844 - RNA, 16 nt, Streptococcus pneumoniae R6
uaguacacuucuacuu

SEQ ID NO: 4101845 - RNA, 20 nt, Streptococcus pneumoniae R6
uaguacacuucugcuucuaa

SEQ ID NO: 4101846 - RNA, 14 nt, Streptococcus pneumoniae R6
uaguacauugaaau

SEQ ID NO: 4101847 - RNA, 15 nt, Streptococcus pneumoniae R6
uaguacgaaacaauu

SEQ ID NO: 4101848 - RNA, 12 nt, Streptococcus pneumoniae R6
uaguacugaaca

SEQ ID NO: 4101849 - RNA, 17 nt, Streptococcus pneumoniae R6
uaguacugaacaaugaa

SEQ ID NO: 4101850 - RNA, 19 nt, Streptococcus pneumoniae R6
uaguagacugaaucugaaa

SEQ ID NO: 4101851 - RNA, 23 nt, Streptococcus pneumoniae R6
uaguagaucaugacugagagcua

SEQ ID NO: 4101852 - RNA, 15 nt, Streptococcus pneumoniae R6
uaguagccaaaaucc

SEQ ID NO: 4101853 - RNA, 17 nt, Streptococcus pneumoniae R6
uaguagcggugaaucua

SEQ ID NO: 4101854 - RNA, 22 nt, Streptococcus pneumoniae R6
uaguagugguuuuuaggcaaua

SEQ ID NO: 4101855 - RNA, 16 nt, Streptococcus pneumoniae R6
uaguaguuagauaacu

SEQ ID NO: 4101856 - RNA, 22 nt, Streptococcus pneumoniae R6
uaguaguuagauaacuuuucug

SEQ ID NO: 4101857 - RNA, 17 nt, Streptococcus pneumoniae R6
uaguaguuucagcgauu

SEQ ID NO: 4101858 - RNA, 16 nt, Streptococcus pneumoniae R6
uaguaucaaaugacua

SEQ ID NO: 4101859 - RNA, 16 nt, Streptococcus pneumoniae R6
uaguaugucugaauau

SEQ ID NO: 4101860 - RNA, 14 nt, Streptococcus pneumoniae R6
uaguauuaguaauu

SEQ ID NO: 4101861 - RNA, 18 nt, Streptococcus pneumoniae R6
uaguauucaucuuaucaa

SEQ ID NO: 4101862 - RNA, 14 nt, Streptococcus pneumoniae R6
uagucaaagggaaa

SEQ ID NO: 4101863 - RNA, 18 nt, Streptococcus pneumoniae R6
uagucaauugaaacaaga

SEQ ID NO: 4101864 - RNA, 21 nt, Streptococcus pneumoniae R6
uagucaauugaaacaagaaca

SEQ ID NO: 4101865 - RNA, 16 nt, Streptococcus pneumoniae R6
uagucauaccaaguuc

SEQ ID NO: 4101866 - RNA, 18 nt, Streptococcus pneumoniae R6
uagucauaccaaguucuu

SEQ ID NO: 4101867 - RNA, 16 nt, Streptococcus pneumoniae R6
uagucaucaauauuag

SEQ ID NO: 4101868 - RNA, 20 nt, Streptococcus pneumoniae R6
uagucaucagaaaaaaggca

SEQ ID NO: 4101869 - RNA, 19 nt, Streptococcus pneumoniae R6
uagucaugaccccuaaaua

SEQ ID NO: 4101870 - RNA, 18 nt, Streptococcus pneumoniae R6
uagucauuagauauagaa

SEQ ID NO: 4101871 - RNA, 23 nt, Streptococcus pneumoniae R6
uagucauucgaaugauuucucuu

SEQ ID NO: 4101872 - RNA, 22 nt, Streptococcus pneumoniae R6
uaguccaagacguucaaagaua

SEQ ID NO: 4101873 - RNA, 22 nt, Streptococcus pneumoniae R6
uaguccacugcaauuucuaaaa

SEQ ID NO: 4101874 - RNA, 17 nt, Streptococcus pneumoniae R6
uaguccugaaaaucauc

SEQ ID NO: 4101875 - RNA, 17 nt, Streptococcus pneumoniae R6
uagucgaagcuuccaau

SEQ ID NO: 4101876 - RNA, 17 nt, Streptococcus pneumoniae R6
uagucgcuacaggcaug

SEQ ID NO: 4101877 - RNA, 18 nt, Streptococcus pneumoniae R6
uagucguaaauaauauua

SEQ ID NO: 4101878 - RNA, 18 nt, Streptococcus pneumoniae R6
uagucuacaauuucucgu

SEQ ID NO: 4101879 - RNA, 14 nt, Streptococcus pneumoniae R6
uagucuagcuagug

SEQ ID NO: 4101880 - RNA, 17 nt, Streptococcus pneumoniae R6
uagucuauucuuuccuu

SEQ ID NO: 4101881 - RNA, 21 nt, Streptococcus pneumoniae R6
uagucucaaaaucaaagacuu

SEQ ID NO: 4101882 - RNA, 19 nt, Streptococcus pneumoniae R6
uagucucagcuugcucaaa

SEQ ID NO: 4101883 - RNA, 15 nt, Streptococcus pneumoniae R6
uagucuucuuuucuu

SEQ ID NO: 4101884 - RNA, 14 nt, Streptococcus pneumoniae R6
uagugaauugaaau

SEQ ID NO: 4101885 - RNA, 14 nt, Streptococcus pneumoniae R6
uagugacuuuaugu

SEQ ID NO: 4101886 - RNA, 22 nt, Streptococcus pneumoniae R6
uagugggccagauuuauggucu

SEQ ID NO: 4101887 - RNA, 14 nt, Streptococcus pneumoniae R6
uauacuuuuuuaau

SEQ ID NO: 4101888 - RNA, 19 nt, Streptococcus pneumoniae R6
uauacuuuuuuaauuuaau

SEQ ID NO: 4101889 - RNA, 23 nt, Streptococcus pneumoniae R6
uauagaaaacaacuuauaaaaaa

SEQ ID NO: 4101890 - RNA, 15 nt, Streptococcus pneumoniae R6
uauagaaauguuuua

SEQ ID NO: 4101891 - RNA, 21 nt, Streptococcus pneumoniae R6
uauagaacuaguaaauugucu

SEQ ID NO: 4101892 - RNA, 18 nt, Streptococcus pneumoniae R6
uauagaaggcaauuaaaa

SEQ ID NO: 4101893 - RNA, 19 nt, Streptococcus pneumoniae R6
uauagaaggcaauuaaaag

SEQ ID NO: 4101894 - RNA, 18 nt, Streptococcus pneumoniae R6
uauagaauauauuucuca

SEQ ID NO: 4101895 - RNA, 21 nt, Streptococcus pneumoniae R6
uauagacaacuccuugaauca

SEQ ID NO: 4101896 - RNA, 22 nt, Streptococcus pneumoniae R6
uauagacaacuccuugaaucau

SEQ ID NO: 4101897 - RNA, 14 nt, Streptococcus pneumoniae R6
uauagacaggauau

SEQ ID NO: 4101898 - RNA, 14 nt, Streptococcus pneumoniae R6
uauagaccugauca

SEQ ID NO: 4101899 - RNA, 16 nt, Streptococcus pneumoniae R6
uauagacuauauugau

SEQ ID NO: 4101900 - RNA, 21 nt, Streptococcus pneumoniae R6
uauagaggagauuuaaaaaug

SEQ ID NO: 4101901 - RNA, 14 nt, Streptococcus pneumoniae R6
uauagauucaauau

SEQ ID NO: 4101902 - RNA, 17 nt, Streptococcus pneumoniae R6
uauagauucaauauauu

SEQ ID NO: 4101903 - RNA, 16 nt, Streptococcus pneumoniae R6
uauagcagauugaaau

SEQ ID NO: 4101904 - RNA, 17 nt, Streptococcus pneumoniae R6
uauagcauacugaauuu

SEQ ID NO: 4101905 - RNA, 15 nt, Streptococcus pneumoniae R6
uauagcauucuucuc

SEQ ID NO: 4101906 - RNA, 19 nt, Streptococcus pneumoniae R6
uauagcauuguccauaacg

SEQ ID NO: 4101907 - RNA, 21 nt, Streptococcus pneumoniae R6
uauagccccuaugcuuuccuu

SEQ ID NO: 4101908 - RNA, 17 nt, Streptococcus pneumoniae R6
uauagcgcuagagacua

SEQ ID NO: 4101909 - RNA, 17 nt, Streptococcus pneumoniae R6
uauagcguuuugaaacu

SEQ ID NO: 4101910 - RNA, 19 nt, Streptococcus pneumoniae R6
uauagguuccuucugcauc

SEQ ID NO: 4101911 - RNA, 13 nt, Streptococcus pneumoniae R6
uauaguaaaauga

SEQ ID NO: 4101912 - RNA, 14 nt, Streptococcus pneumoniae R6
uauaguaaacugaa

SEQ ID NO: 4101913 - RNA, 16 nt, Streptococcus pneumoniae R6
uauaguaauuccacac

SEQ ID NO: 4101914 - RNA, 14 nt, Streptococcus pneumoniae R6
uauaguagaagugu

SEQ ID NO: 4101915 - RNA, 22 nt, Streptococcus pneumoniae R6
uauaguagaaguguauuauucu

SEQ ID NO: 4101916 - RNA, 22 nt, Streptococcus pneumoniae R6
uauaguagauugaaacuagaau

SEQ ID NO: 4101917 - RNA, 18 nt, Streptococcus pneumoniae R6
uauaguagauugaaauaa

SEQ ID NO: 4101918 - RNA, 21 nt, Streptococcus pneumoniae R6
uauaguagauugaaauaagau

SEQ ID NO: 4101919 - RNA, 23 nt, Streptococcus pneumoniae R6
uauagucaaagggaaaucugaaa

SEQ ID NO: 4101920 - RNA, 17 nt, Streptococcus pneumoniae R6
uauagucaauuaguuua

SEQ ID NO: 4101921 - RNA, 21 nt, Streptococcus pneumoniae R6
uauagugaaauuaacaaaaag

SEQ ID NO: 4101922 - RNA, 16 nt, Streptococcus pneumoniae R6
uauagugaauugaaau

SEQ ID NO: 4101923 - RNA, 18 nt, Streptococcus pneumoniae R6
uauagugaauugaaauaa

SEQ ID NO: 4101924 - RNA, 19 nt, Streptococcus pneumoniae R6
uauagugguguuucaaguc

SEQ ID NO: 4101925 - RNA, 15 nt, Streptococcus pneumoniae R6
uauaguuaaaaaaga

SEQ ID NO: 4101926 - RNA, 22 nt, Streptococcus pneumoniae R6
uauaguuaaaaaagauuugaaa

SEQ ID NO: 4101927 - RNA, 13 nt, Streptococcus pneumoniae R6
uauaguuaaauua

SEQ ID NO: 4101928 - RNA, 17 nt, Streptococcus pneumoniae R6
uauaguucguugaaucu

SEQ ID NO: 4101929 - RNA, 18 nt, Streptococcus pneumoniae R6
uauaguucguugaaucua

SEQ ID NO: 4101930 - RNA, 13 nt, Streptococcus pneumoniae R6
uauaguuuaauuu

SEQ ID NO: 4101931 - RNA, 14 nt, Streptococcus pneumoniae R6
uauaguuugucuuu

SEQ ID NO: 4101932 - RNA, 17 nt, Streptococcus pneumoniae R6
uauaguuuugauuauuu

SEQ ID NO: 4101933 - RNA, 17 nt, Streptococcus pneumoniae R6
uauauaauagauugaaa

SEQ ID NO: 4101934 - RNA, 21 nt, Streptococcus pneumoniae R6
uauauaauuauauauaaaaag

SEQ ID NO: 4101935 - RNA, 17 nt, Streptococcus pneumoniae R6
uauauacccaaaacaca

SEQ ID NO: 4101936 - RNA, 13 nt, Streptococcus pneumoniae R6
uauauaguagacu

SEQ ID NO: 4101937 - RNA, 14 nt, Streptococcus pneumoniae R6
uauauaguuuaauc

SEQ ID NO: 4101938 - RNA, 19 nt, Streptococcus pneumoniae R6
uauauaguuuaaucaaaau

SEQ ID NO: 4101939 - RNA, 20 nt, Streptococcus pneumoniae R6
uauauaguuuaaucaaaaua

SEQ ID NO: 4101940 - RNA, 21 nt, Streptococcus pneumoniae R6
uauauaucugcagaauacucu

SEQ ID NO: 4101941 - RNA, 21 nt, Streptococcus pneumoniae R6
uauauaugcacauauacacuu

SEQ ID NO: 4101942 - RNA, 20 nt, Streptococcus pneumoniae R6
uauaucaaaaccaguccuug

SEQ ID NO: 4101943 - RNA, 16 nt, Streptococcus pneumoniae R6
uauaucaugcuuuacu

SEQ ID NO: 4101944 - RNA, 14 nt, Streptococcus pneumoniae R6
uauaucuaauaauu

SEQ ID NO: 4101945 - RNA, 15 nt, Streptococcus pneumoniae R6
uauaucuaauaauuu

SEQ ID NO: 4101946 - RNA, 22 nt, Streptococcus pneumoniae R6
uauaucuuauuuuucuauuuaa

SEQ ID NO: 4101947 - RNA, 17 nt, Streptococcus pneumoniae R6
uauaugaagauucugua

SEQ ID NO: 4101948 - RNA, 22 nt, Streptococcus pneumoniae R6
uauaugaagauucuguauggua

SEQ ID NO: 4101949 - RNA, 20 nt, Streptococcus pneumoniae R6
uauaugcaauuucuuuauau

SEQ ID NO: 4101950 - RNA, 16 nt, Streptococcus pneumoniae R6
uauauggaugauuuaa

SEQ ID NO: 4101951 - RNA, 16 nt, Streptococcus pneumoniae R6
uauauuaaaaaaaggg

SEQ ID NO: 4101952 - RNA, 12 nt, Streptococcus pneumoniae R6
uauauuauaaau

SEQ ID NO: 4101953 - RNA, 15 nt, Streptococcus pneumoniae R6
uauauuauauaucug

SEQ ID NO: 4101954 - RNA, 16 nt, Streptococcus pneumoniae R6
uauauucaaaauacaa

SEQ ID NO: 4101955 - RNA, 18 nt, Streptococcus pneumoniae R6
uauauuccauuccucugg

SEQ ID NO: 4101956 - RNA, 24 nt, Streptococcus pneumoniae R6
uauauucuccagcuauuaaguccu

SEQ ID NO: 4101957 - RNA, 18 nt, Streptococcus pneumoniae R6
uauauugaaaugaaauaa

SEQ ID NO: 4101958 - RNA, 15 nt, Streptococcus pneumoniae R6
uauauugcaagagaa

SEQ ID NO: 4101959 - RNA, 12 nt, Streptococcus pneumoniae R6
uauauuuauuau

SEQ ID NO: 4101960 - RNA, 13 nt, Streptococcus pneumoniae R6
uauauuuauuaua

SEQ ID NO: 4101961 - RNA, 16 nt, Streptococcus pneumoniae R6
uauauuuuucaaauaa

SEQ ID NO: 4101962 - RNA, 17 nt, Streptococcus pneumoniae R6
uaucaaaaaaagaaguu

SEQ ID NO: 4101963 - RNA, 21 nt, Streptococcus pneumoniae R6
uaucaaaaccaguccuugaaa

SEQ ID NO: 4101964 - RNA, 22 nt, Streptococcus pneumoniae R6
uaucaaaagauguuagaaaaag

SEQ ID NO: 4101965 - RNA, 15 nt, Streptococcus pneumoniae R6
uaucaaacuuuuuag

SEQ ID NO: 4101966 - RNA, 16 nt, Streptococcus pneumoniae R6
uaucaaaucccuagcu

SEQ ID NO: 4101967 - RNA, 13 nt, Streptococcus pneumoniae R6
uaucaaaugacua

SEQ ID NO: 4101968 - RNA, 19 nt, Streptococcus pneumoniae R6
uaucaaccacuuaacaacu

SEQ ID NO: 4101969 - RNA, 13 nt, Streptococcus pneumoniae R6
uaucaacugccug

SEQ ID NO: 4101970 - RNA, 15 nt, Streptococcus pneumoniae R6
uaucaagauaagaaa

SEQ ID NO: 4101971 - RNA, 16 nt, Streptococcus pneumoniae R6
uaucaaggauuuuuug

SEQ ID NO: 4101972 - RNA, 15 nt, Streptococcus pneumoniae R6
uaucaagguuuuucu

SEQ ID NO: 4101973 - RNA, 18 nt, Streptococcus pneumoniae R6
uaucaagguuuuucugua

SEQ ID NO: 4101974 - RNA, 17 nt, Streptococcus pneumoniae R6
uaucaaguucacucaaa

SEQ ID NO: 4101975 - RNA, 17 nt, Streptococcus pneumoniae R6
uaucaaguucuuccacu

SEQ ID NO: 4101976 - RNA, 21 nt, Streptococcus pneumoniae R6
uaucaaguucuuccacucaaa

SEQ ID NO: 4101977 - RNA, 12 nt, Streptococcus pneumoniae R6
uaucaauaauag

SEQ ID NO: 4101978 - RNA, 15 nt, Streptococcus pneumoniae R6
uaucaaucaaacgcu

SEQ ID NO: 4101979 - RNA, 13 nt, Streptococcus pneumoniae R6
uaucaaucucugc

SEQ ID NO: 4101980 - RNA, 16 nt, Streptococcus pneumoniae R6
uaucaaugauuuauuu

SEQ ID NO: 4101981 - RNA, 17 nt, Streptococcus pneumoniae R6
uaucaauugauuugaau

SEQ ID NO: 4101982 - RNA, 23 nt, Streptococcus pneumoniae R6
uaucacauuguguucaccccuaa

SEQ ID NO: 4101983 - RNA, 22 nt, Streptococcus pneumoniae R6
uaucaccuccuucuccaauccu

SEQ ID NO: 4101984 - RNA, 16 nt, Streptococcus pneumoniae R6
uaucacgaacccagcc

SEQ ID NO: 4101985 - RNA, 21 nt, Streptococcus pneumoniae R6
uaucacggcauuucugcauaa

SEQ ID NO: 4101986 - RNA, 14 nt, Streptococcus pneumoniae R6
uaucacuccaaaaa

SEQ ID NO: 4101987 - RNA, 23 nt, Streptococcus pneumoniae R6
uaucagaaagucgugauuucuau

SEQ ID NO: 4101988 - RNA, 19 nt, Streptococcus pneumoniae R6
uaucagcuuaucaaauccu

SEQ ID NO: 4101989 - RNA, 21 nt, Streptococcus pneumoniae R6
uaucaggaaagucaaauuaau

SEQ ID NO: 4101990 - RNA, 15 nt, Streptococcus pneumoniae R6
uaugauauacacacu

SEQ ID NO: 4101991 - RNA, 14 nt, Streptococcus pneumoniae R6
uaugaucuauuccu

SEQ ID NO: 4101992 - RNA, 20 nt, Streptococcus pneumoniae R6
uaugaugcguuuuauaauuu

SEQ ID NO: 4101993 - RNA, 18 nt, Streptococcus pneumoniae R6
uaugaugugcuauucuaa

SEQ ID NO: 4101994 - RNA, 18 nt, Streptococcus pneumoniae R6
uaugauuacuuauuugaa

SEQ ID NO: 4101995 - RNA, 13 nt, Streptococcus pneumoniae R6
uaugauugucucc

SEQ ID NO: 4101996 - RNA, 23 nt, Streptococcus pneumoniae R6
uaugauuuaaacuaguuuucuaa

SEQ ID NO: 4101997 - RNA, 12 nt, Streptococcus pneumoniae R6
uaugauuucaau

SEQ ID NO: 4101998 - RNA, 17 nt, Streptococcus pneumoniae R6
uaugauuucaauuuuaa

SEQ ID NO: 4101999 - RNA, 22 nt, Streptococcus pneumoniae R6
uaugauuucaauuuuaaauuuu

SEQ ID NO: 4102000 - RNA, 19 nt, Streptococcus pneumoniae R6
uaugcacagacauaugaaa

SEQ ID NO: 4102001 - RNA, 16 nt, Streptococcus pneumoniae R6
uaugcauaauuuccau

SEQ ID NO: 4102002 - RNA, 16 nt, Streptococcus pneumoniae R6
uaugccguuucaacaa

SEQ ID NO: 4102003 - RNA, 14 nt, Streptococcus pneumoniae R6
uaugcguuuuaaug

SEQ ID NO: 4102004 - RNA, 14 nt, Streptococcus pneumoniae R6
uaugcguuuuacua

SEQ ID NO: 4102005 - RNA, 13 nt, Streptococcus pneumoniae R6
uaugcguuuuauu

SEQ ID NO: 4102006 - RNA, 23 nt, Streptococcus pneumoniae R6
uaugcuauaucuuauuuuucuau

SEQ ID NO: 4102007 - RNA, 19 nt, Streptococcus pneumoniae R6
uaugcucugaaccaacaua

SEQ ID NO: 4102008 - RNA, 13 nt, Streptococcus pneumoniae R6
uaugcuuggugag

SEQ ID NO: 4102009 - RNA, 19 nt, Streptococcus pneumoniae R6
uauggaaaaaaugaaauua

SEQ ID NO: 4102010 - RNA, 13 nt, Streptococcus pneumoniae R6
uauggaaacucaa

SEQ ID NO: 4102011 - RNA, 14 nt, Streptococcus pneumoniae R6
uauggaaucuugca

SEQ ID NO: 4102012 - RNA, 17 nt, Streptococcus pneumoniae R6
uauggaugauaccaucu

SEQ ID NO: 4102013 - RNA, 18 nt, Streptococcus pneumoniae R6
uauggcaucuaguaaauc

SEQ ID NO: 4102014 - RNA, 17 nt, Streptococcus pneumoniae R6
uauggccgauaacagcc

SEQ ID NO: 4102015 - RNA, 18 nt, Streptococcus pneumoniae R6
uaugguucuggagaagca

SEQ ID NO: 4102016 - RNA, 19 nt, Streptococcus pneumoniae R6
uauguaagaagauuuuuua

SEQ ID NO: 4102017 - RNA, 18 nt, Streptococcus pneumoniae R6
uauguccuucaugaaauu

SEQ ID NO: 4102018 - RNA, 14 nt, Streptococcus pneumoniae R6
uaugucggcuucac

SEQ ID NO: 4102019 - RNA, 23 nt, Streptococcus pneumoniae R6
uauguguuaccgguuacauauag

SEQ ID NO: 4102020 - RNA, 15 nt, Streptococcus pneumoniae R6
uauguuacugacuuc

SEQ ID NO: 4102021 - RNA, 15 nt, Streptococcus pneumoniae R6
uauguuauccuauuc

SEQ ID NO: 4102022 - RNA, 22 nt, Streptococcus pneumoniae R6
uauguucugugauaaacuugua

SEQ ID NO: 4102023 - RNA, 14 nt, Streptococcus pneumoniae R6
uauguuuuaaauaa

SEQ ID NO: 4102024 - RNA, 15 nt, Streptococcus pneumoniae R6
uauguuuuaaauaaa

SEQ ID NO: 4102025 - RNA, 17 nt, Streptococcus pneumoniae R6
uauuaaaauaaguucaa

SEQ ID NO: 4102026 - RNA, 14 nt, Streptococcus pneumoniae R6
uauuaacagcaaaa

SEQ ID NO: 4102027 - RNA, 16 nt, Streptococcus pneumoniae R6
uauuaagaacucuuuc

SEQ ID NO: 4102028 - RNA, 12 nt, Streptococcus pneumoniae R6
uauuaagaaucu

SEQ ID NO: 4102029 - RNA, 20 nt, Streptococcus pneumoniae R6
uauuaagaaucuuuucuauu

SEQ ID NO: 4102030 - RNA, 14 nt, Streptococcus pneumoniae R6
uauuaauauauaaa

SEQ ID NO: 4102031 - RNA, 16 nt, Streptococcus pneumoniae R6
uauuaauauauaaaau

SEQ ID NO: 4102032 - RNA, 16 nt, Streptococcus pneumoniae R6
uauuaaucacuaauua

SEQ ID NO: 4102033 - RNA, 20 nt, Streptococcus pneumoniae R6
uauuacaacaauaagagaau

SEQ ID NO: 4102034 - RNA, 14 nt, Streptococcus pneumoniae R6
uauuacaaucauag

SEQ ID NO: 4102035 - RNA, 22 nt, Streptococcus pneumoniae R6
uauuaccaaguuaaacaaccuu

SEQ ID NO: 4102036 - RNA, 15 nt, Streptococcus pneumoniae R6
uauuaccuuucuugu

SEQ ID NO: 4102037 - RNA, 16 nt, Streptococcus pneumoniae R6
uauuagagguuugcuu

SEQ ID NO: 4102038 - RNA, 21 nt, Streptococcus pneumoniae R6
uauuagagguuugcuuagaaa

SEQ ID NO: 4102039 - RNA, 20 nt, Streptococcus pneumoniae R6
uauuagggcaaauaaaaagc

SEQ ID NO: 4102040 - RNA, 15 nt, Streptococcus pneumoniae R6
uauuagucaagaguu

SEQ ID NO: 4102041 - RNA, 12 nt, Streptococcus pneumoniae R6
uauuauaaauuu

SEQ ID NO: 4102042 - RNA, 19 nt, Streptococcus pneumoniae R6
uauuauacaccauuuguua

SEQ ID NO: 4102043 - RNA, 14 nt, Streptococcus pneumoniae R6
uauuauagagaggg

SEQ ID NO: 4102044 - RNA, 19 nt, Streptococcus pneumoniae R6
uauuauaugcaauuucuuu

SEQ ID NO: 4102045 - RNA, 12 nt, Streptococcus pneumoniae R6
uauuaucaaguu

SEQ ID NO: 4102046 - RNA, 20 nt, Streptococcus pneumoniae R6
uauuaucagcguaauagucu

SEQ ID NO: 4102047 - RNA, 16 nt, Streptococcus pneumoniae R6
uauuaucguuuuccua

SEQ ID NO: 4102048 - RNA, 11 nt, Streptococcus pneumoniae R6
uauuaucuuuc

SEQ ID NO: 4102049 - RNA, 18 nt, Streptococcus pneumoniae R6
uauuaugagcuauuagau

SEQ ID NO: 4102050 - RNA, 14 nt, Streptococcus pneumoniae R6
uauuaugcguuuua

SEQ ID NO: 4102051 - RNA, 20 nt, Streptococcus pneumoniae R6
uauuaugcguuuuauugugg

SEQ ID NO: 4102052 - RNA, 16 nt, Streptococcus pneumoniae R6
uauuaugcguuuuuca

SEQ ID NO: 4102053 - RNA, 18 nt, Streptococcus pneumoniae R6
uauuaugcguuuuucaga

SEQ ID NO: 4102054 - RNA, 18 nt, Streptococcus pneumoniae R6
uauuaugcguuuuuucug

SEQ ID NO: 4102055 - RNA, 21 nt, Streptococcus pneumoniae R6
uauuaugguauacgaaaaauc

SEQ ID NO: 4102056 - RNA, 23 nt, Streptococcus pneumoniae R6
uauuaugguauacgaaaaaucca

SEQ ID NO: 4102057 - RNA, 21 nt, Streptococcus pneumoniae R6
uauuauuaauauauaaaauuu

SEQ ID NO: 4102058 - RNA, 22 nt, Streptococcus pneumoniae R6
uauuauuaauauauaaaauuuc

SEQ ID NO: 4102059 - RNA, 19 nt, Streptococcus pneumoniae R6
uauuauuucaaagaacauc

SEQ ID NO: 4102060 - RNA, 16 nt, Streptococcus pneumoniae R6
uauuauuucauuuucu

SEQ ID NO: 4102061 - RNA, 12 nt, Streptococcus pneumoniae R6
uauucaacacuu

SEQ ID NO: 4102062 - RNA, 18 nt, Streptococcus pneumoniae R6
uauucaacacuugauacu

SEQ ID NO: 4102063 - RNA, 16 nt, Streptococcus pneumoniae R6
uauucaacgaaaauaa

SEQ ID NO: 4102064 - RNA, 20 nt, Streptococcus pneumoniae R6
uauucaauucuuuaacaaaa

SEQ ID NO: 4102065 - RNA, 18 nt, Streptococcus pneumoniae R6
uauucacccgaguauaau

SEQ ID NO: 4102066 - RNA, 15 nt, Streptococcus pneumoniae R6
uauucagaaaucuag

SEQ ID NO: 4102067 - RNA, 18 nt, Streptococcus pneumoniae R6
uauucagaaaucuaguug

SEQ ID NO: 4102068 - RNA, 14 nt, Streptococcus pneumoniae R6
uauucauaaaauac

SEQ ID NO: 4102069 - RNA, 15 nt, Streptococcus pneumoniae R6
uauucauaaaauacc

SEQ ID NO: 4102070 - RNA, 21 nt, Streptococcus pneumoniae R6
uauucauauccccagacauaa

SEQ ID NO: 4102071 - RNA, 15 nt, Streptococcus pneumoniae R6
uauucaucuuaucaa

SEQ ID NO: 4102072 - RNA, 18 nt, Streptococcus pneumoniae R6
uauucaugggauuucgga

SEQ ID NO: 4102073 - RNA, 16 nt, Streptococcus pneumoniae R6
uauucauugaaaaaau

SEQ ID NO: 4102074 - RNA, 22 nt, Streptococcus pneumoniae R6
uauucccuaccucauaucuguc

SEQ ID NO: 4102075 - RNA, 14 nt, Streptococcus pneumoniae R6
uauucgcuuacaua

SEQ ID NO: 4102076 - RNA, 17 nt, Streptococcus pneumoniae R6
uauucgcuuacauaaag

SEQ ID NO: 4102077 - RNA, 17 nt, Streptococcus pneumoniae R6
uauucguuuuuuauguu

SEQ ID NO: 4102078 - RNA, 18 nt, Streptococcus pneumoniae R6
uauucuaacuuauuuuaa

SEQ ID NO: 4102079 - RNA, 20 nt, Streptococcus pneumoniae R6
uauucuaacuuauuuuaacu

SEQ ID NO: 4102080 - RNA, 12 nt, Streptococcus pneumoniae R6
uauucuaggaaa

SEQ ID NO: 4102081 - RNA, 18 nt, Streptococcus pneumoniae R6
uauucuagugaaaaauug

SEQ ID NO: 4102082 - RNA, 14 nt, Streptococcus pneumoniae R6
uauucuaguuucaa

SEQ ID NO: 4102083 - RNA, 21 nt, Streptococcus pneumoniae R6
uauucuaguuucaauauauua

SEQ ID NO: 4102084 - RNA, 16 nt, Streptococcus pneumoniae R6
uauucuaguuucaauu

SEQ ID NO: 4102085 - RNA, 11 nt, Streptococcus pneumoniae R6
uauucucuaga

SEQ ID NO: 4102086 - RNA, 11 nt, Streptococcus pneumoniae R6
uauucuggaag

SEQ ID NO: 4102087 - RNA, 14 nt, Streptococcus pneumoniae R6
uauucuuauuucaa

SEQ ID NO: 4102088 - RNA, 21 nt, Streptococcus pneumoniae R6
uauucuucgugaaagacaaag

SEQ ID NO: 4102089 - RNA, 14 nt, Streptococcus pneumoniae R6
uauucuucucuauu

SEQ ID NO: 4102090 - RNA, 12 nt, Streptococcus pneumoniae R6
uauucuugauuu

SEQ ID NO: 4102091 - RNA, 14 nt, Streptococcus pneumoniae R6
uauucuuuuuaaau

SEQ ID NO: 4102092 - RNA, 14 nt, Streptococcus pneumoniae R6
uauugaaaugaaau

SEQ ID NO: 4102093 - RNA, 18 nt, Streptococcus pneumoniae R6
ucaaaacaguguuuugau

SEQ ID NO: 4102094 - RNA, 16 nt, Streptococcus pneumoniae R6
ucaaaacaugguuuug

SEQ ID NO: 4102095 - RNA, 16 nt, Streptococcus pneumoniae R6
ucaaaacauguuuuug

SEQ ID NO: 4102096 - RNA, 18 nt, Streptococcus pneumoniae R6
ucaaaaccaguccuggaa

SEQ ID NO: 4102097 - RNA, 21 nt, Streptococcus pneumoniae R6
ucaaaaccaguccuggaaaaa

SEQ ID NO: 4102098 - RNA, 22 nt, Streptococcus pneumoniae R6
ucaaaaccaucauaaucuggau

SEQ ID NO: 4102099 - RNA, 16 nt, Streptococcus pneumoniae R6
ucaaaaccauguuuug

SEQ ID NO: 4102100 - RNA, 21 nt, Streptococcus pneumoniae R6
ucaaaacuaguuuaaaagacu

SEQ ID NO: 4102101 - RNA, 17 nt, Streptococcus pneumoniae R6
ucaaaagaaagcauaga

SEQ ID NO: 4102102 - RNA, 18 nt, Streptococcus pneumoniae R6
ucaaaagcuuguuuaaaa

SEQ ID NO: 4102103 - RNA, 22 nt, Streptococcus pneumoniae R6
ucaaaagcuuguuuaaaaucuc

SEQ ID NO: 4102104 - RNA, 21 nt, Streptococcus pneumoniae R6
ucaaaaguuuaucuagaauuu

SEQ ID NO: 4102105 - RNA, 19 nt, Streptococcus pneumoniae R6
ucaaaauaaagcaaaucuu

SEQ ID NO: 4102106 - RNA, 18 nt, Streptococcus pneumoniae R6
ucaaaauaagucucagca

SEQ ID NO: 4102107 - RNA, 22 nt, Streptococcus pneumoniae R6
ucaaaauacuagauucuauuuu

SEQ ID NO: 4102108 - RNA, 15 nt, Streptococcus pneumoniae R6
ucaaaauaggaauca

SEQ ID NO: 4102109 - RNA, 17 nt, Streptococcus pneumoniae R6
ucaaaauauguuuucuu

SEQ ID NO: 4102110 - RNA, 11 nt, Streptococcus pneumoniae R6
ucaaaauauuu

SEQ ID NO: 4102111 - RNA, 22 nt, Streptococcus pneumoniae R6
ucaaaaucaagcuggcuacaga

SEQ ID NO: 4102112 - RNA, 13 nt, Streptococcus pneumoniae R6
ucaaaaucaauga

SEQ ID NO: 4102113 - RNA, 15 nt, Streptococcus pneumoniae R6
ucaaaaucagaaaaa

SEQ ID NO: 4102114 - RNA, 20 nt, Streptococcus pneumoniae R6
ucaaaaugacaauuuuucca

SEQ ID NO: 4102115 - RNA, 12 nt, Streptococcus pneumoniae R6
ucaaaauucuuu

SEQ ID NO: 4102116 - RNA, 21 nt, Streptococcus pneumoniae R6
ucaaaauucuuugaaaucaga

SEQ ID NO: 4102117 - RNA, 12 nt, Streptococcus pneumoniae R6
ucaaacaaugug

SEQ ID NO: 4102118 - RNA, 19 nt, Streptococcus pneumoniae R6
ucaaacaaugugcucagaa

SEQ ID NO: 4102119 - RNA, 14 nt, Streptococcus pneumoniae R6
ucaaacaauugacu

SEQ ID NO: 4102120 - RNA, 19 nt, Streptococcus pneumoniae R6
ucaaacacgguauuugaga

SEQ ID NO: 4102121 - RNA, 23 nt, Streptococcus pneumoniae R6
ucaaacagugcuagaaauugacu

SEQ ID NO: 4102122 - RNA, 10 nt, Streptococcus pneumoniae R6
ucaaacauca

SEQ ID NO: 4102123 - RNA, 10 nt, Streptococcus pneumoniae R6
ucaaacauug

SEQ ID NO: 4102124 - RNA, 21 nt, Streptococcus pneumoniae R6
ucaaaccagcaccagacauuu

SEQ ID NO: 4102125 - RNA, 22 nt, Streptococcus pneumoniae R6
ucaaaccguguucugucaugcg

SEQ ID NO: 4102126 - RNA, 17 nt, Streptococcus pneumoniae R6
ucaaacgagaaucugua

SEQ ID NO: 4102127 - RNA, 21 nt, Streptococcus pneumoniae R6
ucaaacguuuaacuguuccuu

SEQ ID NO: 4102128 - RNA, 17 nt, Streptococcus pneumoniae R6
ucaaacuuuuaaugaga

SEQ ID NO: 4102129 - RNA, 16 nt, Streptococcus pneumoniae R6
ucaaacuuuuuaguuu

SEQ ID NO: 4102130 - RNA, 21 nt, Streptococcus pneumoniae R6
ucaaacuuuuucucucugaau

SEQ ID NO: 4102131 - RNA, 15 nt, Streptococcus pneumoniae R6
ucaaagaacaaacua

SEQ ID NO: 4102132 - RNA, 14 nt, Streptococcus pneumoniae R6
ucaaagaaguccaa

SEQ ID NO: 4102133 - RNA, 14 nt, Streptococcus pneumoniae R6
ucaaagacaaggga

SEQ ID NO: 4102134 - RNA, 23 nt, Streptococcus pneumoniae R6
ucaaagagcaaacgagaaaacga

SEQ ID NO: 4102135 - RNA, 21 nt, Streptococcus pneumoniae R6
ucaaagaguuuuuuaucuuug

SEQ ID NO: 4102136 - RNA, 20 nt, Streptococcus pneumoniae R6
ucaaagcauuugccagaaaa

SEQ ID NO: 4102137 - RNA, 18 nt, Streptococcus pneumoniae R6
ucaaagcgggauuuaaaa

SEQ ID NO: 4102138 - RNA, 19 nt, Streptococcus pneumoniae R6
ucaaagcgggauuuaaaau

SEQ ID NO: 4102139 - RNA, 15 nt, Streptococcus pneumoniae R6
ucaaagcuacuuuuu

SEQ ID NO: 4102140 - RNA, 19 nt, Streptococcus pneumoniae R6
ucaaagcuacuuuuuuacc

SEQ ID NO: 4102141 - RNA, 16 nt, Streptococcus pneumoniae R6
ucaaagcugugcuuug

SEQ ID NO: 4102142 - RNA, 22 nt, Streptococcus pneumoniae R6
ucaaaggagauaguaucccauu

SEQ ID NO: 4102143 - RNA, 16 nt, Streptococcus pneumoniae R6
ucaaaggcuuuuucuu

SEQ ID NO: 4102144 - RNA, 20 nt, Streptococcus pneumoniae R6
ucaaaggcuuuuucuucuuc

SEQ ID NO: 4102145 - RNA, 24 nt, Streptococcus pneumoniae R6
ucaaaggcuuuuucuucuucguca

SEQ ID NO: 4102146 - RNA, 18 nt, Streptococcus pneumoniae R6
ucaaagggcaaaucuuug

SEQ ID NO: 4102147 - RNA, 19 nt, Streptococcus pneumoniae R6
ucaaaguacagauuugaaa

SEQ ID NO: 4102148 - RNA, 17 nt, Streptococcus pneumoniae R6
ucaaaguacugccuuga

SEQ ID NO: 4102149 - RNA, 16 nt, Streptococcus pneumoniae R6
ucaaaguacugcuuug

SEQ ID NO: 4102150 - RNA, 18 nt, Streptococcus pneumoniae R6
ucaaaguagugaaugauu

SEQ ID NO: 4102151 - RNA, 22 nt, Streptococcus pneumoniae R6
ucaaaguuuccgaauaccugaa

SEQ ID NO: 4102152 - RNA, 13 nt, Streptococcus pneumoniae R6
ucaaaucaaaaua

SEQ ID NO: 4102153 - RNA, 22 nt, Streptococcus pneumoniae R6
ucaaaucagcucucugauuuuc

SEQ ID NO: 4102154 - RNA, 19 nt, Streptococcus pneumoniae R6
ucaaaucauuucuuuggca

SEQ ID NO: 4102155 - RNA, 16 nt, Streptococcus pneumoniae R6
ucaaauccauaguaaa

SEQ ID NO: 4102156 - RNA, 19 nt, Streptococcus pneumoniae R6
ucaaaucccauguaguuca

SEQ ID NO: 4102157 - RNA, 20 nt, Streptococcus pneumoniae R6
ucaaaucccaugucuuuuaa

SEQ ID NO: 4102158 - RNA, 23 nt, Streptococcus pneumoniae R6
ucaaaucccaugucuuuuaaaua

SEQ ID NO: 4102159 - RNA, 18 nt, Streptococcus pneumoniae R6
ucaaaucccuagcucaug

SEQ ID NO: 4102160 - RNA, 15 nt, Streptococcus pneumoniae R6
ucaaaucgaucuguu

SEQ ID NO: 4102161 - RNA, 17 nt, Streptococcus pneumoniae R6
ucaaaucgauuucuaac

SEQ ID NO: 4102162 - RNA, 22 nt, Streptococcus pneumoniae R6
ucaaaucgauuucuaacaaugu

SEQ ID NO: 4102163 - RNA, 15 nt, Streptococcus pneumoniae R6
ucaaaugaaauauuu

SEQ ID NO: 4102164 - RNA, 16 nt, Streptococcus pneumoniae R6
ucaaaugaaauauuuu

SEQ ID NO: 4102165 - RNA, 22 nt, Streptococcus pneumoniae R6
ucaaaugaaauauuuuuuacuu

SEQ ID NO: 4102166 - RNA, 23 nt, Streptococcus pneumoniae R6
ucaaaugaaauauuuuuuacuuu

SEQ ID NO: 4102167 - RNA, 23 nt, Streptococcus pneumoniae R6
ucaaaugagauuugcaucaaucu

SEQ ID NO: 4102168 - RNA, 19 nt, Streptococcus pneumoniae R6
ucaaauguauuugaaaggg

SEQ ID NO: 4102169 - RNA, 20 nt, Streptococcus pneumoniae R6
ucaaauuaauuuauagaaaa

SEQ ID NO: 4102170 - RNA, 21 nt, Streptococcus pneumoniae R6
ucaaauuaauuuauagaaaaa

SEQ ID NO: 4102171 - RNA, 21 nt, Streptococcus pneumoniae R6
ucaaauuauuggucgcuucaa

SEQ ID NO: 4102172 - RNA, 14 nt, Streptococcus pneumoniae R6
ucaaauucauucgu

SEQ ID NO: 4102173 - RNA, 17 nt, Streptococcus pneumoniae R6
ucaaauucauucguaau

SEQ ID NO: 4102174 - RNA, 14 nt, Streptococcus pneumoniae R6
ucaaauucuuuaga

SEQ ID NO: 4102175 - RNA, 15 nt, Streptococcus pneumoniae R6
ucaaauucuuuagaa

SEQ ID NO: 4102176 - RNA, 16 nt, Streptococcus pneumoniae R6
ucaaauucuuuagaaa

SEQ ID NO: 4102177 - RNA, 22 nt, Streptococcus pneumoniae R6
ucaaauugaaaauucacaaaau

SEQ ID NO: 4102178 - RNA, 14 nt, Streptococcus pneumoniae R6
ucaaauugaaauaa

SEQ ID NO: 4102179 - RNA, 16 nt, Streptococcus pneumoniae R6
ucaaauugaaauaaga

SEQ ID NO: 4102180 - RNA, 16 nt, Streptococcus pneumoniae R6
ucaaauugcuuaaaau

SEQ ID NO: 4102181 - RNA, 15 nt, Streptococcus pneumoniae R6
ucaaauuguuuacga

SEQ ID NO: 4102182 - RNA, 16 nt, Streptococcus pneumoniae R6
ucaaauuuaccaaugc

SEQ ID NO: 4102183 - RNA, 20 nt, Streptococcus pneumoniae R6
ucaaauuuagcuguaucauu

SEQ ID NO: 4102184 - RNA, 15 nt, Streptococcus pneumoniae R6
ucaaauuuauucaga

SEQ ID NO: 4102185 - RNA, 14 nt, Streptococcus pneumoniae R6
ucaaauuugacuaa

SEQ ID NO: 4102186 - RNA, 23 nt, Streptococcus pneumoniae R6
ucaacaaaaucgggagauugagu

SEQ ID NO: 4102187 - RNA, 17 nt, Streptococcus pneumoniae R6
ucaacaaaccuuguucu

SEQ ID NO: 4102188 - RNA, 19 nt, Streptococcus pneumoniae R6
ucaacaaaucagaaaagua

SEQ ID NO: 4102189 - RNA, 16 nt, Streptococcus pneumoniae R6
ucaacaccgacuuggu

SEQ ID NO: 4102190 - RNA, 20 nt, Streptococcus pneumoniae R6
ucaacagcuccauaacaaua

SEQ ID NO: 4102191 - RNA, 16 nt, Streptococcus pneumoniae R6
ucaacagcuccuucaa

SEQ ID NO: 4102192 - RNA, 21 nt, Streptococcus pneumoniae R6
ucaacaugagaauacaaaaau

SEQ ID NO: 4102193 - RNA, 22 nt, Streptococcus pneumoniae R6
ucaacccacuacaguugacaaa

SEQ ID NO: 4102194 - RNA, 18 nt, Streptococcus pneumoniae R6
ucaaccugaaucuccuca

SEQ ID NO: 4102195 - RNA, 17 nt, Streptococcus pneumoniae R6
ucaauuccuucuggaac

SEQ ID NO: 4102196 - RNA, 19 nt, Streptococcus pneumoniae R6
ucaauucuuuaacaaaauc

SEQ ID NO: 4102197 - RNA, 16 nt, Streptococcus pneumoniae R6
ucaauugcaggagaaa

SEQ ID NO: 4102198 - RNA, 12 nt, Streptococcus pneumoniae R6
ucaauugcuagc

SEQ ID NO: 4102199 - RNA, 18 nt, Streptococcus pneumoniae R6
ucaauuuacuauacuuac

SEQ ID NO: 4102200 - RNA, 23 nt, Streptococcus pneumoniae R6
ucaauuucagaagaaaaaaagua

SEQ ID NO: 4102201 - RNA, 12 nt, Streptococcus pneumoniae R6
ucaauuucuaau

SEQ ID NO: 4102202 - RNA, 20 nt, Streptococcus pneumoniae R6
ucaauuucuauuuuaaaaau

SEQ ID NO: 4102203 - RNA, 20 nt, Streptococcus pneumoniae R6
ucaauuuuauacucaucugu

SEQ ID NO: 4102204 - RNA, 15 nt, Streptococcus pneumoniae R6
ucaauuuuccuuucc

SEQ ID NO: 4102205 - RNA, 12 nt, Streptococcus pneumoniae R6
ucacaaaauccu

SEQ ID NO: 4102206 - RNA, 17 nt, Streptococcus pneumoniae R6
ucacaaagaacaugaaa

SEQ ID NO: 4102207 - RNA, 20 nt, Streptococcus pneumoniae R6
ucacaaagaacaugaaagau

SEQ ID NO: 4102208 - RNA, 18 nt, Streptococcus pneumoniae R6
ucacaaagaguucccugc

SEQ ID NO: 4102209 - RNA, 12 nt, Streptococcus pneumoniae R6
ucacaaaugaga

SEQ ID NO: 4102210 - RNA, 15 nt, Streptococcus pneumoniae R6
ucacaaauucuggca

SEQ ID NO: 4102211 - RNA, 16 nt, Streptococcus pneumoniae R6
ucacaaauucuggcau

SEQ ID NO: 4102212 - RNA, 17 nt, Streptococcus pneumoniae R6
ucacaaauucuggcauu

SEQ ID NO: 4102213 - RNA, 18 nt, Streptococcus pneumoniae R6
ucacaacucuuauacuuu

SEQ ID NO: 4102214 - RNA, 23 nt, Streptococcus pneumoniae R6
ucacaacucuuauacuuuucucu

SEQ ID NO: 4102215 - RNA, 24 nt, Streptococcus pneumoniae R6
ucacaacucuuauacuuuucucuu

SEQ ID NO: 4102216 - RNA, 20 nt, Streptococcus pneumoniae R6
ucacaacugaacgacugguu

SEQ ID NO: 4102217 - RNA, 10 nt, Streptococcus pneumoniae R6
ucacacaaaa

SEQ ID NO: 4102218 - RNA, 17 nt, Streptococcus pneumoniae R6
ucacacaaaaaagaggc

SEQ ID NO: 4102219 - RNA, 19 nt, Streptococcus pneumoniae R6
ucacacaaaaaagaggcuc

SEQ ID NO: 4102220 - RNA, 14 nt, Streptococcus pneumoniae R6
ucacacggaaacag

SEQ ID NO: 4102221 - RNA, 19 nt, Streptococcus pneumoniae R6
ucacagaaccaucuucauu

SEQ ID NO: 4102222 - RNA, 20 nt, Streptococcus pneumoniae R6
ucacaguuaaauuauaaauu

SEQ ID NO: 4102223 - RNA, 13 nt, Streptococcus pneumoniae R6
ucacauauauaau

SEQ ID NO: 4102224 - RNA, 16 nt, Streptococcus pneumoniae R6
ucacauccucuacaua

SEQ ID NO: 4102225 - RNA, 12 nt, Streptococcus pneumoniae R6
ucacaucugcua

SEQ ID NO: 4102226 - RNA, 18 nt, Streptococcus pneumoniae R6
ucacaucuguguagcacu

SEQ ID NO: 4102227 - RNA, 20 nt, Streptococcus pneumoniae R6
ucacaucuucagacacacca

SEQ ID NO: 4102228 - RNA, 22 nt, Streptococcus pneumoniae R6
ucacauugccgacucaaguaca

SEQ ID NO: 4102229 - RNA, 14 nt, Streptococcus pneumoniae R6
ucacauuggcaaga

SEQ ID NO: 4102230 - RNA, 13 nt, Streptococcus pneumoniae R6
ucacauuuucaau

SEQ ID NO: 4102231 - RNA, 15 nt, Streptococcus pneumoniae R6
ucaccaaauuucaua

SEQ ID NO: 4102232 - RNA, 16 nt, Streptococcus pneumoniae R6
ucaccaauuuuaccuu

SEQ ID NO: 4102233 - RNA, 19 nt, Streptococcus pneumoniae R6
ucaccacaugacauuauuu

SEQ ID NO: 4102234 - RNA, 23 nt, Streptococcus pneumoniae R6
ucaccaguaaaguguucugucuu

SEQ ID NO: 4102235 - RNA, 23 nt, Streptococcus pneumoniae R6
ucaccaucuaagguauauucaaa

SEQ ID NO: 4102236 - RNA, 16 nt, Streptococcus pneumoniae R6
ucaccauuauaguuua

SEQ ID NO: 4102237 - RNA, 14 nt, Streptococcus pneumoniae R6
ucaccgauugccau

SEQ ID NO: 4102238 - RNA, 14 nt, Streptococcus pneumoniae R6
ucaccgccugcuca

SEQ ID NO: 4102239 - RNA, 18 nt, Streptococcus pneumoniae R6
ucaccuaguccaagacgu

SEQ ID NO: 4102240 - RNA, 14 nt, Streptococcus pneumoniae R6
ucaccuauucuaag

SEQ ID NO: 4102241 - RNA, 21 nt, Streptococcus pneumoniae R6
ucaccuauucuaaguccauca

SEQ ID NO: 4102242 - RNA, 14 nt, Streptococcus pneumoniae R6
ucaccugcuuuuaa

SEQ ID NO: 4102243 - RNA, 18 nt, Streptococcus pneumoniae R6
ucaccuugccaucugcuu

SEQ ID NO: 4102244 - RNA, 15 nt, Streptococcus pneumoniae R6
ucacgaaaauauuug

SEQ ID NO: 4102245 - RNA, 15 nt, Streptococcus pneumoniae R6
ucacgaaccacacuu

SEQ ID NO: 4102246 - RNA, 23 nt, Streptococcus pneumoniae R6
ucacgaagauacugaaucaaaaa

SEQ ID NO: 4102247 - RNA, 16 nt, Streptococcus pneumoniae R6
ucacgaccaaugagaa

SEQ ID NO: 4102248 - RNA, 19 nt, Streptococcus pneumoniae R6
ucacgaggaggagaaaaag

SEQ ID NO: 4102249 - RNA, 22 nt, Streptococcus pneumoniae R6
ucacgcuaaguagaaaguuaau

SEQ ID NO: 4102250 - RNA, 13 nt, Streptococcus pneumoniae R6
ucacgcuuuucuu

SEQ ID NO: 4102251 - RNA, 22 nt, Streptococcus pneumoniae R6
ucacgguuuguauugaacccgc

SEQ ID NO: 4102252 - RNA, 17 nt, Streptococcus pneumoniae R6
ucacguucgguauuuuc

SEQ ID NO: 4102253 - RNA, 21 nt, Streptococcus pneumoniae R6
ucacuaaauccaccuaauuau

SEQ ID NO: 4102254 - RNA, 21 nt, Streptococcus pneumoniae R6
ucacuaauucaccuaaccaaa

SEQ ID NO: 4102255 - RNA, 21 nt, Streptococcus pneumoniae R6
ucacuacuuugacccugacuc

SEQ ID NO: 4102256 - RNA, 21 nt, Streptococcus pneumoniae R6
ucacuaguauucaucuuauca

SEQ ID NO: 4102257 - RNA, 17 nt, Streptococcus pneumoniae R6
ucacuauaguccaaacg

SEQ ID NO: 4102258 - RNA, 14 nt, Streptococcus pneumoniae R6
ucacuauucaucag

SEQ ID NO: 4102259 - RNA, 15 nt, Streptococcus pneumoniae R6
ucacucaucugcuua

SEQ ID NO: 4102260 - RNA, 18 nt, Streptococcus pneumoniae R6
ucacucaucugcuuagaa

SEQ ID NO: 4102261 - RNA, 15 nt, Streptococcus pneumoniae R6
ucacugaacuauuuu

SEQ ID NO: 4102262 - RNA, 17 nt, Streptococcus pneumoniae R6
ucacugagaucuucuuc

SEQ ID NO: 4102263 - RNA, 16 nt, Streptococcus pneumoniae R6
ucacugaugaaacuaa

SEQ ID NO: 4102264 - RNA, 23 nt, Streptococcus pneumoniae R6
ucacuggaaacauugauaauagg

SEQ ID NO: 4102265 - RNA, 14 nt, Streptococcus pneumoniae R6
ucacuggucacauu

SEQ ID NO: 4102266 - RNA, 23 nt, Streptococcus pneumoniae R6
ucacuguauuggucguauuuuug

SEQ ID NO: 4102267 - RNA, 14 nt, Streptococcus pneumoniae R6
ucacuugaccuguu

SEQ ID NO: 4102268 - RNA, 13 nt, Streptococcus pneumoniae R6
ucacuuggaaaaa

SEQ ID NO: 4102269 - RNA, 14 nt, Streptococcus pneumoniae R6
ucacuuggaaaaau

SEQ ID NO: 4102270 - RNA, 19 nt, Streptococcus pneumoniae R6
ucacuuuauaguuuucacu

SEQ ID NO: 4102271 - RNA, 16 nt, Streptococcus pneumoniae R6
ucacuuuauuuuuucu

SEQ ID NO: 4102272 - RNA, 16 nt, Streptococcus pneumoniae R6
ucacuuuuuguuuaau

SEQ ID NO: 4102273 - RNA, 17 nt, Streptococcus pneumoniae R6
ucacuuuuuguuuaaua

SEQ ID NO: 4102274 - RNA, 20 nt, Streptococcus pneumoniae R6
ucacuuuuuguuuaauacuc

SEQ ID NO: 4102275 - RNA, 12 nt, Streptococcus pneumoniae R6
ucagaaaaaagg

SEQ ID NO: 4102276 - RNA, 19 nt, Streptococcus pneumoniae R6
ucagaaaaacgcauaaaau

SEQ ID NO: 4102277 - RNA, 14 nt, Streptococcus pneumoniae R6
ucagaaaaguaacu

SEQ ID NO: 4102278 - RNA, 23 nt, Streptococcus pneumoniae R6
ucagaaaaguaacuauuuuugau

SEQ ID NO: 4102279 - RNA, 16 nt, Streptococcus pneumoniae R6
ucagaaacaagaaauc

SEQ ID NO: 4102280 - RNA, 17 nt, Streptococcus pneumoniae R6
ucagaacacuuccaaua

SEQ ID NO: 4102281 - RNA, 20 nt, Streptococcus pneumoniae R6
ucagaacuaagggaaccuga

SEQ ID NO: 4102282 - RNA, 16 nt, Streptococcus pneumoniae R6
ucagaauccuuauuuu

SEQ ID NO: 4102283 - RNA, 14 nt, Streptococcus pneumoniae R6
ucagacacaccacu

SEQ ID NO: 4102284 - RNA, 13 nt, Streptococcus pneumoniae R6
ucagacuauauau

SEQ ID NO: 4102285 - RNA, 23 nt, Streptococcus pneumoniae R6
ucagagacagcuuguugcuuuuc

SEQ ID NO: 4102286 - RNA, 16 nt, Streptococcus pneumoniae R6
ucagagcgauaaaaau

SEQ ID NO: 4102287 - RNA, 17 nt, Streptococcus pneumoniae R6
ucagagcgauaaaaauc

SEQ ID NO: 4102288 - RNA, 14 nt, Streptococcus pneumoniae R6
ucagaguagucuuu

SEQ ID NO: 4102289 - RNA, 20 nt, Streptococcus pneumoniae R6
ucagauaaacaaugguucca

SEQ ID NO: 4102290 - RNA, 16 nt, Streptococcus pneumoniae R6
ucagauagguuuuucg

SEQ ID NO: 4102291 - RNA, 22 nt, Streptococcus pneumoniae R6
ucagaugacuggaaacuuuuuu

SEQ ID NO: 4102292 - RNA, 17 nt, Streptococcus pneumoniae R6
ucagauucaucauuuau

SEQ ID NO: 4102293 - RNA, 13 nt, Streptococcus pneumoniae R6
ucagauucugaca

SEQ ID NO: 4102294 - RNA, 15 nt, Streptococcus pneumoniae R6
ucagauucugacaau

SEQ ID NO: 4102295 - RNA, 17 nt, Streptococcus pneumoniae R6
ucagauuuuaaagacuu

SEQ ID NO: 4102296 - RNA, 16 nt, Streptococcus pneumoniae R6
ucagcaggagcaguug

SEQ ID NO: 4102297 - RNA, 21 nt, Streptococcus pneumoniae R6
ucagcaguaaucacugcagca

SEQ ID NO: 4102298 - RNA, 19 nt, Streptococcus pneumoniae R6
ucauccaccuugcaaaaaa

SEQ ID NO: 4102299 - RNA, 13 nt, Streptococcus pneumoniae R6
ucauccacuggau

SEQ ID NO: 4102300 - RNA, 14 nt, Streptococcus pneumoniae R6
ucauccagcaggag

SEQ ID NO: 4102301 - RNA, 22 nt, Streptococcus pneumoniae R6
ucauccagcaggagaaaguuug

SEQ ID NO: 4102302 - RNA, 19 nt, Streptococcus pneumoniae R6
ucauccaugauaaugguau

SEQ ID NO: 4102303 - RNA, 22 nt, Streptococcus pneumoniae R6
ucauccauucuuuuuuaauucu

SEQ ID NO: 4102304 - RNA, 23 nt, Streptococcus pneumoniae R6
ucauccauucuuuuuuaauucuu

SEQ ID NO: 4102305 - RNA, 19 nt, Streptococcus pneumoniae R6
ucaucccgcccaucaugcu

SEQ ID NO: 4102306 - RNA, 13 nt, Streptococcus pneumoniae R6
ucauccuuugcau

SEQ ID NO: 4102307 - RNA, 22 nt, Streptococcus pneumoniae R6
ucaucgacuuguuuuuugaugu

SEQ ID NO: 4102308 - RNA, 14 nt, Streptococcus pneumoniae R6
ucaucgcuaucaau

SEQ ID NO: 4102309 - RNA, 21 nt, Streptococcus pneumoniae R6
ucaucgcuuggaaguuuuccu

SEQ ID NO: 4102310 - RNA, 14 nt, Streptococcus pneumoniae R6
ucaucuaaggucaa

SEQ ID NO: 4102311 - RNA, 15 nt, Streptococcus pneumoniae R6
ucaucuauaaucaau

SEQ ID NO: 4102312 - RNA, 23 nt, Streptococcus pneumoniae R6
ucaucuaucuauuuuuaauagac

SEQ ID NO: 4102313 - RNA, 14 nt, Streptococcus pneumoniae R6
ucaucuauuuuuac

SEQ ID NO: 4102314 - RNA, 22 nt, Streptococcus pneumoniae R6
ucaucuauuuuuacucaaggac

SEQ ID NO: 4102315 - RNA, 22 nt, Streptococcus pneumoniae R6
ucaucucaccgaccaauucuuc

SEQ ID NO: 4102316 - RNA, 17 nt, Streptococcus pneumoniae R6
ucaucugaaugacaaau

SEQ ID NO: 4102317 - RNA, 15 nt, Streptococcus pneumoniae R6
ucaucugcaauaaca

SEQ ID NO: 4102318 - RNA, 21 nt, Streptococcus pneumoniae R6
ucaucugcaauaacaaagucu

SEQ ID NO: 4102319 - RNA, 15 nt, Streptococcus pneumoniae R6
ucaucugcaucaaga

SEQ ID NO: 4102320 - RNA, 14 nt, Streptococcus pneumoniae R6
ucaucugcuuucaa

SEQ ID NO: 4102321 - RNA, 18 nt, Streptococcus pneumoniae R6
ucaucugcuuucaaaaag

SEQ ID NO: 4102322 - RNA, 16 nt, Streptococcus pneumoniae R6
ucaucuggaguagcau

SEQ ID NO: 4102323 - RNA, 22 nt, Streptococcus pneumoniae R6
ucaucuggaguagcauccccag

SEQ ID NO: 4102324 - RNA, 23 nt, Streptococcus pneumoniae R6
ucaucuggaguagcauccccagu

SEQ ID NO: 4102325 - RNA, 22 nt, Streptococcus pneumoniae R6
ucaucuggauuuucagccucua

SEQ ID NO: 4102326 - RNA, 19 nt, Streptococcus pneumoniae R6
ucaucuggcuuucuguaau

SEQ ID NO: 4102327 - RNA, 14 nt, Streptococcus pneumoniae R6
ucaucuguuuucaa

SEQ ID NO: 4102328 - RNA, 17 nt, Streptococcus pneumoniae R6
ucaucuuaucaacgcua

SEQ ID NO: 4102329 - RNA, 22 nt, Streptococcus pneumoniae R6
ucaucuuccaagaccuguaaau

SEQ ID NO: 4102330 - RNA, 20 nt, Streptococcus pneumoniae R6
ucaucuugcuaaaaaaaggg

SEQ ID NO: 4102331 - RNA, 17 nt, Streptococcus pneumoniae R6
ucaucuuugauuucuug

SEQ ID NO: 4102332 - RNA, 17 nt, Streptococcus pneumoniae R6
ucaugaaaccaccgaca

SEQ ID NO: 4102333 - RNA, 18 nt, Streptococcus pneumoniae R6
ucaugaaaggauuucucu

SEQ ID NO: 4102334 - RNA, 18 nt, Streptococcus pneumoniae R6
ucaugaaauuauuucaca

SEQ ID NO: 4102335 - RNA, 20 nt, Streptococcus pneumoniae R6
ucaugaaguggggcaccauu

SEQ ID NO: 4102336 - RNA, 19 nt, Streptococcus pneumoniae R6
ucaugacaaucaagaccca

SEQ ID NO: 4102337 - RNA, 14 nt, Streptococcus pneumoniae R6
ucaugaccccuaaa

SEQ ID NO: 4102338 - RNA, 19 nt, Streptococcus pneumoniae R6
ucaugaccccuaaauauaa

SEQ ID NO: 4102339 - RNA, 16 nt, Streptococcus pneumoniae R6
ucaugacuagugaagc

SEQ ID NO: 4102340 - RNA, 18 nt, Streptococcus pneumoniae R6
ucaugacugagagcuaca

SEQ ID NO: 4102341 - RNA, 14 nt, Streptococcus pneumoniae R6
ucaugaugauagac

SEQ ID NO: 4102342 - RNA, 22 nt, Streptococcus pneumoniae R6
ucaugcaaaaaaaaugaaaaaa

SEQ ID NO: 4102343 - RNA, 16 nt, Streptococcus pneumoniae R6
ucaugcaggaaguuca

SEQ ID NO: 4102344 - RNA, 15 nt, Streptococcus pneumoniae R6
ucaugcgaaucaauu

SEQ ID NO: 4102345 - RNA, 18 nt, Streptococcus pneumoniae R6
ucaugcuuggauccauug

SEQ ID NO: 4102346 - RNA, 15 nt, Streptococcus pneumoniae R6
ucauggcaaauucac

SEQ ID NO: 4102347 - RNA, 16 nt, Streptococcus pneumoniae R6
ucauggcaaauucacc

SEQ ID NO: 4102348 - RNA, 19 nt, Streptococcus pneumoniae R6
ucauggcaaauucaccaau

SEQ ID NO: 4102349 - RNA, 13 nt, Streptococcus pneumoniae R6
ucauggcauggaa

SEQ ID NO: 4102350 - RNA, 20 nt, Streptococcus pneumoniae R6
ucauggccacgguuagaagc

SEQ ID NO: 4102351 - RNA, 21 nt, Streptococcus pneumoniae R6
ucauggcgaucacguccaauu

SEQ ID NO: 4102352 - RNA, 17 nt, Streptococcus pneumoniae R6
ucaugggcuucuguaau

SEQ ID NO: 4102353 - RNA, 23 nt, Streptococcus pneumoniae R6
ucaugggguguuuuucuauuuaa

SEQ ID NO: 4102354 - RNA, 14 nt, Streptococcus pneumoniae R6
ucauguaaaucauu

SEQ ID NO: 4102355 - RNA, 20 nt, Streptococcus pneumoniae R6
ucauguaagaguucuuccca

SEQ ID NO: 4102356 - RNA, 22 nt, Streptococcus pneumoniae R6
ucauguagcgcuugaaacucau

SEQ ID NO: 4102357 - RNA, 21 nt, Streptococcus pneumoniae R6
ucauguaguuggaacaaguca

SEQ ID NO: 4102358 - RNA, 18 nt, Streptococcus pneumoniae R6
ucaugucauguuagaaaa

SEQ ID NO: 4102359 - RNA, 15 nt, Streptococcus pneumoniae R6
ucauguuagaaaaau

SEQ ID NO: 4102360 - RNA, 18 nt, Streptococcus pneumoniae R6
ucauguuucggaucauau

SEQ ID NO: 4102361 - RNA, 13 nt, Streptococcus pneumoniae R6
ucauguuuuuaag

SEQ ID NO: 4102362 - RNA, 18 nt, Streptococcus pneumoniae R6
ucauuaaagaccaaagaa

SEQ ID NO: 4102363 - RNA, 17 nt, Streptococcus pneumoniae R6
ucauuaagucaacaucu

SEQ ID NO: 4102364 - RNA, 14 nt, Streptococcus pneumoniae R6
ucauuaauaaaguu

SEQ ID NO: 4102365 - RNA, 19 nt, Streptococcus pneumoniae R6
ucauuacacaaauuuucuu

SEQ ID NO: 4102366 - RNA, 20 nt, Streptococcus pneumoniae R6
ucauuacagaacauuuuaau

SEQ ID NO: 4102367 - RNA, 15 nt, Streptococcus pneumoniae R6
ucauuacuaucaaaa

SEQ ID NO: 4102368 - RNA, 17 nt, Streptococcus pneumoniae R6
ucauuacucaaguccuu

SEQ ID NO: 4102369 - RNA, 18 nt, Streptococcus pneumoniae R6
ucauuagauauagaauuu

SEQ ID NO: 4102370 - RNA, 21 nt, Streptococcus pneumoniae R6
ucauuauagaaggcaauuaaa

SEQ ID NO: 4102371 - RNA, 14 nt, Streptococcus pneumoniae R6
ucauuauauuucuc

SEQ ID NO: 4102372 - RNA, 20 nt, Streptococcus pneumoniae R6
ucauuauuuaacuaaaucuu

SEQ ID NO: 4102373 - RNA, 19 nt, Streptococcus pneumoniae R6
ucauucaauccaucuccaa

SEQ ID NO: 4102374 - RNA, 15 nt, Streptococcus pneumoniae R6
ucauucacuacuuug

SEQ ID NO: 4102375 - RNA, 16 nt, Streptococcus pneumoniae R6
ucauuccaaucaucau

SEQ ID NO: 4102376 - RNA, 16 nt, Streptococcus pneumoniae R6
ucauucccuguaauca

SEQ ID NO: 4102377 - RNA, 16 nt, Streptococcus pneumoniae R6
ucauucgaaugauuuc

SEQ ID NO: 4102378 - RNA, 19 nt, Streptococcus pneumoniae R6
ucauucgaaugauuucucu

SEQ ID NO: 4102379 - RNA, 21 nt, Streptococcus pneumoniae R6
ucauucgacuaauuuggaaau

SEQ ID NO: 4102380 - RNA, 21 nt, Streptococcus pneumoniae R6
ucauucgcaaaggcgcgaucu

SEQ ID NO: 4102381 - RNA, 14 nt, Streptococcus pneumoniae R6
ucauucuacuauau

SEQ ID NO: 4102382 - RNA, 17 nt, Streptococcus pneumoniae R6
ucauucugaacuaaaaa

SEQ ID NO: 4102383 - RNA, 18 nt, Streptococcus pneumoniae R6
ucauucugaacuaaaaaa

SEQ ID NO: 4102384 - RNA, 16 nt, Streptococcus pneumoniae R6
ucauucuuauuuggca

SEQ ID NO: 4102385 - RNA, 12 nt, Streptococcus pneumoniae R6
ucauucuucaca

SEQ ID NO: 4102386 - RNA, 18 nt, Streptococcus pneumoniae R6
ucauugaaaaaauaucuu

SEQ ID NO: 4102387 - RNA, 22 nt, Streptococcus pneumoniae R6
ucauugacagaaccuuggaaau

SEQ ID NO: 4102388 - RNA, 17 nt, Streptococcus pneumoniae R6
ucauugaguaugaaaua

SEQ ID NO: 4102389 - RNA, 18 nt, Streptococcus pneumoniae R6
ucauugaguuuuaaucuc

SEQ ID NO: 4102390 - RNA, 15 nt, Streptococcus pneumoniae R6
ucauugauauaaaga

SEQ ID NO: 4102391 - RNA, 18 nt, Streptococcus pneumoniae R6
ucauugcaaaggagagga

SEQ ID NO: 4102392 - RNA, 17 nt, Streptococcus pneumoniae R6
ucauuggaguuguaauc

SEQ ID NO: 4102393 - RNA, 17 nt, Streptococcus pneumoniae R6
ucauuggauacaaggag

SEQ ID NO: 4102394 - RNA, 16 nt, Streptococcus pneumoniae R6
ucauuuaaaaucaaaa

SEQ ID NO: 4102395 - RNA, 15 nt, Streptococcus pneumoniae R6
ucauuuaucuucuua

SEQ ID NO: 4102396 - RNA, 15 nt, Streptococcus pneumoniae R6
ucauuucaauagaaa

SEQ ID NO: 4102397 - RNA, 17 nt, Streptococcus pneumoniae R6
ucauuucaauagaaauc

SEQ ID NO: 4102398 - RNA, 21 nt, Streptococcus pneumoniae R6
ucauuucaauagaaaucacga

SEQ ID NO: 4102399 - RNA, 19 nt, Streptococcus pneumoniae R6
ucauuucacuauguuuuag

SEQ ID NO: 4102400 - RNA, 16 nt, Streptococcus pneumoniae R6
uccaguuuuaaucuua

SEQ ID NO: 4102401 - RNA, 14 nt, Streptococcus pneumoniae R6
uccaguuuuguuuu

SEQ ID NO: 4102402 - RNA, 21 nt, Streptococcus pneumoniae R6
uccauaaacgcaagcaacaaa

SEQ ID NO: 4102403 - RNA, 22 nt, Streptococcus pneumoniae R6
uccauaaacgcaagcaacaaaa

SEQ ID NO: 4102404 - RNA, 18 nt, Streptococcus pneumoniae R6
uccauaacgaguaaaaga

SEQ ID NO: 4102405 - RNA, 15 nt, Streptococcus pneumoniae R6
uccauaaugagcugu

SEQ ID NO: 4102406 - RNA, 12 nt, Streptococcus pneumoniae R6
uccauaccaaag

SEQ ID NO: 4102407 - RNA, 13 nt, Streptococcus pneumoniae R6
uccauaccauaag

SEQ ID NO: 4102408 - RNA, 13 nt, Streptococcus pneumoniae R6
uccauaccaucaa

SEQ ID NO: 4102409 - RNA, 22 nt, Streptococcus pneumoniae R6
uccauaccuaaacuuugagccu

SEQ ID NO: 4102410 - RNA, 16 nt, Streptococcus pneumoniae R6
uccauagcgucaaaga

SEQ ID NO: 4102411 - RNA, 18 nt, Streptococcus pneumoniae R6
uccauagcgucaaagaag

SEQ ID NO: 4102412 - RNA, 19 nt, Streptococcus pneumoniae R6
uccauagcgucaaagaagg

SEQ ID NO: 4102413 - RNA, 19 nt, Streptococcus pneumoniae R6
uccauaggcagcuuguucu

SEQ ID NO: 4102414 - RNA, 17 nt, Streptococcus pneumoniae R6
uccauaguaaacuucuu

SEQ ID NO: 4102415 - RNA, 18 nt, Streptococcus pneumoniae R6
uccauaguaaacuucuuc

SEQ ID NO: 4102416 - RNA, 21 nt, Streptococcus pneumoniae R6
uccauaguaaacuucuucuuc

SEQ ID NO: 4102417 - RNA, 18 nt, Streptococcus pneumoniae R6
uccauauaaaucuccaga

SEQ ID NO: 4102418 - RNA, 19 nt, Streptococcus pneumoniae R6
uccauaucugcuuccagau

SEQ ID NO: 4102419 - RNA, 19 nt, Streptococcus pneumoniae R6
uccauaugauucuuucuaa

SEQ ID NO: 4102420 - RNA, 19 nt, Streptococcus pneumoniae R6
uccauauuagggcaaauaa

SEQ ID NO: 4102421 - RNA, 14 nt, Streptococcus pneumoniae R6
uccaucauaaaaau

SEQ ID NO: 4102422 - RNA, 15 nt, Streptococcus pneumoniae R6
uccaucguuccuguc

SEQ ID NO: 4102423 - RNA, 17 nt, Streptococcus pneumoniae R6
uccaucuacaaccuuaa

SEQ ID NO: 4102424 - RNA, 15 nt, Streptococcus pneumoniae R6
uccaucuccaacugc

SEQ ID NO: 4102425 - RNA, 19 nt, Streptococcus pneumoniae R6
uccaucuccgauuaacgau

SEQ ID NO: 4102426 - RNA, 13 nt, Streptococcus pneumoniae R6
uccaucugcagcc

SEQ ID NO: 4102427 - RNA, 16 nt, Streptococcus pneumoniae R6
uccaucuguaauauga

SEQ ID NO: 4102428 - RNA, 18 nt, Streptococcus pneumoniae R6
uccaucuucucacguccu

SEQ ID NO: 4102429 - RNA, 22 nt, Streptococcus pneumoniae R6
uccaucuuggcgaauauagaca

SEQ ID NO: 4102430 - RNA, 17 nt, Streptococcus pneumoniae R6
uccaugaccgaaugaag

SEQ ID NO: 4102431 - RNA, 22 nt, Streptococcus pneumoniae R6
uccaugauaaugguaucacauu

SEQ ID NO: 4102432 - RNA, 15 nt, Streptococcus pneumoniae R6
uccaugcucuuucau

SEQ ID NO: 4102433 - RNA, 22 nt, Streptococcus pneumoniae R6
uccaugcuugauucaaagucau

SEQ ID NO: 4102434 - RNA, 15 nt, Streptococcus pneumoniae R6
uccauggaauaccaa

SEQ ID NO: 4102435 - RNA, 17 nt, Streptococcus pneumoniae R6
uccauggaauaccaaua

SEQ ID NO: 4102436 - RNA, 17 nt, Streptococcus pneumoniae R6
uccaugguaucaaaggc

SEQ ID NO: 4102437 - RNA, 17 nt, Streptococcus pneumoniae R6
uccauguuaugauucuc

SEQ ID NO: 4102438 - RNA, 14 nt, Streptococcus pneumoniae R6
uccauuauacaucu

SEQ ID NO: 4102439 - RNA, 11 nt, Streptococcus pneumoniae R6
uccauuccucc

SEQ ID NO: 4102440 - RNA, 14 nt, Streptococcus pneumoniae R6
uccauucuugaccg

SEQ ID NO: 4102441 - RNA, 15 nt, Streptococcus pneumoniae R6
uccauucuuuuacuu

SEQ ID NO: 4102442 - RNA, 20 nt, Streptococcus pneumoniae R6
uccauuucuuugucuccaac

SEQ ID NO: 4102443 - RNA, 16 nt, Streptococcus pneumoniae R6
uccauuuguuuaaaga

SEQ ID NO: 4102444 - RNA, 16 nt, Streptococcus pneumoniae R6
uccauuuuucaaauca

SEQ ID NO: 4102445 - RNA, 17 nt, Streptococcus pneumoniae R6
uccauuuuucaaaucaa

SEQ ID NO: 4102446 - RNA, 13 nt, Streptococcus pneumoniae R6
ucccaaacaucug

SEQ ID NO: 4102447 - RNA, 16 nt, Streptococcus pneumoniae R6
ucccaagguuuugcca

SEQ ID NO: 4102448 - RNA, 15 nt, Streptococcus pneumoniae R6
ucccacaauaaaaag

SEQ ID NO: 4102449 - RNA, 14 nt, Streptococcus pneumoniae R6
ucccacaauaaaac

SEQ ID NO: 4102450 - RNA, 19 nt, Streptococcus pneumoniae R6
ucccaccaaacuuucccuu

SEQ ID NO: 4102451 - RNA, 22 nt, Streptococcus pneumoniae R6
ucccaccaaacuuucccuucgu

SEQ ID NO: 4102452 - RNA, 17 nt, Streptococcus pneumoniae R6
ucccacccauauuuuuc

SEQ ID NO: 4102453 - RNA, 20 nt, Streptococcus pneumoniae R6
ucccacccauauuuuuccuu

SEQ ID NO: 4102454 - RNA, 23 nt, Streptococcus pneumoniae R6
ucccacgacggauaacagucagu

SEQ ID NO: 4102455 - RNA, 19 nt, Streptococcus pneumoniae R6
ucccacuaucuaaaaaaau

SEQ ID NO: 4102456 - RNA, 19 nt, Streptococcus pneumoniae R6
ucccagagcuauaagccca

SEQ ID NO: 4102457 - RNA, 13 nt, Streptococcus pneumoniae R6
ucccaguuuucuu

SEQ ID NO: 4102458 - RNA, 16 nt, Streptococcus pneumoniae R6
ucccaguuuucuucgg

SEQ ID NO: 4102459 - RNA, 12 nt, Streptococcus pneumoniae R6
ucccauauuugg

SEQ ID NO: 4102460 - RNA, 11 nt, Streptococcus pneumoniae R6
ucccaucauuc

SEQ ID NO: 4102461 - RNA, 22 nt, Streptococcus pneumoniae R6
ucccaucgcgaccaagagcaaa

SEQ ID NO: 4102462 - RNA, 22 nt, Streptococcus pneumoniae R6
ucccaucugucuuuauuaauga

SEQ ID NO: 4102463 - RNA, 13 nt, Streptococcus pneumoniae R6
ucccaugcuucca

SEQ ID NO: 4102464 - RNA, 17 nt, Streptococcus pneumoniae R6
ucccaugcuuccagcuu

SEQ ID NO: 4102465 - RNA, 20 nt, Streptococcus pneumoniae R6
ucccaugucuuuuaaauauu

SEQ ID NO: 4102466 - RNA, 16 nt, Streptococcus pneumoniae R6
ucccauuuguaaacug

SEQ ID NO: 4102467 - RNA, 15 nt, Streptococcus pneumoniae R6
ucccauuuucagaaa

SEQ ID NO: 4102468 - RNA, 18 nt, Streptococcus pneumoniae R6
ucccauuuuuugcaucaa

SEQ ID NO: 4102469 - RNA, 16 nt, Streptococcus pneumoniae R6
uccccaagggaccaaa

SEQ ID NO: 4102470 - RNA, 13 nt, Streptococcus pneumoniae R6
uccccaucuucaa

SEQ ID NO: 4102471 - RNA, 21 nt, Streptococcus pneumoniae R6
uccccauuugcuucaucauuu

SEQ ID NO: 4102472 - RNA, 19 nt, Streptococcus pneumoniae R6
ucccccugauaauacuuga

SEQ ID NO: 4102473 - RNA, 15 nt, Streptococcus pneumoniae R6
uccccuauauucuuu

SEQ ID NO: 4102474 - RNA, 18 nt, Streptococcus pneumoniae R6
uccccucgcuugacugua

SEQ ID NO: 4102475 - RNA, 19 nt, Streptococcus pneumoniae R6
uccccugccaacuuaucag

SEQ ID NO: 4102476 - RNA, 21 nt, Streptococcus pneumoniae R6
ucccggagcuuucagagcugc

SEQ ID NO: 4102477 - RNA, 13 nt, Streptococcus pneumoniae R6
ucccguaucuuug

SEQ ID NO: 4102478 - RNA, 14 nt, Streptococcus pneumoniae R6
ucccgucaacaguu

SEQ ID NO: 4102479 - RNA, 17 nt, Streptococcus pneumoniae R6
ucccuacaaggaagccu

SEQ ID NO: 4102480 - RNA, 17 nt, Streptococcus pneumoniae R6
ucccuagcuuuuuccuc

SEQ ID NO: 4102481 - RNA, 15 nt, Streptococcus pneumoniae R6
ucccucagaguaaga

SEQ ID NO: 4102482 - RNA, 16 nt, Streptococcus pneumoniae R6
ucccuccuaaggagua

SEQ ID NO: 4102483 - RNA, 15 nt, Streptococcus pneumoniae R6
ucccugcauuucuuu

SEQ ID NO: 4102484 - RNA, 19 nt, Streptococcus pneumoniae R6
ucccugcauuucuuuuauc

SEQ ID NO: 4102485 - RNA, 20 nt, Streptococcus pneumoniae R6
ucccugccucauaucugucu

SEQ ID NO: 4102486 - RNA, 18 nt, Streptococcus pneumoniae R6
ucccugguaaaagagcaa

SEQ ID NO: 4102487 - RNA, 19 nt, Streptococcus pneumoniae R6
ucccugguaaaagagcaag

SEQ ID NO: 4102488 - RNA, 24 nt, Streptococcus pneumoniae R6
ucccuguagggggcauauaaauac

SEQ ID NO: 4102489 - RNA, 15 nt, Streptococcus pneumoniae R6
ucccuucaauggagu

SEQ ID NO: 4102490 - RNA, 22 nt, Streptococcus pneumoniae R6
ucccuucuuucucaaacauugu

SEQ ID NO: 4102491 - RNA, 10 nt, Streptococcus pneumoniae R6
ucccuuguuu

SEQ ID NO: 4102492 - RNA, 22 nt, Streptococcus pneumoniae R6
ucccuuuugcucggcauuguga

SEQ ID NO: 4102493 - RNA, 18 nt, Streptococcus pneumoniae R6
ucccuuuuugauuuuaaa

SEQ ID NO: 4102494 - RNA, 16 nt, Streptococcus pneumoniae R6
uccgaacccuguuuua

SEQ ID NO: 4102495 - RNA, 13 nt, Streptococcus pneumoniae R6
uccgaacuugugg

SEQ ID NO: 4102496 - RNA, 19 nt, Streptococcus pneumoniae R6
uccgaagacuuuaaaaauu

SEQ ID NO: 4102497 - RNA, 16 nt, Streptococcus pneumoniae R6
uccgaagggcuauuuu

SEQ ID NO: 4102498 - RNA, 18 nt, Streptococcus pneumoniae R6
uccgaauaacucaaaagc

SEQ ID NO: 4102499 - RNA, 16 nt, Streptococcus pneumoniae R6
uccgaauagcucaaaa

SEQ ID NO: 4102500 - RNA, 23 nt, Streptococcus pneumoniae R6
uccgagauaaaagauagcuauga

SEQ ID NO: 4102501 - RNA, 13 nt, Streptococcus pneumoniae R6
uccgagugcaaga

SEQ ID NO: 4102502 - RNA, 15 nt, Streptococcus pneumoniae R6
uccgaguguuuccuu

SEQ ID NO: 4102503 - RNA, 12 nt, Streptococcus pneumoniae R6
uccuucuucuug

SEQ ID NO: 4102504 - RNA, 19 nt, Streptococcus pneumoniae R6
uccuugaccaaguccucaa

SEQ ID NO: 4102505 - RNA, 18 nt, Streptococcus pneumoniae R6
uccuugaccaucccagua

SEQ ID NO: 4102506 - RNA, 19 nt, Streptococcus pneumoniae R6
uccuugaccuuaucaguua

SEQ ID NO: 4102507 - RNA, 20 nt, Streptococcus pneumoniae R6
uccuugaccuuaucaguuac

SEQ ID NO: 4102508 - RNA, 19 nt, Streptococcus pneumoniae R6
uccuugauaaguucuuuuu

SEQ ID NO: 4102509 - RNA, 16 nt, Streptococcus pneumoniae R6
uccuugccuucaaucu

SEQ ID NO: 4102510 - RNA, 19 nt, Streptococcus pneumoniae R6
uccuuggucgaucaauugu

SEQ ID NO: 4102511 - RNA, 14 nt, Streptococcus pneumoniae R6
uccuuguaaagacu

SEQ ID NO: 4102512 - RNA, 12 nt, Streptococcus pneumoniae R6
uccuuuaaaaac

SEQ ID NO: 4102513 - RNA, 20 nt, Streptococcus pneumoniae R6
uccuuuagugauaucuugaa

SEQ ID NO: 4102514 - RNA, 21 nt, Streptococcus pneumoniae R6
uccuuuagugauaucuugaag

SEQ ID NO: 4102515 - RNA, 14 nt, Streptococcus pneumoniae R6
uccuuuauuuucaa

SEQ ID NO: 4102516 - RNA, 13 nt, Streptococcus pneumoniae R6
uccuuucaaaaua

SEQ ID NO: 4102517 - RNA, 12 nt, Streptococcus pneumoniae R6
uccuuucuuuuu

SEQ ID NO: 4102518 - RNA, 21 nt, Streptococcus pneumoniae R6
uccuuugagguuaaucaaucg

SEQ ID NO: 4102519 - RNA, 15 nt, Streptococcus pneumoniae R6
uccuuugaguaagag

SEQ ID NO: 4102520 - RNA, 15 nt, Streptococcus pneumoniae R6
uccuuugauucagau

SEQ ID NO: 4102521 - RNA, 16 nt, Streptococcus pneumoniae R6
uccuuuguuuacuaaa

SEQ ID NO: 4102522 - RNA, 22 nt, Streptococcus pneumoniae R6
uccuuuuacaguacccauguuc

SEQ ID NO: 4102523 - RNA, 16 nt, Streptococcus pneumoniae R6
uccuuuuaguuuuacc

SEQ ID NO: 4102524 - RNA, 17 nt, Streptococcus pneumoniae R6
uccuuuuauuaucuuuc

SEQ ID NO: 4102525 - RNA, 17 nt, Streptococcus pneumoniae R6
uccuuuucuacugaaau

SEQ ID NO: 4102526 - RNA, 15 nt, Streptococcus pneumoniae R6
uccuuuucuguacuu

SEQ ID NO: 4102527 - RNA, 21 nt, Streptococcus pneumoniae R6
uccuuuuugauaacgugcuaa

SEQ ID NO: 4102528 - RNA, 15 nt, Streptococcus pneumoniae R6
uccuuuuugauaaga

SEQ ID NO: 4102529 - RNA, 13 nt, Streptococcus pneumoniae R6
uccuuuuuuacuu

SEQ ID NO: 4102530 - RNA, 13 nt, Streptococcus pneumoniae R6
uccuuuuuucuuu

SEQ ID NO: 4102531 - RNA, 14 nt, Streptococcus pneumoniae R6
uccuuuuuugacuc

SEQ ID NO: 4102532 - RNA, 19 nt, Streptococcus pneumoniae R6
uccuuuuuuugaaguuuuc

SEQ ID NO: 4102533 - RNA, 17 nt, Streptococcus pneumoniae R6
ucgaaaaccaaaggcau

SEQ ID NO: 4102534 - RNA, 23 nt, Streptococcus pneumoniae R6
ucgaaaagaauuaggaaaacaug

SEQ ID NO: 4102535 - RNA, 12 nt, Streptococcus pneumoniae R6
ucgaaaaucucu

SEQ ID NO: 4102536 - RNA, 17 nt, Streptococcus pneumoniae R6
ucgaaaaucucuucaaa

SEQ ID NO: 4102537 - RNA, 18 nt, Streptococcus pneumoniae R6
ucgaaaaucucuucaaac

SEQ ID NO: 4102538 - RNA, 22 nt, Streptococcus pneumoniae R6
ucgaagaguauaaaauuuugac

SEQ ID NO: 4102539 - RNA, 23 nt, Streptococcus pneumoniae R6
ucgaagaguauuagccuuccaua

SEQ ID NO: 4102540 - RNA, 14 nt, Streptococcus pneumoniae R6
ucgaagcuugcuuc

SEQ ID NO: 4102541 - RNA, 22 nt, Streptococcus pneumoniae R6
ucgaagguuauaccaaaaaaac

SEQ ID NO: 4102542 - RNA, 23 nt, Streptococcus pneumoniae R6
ucgaagguuauaccaaaaaaacu

SEQ ID NO: 4102543 - RNA, 15 nt, Streptococcus pneumoniae R6
ucgaaguuucaaucg

SEQ ID NO: 4102544 - RNA, 14 nt, Streptococcus pneumoniae R6
ucgaaugauauuuu

SEQ ID NO: 4102545 - RNA, 16 nt, Streptococcus pneumoniae R6
ucgaaugauuucucuu

SEQ ID NO: 4102546 - RNA, 12 nt, Streptococcus pneumoniae R6
ucgacccuggau

SEQ ID NO: 4102547 - RNA, 22 nt, Streptococcus pneumoniae R6
ucgaccuacauugacucugcug

SEQ ID NO: 4102548 - RNA, 18 nt, Streptococcus pneumoniae R6
ucgaccucuaccaagccc

SEQ ID NO: 4102549 - RNA, 17 nt, Streptococcus pneumoniae R6
ucgacugguaaagaaug

SEQ ID NO: 4102550 - RNA, 15 nt, Streptococcus pneumoniae R6
ucgacugugauuuuu

SEQ ID NO: 4102551 - RNA, 19 nt, Streptococcus pneumoniae R6
ucgagaaaggacaaauuuc

SEQ ID NO: 4102552 - RNA, 20 nt, Streptococcus pneumoniae R6
ucgagacaacgcacaccaga

SEQ ID NO: 4102553 - RNA, 16 nt, Streptococcus pneumoniae R6
ucgagcaguuccauca

SEQ ID NO: 4102554 - RNA, 17 nt, Streptococcus pneumoniae R6
ucgagcaguuccaucaa

SEQ ID NO: 4102555 - RNA, 16 nt, Streptococcus pneumoniae R6
ucgagccaauacugcu

SEQ ID NO: 4102556 - RNA, 23 nt, Streptococcus pneumoniae R6
ucgagcuuagcuuuucuucaacc

SEQ ID NO: 4102557 - RNA, 21 nt, Streptococcus pneumoniae R6
ucgagguagaaaggagcagau

SEQ ID NO: 4102558 - RNA, 21 nt, Streptococcus pneumoniae R6
ucgaguuauuaacaaaagagc

SEQ ID NO: 4102559 - RNA, 13 nt, Streptococcus pneumoniae R6
ucgauaaagaaga

SEQ ID NO: 4102560 - RNA, 14 nt, Streptococcus pneumoniae R6
ucgauaaagaagag

SEQ ID NO: 4102561 - RNA, 18 nt, Streptococcus pneumoniae R6
ucgauaucguuauuagca

SEQ ID NO: 4102562 - RNA, 16 nt, Streptococcus pneumoniae R6
ucgauaucuugguaca

SEQ ID NO: 4102563 - RNA, 22 nt, Streptococcus pneumoniae R6
ucgauaucuugguacaaaguuc

SEQ ID NO: 4102564 - RNA, 20 nt, Streptococcus pneumoniae R6
ucgaucaggacagucaaauc

SEQ ID NO: 4102565 - RNA, 21 nt, Streptococcus pneumoniae R6
ucgaucugauauauuuucgau

SEQ ID NO: 4102566 - RNA, 16 nt, Streptococcus pneumoniae R6
ucgauuauuuuuucuc

SEQ ID NO: 4102567 - RNA, 15 nt, Streptococcus pneumoniae R6
ucgauuuaaugauau

SEQ ID NO: 4102568 - RNA, 18 nt, Streptococcus pneumoniae R6
ucgauuuguucauaucuu

SEQ ID NO: 4102569 - RNA, 21 nt, Streptococcus pneumoniae R6
ucgcaaaggcgcgaucuugua

SEQ ID NO: 4102570 - RNA, 22 nt, Streptococcus pneumoniae R6
ucgcaacggacguugauuuguc

SEQ ID NO: 4102571 - RNA, 23 nt, Streptococcus pneumoniae R6
ucgcaacugucuuauccaaacua

SEQ ID NO: 4102572 - RNA, 13 nt, Streptococcus pneumoniae R6
ucgcaagauagaa

SEQ ID NO: 4102573 - RNA, 15 nt, Streptococcus pneumoniae R6
ucgcaaguuuuuccc

SEQ ID NO: 4102574 - RNA, 17 nt, Streptococcus pneumoniae R6
ucgcauauaagcggcua

SEQ ID NO: 4102575 - RNA, 13 nt, Streptococcus pneumoniae R6
ucgcauauuucau

SEQ ID NO: 4102576 - RNA, 13 nt, Streptococcus pneumoniae R6
ucgccguuuacgu

SEQ ID NO: 4102577 - RNA, 18 nt, Streptococcus pneumoniae R6
ucgccuaguaagaugagu

SEQ ID NO: 4102578 - RNA, 19 nt, Streptococcus pneumoniae R6
ucgccuggagcuucaucag

SEQ ID NO: 4102579 - RNA, 20 nt, Streptococcus pneumoniae R6
ucgccuggagcuucaucagu

SEQ ID NO: 4102580 - RNA, 21 nt, Streptococcus pneumoniae R6
ucgccuggagcuucaucaguu

SEQ ID NO: 4102581 - RNA, 22 nt, Streptococcus pneumoniae R6
ucgccuuaccguauauauguua

SEQ ID NO: 4102582 - RNA, 19 nt, Streptococcus pneumoniae R6
ucgcgauugauuuccaaaa

SEQ ID NO: 4102583 - RNA, 18 nt, Streptococcus pneumoniae R6
ucgcucuaacugaagcug

SEQ ID NO: 4102584 - RNA, 18 nt, Streptococcus pneumoniae R6
ucgcuggaagucuauuau

SEQ ID NO: 4102585 - RNA, 24 nt, Streptococcus pneumoniae R6
ucgcuggagauaggucacagcccc

SEQ ID NO: 4102586 - RNA, 22 nt, Streptococcus pneumoniae R6
ucgcuguuaaagccaucuaaaa

SEQ ID NO: 4102587 - RNA, 15 nt, Streptococcus pneumoniae R6
ucgcuuaauuucuau

SEQ ID NO: 4102588 - RNA, 20 nt, Streptococcus pneumoniae R6
ucgcuucuguaacaaagcua

SEQ ID NO: 4102589 - RNA, 22 nt, Streptococcus pneumoniae R6
ucgcuugcuagauauuguucua

SEQ ID NO: 4102590 - RNA, 18 nt, Streptococcus pneumoniae R6
ucgcuuggaaguuuuccu

SEQ ID NO: 4102591 - RNA, 16 nt, Streptococcus pneumoniae R6
ucgcuuggauuuucaa

SEQ ID NO: 4102592 - RNA, 17 nt, Streptococcus pneumoniae R6
ucgcuugguaggguucu

SEQ ID NO: 4102593 - RNA, 13 nt, Streptococcus pneumoniae R6
ucgcuuuuuuaaa

SEQ ID NO: 4102594 - RNA, 18 nt, Streptococcus pneumoniae R6
ucgcuuuuuuaaaugcug

SEQ ID NO: 4102595 - RNA, 18 nt, Streptococcus pneumoniae R6
ucgcuuuuuuaguuugca

SEQ ID NO: 4102596 - RNA, 14 nt, Streptococcus pneumoniae R6
ucggaaagccaaau

SEQ ID NO: 4102597 - RNA, 17 nt, Streptococcus pneumoniae R6
ucggaaagccaaaucaa

SEQ ID NO: 4102598 - RNA, 18 nt, Streptococcus pneumoniae R6
ucggaaagccaaaucaau

SEQ ID NO: 4102599 - RNA, 21 nt, Streptococcus pneumoniae R6
ucggaauagcucaaaaguuua

SEQ ID NO: 4102600 - RNA, 14 nt, Streptococcus pneumoniae R6
ucggacuuuuucca

SEQ ID NO: 4102601 - RNA, 21 nt, Streptococcus pneumoniae R6
ucggagauggguucccuaucu

SEQ ID NO: 4102602 - RNA, 20 nt, Streptococcus pneumoniae R6
ucggauacuugcaaacuuuu

SEQ ID NO: 4102603 - RNA, 17 nt, Streptococcus pneumoniae R6
ucggauggaaauaaucu

SEQ ID NO: 4102604 - RNA, 22 nt, Streptococcus pneumoniae R6
ucggauggaaauaaucuuucac

SEQ ID NO: 4102605 - RNA, 17 nt, Streptococcus pneumoniae R6
ucuacuaaaauuauguu

SEQ ID NO: 4102606 - RNA, 21 nt, Streptococcus pneumoniae R6
ucuacuauacgacaugccugu

SEQ ID NO: 4102607 - RNA, 15 nt, Streptococcus pneumoniae R6
ucuacuccuuagugu

SEQ ID NO: 4102608 - RNA, 13 nt, Streptococcus pneumoniae R6
ucuacuccuuuuc

SEQ ID NO: 4102609 - RNA, 12 nt, Streptococcus pneumoniae R6
ucuacugaaauu

SEQ ID NO: 4102610 - RNA, 15 nt, Streptococcus pneumoniae R6
ucuacuucuaaaaca

SEQ ID NO: 4102611 - RNA, 14 nt, Streptococcus pneumoniae R6
ucuacuuuuucaaa

SEQ ID NO: 4102612 - RNA, 16 nt, Streptococcus pneumoniae R6
ucuacuuuuuucuaaa

SEQ ID NO: 4102613 - RNA, 22 nt, Streptococcus pneumoniae R6
ucuacuuuuuucuaaagcaauu

SEQ ID NO: 4102614 - RNA, 21 nt, Streptococcus pneumoniae R6
ucuagaaauuaauuugaauuu

SEQ ID NO: 4102615 - RNA, 22 nt, Streptococcus pneumoniae R6
ucuagacuaggguuuccaccuu

SEQ ID NO: 4102616 - RNA, 13 nt, Streptococcus pneumoniae R6
ucuagacuauaac

SEQ ID NO: 4102617 - RNA, 16 nt, Streptococcus pneumoniae R6
ucuagauaguaccaug

SEQ ID NO: 4102618 - RNA, 22 nt, Streptococcus pneumoniae R6
ucuagaugaauuacaugaaacu

SEQ ID NO: 4102619 - RNA, 17 nt, Streptococcus pneumoniae R6
ucuagauuuggaaacuc

SEQ ID NO: 4102620 - RNA, 14 nt, Streptococcus pneumoniae R6
ucuagcaagaguuu

SEQ ID NO: 4102621 - RNA, 18 nt, Streptococcus pneumoniae R6
ucuagcauaaaagccucc

SEQ ID NO: 4102622 - RNA, 14 nt, Streptococcus pneumoniae R6
ucuagcgcaaagcu

SEQ ID NO: 4102623 - RNA, 21 nt, Streptococcus pneumoniae R6
ucuagcuaucuccucauauuu

SEQ ID NO: 4102624 - RNA, 22 nt, Streptococcus pneumoniae R6
ucuagcuuccccauucuaugga

SEQ ID NO: 4102625 - RNA, 23 nt, Streptococcus pneumoniae R6
ucuaggucaacaggauuuuguuc

SEQ ID NO: 4102626 - RNA, 15 nt, Streptococcus pneumoniae R6
ucuagucaucagaaa

SEQ ID NO: 4102627 - RNA, 21 nt, Streptococcus pneumoniae R6
ucuagucuggagauuuuucaa

SEQ ID NO: 4102628 - RNA, 19 nt, Streptococcus pneumoniae R6
ucuaguugguuuccuuggu

SEQ ID NO: 4102629 - RNA, 19 nt, Streptococcus pneumoniae R6
ucuaguuuagcacauuucc

SEQ ID NO: 4102630 - RNA, 19 nt, Streptococcus pneumoniae R6
ucuaguuugcucuuugauu

SEQ ID NO: 4102631 - RNA, 18 nt, Streptococcus pneumoniae R6
ucuaguuuugguuuuucu

SEQ ID NO: 4102632 - RNA, 19 nt, Streptococcus pneumoniae R6
ucuaguuuugguuuuucuu

SEQ ID NO: 4102633 - RNA, 13 nt, Streptococcus pneumoniae R6
ucuauaaacaaag

SEQ ID NO: 4102634 - RNA, 13 nt, Streptococcus pneumoniae R6
ucuauacacaucc

SEQ ID NO: 4102635 - RNA, 14 nt, Streptococcus pneumoniae R6
ucuauacacaucca

SEQ ID NO: 4102636 - RNA, 15 nt, Streptococcus pneumoniae R6
ucuauacauuuagaa

SEQ ID NO: 4102637 - RNA, 23 nt, Streptococcus pneumoniae R6
ucuauagaaaacaacuuauaaaa

SEQ ID NO: 4102638 - RNA, 21 nt, Streptococcus pneumoniae R6
ucuauaggauuuauuuuucuu

SEQ ID NO: 4102639 - RNA, 12 nt, Streptococcus pneumoniae R6
ucuaucaaaaga

SEQ ID NO: 4102640 - RNA, 13 nt, Streptococcus pneumoniae R6
ucuaucaaaagau

SEQ ID NO: 4102641 - RNA, 20 nt, Streptococcus pneumoniae R6
ucuaucaaaagauguuagaa

SEQ ID NO: 4102642 - RNA, 15 nt, Streptococcus pneumoniae R6
ucuaucacuccaaaa

SEQ ID NO: 4102643 - RNA, 13 nt, Streptococcus pneumoniae R6
ucuaucagaaagu

SEQ ID NO: 4102644 - RNA, 22 nt, Streptococcus pneumoniae R6
ucuaucagaaagucgugauuuc

SEQ ID NO: 4102645 - RNA, 22 nt, Streptococcus pneumoniae R6
ucuaucaugcgaaucaauuuuu

SEQ ID NO: 4102646 - RNA, 16 nt, Streptococcus pneumoniae R6
ucuaucauuauacucu

SEQ ID NO: 4102647 - RNA, 14 nt, Streptococcus pneumoniae R6
ucuauccacaaccu

SEQ ID NO: 4102648 - RNA, 21 nt, Streptococcus pneumoniae R6
ucuauccacaaccucaaaaca

SEQ ID NO: 4102649 - RNA, 23 nt, Streptococcus pneumoniae R6
ucuauccacaaccucaaaacagu

SEQ ID NO: 4102650 - RNA, 22 nt, Streptococcus pneumoniae R6
ucuaucucaccaggcauuauuu

SEQ ID NO: 4102651 - RNA, 16 nt, Streptococcus pneumoniae R6
ucuaucugcaaccuca

SEQ ID NO: 4102652 - RNA, 21 nt, Streptococcus pneumoniae R6
ucuaucugcaaccucaaaaca

SEQ ID NO: 4102653 - RNA, 23 nt, Streptococcus pneumoniae R6
ucuaucuuaguaguuuguauaau

SEQ ID NO: 4102654 - RNA, 13 nt, Streptococcus pneumoniae R6
ucuaugauuuuca

SEQ ID NO: 4102655 - RNA, 13 nt, Streptococcus pneumoniae R6
ucuauuauauaua

SEQ ID NO: 4102656 - RNA, 17 nt, Streptococcus pneumoniae R6
ucuauuauuuaaguguu

SEQ ID NO: 4102657 - RNA, 14 nt, Streptococcus pneumoniae R6
ucuauuauuugguu

SEQ ID NO: 4102658 - RNA, 20 nt, Streptococcus pneumoniae R6
ucuauuauuugguuagguga

SEQ ID NO: 4102659 - RNA, 22 nt, Streptococcus pneumoniae R6
ucuauuccuagucagaauagau

SEQ ID NO: 4102660 - RNA, 16 nt, Streptococcus pneumoniae R6
ucuauucuuuccuuuu

SEQ ID NO: 4102661 - RNA, 17 nt, Streptococcus pneumoniae R6
ucuauucuuuuuugguu

SEQ ID NO: 4102662 - RNA, 15 nt, Streptococcus pneumoniae R6
ucuauugaaaaaucu

SEQ ID NO: 4102663 - RNA, 22 nt, Streptococcus pneumoniae R6
ucuauugaaguuagaguaguac

SEQ ID NO: 4102664 - RNA, 22 nt, Streptococcus pneumoniae R6
ucuauugcauauacuuuaucac

SEQ ID NO: 4102665 - RNA, 17 nt, Streptococcus pneumoniae R6
ucuauuuaccccaccuc

SEQ ID NO: 4102666 - RNA, 15 nt, Streptococcus pneumoniae R6
ucuauuucuuuaaaa

SEQ ID NO: 4102667 - RNA, 13 nt, Streptococcus pneumoniae R6
ucuauuuuaaaaa

SEQ ID NO: 4102668 - RNA, 15 nt, Streptococcus pneumoniae R6
ucuauuuuaaaaaua

SEQ ID NO: 4102669 - RNA, 17 nt, Streptococcus pneumoniae R6
ucuauuuuuaaauuuua

SEQ ID NO: 4102670 - RNA, 13 nt, Streptococcus pneumoniae R6
ucuauuuuuaaua

SEQ ID NO: 4102671 - RNA, 21 nt, Streptococcus pneumoniae R6
ucuauuuuuacucaaggacua

SEQ ID NO: 4102672 - RNA, 17 nt, Streptococcus pneumoniae R6
ucuauuuuugagcagaa

SEQ ID NO: 4102673 - RNA, 21 nt, Streptococcus pneumoniae R6
ucuauuuuugagcagaacaau

SEQ ID NO: 4102674 - RNA, 23 nt, Streptococcus pneumoniae R6
ucuauuuuugagcagaacaauga

SEQ ID NO: 4102675 - RNA, 22 nt, Streptococcus pneumoniae R6
ucuauuuuuuauaauaucacua

SEQ ID NO: 4102676 - RNA, 20 nt, Streptococcus pneumoniae R6
ucucaaaaaaguuaaaucuu

SEQ ID NO: 4102677 - RNA, 19 nt, Streptococcus pneumoniae R6
ucucaaacauugugaggaa

SEQ ID NO: 4102678 - RNA, 20 nt, Streptococcus pneumoniae R6
ucucaaauuuucauacucgu

SEQ ID NO: 4102679 - RNA, 21 nt, Streptococcus pneumoniae R6
ucucaacgcuagaagcaucga

SEQ ID NO: 4102680 - RNA, 12 nt, Streptococcus pneumoniae R6
ucucaauaggau

SEQ ID NO: 4102681 - RNA, 16 nt, Streptococcus pneumoniae R6
ucucacacggaaacag

SEQ ID NO: 4102682 - RNA, 17 nt, Streptococcus pneumoniae R6
ucucacgguaaauguag

SEQ ID NO: 4102683 - RNA, 22 nt, Streptococcus pneumoniae R6
ucucacguaacauauuuucaaa

SEQ ID NO: 4102684 - RNA, 13 nt, Streptococcus pneumoniae R6
ucucacuauucau

SEQ ID NO: 4102685 - RNA, 14 nt, Streptococcus pneumoniae R6
ucucacuuaauucu

SEQ ID NO: 4102686 - RNA, 17 nt, Streptococcus pneumoniae R6
ucucacuuaauucuuca

SEQ ID NO: 4102687 - RNA, 21 nt, Streptococcus pneumoniae R6
ucucagcagucguuccuuuug

SEQ ID NO: 4102688 - RNA, 22 nt, Streptococcus pneumoniae R6
ucucagcuagucgugaaagagc

SEQ ID NO: 4102689 - RNA, 16 nt, Streptococcus pneumoniae R6
ucucaggcuuuuucug

SEQ ID NO: 4102690 - RNA, 15 nt, Streptococcus pneumoniae R6
ucucagugggcuauu

SEQ ID NO: 4102691 - RNA, 15 nt, Streptococcus pneumoniae R6
ucucaguucugagga

SEQ ID NO: 4102692 - RNA, 17 nt, Streptococcus pneumoniae R6
ucucauagccauaaaac

SEQ ID NO: 4102693 - RNA, 19 nt, Streptococcus pneumoniae R6
ucucauagccauaaaacau

SEQ ID NO: 4102694 - RNA, 20 nt, Streptococcus pneumoniae R6
ucucauagccauaaaacauu

SEQ ID NO: 4102695 - RNA, 20 nt, Streptococcus pneumoniae R6
ucucaucuucacucuucaaa

SEQ ID NO: 4102696 - RNA, 20 nt, Streptococcus pneumoniae R6
ucucaugaaaggauuucucu

SEQ ID NO: 4102697 - RNA, 16 nt, Streptococcus pneumoniae R6
ucucauucaucaccac

SEQ ID NO: 4102698 - RNA, 15 nt, Streptococcus pneumoniae R6
ucucauuugaugaga

SEQ ID NO: 4102699 - RNA, 20 nt, Streptococcus pneumoniae R6
ucuccaaagauagaauccau

SEQ ID NO: 4102700 - RNA, 18 nt, Streptococcus pneumoniae R6
ucuccaaccaucaaaaua

SEQ ID NO: 4102701 - RNA, 21 nt, Streptococcus pneumoniae R6
ucuccaaucaaauugugcagu

SEQ ID NO: 4102702 - RNA, 14 nt, Streptococcus pneumoniae R6
ucuccaauccuugu

SEQ ID NO: 4102703 - RNA, 21 nt, Streptococcus pneumoniae R6
ucuccagaccaccuuccuugg

SEQ ID NO: 4102704 - RNA, 14 nt, Streptococcus pneumoniae R6
ucuccaguaacuuu

SEQ ID NO: 4102705 - RNA, 20 nt, Streptococcus pneumoniae R6
ucuccaguaacuuuaccaaa

SEQ ID NO: 4102706 - RNA, 22 nt, Streptococcus pneumoniae R6
ucuccaguccuuguaugacauc

SEQ ID NO: 4102707 - RNA, 15 nt, Streptococcus pneumoniae R6
ucuggagauuucuua

SEQ ID NO: 4102708 - RNA, 18 nt, Streptococcus pneumoniae R6
ucuggaggcuuuuucuca

SEQ ID NO: 4102709 - RNA, 15 nt, Streptococcus pneumoniae R6
ucuggaguagcaucc

SEQ ID NO: 4102710 - RNA, 20 nt, Streptococcus pneumoniae R6
ucuggaguagcauccccagu

SEQ ID NO: 4102711 - RNA, 22 nt, Streptococcus pneumoniae R6
ucuggaucuuccgucccuugga

SEQ ID NO: 4102712 - RNA, 16 nt, Streptococcus pneumoniae R6
ucuggaugauucuuuu

SEQ ID NO: 4102713 - RNA, 20 nt, Streptococcus pneumoniae R6
ucuggaugauucuuuucaaa

SEQ ID NO: 4102714 - RNA, 23 nt, Streptococcus pneumoniae R6
ucuggaugauucuuuucaaaaua

SEQ ID NO: 4102715 - RNA, 15 nt, Streptococcus pneumoniae R6
ucuggauuuccauuu

SEQ ID NO: 4102716 - RNA, 22 nt, Streptococcus pneumoniae R6
ucuggauuuucagccucuauac

SEQ ID NO: 4102717 - RNA, 17 nt, Streptococcus pneumoniae R6
ucuggcaauuuauccca

SEQ ID NO: 4102718 - RNA, 18 nt, Streptococcus pneumoniae R6
ucuggcaauuuaucuccu

SEQ ID NO: 4102719 - RNA, 13 nt, Streptococcus pneumoniae R6
ucuggcacagaaa

SEQ ID NO: 4102720 - RNA, 20 nt, Streptococcus pneumoniae R6
ucuggcagaaggauuuccua

SEQ ID NO: 4102721 - RNA, 17 nt, Streptococcus pneumoniae R6
ucuggcagauagagaca

SEQ ID NO: 4102722 - RNA, 20 nt, Streptococcus pneumoniae R6
ucuggcagauuuugaagaug

SEQ ID NO: 4102723 - RNA, 15 nt, Streptococcus pneumoniae R6
ucuggcgucuuaccu

SEQ ID NO: 4102724 - RNA, 16 nt, Streptococcus pneumoniae R6
ucuggcucuuugucaa

SEQ ID NO: 4102725 - RNA, 16 nt, Streptococcus pneumoniae R6
ucugggagaaauuccu

SEQ ID NO: 4102726 - RNA, 13 nt, Streptococcus pneumoniae R6
ucugggugcugaa

SEQ ID NO: 4102727 - RNA, 20 nt, Streptococcus pneumoniae R6
ucugguauauuuuguuuucu

SEQ ID NO: 4102728 - RNA, 15 nt, Streptococcus pneumoniae R6
ucuggucugauuuuc

SEQ ID NO: 4102729 - RNA, 16 nt, Streptococcus pneumoniae R6
ucuggucuuuuugcuc

SEQ ID NO: 4102730 - RNA, 18 nt, Streptococcus pneumoniae R6
ucuggucuuuuugcucau

SEQ ID NO: 4102731 - RNA, 17 nt, Streptococcus pneumoniae R6
ucuggugcuagggcaag

SEQ ID NO: 4102732 - RNA, 20 nt, Streptococcus pneumoniae R6
ucugguuaaaauugcuuucu

SEQ ID NO: 4102733 - RNA, 23 nt, Streptococcus pneumoniae R6
ucugguucccagcauggucaggc

SEQ ID NO: 4102734 - RNA, 20 nt, Streptococcus pneumoniae R6
ucugguuuggcaaauuugac

SEQ ID NO: 4102735 - RNA, 18 nt, Streptococcus pneumoniae R6
ucuguaacccaaaagaua

SEQ ID NO: 4102736 - RNA, 14 nt, Streptococcus pneumoniae R6
ucuguaagcaaagu

SEQ ID NO: 4102737 - RNA, 12 nt, Streptococcus pneumoniae R6
ucuguaaucuua

SEQ ID NO: 4102738 - RNA, 16 nt, Streptococcus pneumoniae R6
ucuguaaugaaauacu

SEQ ID NO: 4102739 - RNA, 20 nt, Streptococcus pneumoniae R6
ucuguacugccccccaaaag

SEQ ID NO: 4102740 - RNA, 17 nt, Streptococcus pneumoniae R6
ucuguagagaguuaaaa

SEQ ID NO: 4102741 - RNA, 16 nt, Streptococcus pneumoniae R6
ucuguauaaauagcua

SEQ ID NO: 4102742 - RNA, 17 nt, Streptococcus pneumoniae R6
ucuguaugguauucguu

SEQ ID NO: 4102743 - RNA, 22 nt, Streptococcus pneumoniae R6
ucuguauugauucguauugaau

SEQ ID NO: 4102744 - RNA, 23 nt, Streptococcus pneumoniae R6
ucugucacuugaccuguuuucac

SEQ ID NO: 4102745 - RNA, 15 nt, Streptococcus pneumoniae R6
ucugucuguucucug

SEQ ID NO: 4102746 - RNA, 15 nt, Streptococcus pneumoniae R6
ucugucuuaccacaa

SEQ ID NO: 4102747 - RNA, 20 nt, Streptococcus pneumoniae R6
ucugucuuagacuuucucac

SEQ ID NO: 4102748 - RNA, 20 nt, Streptococcus pneumoniae R6
ucugucuugacugcaucaga

SEQ ID NO: 4102749 - RNA, 14 nt, Streptococcus pneumoniae R6
ucugucuuguaaaa

SEQ ID NO: 4102750 - RNA, 15 nt, Streptococcus pneumoniae R6
ucugucuuuauuaau

SEQ ID NO: 4102751 - RNA, 19 nt, Streptococcus pneumoniae R6
ucugugaaugccuguucca

SEQ ID NO: 4102752 - RNA, 19 nt, Streptococcus pneumoniae R6
ucugugauugacaccacuu

SEQ ID NO: 4102753 - RNA, 15 nt, Streptococcus pneumoniae R6
ucugugcuuuuucaa

SEQ ID NO: 4102754 - RNA, 18 nt, Streptococcus pneumoniae R6
ucugugcuuuuucaaugc

SEQ ID NO: 4102755 - RNA, 19 nt, Streptococcus pneumoniae R6
ucuguguagcacuuuucca

SEQ ID NO: 4102756 - RNA, 21 nt, Streptococcus pneumoniae R6
ucuguuaaaaaauaaucaaaa

SEQ ID NO: 4102757 - RNA, 16 nt, Streptococcus pneumoniae R6
ucuguuccccaaucgg

SEQ ID NO: 4102758 - RNA, 17 nt, Streptococcus pneumoniae R6
ucuguucuaugcgucua

SEQ ID NO: 4102759 - RNA, 23 nt, Streptococcus pneumoniae R6
ucuguuugaauacgauuggcgac

SEQ ID NO: 4102760 - RNA, 16 nt, Streptococcus pneumoniae R6
ucuguuuucaaaaagc

SEQ ID NO: 4102761 - RNA, 14 nt, Streptococcus pneumoniae R6
ucuguuuuuggauu

SEQ ID NO: 4102762 - RNA, 19 nt, Streptococcus pneumoniae R6
ucuuaaaaaaguccaaaag

SEQ ID NO: 4102763 - RNA, 14 nt, Streptococcus pneumoniae R6
ucuuaaaagcaaaa

SEQ ID NO: 4102764 - RNA, 15 nt, Streptococcus pneumoniae R6
ucuuaaaagcaaaag

SEQ ID NO: 4102765 - RNA, 18 nt, Streptococcus pneumoniae R6
ucuuaaaaucacaaaaac

SEQ ID NO: 4102766 - RNA, 21 nt, Streptococcus pneumoniae R6
ucuuaaaguuauuggaacuaa

SEQ ID NO: 4102767 - RNA, 14 nt, Streptococcus pneumoniae R6
ucuuaaauccacgu

SEQ ID NO: 4102768 - RNA, 20 nt, Streptococcus pneumoniae R6
ucuuaaaugacauuccuguc

SEQ ID NO: 4102769 - RNA, 22 nt, Streptococcus pneumoniae R6
ucuuaaccucuugaaguucauu

SEQ ID NO: 4102770 - RNA, 23 nt, Streptococcus pneumoniae R6
ucuuaauaucagccagagcacca

SEQ ID NO: 4102771 - RNA, 13 nt, Streptococcus pneumoniae R6
ucuuaauucucuu

SEQ ID NO: 4102772 - RNA, 23 nt, Streptococcus pneumoniae R6
ucuuacaaaaaaucaaaaaaauu

SEQ ID NO: 4102773 - RNA, 14 nt, Streptococcus pneumoniae R6
ucuuacaaauugau

SEQ ID NO: 4102774 - RNA, 20 nt, Streptococcus pneumoniae R6
ucuuaccaaccucagaaucc

SEQ ID NO: 4102775 - RNA, 13 nt, Streptococcus pneumoniae R6
ucuuaccacaaac

SEQ ID NO: 4102776 - RNA, 14 nt, Streptococcus pneumoniae R6
ucuuaccacaaaca

SEQ ID NO: 4102777 - RNA, 16 nt, Streptococcus pneumoniae R6
ucuuacugauauacuu

SEQ ID NO: 4102778 - RNA, 17 nt, Streptococcus pneumoniae R6
ucuuacuuccuuuuuaa

SEQ ID NO: 4102779 - RNA, 18 nt, Streptococcus pneumoniae R6
ucuuacuuccuuuuuaaa

SEQ ID NO: 4102780 - RNA, 20 nt, Streptococcus pneumoniae R6
ucuuagaaaaucucuucaaa

SEQ ID NO: 4102781 - RNA, 14 nt, Streptococcus pneumoniae R6
ucuuagacuuucuc

SEQ ID NO: 4102782 - RNA, 12 nt, Streptococcus pneumoniae R6
ucuuagcaaaac

SEQ ID NO: 4102783 - RNA, 12 nt, Streptococcus pneumoniae R6
ucuuagcaaaga

SEQ ID NO: 4102784 - RNA, 21 nt, Streptococcus pneumoniae R6
ucuuagugaguuuuacaaugu

SEQ ID NO: 4102785 - RNA, 20 nt, Streptococcus pneumoniae R6
ucuuauagcgacuauaaaaa

SEQ ID NO: 4102786 - RNA, 22 nt, Streptococcus pneumoniae R6
ucuuaucaaaucccuagcucau

SEQ ID NO: 4102787 - RNA, 13 nt, Streptococcus pneumoniae R6
ucuuaucaacgcu

SEQ ID NO: 4102788 - RNA, 16 nt, Streptococcus pneumoniae R6
ucuuaucacccaaaac

SEQ ID NO: 4102789 - RNA, 16 nt, Streptococcus pneumoniae R6
ucuuaucagaaaauaa

SEQ ID NO: 4102790 - RNA, 17 nt, Streptococcus pneumoniae R6
ucuuaucugcaaccuca

SEQ ID NO: 4102791 - RNA, 16 nt, Streptococcus pneumoniae R6
ucuuaucuugauauuc

SEQ ID NO: 4102792 - RNA, 14 nt, Streptococcus pneumoniae R6
ucuuaucuuuggca

SEQ ID NO: 4102793 - RNA, 13 nt, Streptococcus pneumoniae R6
ucuuauuauucuc

SEQ ID NO: 4102794 - RNA, 17 nt, Streptococcus pneumoniae R6
ucuuauuucaaucugcu

SEQ ID NO: 4102795 - RNA, 14 nt, Streptococcus pneumoniae R6
ucuuauuucaauuu

SEQ ID NO: 4102796 - RNA, 12 nt, Streptococcus pneumoniae R6
ucuuauuucauu

SEQ ID NO: 4102797 - RNA, 21 nt, Streptococcus pneumoniae R6
ucuuauuucauuuuacuauau

SEQ ID NO: 4102798 - RNA, 15 nt, Streptococcus pneumoniae R6
ucuuauuuuucuauu

SEQ ID NO: 4102799 - RNA, 19 nt, Streptococcus pneumoniae R6
ucuucaaaaaucucuucaa

SEQ ID NO: 4102800 - RNA, 19 nt, Streptococcus pneumoniae R6
ucuucaaaccgcgucagcu

SEQ ID NO: 4102801 - RNA, 23 nt, Streptococcus pneumoniae R6
ucuucaaacuacgucagcuucca

SEQ ID NO: 4102802 - RNA, 15 nt, Streptococcus pneumoniae R6
ucuucaaauuuuuca

SEQ ID NO: 4102803 - RNA, 19 nt, Streptococcus pneumoniae R6
ucuucaacauucuccagua

SEQ ID NO: 4102804 - RNA, 23 nt, Streptococcus pneumoniae R6
ucuucaacccacuacaguugaca

SEQ ID NO: 4102805 - RNA, 18 nt, Streptococcus pneumoniae R6
ucuucaagagcuuuaaua

SEQ ID NO: 4102806 - RNA, 19 nt, Streptococcus pneumoniae R6
ucuucaagguuuuauacuc

SEQ ID NO: 4102807 - RNA, 18 nt, Streptococcus pneumoniae R6
ucuucaauaccaaagaag

SEQ ID NO: 4102808 - RNA, 15 nt, Streptococcus pneumoniae R6
ucuucacaaucaaaa

SEQ ID NO: 4102809 - RNA, 23 nt, Streptococcus pneumoniae R6
ucuuuacguccaccacaaaagag

SEQ ID NO: 4102810 - RNA, 23 nt, Streptococcus pneumoniae R6
ucuuuacugagauggauuuuccu

SEQ ID NO: 4102811 - RNA, 19 nt, Streptococcus pneumoniae R6
ucuuuagaaagauuaccaa

SEQ ID NO: 4102812 - RNA, 15 nt, Streptococcus pneumoniae R6
ucuuuagaaagguuu

SEQ ID NO: 4102813 - RNA, 19 nt, Streptococcus pneumoniae R6
ucuuuagcagaugcuugca

SEQ ID NO: 4102814 - RNA, 21 nt, Streptococcus pneumoniae R6
ucuuuagggaaauuauuuauu

SEQ ID NO: 4102815 - RNA, 16 nt, Streptococcus pneumoniae R6
ucuuuaguagucuaaa

SEQ ID NO: 4102816 - RNA, 19 nt, Streptococcus pneumoniae R6
ucuuuagucccauuuucag

SEQ ID NO: 4102817 - RNA, 20 nt, Streptococcus pneumoniae R6
ucuuuagucccauuuucaga

SEQ ID NO: 4102818 - RNA, 14 nt, Streptococcus pneumoniae R6
ucuuuauaauauuu

SEQ ID NO: 4102819 - RNA, 17 nt, Streptococcus pneumoniae R6
ucuuuauaauauuuaau

SEQ ID NO: 4102820 - RNA, 13 nt, Streptococcus pneumoniae R6
ucuuuauaggcuu

SEQ ID NO: 4102821 - RNA, 16 nt, Streptococcus pneumoniae R6
ucuuuauauaaaaaga

SEQ ID NO: 4102822 - RNA, 23 nt, Streptococcus pneumoniae R6
ucuuuaucuuugaggaagguuuu

SEQ ID NO: 4102823 - RNA, 16 nt, Streptococcus pneumoniae R6
ucuuuauuaguaaucu

SEQ ID NO: 4102824 - RNA, 13 nt, Streptococcus pneumoniae R6
ucuuuauucgucu

SEQ ID NO: 4102825 - RNA, 14 nt, Streptococcus pneumoniae R6
ucuuucaaagccug

SEQ ID NO: 4102826 - RNA, 22 nt, Streptococcus pneumoniae R6
ucuuucaagcgaacaucuccaa

SEQ ID NO: 4102827 - RNA, 17 nt, Streptococcus pneumoniae R6
ucuuucacuucacgaau

SEQ ID NO: 4102828 - RNA, 21 nt, Streptococcus pneumoniae R6
ucuuucacuucacgaaugaca

SEQ ID NO: 4102829 - RNA, 14 nt, Streptococcus pneumoniae R6
ucuuucaguuucau

SEQ ID NO: 4102830 - RNA, 17 nt, Streptococcus pneumoniae R6
ucuuucauagcaaaaua

SEQ ID NO: 4102831 - RNA, 14 nt, Streptococcus pneumoniae R6
ucuuuccauucaaa

SEQ ID NO: 4102832 - RNA, 12 nt, Streptococcus pneumoniae R6
ucuuuccuuuua

SEQ ID NO: 4102833 - RNA, 12 nt, Streptococcus pneumoniae R6
ucuuucuaaaau

SEQ ID NO: 4102834 - RNA, 16 nt, Streptococcus pneumoniae R6
ucuuucucaaacauug

SEQ ID NO: 4102835 - RNA, 19 nt, Streptococcus pneumoniae R6
ucuuucuucguuuuuacua

SEQ ID NO: 4102836 - RNA, 21 nt, Streptococcus pneumoniae R6
ucuuucuugucguugaaaaag

SEQ ID NO: 4102837 - RNA, 15 nt, Streptococcus pneumoniae R6
ucuuucuuucucacu

SEQ ID NO: 4102838 - RNA, 18 nt, Streptococcus pneumoniae R6
ucuuugaaauaaucaaaa

SEQ ID NO: 4102839 - RNA, 18 nt, Streptococcus pneumoniae R6
ucuuugaaaucuuguuga

SEQ ID NO: 4102840 - RNA, 21 nt, Streptococcus pneumoniae R6
ucuuugacaccgauaauauuu

SEQ ID NO: 4102841 - RNA, 15 nt, Streptococcus pneumoniae R6
ucuuugauuuucauu

SEQ ID NO: 4102842 - RNA, 19 nt, Streptococcus pneumoniae R6
ucuuugcauuaucuaauac

SEQ ID NO: 4102843 - RNA, 20 nt, Streptococcus pneumoniae R6
ucuuugcauuucaucuucua

SEQ ID NO: 4102844 - RNA, 19 nt, Streptococcus pneumoniae R6
ucuuuggacauagccaaua

SEQ ID NO: 4102845 - RNA, 21 nt, Streptococcus pneumoniae R6
ucuuuggacauagccaauaaa

SEQ ID NO: 4102846 - RNA, 21 nt, Streptococcus pneumoniae R6
ucuuugguugcuacaucuucu

SEQ ID NO: 4102847 - RNA, 19 nt, Streptococcus pneumoniae R6
ucuuuguaaguuucuucuu

SEQ ID NO: 4102848 - RNA, 22 nt, Streptococcus pneumoniae R6
ucuuuguccuuuagaaagguuu

SEQ ID NO: 4102849 - RNA, 21 nt, Streptococcus pneumoniae R6
ucuuuguuaaaugaauauauu

SEQ ID NO: 4102850 - RNA, 17 nt, Streptococcus pneumoniae R6
ucuuuguucugaaagug

SEQ ID NO: 4102851 - RNA, 23 nt, Streptococcus pneumoniae R6
ucuuuuaaacuaguuuugagaau

SEQ ID NO: 4102852 - RNA, 14 nt, Streptococcus pneumoniae R6
ucuuuuaaauauuu

SEQ ID NO: 4102853 - RNA, 18 nt, Streptococcus pneumoniae R6
ucuuuuacuuacgugagu

SEQ ID NO: 4102854 - RNA, 13 nt, Streptococcus pneumoniae R6
ucuuuuacuucug

SEQ ID NO: 4102855 - RNA, 20 nt, Streptococcus pneumoniae R6
ucuuuuacuucuuugguugc

SEQ ID NO: 4102856 - RNA, 16 nt, Streptococcus pneumoniae R6
ucuuuuauccuguucu

SEQ ID NO: 4102857 - RNA, 12 nt, Streptococcus pneumoniae R6
ucuuuucaaagu

SEQ ID NO: 4102858 - RNA, 15 nt, Streptococcus pneumoniae R6
ucuuuucauuccaaa

SEQ ID NO: 4102859 - RNA, 20 nt, Streptococcus pneumoniae R6
ucuuuucucuagcuuuuaua

SEQ ID NO: 4102860 - RNA, 22 nt, Streptococcus pneumoniae R6
ucuuuucucuagcuuuuauaaa

SEQ ID NO: 4102861 - RNA, 12 nt, Streptococcus pneumoniae R6
ucuuuucuuauc

SEQ ID NO: 4102862 - RNA, 23 nt, Streptococcus pneumoniae R6
ucuuuugauugauggauucuaaa

SEQ ID NO: 4102863 - RNA, 21 nt, Streptococcus pneumoniae R6
ucuuuugggacagaaaugccc

SEQ ID NO: 4102864 - RNA, 16 nt, Streptococcus pneumoniae R6
ucuuuuuaaauaaauc

SEQ ID NO: 4102865 - RNA, 22 nt, Streptococcus pneumoniae R6
ucuuuuuaauuauuuucaaaau

SEQ ID NO: 4102866 - RNA, 22 nt, Streptococcus pneumoniae R6
ucuuuuuacaauuguaaaaaga

SEQ ID NO: 4102867 - RNA, 14 nt, Streptococcus pneumoniae R6
ucuuuuuacauaga

SEQ ID NO: 4102868 - RNA, 16 nt, Streptococcus pneumoniae R6
ucuuuuuacuuauaau

SEQ ID NO: 4102869 - RNA, 20 nt, Streptococcus pneumoniae R6
ucuuuuuacuuauaauuaaa

SEQ ID NO: 4102870 - RNA, 21 nt, Streptococcus pneumoniae R6
ucuuuuuauacucaaugaaaa

SEQ ID NO: 4102871 - RNA, 19 nt, Streptococcus pneumoniae R6
ucuuuuuauaggcucuuug

SEQ ID NO: 4102872 - RNA, 17 nt, Streptococcus pneumoniae R6
ucuuuuuauauauaaaa

SEQ ID NO: 4102873 - RNA, 15 nt, Streptococcus pneumoniae R6
ucuuuuucaaaggug

SEQ ID NO: 4102874 - RNA, 12 nt, Streptococcus pneumoniae R6
ucuuuuucaaau

SEQ ID NO: 4102875 - RNA, 13 nt, Streptococcus pneumoniae R6
ucuuuuucagaac

SEQ ID NO: 4102876 - RNA, 15 nt, Streptococcus pneumoniae R6
ucuuuuucaucuuuu

SEQ ID NO: 4102877 - RNA, 17 nt, Streptococcus pneumoniae R6
ucuuuuuguaucaauuu

SEQ ID NO: 4102878 - RNA, 12 nt, Streptococcus pneumoniae R6
ucuuuuuuaauu

SEQ ID NO: 4102879 - RNA, 19 nt, Streptococcus pneumoniae R6
ucuuuuuuauccucaaaau

SEQ ID NO: 4102880 - RNA, 23 nt, Streptococcus pneumoniae R6
ucuuuuuuauccucaaaauucug

SEQ ID NO: 4102881 - RNA, 21 nt, Streptococcus pneumoniae R6
ucuuuuuuccgaauaaauaga

SEQ ID NO: 4102882 - RNA, 19 nt, Streptococcus pneumoniae R6
ucuuuuuugaaguuuucaa

SEQ ID NO: 4102883 - RNA, 19 nt, Streptococcus pneumoniae R6
ucuuuuuugauaucuuccu

SEQ ID NO: 4102884 - RNA, 14 nt, Streptococcus pneumoniae R6
ucuuuuuugauguu

SEQ ID NO: 4102885 - RNA, 18 nt, Streptococcus pneumoniae R6
ucuuuuuuguuucuugaa

SEQ ID NO: 4102886 - RNA, 20 nt, Streptococcus pneumoniae R6
ucuuuuuuuagucucuaaau

SEQ ID NO: 4102887 - RNA, 13 nt, Streptococcus pneumoniae R6
ucuuuuuuugaua

SEQ ID NO: 4102888 - RNA, 13 nt, Streptococcus pneumoniae R6
ugaaaaaaaguuu

SEQ ID NO: 4102889 - RNA, 21 nt, Streptococcus pneumoniae R6
ugaaaaaaaugucauaauuga

SEQ ID NO: 4102890 - RNA, 23 nt, Streptococcus pneumoniae R6
ugaaaaaaauuagaaaaaguagu

SEQ ID NO: 4102891 - RNA, 19 nt, Streptococcus pneumoniae R6
ugaaaaaaauuuuauuuaa

SEQ ID NO: 4102892 - RNA, 16 nt, Streptococcus pneumoniae R6
ugaaaaaauggacuuu

SEQ ID NO: 4102893 - RNA, 15 nt, Streptococcus pneumoniae R6
ugaaaaaccaauagc

SEQ ID NO: 4102894 - RNA, 13 nt, Streptococcus pneumoniae R6
ugaaaaagugaga

SEQ ID NO: 4102895 - RNA, 21 nt, Streptococcus pneumoniae R6
ugaaaaagugagauauauuga

SEQ ID NO: 4102896 - RNA, 20 nt, Streptococcus pneumoniae R6
ugaaaaaguuuauauuauaa

SEQ ID NO: 4102897 - RNA, 16 nt, Streptococcus pneumoniae R6
ugaaaaauauacaaaa

SEQ ID NO: 4102898 - RNA, 19 nt, Streptococcus pneumoniae R6
ugaaaaauauacaaaaaag

SEQ ID NO: 4102899 - RNA, 11 nt, Streptococcus pneumoniae R6
ugaaaaccaag

SEQ ID NO: 4102900 - RNA, 20 nt, Streptococcus pneumoniae R6
ugaaaacgguaacaaaacua

SEQ ID NO: 4102901 - RNA, 16 nt, Streptococcus pneumoniae R6
ugaaaacugaacaaga

SEQ ID NO: 4102902 - RNA, 22 nt, Streptococcus pneumoniae R6
ugaaaagaacuccagugaaaac

SEQ ID NO: 4102903 - RNA, 19 nt, Streptococcus pneumoniae R6
ugaaaagacguauucaguc

SEQ ID NO: 4102904 - RNA, 16 nt, Streptococcus pneumoniae R6
ugaaaagccacguuca

SEQ ID NO: 4102905 - RNA, 18 nt, Streptococcus pneumoniae R6
ugaaaauaccaaguucau

SEQ ID NO: 4102906 - RNA, 22 nt, Streptococcus pneumoniae R6
ugaaaauauuucgcuuauaaac

SEQ ID NO: 4102907 - RNA, 24 nt, Streptococcus pneumoniae R6
ugaaaaucaaagagcaaacuagaa

SEQ ID NO: 4102908 - RNA, 22 nt, Streptococcus pneumoniae R6
ugaaaaucgcaaguuuuuccca

SEQ ID NO: 4102909 - RNA, 13 nt, Streptococcus pneumoniae R6
ugaaaaucuuuaa

SEQ ID NO: 4102910 - RNA, 10 nt, Streptococcus pneumoniae R6
ugaaaauuug

SEQ ID NO: 4102911 - RNA, 20 nt, Streptococcus pneumoniae R6
ugaaguuccucuuuuucccc

SEQ ID NO: 4102912 - RNA, 21 nt, Streptococcus pneumoniae R6
ugaaguugacgaaguuguucu

SEQ ID NO: 4102913 - RNA, 19 nt, Streptococcus pneumoniae R6
ugaaguugauucaugacau

SEQ ID NO: 4102914 - RNA, 12 nt, Streptococcus pneumoniae R6
ugaaguuuucaa

SEQ ID NO: 4102915 - RNA, 16 nt, Streptococcus pneumoniae R6
ugaaguuuucuagacg

SEQ ID NO: 4102916 - RNA, 16 nt, Streptococcus pneumoniae R6
ugaauaccuaaucuuu

SEQ ID NO: 4102917 - RNA, 12 nt, Streptococcus pneumoniae R6
ugaauagcucaa

SEQ ID NO: 4102918 - RNA, 23 nt, Streptococcus pneumoniae R6
ugaauagcugcggcuuucuucac

SEQ ID NO: 4102919 - RNA, 22 nt, Streptococcus pneumoniae R6
ugaauagcuuaaaaucuuguca

SEQ ID NO: 4102920 - RNA, 19 nt, Streptococcus pneumoniae R6
ugaauaggcauaauacugu

SEQ ID NO: 4102921 - RNA, 16 nt, Streptococcus pneumoniae R6
ugaauaguaaguuaaa

SEQ ID NO: 4102922 - RNA, 16 nt, Streptococcus pneumoniae R6
ugaauagugaagauac

SEQ ID NO: 4102923 - RNA, 19 nt, Streptococcus pneumoniae R6
ugaauauaccuuagauggu

SEQ ID NO: 4102924 - RNA, 21 nt, Streptococcus pneumoniae R6
ugaauauagauggucaaaaua

SEQ ID NO: 4102925 - RNA, 15 nt, Streptococcus pneumoniae R6
ugaauauauucucca

SEQ ID NO: 4102926 - RNA, 16 nt, Streptococcus pneumoniae R6
ugaauauauucuccag

SEQ ID NO: 4102927 - RNA, 18 nt, Streptococcus pneumoniae R6
ugaauauggauaauugaa

SEQ ID NO: 4102928 - RNA, 19 nt, Streptococcus pneumoniae R6
ugaauauuaguaaauagaa

SEQ ID NO: 4102929 - RNA, 16 nt, Streptococcus pneumoniae R6
ugaaucaaaaaugaag

SEQ ID NO: 4102930 - RNA, 13 nt, Streptococcus pneumoniae R6
ugaaucaauucuu

SEQ ID NO: 4102931 - RNA, 21 nt, Streptococcus pneumoniae R6
ugaaucauaggcauaguacca

SEQ ID NO: 4102932 - RNA, 14 nt, Streptococcus pneumoniae R6
ugaauccgaaaaau

SEQ ID NO: 4102933 - RNA, 18 nt, Streptococcus pneumoniae R6
ugaaucgacgcuuucuaa

SEQ ID NO: 4102934 - RNA, 19 nt, Streptococcus pneumoniae R6
ugaaucugaaucaaaauua

SEQ ID NO: 4102935 - RNA, 16 nt, Streptococcus pneumoniae R6
ugaaugagcuuccagu

SEQ ID NO: 4102936 - RNA, 13 nt, Streptococcus pneumoniae R6
ugaaugauaaaac

SEQ ID NO: 4102937 - RNA, 15 nt, Streptococcus pneumoniae R6
ugaaugauaaaacau

SEQ ID NO: 4102938 - RNA, 19 nt, Streptococcus pneumoniae R6
ugaaugauguuuaagucuu

SEQ ID NO: 4102939 - RNA, 16 nt, Streptococcus pneumoniae R6
ugaaugauuucuucuu

SEQ ID NO: 4102940 - RNA, 15 nt, Streptococcus pneumoniae R6
ugaaugccuccaaga

SEQ ID NO: 4102941 - RNA, 19 nt, Streptococcus pneumoniae R6
ugaaugccuccaagaaaga

SEQ ID NO: 4102942 - RNA, 21 nt, Streptococcus pneumoniae R6
ugaaugcucccuucuuuagcc

SEQ ID NO: 4102943 - RNA, 16 nt, Streptococcus pneumoniae R6
ugaauuacaugaaacu

SEQ ID NO: 4102944 - RNA, 12 nt, Streptococcus pneumoniae R6
ugaauucuccaa

SEQ ID NO: 4102945 - RNA, 21 nt, Streptococcus pneumoniae R6
ugaauucuccaaucaaauugu

SEQ ID NO: 4102946 - RNA, 17 nt, Streptococcus pneumoniae R6
ugaauugaaauaagaug

SEQ ID NO: 4102947 - RNA, 19 nt, Streptococcus pneumoniae R6
ugaauugguggguuuucug

SEQ ID NO: 4102948 - RNA, 22 nt, Streptococcus pneumoniae R6
ugaauuguaggacuuccuuuuc

SEQ ID NO: 4102949 - RNA, 16 nt, Streptococcus pneumoniae R6
ugaauuguguaucaau

SEQ ID NO: 4102950 - RNA, 21 nt, Streptococcus pneumoniae R6
ugaauuucaagaaugaaaguu

SEQ ID NO: 4102951 - RNA, 17 nt, Streptococcus pneumoniae R6
ugaauuugaaacaauga

SEQ ID NO: 4102952 - RNA, 23 nt, Streptococcus pneumoniae R6
ugacaaaauaaaaacaucuaccu

SEQ ID NO: 4102953 - RNA, 13 nt, Streptococcus pneumoniae R6
ugacaaagaaaaa

SEQ ID NO: 4102954 - RNA, 23 nt, Streptococcus pneumoniae R6
ugacaaagaaaaaacaaaguauu

SEQ ID NO: 4102955 - RNA, 21 nt, Streptococcus pneumoniae R6
ugacaaagaccuuugaaaacu

SEQ ID NO: 4102956 - RNA, 19 nt, Streptococcus pneumoniae R6
ugacaaagagccauaaaaa

SEQ ID NO: 4102957 - RNA, 21 nt, Streptococcus pneumoniae R6
ugacaaagagccauaaaaaua

SEQ ID NO: 4102958 - RNA, 21 nt, Streptococcus pneumoniae R6
ugacaaagagccgaaaaaaua

SEQ ID NO: 4102959 - RNA, 14 nt, Streptococcus pneumoniae R6
ugacaaagagccua

SEQ ID NO: 4102960 - RNA, 17 nt, Streptococcus pneumoniae R6
ugacaaauccauucuuu

SEQ ID NO: 4102961 - RNA, 15 nt, Streptococcus pneumoniae R6
ugacaacauaaggca

SEQ ID NO: 4102962 - RNA, 14 nt, Streptococcus pneumoniae R6
ugacaacguaaaau

SEQ ID NO: 4102963 - RNA, 17 nt, Streptococcus pneumoniae R6
ugacaagguuuccugca

SEQ ID NO: 4102964 - RNA, 21 nt, Streptococcus pneumoniae R6
ugacaaguaaguagcaucuug

SEQ ID NO: 4102965 - RNA, 15 nt, Streptococcus pneumoniae R6
ugacaauaaagauaa

SEQ ID NO: 4102966 - RNA, 17 nt, Streptococcus pneumoniae R6
ugacaaucuuuucuuua

SEQ ID NO: 4102967 - RNA, 19 nt, Streptococcus pneumoniae R6
ugacaaucuuuucuuuauc

SEQ ID NO: 4102968 - RNA, 19 nt, Streptococcus pneumoniae R6
ugacaauguaccugcaaau

SEQ ID NO: 4102969 - RNA, 23 nt, Streptococcus pneumoniae R6
ugacacgaucauccauucuuuuu

SEQ ID NO: 4102970 - RNA, 16 nt, Streptococcus pneumoniae R6
ugacacuagacaguga

SEQ ID NO: 4102971 - RNA, 13 nt, Streptococcus pneumoniae R6
ugacagugauuaa

SEQ ID NO: 4102972 - RNA, 16 nt, Streptococcus pneumoniae R6
ugacagugauuaaaac

SEQ ID NO: 4102973 - RNA, 19 nt, Streptococcus pneumoniae R6
ugacauacaacuuaaaaag

SEQ ID NO: 4102974 - RNA, 21 nt, Streptococcus pneumoniae R6
ugacauacaacuuaaaaagag

SEQ ID NO: 4102975 - RNA, 21 nt, Streptococcus pneumoniae R6
ugacaucugugauuucaguug

SEQ ID NO: 4102976 - RNA, 23 nt, Streptococcus pneumoniae R6
ugacaugaugugaagagauuuuc

SEQ ID NO: 4102977 - RNA, 19 nt, Streptococcus pneumoniae R6
ugacauggaaauuauaaaa

SEQ ID NO: 4102978 - RNA, 22 nt, Streptococcus pneumoniae R6
ugacauuauuuucuuagcaauu

SEQ ID NO: 4102979 - RNA, 12 nt, Streptococcus pneumoniae R6
ugacauuccugu

SEQ ID NO: 4102980 - RNA, 15 nt, Streptococcus pneumoniae R6
ugaccaaagcaucaa

SEQ ID NO: 4102981 - RNA, 14 nt, Streptococcus pneumoniae R6
ugaccaaguccuca

SEQ ID NO: 4102982 - RNA, 12 nt, Streptococcus pneumoniae R6
ugaccaucccag

SEQ ID NO: 4102983 - RNA, 21 nt, Streptococcus pneumoniae R6
ugaccaucccaguaaaggacu

SEQ ID NO: 4102984 - RNA, 19 nt, Streptococcus pneumoniae R6
ugaccaugucguuuccuuc

SEQ ID NO: 4102985 - RNA, 12 nt, Streptococcus pneumoniae R6
ugaccauuucaa

SEQ ID NO: 4102986 - RNA, 21 nt, Streptococcus pneumoniae R6
ugaccauuucaauagcuccuu

SEQ ID NO: 4102987 - RNA, 23 nt, Streptococcus pneumoniae R6
ugaccauuucaauagcuccuugu

SEQ ID NO: 4102988 - RNA, 20 nt, Streptococcus pneumoniae R6
ugaccguccucauauucaag

SEQ ID NO: 4102989 - RNA, 15 nt, Streptococcus pneumoniae R6
ugaccuaaaucacuu

SEQ ID NO: 4102990 - RNA, 14 nt, Streptococcus pneumoniae R6
ugaccuguuuucac

SEQ ID NO: 4102991 - RNA, 15 nt, Streptococcus pneumoniae R6
ugaccuguuuucaca

SEQ ID NO: 4102992 - RNA, 16 nt, Streptococcus pneumoniae R6
ugaccuuggcuuccga

SEQ ID NO: 4102993 - RNA, 21 nt, Streptococcus pneumoniae R6
ugacgaaacgaagaaggaaga

SEQ ID NO: 4102994 - RNA, 20 nt, Streptococcus pneumoniae R6
ugacgaacggguucuuccaa

SEQ ID NO: 4102995 - RNA, 17 nt, Streptococcus pneumoniae R6
ugacgaagaaaccaagc

SEQ ID NO: 4102996 - RNA, 18 nt, Streptococcus pneumoniae R6
ugacgaagucagcucaaa

SEQ ID NO: 4102997 - RNA, 22 nt, Streptococcus pneumoniae R6
ugacgaagucagcucaaaacau

SEQ ID NO: 4102998 - RNA, 20 nt, Streptococcus pneumoniae R6
ugacgagacagauucaucag

SEQ ID NO: 4102999 - RNA, 14 nt, Streptococcus pneumoniae R6
ugacgagugaagaa

SEQ ID NO: 4103000 - RNA, 15 nt, Streptococcus pneumoniae R6
ugacgagugaagaau

SEQ ID NO: 4103001 - RNA, 23 nt, Streptococcus pneumoniae R6
ugacgagugaagaauugaaaguc

SEQ ID NO: 4103002 - RNA, 12 nt, Streptococcus pneumoniae R6
ugacgauaaaag

SEQ ID NO: 4103003 - RNA, 21 nt, Streptococcus pneumoniae R6
ugacgauaaauugcuggagaa

SEQ ID NO: 4103004 - RNA, 22 nt, Streptococcus pneumoniae R6
ugacgcacaaacuucaucccag

SEQ ID NO: 4103005 - RNA, 16 nt, Streptococcus pneumoniae R6
ugacgcuggaaauaag

SEQ ID NO: 4103006 - RNA, 19 nt, Streptococcus pneumoniae R6
ugacgcuucccucucagau

SEQ ID NO: 4103007 - RNA, 17 nt, Streptococcus pneumoniae R6
ugacgggcaaauuucau

SEQ ID NO: 4103008 - RNA, 13 nt, Streptococcus pneumoniae R6
ugacgucguaacc

SEQ ID NO: 4103009 - RNA, 19 nt, Streptococcus pneumoniae R6
ugacguggguguagaugga

SEQ ID NO: 4103010 - RNA, 20 nt, Streptococcus pneumoniae R6
ugacgugguuugaagagauu

SEQ ID NO: 4103011 - RNA, 16 nt, Streptococcus pneumoniae R6
ugacguucuucugcag

SEQ ID NO: 4103012 - RNA, 21 nt, Streptococcus pneumoniae R6
ugacuaacccuucuuuuuaua

SEQ ID NO: 4103013 - RNA, 13 nt, Streptococcus pneumoniae R6
ugaguuuuuccca

SEQ ID NO: 4103014 - RNA, 19 nt, Streptococcus pneumoniae R6
ugaguuuuucccagccuuc

SEQ ID NO: 4103015 - RNA, 14 nt, Streptococcus pneumoniae R6
ugauaaaacauacu

SEQ ID NO: 4103016 - RNA, 19 nt, Streptococcus pneumoniae R6
ugauaaaggcagauuucaa

SEQ ID NO: 4103017 - RNA, 19 nt, Streptococcus pneumoniae R6
ugauaaauuucaaaguaga

SEQ ID NO: 4103018 - RNA, 19 nt, Streptococcus pneumoniae R6
ugauaacgaauccaacucu

SEQ ID NO: 4103019 - RNA, 18 nt, Streptococcus pneumoniae R6
ugauaagaauaucaagau

SEQ ID NO: 4103020 - RNA, 16 nt, Streptococcus pneumoniae R6
ugauaagauaaggcau

SEQ ID NO: 4103021 - RNA, 14 nt, Streptococcus pneumoniae R6
ugauaagguacaga

SEQ ID NO: 4103022 - RNA, 15 nt, Streptococcus pneumoniae R6
ugauaaguucuuuuu

SEQ ID NO: 4103023 - RNA, 17 nt, Streptococcus pneumoniae R6
ugauaauauuuucuuua

SEQ ID NO: 4103024 - RNA, 13 nt, Streptococcus pneumoniae R6
ugauaaucauaaa

SEQ ID NO: 4103025 - RNA, 17 nt, Streptococcus pneumoniae R6
ugauaauccaggaauca

SEQ ID NO: 4103026 - RNA, 18 nt, Streptococcus pneumoniae R6
ugauaauccaggaaucaa

SEQ ID NO: 4103027 - RNA, 21 nt, Streptococcus pneumoniae R6
ugauaauccaggaaucaacau

SEQ ID NO: 4103028 - RNA, 21 nt, Streptococcus pneumoniae R6
ugauaaugcguuuagcaucuu

SEQ ID NO: 4103029 - RNA, 16 nt, Streptococcus pneumoniae R6
ugauaauugauuaaga

SEQ ID NO: 4103030 - RNA, 17 nt, Streptococcus pneumoniae R6
ugauaccaucuaacuca

SEQ ID NO: 4103031 - RNA, 14 nt, Streptococcus pneumoniae R6
ugauaccuucuuua

SEQ ID NO: 4103032 - RNA, 17 nt, Streptococcus pneumoniae R6
ugauaccuucuuuauca

SEQ ID NO: 4103033 - RNA, 15 nt, Streptococcus pneumoniae R6
ugauacgaaaucaua

SEQ ID NO: 4103034 - RNA, 19 nt, Streptococcus pneumoniae R6
ugauacuaugcguuuuauu

SEQ ID NO: 4103035 - RNA, 20 nt, Streptococcus pneumoniae R6
ugauacuaugcguuuuauug

SEQ ID NO: 4103036 - RNA, 16 nt, Streptococcus pneumoniae R6
ugauacugaucaaaaa

SEQ ID NO: 4103037 - RNA, 18 nt, Streptococcus pneumoniae R6
ugauagaaucguuucuga

SEQ ID NO: 4103038 - RNA, 16 nt, Streptococcus pneumoniae R6
ugauagagcugauagu

SEQ ID NO: 4103039 - RNA, 13 nt, Streptococcus pneumoniae R6
ugauagaguagug

SEQ ID NO: 4103040 - RNA, 18 nt, Streptococcus pneumoniae R6
ugauagaguucguaguaa

SEQ ID NO: 4103041 - RNA, 22 nt, Streptococcus pneumoniae R6
ugauagccauucccaucaauau

SEQ ID NO: 4103042 - RNA, 17 nt, Streptococcus pneumoniae R6
ugauagccuuguauuca

SEQ ID NO: 4103043 - RNA, 19 nt, Streptococcus pneumoniae R6
ugauagcguucguucauau

SEQ ID NO: 4103044 - RNA, 20 nt, Streptococcus pneumoniae R6
ugauagcguucguucauaua

SEQ ID NO: 4103045 - RNA, 16 nt, Streptococcus pneumoniae R6
ugauaggagcuaugua

SEQ ID NO: 4103046 - RNA, 18 nt, Streptococcus pneumoniae R6
ugauaggaugcguuuuua

SEQ ID NO: 4103047 - RNA, 16 nt, Streptococcus pneumoniae R6
ugauauaauaaaaaga

SEQ ID NO: 4103048 - RNA, 20 nt, Streptococcus pneumoniae R6
ugauauacacacuuaaauug

SEQ ID NO: 4103049 - RNA, 23 nt, Streptococcus pneumoniae R6
ugauauagucuauugaaguuaga

SEQ ID NO: 4103050 - RNA, 23 nt, Streptococcus pneumoniae R6
ugauauauaguagacugaaucug

SEQ ID NO: 4103051 - RNA, 13 nt, Streptococcus pneumoniae R6
ugauaucaccauc

SEQ ID NO: 4103052 - RNA, 20 nt, Streptococcus pneumoniae R6
ugauauccugucuauacacg

SEQ ID NO: 4103053 - RNA, 14 nt, Streptococcus pneumoniae R6
ugauaucugguugc

SEQ ID NO: 4103054 - RNA, 13 nt, Streptococcus pneumoniae R6
ugauaucuuuaga

SEQ ID NO: 4103055 - RNA, 17 nt, Streptococcus pneumoniae R6
ugauaucuuugauuuua

SEQ ID NO: 4103056 - RNA, 16 nt, Streptococcus pneumoniae R6
ugauaugggauuuuca

SEQ ID NO: 4103057 - RNA, 19 nt, Streptococcus pneumoniae R6
ugauauugcaguauaucug

SEQ ID NO: 4103058 - RNA, 14 nt, Streptococcus pneumoniae R6
ugauauuuauagaa

SEQ ID NO: 4103059 - RNA, 21 nt, Streptococcus pneumoniae R6
ugauauuuauuuacauaauuu

SEQ ID NO: 4103060 - RNA, 15 nt, Streptococcus pneumoniae R6
ugaucaaaaaauuuc

SEQ ID NO: 4103061 - RNA, 22 nt, Streptococcus pneumoniae R6
ugaucaaucauguuaacccacu

SEQ ID NO: 4103062 - RNA, 14 nt, Streptococcus pneumoniae R6
ugaucagaccaguu

SEQ ID NO: 4103063 - RNA, 20 nt, Streptococcus pneumoniae R6
ugaucagaguuuugaaaacu

SEQ ID NO: 4103064 - RNA, 21 nt, Streptococcus pneumoniae R6
ugaucagaguuuugaaaacuu

SEQ ID NO: 4103065 - RNA, 17 nt, Streptococcus pneumoniae R6
ugaucccuccauuucau

SEQ ID NO: 4103066 - RNA, 22 nt, Streptococcus pneumoniae R6
ugaucccuccauuucauagcua

SEQ ID NO: 4103067 - RNA, 21 nt, Streptococcus pneumoniae R6
ugaucgaguuauuaacaaaag

SEQ ID NO: 4103068 - RNA, 17 nt, Streptococcus pneumoniae R6
ugaucuaaauguauugu

SEQ ID NO: 4103069 - RNA, 19 nt, Streptococcus pneumoniae R6
ugaucuauuguugcauuaa

SEQ ID NO: 4103070 - RNA, 18 nt, Streptococcus pneumoniae R6
ugaucuuaaauuuucgag

SEQ ID NO: 4103071 - RNA, 19 nt, Streptococcus pneumoniae R6
ugaucuuccauuucuuuug

SEQ ID NO: 4103072 - RNA, 12 nt, Streptococcus pneumoniae R6
ugaugaaaaaaa

SEQ ID NO: 4103073 - RNA, 14 nt, Streptococcus pneumoniae R6
ugaugaaaaaaagu

SEQ ID NO: 4103074 - RNA, 21 nt, Streptococcus pneumoniae R6
ugaugaaaaaaaguuuaaaaa

SEQ ID NO: 4103075 - RNA, 18 nt, Streptococcus pneumoniae R6
ugaugaaccuucaucaaa

SEQ ID NO: 4103076 - RNA, 17 nt, Streptococcus pneumoniae R6
ugaugaacggagauagu

SEQ ID NO: 4103077 - RNA, 21 nt, Streptococcus pneumoniae R6
ugaugaagggcuuuucuauca

SEQ ID NO: 4103078 - RNA, 16 nt, Streptococcus pneumoniae R6
ugaugagagaucuaga

SEQ ID NO: 4103079 - RNA, 22 nt, Streptococcus pneumoniae R6
ugaugauaacgaauccaacucu

SEQ ID NO: 4103080 - RNA, 14 nt, Streptococcus pneumoniae R6
ugaugauucaagga

SEQ ID NO: 4103081 - RNA, 22 nt, Streptococcus pneumoniae R6
ugaugcaagauauucauuaagu

SEQ ID NO: 4103082 - RNA, 12 nt, Streptococcus pneumoniae R6
ugaugcugcauu

SEQ ID NO: 4103083 - RNA, 11 nt, Streptococcus pneumoniae R6
ugauggaagac

SEQ ID NO: 4103084 - RNA, 14 nt, Streptococcus pneumoniae R6
ugauggaagacuga

SEQ ID NO: 4103085 - RNA, 23 nt, Streptococcus pneumoniae R6
ugauguaacuguuuuaggaacaa

SEQ ID NO: 4103086 - RNA, 21 nt, Streptococcus pneumoniae R6
ugaugucuuggauuuuugauu

SEQ ID NO: 4103087 - RNA, 16 nt, Streptococcus pneumoniae R6
ugauguuaucaaaucg

SEQ ID NO: 4103088 - RNA, 23 nt, Streptococcus pneumoniae R6
ugauuaagaagucaucuaucaaa

SEQ ID NO: 4103089 - RNA, 23 nt, Streptococcus pneumoniae R6
ugauuacaugaugugaagaacau

SEQ ID NO: 4103090 - RNA, 23 nt, Streptococcus pneumoniae R6
ugauuagaaauagggauuaauaa

SEQ ID NO: 4103091 - RNA, 20 nt, Streptococcus pneumoniae R6
ugauuaggaaauucaaauga

SEQ ID NO: 4103092 - RNA, 22 nt, Streptococcus pneumoniae R6
ugauuaggaaauucaaaugaau

SEQ ID NO: 4103093 - RNA, 11 nt, Streptococcus pneumoniae R6
ugauuaggaga

SEQ ID NO: 4103094 - RNA, 19 nt, Streptococcus pneumoniae R6
ugauuaggagauucuuaua

SEQ ID NO: 4103095 - RNA, 16 nt, Streptococcus pneumoniae R6
ugauuaggauuuuuua

SEQ ID NO: 4103096 - RNA, 20 nt, Streptococcus pneumoniae R6
ugauuauguuuuaaauaaac

SEQ ID NO: 4103097 - RNA, 21 nt, Streptococcus pneumoniae R6
ugauucaaggaguugucuaua

SEQ ID NO: 4103098 - RNA, 23 nt, Streptococcus pneumoniae R6
ugauucaguaacguuagcaaaga

SEQ ID NO: 4103099 - RNA, 15 nt, Streptococcus pneumoniae R6
ugauucaugacaucu

SEQ ID NO: 4103100 - RNA, 17 nt, Streptococcus pneumoniae R6
ugauucgcuauucuucu

SEQ ID NO: 4103101 - RNA, 19 nt, Streptococcus pneumoniae R6
ugauugacaccacuuuugg

SEQ ID NO: 4103102 - RNA, 21 nt, Streptococcus pneumoniae R6
ugauuggaaugacgaaacgaa

SEQ ID NO: 4103103 - RNA, 19 nt, Streptococcus pneumoniae R6
ugauuggagauacuuuuuu

SEQ ID NO: 4103104 - RNA, 19 nt, Streptococcus pneumoniae R6
ugauuggugucaaaaagga

SEQ ID NO: 4103105 - RNA, 15 nt, Streptococcus pneumoniae R6
ugauuguuuuuaaag

SEQ ID NO: 4103106 - RNA, 13 nt, Streptococcus pneumoniae R6
ugauuuaaauguu

SEQ ID NO: 4103107 - RNA, 20 nt, Streptococcus pneumoniae R6
ugauuuaaauguuuucucau

SEQ ID NO: 4103108 - RNA, 22 nt, Streptococcus pneumoniae R6
ugauuuaccauuuucguccaag

SEQ ID NO: 4103109 - RNA, 12 nt, Streptococcus pneumoniae R6
ugauuuauagaa

SEQ ID NO: 4103110 - RNA, 17 nt, Streptococcus pneumoniae R6
ugauuuauagaaauguu

SEQ ID NO: 4103111 - RNA, 21 nt, Streptococcus pneumoniae R6
ugauuuauagaaauguuuuag

SEQ ID NO: 4103112 - RNA, 14 nt, Streptococcus pneumoniae R6
ugauuuauuuguuu

SEQ ID NO: 4103113 - RNA, 15 nt, Streptococcus pneumoniae R6
ugauuucaaguaaaa

SEQ ID NO: 4103114 - RNA, 16 nt, Streptococcus pneumoniae R6
ugauuucaaguaaaau

SEQ ID NO: 4103115 - RNA, 11 nt, Streptococcus pneumoniae R6
ugccagccuua

SEQ ID NO: 4103116 - RNA, 15 nt, Streptococcus pneumoniae R6
ugccaguucuucaug

SEQ ID NO: 4103117 - RNA, 20 nt, Streptococcus pneumoniae R6
ugccaucuagacuaggguuu

SEQ ID NO: 4103118 - RNA, 22 nt, Streptococcus pneumoniae R6
ugccaugagcgucuuucuuauc

SEQ ID NO: 4103119 - RNA, 14 nt, Streptococcus pneumoniae R6
ugccaugcugacga

SEQ ID NO: 4103120 - RNA, 16 nt, Streptococcus pneumoniae R6
ugccaugguuucaucu

SEQ ID NO: 4103121 - RNA, 17 nt, Streptococcus pneumoniae R6
ugccaugguuucaucuu

SEQ ID NO: 4103122 - RNA, 14 nt, Streptococcus pneumoniae R6
ugccauugguguuu

SEQ ID NO: 4103123 - RNA, 18 nt, Streptococcus pneumoniae R6
ugccauugguguuugguu

SEQ ID NO: 4103124 - RNA, 12 nt, Streptococcus pneumoniae R6
ugcccaagagac

SEQ ID NO: 4103125 - RNA, 14 nt, Streptococcus pneumoniae R6
ugcccacuaaaaau

SEQ ID NO: 4103126 - RNA, 19 nt, Streptococcus pneumoniae R6
ugcccauaagcugaucaau

SEQ ID NO: 4103127 - RNA, 22 nt, Streptococcus pneumoniae R6
ugccccccaaaaguuagacaaa

SEQ ID NO: 4103128 - RNA, 21 nt, Streptococcus pneumoniae R6
ugcccugaaaucccauaguag

SEQ ID NO: 4103129 - RNA, 13 nt, Streptococcus pneumoniae R6
ugcccuucuagag

SEQ ID NO: 4103130 - RNA, 13 nt, Streptococcus pneumoniae R6
ugcccuuuuuugu

SEQ ID NO: 4103131 - RNA, 17 nt, Streptococcus pneumoniae R6
ugccgccaccuccgccu

SEQ ID NO: 4103132 - RNA, 23 nt, Streptococcus pneumoniae R6
ugccgccaccuccgccuccagag

SEQ ID NO: 4103133 - RNA, 14 nt, Streptococcus pneumoniae R6
ugccgcuccuuuau

SEQ ID NO: 4103134 - RNA, 21 nt, Streptococcus pneumoniae R6
ugccguccuuguaaagacuag

SEQ ID NO: 4103135 - RNA, 22 nt, Streptococcus pneumoniae R6
ugccuaauacaugcaaguagaa

SEQ ID NO: 4103136 - RNA, 18 nt, Streptococcus pneumoniae R6
ugccuaauuuuucaauau

SEQ ID NO: 4103137 - RNA, 19 nt, Streptococcus pneumoniae R6
ugccuagcgauuuccauug

SEQ ID NO: 4103138 - RNA, 14 nt, Streptococcus pneumoniae R6
ugccuaugaaauga

SEQ ID NO: 4103139 - RNA, 12 nt, Streptococcus pneumoniae R6
ugccucaauauc

SEQ ID NO: 4103140 - RNA, 15 nt, Streptococcus pneumoniae R6
ugccucaauccuuuu

SEQ ID NO: 4103141 - RNA, 18 nt, Streptococcus pneumoniae R6
ugccucagauucugacaa

SEQ ID NO: 4103142 - RNA, 23 nt, Streptococcus pneumoniae R6
ugccucagauucugacaauccac

SEQ ID NO: 4103143 - RNA, 13 nt, Streptococcus pneumoniae R6
ugccucauuagua

SEQ ID NO: 4103144 - RNA, 11 nt, Streptococcus pneumoniae R6
ugccugacaau

SEQ ID NO: 4103145 - RNA, 17 nt, Streptococcus pneumoniae R6
ugccuucaaucuuuugc

SEQ ID NO: 4103146 - RNA, 19 nt, Streptococcus pneumoniae R6
ugccuugaccaaucaaucg

SEQ ID NO: 4103147 - RNA, 20 nt, Streptococcus pneumoniae R6
ugccuugcaggauuuuugcu

SEQ ID NO: 4103148 - RNA, 21 nt, Streptococcus pneumoniae R6
ugccuuuuucaaucaauguca

SEQ ID NO: 4103149 - RNA, 16 nt, Streptococcus pneumoniae R6
ugcgaacuagcuaacu

SEQ ID NO: 4103150 - RNA, 16 nt, Streptococcus pneumoniae R6
ugcgacuacuaguucu

SEQ ID NO: 4103151 - RNA, 15 nt, Streptococcus pneumoniae R6
ugcgagacaaaaaaa

SEQ ID NO: 4103152 - RNA, 18 nt, Streptococcus pneumoniae R6
ugcgagacaaaaaaaaca

SEQ ID NO: 4103153 - RNA, 12 nt, Streptococcus pneumoniae R6
ugcgagccucuu

SEQ ID NO: 4103154 - RNA, 22 nt, Streptococcus pneumoniae R6
ugcgaguugcauagcgaagaac

SEQ ID NO: 4103155 - RNA, 20 nt, Streptococcus pneumoniae R6
ugcgaguugugaauuucauu

SEQ ID NO: 4103156 - RNA, 21 nt, Streptococcus pneumoniae R6
ugcgaguugugaauuucauua

SEQ ID NO: 4103157 - RNA, 22 nt, Streptococcus pneumoniae R6
ugcgauaaagcuaaagaugaug

SEQ ID NO: 4103158 - RNA, 20 nt, Streptococcus pneumoniae R6
ugcgauacgaucugaaauaa

SEQ ID NO: 4103159 - RNA, 21 nt, Streptococcus pneumoniae R6
ugcgauacgaucugaaauaaa

SEQ ID NO: 4103160 - RNA, 13 nt, Streptococcus pneumoniae R6
ugcgaugaugagg

SEQ ID NO: 4103161 - RNA, 22 nt, Streptococcus pneumoniae R6
ugcgauuuuuguguuuuuucuu

SEQ ID NO: 4103162 - RNA, 23 nt, Streptococcus pneumoniae R6
ugcgcaacacacuguuuugaggu

SEQ ID NO: 4103163 - RNA, 20 nt, Streptococcus pneumoniae R6
ugcgcaagguuguuagauua

SEQ ID NO: 4103164 - RNA, 15 nt, Streptococcus pneumoniae R6
ugcgcgugguccaga

SEQ ID NO: 4103165 - RNA, 16 nt, Streptococcus pneumoniae R6
ugcgcgugguccagau

SEQ ID NO: 4103166 - RNA, 14 nt, Streptococcus pneumoniae R6
ugcgcucaagcacc

SEQ ID NO: 4103167 - RNA, 18 nt, Streptococcus pneumoniae R6
ugcgcuugauaaccuuaa

SEQ ID NO: 4103168 - RNA, 15 nt, Streptococcus pneumoniae R6
ugcggaccaaauccc

SEQ ID NO: 4103169 - RNA, 21 nt, Streptococcus pneumoniae R6
ugcggacggucuuuggaaaua

SEQ ID NO: 4103170 - RNA, 17 nt, Streptococcus pneumoniae R6
ugcggauaaaagagaau

SEQ ID NO: 4103171 - RNA, 12 nt, Streptococcus pneumoniae R6
ugcggauaaacc

SEQ ID NO: 4103172 - RNA, 14 nt, Streptococcus pneumoniae R6
ugcguuaaaaguua

SEQ ID NO: 4103173 - RNA, 14 nt, Streptococcus pneumoniae R6
ugcguucaccagga

SEQ ID NO: 4103174 - RNA, 19 nt, Streptococcus pneumoniae R6
ugcguuucagcauauuucc

SEQ ID NO: 4103175 - RNA, 19 nt, Streptococcus pneumoniae R6
ugcguuuuugccucaauau

SEQ ID NO: 4103176 - RNA, 18 nt, Streptococcus pneumoniae R6
ugcguuuuugugauuuua

SEQ ID NO: 4103177 - RNA, 21 nt, Streptococcus pneumoniae R6
ugcguuuuuucugauuucaaa

SEQ ID NO: 4103178 - RNA, 18 nt, Streptococcus pneumoniae R6
ugcguuuuuuugauuuua

SEQ ID NO: 4103179 - RNA, 18 nt, Streptococcus pneumoniae R6
ugcuaaaagauuucuaua

SEQ ID NO: 4103180 - RNA, 13 nt, Streptococcus pneumoniae R6
ugcuaacugcugg

SEQ ID NO: 4103181 - RNA, 20 nt, Streptococcus pneumoniae R6
ugcuaaguccuugaugcucu

SEQ ID NO: 4103182 - RNA, 17 nt, Streptococcus pneumoniae R6
ugcuaccguugaaauca

SEQ ID NO: 4103183 - RNA, 19 nt, Streptococcus pneumoniae R6
ugcuaccguugaaaucaau

SEQ ID NO: 4103184 - RNA, 22 nt, Streptococcus pneumoniae R6
ugcuacgacacuauuuacaagu

SEQ ID NO: 4103185 - RNA, 17 nt, Streptococcus pneumoniae R6
ugcuacugcauccaaca

SEQ ID NO: 4103186 - RNA, 22 nt, Streptococcus pneumoniae R6
ugcuagacgaccauugucacaa

SEQ ID NO: 4103187 - RNA, 14 nt, Streptococcus pneumoniae R6
ugcuagacuaacuu

SEQ ID NO: 4103188 - RNA, 13 nt, Streptococcus pneumoniae R6
ugcuagcaucauc

SEQ ID NO: 4103189 - RNA, 18 nt, Streptococcus pneumoniae R6
ugcuaggcugauuccugg

SEQ ID NO: 4103190 - RNA, 20 nt, Streptococcus pneumoniae R6
ugcuauacuguaguuaugaa

SEQ ID NO: 4103191 - RNA, 22 nt, Streptococcus pneumoniae R6
ugcuauaucuuauuuuucuauu

SEQ ID NO: 4103192 - RNA, 12 nt, Streptococcus pneumoniae R6
ugcuauucuaaa

SEQ ID NO: 4103193 - RNA, 14 nt, Streptococcus pneumoniae R6
ugcuauucuaaauu

SEQ ID NO: 4103194 - RNA, 16 nt, Streptococcus pneumoniae R6
ugcuauugcuuuuaga

SEQ ID NO: 4103195 - RNA, 18 nt, Streptococcus pneumoniae R6
ugcuauugcuuuuagaga

SEQ ID NO: 4103196 - RNA, 20 nt, Streptococcus pneumoniae R6
ugcuauugcuuuuagagauu

SEQ ID NO: 4103197 - RNA, 11 nt, Streptococcus pneumoniae R6
ugcuauuucua

SEQ ID NO: 4103198 - RNA, 12 nt, Streptococcus pneumoniae R6
ugcucaaaacac

SEQ ID NO: 4103199 - RNA, 13 nt, Streptococcus pneumoniae R6
ugcucaaaacacu

SEQ ID NO: 4103200 - RNA, 17 nt, Streptococcus pneumoniae R6
ugcucaaaacacuguuu

SEQ ID NO: 4103201 - RNA, 19 nt, Streptococcus pneumoniae R6
ugcucaaaacacuguuuua

SEQ ID NO: 4103202 - RNA, 13 nt, Streptococcus pneumoniae R6
ugcucaaaguacu

SEQ ID NO: 4103203 - RNA, 18 nt, Streptococcus pneumoniae R6
ugcucaaucaauccaaag

SEQ ID NO: 4103204 - RNA, 16 nt, Streptococcus pneumoniae R6
ugcucaaucuuaucaa

SEQ ID NO: 4103205 - RNA, 22 nt, Streptococcus pneumoniae R6
ugcucaaucuuaucaaucaaac

SEQ ID NO: 4103206 - RNA, 20 nt, Streptococcus pneumoniae R6
ugcucacagaguagaaguug

SEQ ID NO: 4103207 - RNA, 23 nt, Streptococcus pneumoniae R6
ugcucagcauucucaaugauuug

SEQ ID NO: 4103208 - RNA, 15 nt, Streptococcus pneumoniae R6
ugcuccaagucagca

SEQ ID NO: 4103209 - RNA, 18 nt, Streptococcus pneumoniae R6
ugcuccaauacaaauugu

SEQ ID NO: 4103210 - RNA, 14 nt, Streptococcus pneumoniae R6
ugcucccauuuuug

SEQ ID NO: 4103211 - RNA, 16 nt, Streptococcus pneumoniae R6
ugcuccgcggugcaau

SEQ ID NO: 4103212 - RNA, 13 nt, Streptococcus pneumoniae R6
ugcucgaccaagc

SEQ ID NO: 4103213 - RNA, 20 nt, Streptococcus pneumoniae R6
ugcucggcuuuuuguuuucu

SEQ ID NO: 4103214 - RNA, 15 nt, Streptococcus pneumoniae R6
ugcucgguaaaacau

SEQ ID NO: 4103215 - RNA, 24 nt, Streptococcus pneumoniae R6
ugcucgugauguuaaaaugagucu

SEQ ID NO: 4103216 - RNA, 13 nt, Streptococcus pneumoniae R6
ugcucuaugauuu

SEQ ID NO: 4103217 - RNA, 15 nt, Streptococcus pneumoniae R6
ugcucuaugauuuuc

SEQ ID NO: 4103218 - RNA, 21 nt, Streptococcus pneumoniae R6
uggaguucuuuucauuguuuu

SEQ ID NO: 4103219 - RNA, 11 nt, Streptococcus pneumoniae R6
uggauaaaauc

SEQ ID NO: 4103220 - RNA, 22 nt, Streptococcus pneumoniae R6
uggauaaaguuaugaaaaagau

SEQ ID NO: 4103221 - RNA, 14 nt, Streptococcus pneumoniae R6
uggauaauuucuuu

SEQ ID NO: 4103222 - RNA, 14 nt, Streptococcus pneumoniae R6
uggauaccuuuaga

SEQ ID NO: 4103223 - RNA, 16 nt, Streptococcus pneumoniae R6
uggauacgacgauucc

SEQ ID NO: 4103224 - RNA, 23 nt, Streptococcus pneumoniae R6
uggauacuguauuuuuuuugguu

SEQ ID NO: 4103225 - RNA, 21 nt, Streptococcus pneumoniae R6
uggauacuuaacuuuguauaa

SEQ ID NO: 4103226 - RNA, 15 nt, Streptococcus pneumoniae R6
uggauagaacugacg

SEQ ID NO: 4103227 - RNA, 18 nt, Streptococcus pneumoniae R6
uggauauaacaacucccu

SEQ ID NO: 4103228 - RNA, 20 nt, Streptococcus pneumoniae R6
uggauauaacaacucccucc

SEQ ID NO: 4103229 - RNA, 18 nt, Streptococcus pneumoniae R6
uggauauugaguaauucc

SEQ ID NO: 4103230 - RNA, 12 nt, Streptococcus pneumoniae R6
uggaucaugacu

SEQ ID NO: 4103231 - RNA, 16 nt, Streptococcus pneumoniae R6
uggaucauuucuucug

SEQ ID NO: 4103232 - RNA, 16 nt, Streptococcus pneumoniae R6
uggaucuacuuuuuuc

SEQ ID NO: 4103233 - RNA, 14 nt, Streptococcus pneumoniae R6
uggaucuagauagu

SEQ ID NO: 4103234 - RNA, 17 nt, Streptococcus pneumoniae R6
uggaucuagauaguacc

SEQ ID NO: 4103235 - RNA, 23 nt, Streptococcus pneumoniae R6
uggaucuuagguugguugcuucc

SEQ ID NO: 4103236 - RNA, 13 nt, Streptococcus pneumoniae R6
uggaugauucuuu

SEQ ID NO: 4103237 - RNA, 15 nt, Streptococcus pneumoniae R6
uggaugauucuuuuc

SEQ ID NO: 4103238 - RNA, 15 nt, Streptococcus pneumoniae R6
uggaugauuuaauua

SEQ ID NO: 4103239 - RNA, 22 nt, Streptococcus pneumoniae R6
uggaugauuuaauuagaaaaaa

SEQ ID NO: 4103240 - RNA, 14 nt, Streptococcus pneumoniae R6
uggaugcaauuuuu

SEQ ID NO: 4103241 - RNA, 14 nt, Streptococcus pneumoniae R6
uggaugccauugga

SEQ ID NO: 4103242 - RNA, 19 nt, Streptococcus pneumoniae R6
uggaugcccguacuuacca

SEQ ID NO: 4103243 - RNA, 15 nt, Streptococcus pneumoniae R6
uggaugucauuccaa

SEQ ID NO: 4103244 - RNA, 20 nt, Streptococcus pneumoniae R6
uggauuauauaugugacuga

SEQ ID NO: 4103245 - RNA, 15 nt, Streptococcus pneumoniae R6
uggauuaugauuuaa

SEQ ID NO: 4103246 - RNA, 18 nt, Streptococcus pneumoniae R6
uggauugauacucuucga

SEQ ID NO: 4103247 - RNA, 16 nt, Streptococcus pneumoniae R6
uggauugauugagaaa

SEQ ID NO: 4103248 - RNA, 21 nt, Streptococcus pneumoniae R6
uggauuguauagugaauugaa

SEQ ID NO: 4103249 - RNA, 21 nt, Streptococcus pneumoniae R6
uggauuuccacuaaagguuga

SEQ ID NO: 4103250 - RNA, 19 nt, Streptococcus pneumoniae R6
uggauuucuuuagucccau

SEQ ID NO: 4103251 - RNA, 16 nt, Streptococcus pneumoniae R6
uggauuuuaagcucca

SEQ ID NO: 4103252 - RNA, 22 nt, Streptococcus pneumoniae R6
uggauuuucugaaguuccucuu

SEQ ID NO: 4103253 - RNA, 13 nt, Streptococcus pneumoniae R6
uggauuuuucuua

SEQ ID NO: 4103254 - RNA, 18 nt, Streptococcus pneumoniae R6
uggauuuuucuucuuuuc

SEQ ID NO: 4103255 - RNA, 20 nt, Streptococcus pneumoniae R6
uggcaaaaauaucauuaagu

SEQ ID NO: 4103256 - RNA, 13 nt, Streptococcus pneumoniae R6
uggcaaauugaua

SEQ ID NO: 4103257 - RNA, 19 nt, Streptococcus pneumoniae R6
uggcaaccaagucugcaug

SEQ ID NO: 4103258 - RNA, 12 nt, Streptococcus pneumoniae R6
uggcaagagcug

SEQ ID NO: 4103259 - RNA, 21 nt, Streptococcus pneumoniae R6
uggcaagaucaaguucaagau

SEQ ID NO: 4103260 - RNA, 22 nt, Streptococcus pneumoniae R6
uggcaaggaguaccguucauau

SEQ ID NO: 4103261 - RNA, 13 nt, Streptococcus pneumoniae R6
uggcaaucaaaau

SEQ ID NO: 4103262 - RNA, 14 nt, Streptococcus pneumoniae R6
uggcaauucaauua

SEQ ID NO: 4103263 - RNA, 22 nt, Streptococcus pneumoniae R6
uggcaauuuuacuucuucccca

SEQ ID NO: 4103264 - RNA, 20 nt, Streptococcus pneumoniae R6
uggcacaaaagguucuuuua

SEQ ID NO: 4103265 - RNA, 17 nt, Streptococcus pneumoniae R6
uggcaccgaauuuuuca

SEQ ID NO: 4103266 - RNA, 20 nt, Streptococcus pneumoniae R6
uggcacgccagucauuacca

SEQ ID NO: 4103267 - RNA, 18 nt, Streptococcus pneumoniae R6
uggcacguguaauggcug

SEQ ID NO: 4103268 - RNA, 16 nt, Streptococcus pneumoniae R6
uggcagagcuaaaaac

SEQ ID NO: 4103269 - RNA, 16 nt, Streptococcus pneumoniae R6
uggcaggucgguuuua

SEQ ID NO: 4103270 - RNA, 19 nt, Streptococcus pneumoniae R6
uggcaggucgguuuuauua

SEQ ID NO: 4103271 - RNA, 16 nt, Streptococcus pneumoniae R6
uggcauaagcaaucau

SEQ ID NO: 4103272 - RNA, 12 nt, Streptococcus pneumoniae R6
uggcauccccag

SEQ ID NO: 4103273 - RNA, 13 nt, Streptococcus pneumoniae R6
uggcauccccagc

SEQ ID NO: 4103274 - RNA, 23 nt, Streptococcus pneumoniae R6
uggcauggaaagcaucuccaucc

SEQ ID NO: 4103275 - RNA, 14 nt, Streptococcus pneumoniae R6
uggcauucaaaacg

SEQ ID NO: 4103276 - RNA, 16 nt, Streptococcus pneumoniae R6
uggccaacuucuuuuu

SEQ ID NO: 4103277 - RNA, 17 nt, Streptococcus pneumoniae R6
uggccaagguucauuuc

SEQ ID NO: 4103278 - RNA, 21 nt, Streptococcus pneumoniae R6
uggccaagguucauuucuucu

SEQ ID NO: 4103279 - RNA, 15 nt, Streptococcus pneumoniae R6
uggccacuucccaag

SEQ ID NO: 4103280 - RNA, 15 nt, Streptococcus pneumoniae R6
uggcccuaccugcuc

SEQ ID NO: 4103281 - RNA, 22 nt, Streptococcus pneumoniae R6
uggcccuaccugcuccaaauau

SEQ ID NO: 4103282 - RNA, 16 nt, Streptococcus pneumoniae R6
uggccgauaacagcca

SEQ ID NO: 4103283 - RNA, 16 nt, Streptococcus pneumoniae R6
uggccuguaguuucau

SEQ ID NO: 4103284 - RNA, 17 nt, Streptococcus pneumoniae R6
uggcgaaggucuuucaa

SEQ ID NO: 4103285 - RNA, 17 nt, Streptococcus pneumoniae R6
uggcgaguccuacgaac

SEQ ID NO: 4103286 - RNA, 22 nt, Streptococcus pneumoniae R6
uggcguaguaaaucaguccagu

SEQ ID NO: 4103287 - RNA, 18 nt, Streptococcus pneumoniae R6
uggcgugggucaucaagc

SEQ ID NO: 4103288 - RNA, 14 nt, Streptococcus pneumoniae R6
uggcguuggaauaa

SEQ ID NO: 4103289 - RNA, 17 nt, Streptococcus pneumoniae R6
uggcguuggaauaaggu

SEQ ID NO: 4103290 - RNA, 22 nt, Streptococcus pneumoniae R6
uggcuaaagaguugggugauga

SEQ ID NO: 4103291 - RNA, 13 nt, Streptococcus pneumoniae R6
uggcuaauaauuc

SEQ ID NO: 4103292 - RNA, 20 nt, Streptococcus pneumoniae R6
uggcuaggcgcuucacuagu

SEQ ID NO: 4103293 - RNA, 15 nt, Streptococcus pneumoniae R6
uggcuaguaaauauc

SEQ ID NO: 4103294 - RNA, 20 nt, Streptococcus pneumoniae R6
uggcuauaauuauucugcaa

SEQ ID NO: 4103295 - RNA, 15 nt, Streptococcus pneumoniae R6
uggcuauuuuuauug

SEQ ID NO: 4103296 - RNA, 23 nt, Streptococcus pneumoniae R6
uggcucauaucuggcauuccugc

SEQ ID NO: 4103297 - RNA, 15 nt, Streptococcus pneumoniae R6
uggcucaucugcaau

SEQ ID NO: 4103298 - RNA, 18 nt, Streptococcus pneumoniae R6
uggcucaucugcaauaac

SEQ ID NO: 4103299 - RNA, 16 nt, Streptococcus pneumoniae R6
uggcuccagaaauaau

SEQ ID NO: 4103300 - RNA, 19 nt, Streptococcus pneumoniae R6
uggcuccagaaauaauauc

SEQ ID NO: 4103301 - RNA, 19 nt, Streptococcus pneumoniae R6
uggcucguggcagaccaua

SEQ ID NO: 4103302 - RNA, 15 nt, Streptococcus pneumoniae R6
uggcugcgaaaaaug

SEQ ID NO: 4103303 - RNA, 22 nt, Streptococcus pneumoniae R6
uggcugcgaaaaaugcuggcgg

SEQ ID NO: 4103304 - RNA, 15 nt, Streptococcus pneumoniae R6
uggcugguauuaaga

SEQ ID NO: 4103305 - RNA, 14 nt, Streptococcus pneumoniae R6
uggcuuaucagucu

SEQ ID NO: 4103306 - RNA, 15 nt, Streptococcus pneumoniae R6
uggcuuaucagucuc

SEQ ID NO: 4103307 - RNA, 14 nt, Streptococcus pneumoniae R6
uggcuuccaguuug

SEQ ID NO: 4103308 - RNA, 23 nt, Streptococcus pneumoniae R6
uggcuugaggucccaugcuucca

SEQ ID NO: 4103309 - RNA, 15 nt, Streptococcus pneumoniae R6
uggcuugucuuuuuc

SEQ ID NO: 4103310 - RNA, 15 nt, Streptococcus pneumoniae R6
uggcuuucacguugu

SEQ ID NO: 4103311 - RNA, 12 nt, Streptococcus pneumoniae R6
uggcuuucuuuc

SEQ ID NO: 4103312 - RNA, 12 nt, Streptococcus pneumoniae R6
ugggaaaccaaa

SEQ ID NO: 4103313 - RNA, 13 nt, Streptococcus pneumoniae R6
ugggaaaguaaaa

SEQ ID NO: 4103314 - RNA, 23 nt, Streptococcus pneumoniae R6
ugggaaauaucgcguucgugcca

SEQ ID NO: 4103315 - RNA, 18 nt, Streptococcus pneumoniae R6
ugggaagaguugcuuguc

SEQ ID NO: 4103316 - RNA, 21 nt, Streptococcus pneumoniae R6
ugggaagauuuacuuccuuuu

SEQ ID NO: 4103317 - RNA, 19 nt, Streptococcus pneumoniae R6
ugggaagauuuacuucuuu

SEQ ID NO: 4103318 - RNA, 21 nt, Streptococcus pneumoniae R6
ugggaagauuuacuucuuuuu

SEQ ID NO: 4103319 - RNA, 23 nt, Streptococcus pneumoniae R6
ugggaagauuuacuucuuuuucu

SEQ ID NO: 4103320 - RNA, 12 nt, Streptococcus pneumoniae R6
ugggaccugucc

SEQ ID NO: 4103321 - RNA, 20 nt, Streptococcus pneumoniae R6
uguaaugacaauuauauaaa

SEQ ID NO: 4103322 - RNA, 21 nt, Streptococcus pneumoniae R6
uguaaugcguucaccaggagc

SEQ ID NO: 4103323 - RNA, 13 nt, Streptococcus pneumoniae R6
uguaauucucaag

SEQ ID NO: 4103324 - RNA, 19 nt, Streptococcus pneumoniae R6
uguaauuguuccauaugau

SEQ ID NO: 4103325 - RNA, 12 nt, Streptococcus pneumoniae R6
uguaauuugguu

SEQ ID NO: 4103326 - RNA, 18 nt, Streptococcus pneumoniae R6
uguacagcaaaaaauuau

SEQ ID NO: 4103327 - RNA, 20 nt, Streptococcus pneumoniae R6
uguacccaaguaaucugcac

SEQ ID NO: 4103328 - RNA, 22 nt, Streptococcus pneumoniae R6
uguacgcccccacccugguagg

SEQ ID NO: 4103329 - RNA, 20 nt, Streptococcus pneumoniae R6
uguacgguaaucaagugagu

SEQ ID NO: 4103330 - RNA, 18 nt, Streptococcus pneumoniae R6
uguacuagggcauuuuga

SEQ ID NO: 4103331 - RNA, 18 nt, Streptococcus pneumoniae R6
uguacuagucuaacuucu

SEQ ID NO: 4103332 - RNA, 23 nt, Streptococcus pneumoniae R6
uguacuauucuaguuucaauaua

SEQ ID NO: 4103333 - RNA, 18 nt, Streptococcus pneumoniae R6
uguacuguauacuuugca

SEQ ID NO: 4103334 - RNA, 15 nt, Streptococcus pneumoniae R6
uguacuguuauagau

SEQ ID NO: 4103335 - RNA, 16 nt, Streptococcus pneumoniae R6
uguacuguuauagauu

SEQ ID NO: 4103336 - RNA, 16 nt, Streptococcus pneumoniae R6
uguacuguucuaaauu

SEQ ID NO: 4103337 - RNA, 14 nt, Streptococcus pneumoniae R6
uguagaugaaacug

SEQ ID NO: 4103338 - RNA, 16 nt, Streptococcus pneumoniae R6
uguagaugaaacugac

SEQ ID NO: 4103339 - RNA, 19 nt, Streptococcus pneumoniae R6
uguagauguucuuugaaau

SEQ ID NO: 4103340 - RNA, 18 nt, Streptococcus pneumoniae R6
uguagccagugagaagaa

SEQ ID NO: 4103341 - RNA, 23 nt, Streptococcus pneumoniae R6
uguaggaaaccaaucucaaaucc

SEQ ID NO: 4103342 - RNA, 12 nt, Streptococcus pneumoniae R6
uguaggaaguuu

SEQ ID NO: 4103343 - RNA, 16 nt, Streptococcus pneumoniae R6
uguaggcuuucaacug

SEQ ID NO: 4103344 - RNA, 16 nt, Streptococcus pneumoniae R6
uguaggggauaaugag

SEQ ID NO: 4103345 - RNA, 21 nt, Streptococcus pneumoniae R6
uguagggggcauauaaauaca

SEQ ID NO: 4103346 - RNA, 13 nt, Streptococcus pneumoniae R6
uguaguaaaagaa

SEQ ID NO: 4103347 - RNA, 16 nt, Streptococcus pneumoniae R6
uguaguacugaacaau

SEQ ID NO: 4103348 - RNA, 23 nt, Streptococcus pneumoniae R6
uguaguagguuccgagauaaaag

SEQ ID NO: 4103349 - RNA, 16 nt, Streptococcus pneumoniae R6
uguagucaucaauauu

SEQ ID NO: 4103350 - RNA, 15 nt, Streptococcus pneumoniae R6
uguaguggguaggcg

SEQ ID NO: 4103351 - RNA, 15 nt, Streptococcus pneumoniae R6
uguaguggguugaaa

SEQ ID NO: 4103352 - RNA, 18 nt, Streptococcus pneumoniae R6
uguaguggguugaagaaa

SEQ ID NO: 4103353 - RNA, 20 nt, Streptococcus pneumoniae R6
uguaguggguugaagucagc

SEQ ID NO: 4103354 - RNA, 16 nt, Streptococcus pneumoniae R6
uguaguuaguguauaa

SEQ ID NO: 4103355 - RNA, 20 nt, Streptococcus pneumoniae R6
uguauaaauagcuacaguca

SEQ ID NO: 4103356 - RNA, 23 nt, Streptococcus pneumoniae R6
uguauaauagguggauaaaaguc

SEQ ID NO: 4103357 - RNA, 20 nt, Streptococcus pneumoniae R6
uguauaauggauugaaauaa

SEQ ID NO: 4103358 - RNA, 18 nt, Streptococcus pneumoniae R6
uguauaggucuggcuauu

SEQ ID NO: 4103359 - RNA, 16 nt, Streptococcus pneumoniae R6
uguauagugaauugaa

SEQ ID NO: 4103360 - RNA, 18 nt, Streptococcus pneumoniae R6
uguauaugaagauucugu

SEQ ID NO: 4103361 - RNA, 18 nt, Streptococcus pneumoniae R6
uguauauuuuucaaauaa

SEQ ID NO: 4103362 - RNA, 12 nt, Streptococcus pneumoniae R6
uguaucaagaua

SEQ ID NO: 4103363 - RNA, 21 nt, Streptococcus pneumoniae R6
uguaucaccaagcauuuucau

SEQ ID NO: 4103364 - RNA, 16 nt, Streptococcus pneumoniae R6
uguauccaaucucuug

SEQ ID NO: 4103365 - RNA, 22 nt, Streptococcus pneumoniae R6
uguauccuaaaucauuauagaa

SEQ ID NO: 4103366 - RNA, 18 nt, Streptococcus pneumoniae R6
uguauccugaaaagccac

SEQ ID NO: 4103367 - RNA, 17 nt, Streptococcus pneumoniae R6
uguaucgaaacauucaa

SEQ ID NO: 4103368 - RNA, 16 nt, Streptococcus pneumoniae R6
uguaucgccucuucaa

SEQ ID NO: 4103369 - RNA, 15 nt, Streptococcus pneumoniae R6
uguaucugucguuag

SEQ ID NO: 4103370 - RNA, 12 nt, Streptococcus pneumoniae R6
uguaucuuccuu

SEQ ID NO: 4103371 - RNA, 19 nt, Streptococcus pneumoniae R6
uguaugacaucuugaaguu

SEQ ID NO: 4103372 - RNA, 18 nt, Streptococcus pneumoniae R6
uguaugugcauaguauuu

SEQ ID NO: 4103373 - RNA, 22 nt, Streptococcus pneumoniae R6
uguaugugcauaguauuuguua

SEQ ID NO: 4103374 - RNA, 21 nt, Streptococcus pneumoniae R6
uguauucauugaaaaaauauc

SEQ ID NO: 4103375 - RNA, 20 nt, Streptococcus pneumoniae R6
uguauugguaacaaaaauac

SEQ ID NO: 4103376 - RNA, 15 nt, Streptococcus pneumoniae R6
uguauuguuuuauuu

SEQ ID NO: 4103377 - RNA, 15 nt, Streptococcus pneumoniae R6
uguauuuagacucuu

SEQ ID NO: 4103378 - RNA, 22 nt, Streptococcus pneumoniae R6
uguauuucuucuucugaagcau

SEQ ID NO: 4103379 - RNA, 19 nt, Streptococcus pneumoniae R6
uguauuuugaauauaccuu

SEQ ID NO: 4103380 - RNA, 19 nt, Streptococcus pneumoniae R6
ugucaaagaguugaggcaa

SEQ ID NO: 4103381 - RNA, 18 nt, Streptococcus pneumoniae R6
ugucaaaucaaaaucacg

SEQ ID NO: 4103382 - RNA, 20 nt, Streptococcus pneumoniae R6
ugucaaaucaaaaucacgug

SEQ ID NO: 4103383 - RNA, 16 nt, Streptococcus pneumoniae R6
ugucaagucuugcucu

SEQ ID NO: 4103384 - RNA, 15 nt, Streptococcus pneumoniae R6
ugucaauuuccauuu

SEQ ID NO: 4103385 - RNA, 18 nt, Streptococcus pneumoniae R6
ugucacaaaggauagaca

SEQ ID NO: 4103386 - RNA, 14 nt, Streptococcus pneumoniae R6
ugucaccaaacaaa

SEQ ID NO: 4103387 - RNA, 22 nt, Streptococcus pneumoniae R6
ugucacgaaccacacuuucauu

SEQ ID NO: 4103388 - RNA, 23 nt, Streptococcus pneumoniae R6
ugucacgaaccacacuuucauug

SEQ ID NO: 4103389 - RNA, 20 nt, Streptococcus pneumoniae R6
ugucacucgggcaauuggaa

SEQ ID NO: 4103390 - RNA, 15 nt, Streptococcus pneumoniae R6
ugucaguaaaaaaaa

SEQ ID NO: 4103391 - RNA, 23 nt, Streptococcus pneumoniae R6
ugucaguaaaaaaaacauauauu

SEQ ID NO: 4103392 - RNA, 12 nt, Streptococcus pneumoniae R6
ugucagugacag

SEQ ID NO: 4103393 - RNA, 13 nt, Streptococcus pneumoniae R6
ugucauaaucugu

SEQ ID NO: 4103394 - RNA, 21 nt, Streptococcus pneumoniae R6
ugucauaauugaguugggaua

SEQ ID NO: 4103395 - RNA, 23 nt, Streptococcus pneumoniae R6
ugucaucaucuugcuaaaaaaag

SEQ ID NO: 4103396 - RNA, 21 nt, Streptococcus pneumoniae R6
ugucauccuuacggucaaagu

SEQ ID NO: 4103397 - RNA, 23 nt, Streptococcus pneumoniae R6
ugucauccuuacggucaaaguca

SEQ ID NO: 4103398 - RNA, 13 nt, Streptococcus pneumoniae R6
ugucaucuuccaa

SEQ ID NO: 4103399 - RNA, 16 nt, Streptococcus pneumoniae R6
ugucauguuagaaaaa

SEQ ID NO: 4103400 - RNA, 17 nt, Streptococcus pneumoniae R6
ugucauguuagaaaaau

SEQ ID NO: 4103401 - RNA, 20 nt, Streptococcus pneumoniae R6
ugucauuccaauucugcuuu

SEQ ID NO: 4103402 - RNA, 15 nt, Streptococcus pneumoniae R6
ugucauuuuuuccaa

SEQ ID NO: 4103403 - RNA, 21 nt, Streptococcus pneumoniae R6
ugucauuuuuuccaauucuuc

SEQ ID NO: 4103404 - RNA, 19 nt, Streptococcus pneumoniae R6
ugucccaucauuucuucaa

SEQ ID NO: 4103405 - RNA, 18 nt, Streptococcus pneumoniae R6
uguccgaguguuuccuuc

SEQ ID NO: 4103406 - RNA, 22 nt, Streptococcus pneumoniae R6
uguccgccagauaaggagcgaa

SEQ ID NO: 4103407 - RNA, 14 nt, Streptococcus pneumoniae R6
uguccguuuucauc

SEQ ID NO: 4103408 - RNA, 14 nt, Streptococcus pneumoniae R6
uguccuauucuugu

SEQ ID NO: 4103409 - RNA, 22 nt, Streptococcus pneumoniae R6
uguccucaauaaguccgaaaaa

SEQ ID NO: 4103410 - RNA, 22 nt, Streptococcus pneumoniae R6
uguccucaaugaauccgaaaaa

SEQ ID NO: 4103411 - RNA, 18 nt, Streptococcus pneumoniae R6
uguccugaaugauuucuu

SEQ ID NO: 4103412 - RNA, 13 nt, Streptococcus pneumoniae R6
uguccugauuggu

SEQ ID NO: 4103413 - RNA, 15 nt, Streptococcus pneumoniae R6
uguccuggauagaca

SEQ ID NO: 4103414 - RNA, 17 nt, Streptococcus pneumoniae R6
uguccuggauagacauc

SEQ ID NO: 4103415 - RNA, 18 nt, Streptococcus pneumoniae R6
uguccuggucuuauuuca

SEQ ID NO: 4103416 - RNA, 19 nt, Streptococcus pneumoniae R6
uguccuguguaagugacaa

SEQ ID NO: 4103417 - RNA, 15 nt, Streptococcus pneumoniae R6
uguccuucuuuuacu

SEQ ID NO: 4103418 - RNA, 16 nt, Streptococcus pneumoniae R6
uguccuugauagcaga

SEQ ID NO: 4103419 - RNA, 21 nt, Streptococcus pneumoniae R6
uguccuuuagaaagguuuuaa

SEQ ID NO: 4103420 - RNA, 21 nt, Streptococcus pneumoniae R6
uguccuuucucgagcuuagcu

SEQ ID NO: 4103421 - RNA, 16 nt, Streptococcus pneumoniae R6
ugucgauugugauagc

SEQ ID NO: 4103422 - RNA, 14 nt, Streptococcus pneumoniae R6
ugucguugaaugaa

SEQ ID NO: 4103423 - RNA, 20 nt, Streptococcus pneumoniae R6
uguuccgauuuuauuucauu

SEQ ID NO: 4103424 - RNA, 21 nt, Streptococcus pneumoniae R6
uguucuaaaauaaguucuguu

SEQ ID NO: 4103425 - RNA, 17 nt, Streptococcus pneumoniae R6
uguucuaagguuucaaa

SEQ ID NO: 4103426 - RNA, 19 nt, Streptococcus pneumoniae R6
uguucuaagguuucaaaac

SEQ ID NO: 4103427 - RNA, 14 nt, Streptococcus pneumoniae R6
uguucuaaguuggg

SEQ ID NO: 4103428 - RNA, 11 nt, Streptococcus pneumoniae R6
uguucuaucac

SEQ ID NO: 4103429 - RNA, 16 nt, Streptococcus pneumoniae R6
uguucuaugaguaugu

SEQ ID NO: 4103430 - RNA, 22 nt, Streptococcus pneumoniae R6
uguucucaaccuugcuucuuuc

SEQ ID NO: 4103431 - RNA, 16 nt, Streptococcus pneumoniae R6
uguucugccuauuuuu

SEQ ID NO: 4103432 - RNA, 20 nt, Streptococcus pneumoniae R6
uguucugucuguucucugag

SEQ ID NO: 4103433 - RNA, 15 nt, Streptococcus pneumoniae R6
uguucuguucuuauu

SEQ ID NO: 4103434 - RNA, 20 nt, Streptococcus pneumoniae R6
uguucuguucuuauuucauu

SEQ ID NO: 4103435 - RNA, 20 nt, Streptococcus pneumoniae R6
uguucuuguuucaauugacu

SEQ ID NO: 4103436 - RNA, 20 nt, Streptococcus pneumoniae R6
uguucuuguuuugacauugu

SEQ ID NO: 4103437 - RNA, 14 nt, Streptococcus pneumoniae R6
uguucuuuagaaag

SEQ ID NO: 4103438 - RNA, 14 nt, Streptococcus pneumoniae R6
uguucuuuuucaaa

SEQ ID NO: 4103439 - RNA, 16 nt, Streptococcus pneumoniae R6
uguucuuuuucaaaag

SEQ ID NO: 4103440 - RNA, 14 nt, Streptococcus pneumoniae R6
uguugaaugagcuu

SEQ ID NO: 4103441 - RNA, 16 nt, Streptococcus pneumoniae R6
uguugacuuguacuca

SEQ ID NO: 4103442 - RNA, 17 nt, Streptococcus pneumoniae R6
uguugagcauacugccc

SEQ ID NO: 4103443 - RNA, 16 nt, Streptococcus pneumoniae R6
uguugauauuuccauc

SEQ ID NO: 4103444 - RNA, 13 nt, Streptococcus pneumoniae R6
uguugcauuaaaa

SEQ ID NO: 4103445 - RNA, 14 nt, Streptococcus pneumoniae R6
uguugcauuaaaaa

SEQ ID NO: 4103446 - RNA, 21 nt, Streptococcus pneumoniae R6
uguugcuagauuugucaaauu

SEQ ID NO: 4103447 - RNA, 13 nt, Streptococcus pneumoniae R6
uguugcugaaaug

SEQ ID NO: 4103448 - RNA, 21 nt, Streptococcus pneumoniae R6
uguugcuuuggagucaauaau

SEQ ID NO: 4103449 - RNA, 13 nt, Streptococcus pneumoniae R6
uguuggauauaag

SEQ ID NO: 4103450 - RNA, 16 nt, Streptococcus pneumoniae R6
uguugucccuuuuuca

SEQ ID NO: 4103451 - RNA, 13 nt, Streptococcus pneumoniae R6
uguuguuguaaua

SEQ ID NO: 4103452 - RNA, 16 nt, Streptococcus pneumoniae R6
uguuguuuauuaccuu

SEQ ID NO: 4103453 - RNA, 17 nt, Streptococcus pneumoniae R6
uguuuaaauacuuuuuc

SEQ ID NO: 4103454 - RNA, 19 nt, Streptococcus pneumoniae R6
uguuuaaauacuuuuuccu

SEQ ID NO: 4103455 - RNA, 20 nt, Streptococcus pneumoniae R6
uguuuaauacucaaugaaaa

SEQ ID NO: 4103456 - RNA, 17 nt, Streptococcus pneumoniae R6
uguuuaauucuugaaaa

SEQ ID NO: 4103457 - RNA, 19 nt, Streptococcus pneumoniae R6
uguuuaauucuugaaaauc

SEQ ID NO: 4103458 - RNA, 15 nt, Streptococcus pneumoniae R6
uguuuacgaauaucu

SEQ ID NO: 4103459 - RNA, 16 nt, Streptococcus pneumoniae R6
uguuuacguuuuaaaa

SEQ ID NO: 4103460 - RNA, 14 nt, Streptococcus pneumoniae R6
uguuuauaaucauu

SEQ ID NO: 4103461 - RNA, 22 nt, Streptococcus pneumoniae R6
uguuuauaaucauuaaaauaac

SEQ ID NO: 4103462 - RNA, 18 nt, Streptococcus pneumoniae R6
uguuucaaaugaaauauu

SEQ ID NO: 4103463 - RNA, 19 nt, Streptococcus pneumoniae R6
uguuucaaaugaaauauuu

SEQ ID NO: 4103464 - RNA, 17 nt, Streptococcus pneumoniae R6
uguuucacuaggauuuu

SEQ ID NO: 4103465 - RNA, 21 nt, Streptococcus pneumoniae R6
uguuuccaguuaucugcaaaa

SEQ ID NO: 4103466 - RNA, 15 nt, Streptococcus pneumoniae R6
uguuucccuaauaau

SEQ ID NO: 4103467 - RNA, 18 nt, Streptococcus pneumoniae R6
uguuucguacuauuucag

SEQ ID NO: 4103468 - RNA, 20 nt, Streptococcus pneumoniae R6
uguuucguacuauuucagau

SEQ ID NO: 4103469 - RNA, 15 nt, Streptococcus pneumoniae R6
uguuucguuucuucg

SEQ ID NO: 4103470 - RNA, 17 nt, Streptococcus pneumoniae R6
uguuucuaaaacauugu

SEQ ID NO: 4103471 - RNA, 17 nt, Streptococcus pneumoniae R6
uguuucucugugaaugc

SEQ ID NO: 4103472 - RNA, 15 nt, Streptococcus pneumoniae R6
uguuucuugagaaga

SEQ ID NO: 4103473 - RNA, 19 nt, Streptococcus pneumoniae R6
uguuucuugagaagagcuu

SEQ ID NO: 4103474 - RNA, 20 nt, Streptococcus pneumoniae R6
uguuucuugggguuucaucc

SEQ ID NO: 4103475 - RNA, 13 nt, Streptococcus pneumoniae R6
uguuucuuuaaau

SEQ ID NO: 4103476 - RNA, 13 nt, Streptococcus pneumoniae R6
uguuucuuuuugg

SEQ ID NO: 4103477 - RNA, 20 nt, Streptococcus pneumoniae R6
uguuugacgagugaagaauu

SEQ ID NO: 4103478 - RNA, 20 nt, Streptococcus pneumoniae R6
uguuugagaugauuugcuca

SEQ ID NO: 4103479 - RNA, 13 nt, Streptococcus pneumoniae R6
uguuugcagcacc

SEQ ID NO: 4103480 - RNA, 15 nt, Streptococcus pneumoniae R6
uguuugcuucauuuu

SEQ ID NO: 4103481 - RNA, 20 nt, Streptococcus pneumoniae R6
uguuugggggcaguacagaa

SEQ ID NO: 4103482 - RNA, 20 nt, Streptococcus pneumoniae R6
uguuugguugucaaaccaca

SEQ ID NO: 4103483 - RNA, 15 nt, Streptococcus pneumoniae R6
uguuuuaaggagcaa

SEQ ID NO: 4103484 - RNA, 15 nt, Streptococcus pneumoniae R6
uguuuuagcaaucgc

SEQ ID NO: 4103485 - RNA, 11 nt, Streptococcus pneumoniae R6
uguuuuauuac

SEQ ID NO: 4103486 - RNA, 19 nt, Streptococcus pneumoniae R6
uguuuucaaaaagcauucu

SEQ ID NO: 4103487 - RNA, 17 nt, Streptococcus pneumoniae R6
uguuuucacauuuucaa

SEQ ID NO: 4103488 - RNA, 18 nt, Streptococcus pneumoniae R6
uguuuucacauuuucaaa

SEQ ID NO: 4103489 - RNA, 15 nt, Streptococcus pneumoniae R6
uguuuucauaucucc

SEQ ID NO: 4103490 - RNA, 15 nt, Streptococcus pneumoniae R6
uguuuuccuuucaau

SEQ ID NO: 4103491 - RNA, 22 nt, Streptococcus pneumoniae R6
uguuuucuuggucauuugagau

SEQ ID NO: 4103492 - RNA, 19 nt, Streptococcus pneumoniae R6
uguuuuuauaugauuucaa

SEQ ID NO: 4103493 - RNA, 13 nt, Streptococcus pneumoniae R6
uguuuuucgucac

SEQ ID NO: 4103494 - RNA, 13 nt, Streptococcus pneumoniae R6
uguuuuuucuugc

SEQ ID NO: 4103495 - RNA, 17 nt, Streptococcus pneumoniae R6
uguuuuuucuugcuugu

SEQ ID NO: 4103496 - RNA, 22 nt, Streptococcus pneumoniae R6
uuaaaaaaagggcuguaucugu

SEQ ID NO: 4103497 - RNA, 11 nt, Streptococcus pneumoniae R6
uuaaaaaacca

SEQ ID NO: 4103498 - RNA, 13 nt, Streptococcus pneumoniae R6
uuaaaaaaccaau

SEQ ID NO: 4103499 - RNA, 14 nt, Streptococcus pneumoniae R6
uuaaaaaaccaauu

SEQ ID NO: 4103500 - RNA, 11 nt, Streptococcus pneumoniae R6
uuaaaaaagau

SEQ ID NO: 4103501 - RNA, 17 nt, Streptococcus pneumoniae R6
uuaaaaaauaaucaaaa

SEQ ID NO: 4103502 - RNA, 18 nt, Streptococcus pneumoniae R6
uuaaaaaauaaucaaaac

SEQ ID NO: 4103503 - RNA, 12 nt, Streptococcus pneumoniae R6
uuaaaaacucag

SEQ ID NO: 4103504 - RNA, 18 nt, Streptococcus pneumoniae R6
uuaaaaauagauuuuuaa

SEQ ID NO: 4103505 - RNA, 20 nt, Streptococcus pneumoniae R6
uuaaaaauguugcauuuuuu

SEQ ID NO: 4103506 - RNA, 16 nt, Streptococcus pneumoniae R6
uuaaaaauuacaaaca

SEQ ID NO: 4103507 - RNA, 13 nt, Streptococcus pneumoniae R6
uuaaaacaaagaa

SEQ ID NO: 4103508 - RNA, 20 nt, Streptococcus pneumoniae R6
uuaaaacaguguuuugagcu

SEQ ID NO: 4103509 - RNA, 21 nt, Streptococcus pneumoniae R6
uuaaaaguagcgcccuuguuc

SEQ ID NO: 4103510 - RNA, 22 nt, Streptococcus pneumoniae R6
uuaaaaguagcgcccuuguucu

SEQ ID NO: 4103511 - RNA, 13 nt, Streptococcus pneumoniae R6
uuaaaauaaguua

SEQ ID NO: 4103512 - RNA, 21 nt, Streptococcus pneumoniae R6
uuaaaaucaccugcaauaaua

SEQ ID NO: 4103513 - RNA, 17 nt, Streptococcus pneumoniae R6
uuaaaaugaauucuaug

SEQ ID NO: 4103514 - RNA, 21 nt, Streptococcus pneumoniae R6
uuaaaaugagucuaucaaaca

SEQ ID NO: 4103515 - RNA, 17 nt, Streptococcus pneumoniae R6
uuaaaauguucuguaau

SEQ ID NO: 4103516 - RNA, 19 nt, Streptococcus pneumoniae R6
uuaaaauguucuguaauga

SEQ ID NO: 4103517 - RNA, 12 nt, Streptococcus pneumoniae R6
uuaaaauguugg

SEQ ID NO: 4103518 - RNA, 21 nt, Streptococcus pneumoniae R6
uuaaaauuacucccauucuuc

SEQ ID NO: 4103519 - RNA, 21 nt, Streptococcus pneumoniae R6
uuaaacgacuagauaaaagaa

SEQ ID NO: 4103520 - RNA, 20 nt, Streptococcus pneumoniae R6
uuaaacgugcuauaucaaaa

SEQ ID NO: 4103521 - RNA, 17 nt, Streptococcus pneumoniae R6
uuaaacuaauguaaaaa

SEQ ID NO: 4103522 - RNA, 18 nt, Streptococcus pneumoniae R6
uuaaacucagguuucucu

SEQ ID NO: 4103523 - RNA, 16 nt, Streptococcus pneumoniae R6
uuaaacucuccaauau

SEQ ID NO: 4103524 - RNA, 21 nt, Streptococcus pneumoniae R6
uuaaacucugcacguguaaug

SEQ ID NO: 4103525 - RNA, 16 nt, Streptococcus pneumoniae R6
uuaaagaaauagaaaa

SEQ ID NO: 4103526 - RNA, 16 nt, Streptococcus pneumoniae R6
uuacauaauuuaaaau

SEQ ID NO: 4103527 - RNA, 24 nt, Streptococcus pneumoniae R6
uuacauaauuuaaaauacgcaaaa

SEQ ID NO: 4103528 - RNA, 20 nt, Streptococcus pneumoniae R6
uuacauagagagacagcagu

SEQ ID NO: 4103529 - RNA, 17 nt, Streptococcus pneumoniae R6
uuacaucaagcucaucu

SEQ ID NO: 4103530 - RNA, 17 nt, Streptococcus pneumoniae R6
uuacaucaguauuucau

SEQ ID NO: 4103531 - RNA, 20 nt, Streptococcus pneumoniae R6
uuacaugcgcaaaauaauuu

SEQ ID NO: 4103532 - RNA, 17 nt, Streptococcus pneumoniae R6
uuacaugcguuucagca

SEQ ID NO: 4103533 - RNA, 17 nt, Streptococcus pneumoniae R6
uuacauuaugcguuuuu

SEQ ID NO: 4103534 - RNA, 14 nt, Streptococcus pneumoniae R6
uuaccaaaaccuuc

SEQ ID NO: 4103535 - RNA, 20 nt, Streptococcus pneumoniae R6
uuaccaaguuaaacaaccuu

SEQ ID NO: 4103536 - RNA, 22 nt, Streptococcus pneumoniae R6
uuaccaauacaggaaaaccagu

SEQ ID NO: 4103537 - RNA, 14 nt, Streptococcus pneumoniae R6
uuaccaauuuuucc

SEQ ID NO: 4103538 - RNA, 16 nt, Streptococcus pneumoniae R6
uuaccaauuuuuccuu

SEQ ID NO: 4103539 - RNA, 17 nt, Streptococcus pneumoniae R6
uuaccaauuuuuccuuu

SEQ ID NO: 4103540 - RNA, 16 nt, Streptococcus pneumoniae R6
uuaccacuaaacuaca

SEQ ID NO: 4103541 - RNA, 12 nt, Streptococcus pneumoniae R6
uuacccgaccua

SEQ ID NO: 4103542 - RNA, 13 nt, Streptococcus pneumoniae R6
uuaccgagaaucc

SEQ ID NO: 4103543 - RNA, 14 nt, Streptococcus pneumoniae R6
uuaccuuugaaaaa

SEQ ID NO: 4103544 - RNA, 16 nt, Streptococcus pneumoniae R6
uuacgaaauuggauau

SEQ ID NO: 4103545 - RNA, 19 nt, Streptococcus pneumoniae R6
uuacggggguaagagacuu

SEQ ID NO: 4103546 - RNA, 20 nt, Streptococcus pneumoniae R6
uuacggguuuuaaacuauua

SEQ ID NO: 4103547 - RNA, 13 nt, Streptococcus pneumoniae R6
uuacggucaaagu

SEQ ID NO: 4103548 - RNA, 14 nt, Streptococcus pneumoniae R6
uuacguccaccaca

SEQ ID NO: 4103549 - RNA, 18 nt, Streptococcus pneumoniae R6
uuacguccuguugcuuca

SEQ ID NO: 4103550 - RNA, 22 nt, Streptococcus pneumoniae R6
uuacuaaacaagggauuuuucu

SEQ ID NO: 4103551 - RNA, 14 nt, Streptococcus pneumoniae R6
uuacuaaauacuag

SEQ ID NO: 4103552 - RNA, 23 nt, Streptococcus pneumoniae R6
uuacuaauuaauuaacugguuaa

SEQ ID NO: 4103553 - RNA, 14 nt, Streptococcus pneumoniae R6
uuacuacuuuuguc

SEQ ID NO: 4103554 - RNA, 14 nt, Streptococcus pneumoniae R6
uuacuauaaaauaa

SEQ ID NO: 4103555 - RNA, 18 nt, Streptococcus pneumoniae R6
uuacuauaagacuccucu

SEQ ID NO: 4103556 - RNA, 20 nt, Streptococcus pneumoniae R6
uuacuauauaucaugcuuua

SEQ ID NO: 4103557 - RNA, 21 nt, Streptococcus pneumoniae R6
uuacuaucaagaaguccauaa

SEQ ID NO: 4103558 - RNA, 16 nt, Streptococcus pneumoniae R6
uuacucaggauaaaac

SEQ ID NO: 4103559 - RNA, 15 nt, Streptococcus pneumoniae R6
uuacucucauucuua

SEQ ID NO: 4103560 - RNA, 23 nt, Streptococcus pneumoniae R6
uuacucuccuccauaaaaagacc

SEQ ID NO: 4103561 - RNA, 23 nt, Streptococcus pneumoniae R6
uuacugaacggugaacuucuuca

SEQ ID NO: 4103562 - RNA, 20 nt, Streptococcus pneumoniae R6
uuacugacuucgucaguucu

SEQ ID NO: 4103563 - RNA, 13 nt, Streptococcus pneumoniae R6
uuacugauaaaac

SEQ ID NO: 4103564 - RNA, 16 nt, Streptococcus pneumoniae R6
uuacugauaaaacuga

SEQ ID NO: 4103565 - RNA, 22 nt, Streptococcus pneumoniae R6
uuacugucacccuaggcaagcu

SEQ ID NO: 4103566 - RNA, 23 nt, Streptococcus pneumoniae R6
uuacugucuucagccuuauauuu

SEQ ID NO: 4103567 - RNA, 14 nt, Streptococcus pneumoniae R6
uuacuucaauuucu

SEQ ID NO: 4103568 - RNA, 23 nt, Streptococcus pneumoniae R6
uuacuucaauuucuaaugucucu

SEQ ID NO: 4103569 - RNA, 11 nt, Streptococcus pneumoniae R6
uuacuuccuuu

SEQ ID NO: 4103570 - RNA, 20 nt, Streptococcus pneumoniae R6
uuacuuccuuuucuacugaa

SEQ ID NO: 4103571 - RNA, 21 nt, Streptococcus pneumoniae R6
uuacuucguucacccuugcuu

SEQ ID NO: 4103572 - RNA, 14 nt, Streptococcus pneumoniae R6
uuacuucuaaaaca

SEQ ID NO: 4103573 - RNA, 12 nt, Streptococcus pneumoniae R6
uuacuucuuccc

SEQ ID NO: 4103574 - RNA, 17 nt, Streptococcus pneumoniae R6
uuacuugcguuucuucu

SEQ ID NO: 4103575 - RNA, 12 nt, Streptococcus pneumoniae R6
uuacuuugcuug

SEQ ID NO: 4103576 - RNA, 21 nt, Streptococcus pneumoniae R6
uuacuuuugcacgacccugcg

SEQ ID NO: 4103577 - RNA, 18 nt, Streptococcus pneumoniae R6
uuagaaaaagacuugaaa

SEQ ID NO: 4103578 - RNA, 19 nt, Streptococcus pneumoniae R6
uuagaaaaagacuugaaau

SEQ ID NO: 4103579 - RNA, 23 nt, Streptococcus pneumoniae R6
uuagaaaaagacuugaaauacua

SEQ ID NO: 4103580 - RNA, 12 nt, Streptococcus pneumoniae R6
uuagaaaaagua

SEQ ID NO: 4103581 - RNA, 18 nt, Streptococcus pneumoniae R6
uuagaaaaucucuucaaa

SEQ ID NO: 4103582 - RNA, 16 nt, Streptococcus pneumoniae R6
uuagaaaauucaaauu

SEQ ID NO: 4103583 - RNA, 15 nt, Streptococcus pneumoniae R6
uuagaaagguaaaau

SEQ ID NO: 4103584 - RNA, 18 nt, Streptococcus pneumoniae R6
uuagaaagguaaaauaua

SEQ ID NO: 4103585 - RNA, 17 nt, Streptococcus pneumoniae R6
uuagaaagguuuuaaag

SEQ ID NO: 4103586 - RNA, 20 nt, Streptococcus pneumoniae R6
uuagaaagguuuuaaagaca

SEQ ID NO: 4103587 - RNA, 18 nt, Streptococcus pneumoniae R6
uuagaaaucaaaaagcaa

SEQ ID NO: 4103588 - RNA, 22 nt, Streptococcus pneumoniae R6
uuagaaccgaaaaucuccucua

SEQ ID NO: 4103589 - RNA, 22 nt, Streptococcus pneumoniae R6
uuagaacuugcuccaaaggaga

SEQ ID NO: 4103590 - RNA, 20 nt, Streptococcus pneumoniae R6
uuagaagcaguuguguacua

SEQ ID NO: 4103591 - RNA, 15 nt, Streptococcus pneumoniae R6
uuagaauaaggaaaa

SEQ ID NO: 4103592 - RNA, 17 nt, Streptococcus pneumoniae R6
uuagaauaaggaaaaca

SEQ ID NO: 4103593 - RNA, 18 nt, Streptococcus pneumoniae R6
uuagaauaaggaaaacau

SEQ ID NO: 4103594 - RNA, 13 nt, Streptococcus pneumoniae R6
uuagacaaauaau

SEQ ID NO: 4103595 - RNA, 13 nt, Streptococcus pneumoniae R6
uuagacagaaaaa

SEQ ID NO: 4103596 - RNA, 15 nt, Streptococcus pneumoniae R6
uuagacagaaaaaau

SEQ ID NO: 4103597 - RNA, 15 nt, Streptococcus pneumoniae R6
uuagaccugccaugc

SEQ ID NO: 4103598 - RNA, 17 nt, Streptococcus pneumoniae R6
uuagagaaugaaauaua

SEQ ID NO: 4103599 - RNA, 21 nt, Streptococcus pneumoniae R6
uuagagauuuucauaaacaag

SEQ ID NO: 4103600 - RNA, 20 nt, Streptococcus pneumoniae R6
uuagagguuugcuuagaaac

SEQ ID NO: 4103601 - RNA, 19 nt, Streptococcus pneumoniae R6
uuagagucaagguucuuaa

SEQ ID NO: 4103602 - RNA, 13 nt, Streptococcus pneumoniae R6
uuagauaaaacua

SEQ ID NO: 4103603 - RNA, 23 nt, Streptococcus pneumoniae R6
uuagauagaugcuacuauauucu

SEQ ID NO: 4103604 - RNA, 15 nt, Streptococcus pneumoniae R6
uuagaugauuuuucu

SEQ ID NO: 4103605 - RNA, 20 nt, Streptococcus pneumoniae R6
uuagaugauuuuucuguuuu

SEQ ID NO: 4103606 - RNA, 21 nt, Streptococcus pneumoniae R6
uuagaugguauugacugccca

SEQ ID NO: 4103607 - RNA, 18 nt, Streptococcus pneumoniae R6
uuagauugagaucucuua

SEQ ID NO: 4103608 - RNA, 15 nt, Streptococcus pneumoniae R6
uuagauuuauaauuu

SEQ ID NO: 4103609 - RNA, 16 nt, Streptococcus pneumoniae R6
uuagauuuucuggcag

SEQ ID NO: 4103610 - RNA, 21 nt, Streptococcus pneumoniae R6
uuagauuuuuucugucuaacu

SEQ ID NO: 4103611 - RNA, 14 nt, Streptococcus pneumoniae R6
uuagcaacuguuuu

SEQ ID NO: 4103612 - RNA, 19 nt, Streptococcus pneumoniae R6
uuagcaaucacucuaacuu

SEQ ID NO: 4103613 - RNA, 14 nt, Streptococcus pneumoniae R6
uuagcagacuucuu

SEQ ID NO: 4103614 - RNA, 23 nt, Streptococcus pneumoniae R6
uuagcagacuucuuuuuuacuuc

SEQ ID NO: 4103615 - RNA, 19 nt, Streptococcus pneumoniae R6
uuagcaucuucuucuggug

SEQ ID NO: 4103616 - RNA, 18 nt, Streptococcus pneumoniae R6
uuagccacaacuaggaag

SEQ ID NO: 4103617 - RNA, 13 nt, Streptococcus pneumoniae R6
uuagccauacguu

SEQ ID NO: 4103618 - RNA, 16 nt, Streptococcus pneumoniae R6
uuagccauacguuuca

SEQ ID NO: 4103619 - RNA, 22 nt, Streptococcus pneumoniae R6
uuagccuccauucaguuucuau

SEQ ID NO: 4103620 - RNA, 20 nt, Streptococcus pneumoniae R6
uuagcucaaaacacuguuuu

SEQ ID NO: 4103621 - RNA, 19 nt, Streptococcus pneumoniae R6
uuagcucugugcaauacag

SEQ ID NO: 4103622 - RNA, 23 nt, Streptococcus pneumoniae R6
uuagcugauuuuuuacaauccug

SEQ ID NO: 4103623 - RNA, 16 nt, Streptococcus pneumoniae R6
uuagcuguuuggccaa

SEQ ID NO: 4103624 - RNA, 16 nt, Streptococcus pneumoniae R6
uuagcuuuucuucaac

SEQ ID NO: 4103625 - RNA, 15 nt, Streptococcus pneumoniae R6
uuaggaaacucuuac

SEQ ID NO: 4103626 - RNA, 18 nt, Streptococcus pneumoniae R6
uuaggaaacucuuacaaa

SEQ ID NO: 4103627 - RNA, 14 nt, Streptococcus pneumoniae R6
uuaggaaaggaaaa

SEQ ID NO: 4103628 - RNA, 14 nt, Streptococcus pneumoniae R6
uuauucuuaaauga

SEQ ID NO: 4103629 - RNA, 23 nt, Streptococcus pneumoniae R6
uuauucuuggcguccucuaguaa

SEQ ID NO: 4103630 - RNA, 14 nt, Streptococcus pneumoniae R6
uuauucuuuuucaa

SEQ ID NO: 4103631 - RNA, 14 nt, Streptococcus pneumoniae R6
uuauugagcgcagg

SEQ ID NO: 4103632 - RNA, 23 nt, Streptococcus pneumoniae R6
uuauugaguauuagagguuugcu

SEQ ID NO: 4103633 - RNA, 21 nt, Streptococcus pneumoniae R6
uuauuggcuacgacugcuucu

SEQ ID NO: 4103634 - RNA, 21 nt, Streptococcus pneumoniae R6
uuauugugggaagauguauaa

SEQ ID NO: 4103635 - RNA, 15 nt, Streptococcus pneumoniae R6
uuauuuauuuacuua

SEQ ID NO: 4103636 - RNA, 23 nt, Streptococcus pneumoniae R6
uuauuucaaaucauaaagccagu

SEQ ID NO: 4103637 - RNA, 12 nt, Streptococcus pneumoniae R6
uuauuucauuuc

SEQ ID NO: 4103638 - RNA, 20 nt, Streptococcus pneumoniae R6
uuauuuccuugaccaagucc

SEQ ID NO: 4103639 - RNA, 12 nt, Streptococcus pneumoniae R6
uuauuucucaag

SEQ ID NO: 4103640 - RNA, 21 nt, Streptococcus pneumoniae R6
uuauuucuccuaaagaaaaag

SEQ ID NO: 4103641 - RNA, 23 nt, Streptococcus pneumoniae R6
uuauuugccuaugaaaugagaaa

SEQ ID NO: 4103642 - RNA, 16 nt, Streptococcus pneumoniae R6
uuauuuucuacucuuu

SEQ ID NO: 4103643 - RNA, 15 nt, Streptococcus pneumoniae R6
uuauuuuugaaagua

SEQ ID NO: 4103644 - RNA, 15 nt, Streptococcus pneumoniae R6
uucaaaagcuaauag

SEQ ID NO: 4103645 - RNA, 16 nt, Streptococcus pneumoniae R6
uucaaaaucagaaaaa

SEQ ID NO: 4103646 - RNA, 19 nt, Streptococcus pneumoniae R6
uucaaaccgccaccaaaca

SEQ ID NO: 4103647 - RNA, 13 nt, Streptococcus pneumoniae R6
uucaaaccguguu

SEQ ID NO: 4103648 - RNA, 14 nt, Streptococcus pneumoniae R6
uucaaagaauuuug

SEQ ID NO: 4103649 - RNA, 19 nt, Streptococcus pneumoniae R6
uucaaagaguauuaaacaa

SEQ ID NO: 4103650 - RNA, 21 nt, Streptococcus pneumoniae R6
uucaaagaguauuaaacaaaa

SEQ ID NO: 4103651 - RNA, 12 nt, Streptococcus pneumoniae R6
uucaaagauauc

SEQ ID NO: 4103652 - RNA, 17 nt, Streptococcus pneumoniae R6
uucaaagauaucaucca

SEQ ID NO: 4103653 - RNA, 17 nt, Streptococcus pneumoniae R6
uucaaagcgauaaaaau

SEQ ID NO: 4103654 - RNA, 22 nt, Streptococcus pneumoniae R6
uucaaagcgggauuuaaaauaa

SEQ ID NO: 4103655 - RNA, 21 nt, Streptococcus pneumoniae R6
uucaaagcuacuuuuuuacca

SEQ ID NO: 4103656 - RNA, 19 nt, Streptococcus pneumoniae R6
uucaaagucauaaacaucu

SEQ ID NO: 4103657 - RNA, 14 nt, Streptococcus pneumoniae R6
uucaaaguuaacuu

SEQ ID NO: 4103658 - RNA, 13 nt, Streptococcus pneumoniae R6
uucaaaguuccga

SEQ ID NO: 4103659 - RNA, 16 nt, Streptococcus pneumoniae R6
uucaaaguuucgaaaa

SEQ ID NO: 4103660 - RNA, 12 nt, Streptococcus pneumoniae R6
uucaaaucccau

SEQ ID NO: 4103661 - RNA, 18 nt, Streptococcus pneumoniae R6
uucaaauccgacuucaau

SEQ ID NO: 4103662 - RNA, 13 nt, Streptococcus pneumoniae R6
uucaaauccuuua

SEQ ID NO: 4103663 - RNA, 19 nt, Streptococcus pneumoniae R6
uucaaauuaauuucuagaa

SEQ ID NO: 4103664 - RNA, 17 nt, Streptococcus pneumoniae R6
uucaacacguccauaau

SEQ ID NO: 4103665 - RNA, 22 nt, Streptococcus pneumoniae R6
uucaacagcaccagcuuccgca

SEQ ID NO: 4103666 - RNA, 14 nt, Streptococcus pneumoniae R6
uucaacaugucagc

SEQ ID NO: 4103667 - RNA, 14 nt, Streptococcus pneumoniae R6
uucaacgaaaauaa

SEQ ID NO: 4103668 - RNA, 15 nt, Streptococcus pneumoniae R6
uucaacucuauuuuu

SEQ ID NO: 4103669 - RNA, 17 nt, Streptococcus pneumoniae R6
uucaacucuauuuuuga

SEQ ID NO: 4103670 - RNA, 17 nt, Streptococcus pneumoniae R6
uucaagaacuuuaacuu

SEQ ID NO: 4103671 - RNA, 11 nt, Streptococcus pneumoniae R6
uucaagagcuu

SEQ ID NO: 4103672 - RNA, 14 nt, Streptococcus pneumoniae R6
uucaagcauuuuuu

SEQ ID NO: 4103673 - RNA, 21 nt, Streptococcus pneumoniae R6
uucaaggugaaguucacguaa

SEQ ID NO: 4103674 - RNA, 18 nt, Streptococcus pneumoniae R6
uucaagguuuuauacucu

SEQ ID NO: 4103675 - RNA, 16 nt, Streptococcus pneumoniae R6
uucaagucuugugaau

SEQ ID NO: 4103676 - RNA, 20 nt, Streptococcus pneumoniae R6
uucaauaaauugagcauuau

SEQ ID NO: 4103677 - RNA, 17 nt, Streptococcus pneumoniae R6
uucaauaauuucuuuuu

SEQ ID NO: 4103678 - RNA, 12 nt, Streptococcus pneumoniae R6
uucaauaccaaa

SEQ ID NO: 4103679 - RNA, 13 nt, Streptococcus pneumoniae R6
uucaauaccaaag

SEQ ID NO: 4103680 - RNA, 17 nt, Streptococcus pneumoniae R6
uucaauaccaaagaagu

SEQ ID NO: 4103681 - RNA, 24 nt, Streptococcus pneumoniae R6
uucaauacgaaucaauacagaaga

SEQ ID NO: 4103682 - RNA, 18 nt, Streptococcus pneumoniae R6
uucaauacggucaaucaa

SEQ ID NO: 4103683 - RNA, 20 nt, Streptococcus pneumoniae R6
uucaauagacuauaucauau

SEQ ID NO: 4103684 - RNA, 23 nt, Streptococcus pneumoniae R6
uucaauauauuauauaucugcag

SEQ ID NO: 4103685 - RNA, 15 nt, Streptococcus pneumoniae R6
uucaaucaagacaga

SEQ ID NO: 4103686 - RNA, 19 nt, Streptococcus pneumoniae R6
uucaaucagcuaaaaauaa

SEQ ID NO: 4103687 - RNA, 14 nt, Streptococcus pneumoniae R6
uucaauccacuugu

SEQ ID NO: 4103688 - RNA, 13 nt, Streptococcus pneumoniae R6
uucaauccaucuc

SEQ ID NO: 4103689 - RNA, 18 nt, Streptococcus pneumoniae R6
uucaaucuacuauagaaa

SEQ ID NO: 4103690 - RNA, 18 nt, Streptococcus pneumoniae R6
uucaaucucgcuguuuau

SEQ ID NO: 4103691 - RNA, 21 nt, Streptococcus pneumoniae R6
uucaaugcccuugauaauaaa

SEQ ID NO: 4103692 - RNA, 13 nt, Streptococcus pneumoniae R6
uucaauguacuag

SEQ ID NO: 4103693 - RNA, 18 nt, Streptococcus pneumoniae R6
uucaaugugggaaacaga

SEQ ID NO: 4103694 - RNA, 20 nt, Streptococcus pneumoniae R6
uucaauucacuauaacuugu

SEQ ID NO: 4103695 - RNA, 22 nt, Streptococcus pneumoniae R6
uucaauugcaggagaaaaugaa

SEQ ID NO: 4103696 - RNA, 18 nt, Streptococcus pneumoniae R6
uucaauuguuuauaaaau

SEQ ID NO: 4103697 - RNA, 17 nt, Streptococcus pneumoniae R6
uucaauuugauauauaa

SEQ ID NO: 4103698 - RNA, 21 nt, Streptococcus pneumoniae R6
uucaauuugauauauaaauga

SEQ ID NO: 4103699 - RNA, 16 nt, Streptococcus pneumoniae R6
uucaauuuuauacuca

SEQ ID NO: 4103700 - RNA, 11 nt, Streptococcus pneumoniae R6
uucacaaauuc

SEQ ID NO: 4103701 - RNA, 19 nt, Streptococcus pneumoniae R6
uucacaacaucuucuguac

SEQ ID NO: 4103702 - RNA, 21 nt, Streptococcus pneumoniae R6
uucacaacucuuauacuuuuc

SEQ ID NO: 4103703 - RNA, 14 nt, Streptococcus pneumoniae R6
uucacaaucaaaaa

SEQ ID NO: 4103704 - RNA, 21 nt, Streptococcus pneumoniae R6
uucaccaaaacuauauucucu

SEQ ID NO: 4103705 - RNA, 14 nt, Streptococcus pneumoniae R6
uucaccaaucaaau

SEQ ID NO: 4103706 - RNA, 23 nt, Streptococcus pneumoniae R6
uucaccaguaaaguguucugucu

SEQ ID NO: 4103707 - RNA, 16 nt, Streptococcus pneumoniae R6
uucaccuaaccaaaua

SEQ ID NO: 4103708 - RNA, 16 nt, Streptococcus pneumoniae R6
uucaccuccucucacg

SEQ ID NO: 4103709 - RNA, 16 nt, Streptococcus pneumoniae R6
uucacggcuaauacca

SEQ ID NO: 4103710 - RNA, 23 nt, Streptococcus pneumoniae R6
uucacgggcuuggcguuuugagu

SEQ ID NO: 4103711 - RNA, 17 nt, Streptococcus pneumoniae R6
uucacguucgguauuuu

SEQ ID NO: 4103712 - RNA, 14 nt, Streptococcus pneumoniae R6
uucacguucuucca

SEQ ID NO: 4103713 - RNA, 17 nt, Streptococcus pneumoniae R6
uucacguuguucaagcc

SEQ ID NO: 4103714 - RNA, 20 nt, Streptococcus pneumoniae R6
uucacuagccccagcuagga

SEQ ID NO: 4103715 - RNA, 23 nt, Streptococcus pneumoniae R6
uucacuaguauucaucuuaucaa

SEQ ID NO: 4103716 - RNA, 13 nt, Streptococcus pneumoniae R6
uucacuaguuuua

SEQ ID NO: 4103717 - RNA, 19 nt, Streptococcus pneumoniae R6
uucacuauugaugaaguaa

SEQ ID NO: 4103718 - RNA, 22 nt, Streptococcus pneumoniae R6
uucacucaaaucauauucacuu

SEQ ID NO: 4103719 - RNA, 18 nt, Streptococcus pneumoniae R6
uucacuccacuauaaaac

SEQ ID NO: 4103720 - RNA, 13 nt, Streptococcus pneumoniae R6
uucagaacuuuua

SEQ ID NO: 4103721 - RNA, 16 nt, Streptococcus pneumoniae R6
uucagaagaaaaaaag

SEQ ID NO: 4103722 - RNA, 15 nt, Streptococcus pneumoniae R6
uucagaaucccaaag

SEQ ID NO: 4103723 - RNA, 23 nt, Streptococcus pneumoniae R6
uucagagacagcuuguugcuuuu

SEQ ID NO: 4103724 - RNA, 17 nt, Streptococcus pneumoniae R6
uucagagcgauaaaaau

SEQ ID NO: 4103725 - RNA, 19 nt, Streptococcus pneumoniae R6
uucagauaaccaucucaca

SEQ ID NO: 4103726 - RNA, 15 nt, Streptococcus pneumoniae R6
uucagauucagucua

SEQ ID NO: 4103727 - RNA, 22 nt, Streptococcus pneumoniae R6
uucagauuuuaaagacuuuuuu

SEQ ID NO: 4103728 - RNA, 18 nt, Streptococcus pneumoniae R6
uucagcauauuucccauu

SEQ ID NO: 4103729 - RNA, 13 nt, Streptococcus pneumoniae R6
uucagccacuauu

SEQ ID NO: 4103730 - RNA, 15 nt, Streptococcus pneumoniae R6
uucagccucuauacu

SEQ ID NO: 4103731 - RNA, 17 nt, Streptococcus pneumoniae R6
uuccaugacgcacaaac

SEQ ID NO: 4103732 - RNA, 14 nt, Streptococcus pneumoniae R6
uuccaugcuacuag

SEQ ID NO: 4103733 - RNA, 13 nt, Streptococcus pneumoniae R6
uuccauucaaauu

SEQ ID NO: 4103734 - RNA, 15 nt, Streptococcus pneumoniae R6
uuccauuuaacaaac

SEQ ID NO: 4103735 - RNA, 14 nt, Streptococcus pneumoniae R6
uuccauuuacagaa

SEQ ID NO: 4103736 - RNA, 21 nt, Streptococcus pneumoniae R6
uuccauuucagaagaaaauga

SEQ ID NO: 4103737 - RNA, 17 nt, Streptococcus pneumoniae R6
uucccaaacaaaaaacc

SEQ ID NO: 4103738 - RNA, 13 nt, Streptococcus pneumoniae R6
uucccaaacuugu

SEQ ID NO: 4103739 - RNA, 12 nt, Streptococcus pneumoniae R6
uucccaacguga

SEQ ID NO: 4103740 - RNA, 17 nt, Streptococcus pneumoniae R6
uucccacuuguguuuau

SEQ ID NO: 4103741 - RNA, 15 nt, Streptococcus pneumoniae R6
uucccagacuuuuuu

SEQ ID NO: 4103742 - RNA, 15 nt, Streptococcus pneumoniae R6
uucccuccuuuugug

SEQ ID NO: 4103743 - RNA, 15 nt, Streptococcus pneumoniae R6
uucccugcauuucuu

SEQ ID NO: 4103744 - RNA, 17 nt, Streptococcus pneumoniae R6
uucccugccucauaucu

SEQ ID NO: 4103745 - RNA, 21 nt, Streptococcus pneumoniae R6
uucccuugcuagucauaacug

SEQ ID NO: 4103746 - RNA, 13 nt, Streptococcus pneumoniae R6
uuccgcacucagg

SEQ ID NO: 4103747 - RNA, 16 nt, Streptococcus pneumoniae R6
uuccgccaucuuguuu

SEQ ID NO: 4103748 - RNA, 16 nt, Streptococcus pneumoniae R6
uuccgcuaacguuuuu

SEQ ID NO: 4103749 - RNA, 18 nt, Streptococcus pneumoniae R6
uuccgucaagagaugguu

SEQ ID NO: 4103750 - RNA, 17 nt, Streptococcus pneumoniae R6
uuccuaaaacaguuaca

SEQ ID NO: 4103751 - RNA, 19 nt, Streptococcus pneumoniae R6
uuccuaaucgauuuguuca

SEQ ID NO: 4103752 - RNA, 22 nt, Streptococcus pneumoniae R6
uuccuaaucgauuuguucauau

SEQ ID NO: 4103753 - RNA, 20 nt, Streptococcus pneumoniae R6
uuccuacauauguaagaaga

SEQ ID NO: 4103754 - RNA, 19 nt, Streptococcus pneumoniae R6
uuccuacugauaucuuuag

SEQ ID NO: 4103755 - RNA, 13 nt, Streptococcus pneumoniae R6
uuccuacuucaaa

SEQ ID NO: 4103756 - RNA, 23 nt, Streptococcus pneumoniae R6
uuccuagccuauuuuuuauuuca

SEQ ID NO: 4103757 - RNA, 15 nt, Streptococcus pneumoniae R6
uuccuaguuugcucu

SEQ ID NO: 4103758 - RNA, 13 nt, Streptococcus pneumoniae R6
uuccuaugauuaa

SEQ ID NO: 4103759 - RNA, 18 nt, Streptococcus pneumoniae R6
uuccucccugcgacaaaa

SEQ ID NO: 4103760 - RNA, 19 nt, Streptococcus pneumoniae R6
uuccucgauuuguuuuugg

SEQ ID NO: 4103761 - RNA, 23 nt, Streptococcus pneumoniae R6
uuccucugguagcaacuaucuga

SEQ ID NO: 4103762 - RNA, 23 nt, Streptococcus pneumoniae R6
uuccucuugauuuuuuuuaaaaa

SEQ ID NO: 4103763 - RNA, 18 nt, Streptococcus pneumoniae R6
uuccugaaauaaaaugcu

SEQ ID NO: 4103764 - RNA, 19 nt, Streptococcus pneumoniae R6
uuccugaagucgaguuuuu

SEQ ID NO: 4103765 - RNA, 15 nt, Streptococcus pneumoniae R6
uuccugagaugacaa

SEQ ID NO: 4103766 - RNA, 16 nt, Streptococcus pneumoniae R6
uuccugauuaaaauca

SEQ ID NO: 4103767 - RNA, 13 nt, Streptococcus pneumoniae R6
uuccugcucaaaa

SEQ ID NO: 4103768 - RNA, 19 nt, Streptococcus pneumoniae R6
uuccugcucaaaauaacca

SEQ ID NO: 4103769 - RNA, 22 nt, Streptococcus pneumoniae R6
uuccuggaaucagaacacuucc

SEQ ID NO: 4103770 - RNA, 23 nt, Streptococcus pneumoniae R6
uuccuggaaucagaacacuucca

SEQ ID NO: 4103771 - RNA, 20 nt, Streptococcus pneumoniae R6
uuccuguguacuguucuaaa

SEQ ID NO: 4103772 - RNA, 24 nt, Streptococcus pneumoniae R6
uuccuuaaaaguagcgcccuuguu

SEQ ID NO: 4103773 - RNA, 22 nt, Streptococcus pneumoniae R6
uuccuuaaacgacuagauaaaa

SEQ ID NO: 4103774 - RNA, 16 nt, Streptococcus pneumoniae R6
uuccuuaacaaucuua

SEQ ID NO: 4103775 - RNA, 18 nt, Streptococcus pneumoniae R6
uuccuuaacaucuuugaa

SEQ ID NO: 4103776 - RNA, 15 nt, Streptococcus pneumoniae R6
uuccuuauucugaaa

SEQ ID NO: 4103777 - RNA, 15 nt, Streptococcus pneumoniae R6
uuccuucauuuccaa

SEQ ID NO: 4103778 - RNA, 21 nt, Streptococcus pneumoniae R6
uuccuugaugagcaaaggauu

SEQ ID NO: 4103779 - RNA, 20 nt, Streptococcus pneumoniae R6
uuccuugccuaauuuuucaa

SEQ ID NO: 4103780 - RNA, 13 nt, Streptococcus pneumoniae R6
uuccuuuaaaaac

SEQ ID NO: 4103781 - RNA, 14 nt, Streptococcus pneumoniae R6
uuccuuuaaaaaca

SEQ ID NO: 4103782 - RNA, 14 nt, Streptococcus pneumoniae R6
uuccuuuaaaauga

SEQ ID NO: 4103783 - RNA, 20 nt, Streptococcus pneumoniae R6
uuccuuucaaaauaucuagg

SEQ ID NO: 4103784 - RNA, 22 nt, Streptococcus pneumoniae R6
uuccuuucaauagcauauuuuu

SEQ ID NO: 4103785 - RNA, 15 nt, Streptococcus pneumoniae R6
uuccuuugucuuuag

SEQ ID NO: 4103786 - RNA, 20 nt, Streptococcus pneumoniae R6
uuccuuuucuuauccagaaa

SEQ ID NO: 4103787 - RNA, 14 nt, Streptococcus pneumoniae R6
uuccuuuuuucuau

SEQ ID NO: 4103788 - RNA, 15 nt, Streptococcus pneumoniae R6
uuccuuuuuuuacau

SEQ ID NO: 4103789 - RNA, 17 nt, Streptococcus pneumoniae R6
uuccuuuuuuuacauca

SEQ ID NO: 4103790 - RNA, 19 nt, Streptococcus pneumoniae R6
uucgaaaagaauuaggaaa

SEQ ID NO: 4103791 - RNA, 21 nt, Streptococcus pneumoniae R6
uucgaaaaucucugcaaacca

SEQ ID NO: 4103792 - RNA, 18 nt, Streptococcus pneumoniae R6
uucgaaaaucucuucaaa

SEQ ID NO: 4103793 - RNA, 21 nt, Streptococcus pneumoniae R6
uucgaaaaucucuucaaacca

SEQ ID NO: 4103794 - RNA, 22 nt, Streptococcus pneumoniae R6
uucgaaaggcuuuauucuuaaa

SEQ ID NO: 4103795 - RNA, 18 nt, Streptococcus pneumoniae R6
uucgaaauuccauaccua

SEQ ID NO: 4103796 - RNA, 22 nt, Streptococcus pneumoniae R6
uucgaagaguauaaaaacucuc

SEQ ID NO: 4103797 - RNA, 22 nt, Streptococcus pneumoniae R6
uucgaagaguauaaaaucaaau

SEQ ID NO: 4103798 - RNA, 15 nt, Streptococcus pneumoniae R6
uucgaagauaucucu

SEQ ID NO: 4103799 - RNA, 16 nt, Streptococcus pneumoniae R6
uucgaaugauuucucu

SEQ ID NO: 4103800 - RNA, 20 nt, Streptococcus pneumoniae R6
uucgacauuuggauagucca

SEQ ID NO: 4103801 - RNA, 17 nt, Streptococcus pneumoniae R6
uucgaugaaucauuucc

SEQ ID NO: 4103802 - RNA, 21 nt, Streptococcus pneumoniae R6
uucgcagucacugucuugcca

SEQ ID NO: 4103803 - RNA, 18 nt, Streptococcus pneumoniae R6
uucgcaucuuauuucaau

SEQ ID NO: 4103804 - RNA, 16 nt, Streptococcus pneumoniae R6
uucgcucuucaaucuu

SEQ ID NO: 4103805 - RNA, 22 nt, Streptococcus pneumoniae R6
uucggaugauggcuuguguucu

SEQ ID NO: 4103806 - RNA, 21 nt, Streptococcus pneumoniae R6
uucggcauacggcgguucaac

SEQ ID NO: 4103807 - RNA, 17 nt, Streptococcus pneumoniae R6
uucggcuguucuuuuuu

SEQ ID NO: 4103808 - RNA, 21 nt, Streptococcus pneumoniae R6
uucggcuguuuuugaugugga

SEQ ID NO: 4103809 - RNA, 13 nt, Streptococcus pneumoniae R6
uucgguauuuuca

SEQ ID NO: 4103810 - RNA, 18 nt, Streptococcus pneumoniae R6
uucguaagaaauuuugga

SEQ ID NO: 4103811 - RNA, 15 nt, Streptococcus pneumoniae R6
uucguaaucauaagc

SEQ ID NO: 4103812 - RNA, 14 nt, Streptococcus pneumoniae R6
uucguagcauaucc

SEQ ID NO: 4103813 - RNA, 17 nt, Streptococcus pneumoniae R6
uucguagucgccaucua

SEQ ID NO: 4103814 - RNA, 13 nt, Streptococcus pneumoniae R6
uucgucaaaucca

SEQ ID NO: 4103815 - RNA, 20 nt, Streptococcus pneumoniae R6
uucgucaccaaauuucauau

SEQ ID NO: 4103816 - RNA, 12 nt, Streptococcus pneumoniae R6
uucgucagucuu

SEQ ID NO: 4103817 - RNA, 20 nt, Streptococcus pneumoniae R6
uucgucaguucuaucugcaa

SEQ ID NO: 4103818 - RNA, 19 nt, Streptococcus pneumoniae R6
uucgucguaaccuucuucu

SEQ ID NO: 4103819 - RNA, 14 nt, Streptococcus pneumoniae R6
uucgucuuguaaug

SEQ ID NO: 4103820 - RNA, 13 nt, Streptococcus pneumoniae R6
uucgugaaagaca

SEQ ID NO: 4103821 - RNA, 18 nt, Streptococcus pneumoniae R6
uucgugagaggaggugaa

SEQ ID NO: 4103822 - RNA, 17 nt, Streptococcus pneumoniae R6
uucguucacccuugcuu

SEQ ID NO: 4103823 - RNA, 15 nt, Streptococcus pneumoniae R6
uucguuuuuacuaca

SEQ ID NO: 4103824 - RNA, 14 nt, Streptococcus pneumoniae R6
uucuaaaacauugu

SEQ ID NO: 4103825 - RNA, 17 nt, Streptococcus pneumoniae R6
uucuaaaacauugugag

SEQ ID NO: 4103826 - RNA, 15 nt, Streptococcus pneumoniae R6
uucuaaaacuccuau

SEQ ID NO: 4103827 - RNA, 16 nt, Streptococcus pneumoniae R6
uucuaaaauaaguucu

SEQ ID NO: 4103828 - RNA, 19 nt, Streptococcus pneumoniae R6
uucuaaaaucugauuccuu

SEQ ID NO: 4103829 - RNA, 21 nt, Streptococcus pneumoniae R6
uucuaaagaauuugaaaaaaa

SEQ ID NO: 4103830 - RNA, 22 nt, Streptococcus pneumoniae R6
uucuaaagaauuugaaaaaaau

SEQ ID NO: 4103831 - RNA, 18 nt, Streptococcus pneumoniae R6
uucuaaagcaauuuugaa

SEQ ID NO: 4103832 - RNA, 21 nt, Streptococcus pneumoniae R6
uucuaaaugcugaaaaguugu

SEQ ID NO: 4103833 - RNA, 21 nt, Streptococcus pneumoniae R6
uucuucaggauugauaaaauu

SEQ ID NO: 4103834 - RNA, 19 nt, Streptococcus pneumoniae R6
uucuucauacauuucgaua

SEQ ID NO: 4103835 - RNA, 22 nt, Streptococcus pneumoniae R6
uucuucauggaucauuucuucu

SEQ ID NO: 4103836 - RNA, 15 nt, Streptococcus pneumoniae R6
uucuuccaacucuuc

SEQ ID NO: 4103837 - RNA, 23 nt, Streptococcus pneumoniae R6
uucuuccacucaaaucauuucuu

SEQ ID NO: 4103838 - RNA, 19 nt, Streptococcus pneumoniae R6
uucuucguaagauucuucu

SEQ ID NO: 4103839 - RNA, 19 nt, Streptococcus pneumoniae R6
uucuucuccgugaacaagu

SEQ ID NO: 4103840 - RNA, 13 nt, Streptococcus pneumoniae R6
uucuucugaaauu

SEQ ID NO: 4103841 - RNA, 14 nt, Streptococcus pneumoniae R6
uucuucuggaaguu

SEQ ID NO: 4103842 - RNA, 20 nt, Streptococcus pneumoniae R6
uucuucuucgucaaauccau

SEQ ID NO: 4103843 - RNA, 19 nt, Streptococcus pneumoniae R6
uucuucuuuauaauauuua

SEQ ID NO: 4103844 - RNA, 14 nt, Streptococcus pneumoniae R6
uucuucuuucacuu

SEQ ID NO: 4103845 - RNA, 20 nt, Streptococcus pneumoniae R6
uucuucuuuucauaauuucu

SEQ ID NO: 4103846 - RNA, 23 nt, Streptococcus pneumoniae R6
uucuugaaaccaguuccuuuguc

SEQ ID NO: 4103847 - RNA, 22 nt, Streptococcus pneumoniae R6
uucuugaccaacuuuaagagcu

SEQ ID NO: 4103848 - RNA, 22 nt, Streptococcus pneumoniae R6
uucuugagaagagcuucuuuca

SEQ ID NO: 4103849 - RNA, 22 nt, Streptococcus pneumoniae R6
uucuugauacugaucaaaaaau

SEQ ID NO: 4103850 - RNA, 15 nt, Streptococcus pneumoniae R6
uucuugauuuguucu

SEQ ID NO: 4103851 - RNA, 18 nt, Streptococcus pneumoniae R6
uucuuggauaccuuuaga

SEQ ID NO: 4103852 - RNA, 23 nt, Streptococcus pneumoniae R6
uucuugggcuggacguucuucaa

SEQ ID NO: 4103853 - RNA, 12 nt, Streptococcus pneumoniae R6
uucuugguauug

SEQ ID NO: 4103854 - RNA, 17 nt, Streptococcus pneumoniae R6
uucuugguugccuuuuu

SEQ ID NO: 4103855 - RNA, 15 nt, Streptococcus pneumoniae R6
uucuuuaaaaaauuu

SEQ ID NO: 4103856 - RNA, 19 nt, Streptococcus pneumoniae R6
uucuuuaaucaagacuuuc

SEQ ID NO: 4103857 - RNA, 13 nt, Streptococcus pneumoniae R6
uucuuuagaaaac

SEQ ID NO: 4103858 - RNA, 19 nt, Streptococcus pneumoniae R6
uucuuuagaaagguuuuaa

SEQ ID NO: 4103859 - RNA, 18 nt, Streptococcus pneumoniae R6
uucuuuauauaaaaagac

SEQ ID NO: 4103860 - RNA, 17 nt, Streptococcus pneumoniae R6
uucuuuauguucaucuu

SEQ ID NO: 4103861 - RNA, 18 nt, Streptococcus pneumoniae R6
uucuuucaaaccagcacc

SEQ ID NO: 4103862 - RNA, 24 nt, Streptococcus pneumoniae R6
uucuuucaacuucgucacauuccc

SEQ ID NO: 4103863 - RNA, 18 nt, Streptococcus pneumoniae R6
uucuuucaucccuuccuu

SEQ ID NO: 4103864 - RNA, 19 nt, Streptococcus pneumoniae R6
uucuuuccgucaagagaug

SEQ ID NO: 4103865 - RNA, 16 nt, Streptococcus pneumoniae R6
uucuuuucauaaagag

SEQ ID NO: 4103866 - RNA, 21 nt, Streptococcus pneumoniae R6
uucuuuucuguugauauuucc

SEQ ID NO: 4103867 - RNA, 17 nt, Streptococcus pneumoniae R6
uucuuuuggauuuucaa

SEQ ID NO: 4103868 - RNA, 12 nt, Streptococcus pneumoniae R6
uucuuuuuauau

SEQ ID NO: 4103869 - RNA, 13 nt, Streptococcus pneumoniae R6
uucuuuuucuccu

SEQ ID NO: 4103870 - RNA, 15 nt, Streptococcus pneumoniae R6
uucuuuuugauuuau

SEQ ID NO: 4103871 - RNA, 17 nt, Streptococcus pneumoniae R6
uucuuuuuguccuucuu

SEQ ID NO: 4103872 - RNA, 14 nt, Streptococcus pneumoniae R6
uucuuuuuguucaa

SEQ ID NO: 4103873 - RNA, 20 nt, Streptococcus pneumoniae R6
uucuuuuuuaauucuuuuuc

SEQ ID NO: 4103874 - RNA, 13 nt, Streptococcus pneumoniae R6
uucuuuuuuacuu

SEQ ID NO: 4103875 - RNA, 19 nt, Streptococcus pneumoniae R6
uucuuuuuuauccucaaaa

SEQ ID NO: 4103876 - RNA, 15 nt, Streptococcus pneumoniae R6
uucuuuuuuauucaa

SEQ ID NO: 4103877 - RNA, 17 nt, Streptococcus pneumoniae R6
uucuuuuuugauguuca

SEQ ID NO: 4103878 - RNA, 15 nt, Streptococcus pneumoniae R6
uucuuuuuuuccaug

SEQ ID NO: 4103879 - RNA, 16 nt, Streptococcus pneumoniae R6
uugaaaaaauaucuuu

SEQ ID NO: 4103880 - RNA, 21 nt, Streptococcus pneumoniae R6
uugaaaaaauaucuuuuauuu

SEQ ID NO: 4103881 - RNA, 16 nt, Streptococcus pneumoniae R6
uugaaaaaauggacuu

SEQ ID NO: 4103882 - RNA, 15 nt, Streptococcus pneumoniae R6
uugaaaaaccaauag

SEQ ID NO: 4103883 - RNA, 10 nt, Streptococcus pneumoniae R6
uugaaaacaa

SEQ ID NO: 4103884 - RNA, 12 nt, Streptococcus pneumoniae R6
uugaaaacaaua

SEQ ID NO: 4103885 - RNA, 14 nt, Streptococcus pneumoniae R6
uugaaaacaauauu

SEQ ID NO: 4103886 - RNA, 22 nt, Streptococcus pneumoniae R6
uugaaaacaauauuuuugagcc

SEQ ID NO: 4103887 - RNA, 21 nt, Streptococcus pneumoniae R6
uugaaaacgguaacaaaacua

SEQ ID NO: 4103888 - RNA, 14 nt, Streptococcus pneumoniae R6
uugaaaauuccauu

SEQ ID NO: 4103889 - RNA, 17 nt, Streptococcus pneumoniae R6
uugaaacaaauaaauca

SEQ ID NO: 4103890 - RNA, 22 nt, Streptococcus pneumoniae R6
uugaaacaagaacaagacaaaa

SEQ ID NO: 4103891 - RNA, 12 nt, Streptococcus pneumoniae R6
uugaaacaauga

SEQ ID NO: 4103892 - RNA, 15 nt, Streptococcus pneumoniae R6
uugaaacaaugaaaa

SEQ ID NO: 4103893 - RNA, 22 nt, Streptococcus pneumoniae R6
uugaaaggaaaaugauuuuuua

SEQ ID NO: 4103894 - RNA, 15 nt, Streptococcus pneumoniae R6
uugaaauaagaauac

SEQ ID NO: 4103895 - RNA, 14 nt, Streptococcus pneumoniae R6
uugaaauaauagac

SEQ ID NO: 4103896 - RNA, 13 nt, Streptococcus pneumoniae R6
uugaaaucaaggc

SEQ ID NO: 4103897 - RNA, 16 nt, Streptococcus pneumoniae R6
uugaaaucagaaaaaa

SEQ ID NO: 4103898 - RNA, 14 nt, Streptococcus pneumoniae R6
uugaaaucugcuca

SEQ ID NO: 4103899 - RNA, 15 nt, Streptococcus pneumoniae R6
uugaaaugaaauaaa

SEQ ID NO: 4103900 - RNA, 11 nt, Streptococcus pneumoniae R6
uugaaaugacc

SEQ ID NO: 4103901 - RNA, 13 nt, Streptococcus pneumoniae R6
uugaaaugaccug

SEQ ID NO: 4103902 - RNA, 17 nt, Streptococcus pneumoniae R6
uugaaauuuaucaacca

SEQ ID NO: 4103903 - RNA, 23 nt, Streptococcus pneumoniae R6
uugaacaaauguugaaucauuuu

SEQ ID NO: 4103904 - RNA, 16 nt, Streptococcus pneumoniae R6
uugaacaccugauuuu

SEQ ID NO: 4103905 - RNA, 14 nt, Streptococcus pneumoniae R6
uugaacuugaaucc

SEQ ID NO: 4103906 - RNA, 11 nt, Streptococcus pneumoniae R6
uugaagaaaag

SEQ ID NO: 4103907 - RNA, 18 nt, Streptococcus pneumoniae R6
uugaagaaaagcuaagcu

SEQ ID NO: 4103908 - RNA, 21 nt, Streptococcus pneumoniae R6
uugaaggggcaacucuucaag

SEQ ID NO: 4103909 - RNA, 14 nt, Streptococcus pneumoniae R6
uugaaguaaagacg

SEQ ID NO: 4103910 - RNA, 22 nt, Streptococcus pneumoniae R6
uugaaguucauuuucuuuacuu

SEQ ID NO: 4103911 - RNA, 23 nt, Streptococcus pneumoniae R6
uugaaguucauuuucuuuacuuc

SEQ ID NO: 4103912 - RNA, 23 nt, Streptococcus pneumoniae R6
uugaaguugacgaaguuguucuu

SEQ ID NO: 4103913 - RNA, 17 nt, Streptococcus pneumoniae R6
uugaaguuggaauaguc

SEQ ID NO: 4103914 - RNA, 15 nt, Streptococcus pneumoniae R6
uugaauaaccucuau

SEQ ID NO: 4103915 - RNA, 15 nt, Streptococcus pneumoniae R6
uugaauagauacaaa

SEQ ID NO: 4103916 - RNA, 18 nt, Streptococcus pneumoniae R6
uugaauauggauaauuga

SEQ ID NO: 4103917 - RNA, 14 nt, Streptococcus pneumoniae R6
uugaaucaauucuu

SEQ ID NO: 4103918 - RNA, 19 nt, Streptococcus pneumoniae R6
uugaaucgacgcuuucuaa

SEQ ID NO: 4103919 - RNA, 17 nt, Streptococcus pneumoniae R6
uugaaucuggcuuucaa

SEQ ID NO: 4103920 - RNA, 17 nt, Streptococcus pneumoniae R6
uugaaugccuguuccaa

SEQ ID NO: 4103921 - RNA, 13 nt, Streptococcus pneumoniae R6
uugaaugcuuacu

SEQ ID NO: 4103922 - RNA, 18 nt, Streptococcus pneumoniae R6
uugaaugcuuacuucacu

SEQ ID NO: 4103923 - RNA, 13 nt, Streptococcus pneumoniae R6
uugaauguacugc

SEQ ID NO: 4103924 - RNA, 22 nt, Streptococcus pneumoniae R6
uugaauguacugcccccaaaca

SEQ ID NO: 4103925 - RNA, 13 nt, Streptococcus pneumoniae R6
uugaauguccuug

SEQ ID NO: 4103926 - RNA, 14 nt, Streptococcus pneumoniae R6
uugaauguugaaac

SEQ ID NO: 4103927 - RNA, 15 nt, Streptococcus pneumoniae R6
uugacaaagaaaaaa

SEQ ID NO: 4103928 - RNA, 18 nt, Streptococcus pneumoniae R6
uugacaaagaaaaaacaa

SEQ ID NO: 4103929 - RNA, 11 nt, Streptococcus pneumoniae R6
uugacaaagag

SEQ ID NO: 4103930 - RNA, 20 nt, Streptococcus pneumoniae R6
uugacaaagagccaaaaaag

SEQ ID NO: 4103931 - RNA, 23 nt, Streptococcus pneumoniae R6
uugacaaagagccaaaaaagaaa

SEQ ID NO: 4103932 - RNA, 22 nt, Streptococcus pneumoniae R6
uugacaaagagccauaaaaaua

SEQ ID NO: 4103933 - RNA, 13 nt, Streptococcus pneumoniae R6
uugacaaaguuug

SEQ ID NO: 4103934 - RNA, 16 nt, Streptococcus pneumoniae R6
uugacaagguuuccug

SEQ ID NO: 4103935 - RNA, 19 nt, Streptococcus pneumoniae R6
uugacagaaccuuggaaau

SEQ ID NO: 4103936 - RNA, 18 nt, Streptococcus pneumoniae R6
uugauguacuacugcuug

SEQ ID NO: 4103937 - RNA, 22 nt, Streptococcus pneumoniae R6
uugauguucaaagucaucaaaa

SEQ ID NO: 4103938 - RNA, 14 nt, Streptococcus pneumoniae R6
uugauuaagugacu

SEQ ID NO: 4103939 - RNA, 20 nt, Streptococcus pneumoniae R6
uugauuacaauuuaccugcu

SEQ ID NO: 4103940 - RNA, 14 nt, Streptococcus pneumoniae R6
uugauuagcaaaac

SEQ ID NO: 4103941 - RNA, 16 nt, Streptococcus pneumoniae R6
uugauuagcaaaacgu

SEQ ID NO: 4103942 - RNA, 16 nt, Streptococcus pneumoniae R6
uugauuaggauuuuuu

SEQ ID NO: 4103943 - RNA, 17 nt, Streptococcus pneumoniae R6
uugauuauccuuuacuu

SEQ ID NO: 4103944 - RNA, 13 nt, Streptococcus pneumoniae R6
uugauucaaaguc

SEQ ID NO: 4103945 - RNA, 16 nt, Streptococcus pneumoniae R6
uugauucaaagucaua

SEQ ID NO: 4103946 - RNA, 11 nt, Streptococcus pneumoniae R6
uugauucagua

SEQ ID NO: 4103947 - RNA, 22 nt, Streptococcus pneumoniae R6
uugauucaugacaucuuccaaa

SEQ ID NO: 4103948 - RNA, 21 nt, Streptococcus pneumoniae R6
uugauuccgucauguucauuu

SEQ ID NO: 4103949 - RNA, 19 nt, Streptococcus pneumoniae R6
uugauucgcucuucaaucu

SEQ ID NO: 4103950 - RNA, 15 nt, Streptococcus pneumoniae R6
uugauuuaugccaua

SEQ ID NO: 4103951 - RNA, 18 nt, Streptococcus pneumoniae R6
uugauuuccaaaaaguag

SEQ ID NO: 4103952 - RNA, 23 nt, Streptococcus pneumoniae R6
uugauuuccauuucuuuucugac

SEQ ID NO: 4103953 - RNA, 19 nt, Streptococcus pneumoniae R6
uugauuuccugauuaccaa

SEQ ID NO: 4103954 - RNA, 13 nt, Streptococcus pneumoniae R6
uugauuucuaaag

SEQ ID NO: 4103955 - RNA, 15 nt, Streptococcus pneumoniae R6
uugauuugauuagga

SEQ ID NO: 4103956 - RNA, 19 nt, Streptococcus pneumoniae R6
uugauuuguucgcaucuua

SEQ ID NO: 4103957 - RNA, 14 nt, Streptococcus pneumoniae R6
uugauuuuacugau

SEQ ID NO: 4103958 - RNA, 12 nt, Streptococcus pneumoniae R6
uugauuuuaugc

SEQ ID NO: 4103959 - RNA, 19 nt, Streptococcus pneumoniae R6
uugauuuugagacuaagga

SEQ ID NO: 4103960 - RNA, 17 nt, Streptococcus pneumoniae R6
uugauuuuguaaaaaua

SEQ ID NO: 4103961 - RNA, 16 nt, Streptococcus pneumoniae R6
uugauuuuuauugagu

SEQ ID NO: 4103962 - RNA, 16 nt, Streptococcus pneumoniae R6
uugauuuuucugaguc

SEQ ID NO: 4103963 - RNA, 16 nt, Streptococcus pneumoniae R6
uugauuuuugccauau

SEQ ID NO: 4103964 - RNA, 13 nt, Streptococcus pneumoniae R6
uugcaaacuuuuu

SEQ ID NO: 4103965 - RNA, 20 nt, Streptococcus pneumoniae R6
uugcaaagaguuuucugauu

SEQ ID NO: 4103966 - RNA, 13 nt, Streptococcus pneumoniae R6
uugcaaaguuuuc

SEQ ID NO: 4103967 - RNA, 22 nt, Streptococcus pneumoniae R6
uugcaacuggagacuuucguuc

SEQ ID NO: 4103968 - RNA, 19 nt, Streptococcus pneumoniae R6
uugcaagaaaguagagucc

SEQ ID NO: 4103969 - RNA, 20 nt, Streptococcus pneumoniae R6
uugcaagaaaguagagucca

SEQ ID NO: 4103970 - RNA, 22 nt, Streptococcus pneumoniae R6
uugcaagaaaguagaguccaaa

SEQ ID NO: 4103971 - RNA, 12 nt, Streptococcus pneumoniae R6
uugcaagaagca

SEQ ID NO: 4103972 - RNA, 13 nt, Streptococcus pneumoniae R6
uugcaagagaaau

SEQ ID NO: 4103973 - RNA, 20 nt, Streptococcus pneumoniae R6
uugcaagcccuuauuuccau

SEQ ID NO: 4103974 - RNA, 22 nt, Streptococcus pneumoniae R6
uugcaagcccuuauuuccaucu

SEQ ID NO: 4103975 - RNA, 17 nt, Streptococcus pneumoniae R6
uugcacaauauagccua

SEQ ID NO: 4103976 - RNA, 20 nt, Streptococcus pneumoniae R6
uugcaccugaacggcuaguc

SEQ ID NO: 4103977 - RNA, 14 nt, Streptococcus pneumoniae R6
uugcagacgaccag

SEQ ID NO: 4103978 - RNA, 18 nt, Streptococcus pneumoniae R6
uugcagauagaacugacg

SEQ ID NO: 4103979 - RNA, 20 nt, Streptococcus pneumoniae R6
uugcaggagaaaaugaaaua

SEQ ID NO: 4103980 - RNA, 19 nt, Streptococcus pneumoniae R6
uugcagguucgauuccugc

SEQ ID NO: 4103981 - RNA, 11 nt, Streptococcus pneumoniae R6
uugcaguauau

SEQ ID NO: 4103982 - RNA, 15 nt, Streptococcus pneumoniae R6
uugcaguugaaauaa

SEQ ID NO: 4103983 - RNA, 14 nt, Streptococcus pneumoniae R6
uugcauaaaugucg

SEQ ID NO: 4103984 - RNA, 16 nt, Streptococcus pneumoniae R6
uugcauagacuucaac

SEQ ID NO: 4103985 - RNA, 16 nt, Streptococcus pneumoniae R6
uugcauuaaaaaguuu

SEQ ID NO: 4103986 - RNA, 17 nt, Streptococcus pneumoniae R6
uugcauuaaaaaguuuu

SEQ ID NO: 4103987 - RNA, 14 nt, Streptococcus pneumoniae R6
uugcauuuuaauuu

SEQ ID NO: 4103988 - RNA, 21 nt, Streptococcus pneumoniae R6
uugcauuuuuuauugcaauuu

SEQ ID NO: 4103989 - RNA, 17 nt, Streptococcus pneumoniae R6
uugccagaaaaagucaa

SEQ ID NO: 4103990 - RNA, 14 nt, Streptococcus pneumoniae R6
uugcccuagcuguu

SEQ ID NO: 4103991 - RNA, 21 nt, Streptococcus pneumoniae R6
uugccuaaacacuucacuaau

SEQ ID NO: 4103992 - RNA, 13 nt, Streptococcus pneumoniae R6
uugccuaauuuuu

SEQ ID NO: 4103993 - RNA, 20 nt, Streptococcus pneumoniae R6
uugccucagauucugacaau

SEQ ID NO: 4103994 - RNA, 22 nt, Streptococcus pneumoniae R6
uugccucccacuaucuaaaaaa

SEQ ID NO: 4103995 - RNA, 17 nt, Streptococcus pneumoniae R6
uugccuuagcaacuguu

SEQ ID NO: 4103996 - RNA, 13 nt, Streptococcus pneumoniae R6
uugcgaagugaua

SEQ ID NO: 4103997 - RNA, 19 nt, Streptococcus pneumoniae R6
uugcgauaaagcuaaagau

SEQ ID NO: 4103998 - RNA, 12 nt, Streptococcus pneumoniae R6
uugcgaugauga

SEQ ID NO: 4103999 - RNA, 15 nt, Streptococcus pneumoniae R6
uugcgcagccuuuaa

SEQ ID NO: 4104000 - RNA, 20 nt, Streptococcus pneumoniae R6
uugcgcauguaaagaggagu

SEQ ID NO: 4104001 - RNA, 17 nt, Streptococcus pneumoniae R6
uugcggaauucaaacca

SEQ ID NO: 4104002 - RNA, 13 nt, Streptococcus pneumoniae R6
uugcuaaaacauu

SEQ ID NO: 4104003 - RNA, 21 nt, Streptococcus pneumoniae R6
uugcuaaaacauuuauagaaa

SEQ ID NO: 4104004 - RNA, 22 nt, Streptococcus pneumoniae R6
uugcuacaaggacauugacuuu

SEQ ID NO: 4104005 - RNA, 20 nt, Streptococcus pneumoniae R6
uugcucaaaguacugccuug

SEQ ID NO: 4104006 - RNA, 19 nt, Streptococcus pneumoniae R6
uugcucacgggucaugccu

SEQ ID NO: 4104007 - RNA, 18 nt, Streptococcus pneumoniae R6
uugcucagcauucucaau

SEQ ID NO: 4104008 - RNA, 17 nt, Streptococcus pneumoniae R6
uugcucagugauguuaa

SEQ ID NO: 4104009 - RNA, 19 nt, Streptococcus pneumoniae R6
uugcuccauucuuuuacuu

SEQ ID NO: 4104010 - RNA, 23 nt, Streptococcus pneumoniae R6
uugcucggcuuuuuguuuucuau

SEQ ID NO: 4104011 - RNA, 21 nt, Streptococcus pneumoniae R6
uugcucuauacacauccagug

SEQ ID NO: 4104012 - RNA, 12 nt, Streptococcus pneumoniae R6
uugcucugucac

SEQ ID NO: 4104013 - RNA, 13 nt, Streptococcus pneumoniae R6
uugcucuuaucug

SEQ ID NO: 4104014 - RNA, 14 nt, Streptococcus pneumoniae R6
uugcucuucugaaa

SEQ ID NO: 4104015 - RNA, 16 nt, Streptococcus pneumoniae R6
uugcucuucugaaauc

SEQ ID NO: 4104016 - RNA, 19 nt, Streptococcus pneumoniae R6
uugcugcguuaaauccuau

SEQ ID NO: 4104017 - RNA, 20 nt, Streptococcus pneumoniae R6
uugcuguccucaaaaugaaa

SEQ ID NO: 4104018 - RNA, 14 nt, Streptococcus pneumoniae R6
uugcugucuccagu

SEQ ID NO: 4104019 - RNA, 17 nt, Streptococcus pneumoniae R6
uugcuguuuauaucuaa

SEQ ID NO: 4104020 - RNA, 18 nt, Streptococcus pneumoniae R6
uugcuuaauccucaauca

SEQ ID NO: 4104021 - RNA, 11 nt, Streptococcus pneumoniae R6
uugcuuagaaa

SEQ ID NO: 4104022 - RNA, 15 nt, Streptococcus pneumoniae R6
uugcuuauacucaau

SEQ ID NO: 4104023 - RNA, 16 nt, Streptococcus pneumoniae R6
uugcuuccaaaaauuc

SEQ ID NO: 4104024 - RNA, 14 nt, Streptococcus pneumoniae R6
uugcuugaaaacuc

SEQ ID NO: 4104025 - RNA, 14 nt, Streptococcus pneumoniae R6
uugcuugaccagcu

SEQ ID NO: 4104026 - RNA, 13 nt, Streptococcus pneumoniae R6
uugcuugucaucu

SEQ ID NO: 4104027 - RNA, 14 nt, Streptococcus pneumoniae R6
uugcuuguuccaau

SEQ ID NO: 4104028 - RNA, 21 nt, Streptococcus pneumoniae R6
uugcuuuccucagcaggagca

SEQ ID NO: 4104029 - RNA, 23 nt, Streptococcus pneumoniae R6
uugcuuuuagagauuuucauaaa

SEQ ID NO: 4104030 - RNA, 14 nt, Streptococcus pneumoniae R6
uugcuuuuuuauau

SEQ ID NO: 4104031 - RNA, 13 nt, Streptococcus pneumoniae R6
uuggaaaaaauaa

SEQ ID NO: 4104032 - RNA, 22 nt, Streptococcus pneumoniae R6
uuggaaauaacaaaccaagaau

SEQ ID NO: 4104033 - RNA, 14 nt, Streptococcus pneumoniae R6
uuggaacuaaaguu

SEQ ID NO: 4104034 - RNA, 18 nt, Streptococcus pneumoniae R6
uuggaacuaaaguuccua

SEQ ID NO: 4104035 - RNA, 20 nt, Streptococcus pneumoniae R6
uuggaacuaaaguuccuaau

SEQ ID NO: 4104036 - RNA, 13 nt, Streptococcus pneumoniae R6
uuggaagaaaucc

SEQ ID NO: 4104037 - RNA, 16 nt, Streptococcus pneumoniae R6
uuggaagucaaaucaa

SEQ ID NO: 4104038 - RNA, 14 nt, Streptococcus pneumoniae R6
uuggaaguuuuccu

SEQ ID NO: 4104039 - RNA, 22 nt, Streptococcus pneumoniae R6
uugugaggaccagguuuuucac

SEQ ID NO: 4104040 - RNA, 20 nt, Streptococcus pneumoniae R6
uugugauuuuaaauuuacuu

SEQ ID NO: 4104041 - RNA, 13 nt, Streptococcus pneumoniae R6
uugugcaacuucc

SEQ ID NO: 4104042 - RNA, 17 nt, Streptococcus pneumoniae R6
uugugcacacucagaac

SEQ ID NO: 4104043 - RNA, 22 nt, Streptococcus pneumoniae R6
uugugcaguuuucauucuacua

SEQ ID NO: 4104044 - RNA, 16 nt, Streptococcus pneumoniae R6
uugugcugacauugaa

SEQ ID NO: 4104045 - RNA, 17 nt, Streptococcus pneumoniae R6
uugugcuugauaaguuu

SEQ ID NO: 4104046 - RNA, 15 nt, Streptococcus pneumoniae R6
uuguggauagaacug

SEQ ID NO: 4104047 - RNA, 18 nt, Streptococcus pneumoniae R6
uuguggaugaaacugacg

SEQ ID NO: 4104048 - RNA, 16 nt, Streptococcus pneumoniae R6
uugugguugaaaacaa

SEQ ID NO: 4104049 - RNA, 19 nt, Streptococcus pneumoniae R6
uuguguacucaacagaaga

SEQ ID NO: 4104050 - RNA, 18 nt, Streptococcus pneumoniae R6
uugugugaaauuugugau

SEQ ID NO: 4104051 - RNA, 22 nt, Streptococcus pneumoniae R6
uuguguuccgaagaguucaaua

SEQ ID NO: 4104052 - RNA, 13 nt, Streptococcus pneumoniae R6
uuguguucuacuc

SEQ ID NO: 4104053 - RNA, 13 nt, Streptococcus pneumoniae R6
uuguguuugacca

SEQ ID NO: 4104054 - RNA, 21 nt, Streptococcus pneumoniae R6
uuguuaauaacucgaucaaca

SEQ ID NO: 4104055 - RNA, 23 nt, Streptococcus pneumoniae R6
uuguuagccauacguuucaugga

SEQ ID NO: 4104056 - RNA, 19 nt, Streptococcus pneumoniae R6
uuguuauuuaggacaucau

SEQ ID NO: 4104057 - RNA, 21 nt, Streptococcus pneumoniae R6
uuguucaaaauuaagauagcc

SEQ ID NO: 4104058 - RNA, 14 nt, Streptococcus pneumoniae R6
uuguucacaucuua

SEQ ID NO: 4104059 - RNA, 14 nt, Streptococcus pneumoniae R6
uuguuccuaaaaca

SEQ ID NO: 4104060 - RNA, 16 nt, Streptococcus pneumoniae R6
uuguucguauccuauu

SEQ ID NO: 4104061 - RNA, 23 nt, Streptococcus pneumoniae R6
uuguugaaaauauuuuaaacguu

SEQ ID NO: 4104062 - RNA, 15 nt, Streptococcus pneumoniae R6
uuguuguaauaauca

SEQ ID NO: 4104063 - RNA, 15 nt, Streptococcus pneumoniae R6
uuguuguaguaauca

SEQ ID NO: 4104064 - RNA, 21 nt, Streptococcus pneumoniae R6
uuguuuaagagcacaaaauca

SEQ ID NO: 4104065 - RNA, 22 nt, Streptococcus pneumoniae R6
uuguuuaagguggcgauuuuuu

SEQ ID NO: 4104066 - RNA, 14 nt, Streptococcus pneumoniae R6
uuguuuauaaaaua

SEQ ID NO: 4104067 - RNA, 12 nt, Streptococcus pneumoniae R6
uuguuuccaugc

SEQ ID NO: 4104068 - RNA, 12 nt, Streptococcus pneumoniae R6
uuguuucuuauc

SEQ ID NO: 4104069 - RNA, 16 nt, Streptococcus pneumoniae R6
uuguuuguacuuguuc

SEQ ID NO: 4104070 - RNA, 18 nt, Streptococcus pneumoniae R6
uuguuuuaauauaauauc

SEQ ID NO: 4104071 - RNA, 13 nt, Streptococcus pneumoniae R6
uuguuuucaagug

SEQ ID NO: 4104072 - RNA, 16 nt, Streptococcus pneumoniae R6
uuguuuugucgcuuuu

SEQ ID NO: 4104073 - RNA, 14 nt, Streptococcus pneumoniae R6
uuguuuuuccugau

SEQ ID NO: 4104074 - RNA, 14 nt, Streptococcus pneumoniae R6
uuguuuuuuccuau

SEQ ID NO: 4104075 - RNA, 12 nt, Streptococcus pneumoniae R6
uuuaaaaaaacu

SEQ ID NO: 4104076 - RNA, 22 nt, Streptococcus pneumoniae R6
uuuaaaaaagugguaucauaua

SEQ ID NO: 4104077 - RNA, 19 nt, Streptococcus pneumoniae R6
uuuaaaaaaucuuuuucau

SEQ ID NO: 4104078 - RNA, 14 nt, Streptococcus pneumoniae R6
uuuaaaaacaauca

SEQ ID NO: 4104079 - RNA, 17 nt, Streptococcus pneumoniae R6
uuuaaaaagaaauauau

SEQ ID NO: 4104080 - RNA, 23 nt, Streptococcus pneumoniae R6
uuuaaaaauccacuugggaaacc

SEQ ID NO: 4104081 - RNA, 21 nt, Streptococcus pneumoniae R6
uuuaaaaauuuuuuucuaauu

SEQ ID NO: 4104082 - RNA, 21 nt, Streptococcus pneumoniae R6
uuuaaaagauacuaacacaua

SEQ ID NO: 4104083 - RNA, 15 nt, Streptococcus pneumoniae R6
uuuaaaauccauaau

SEQ ID NO: 4104084 - RNA, 12 nt, Streptococcus pneumoniae R6
uuuaaaauccuc

SEQ ID NO: 4104085 - RNA, 13 nt, Streptococcus pneumoniae R6
uuuaaaauccucu

SEQ ID NO: 4104086 - RNA, 17 nt, Streptococcus pneumoniae R6
uuuaaaauuaaaaagag

SEQ ID NO: 4104087 - RNA, 18 nt, Streptococcus pneumoniae R6
uuuaaaccacgucaguuu

SEQ ID NO: 4104088 - RNA, 18 nt, Streptococcus pneumoniae R6
uuuaaaccgcgauuuuuu

SEQ ID NO: 4104089 - RNA, 13 nt, Streptococcus pneumoniae R6
uuuaaacugauuu

SEQ ID NO: 4104090 - RNA, 22 nt, Streptococcus pneumoniae R6
uuuaaagaaauagaaaacaaaa

SEQ ID NO: 4104091 - RNA, 22 nt, Streptococcus pneumoniae R6
uuuaaagacagucugaaaaaua

SEQ ID NO: 4104092 - RNA, 23 nt, Streptococcus pneumoniae R6
uuuaaagacagucugaaaaauag

SEQ ID NO: 4104093 - RNA, 20 nt, Streptococcus pneumoniae R6
uuuaaagacuuuuuucuaua

SEQ ID NO: 4104094 - RNA, 17 nt, Streptococcus pneumoniae R6
uuuaaaggucaauuccu

SEQ ID NO: 4104095 - RNA, 17 nt, Streptococcus pneumoniae R6
uuuaaauacuuuuuccu

SEQ ID NO: 4104096 - RNA, 14 nt, Streptococcus pneumoniae R6
uuuaaauccugcaa

SEQ ID NO: 4104097 - RNA, 18 nt, Streptococcus pneumoniae R6
uuuaaaucgcuucuguaa

SEQ ID NO: 4104098 - RNA, 18 nt, Streptococcus pneumoniae R6
uuuaaauguuuucucaua

SEQ ID NO: 4104099 - RNA, 13 nt, Streptococcus pneumoniae R6
uuuaaauuuacuu

SEQ ID NO: 4104100 - RNA, 12 nt, Streptococcus pneumoniae R6
uuuaacaaacca

SEQ ID NO: 4104101 - RNA, 20 nt, Streptococcus pneumoniae R6
uuuaacauacuguuuuccuu

SEQ ID NO: 4104102 - RNA, 14 nt, Streptococcus pneumoniae R6
uuuaaccugaugaa

SEQ ID NO: 4104103 - RNA, 15 nt, Streptococcus pneumoniae R6
uuuaacgccucccaa

SEQ ID NO: 4104104 - RNA, 18 nt, Streptococcus pneumoniae R6
uuuaacuacuugauaaaa

SEQ ID NO: 4104105 - RNA, 20 nt, Streptococcus pneumoniae R6
uuuaacuuuuuugagaaauu

SEQ ID NO: 4104106 - RNA, 19 nt, Streptococcus pneumoniae R6
uuuaagacuuguuagcuga

SEQ ID NO: 4104107 - RNA, 21 nt, Streptococcus pneumoniae R6
uuuaagguuguggauggaacu

SEQ ID NO: 4104108 - RNA, 23 nt, Streptococcus pneumoniae R6
uuuaagguuguggauggaacuga

SEQ ID NO: 4104109 - RNA, 15 nt, Streptococcus pneumoniae R6
uuuaauauacuugau

SEQ ID NO: 4104110 - RNA, 22 nt, Streptococcus pneumoniae R6
uuuaaucuugacuauauuucuu

SEQ ID NO: 4104111 - RNA, 23 nt, Streptococcus pneumoniae R6
uuuaaucuugacuauauuucuua

SEQ ID NO: 4104112 - RNA, 15 nt, Streptococcus pneumoniae R6
uuuaaugcaguaaau

SEQ ID NO: 4104113 - RNA, 19 nt, Streptococcus pneumoniae R6
uuuaaugcuaauuuagaaa

SEQ ID NO: 4104114 - RNA, 22 nt, Streptococcus pneumoniae R6
uuuaaugcuaauuuagaaauag

SEQ ID NO: 4104115 - RNA, 15 nt, Streptococcus pneumoniae R6
uuuaauuagaaaaaa

SEQ ID NO: 4104116 - RNA, 16 nt, Streptococcus pneumoniae R6
uuuaauuauuuucaaa

SEQ ID NO: 4104117 - RNA, 18 nt, Streptococcus pneumoniae R6
uuuaauuauuuucaaaau

SEQ ID NO: 4104118 - RNA, 21 nt, Streptococcus pneumoniae R6
uuuaauucuuuuucaaaugua

SEQ ID NO: 4104119 - RNA, 16 nt, Streptococcus pneumoniae R6
uuuacaagugaaguaa

SEQ ID NO: 4104120 - RNA, 15 nt, Streptococcus pneumoniae R6
uuuacaauguuguca

SEQ ID NO: 4104121 - RNA, 23 nt, Streptococcus pneumoniae R6
uuuacaauguugucaauuuccau

SEQ ID NO: 4104122 - RNA, 15 nt, Streptococcus pneumoniae R6
uuuacaucaagcuca

SEQ ID NO: 4104123 - RNA, 19 nt, Streptococcus pneumoniae R6
uuuacaucaagcucaucua

SEQ ID NO: 4104124 - RNA, 18 nt, Streptococcus pneumoniae R6
uuuacaugcgcaaaauaa

SEQ ID NO: 4104125 - RNA, 20 nt, Streptococcus pneumoniae R6
uuuaccaaaaaugugaacau

SEQ ID NO: 4104126 - RNA, 15 nt, Streptococcus pneumoniae R6
uuuaccaaaaccuuc

SEQ ID NO: 4104127 - RNA, 16 nt, Streptococcus pneumoniae R6
uuuaccccaaauuccu

SEQ ID NO: 4104128 - RNA, 17 nt, Streptococcus pneumoniae R6
uuuaccugcuacugcau

SEQ ID NO: 4104129 - RNA, 21 nt, Streptococcus pneumoniae R6
uuuaccuuaauucguuuguug

SEQ ID NO: 4104130 - RNA, 21 nt, Streptococcus pneumoniae R6
uuuaccuuaauucucuuguug

SEQ ID NO: 4104131 - RNA, 14 nt, Streptococcus pneumoniae R6
uuuaccuucaaguu

SEQ ID NO: 4104132 - RNA, 18 nt, Streptococcus pneumoniae R6
uuuacggacauguauauu

SEQ ID NO: 4104133 - RNA, 18 nt, Streptococcus pneumoniae R6
uuuacguccaccacaaaa

SEQ ID NO: 4104134 - RNA, 16 nt, Streptococcus pneumoniae R6
uuuacguuuucguguu

SEQ ID NO: 4104135 - RNA, 13 nt, Streptococcus pneumoniae R6
uuuacuaaaauaa

SEQ ID NO: 4104136 - RNA, 20 nt, Streptococcus pneumoniae R6
uuuacuaaaauaacuguaau

SEQ ID NO: 4104137 - RNA, 23 nt, Streptococcus pneumoniae R6
uuuacuaaauacuagucuuucuu

SEQ ID NO: 4104138 - RNA, 14 nt, Streptococcus pneumoniae R6
uuuacuacaaagag

SEQ ID NO: 4104139 - RNA, 16 nt, Streptococcus pneumoniae R6
uuuacuaguucucaaa

SEQ ID NO: 4104140 - RNA, 17 nt, Streptococcus pneumoniae R6
uuuacuauacuuacuua

SEQ ID NO: 4104141 - RNA, 23 nt, Streptococcus pneumoniae R6
uuucaaauucuuuagaaaacuag

SEQ ID NO: 4104142 - RNA, 16 nt, Streptococcus pneumoniae R6
uuucaaauuuucuuua

SEQ ID NO: 4104143 - RNA, 18 nt, Streptococcus pneumoniae R6
uuucaacaugucagcuga

SEQ ID NO: 4104144 - RNA, 22 nt, Streptococcus pneumoniae R6
uuucaacccacuacaguugaca

SEQ ID NO: 4104145 - RNA, 18 nt, Streptococcus pneumoniae R6
uuucaacuauagccaucu

SEQ ID NO: 4104146 - RNA, 17 nt, Streptococcus pneumoniae R6
uuucaacugcuuuuuca

SEQ ID NO: 4104147 - RNA, 18 nt, Streptococcus pneumoniae R6
uuucaagaauuaagugac

SEQ ID NO: 4104148 - RNA, 18 nt, Streptococcus pneumoniae R6
uuucaagaccauuuccau

SEQ ID NO: 4104149 - RNA, 20 nt, Streptococcus pneumoniae R6
uuucaagcgaacaucuccaa

SEQ ID NO: 4104150 - RNA, 16 nt, Streptococcus pneumoniae R6
uuucaagucuucugaa

SEQ ID NO: 4104151 - RNA, 16 nt, Streptococcus pneumoniae R6
uuucaagucuugugaa

SEQ ID NO: 4104152 - RNA, 14 nt, Streptococcus pneumoniae R6
uuucaagugacaua

SEQ ID NO: 4104153 - RNA, 19 nt, Streptococcus pneumoniae R6
uuucaauauguuugguugu

SEQ ID NO: 4104154 - RNA, 21 nt, Streptococcus pneumoniae R6
uuucaaugcccuugauaauaa

SEQ ID NO: 4104155 - RNA, 13 nt, Streptococcus pneumoniae R6
uuucaauucuuca

SEQ ID NO: 4104156 - RNA, 12 nt, Streptococcus pneumoniae R6
uuucaauugacu

SEQ ID NO: 4104157 - RNA, 12 nt, Streptococcus pneumoniae R6
uuucaauuguag

SEQ ID NO: 4104158 - RNA, 21 nt, Streptococcus pneumoniae R6
uuucaauuguuuauaaaauaa

SEQ ID NO: 4104159 - RNA, 18 nt, Streptococcus pneumoniae R6
uuucacaauuucauuucu

SEQ ID NO: 4104160 - RNA, 12 nt, Streptococcus pneumoniae R6
uuucacauagcu

SEQ ID NO: 4104161 - RNA, 22 nt, Streptococcus pneumoniae R6
uuucacgcgcauucguuucuuu

SEQ ID NO: 4104162 - RNA, 23 nt, Streptococcus pneumoniae R6
uuucacgguaaacggcauuguug

SEQ ID NO: 4104163 - RNA, 18 nt, Streptococcus pneumoniae R6
uuucacguuguucaagcc

SEQ ID NO: 4104164 - RNA, 21 nt, Streptococcus pneumoniae R6
uuucacguuguucaagccuua

SEQ ID NO: 4104165 - RNA, 16 nt, Streptococcus pneumoniae R6
uuucacuagaaaauga

SEQ ID NO: 4104166 - RNA, 22 nt, Streptococcus pneumoniae R6
uuucacuagaaaaugaggaaaa

SEQ ID NO: 4104167 - RNA, 22 nt, Streptococcus pneumoniae R6
uuucacuauauugcaagagaaa

SEQ ID NO: 4104168 - RNA, 18 nt, Streptococcus pneumoniae R6
uuucacuccacuauaaaa

SEQ ID NO: 4104169 - RNA, 18 nt, Streptococcus pneumoniae R6
uuucacuuguauccuccu

SEQ ID NO: 4104170 - RNA, 21 nt, Streptococcus pneumoniae R6
uuucacuuguauccuccucua

SEQ ID NO: 4104171 - RNA, 21 nt, Streptococcus pneumoniae R6
uuucagaaagaagggcagcca

SEQ ID NO: 4104172 - RNA, 21 nt, Streptococcus pneumoniae R6
uuucagaacuuuuaacuucag

SEQ ID NO: 4104173 - RNA, 17 nt, Streptococcus pneumoniae R6
uuucagagacagcuugu

SEQ ID NO: 4104174 - RNA, 20 nt, Streptococcus pneumoniae R6
uuucagagggcuuuuucauu

SEQ ID NO: 4104175 - RNA, 12 nt, Streptococcus pneumoniae R6
uuucagauuuua

SEQ ID NO: 4104176 - RNA, 15 nt, Streptococcus pneumoniae R6
uuucagauuuuaaag

SEQ ID NO: 4104177 - RNA, 13 nt, Streptococcus pneumoniae R6
uuucagauuuuua

SEQ ID NO: 4104178 - RNA, 18 nt, Streptococcus pneumoniae R6
uuucagccaagugaguaa

SEQ ID NO: 4104179 - RNA, 18 nt, Streptococcus pneumoniae R6
uuucagccacuauuuuau

SEQ ID NO: 4104180 - RNA, 20 nt, Streptococcus pneumoniae R6
uuucagcuucuauuucuugu

SEQ ID NO: 4104181 - RNA, 15 nt, Streptococcus pneumoniae R6
uuucaguagauaaua

SEQ ID NO: 4104182 - RNA, 19 nt, Streptococcus pneumoniae R6
uuucaguuuacuauacuag

SEQ ID NO: 4104183 - RNA, 12 nt, Streptococcus pneumoniae R6
uuucaguuucau

SEQ ID NO: 4104184 - RNA, 12 nt, Streptococcus pneumoniae R6
uuucauaaacaa

SEQ ID NO: 4104185 - RNA, 18 nt, Streptococcus pneumoniae R6
uuucauaaacaagagcaa

SEQ ID NO: 4104186 - RNA, 13 nt, Streptococcus pneumoniae R6
uuucauaaauaga

SEQ ID NO: 4104187 - RNA, 19 nt, Streptococcus pneumoniae R6
uuucauaagccguaaucau

SEQ ID NO: 4104188 - RNA, 13 nt, Streptococcus pneumoniae R6
uuucauaauuucu

SEQ ID NO: 4104189 - RNA, 19 nt, Streptococcus pneumoniae R6
uuucauauaauaaauugua

SEQ ID NO: 4104190 - RNA, 19 nt, Streptococcus pneumoniae R6
uuucauauguaaacaguaa

SEQ ID NO: 4104191 - RNA, 15 nt, Streptococcus pneumoniae R6
uuucauccacaaccu

SEQ ID NO: 4104192 - RNA, 17 nt, Streptococcus pneumoniae R6
uuucauccacaaccuca

SEQ ID NO: 4104193 - RNA, 23 nt, Streptococcus pneumoniae R6
uuucauccacaaccucaaaacag

SEQ ID NO: 4104194 - RNA, 18 nt, Streptococcus pneumoniae R6
uuucauccccauuuguau

SEQ ID NO: 4104195 - RNA, 17 nt, Streptococcus pneumoniae R6
uuucaucuacaaccuca

SEQ ID NO: 4104196 - RNA, 19 nt, Streptococcus pneumoniae R6
uuucaucuacaaccucaaa

SEQ ID NO: 4104197 - RNA, 19 nt, Streptococcus pneumoniae R6
uuucaugacagauucauca

SEQ ID NO: 4104198 - RNA, 20 nt, Streptococcus pneumoniae R6
uuucauguauuccaagagua

SEQ ID NO: 4104199 - RNA, 16 nt, Streptococcus pneumoniae R6
uuucauguuccagacu

SEQ ID NO: 4104200 - RNA, 15 nt, Streptococcus pneumoniae R6
uuucauuacagaaca

SEQ ID NO: 4104201 - RNA, 20 nt, Streptococcus pneumoniae R6
uuucauuacuaaguuccugu

SEQ ID NO: 4104202 - RNA, 20 nt, Streptococcus pneumoniae R6
uuucauugaguauuauuuca

SEQ ID NO: 4104203 - RNA, 17 nt, Streptococcus pneumoniae R6
uuucauuucgacugaaa

SEQ ID NO: 4104204 - RNA, 18 nt, Streptococcus pneumoniae R6
uuucauuuggcuauaaaa

SEQ ID NO: 4104205 - RNA, 18 nt, Streptococcus pneumoniae R6
uuucauuuuaauauauaa

SEQ ID NO: 4104206 - RNA, 21 nt, Streptococcus pneumoniae R6
uuucauuuuacuauauaucau

SEQ ID NO: 4104207 - RNA, 15 nt, Streptococcus pneumoniae R6
uuuccaagaucuuuu

SEQ ID NO: 4104208 - RNA, 18 nt, Streptococcus pneumoniae R6
uuuccaagaucuuuuuau

SEQ ID NO: 4104209 - RNA, 22 nt, Streptococcus pneumoniae R6
uuuccaaggaaaguucuucccc

SEQ ID NO: 4104210 - RNA, 12 nt, Streptococcus pneumoniae R6
uuuccaaucaga

SEQ ID NO: 4104211 - RNA, 23 nt, Streptococcus pneumoniae R6
uuuccaaucagacuguuuuucuu

SEQ ID NO: 4104212 - RNA, 15 nt, Streptococcus pneumoniae R6
uuuccacaauuuuca

SEQ ID NO: 4104213 - RNA, 23 nt, Streptococcus pneumoniae R6
uuuccacaucaaaaacagccgaa

SEQ ID NO: 4104214 - RNA, 12 nt, Streptococcus pneumoniae R6
uuuccacuaaag

SEQ ID NO: 4104215 - RNA, 17 nt, Streptococcus pneumoniae R6
uuuccagcguugcgauu

SEQ ID NO: 4104216 - RNA, 13 nt, Streptococcus pneumoniae R6
uuuccagcuuuuu

SEQ ID NO: 4104217 - RNA, 22 nt, Streptococcus pneumoniae R6
uuuccagcuuuuucuuguugau

SEQ ID NO: 4104218 - RNA, 18 nt, Streptococcus pneumoniae R6
uuuccauuguuguuucuu

SEQ ID NO: 4104219 - RNA, 20 nt, Streptococcus pneumoniae R6
uuuccauuguuguuucuugg

SEQ ID NO: 4104220 - RNA, 19 nt, Streptococcus pneumoniae R6
uuucccaccuuuucucaau

SEQ ID NO: 4104221 - RNA, 18 nt, Streptococcus pneumoniae R6
uuucccagacaaauuguu

SEQ ID NO: 4104222 - RNA, 20 nt, Streptococcus pneumoniae R6
uuuccccugccaacuuauca

SEQ ID NO: 4104223 - RNA, 13 nt, Streptococcus pneumoniae R6
uuucccuucgucu

SEQ ID NO: 4104224 - RNA, 14 nt, Streptococcus pneumoniae R6
uuuccgauuucaga

SEQ ID NO: 4104225 - RNA, 15 nt, Streptococcus pneumoniae R6
uuuccgauuucagaa

SEQ ID NO: 4104226 - RNA, 16 nt, Streptococcus pneumoniae R6
uuuccggcucuuuguc

SEQ ID NO: 4104227 - RNA, 16 nt, Streptococcus pneumoniae R6
uuuccuaaucaauuug

SEQ ID NO: 4104228 - RNA, 18 nt, Streptococcus pneumoniae R6
uuuccuaaucgauuuguu

SEQ ID NO: 4104229 - RNA, 19 nt, Streptococcus pneumoniae R6
uuuccuagauuacaaaaaa

SEQ ID NO: 4104230 - RNA, 14 nt, Streptococcus pneumoniae R6
uuuccuauuauuua

SEQ ID NO: 4104231 - RNA, 21 nt, Streptococcus pneumoniae R6
uuuccucgaagcaagaacgau

SEQ ID NO: 4104232 - RNA, 18 nt, Streptococcus pneumoniae R6
uuuccugauuaccaacua

SEQ ID NO: 4104233 - RNA, 20 nt, Streptococcus pneumoniae R6
uuuccugcaugaaggucuuu

SEQ ID NO: 4104234 - RNA, 19 nt, Streptococcus pneumoniae R6
uuuccuguuguauuuauau

SEQ ID NO: 4104235 - RNA, 12 nt, Streptococcus pneumoniae R6
uuuccuucauca

SEQ ID NO: 4104236 - RNA, 18 nt, Streptococcus pneumoniae R6
uuuccuucgcgaaaugga

SEQ ID NO: 4104237 - RNA, 18 nt, Streptococcus pneumoniae R6
uuuccuucguuuucacaa

SEQ ID NO: 4104238 - RNA, 21 nt, Streptococcus pneumoniae R6
uuuccuuguguguauccuuau

SEQ ID NO: 4104239 - RNA, 15 nt, Streptococcus pneumoniae R6
uuuccuuuuugacac

SEQ ID NO: 4104240 - RNA, 15 nt, Streptococcus pneumoniae R6
uuucgaaaagaauua

SEQ ID NO: 4104241 - RNA, 21 nt, Streptococcus pneumoniae R6
uuucgaaaagaauuaggaaaa

SEQ ID NO: 4104242 - RNA, 13 nt, Streptococcus pneumoniae R6
uuucgaaaaguau

SEQ ID NO: 4104243 - RNA, 16 nt, Streptococcus pneumoniae R6
uuugacuuuucuaauc

SEQ ID NO: 4104244 - RNA, 20 nt, Streptococcus pneumoniae R6
uuugagaaauuucaacaaaa

SEQ ID NO: 4104245 - RNA, 20 nt, Streptococcus pneumoniae R6
uuugagaugggacuaaagau

SEQ ID NO: 4104246 - RNA, 19 nt, Streptococcus pneumoniae R6
uuugagcagaacaaugacu

SEQ ID NO: 4104247 - RNA, 13 nt, Streptococcus pneumoniae R6
uuugagcugacuu

SEQ ID NO: 4104248 - RNA, 14 nt, Streptococcus pneumoniae R6
uuugagcugacuuc

SEQ ID NO: 4104249 - RNA, 23 nt, Streptococcus pneumoniae R6
uuugaggaagguuuuaaagacag

SEQ ID NO: 4104250 - RNA, 23 nt, Streptococcus pneumoniae R6
uuugagggcugcaaaauuuugag

SEQ ID NO: 4104251 - RNA, 20 nt, Streptococcus pneumoniae R6
uuugagguugcagauaagac

SEQ ID NO: 4104252 - RNA, 18 nt, Streptococcus pneumoniae R6
uuugaguuucucuuacuu

SEQ ID NO: 4104253 - RNA, 18 nt, Streptococcus pneumoniae R6
uuugauacuguuaauaaa

SEQ ID NO: 4104254 - RNA, 13 nt, Streptococcus pneumoniae R6
uuugauagcaucu

SEQ ID NO: 4104255 - RNA, 16 nt, Streptococcus pneumoniae R6
uuugauagugauauca

SEQ ID NO: 4104256 - RNA, 20 nt, Streptococcus pneumoniae R6
uuugauauagaguucuuggu

SEQ ID NO: 4104257 - RNA, 18 nt, Streptococcus pneumoniae R6
uuugaugacauucaggcu

SEQ ID NO: 4104258 - RNA, 22 nt, Streptococcus pneumoniae R6
uuugaugagaaaauaaaguaaa

SEQ ID NO: 4104259 - RNA, 21 nt, Streptococcus pneumoniae R6
uuugauggguucuuugccagu

SEQ ID NO: 4104260 - RNA, 13 nt, Streptococcus pneumoniae R6
uuugauguacgac

SEQ ID NO: 4104261 - RNA, 17 nt, Streptococcus pneumoniae R6
uuugauguggaaaacua

SEQ ID NO: 4104262 - RNA, 14 nt, Streptococcus pneumoniae R6
uuugauuagcaaaa

SEQ ID NO: 4104263 - RNA, 18 nt, Streptococcus pneumoniae R6
uuugauuagcaaaacgua

SEQ ID NO: 4104264 - RNA, 19 nt, Streptococcus pneumoniae R6
uuugauucagauucaucau

SEQ ID NO: 4104265 - RNA, 21 nt, Streptococcus pneumoniae R6
uuugauuucuugguauuguuu

SEQ ID NO: 4104266 - RNA, 18 nt, Streptococcus pneumoniae R6
uuugauuucuugugcuga

SEQ ID NO: 4104267 - RNA, 15 nt, Streptococcus pneumoniae R6
uuugauuuuaaagac

SEQ ID NO: 4104268 - RNA, 16 nt, Streptococcus pneumoniae R6
uuugauuuuaaagacu

SEQ ID NO: 4104269 - RNA, 12 nt, Streptococcus pneumoniae R6
uuugauuuuaau

SEQ ID NO: 4104270 - RNA, 11 nt, Streptococcus pneumoniae R6
uuugauuuuca

SEQ ID NO: 4104271 - RNA, 19 nt, Streptococcus pneumoniae R6
uuugauuuucauugaguau

SEQ ID NO: 4104272 - RNA, 13 nt, Streptococcus pneumoniae R6
uuugauuuuccua

SEQ ID NO: 4104273 - RNA, 18 nt, Streptococcus pneumoniae R6
uuugauuuuguaaaaaua

SEQ ID NO: 4104274 - RNA, 21 nt, Streptococcus pneumoniae R6
uuugauuuuguaaaaauagaa

SEQ ID NO: 4104275 - RNA, 19 nt, Streptococcus pneumoniae R6
uuugauuuuuauugaguau

SEQ ID NO: 4104276 - RNA, 19 nt, Streptococcus pneumoniae R6
uuugcaaaguuuucuuugu

SEQ ID NO: 4104277 - RNA, 19 nt, Streptococcus pneumoniae R6
uuugcacuuugauuuuuau

SEQ ID NO: 4104278 - RNA, 23 nt, Streptococcus pneumoniae R6
uuugcacuuuucuuguacaacuu

SEQ ID NO: 4104279 - RNA, 21 nt, Streptococcus pneumoniae R6
uuugcagaaggcuuucuaauu

SEQ ID NO: 4104280 - RNA, 10 nt, Streptococcus pneumoniae R6
uuugcagcac

SEQ ID NO: 4104281 - RNA, 16 nt, Streptococcus pneumoniae R6
uuugcaucaaucucuu

SEQ ID NO: 4104282 - RNA, 23 nt, Streptococcus pneumoniae R6
uuugccagaaaaagucaauaaua

SEQ ID NO: 4104283 - RNA, 18 nt, Streptococcus pneumoniae R6
uuugccgugcucuaaaau

SEQ ID NO: 4104284 - RNA, 16 nt, Streptococcus pneumoniae R6
uuugccucaauaucuu

SEQ ID NO: 4104285 - RNA, 19 nt, Streptococcus pneumoniae R6
uuugcgcuugauaaccuua

SEQ ID NO: 4104286 - RNA, 20 nt, Streptococcus pneumoniae R6
uuugcucaccaucuucguca

SEQ ID NO: 4104287 - RNA, 22 nt, Streptococcus pneumoniae R6
uuugcucagcauucucaaugau

SEQ ID NO: 4104288 - RNA, 17 nt, Streptococcus pneumoniae R6
uuugcugguuaaugauu

SEQ ID NO: 4104289 - RNA, 14 nt, Streptococcus pneumoniae R6
uuugcuuaaauaaa

SEQ ID NO: 4104290 - RNA, 14 nt, Streptococcus pneumoniae R6
uuugcuuacagaca

SEQ ID NO: 4104291 - RNA, 15 nt, Streptococcus pneumoniae R6
uuugcuucaucauuu

SEQ ID NO: 4104292 - RNA, 15 nt, Streptococcus pneumoniae R6
uuugcuucauuuuuu

SEQ ID NO: 4104293 - RNA, 13 nt, Streptococcus pneumoniae R6
uuugcuugaccag

SEQ ID NO: 4104294 - RNA, 22 nt, Streptococcus pneumoniae R6
uuugcuuuuggcacguguaaug

SEQ ID NO: 4104295 - RNA, 9 nt, Streptococcus pneumoniae R6
uuuggaaaa

SEQ ID NO: 4104296 - RNA, 16 nt, Streptococcus pneumoniae R6
uuuggagucaauaauc

SEQ ID NO: 4104297 - RNA, 13 nt, Streptococcus pneumoniae R6
uuuggcaacugcu

SEQ ID NO: 4104298 - RNA, 13 nt, Streptococcus pneumoniae R6
uuuggcagauuua

SEQ ID NO: 4104299 - RNA, 16 nt, Streptococcus pneumoniae R6
uuugggacgauuuuca

SEQ ID NO: 4104300 - RNA, 19 nt, Streptococcus pneumoniae R6
uuugguaauuuucaagaau

SEQ ID NO: 4104301 - RNA, 14 nt, Streptococcus pneumoniae R6
uuuggucaauccga

SEQ ID NO: 4104302 - RNA, 20 nt, Streptococcus pneumoniae R6
uuugguguucacgaaagcaa

SEQ ID NO: 4104303 - RNA, 17 nt, Streptococcus pneumoniae R6
uuugguuauaaaaaaca

SEQ ID NO: 4104304 - RNA, 18 nt, Streptococcus pneumoniae R6
uuugguugcaccaaguca

SEQ ID NO: 4104305 - RNA, 23 nt, Streptococcus pneumoniae R6
uuugguugcaccaagucauaggc

SEQ ID NO: 4104306 - RNA, 16 nt, Streptococcus pneumoniae R6
uuugguuuuucuucag

SEQ ID NO: 4104307 - RNA, 12 nt, Streptococcus pneumoniae R6
uuuguaaaaaag

SEQ ID NO: 4104308 - RNA, 22 nt, Streptococcus pneumoniae R6
uuuguaaucuaggaaaacgaua

SEQ ID NO: 4104309 - RNA, 21 nt, Streptococcus pneumoniae R6
uuuguacugccccccaaaaaa

SEQ ID NO: 4104310 - RNA, 14 nt, Streptococcus pneumoniae R6
uuuguacuuguucu

SEQ ID NO: 4104311 - RNA, 18 nt, Streptococcus pneumoniae R6
uuuguagcaaauucacca

SEQ ID NO: 4104312 - RNA, 19 nt, Streptococcus pneumoniae R6
uuuguaggccacaaaugcu

SEQ ID NO: 4104313 - RNA, 12 nt, Streptococcus pneumoniae R6
uuuguaucuucc

SEQ ID NO: 4104314 - RNA, 19 nt, Streptococcus pneumoniae R6
uuuguauuucuucuucuga

SEQ ID NO: 4104315 - RNA, 14 nt, Streptococcus pneumoniae R6
uuuguauuuugaau

SEQ ID NO: 4104316 - RNA, 19 nt, Streptococcus pneumoniae R6
uuugucaucguuccaguuu

SEQ ID NO: 4104317 - RNA, 12 nt, Streptococcus pneumoniae R6
uuuguccuucuu

SEQ ID NO: 4104318 - RNA, 13 nt, Streptococcus pneumoniae R6
uuugucucugaaa

SEQ ID NO: 4104319 - RNA, 21 nt, Streptococcus pneumoniae R6
uuugugaaaaacuuaguaaac

SEQ ID NO: 4104320 - RNA, 22 nt, Streptococcus pneumoniae R6
uuugugaaaaacuuaguaaaca

SEQ ID NO: 4104321 - RNA, 14 nt, Streptococcus pneumoniae R6
uuugugaggaccag

SEQ ID NO: 4104322 - RNA, 13 nt, Streptococcus pneumoniae R6
uuugugauuuuaa

SEQ ID NO: 4104323 - RNA, 22 nt, Streptococcus pneumoniae R6
uuugugcucuuaaacaagagau

SEQ ID NO: 4104324 - RNA, 12 nt, Streptococcus pneumoniae R6
uuuguguuuuuu

SEQ ID NO: 4104325 - RNA, 14 nt, Streptococcus pneumoniae R6
uuuguuaccaauac

SEQ ID NO: 4104326 - RNA, 21 nt, Streptococcus pneumoniae R6
uuuguucauaucuuauuucaa

SEQ ID NO: 4104327 - RNA, 20 nt, Streptococcus pneumoniae R6
uuuguucguauccuauuuca

SEQ ID NO: 4104328 - RNA, 22 nt, Streptococcus pneumoniae R6
uuuguucguauccuauuucacu

SEQ ID NO: 4104329 - RNA, 17 nt, Streptococcus pneumoniae R6
uuuguucuguucuuauu

SEQ ID NO: 4104330 - RNA, 21 nt, Streptococcus pneumoniae R6
uuuguucuguucuuauuucau

SEQ ID NO: 4104331 - RNA, 11 nt, Streptococcus pneumoniae R6
uuuguucuuuu

SEQ ID NO: 4104332 - RNA, 19 nt, Streptococcus pneumoniae R6
uuuguuuaauacucaauga

SEQ ID NO: 4104333 - RNA, 14 nt, Streptococcus pneumoniae R6
uuuguuucuugaaa

SEQ ID NO: 4104334 - RNA, 16 nt, Streptococcus pneumoniae R6
uuuguuuucuauuucu

SEQ ID NO: 4104335 - RNA, 13 nt, Streptococcus pneumoniae R6
uuuguuuuuuccu

SEQ ID NO: 4104336 - RNA, 19 nt, Streptococcus pneumoniae R6
uuuuaaaaaaucuuuuuca

SEQ ID NO: 4104337 - RNA, 14 nt, Streptococcus pneumoniae R6
uuuuaaaaauagcu

SEQ ID NO: 4104338 - RNA, 21 nt, Streptococcus pneumoniae R6
uuuuaaaauauuagcaaaaaa

SEQ ID NO: 4104339 - RNA, 17 nt, Streptococcus pneumoniae R6
uuuuaaaauccauaauu

SEQ ID NO: 4104340 - RNA, 22 nt, Streptococcus pneumoniae R6
uuuuaaaccacgucaguuuuau

SEQ ID NO: 4104341 - RNA, 20 nt, Streptococcus pneumoniae R6
uuuuaaagacagucugaaaa

SEQ ID NO: 4104342 - RNA, 12 nt, Streptococcus pneumoniae R6
uuuuaaagacuu

SEQ ID NO: 4104343 - RNA, 20 nt, Streptococcus pneumoniae R6
uuuuaaaggucaauuccuca

SEQ ID NO: 4104344 - RNA, 23 nt, Streptococcus pneumoniae R6
uuuuaaaguauucccuacaaaua

SEQ ID NO: 4104345 - RNA, 22 nt, Streptococcus pneumoniae R6
uuuuaaaugaguaugaaaagag

SEQ ID NO: 4104346 - RNA, 19 nt, Streptococcus pneumoniae R6
uuuucguacaauauuuguu

SEQ ID NO: 4104347 - RNA, 20 nt, Streptococcus pneumoniae R6
uuuucguacaauauuuguug

SEQ ID NO: 4104348 - RNA, 22 nt, Streptococcus pneumoniae R6
uuuucguacacucaaaucaaaa

SEQ ID NO: 4104349 - RNA, 19 nt, Streptococcus pneumoniae R6
uuuucguacauaguuucau

SEQ ID NO: 4104350 - RNA, 18 nt, Streptococcus pneumoniae R6
uuuucguagcauauccac

SEQ ID NO: 4104351 - RNA, 20 nt, Streptococcus pneumoniae R6
uuuucuaaagcaauuuugaa

SEQ ID NO: 4104352 - RNA, 24 nt, Streptococcus pneumoniae R6
uuuucuacuaaaauuauguuuuug

SEQ ID NO: 4104353 - RNA, 17 nt, Streptococcus pneumoniae R6
uuuucuacuccuuuucu

SEQ ID NO: 4104354 - RNA, 22 nt, Streptococcus pneumoniae R6
uuuucuauaguagauugaaaua

SEQ ID NO: 4104355 - RNA, 14 nt, Streptococcus pneumoniae R6
uuuucuaucacucc

SEQ ID NO: 4104356 - RNA, 13 nt, Streptococcus pneumoniae R6
uuuucucaauacu

SEQ ID NO: 4104357 - RNA, 13 nt, Streptococcus pneumoniae R6
uuuucucuagcuu

SEQ ID NO: 4104358 - RNA, 21 nt, Streptococcus pneumoniae R6
uuuucucuuuguccuuuagaa

SEQ ID NO: 4104359 - RNA, 12 nt, Streptococcus pneumoniae R6
uuuucugaaguu

SEQ ID NO: 4104360 - RNA, 18 nt, Streptococcus pneumoniae R6
uuuucugaguuaaacucu

SEQ ID NO: 4104361 - RNA, 21 nt, Streptococcus pneumoniae R6
uuuucugaguuaaacucucca

SEQ ID NO: 4104362 - RNA, 17 nt, Streptococcus pneumoniae R6
uuuucugauaagaugcu

SEQ ID NO: 4104363 - RNA, 19 nt, Streptococcus pneumoniae R6
uuuucugcaaaaaauauuu

SEQ ID NO: 4104364 - RNA, 14 nt, Streptococcus pneumoniae R6
uuuucuggcucuuu

SEQ ID NO: 4104365 - RNA, 17 nt, Streptococcus pneumoniae R6
uuuucuggcucuuuguc

SEQ ID NO: 4104366 - RNA, 18 nt, Streptococcus pneumoniae R6
uuuucugggugauuuuuu

SEQ ID NO: 4104367 - RNA, 14 nt, Streptococcus pneumoniae R6
uuuucuuacuuccu

SEQ ID NO: 4104368 - RNA, 17 nt, Streptococcus pneumoniae R6
uuuucuucaacccacua

SEQ ID NO: 4104369 - RNA, 14 nt, Streptococcus pneumoniae R6
uuuucuucugaaau

SEQ ID NO: 4104370 - RNA, 18 nt, Streptococcus pneumoniae R6
uuuucuuggguuucuucu

SEQ ID NO: 4104371 - RNA, 14 nt, Streptococcus pneumoniae R6
uuuucuuuacuucu

SEQ ID NO: 4104372 - RNA, 17 nt, Streptococcus pneumoniae R6
uuuucuuugauuuuaau

SEQ ID NO: 4104373 - RNA, 12 nt, Streptococcus pneumoniae R6
uuuucuuugcag

SEQ ID NO: 4104374 - RNA, 13 nt, Streptococcus pneumoniae R6
uuuucuuugcagu

SEQ ID NO: 4104375 - RNA, 19 nt, Streptococcus pneumoniae R6
uuuucuuugccucccacua

SEQ ID NO: 4104376 - RNA, 14 nt, Streptococcus pneumoniae R6
uuuugaaaaugaau

SEQ ID NO: 4104377 - RNA, 14 nt, Streptococcus pneumoniae R6
uuuugaaaauuuuu

SEQ ID NO: 4104378 - RNA, 14 nt, Streptococcus pneumoniae R6
uuuugaaagucaua

SEQ ID NO: 4104379 - RNA, 22 nt, Streptococcus pneumoniae R6
uuuugaaauaaucucugaacuu

SEQ ID NO: 4104380 - RNA, 17 nt, Streptococcus pneumoniae R6
uuuugaacaccugauuu

SEQ ID NO: 4104381 - RNA, 20 nt, Streptococcus pneumoniae R6
uuuugaagaauguuuucagc

SEQ ID NO: 4104382 - RNA, 16 nt, Streptococcus pneumoniae R6
uuuugaaguuuucaaa

SEQ ID NO: 4104383 - RNA, 19 nt, Streptococcus pneumoniae R6
uuuugaauauuaguaaaua

SEQ ID NO: 4104384 - RNA, 20 nt, Streptococcus pneumoniae R6
uuuugacguucuucugcagu

SEQ ID NO: 4104385 - RNA, 21 nt, Streptococcus pneumoniae R6
uuuugacugauggaaguaauu

SEQ ID NO: 4104386 - RNA, 15 nt, Streptococcus pneumoniae R6
uuuugagcaauaaua

SEQ ID NO: 4104387 - RNA, 16 nt, Streptococcus pneumoniae R6
uuuugagcaauacuuu

SEQ ID NO: 4104388 - RNA, 14 nt, Streptococcus pneumoniae R6
uuuugagcuaauuu

SEQ ID NO: 4104389 - RNA, 20 nt, Streptococcus pneumoniae R6
uuuugagcuaauuuugccag

SEQ ID NO: 4104390 - RNA, 13 nt, Streptococcus pneumoniae R6
uuuugagugguuu

SEQ ID NO: 4104391 - RNA, 17 nt, Streptococcus pneumoniae R6
uuuugaugccugacaau

SEQ ID NO: 4104392 - RNA, 16 nt, Streptococcus pneumoniae R6
uuuugauuagcaaaac

SEQ ID NO: 4104393 - RNA, 16 nt, Streptococcus pneumoniae R6
uuuugauuauuuuuua

SEQ ID NO: 4104394 - RNA, 19 nt, Streptococcus pneumoniae R6
uuuugauuauuuuuuaaca

SEQ ID NO: 4104395 - RNA, 13 nt, Streptococcus pneumoniae R6
uuuugauuuuaaa

SEQ ID NO: 4104396 - RNA, 20 nt, Streptococcus pneumoniae R6
uuuugcacaccugauauuau

SEQ ID NO: 4104397 - RNA, 18 nt, Streptococcus pneumoniae R6
uuuugcaucaacuauucu

SEQ ID NO: 4104398 - RNA, 14 nt, Streptococcus pneumoniae R6
uuuugcccucuaaa

SEQ ID NO: 4104399 - RNA, 21 nt, Streptococcus pneumoniae R6
uuuugccgugcucuaaaauca

SEQ ID NO: 4104400 - RNA, 11 nt, Streptococcus pneumoniae R6
uuuugccucaa

SEQ ID NO: 4104401 - RNA, 19 nt, Streptococcus pneumoniae R6
uuuugcguuggaauaaggu

SEQ ID NO: 4104402 - RNA, 14 nt, Streptococcus pneumoniae R6
uuuugcuaaucaaa

SEQ ID NO: 4104403 - RNA, 23 nt, Streptococcus pneumoniae R6
uuuugcucggcauugugaugaag

SEQ ID NO: 4104404 - RNA, 21 nt, Streptococcus pneumoniae R6
uuuugcuguuaauaacucuca

SEQ ID NO: 4104405 - RNA, 22 nt, Streptococcus pneumoniae R6
uuuugcuguuaauaacucucau

SEQ ID NO: 4104406 - RNA, 18 nt, Streptococcus pneumoniae R6
uuuuggcaauuuuugaaa

SEQ ID NO: 4104407 - RNA, 23 nt, Streptococcus pneumoniae R6
uuuuguaaaggguucuacaaauc

SEQ ID NO: 4104408 - RNA, 19 nt, Streptococcus pneumoniae R6
uuuuguaggccacaaaugc

SEQ ID NO: 4104409 - RNA, 15 nt, Streptococcus pneumoniae R6
uuuuguauuuugaau

SEQ ID NO: 4104410 - RNA, 23 nt, Streptococcus pneumoniae R6
uuuugucaguaaaaaaaacauau

SEQ ID NO: 4104411 - RNA, 23 nt, Streptococcus pneumoniae R6
uuuugucuucuaagcucuuaaaa

SEQ ID NO: 4104412 - RNA, 19 nt, Streptococcus pneumoniae R6
uuuugugaccacaucugcc

SEQ ID NO: 4104413 - RNA, 16 nt, Streptococcus pneumoniae R6
uuuugugauuuuaaga

SEQ ID NO: 4104414 - RNA, 16 nt, Streptococcus pneumoniae R6
uuuuguucaucauuaa

SEQ ID NO: 4104415 - RNA, 18 nt, Streptococcus pneumoniae R6
uuuuguuuaauacucaau

SEQ ID NO: 4104416 - RNA, 22 nt, Streptococcus pneumoniae R6
uuuuguuucacuaggauuuuag

SEQ ID NO: 4104417 - RNA, 20 nt, Streptococcus pneumoniae R6
uuuuguuucuuaaucuguuu

SEQ ID NO: 4104418 - RNA, 10 nt, Streptococcus pneumoniae R6
uuuuuaaaaa

SEQ ID NO: 4104419 - RNA, 18 nt, Streptococcus pneumoniae R6
uuuuuaaagauauagccu

SEQ ID NO: 4104420 - RNA, 10 nt, Streptococcus pneumoniae R6
uuuuuaaagg

SEQ ID NO: 4104421 - RNA, 14 nt, Streptococcus pneumoniae R6
uuuuuaaaggugaa

SEQ ID NO: 4104422 - RNA, 13 nt, Streptococcus pneumoniae R6
uuuuuaacaaaaa

SEQ ID NO: 4104423 - RNA, 14 nt, Streptococcus pneumoniae R6
uuuuuaauuaauca

SEQ ID NO: 4104424 - RNA, 14 nt, Streptococcus pneumoniae R6
uuuuuaauuauuuu

SEQ ID NO: 4104425 - RNA, 18 nt, Streptococcus pneumoniae R6
uuuuuaauuauuuucaaa

SEQ ID NO: 4104426 - RNA, 14 nt, Streptococcus pneumoniae R6
uuuuuaauuuuucu

SEQ ID NO: 4104427 - RNA, 15 nt, Streptococcus pneumoniae R6
uuuuuagaagcuucu

SEQ ID NO: 4104428 - RNA, 21 nt, Streptococcus pneumoniae R6
uuuuuaggcaauaaaauauga

SEQ ID NO: 4104429 - RNA, 15 nt, Streptococcus pneumoniae R6
uuuuuaguugaguua

SEQ ID NO: 4104430 - RNA, 17 nt, Streptococcus pneumoniae R6
uuuuuauaagcaauuca

SEQ ID NO: 4104431 - RNA, 16 nt, Streptococcus pneumoniae R6
uuuuuauaauaucacu

SEQ ID NO: 4104432 - RNA, 14 nt, Streptococcus pneumoniae R6
uuuuuauacucaau

SEQ ID NO: 4104433 - RNA, 14 nt, Streptococcus pneumoniae R6
uuuuuauauauaaa

SEQ ID NO: 4104434 - RNA, 23 nt, Streptococcus pneumoniae R6
uuuuuaugauucgcuauucuucu

SEQ ID NO: 4104435 - RNA, 16 nt, Streptococcus pneumoniae R6
uuuuucaaagacuucu

SEQ ID NO: 4104436 - RNA, 19 nt, Streptococcus pneumoniae R6
uuuuucaaaguuugacuua

SEQ ID NO: 4104437 - RNA, 14 nt, Streptococcus pneumoniae R6
uuuuucaaucaaug

SEQ ID NO: 4104438 - RNA, 15 nt, Streptococcus pneumoniae R6
uuuuucaccaaaacc

SEQ ID NO: 4104439 - RNA, 21 nt, Streptococcus pneumoniae R6
uuuuucagcuggcuccuucuu

SEQ ID NO: 4104440 - RNA, 22 nt, Streptococcus pneumoniae R6
uuuuucagguccaguuacuacu

SEQ ID NO: 4104441 - RNA, 14 nt, Streptococcus pneumoniae R6
uuuuucaugaauac

SEQ ID NO: 4104442 - RNA, 17 nt, Streptococcus pneumoniae R6
uuuuucauggaugcaau

SEQ ID NO: 4104443 - RNA, 17 nt, Streptococcus pneumoniae R6
uuuuucauguauuccaa

SEQ ID NO: 4104444 - RNA, 18 nt, Streptococcus pneumoniae R6
uuuuucauugaguauaaa

SEQ ID NO: 4104445 - RNA, 16 nt, Streptococcus pneumoniae R6
uuuuucccaccuuuuc

SEQ ID NO: 4104446 - RNA, 21 nt, Streptococcus pneumoniae R6
uuuuucccaccuuuucucaau

SEQ ID NO: 4104447 - RNA, 21 nt, Streptococcus pneumoniae R6
uuuuucccagccuucagccca

SEQ ID NO: 4104448 - RNA, 12 nt, Streptococcus pneumoniae R6
uuuuuccuuuuc

SEQ ID NO: 4104449 - RNA, 18 nt, Streptococcus pneumoniae R6
auacgaccaaucuuuucc

SEQ ID NO: 4104450 - RNA, 15 nt, Streptococcus pneumoniae R6
auacgauaaaaauca

SEQ ID NO: 4104451 - RNA, 14 nt, Streptococcus pneumoniae R6
auacgaucugaaau

SEQ ID NO: 4104452 - RNA, 12 nt, Streptococcus pneumoniae R6
auacgcccucca

SEQ ID NO: 4104453 - RNA, 17 nt, Streptococcus pneumoniae R6
auacggacauagcagau

SEQ ID NO: 4104454 - RNA, 13 nt, Streptococcus pneumoniae R6
auacggcauugag

SEQ ID NO: 4104455 - RNA, 19 nt, Streptococcus pneumoniae R6
auacguuucauggacuguu

SEQ ID NO: 4104456 - RNA, 20 nt, Streptococcus pneumoniae R6
auacguuuuuacuacuuuug

SEQ ID NO: 4104457 - RNA, 21 nt, Streptococcus pneumoniae R6
auacguuuuuugauuuuaaua

SEQ ID NO: 4104458 - RNA, 20 nt, Streptococcus pneumoniae R6
auacuaaaaaaaaaaaguau

SEQ ID NO: 4104459 - RNA, 19 nt, Streptococcus pneumoniae R6
auacuaaaauauuucuaga

SEQ ID NO: 4104460 - RNA, 17 nt, Streptococcus pneumoniae R6
auacuaaggaaagucaa

SEQ ID NO: 4104461 - RNA, 18 nt, Streptococcus pneumoniae R6
auacuaaggaaagucaaa

SEQ ID NO: 4104462 - RNA, 14 nt, Streptococcus pneumoniae R6
auacuacaauaauu

SEQ ID NO: 4104463 - RNA, 16 nt, Streptococcus pneumoniae R6
auacuagucuuucuuc

SEQ ID NO: 4104464 - RNA, 13 nt, Streptococcus pneumoniae R6
auacuaugaagga

SEQ ID NO: 4104465 - RNA, 20 nt, Streptococcus pneumoniae R6
auacuaugcguuuuauugug

SEQ ID NO: 4104466 - RNA, 18 nt, Streptococcus pneumoniae R6
auacuaugcguuuugcuu

SEQ ID NO: 4104467 - RNA, 15 nt, Streptococcus pneumoniae R6
auacuaugcuuuuua

SEQ ID NO: 4104468 - RNA, 19 nt, Streptococcus pneumoniae R6
auacuaugcuuuuuucuau

SEQ ID NO: 4104469 - RNA, 13 nt, Streptococcus pneumoniae R6
auacuauuuuugu

SEQ ID NO: 4104470 - RNA, 16 nt, Streptococcus pneumoniae R6
auacuauuuuugucau

SEQ ID NO: 4104471 - RNA, 12 nt, Streptococcus pneumoniae R6
auacucaaugaa

SEQ ID NO: 4104472 - RNA, 13 nt, Streptococcus pneumoniae R6
auacucaaugaaa

SEQ ID NO: 4104473 - RNA, 18 nt, Streptococcus pneumoniae R6
auacucaaugaaaaucaa

SEQ ID NO: 4104474 - RNA, 18 nt, Streptococcus pneumoniae R6
auacucauaaagucuuua

SEQ ID NO: 4104475 - RNA, 21 nt, Streptococcus pneumoniae R6
auacucauaaagucuuuaaca

SEQ ID NO: 4104476 - RNA, 17 nt, Streptococcus pneumoniae R6
auacucaucugcuuuca

SEQ ID NO: 4104477 - RNA, 21 nt, Streptococcus pneumoniae R6
auacucaucugcuuucaaaaa

SEQ ID NO: 4104478 - RNA, 14 nt, Streptococcus pneumoniae R6
auacuccaaaacau

SEQ ID NO: 4104479 - RNA, 15 nt, Streptococcus pneumoniae R6
auacucuaauugaaa

SEQ ID NO: 4104480 - RNA, 13 nt, Streptococcus pneumoniae R6
auacucuuagaaa

SEQ ID NO: 4104481 - RNA, 19 nt, Streptococcus pneumoniae R6
auacucuuagaaaaucucu

SEQ ID NO: 4104482 - RNA, 21 nt, Streptococcus pneumoniae R6
auacucuuagaaaaucucuuc

SEQ ID NO: 4104483 - RNA, 21 nt, Streptococcus pneumoniae R6
auacucuucaaaaaucucuuc

SEQ ID NO: 4104484 - RNA, 19 nt, Streptococcus pneumoniae R6
auacucuucgaaaaucucu

SEQ ID NO: 4104485 - RNA, 20 nt, Streptococcus pneumoniae R6
auacucuucgaaaaucucuu

SEQ ID NO: 4104486 - RNA, 12 nt, Streptococcus pneumoniae R6
auacugauaaaa

SEQ ID NO: 4104487 - RNA, 19 nt, Streptococcus pneumoniae R6
auacugcucgguaaaacau

SEQ ID NO: 4104488 - RNA, 20 nt, Streptococcus pneumoniae R6
auacuguacguuuuaucaua

SEQ ID NO: 4104489 - RNA, 17 nt, Streptococcus pneumoniae R6
auacuguaguuuuuccu

SEQ ID NO: 4104490 - RNA, 22 nt, Streptococcus pneumoniae R6
auacuguauuuuuuuugguuuu

SEQ ID NO: 4104491 - RNA, 22 nt, Streptococcus pneumoniae R6
auacuguggaauauagaggaua

SEQ ID NO: 4104492 - RNA, 15 nt, Streptococcus pneumoniae R6
auacuguuaauaaaa

SEQ ID NO: 4104493 - RNA, 14 nt, Streptococcus pneumoniae R6
auacuguuuuccuu

SEQ ID NO: 4104494 - RNA, 23 nt, Streptococcus pneumoniae R6
auacuuaacuuuguauaauaggu

SEQ ID NO: 4104495 - RNA, 12 nt, Streptococcus pneumoniae R6
auacuuacucuu

SEQ ID NO: 4104496 - RNA, 18 nt, Streptococcus pneumoniae R6
auacuuagauuuucuggc

SEQ ID NO: 4104497 - RNA, 12 nt, Streptococcus pneumoniae R6
auacuuauccuu

SEQ ID NO: 4104498 - RNA, 13 nt, Streptococcus pneumoniae R6
auacuuauccuuu

SEQ ID NO: 4104499 - RNA, 19 nt, Streptococcus pneumoniae R6
auacuuauccuuuuuuacu

SEQ ID NO: 4104500 - RNA, 18 nt, Streptococcus pneumoniae R6
auacuugaaucuggcuuu

SEQ ID NO: 4104501 - RNA, 14 nt, Streptococcus pneumoniae R6
auacuugaucccac

SEQ ID NO: 4104502 - RNA, 22 nt, Streptococcus pneumoniae R6
auacuuggugcuauuuguugua

SEQ ID NO: 4104503 - RNA, 12 nt, Streptococcus pneumoniae R6
auacuuucucug

SEQ ID NO: 4104504 - RNA, 17 nt, Streptococcus pneumoniae R6
auacuuucucugacuuu

SEQ ID NO: 4104505 - RNA, 21 nt, Streptococcus pneumoniae R6
auacuuugcaacuggagacuu

SEQ ID NO: 4104506 - RNA, 19 nt, Streptococcus pneumoniae R6
auacuuuggcuucguguuc

SEQ ID NO: 4104507 - RNA, 17 nt, Streptococcus pneumoniae R6
auacuuuuaauauuucc

SEQ ID NO: 4104508 - RNA, 18 nt, Streptococcus pneumoniae R6
auacuuuuaauauuuccc

SEQ ID NO: 4104509 - RNA, 14 nt, Streptococcus pneumoniae R6
auacuuuuucaguu

SEQ ID NO: 4104510 - RNA, 23 nt, Streptococcus pneumoniae R6
auacuuuuuccugguaauagcgu

SEQ ID NO: 4104511 - RNA, 15 nt, Streptococcus pneumoniae R6
auacuuuuucuuccu

SEQ ID NO: 4104512 - RNA, 18 nt, Streptococcus pneumoniae R6
auacuuuuucuuccuuuc

SEQ ID NO: 4104513 - RNA, 20 nt, Streptococcus pneumoniae R6
auagaaaaaagucuuuaaaa

SEQ ID NO: 4104514 - RNA, 12 nt, Streptococcus pneumoniae R6
auagaaaaaauc

SEQ ID NO: 4104515 - RNA, 14 nt, Streptococcus pneumoniae R6
auagaaaaaucccc

SEQ ID NO: 4104516 - RNA, 12 nt, Streptococcus pneumoniae R6
auagaaaacaaa

SEQ ID NO: 4104517 - RNA, 15 nt, Streptococcus pneumoniae R6
auagaaaacaaaaag

SEQ ID NO: 4104518 - RNA, 19 nt, Streptococcus pneumoniae R6
auagaaaacaacuuauaaa

SEQ ID NO: 4104519 - RNA, 20 nt, Streptococcus pneumoniae R6
auagaaacaucuuauuauca

SEQ ID NO: 4104520 - RNA, 14 nt, Streptococcus pneumoniae R6
auagaaaccagcua

SEQ ID NO: 4104521 - RNA, 18 nt, Streptococcus pneumoniae R6
auagaaagcuuacaucau

SEQ ID NO: 4104522 - RNA, 14 nt, Streptococcus pneumoniae R6
auagaaauauuuac

SEQ ID NO: 4104523 - RNA, 13 nt, Streptococcus pneumoniae R6
auagaaauuuuua

SEQ ID NO: 4104524 - RNA, 18 nt, Streptococcus pneumoniae R6
auagaaggaguugagccu

SEQ ID NO: 4104525 - RNA, 17 nt, Streptococcus pneumoniae R6
auagaaggcaauuaaaa

SEQ ID NO: 4104526 - RNA, 16 nt, Streptococcus pneumoniae R6
auagaaggucaagaga

SEQ ID NO: 4104527 - RNA, 20 nt, Streptococcus pneumoniae R6
auagaaguaggccaaacuug

SEQ ID NO: 4104528 - RNA, 18 nt, Streptococcus pneumoniae R6
auagaaguggauuuucuu

SEQ ID NO: 4104529 - RNA, 17 nt, Streptococcus pneumoniae R6
auagaaucauggccacg

SEQ ID NO: 4104530 - RNA, 20 nt, Streptococcus pneumoniae R6
auagaaucguuucugacaga

SEQ ID NO: 4104531 - RNA, 12 nt, Streptococcus pneumoniae R6
auagaauuuuuu

SEQ ID NO: 4104532 - RNA, 17 nt, Streptococcus pneumoniae R6
auagaauuuuuuguugc

SEQ ID NO: 4104533 - RNA, 20 nt, Streptococcus pneumoniae R6
auagacacaaugguuagaaa

SEQ ID NO: 4104534 - RNA, 15 nt, Streptococcus pneumoniae R6
auagaccaagagacg

SEQ ID NO: 4104535 - RNA, 23 nt, Streptococcus pneumoniae R6
auagaccuguuuggucagacugg

SEQ ID NO: 4104536 - RNA, 17 nt, Streptococcus pneumoniae R6
auagacuauauugauua

SEQ ID NO: 4104537 - RNA, 15 nt, Streptococcus pneumoniae R6
auagacuucccagcc

SEQ ID NO: 4104538 - RNA, 19 nt, Streptococcus pneumoniae R6
auagacuuccugcaaaacu

SEQ ID NO: 4104539 - RNA, 19 nt, Streptococcus pneumoniae R6
auagagacauaaucaagau

SEQ ID NO: 4104540 - RNA, 23 nt, Streptococcus pneumoniae R6
auagagauagaaggucaagagaa

SEQ ID NO: 4104541 - RNA, 21 nt, Streptococcus pneumoniae R6
auagagccuucuuccaucuuc

SEQ ID NO: 4104542 - RNA, 20 nt, Streptococcus pneumoniae R6
auagaggagauuuaaaaaug

SEQ ID NO: 4104543 - RNA, 16 nt, Streptococcus pneumoniae R6
auagaggucagugacu

SEQ ID NO: 4104544 - RNA, 23 nt, Streptococcus pneumoniae R6
auagagugacagggccuuuugca

SEQ ID NO: 4104545 - RNA, 19 nt, Streptococcus pneumoniae R6
auagaguucuugguuuuuu

SEQ ID NO: 4104546 - RNA, 15 nt, Streptococcus pneumoniae R6
auagauaaaaaacaa

SEQ ID NO: 4104547 - RNA, 19 nt, Streptococcus pneumoniae R6
auagauaaaggccaagucc

SEQ ID NO: 4104548 - RNA, 15 nt, Streptococcus pneumoniae R6
auagauaauuuaaaa

SEQ ID NO: 4104549 - RNA, 15 nt, Streptococcus pneumoniae R6
auagauacaaaacca

SEQ ID NO: 4104550 - RNA, 13 nt, Streptococcus pneumoniae R6
auagauaccuugu

SEQ ID NO: 4104551 - RNA, 18 nt, Streptococcus pneumoniae R6
auagauccuucaaauccu

SEQ ID NO: 4104552 - RNA, 12 nt, Streptococcus pneumoniae R6
auauaaggauug

SEQ ID NO: 4104553 - RNA, 17 nt, Streptococcus pneumoniae R6
auauaagguaggaguga

SEQ ID NO: 4104554 - RNA, 17 nt, Streptococcus pneumoniae R6
auauaauggcuucauua

SEQ ID NO: 4104555 - RNA, 16 nt, Streptococcus pneumoniae R6
auauacacuaaacaaa

SEQ ID NO: 4104556 - RNA, 21 nt, Streptococcus pneumoniae R6
auauaccaacuacuaaaccaa

SEQ ID NO: 4104557 - RNA, 17 nt, Streptococcus pneumoniae R6
auauacccaaaacacaa

SEQ ID NO: 4104558 - RNA, 18 nt, Streptococcus pneumoniae R6
auauacccaaaacacaaa

SEQ ID NO: 4104559 - RNA, 21 nt, Streptococcus pneumoniae R6
auauacccaaaacacaaaaag

SEQ ID NO: 4104560 - RNA, 18 nt, Streptococcus pneumoniae R6
auauacugcgauagaauc

SEQ ID NO: 4104561 - RNA, 13 nt, Streptococcus pneumoniae R6
auauacuugauau

SEQ ID NO: 4104562 - RNA, 13 nt, Streptococcus pneumoniae R6
auauagaaguagu

SEQ ID NO: 4104563 - RNA, 13 nt, Streptococcus pneumoniae R6
auauagaauuuua

SEQ ID NO: 4104564 - RNA, 18 nt, Streptococcus pneumoniae R6
auauagacaaaaucauca

SEQ ID NO: 4104565 - RNA, 12 nt, Streptococcus pneumoniae R6
auauagaccaac

SEQ ID NO: 4104566 - RNA, 16 nt, Streptococcus pneumoniae R6
auauagaccaacuauu

SEQ ID NO: 4104567 - RNA, 16 nt, Streptococcus pneumoniae R6
auauagagugacaggg

SEQ ID NO: 4104568 - RNA, 22 nt, Streptococcus pneumoniae R6
auauagaguucuugguuuuuua

SEQ ID NO: 4104569 - RNA, 22 nt, Streptococcus pneumoniae R6
auauagcauacugaauuuagaa

SEQ ID NO: 4104570 - RNA, 22 nt, Streptococcus pneumoniae R6
auauagccuguaaaaagugaaa

SEQ ID NO: 4104571 - RNA, 11 nt, Streptococcus pneumoniae R6
auauaggcaua

SEQ ID NO: 4104572 - RNA, 17 nt, Streptococcus pneumoniae R6
auauagggcuuuuuuug

SEQ ID NO: 4104573 - RNA, 16 nt, Streptococcus pneumoniae R6
auauaguaaaaugaaa

SEQ ID NO: 4104574 - RNA, 16 nt, Streptococcus pneumoniae R6
auauaguagauugaaa

SEQ ID NO: 4104575 - RNA, 19 nt, Streptococcus pneumoniae R6
auauaguagauugaaauaa

SEQ ID NO: 4104576 - RNA, 19 nt, Streptococcus pneumoniae R6
auauaguagccaaaauccu

SEQ ID NO: 4104577 - RNA, 20 nt, Streptococcus pneumoniae R6
auauaguagccaaaauccuu

SEQ ID NO: 4104578 - RNA, 17 nt, Streptococcus pneumoniae R6
auauagucuacaauagc

SEQ ID NO: 4104579 - RNA, 18 nt, Streptococcus pneumoniae R6
auauagucuauugaaguu

SEQ ID NO: 4104580 - RNA, 20 nt, Streptococcus pneumoniae R6
auauaguuaaaaaagauuug

SEQ ID NO: 4104581 - RNA, 23 nt, Streptococcus pneumoniae R6
auauaguuaaaaaagauuugaaa

SEQ ID NO: 4104582 - RNA, 15 nt, Streptococcus pneumoniae R6
auauaguuuaaucaa

SEQ ID NO: 4104583 - RNA, 19 nt, Streptococcus pneumoniae R6
auauaguuuaaucaaaaua

SEQ ID NO: 4104584 - RNA, 20 nt, Streptococcus pneumoniae R6
auauaguuuaaucaaaauaa

SEQ ID NO: 4104585 - RNA, 13 nt, Streptococcus pneumoniae R6
auauauaaaaaau

SEQ ID NO: 4104586 - RNA, 14 nt, Streptococcus pneumoniae R6
auauauaaaauuuc

SEQ ID NO: 4104587 - RNA, 13 nt, Streptococcus pneumoniae R6
auauauaaaugaa

SEQ ID NO: 4104588 - RNA, 15 nt, Streptococcus pneumoniae R6
auauauauaauagau

SEQ ID NO: 4104589 - RNA, 18 nt, Streptococcus pneumoniae R6
auauauugacuuuugaaa

SEQ ID NO: 4104590 - RNA, 15 nt, Streptococcus pneumoniae R6
auauauuuauuauaa

SEQ ID NO: 4104591 - RNA, 18 nt, Streptococcus pneumoniae R6
auaucaaaaaaagaaguu

SEQ ID NO: 4104592 - RNA, 20 nt, Streptococcus pneumoniae R6
auaucaagguuuuugaaaaa

SEQ ID NO: 4104593 - RNA, 16 nt, Streptococcus pneumoniae R6
auaucaagguuuuugc

SEQ ID NO: 4104594 - RNA, 17 nt, Streptococcus pneumoniae R6
auaucaaguuuucacac

SEQ ID NO: 4104595 - RNA, 17 nt, Streptococcus pneumoniae R6
auaucaaucucugcaau

SEQ ID NO: 4104596 - RNA, 16 nt, Streptococcus pneumoniae R6
auaucaccaucaagga

SEQ ID NO: 4104597 - RNA, 17 nt, Streptococcus pneumoniae R6
auaucaccaucaaggac

SEQ ID NO: 4104598 - RNA, 22 nt, Streptococcus pneumoniae R6
auaucacggcauuucugcauaa

SEQ ID NO: 4104599 - RNA, 15 nt, Streptococcus pneumoniae R6
auaucagacauauca

SEQ ID NO: 4104600 - RNA, 21 nt, Streptococcus pneumoniae R6
auaucagcuaggauagcuuga

SEQ ID NO: 4104601 - RNA, 17 nt, Streptococcus pneumoniae R6
auaucaucgauuuuuuc

SEQ ID NO: 4104602 - RNA, 21 nt, Streptococcus pneumoniae R6
auaucaugcuuuacuaguucu

SEQ ID NO: 4104603 - RNA, 17 nt, Streptococcus pneumoniae R6
auaucauuuccaacaaa

SEQ ID NO: 4104604 - RNA, 17 nt, Streptococcus pneumoniae R6
auauccaaaaccauuca

SEQ ID NO: 4104605 - RNA, 17 nt, Streptococcus pneumoniae R6
auauccaaguuuuguug

SEQ ID NO: 4104606 - RNA, 20 nt, Streptococcus pneumoniae R6
auauccagcuuucuagccug

SEQ ID NO: 4104607 - RNA, 13 nt, Streptococcus pneumoniae R6
auauccauuccuc

SEQ ID NO: 4104608 - RNA, 13 nt, Streptococcus pneumoniae R6
auauccccagaca

SEQ ID NO: 4104609 - RNA, 13 nt, Streptococcus pneumoniae R6
auauccuaaaaaa

SEQ ID NO: 4104610 - RNA, 14 nt, Streptococcus pneumoniae R6
auauccuaaaaaag

SEQ ID NO: 4104611 - RNA, 15 nt, Streptococcus pneumoniae R6
auauccuaaaaaaga

SEQ ID NO: 4104612 - RNA, 21 nt, Streptococcus pneumoniae R6
auauccuuguucaugcaggaa

SEQ ID NO: 4104613 - RNA, 16 nt, Streptococcus pneumoniae R6
auaucgauauaauggc

SEQ ID NO: 4104614 - RNA, 19 nt, Streptococcus pneumoniae R6
auaucgaugcccucuucuu

SEQ ID NO: 4104615 - RNA, 18 nt, Streptococcus pneumoniae R6
auaucuaauugauuuaaa

SEQ ID NO: 4104616 - RNA, 22 nt, Streptococcus pneumoniae R6
auaucuaauugauuuaaauuca

SEQ ID NO: 4104617 - RNA, 18 nt, Streptococcus pneumoniae R6
auaucuccagauagagcu

SEQ ID NO: 4104618 - RNA, 20 nt, Streptococcus pneumoniae R6
auaucuccagauagagcuaa

SEQ ID NO: 4104619 - RNA, 14 nt, Streptococcus pneumoniae R6
auaucuccauuacu

SEQ ID NO: 4104620 - RNA, 22 nt, Streptococcus pneumoniae R6
auaucugaaaguuuaucucuug

SEQ ID NO: 4104621 - RNA, 23 nt, Streptococcus pneumoniae R6
auaucugaaaguuuaucucuugc

SEQ ID NO: 4104622 - RNA, 22 nt, Streptococcus pneumoniae R6
auaucugagauaguauuuuaaa

SEQ ID NO: 4104623 - RNA, 18 nt, Streptococcus pneumoniae R6
auaucugagguaggaguc

SEQ ID NO: 4104624 - RNA, 16 nt, Streptococcus pneumoniae R6
auaucugauauuauac

SEQ ID NO: 4104625 - RNA, 13 nt, Streptococcus pneumoniae R6
auaucugcuucca

SEQ ID NO: 4104626 - RNA, 15 nt, Streptococcus pneumoniae R6
auaucuggauuuuca

SEQ ID NO: 4104627 - RNA, 21 nt, Streptococcus pneumoniae R6
auaucugguacucacuuacau

SEQ ID NO: 4104628 - RNA, 17 nt, Streptococcus pneumoniae R6
auaucugguugccaagu

SEQ ID NO: 4104629 - RNA, 23 nt, Streptococcus pneumoniae R6
auaucugguugccaaguccauuu

SEQ ID NO: 4104630 - RNA, 13 nt, Streptococcus pneumoniae R6
auaucuuauuuca

SEQ ID NO: 4104631 - RNA, 19 nt, Streptococcus pneumoniae R6
auaucuuauuucaauccau

SEQ ID NO: 4104632 - RNA, 20 nt, Streptococcus pneumoniae R6
auaucuuauuucaauccauu

SEQ ID NO: 4104633 - RNA, 20 nt, Streptococcus pneumoniae R6
auaucuuauuucaguuuacu

SEQ ID NO: 4104634 - RNA, 15 nt, Streptococcus pneumoniae R6
auaucuucugcuugc

SEQ ID NO: 4104635 - RNA, 23 nt, Streptococcus pneumoniae R6
auaucuuuagggaaauuauuuau

SEQ ID NO: 4104636 - RNA, 14 nt, Streptococcus pneumoniae R6
auaucuuuagugau

SEQ ID NO: 4104637 - RNA, 21 nt, Streptococcus pneumoniae R6
auaucuuuuauuuuuauaaca

SEQ ID NO: 4104638 - RNA, 21 nt, Streptococcus pneumoniae R6
auaugaaaucuuuuugauaca

SEQ ID NO: 4104639 - RNA, 16 nt, Streptococcus pneumoniae R6
auaugaacaaaaccug

SEQ ID NO: 4104640 - RNA, 13 nt, Streptococcus pneumoniae R6
auaugaaguuuau

SEQ ID NO: 4104641 - RNA, 15 nt, Streptococcus pneumoniae R6
auaugaggagaaaga

SEQ ID NO: 4104642 - RNA, 13 nt, Streptococcus pneumoniae R6
auaugauggaaga

SEQ ID NO: 4104643 - RNA, 17 nt, Streptococcus pneumoniae R6
auaugauucuuucuaau

SEQ ID NO: 4104644 - RNA, 21 nt, Streptococcus pneumoniae R6
auaugauuucaauuuuaaauu

SEQ ID NO: 4104645 - RNA, 18 nt, Streptococcus pneumoniae R6
auaugcaauuucuuuaua

SEQ ID NO: 4104646 - RNA, 23 nt, Streptococcus pneumoniae R6
auaugcuagugucauaguccuga

SEQ ID NO: 4104647 - RNA, 18 nt, Streptococcus pneumoniae R6
auauggaaaaauggauga

SEQ ID NO: 4104648 - RNA, 18 nt, Streptococcus pneumoniae R6
auauggauaauugaauau

SEQ ID NO: 4104649 - RNA, 15 nt, Streptococcus pneumoniae R6
auauggaugauuuaa

SEQ ID NO: 4104650 - RNA, 21 nt, Streptococcus pneumoniae R6
auauggcacaaaagguucuuu

SEQ ID NO: 4104651 - RNA, 20 nt, Streptococcus pneumoniae R6
auaugggcuuacaucaaaaa

SEQ ID NO: 4104652 - RNA, 23 nt, Streptococcus pneumoniae R6
auauggugcguuuuuugauuaag

SEQ ID NO: 4104653 - RNA, 23 nt, Streptococcus pneumoniae R6
auauguccuucaugaaauuauuu

SEQ ID NO: 4104654 - RNA, 16 nt, Streptococcus pneumoniae R6
aucaagguuuuugaaa

SEQ ID NO: 4104655 - RNA, 17 nt, Streptococcus pneumoniae R6
aucaaguaggcucaucc

SEQ ID NO: 4104656 - RNA, 19 nt, Streptococcus pneumoniae R6
aucaaguuuaccauucaau

SEQ ID NO: 4104657 - RNA, 14 nt, Streptococcus pneumoniae R6
aucaaguuuucaca

SEQ ID NO: 4104658 - RNA, 16 nt, Streptococcus pneumoniae R6
aucaaguuuuugcaca

SEQ ID NO: 4104659 - RNA, 24 nt, Streptococcus pneumoniae R6
aucaauaacacgagaaacaauaaa

SEQ ID NO: 4104660 - RNA, 23 nt, Streptococcus pneumoniae R6
aucaauacccccuuaaaaccaug

SEQ ID NO: 4104661 - RNA, 15 nt, Streptococcus pneumoniae R6
aucaaucaagauaca

SEQ ID NO: 4104662 - RNA, 17 nt, Streptococcus pneumoniae R6
aucaauccugaagaaug

SEQ ID NO: 4104663 - RNA, 16 nt, Streptococcus pneumoniae R6
aucaaucguuucaagu

SEQ ID NO: 4104664 - RNA, 17 nt, Streptococcus pneumoniae R6
aucaaucuucaaaaucu

SEQ ID NO: 4104665 - RNA, 22 nt, Streptococcus pneumoniae R6
aucaaucuucaaaaucucagcu

SEQ ID NO: 4104666 - RNA, 17 nt, Streptococcus pneumoniae R6
ucaacauuaaagacaau

SEQ ID NO: 4104667 - RNA, 16 nt, Streptococcus pneumoniae R6
ucaaccaacuuuuccu

SEQ ID NO: 4104668 - RNA, 14 nt, Streptococcus pneumoniae R6
ucaaccaacuuuug

SEQ ID NO: 4104669 - RNA, 13 nt, Streptococcus pneumoniae R6
ucaaccacaaaaa

SEQ ID NO: 4104670 - RNA, 16 nt, Streptococcus pneumoniae R6
ucaaccacuuaacaac

SEQ ID NO: 4104671 - RNA, 15 nt, Streptococcus pneumoniae R6
ucaacccacuacagu

SEQ ID NO: 4104672 - RNA, 23 nt, Streptococcus pneumoniae R6
ucaacccacuacaguugacaaag

SEQ ID NO: 4104673 - RNA, 20 nt, Streptococcus pneumoniae R6
ucaaccucgauaugaauaau

SEQ ID NO: 4104674 - RNA, 21 nt, Streptococcus pneumoniae R6
ucaaccuuaccgaugauguuc

SEQ ID NO: 4104675 - RNA, 13 nt, Streptococcus pneumoniae R6
ucaaccuuccacu

SEQ ID NO: 4104676 - RNA, 14 nt, Streptococcus pneumoniae R6
ucaaccuuccacuu

SEQ ID NO: 4104677 - RNA, 15 nt, Streptococcus pneumoniae R6
ucaacgaacuauaaa

SEQ ID NO: 4104678 - RNA, 17 nt, Streptococcus pneumoniae R6
ucaacgaacuauaaaau

SEQ ID NO: 4104679 - RNA, 18 nt, Streptococcus pneumoniae R6
ucaacgucaucuuggauu

SEQ ID NO: 4104680 - RNA, 20 nt, Streptococcus pneumoniae R6
ucaacuagagcccaauauuc

SEQ ID NO: 4104681 - RNA, 18 nt, Streptococcus pneumoniae R6
ucaacucagcauuuucuu

SEQ ID NO: 4104682 - RNA, 20 nt, Streptococcus pneumoniae R6
ucaacugccugguaaagacu

SEQ ID NO: 4104683 - RNA, 15 nt, Streptococcus pneumoniae R6
ucaacuggcaucccc

SEQ ID NO: 4104684 - RNA, 18 nt, Streptococcus pneumoniae R6
ucaacuggcauccccagc

SEQ ID NO: 4104685 - RNA, 23 nt, Streptococcus pneumoniae R6
ucaacuguaguggguugaaaaaa

SEQ ID NO: 4104686 - RNA, 18 nt, Streptococcus pneumoniae R6
ucaacuucgucacauucc

SEQ ID NO: 4104687 - RNA, 13 nt, Streptococcus pneumoniae R6
ucaacuucuauca

SEQ ID NO: 4104688 - RNA, 15 nt, Streptococcus pneumoniae R6
ucaagaacaauuuca

SEQ ID NO: 4104689 - RNA, 17 nt, Streptococcus pneumoniae R6
ucaagaacaauuucaca

SEQ ID NO: 4104690 - RNA, 22 nt, Streptococcus pneumoniae R6
ucaagaacugcuaccaauucag

SEQ ID NO: 4104691 - RNA, 21 nt, Streptococcus pneumoniae R6
ucaagaagagggcuucuucaa

SEQ ID NO: 4104692 - RNA, 16 nt, Streptococcus pneumoniae R6
ucaagaagcgaauagc

SEQ ID NO: 4104693 - RNA, 14 nt, Streptococcus pneumoniae R6
ucaagaaugaaagu

SEQ ID NO: 4104694 - RNA, 20 nt, Streptococcus pneumoniae R6
ucaagacaaggauaaaaagu

SEQ ID NO: 4104695 - RNA, 18 nt, Streptococcus pneumoniae R6
ucaagaccauuuccaucu

SEQ ID NO: 4104696 - RNA, 15 nt, Streptococcus pneumoniae R6
ucaagacuaggugag

SEQ ID NO: 4104697 - RNA, 11 nt, Streptococcus pneumoniae R6
ucaagagaaaa

SEQ ID NO: 4104698 - RNA, 14 nt, Streptococcus pneumoniae R6
ucaagagaaaacca

SEQ ID NO: 4104699 - RNA, 22 nt, Streptococcus pneumoniae R6
ucaagagaaaaccaaaacucaa

SEQ ID NO: 4104700 - RNA, 13 nt, Streptococcus pneumoniae R6
ucaagauaagaaa

SEQ ID NO: 4104701 - RNA, 19 nt, Streptococcus pneumoniae R6
ucaagauaagaaaaaacag

SEQ ID NO: 4104702 - RNA, 24 nt, Streptococcus pneumoniae R6
ucaagauagcugugaagcguucca

SEQ ID NO: 4104703 - RNA, 17 nt, Streptococcus pneumoniae R6
ucaagcaaaucaaagcu

SEQ ID NO: 4104704 - RNA, 22 nt, Streptococcus pneumoniae R6
ucaagcaacuaaaaaggaacca

SEQ ID NO: 4104705 - RNA, 17 nt, Streptococcus pneumoniae R6
ucaagcauuuuuuugau

SEQ ID NO: 4104706 - RNA, 17 nt, Streptococcus pneumoniae R6
ucaagccuuauugcucu

SEQ ID NO: 4104707 - RNA, 18 nt, Streptococcus pneumoniae R6
ucaagcgaacaucuccaa

SEQ ID NO: 4104708 - RNA, 23 nt, Streptococcus pneumoniae R6
ucaagcuggcuacagaugcugca

SEQ ID NO: 4104709 - RNA, 18 nt, Streptococcus pneumoniae R6
ucaagcugugaguucauu

SEQ ID NO: 4104710 - RNA, 23 nt, Streptococcus pneumoniae R6
ucaagcugugaguucauuaugau

SEQ ID NO: 4104711 - RNA, 20 nt, Streptococcus pneumoniae R6
ucaaggcaguacuuugagca

SEQ ID NO: 4104712 - RNA, 15 nt, Streptococcus pneumoniae R6
ucaagggaaaaugaa

SEQ ID NO: 4104713 - RNA, 16 nt, Streptococcus pneumoniae R6
ucaagguaauaaucca

SEQ ID NO: 4104714 - RNA, 17 nt, Streptococcus pneumoniae R6
ucaaggucgcauaggca

SEQ ID NO: 4104715 - RNA, 19 nt, Streptococcus pneumoniae R6
ucaagguuuuauacucuua

SEQ ID NO: 4104716 - RNA, 14 nt, Streptococcus pneumoniae R6
ucaagguuuuucaa

SEQ ID NO: 4104717 - RNA, 23 nt, Streptococcus pneumoniae R6
ucaaguaacuuuggcgauuuaca

SEQ ID NO: 4104718 - RNA, 16 nt, Streptococcus pneumoniae R6
ucaagucaacuugaag

SEQ ID NO: 4104719 - RNA, 15 nt, Streptococcus pneumoniae R6
ucaaguccuuuauug

SEQ ID NO: 4104720 - RNA, 21 nt, Streptococcus pneumoniae R6
ucaaguccuuuugauuacaua

SEQ ID NO: 4104721 - RNA, 24 nt, Streptococcus pneumoniae R6
ucaagucuguauagaccugaucaa

SEQ ID NO: 4104722 - RNA, 19 nt, Streptococcus pneumoniae R6
ucaagucuuccgaauaacu

SEQ ID NO: 4104723 - RNA, 22 nt, Streptococcus pneumoniae R6
ucaagugccaagaagguuucau

SEQ ID NO: 4104724 - RNA, 23 nt, Streptococcus pneumoniae R6
ucaagugcuuuugugauuuuaaa

SEQ ID NO: 4104725 - RNA, 18 nt, Streptococcus pneumoniae R6
ucaaguguaucaggaaua

SEQ ID NO: 4104726 - RNA, 14 nt, Streptococcus pneumoniae R6
ucaaguguugaaaa

SEQ ID NO: 4104727 - RNA, 22 nt, Streptococcus pneumoniae R6
ucaaguucugucuugcugucuc

SEQ ID NO: 4104728 - RNA, 23 nt, Streptococcus pneumoniae R6
ucaaguuguuugacgucuguaau

SEQ ID NO: 4104729 - RNA, 15 nt, Streptococcus pneumoniae R6
ucaaguuuaccauuc

SEQ ID NO: 4104730 - RNA, 14 nt, Streptococcus pneumoniae R6
ucaauaaaauauaa

SEQ ID NO: 4104731 - RNA, 19 nt, Streptococcus pneumoniae R6
ucaauaacacgagaaacaa

SEQ ID NO: 4104732 - RNA, 16 nt, Streptococcus pneumoniae R6
ucaauaaccaucauuu

SEQ ID NO: 4104733 - RNA, 21 nt, Streptococcus pneumoniae R6
ucaauaauuucuuuuuguguu

SEQ ID NO: 4104734 - RNA, 14 nt, Streptococcus pneumoniae R6
ucaauacagaagaa

SEQ ID NO: 4104735 - RNA, 17 nt, Streptococcus pneumoniae R6
ucaauacagaagaaaaa

SEQ ID NO: 4104736 - RNA, 13 nt, Streptococcus pneumoniae R6
ucaauaccaaaga

SEQ ID NO: 4104737 - RNA, 12 nt, Streptococcus pneumoniae R6
ucaauaccaggu

SEQ ID NO: 4104738 - RNA, 24 nt, Streptococcus pneumoniae R6
ucaauacgaaucaauacagaagaa

SEQ ID NO: 4104739 - RNA, 14 nt, Streptococcus pneumoniae R6
ucaauagacuauau

SEQ ID NO: 4104740 - RNA, 22 nt, Streptococcus pneumoniae R6
ucaauagugagacaagcaaucu

SEQ ID NO: 4104741 - RNA, 18 nt, Streptococcus pneumoniae R6
ucaauauagucuacaaua

SEQ ID NO: 4104742 - RNA, 17 nt, Streptococcus pneumoniae R6
ucaauauagucuauaau

SEQ ID NO: 4104743 - RNA, 22 nt, Streptococcus pneumoniae R6
ucaauaucaaaaccaaacucac

SEQ ID NO: 4104744 - RNA, 17 nt, Streptococcus pneumoniae R6
ucaauaucguaucuuug

SEQ ID NO: 4104745 - RNA, 16 nt, Streptococcus pneumoniae R6
ucaauaucuucugcuu

SEQ ID NO: 4104746 - RNA, 12 nt, Streptococcus pneumoniae R6
ucaauaucuuua

SEQ ID NO: 4104747 - RNA, 14 nt, Streptococcus pneumoniae R6
ucaauaucuuuauu

SEQ ID NO: 4104748 - RNA, 21 nt, Streptococcus pneumoniae R6
ucaauaugcucacugaugaaa

SEQ ID NO: 4104749 - RNA, 14 nt, Streptococcus pneumoniae R6
ucaaucaagacaga

SEQ ID NO: 4104750 - RNA, 20 nt, Streptococcus pneumoniae R6
ucaaucaaguaagccauauu

SEQ ID NO: 4104751 - RNA, 17 nt, Streptococcus pneumoniae R6
ucaaucaccguuugauu

SEQ ID NO: 4104752 - RNA, 19 nt, Streptococcus pneumoniae R6
ucaaucaguuuuuucacaa

SEQ ID NO: 4104753 - RNA, 20 nt, Streptococcus pneumoniae R6
ucaaucaguuuuuucacaaa

SEQ ID NO: 4104754 - RNA, 19 nt, Streptococcus pneumoniae R6
ucaaucauaagauuaauuu

SEQ ID NO: 4104755 - RNA, 16 nt, Streptococcus pneumoniae R6
ucaaucauaucaucaa

SEQ ID NO: 4104756 - RNA, 16 nt, Streptococcus pneumoniae R6
ucaaucaugagaauau

SEQ ID NO: 4104757 - RNA, 15 nt, Streptococcus pneumoniae R6
ucaauccacuuguaa

SEQ ID NO: 4104758 - RNA, 21 nt, Streptococcus pneumoniae R6
ucaauccacuuguaaagcgaa

SEQ ID NO: 4104759 - RNA, 17 nt, Streptococcus pneumoniae R6
ucaauccguucugagau

SEQ ID NO: 4104760 - RNA, 18 nt, Streptococcus pneumoniae R6
ucaauccuuuucugagga

SEQ ID NO: 4104761 - RNA, 16 nt, Streptococcus pneumoniae R6
ucaaucgcagcaucga

SEQ ID NO: 4104762 - RNA, 15 nt, Streptococcus pneumoniae R6
ucaaucgcuuaauuu

SEQ ID NO: 4104763 - RNA, 17 nt, Streptococcus pneumoniae R6
ucaaucguuucuggcag

SEQ ID NO: 4104764 - RNA, 17 nt, Streptococcus pneumoniae R6
ucaaucuacuauauuuu

SEQ ID NO: 4104765 - RNA, 18 nt, Streptococcus pneumoniae R6
ucaaucucugcaauuucu

SEQ ID NO: 4104766 - RNA, 13 nt, Streptococcus pneumoniae R6
ucaaucuuaucaa

SEQ ID NO: 4104767 - RNA, 18 nt, Streptococcus pneumoniae R6
ucaaucuuaucaaucaaa

SEQ ID NO: 4104768 - RNA, 17 nt, Streptococcus pneumoniae R6
uaaaacauuuauagaaa

SEQ ID NO: 4104769 - RNA, 19 nt, Streptococcus pneumoniae R6
uaaaacauuuauagaaauu

SEQ ID NO: 4104770 - RNA, 22 nt, Streptococcus pneumoniae R6
uaaaacauuuauagaaauuaau

SEQ ID NO: 4104771 - RNA, 23 nt, Streptococcus pneumoniae R6
uaaaacauuuauagaaauuaauu

SEQ ID NO: 4104772 - RNA, 20 nt, Streptococcus pneumoniae R6
uaaaacauuuccgauuucag

SEQ ID NO: 4104773 - RNA, 21 nt, Streptococcus pneumoniae R6
uaaaaccagguucuucaauca

SEQ ID NO: 4104774 - RNA, 20 nt, Streptococcus pneumoniae R6
uaaaaccauguuuuucaaua

SEQ ID NO: 4104775 - RNA, 14 nt, Streptococcus pneumoniae R6
uaaaaccuuuauac

SEQ ID NO: 4104776 - RNA, 21 nt, Streptococcus pneumoniae R6
uaaaaccuuuugggcacgaag

SEQ ID NO: 4104777 - RNA, 20 nt, Streptococcus pneumoniae R6
uaaaacgaaaggauuauaaa

SEQ ID NO: 4104778 - RNA, 14 nt, Streptococcus pneumoniae R6
uaaaacgauaaauu

SEQ ID NO: 4104779 - RNA, 17 nt, Streptococcus pneumoniae R6
uaaaacgcauaauauca

SEQ ID NO: 4104780 - RNA, 17 nt, Streptococcus pneumoniae R6
uaaaacguacaguauca

SEQ ID NO: 4104781 - RNA, 15 nt, Streptococcus pneumoniae R6
uaaaacuagugaagc

SEQ ID NO: 4104782 - RNA, 17 nt, Streptococcus pneumoniae R6
uaaaacucauuaauaaa

SEQ ID NO: 4104783 - RNA, 16 nt, Streptococcus pneumoniae R6
uaaaacuguaugagaa

SEQ ID NO: 4104784 - RNA, 17 nt, Streptococcus pneumoniae R6
uaaaacuugugauuuag

SEQ ID NO: 4104785 - RNA, 19 nt, Streptococcus pneumoniae R6
uaaaagaauagagggauuc

SEQ ID NO: 4104786 - RNA, 19 nt, Streptococcus pneumoniae R6
uaaaagaauucacugagau

SEQ ID NO: 4104787 - RNA, 14 nt, Streptococcus pneumoniae R6
uaaaagagaauagu

SEQ ID NO: 4104788 - RNA, 11 nt, Streptococcus pneumoniae R6
uaaaagagcaa

SEQ ID NO: 4104789 - RNA, 17 nt, Streptococcus pneumoniae R6
uaaaagaggagguaaau

SEQ ID NO: 4104790 - RNA, 16 nt, Streptococcus pneumoniae R6
uaaaagaguuuuugga

SEQ ID NO: 4104791 - RNA, 17 nt, Streptococcus pneumoniae R6
uaaaagauaaucaucug

SEQ ID NO: 4104792 - RNA, 18 nt, Streptococcus pneumoniae R6
uaaaagauagagaaagaa

SEQ ID NO: 4104793 - RNA, 23 nt, Streptococcus pneumoniae R6
uaaaagauuucuauaaauucauu

SEQ ID NO: 4104794 - RNA, 14 nt, Streptococcus pneumoniae R6
uaaaagcaaaagaa

SEQ ID NO: 4104795 - RNA, 18 nt, Streptococcus pneumoniae R6
uaaaagcaaaagaacaag

SEQ ID NO: 4104796 - RNA, 20 nt, Streptococcus pneumoniae R6
uaaaaggcucauaaauggag

SEQ ID NO: 4104797 - RNA, 12 nt, Streptococcus pneumoniae R6
uaaaaguacuuu

SEQ ID NO: 4104798 - RNA, 17 nt, Streptococcus pneumoniae R6
uaaaagucuccugugcu

SEQ ID NO: 4104799 - RNA, 19 nt, Streptococcus pneumoniae R6
uaaaagucuccugugcucc

SEQ ID NO: 4104800 - RNA, 15 nt, Streptococcus pneumoniae R6
uaaaagucuucacaa

SEQ ID NO: 4104801 - RNA, 19 nt, Streptococcus pneumoniae R6
uaaaagugucuuaacaaaa

SEQ ID NO: 4104802 - RNA, 14 nt, Streptococcus pneumoniae R6
uaaaaguuauagaa

SEQ ID NO: 4104803 - RNA, 14 nt, Streptococcus pneumoniae R6
uaaaauaacucaau

SEQ ID NO: 4104804 - RNA, 19 nt, Streptococcus pneumoniae R6
uaaaauaacucaauuaaga

SEQ ID NO: 4104805 - RNA, 21 nt, Streptococcus pneumoniae R6
uaaaauaacucaauuaagaaa

SEQ ID NO: 4104806 - RNA, 17 nt, Streptococcus pneumoniae R6
uaaaauaacuguaauuu

SEQ ID NO: 4104807 - RNA, 23 nt, Streptococcus pneumoniae R6
uaaaauaaguucaacaaaucaga

SEQ ID NO: 4104808 - RNA, 18 nt, Streptococcus pneumoniae R6
uaaaauacccucuaucaa

SEQ ID NO: 4104809 - RNA, 17 nt, Streptococcus pneumoniae R6
uaaaauagauaaauacu

SEQ ID NO: 4104810 - RNA, 19 nt, Streptococcus pneumoniae R6
uaaaauaguacgaaacaau

SEQ ID NO: 4104811 - RNA, 23 nt, Streptococcus pneumoniae R6
uaaaauaguacgaaacaauugcu

SEQ ID NO: 4104812 - RNA, 14 nt, Streptococcus pneumoniae R6
uaaaauaguucacu

SEQ ID NO: 4104813 - RNA, 16 nt, Streptococcus pneumoniae R6
uaaaauaguucacuga

SEQ ID NO: 4104814 - RNA, 17 nt, Streptococcus pneumoniae R6
uaaaauauuucuagaaa

SEQ ID NO: 4104815 - RNA, 23 nt, Streptococcus pneumoniae R6
uaaaauauuucuagaaauuaauu

SEQ ID NO: 4104816 - RNA, 14 nt, Streptococcus pneumoniae R6
uaaaaucaaaaagg

SEQ ID NO: 4104817 - RNA, 14 nt, Streptococcus pneumoniae R6
uaaaaucaaacaaa

SEQ ID NO: 4104818 - RNA, 15 nt, Streptococcus pneumoniae R6
uaaaaucaaacaaaa

SEQ ID NO: 4104819 - RNA, 16 nt, Streptococcus pneumoniae R6
uaaaaucaaacaaaag

SEQ ID NO: 4104820 - RNA, 18 nt, Streptococcus pneumoniae R6
uaaaaucacaucugcuag

SEQ ID NO: 4104821 - RNA, 15 nt, Streptococcus pneumoniae R6
uaaaauccgagccaa

SEQ ID NO: 4104822 - RNA, 16 nt, Streptococcus pneumoniae R6
uaaaaucguagucuuu

SEQ ID NO: 4104823 - RNA, 15 nt, Streptococcus pneumoniae R6
uaaaaucucuuuauu

SEQ ID NO: 4104824 - RNA, 18 nt, Streptococcus pneumoniae R6
uaaaaucucuuuauuggu

SEQ ID NO: 4104825 - RNA, 16 nt, Streptococcus pneumoniae R6
uaaaaucuuuuacuuc

SEQ ID NO: 4104826 - RNA, 21 nt, Streptococcus pneumoniae R6
uaaaaugaaacaaaaacagga

SEQ ID NO: 4104827 - RNA, 13 nt, Streptococcus pneumoniae R6
uaaaaugaaauaa

SEQ ID NO: 4104828 - RNA, 17 nt, Streptococcus pneumoniae R6
uaaaaugaaauaagaau

SEQ ID NO: 4104829 - RNA, 19 nt, Streptococcus pneumoniae R6
uaaaaugcaccaaaacagg

SEQ ID NO: 4104830 - RNA, 21 nt, Streptococcus pneumoniae R6
uaaaaugccaaagaaagauuc

SEQ ID NO: 4104831 - RNA, 16 nt, Streptococcus pneumoniae R6
uaaaauguucuguaau

SEQ ID NO: 4104832 - RNA, 13 nt, Streptococcus pneumoniae R6
uaaaauuauaaaa

SEQ ID NO: 4104833 - RNA, 16 nt, Streptococcus pneumoniae R6
uaaaauuauagucuuu

SEQ ID NO: 4104834 - RNA, 20 nt, Streptococcus pneumoniae R6
uaaaauucaauguuuacuca

SEQ ID NO: 4104835 - RNA, 20 nt, Streptococcus pneumoniae R6
uaaaauuccuuuaaaaacaa

SEQ ID NO: 4104836 - RNA, 22 nt, Streptococcus pneumoniae R6
uaaaauuccuuuaaaaacaauc

SEQ ID NO: 4104837 - RNA, 18 nt, Streptococcus pneumoniae R6
uaaaauuguguuuuugcc

SEQ ID NO: 4104838 - RNA, 18 nt, Streptococcus pneumoniae R6
uaaaauuuaaaaauagau

SEQ ID NO: 4104839 - RNA, 12 nt, Streptococcus pneumoniae R6
uaaaauuuaaua

SEQ ID NO: 4104840 - RNA, 20 nt, Streptococcus pneumoniae R6
uaaaauuucuugacauacaa

SEQ ID NO: 4104841 - RNA, 20 nt, Streptococcus pneumoniae R6
uaaaauuugaacaaauuaau

SEQ ID NO: 4104842 - RNA, 21 nt, Streptococcus pneumoniae R6
uaaaauuugaacaaauuaauu

SEQ ID NO: 4104843 - RNA, 15 nt, Streptococcus pneumoniae R6
uaaaauuuuaucuuu

SEQ ID NO: 4104844 - RNA, 16 nt, Streptococcus pneumoniae R6
uaaacaaaaagaaaaa

SEQ ID NO: 4104845 - RNA, 16 nt, Streptococcus pneumoniae R6
uaaacaaacuccucuc

SEQ ID NO: 4104846 - RNA, 15 nt, Streptococcus pneumoniae R6
uaaacaagagauguu

SEQ ID NO: 4104847 - RNA, 13 nt, Streptococcus pneumoniae R6
uaaacaaggcaga

SEQ ID NO: 4104848 - RNA, 21 nt, Streptococcus pneumoniae R6
uaaacaaggcagagauguaaa

SEQ ID NO: 4104849 - RNA, 20 nt, Streptococcus pneumoniae R6
uaaacacuucacuaauucac

SEQ ID NO: 4104850 - RNA, 22 nt, Streptococcus pneumoniae R6
uaaacacuucacuaauucaccu

SEQ ID NO: 4104851 - RNA, 12 nt, Streptococcus pneumoniae R6
uaaacaggcucg

SEQ ID NO: 4104852 - RNA, 12 nt, Streptococcus pneumoniae R6
uaaacaguaaua

SEQ ID NO: 4104853 - RNA, 18 nt, Streptococcus pneumoniae R6
uaaacaguaauaaagaca

SEQ ID NO: 4104854 - RNA, 12 nt, Streptococcus pneumoniae R6
uaaacaucuguc

SEQ ID NO: 4104855 - RNA, 19 nt, Streptococcus pneumoniae R6
uaaaccaaaggaagcugag

SEQ ID NO: 4104856 - RNA, 14 nt, Streptococcus pneumoniae R6
uaaaccaauuuuaa

SEQ ID NO: 4104857 - RNA, 15 nt, Streptococcus pneumoniae R6
uaaaccaauuuuaag

SEQ ID NO: 4104858 - RNA, 22 nt, Streptococcus pneumoniae R6
uaaaccacgucaguuuuaucag

SEQ ID NO: 4104859 - RNA, 23 nt, Streptococcus pneumoniae R6
uaaaccacgucaguuuuaucagu

SEQ ID NO: 4104860 - RNA, 14 nt, Streptococcus pneumoniae R6
uaaaccaucgugua

SEQ ID NO: 4104861 - RNA, 14 nt, Streptococcus pneumoniae R6
uaaaccgcgauuuu

SEQ ID NO: 4104862 - RNA, 19 nt, Streptococcus pneumoniae R6
uaaaccucgauaccuguua

SEQ ID NO: 4104863 - RNA, 14 nt, Streptococcus pneumoniae R6
uaaaccuuccaaga

SEQ ID NO: 4104864 - RNA, 17 nt, Streptococcus pneumoniae R6
uaaacggacaaaacugu

SEQ ID NO: 4104865 - RNA, 20 nt, Streptococcus pneumoniae R6
uaaacguuuuuacuuuggca

SEQ ID NO: 4104866 - RNA, 16 nt, Streptococcus pneumoniae R6
uaaacuaagcuuauau

SEQ ID NO: 4104867 - RNA, 15 nt, Streptococcus pneumoniae R6
uaaacuaauguaaaa

SEQ ID NO: 4104868 - RNA, 21 nt, Streptococcus pneumoniae R6
uaaacuacacccgcauaaaua

SEQ ID NO: 4104869 - RNA, 17 nt, Streptococcus pneumoniae R6
uaaacuaguuuucuaaa

SEQ ID NO: 4104870 - RNA, 17 nt, Streptococcus pneumoniae R6
uaaacuauccagagcau

SEQ ID NO: 4104871 - RNA, 21 nt, Streptococcus pneumoniae R6
uaaacuauccagagcauucuu

SEQ ID NO: 4104872 - RNA, 21 nt, Streptococcus pneumoniae R6
uaaacuauuaagccuucucca

SEQ ID NO: 4104873 - RNA, 16 nt, Streptococcus pneumoniae R6
uaaacuauuucuuauu

SEQ ID NO: 4104874 - RNA, 12 nt, Streptococcus pneumoniae R6
uaaacucugcac

SEQ ID NO: 4104875 - RNA, 18 nt, Streptococcus pneumoniae R6
uaaacucuugauuuucau

SEQ ID NO: 4104876 - RNA, 23 nt, Streptococcus pneumoniae R6
uaaacucuugauuuucauugacu

SEQ ID NO: 4104877 - RNA, 19 nt, Streptococcus pneumoniae R6
uaaacugcgaagaaaucau

SEQ ID NO: 4104878 - RNA, 23 nt, Streptococcus pneumoniae R6
uaaacugcgaagaaaucauugga

SEQ ID NO: 4104879 - RNA, 15 nt, Streptococcus pneumoniae R6
uaaacuucuucuucc

SEQ ID NO: 4104880 - RNA, 17 nt, Streptococcus pneumoniae R6
uaaacuucuucuuccau

SEQ ID NO: 4104881 - RNA, 19 nt, Streptococcus pneumoniae R6
uaaacuuuauaauauguau

SEQ ID NO: 4104882 - RNA, 15 nt, Streptococcus pneumoniae R6
uaaacuuugagccua

SEQ ID NO: 4104883 - RNA, 14 nt, Streptococcus pneumoniae R6
uaaacuuuuucaua

SEQ ID NO: 4104884 - RNA, 17 nt, Streptococcus pneumoniae R6
uaaagaaaagagcauau

SEQ ID NO: 4104885 - RNA, 15 nt, Streptococcus pneumoniae R6
uaaagaauuugaaaa

SEQ ID NO: 4104886 - RNA, 17 nt, Streptococcus pneumoniae R6
uaaagaauuugaaaaaa

SEQ ID NO: 4104887 - RNA, 18 nt, Streptococcus pneumoniae R6
uaaagaauuugaaaaaaa

SEQ ID NO: 4104888 - RNA, 19 nt, Streptococcus pneumoniae R6
uaaagaauuugaaaaaaau

SEQ ID NO: 4104889 - RNA, 11 nt, Streptococcus pneumoniae R6
uaaagacaaug

SEQ ID NO: 4104890 - RNA, 12 nt, Streptococcus pneumoniae R6
uaaagacaaugu

SEQ ID NO: 4104891 - RNA, 14 nt, Streptococcus pneumoniae R6
uaaagacagucuga

SEQ ID NO: 4104892 - RNA, 16 nt, Streptococcus pneumoniae R6
uaaagacagucugaaa

SEQ ID NO: 4104893 - RNA, 20 nt, Streptococcus pneumoniae R6
uaaagacagucugaaaaaua

SEQ ID NO: 4104894 - RNA, 14 nt, Streptococcus pneumoniae R6
uaaagaccaaagaa

SEQ ID NO: 4104895 - RNA, 17 nt, Streptococcus pneumoniae R6
uaaagaccaaagaaaaa

SEQ ID NO: 4104896 - RNA, 20 nt, Streptococcus pneumoniae R6
uaaagacuagaaaaagcuuc

SEQ ID NO: 4104897 - RNA, 12 nt, Streptococcus pneumoniae R6
uaaagacuagac

SEQ ID NO: 4104898 - RNA, 17 nt, Streptococcus pneumoniae R6
uaaagacuagacuugcc

SEQ ID NO: 4104899 - RNA, 17 nt, Streptococcus pneumoniae R6
uaaagacucuugcccuu

SEQ ID NO: 4104900 - RNA, 21 nt, Streptococcus pneumoniae R6
uaaagagaugagagauaaaua

SEQ ID NO: 4104901 - RNA, 15 nt, Streptococcus pneumoniae R6
uaaagaggaaaucuu

SEQ ID NO: 4104902 - RNA, 16 nt, Streptococcus pneumoniae R6
uaaagaggaaaucuuu

SEQ ID NO: 4104903 - RNA, 21 nt, Streptococcus pneumoniae R6
uaaagaggagucuuauaguaa

SEQ ID NO: 4104904 - RNA, 19 nt, Streptococcus pneumoniae R6
uaaagaggucgaagccauc

SEQ ID NO: 4104905 - RNA, 18 nt, Streptococcus pneumoniae R6
uaaagagguugcuacagg

SEQ ID NO: 4104906 - RNA, 16 nt, Streptococcus pneumoniae R6
uaaagaguacagucuu

SEQ ID NO: 4104907 - RNA, 22 nt, Streptococcus pneumoniae R6
uaaagagucaagacaaggauaa

SEQ ID NO: 4104908 - RNA, 20 nt, Streptococcus pneumoniae R6
uaaagagucuggaacaaaau

SEQ ID NO: 4104909 - RNA, 14 nt, Streptococcus pneumoniae R6
uaaagauagccaug

SEQ ID NO: 4104910 - RNA, 14 nt, Streptococcus pneumoniae R6
uaaagauauuuugg

SEQ ID NO: 4104911 - RNA, 20 nt, Streptococcus pneumoniae R6
uaaagaucuauccauuuggg

SEQ ID NO: 4104912 - RNA, 21 nt, Streptococcus pneumoniae R6
uaaagcgaaaggagaaaaaau

SEQ ID NO: 4104913 - RNA, 20 nt, Streptococcus pneumoniae R6
uaaagcgaaaggagaaaaau

SEQ ID NO: 4104914 - RNA, 15 nt, Streptococcus pneumoniae R6
uaaagcuagauuuaa

SEQ ID NO: 4104915 - RNA, 17 nt, Streptococcus pneumoniae R6
uaaagcuagauuuaaaa

SEQ ID NO: 4104916 - RNA, 22 nt, Streptococcus pneumoniae R6
uaaagcuuuuuguuagauuuau

SEQ ID NO: 4104917 - RNA, 11 nt, Streptococcus pneumoniae R6
uaaaggaaagu

SEQ ID NO: 4104918 - RNA, 16 nt, Streptococcus pneumoniae R6
uaaaggacuuuaaagc

SEQ ID NO: 4104919 - RNA, 17 nt, Streptococcus pneumoniae R6
uaaaggaugacaauagc

SEQ ID NO: 4104920 - RNA, 21 nt, Streptococcus pneumoniae R6
uaaaggcagauuucaaaccug

SEQ ID NO: 4104921 - RNA, 16 nt, Streptococcus pneumoniae R6
uaaaggccuuggccuu

SEQ ID NO: 4104922 - RNA, 16 nt, Streptococcus pneumoniae R6
uaaagggcuuuaaagc

SEQ ID NO: 4104923 - RNA, 17 nt, Streptococcus pneumoniae R6
uaaaguaaaaauuucua

SEQ ID NO: 4104924 - RNA, 15 nt, Streptococcus pneumoniae R6
uaaaguaaucucuaa

SEQ ID NO: 4104925 - RNA, 17 nt, Streptococcus pneumoniae R6
uaaaguagcaaaacacu

SEQ ID NO: 4104926 - RNA, 19 nt, Streptococcus pneumoniae R6
uaaagucuucggagaagaa

SEQ ID NO: 4104927 - RNA, 23 nt, Streptococcus pneumoniae R6
uaaagucuucggagaagaaaaca

SEQ ID NO: 4104928 - RNA, 22 nt, Streptococcus pneumoniae R6
uaaagugggaacuagagaguuu

SEQ ID NO: 4104929 - RNA, 15 nt, Streptococcus pneumoniae R6
uaaagugucucccuu

SEQ ID NO: 4104930 - RNA, 23 nt, Streptococcus pneumoniae R6
uaaagugucucccuuuuuggauu

SEQ ID NO: 4104931 - RNA, 22 nt, Streptococcus pneumoniae R6
uaaaguguucugucuuguaaaa

SEQ ID NO: 4104932 - RNA, 20 nt, Streptococcus pneumoniae R6
uaaaguuaauugaauuucaa

SEQ ID NO: 4104933 - RNA, 22 nt, Streptococcus pneumoniae R6
uaaaguuacucuauuguagagu

SEQ ID NO: 4104934 - RNA, 18 nt, Streptococcus pneumoniae R6
uaaaguuaugaaaaagau

SEQ ID NO: 4104935 - RNA, 20 nt, Streptococcus pneumoniae R6
uaaaguugaaaugaccugca

SEQ ID NO: 4104936 - RNA, 16 nt, Streptococcus pneumoniae R6
uaaauaaaacaaaaaa

SEQ ID NO: 4104937 - RNA, 15 nt, Streptococcus pneumoniae R6
uaaauaaaucucugg

SEQ ID NO: 4104938 - RNA, 13 nt, Streptococcus pneumoniae R6
uaaauaauauuau

SEQ ID NO: 4104939 - RNA, 24 nt, Streptococcus pneumoniae R6
uaaauaaucuccacgcuccacuuc

SEQ ID NO: 4104940 - RNA, 12 nt, Streptococcus pneumoniae R6
uaaauacaaaaa

SEQ ID NO: 4104941 - RNA, 16 nt, Streptococcus pneumoniae R6
uaaauacaaaaauagc

SEQ ID NO: 4104942 - RNA, 20 nt, Streptococcus pneumoniae R6
uaaauacaaaaauagcccuu

SEQ ID NO: 4104943 - RNA, 23 nt, Streptococcus pneumoniae R6
uaaauacaccuaauccacucaga

SEQ ID NO: 4104944 - RNA, 24 nt, Streptococcus pneumoniae R6
uaaauacaccuaauccacucagac

SEQ ID NO: 4104945 - RNA, 14 nt, Streptococcus pneumoniae R6
uaaauaccuuaucc

SEQ ID NO: 4104946 - RNA, 18 nt, Streptococcus pneumoniae R6
uaaauacuaucaauaaaa

SEQ ID NO: 4104947 - RNA, 13 nt, Streptococcus pneumoniae R6
uaaauagaaacca

SEQ ID NO: 4104948 - RNA, 16 nt, Streptococcus pneumoniae R6
uaaauagaagauaaag

SEQ ID NO: 4104949 - RNA, 19 nt, Streptococcus pneumoniae R6
uaaauagauuggauaaaau

SEQ ID NO: 4104950 - RNA, 22 nt, Streptococcus pneumoniae R6
uaaauagauuggauaaaaucuu

SEQ ID NO: 4104951 - RNA, 21 nt, Streptococcus pneumoniae R6
uaaauagcguagucuuuuaaa

SEQ ID NO: 4104952 - RNA, 20 nt, Streptococcus pneumoniae R6
uaaauaguuauagaguguua

SEQ ID NO: 4104953 - RNA, 15 nt, Streptococcus pneumoniae R6
uaaauaguucuucca

SEQ ID NO: 4104954 - RNA, 16 nt, Streptococcus pneumoniae R6
uaaauaguucuuccaa

SEQ ID NO: 4104955 - RNA, 15 nt, Streptococcus pneumoniae R6
uaaauauaaucgauu

SEQ ID NO: 4104956 - RNA, 15 nt, Streptococcus pneumoniae R6
uaaauauaguaaaau

SEQ ID NO: 4104957 - RNA, 17 nt, Streptococcus pneumoniae R6
uaaauaucaaaaaaaga

SEQ ID NO: 4104958 - RNA, 22 nt, Streptococcus pneumoniae R6
uaaauaucauuuccaacaaacg

SEQ ID NO: 4104959 - RNA, 19 nt, Streptococcus pneumoniae R6
uaaauaugaacaaaucaau

SEQ ID NO: 4104960 - RNA, 23 nt, Streptococcus pneumoniae R6
uaaauaugaacaaaucaauugcu

SEQ ID NO: 4104961 - RNA, 21 nt, Streptococcus pneumoniae R6
uaaaucauaauccaacaccaa

SEQ ID NO: 4104962 - RNA, 16 nt, Streptococcus pneumoniae R6
uaaaucauccauauaa

SEQ ID NO: 4104963 - RNA, 24 nt, Streptococcus pneumoniae R6
uaaauccaaaagcaggaguuuucc

SEQ ID NO: 4104964 - RNA, 22 nt, Streptococcus pneumoniae R6
uaaauccaagccugucuguaag

SEQ ID NO: 4104965 - RNA, 23 nt, Streptococcus pneumoniae R6
uaaauccacguuuacgaaucucu

SEQ ID NO: 4104966 - RNA, 19 nt, Streptococcus pneumoniae R6
uaaauccgauaauauauag

SEQ ID NO: 4104967 - RNA, 16 nt, Streptococcus pneumoniae R6
uaaauccugcaaagau

SEQ ID NO: 4104968 - RNA, 20 nt, Streptococcus pneumoniae R6
uaaauccuuuuuucuuuacu

SEQ ID NO: 4104969 - RNA, 16 nt, Streptococcus pneumoniae R6
uaaaucgaucauauuu

SEQ ID NO: 4104970 - RNA, 15 nt, Streptococcus pneumoniae R6
uaaaucgauuauauu

SEQ ID NO: 4104971 - RNA, 16 nt, Streptococcus pneumoniae R6
uaaaucgauuauauuu

SEQ ID NO: 4104972 - RNA, 16 nt, Streptococcus pneumoniae R6
uaaaucgcuaagauau

SEQ ID NO: 4104973 - RNA, 16 nt, Streptococcus pneumoniae R6
uaaaucuaaucauucu

SEQ ID NO: 4104974 - RNA, 19 nt, Streptococcus pneumoniae R6
uaaaucuacuaucucuaca

SEQ ID NO: 4104975 - RNA, 12 nt, Streptococcus pneumoniae R6
uaaaucuaucag

SEQ ID NO: 4104976 - RNA, 16 nt, Streptococcus pneumoniae R6
uaaaucuaucagaaag

SEQ ID NO: 4104977 - RNA, 20 nt, Streptococcus pneumoniae R6
uaaaucucagaaaaaccuug

SEQ ID NO: 4104978 - RNA, 15 nt, Streptococcus pneumoniae R6
uaaaucuccagacca

SEQ ID NO: 4104979 - RNA, 21 nt, Streptococcus pneumoniae R6
uaaaucuuauauuuaguacuc

SEQ ID NO: 4104980 - RNA, 16 nt, Streptococcus pneumoniae R6
uaaaucuucuaaauua

SEQ ID NO: 4104981 - RNA, 21 nt, Streptococcus pneumoniae R6
uaaaucuugaugucuuggauu

SEQ ID NO: 4104982 - RNA, 14 nt, Streptococcus pneumoniae R6
uaaaucuugcccuu

SEQ ID NO: 4104983 - RNA, 14 nt, Streptococcus pneumoniae R6
uaaaugaauauauu

SEQ ID NO: 4104984 - RNA, 21 nt, Streptococcus pneumoniae R6
uaaaugaauauauuccauucc

SEQ ID NO: 4104985 - RNA, 16 nt, Streptococcus pneumoniae R6
uaaaugaguaugaaaa

SEQ ID NO: 4104986 - RNA, 20 nt, Streptococcus pneumoniae R6
uaaaugcauacgaaaaguag

SEQ ID NO: 4104987 - RNA, 13 nt, Streptococcus pneumoniae R6
uaaauuacugauu

SEQ ID NO: 4104988 - RNA, 15 nt, Streptococcus pneumoniae R6
uaaauuauuaaaauc

SEQ ID NO: 4104989 - RNA, 18 nt, Streptococcus pneumoniae R6
uaaauucaggugauuuac

SEQ ID NO: 4104990 - RNA, 16 nt, Streptococcus pneumoniae R6
uaaauucauuaaacuc

SEQ ID NO: 4104991 - RNA, 14 nt, Streptococcus pneumoniae R6
uaaauucauuuacu

SEQ ID NO: 4104992 - RNA, 18 nt, Streptococcus pneumoniae R6
uaaauuccaaauuagaaa

SEQ ID NO: 4104993 - RNA, 20 nt, Streptococcus pneumoniae R6
uaaauuccaaauuagaaaaa

SEQ ID NO: 4104994 - RNA, 23 nt, Streptococcus pneumoniae R6
uaaauuccaaauuagaaaaagac

SEQ ID NO: 4104995 - RNA, 13 nt, Streptococcus pneumoniae R6
uaaauucuuccag

SEQ ID NO: 4104996 - RNA, 21 nt, Streptococcus pneumoniae R6
uaaauucuuccagcucaucau

SEQ ID NO: 4104997 - RNA, 20 nt, Streptococcus pneumoniae R6
uaaauugucuaaaaauuuaa

SEQ ID NO: 4104998 - RNA, 21 nt, Streptococcus pneumoniae R6
uaaauugucuaagcgaaacaa

SEQ ID NO: 4104999 - RNA, 13 nt, Streptococcus pneumoniae R6
uaaauuuaacauu

SEQ ID NO: 4105000 - RNA, 17 nt, Streptococcus pneumoniae R6
uaaauuuauugguauua

SEQ ID NO: 4105001 - RNA, 19 nt, Streptococcus pneumoniae R6
uaaauuuauugguauuaau

SEQ ID NO: 4105002 - RNA, 20 nt, Streptococcus pneumoniae R6
uaaauuuauugguauuaaua

SEQ ID NO: 4105003 - RNA, 18 nt, Streptococcus pneumoniae R6
uaaauuuuucugcaaaaa

SEQ ID NO: 4105004 - RNA, 21 nt, Streptococcus pneumoniae R6
uaaauuuuucugcaaaaaaua

SEQ ID NO: 4105005 - RNA, 19 nt, Streptococcus pneumoniae R6
uaacaaaaauuugaucauc

SEQ ID NO: 4105006 - RNA, 12 nt, Streptococcus pneumoniae R6
uaacaaaauuau

SEQ ID NO: 4105007 - RNA, 17 nt, Streptococcus pneumoniae R6
uaacaaaauuauuaaaa

SEQ ID NO: 4105008 - RNA, 21 nt, Streptococcus pneumoniae R6
uaacaaaauuauuaaaaucaa

SEQ ID NO: 4105009 - RNA, 23 nt, Streptococcus pneumoniae R6
uaacaaagcuacgacuuucaagu

SEQ ID NO: 4105010 - RNA, 16 nt, Streptococcus pneumoniae R6
uaacaacccaauucau

SEQ ID NO: 4105011 - RNA, 18 nt, Streptococcus pneumoniae R6
uaacaauagcgaaauucu

SEQ ID NO: 4105012 - RNA, 18 nt, Streptococcus pneumoniae R6
uaacaauauuuuagaagc

SEQ ID NO: 4105013 - RNA, 21 nt, Streptococcus pneumoniae R6
uaacaauauuuuagaagcaga

SEQ ID NO: 4105014 - RNA, 22 nt, Streptococcus pneumoniae R6
uaacaauauuuuagaagcagag

SEQ ID NO: 4105015 - RNA, 23 nt, Streptococcus pneumoniae R6
uaacaaucuaucuuuuaauucau

SEQ ID NO: 4105016 - RNA, 16 nt, Streptococcus pneumoniae R6
uaacaauguuuuagaa

SEQ ID NO: 4105017 - RNA, 17 nt, Streptococcus pneumoniae R6
uaacacauauugauauu

SEQ ID NO: 4105018 - RNA, 17 nt, Streptococcus pneumoniae R6
uaacaccuuuauuauua

SEQ ID NO: 4105019 - RNA, 15 nt, Streptococcus pneumoniae R6
uaacagagaagaaau

SEQ ID NO: 4105020 - RNA, 15 nt, Streptococcus pneumoniae R6
uaacagcauuuccac

SEQ ID NO: 4105021 - RNA, 13 nt, Streptococcus pneumoniae R6
uaacagccaaaag

SEQ ID NO: 4105022 - RNA, 22 nt, Streptococcus pneumoniae R6
uaacagccaaaaguccaaagau

SEQ ID NO: 4105023 - RNA, 15 nt, Streptococcus pneumoniae R6
uaacagccaucagag

SEQ ID NO: 4105024 - RNA, 18 nt, Streptococcus pneumoniae R6
uaacagccaucagagagg

SEQ ID NO: 4105025 - RNA, 20 nt, Streptococcus pneumoniae R6
uaacaggccaauacagauaa

SEQ ID NO: 4105026 - RNA, 18 nt, Streptococcus pneumoniae R6
uaacaguauacuggagaa

SEQ ID NO: 4105027 - RNA, 22 nt, Streptococcus pneumoniae R6
uaacagucaguucauucucuaa

SEQ ID NO: 4105028 - RNA, 15 nt, Streptococcus pneumoniae R6
uaacaguuuuuaauu

SEQ ID NO: 4105029 - RNA, 20 nt, Streptococcus pneumoniae R6
uaacaguuuuuaauuuuucu

SEQ ID NO: 4105030 - RNA, 13 nt, Streptococcus pneumoniae R6
uaacauaaaugau

SEQ ID NO: 4105031 - RNA, 17 nt, Streptococcus pneumoniae R6
uaacauaaaugauguuc

SEQ ID NO: 4105032 - RNA, 21 nt, Streptococcus pneumoniae R6
uaacauaucaaccuuucucag

SEQ ID NO: 4105033 - RNA, 23 nt, Streptococcus pneumoniae R6
uaacauauuucuagaaauuaauu

SEQ ID NO: 4105034 - RNA, 20 nt, Streptococcus pneumoniae R6
uaacaucaauaaccaucauu

SEQ ID NO: 4105035 - RNA, 22 nt, Streptococcus pneumoniae R6
uaacaucuuugaagauaucgcc

SEQ ID NO: 4105036 - RNA, 14 nt, Streptococcus pneumoniae R6
uaacauuauugauu

SEQ ID NO: 4105037 - RNA, 17 nt, Streptococcus pneumoniae R6
uaaccaaguucuaaaua

SEQ ID NO: 4105038 - RNA, 16 nt, Streptococcus pneumoniae R6
uaaccaauuucucaaa

SEQ ID NO: 4105039 - RNA, 21 nt, Streptococcus pneumoniae R6
uaaccaauuucucaaaaaagu

SEQ ID NO: 4105040 - RNA, 13 nt, Streptococcus pneumoniae R6
uaaccacaaaaag

SEQ ID NO: 4105041 - RNA, 17 nt, Streptococcus pneumoniae R6
uaaccacagacugagga

SEQ ID NO: 4105042 - RNA, 17 nt, Streptococcus pneumoniae R6
uaaccagaucuuagaag

SEQ ID NO: 4105043 - RNA, 22 nt, Streptococcus pneumoniae R6
uaaccagaucuuagaagcaguu

SEQ ID NO: 4105044 - RNA, 15 nt, Streptococcus pneumoniae R6
uaaccaucauuuuua

SEQ ID NO: 4105045 - RNA, 12 nt, Streptococcus pneumoniae R6
uaaccaucugua

SEQ ID NO: 4105046 - RNA, 12 nt, Streptococcus pneumoniae R6
uaacccaaacaa

SEQ ID NO: 4105047 - RNA, 14 nt, Streptococcus pneumoniae R6
uaacccuagaaaac

SEQ ID NO: 4105048 - RNA, 19 nt, Streptococcus pneumoniae R6
uaaccgaugacaaaaauag

SEQ ID NO: 4105049 - RNA, 23 nt, Streptococcus pneumoniae R6
uaaccgaugacaaaaauaguaua

SEQ ID NO: 4105050 - RNA, 22 nt, Streptococcus pneumoniae R6
uaaccucuugaaguucauuuuc

SEQ ID NO: 4105051 - RNA, 19 nt, Streptococcus pneumoniae R6
uaaccuuauuucucaagau

SEQ ID NO: 4105052 - RNA, 13 nt, Streptococcus pneumoniae R6
uaacgaagagcug

SEQ ID NO: 4105053 - RNA, 13 nt, Streptococcus pneumoniae R6
uaacgaagucuau

SEQ ID NO: 4105054 - RNA, 18 nt, Streptococcus pneumoniae R6
uaacgaauccaacucuug

SEQ ID NO: 4105055 - RNA, 22 nt, Streptococcus pneumoniae R6
uaacgaauccaacucuuggaag

SEQ ID NO: 4105056 - RNA, 19 nt, Streptococcus pneumoniae R6
uaacgacauagucaaagag

SEQ ID NO: 4105057 - RNA, 20 nt, Streptococcus pneumoniae R6
uaacgagugggacauguuca

SEQ ID NO: 4105058 - RNA, 18 nt, Streptococcus pneumoniae R6
uaacgauagauccuucaa

SEQ ID NO: 4105059 - RNA, 16 nt, Streptococcus pneumoniae R6
uaacgauagcaccaaa

SEQ ID NO: 4105060 - RNA, 17 nt, Streptococcus pneumoniae R6
uaacgauggacuuuauc

SEQ ID NO: 4105061 - RNA, 22 nt, Streptococcus pneumoniae R6
uaacgauggacuuuaucaccuc

SEQ ID NO: 4105062 - RNA, 12 nt, Streptococcus pneumoniae R6
uaacgccaaauc

SEQ ID NO: 4105063 - RNA, 21 nt, Streptococcus pneumoniae R6
uaacggcuuccugugcuacga

SEQ ID NO: 4105064 - RNA, 18 nt, Streptococcus pneumoniae R6
uaacggcuuucaguuuca

SEQ ID NO: 4105065 - RNA, 22 nt, Streptococcus pneumoniae R6
uaacgguauagagaccaacucc

SEQ ID NO: 4105066 - RNA, 14 nt, Streptococcus pneumoniae R6
uaacgucuuuucgu

SEQ ID NO: 4105067 - RNA, 16 nt, Streptococcus pneumoniae R6
uaacuaguuaauacug

SEQ ID NO: 4105068 - RNA, 15 nt, Streptococcus pneumoniae R6
uaacucauaauaguc

SEQ ID NO: 4105069 - RNA, 16 nt, Streptococcus pneumoniae R6
uaacucauaauagucu

SEQ ID NO: 4105070 - RNA, 12 nt, Streptococcus pneumoniae R6
uaacucaucaaa

SEQ ID NO: 4105071 - RNA, 23 nt, Streptococcus pneumoniae R6
uaacucaucaaaggucucuucuu

SEQ ID NO: 4105072 - RNA, 20 nt, Streptococcus pneumoniae R6
uaacucccauaguuaagaga

SEQ ID NO: 4105073 - RNA, 15 nt, Streptococcus pneumoniae R6
uaacucuguaaucuc

SEQ ID NO: 4105074 - RNA, 16 nt, Streptococcus pneumoniae R6
uaacucuuuuuugguc

SEQ ID NO: 4105075 - RNA, 13 nt, Streptococcus pneumoniae R6
uaacugcuucacu

SEQ ID NO: 4105076 - RNA, 20 nt, Streptococcus pneumoniae R6
uaacuggaaagauaacugcu

SEQ ID NO: 4105077 - RNA, 19 nt, Streptococcus pneumoniae R6
uaacuucacuaguauucau

SEQ ID NO: 4105078 - RNA, 22 nt, Streptococcus pneumoniae R6
uaacuucagauuaguaauucaa

SEQ ID NO: 4105079 - RNA, 15 nt, Streptococcus pneumoniae R6
uaacuucuuauuagc

SEQ ID NO: 4105080 - RNA, 14 nt, Streptococcus pneumoniae R6
uaacuuuaccaaaa

SEQ ID NO: 4105081 - RNA, 14 nt, Streptococcus pneumoniae R6
uaacuuuguauaau

SEQ ID NO: 4105082 - RNA, 16 nt, Streptococcus pneumoniae R6
uaacuuuuuugagaaa

SEQ ID NO: 4105083 - RNA, 20 nt, Streptococcus pneumoniae R6
uaagaaagcaacuaaaauca

SEQ ID NO: 4105084 - RNA, 21 nt, Streptococcus pneumoniae R6
uaagaaagcaacuaaaaucau

SEQ ID NO: 4105085 - RNA, 13 nt, Streptococcus pneumoniae R6
uaagaaagcagcu

SEQ ID NO: 4105086 - RNA, 19 nt, Streptococcus pneumoniae R6
uaagaaagcagcuuaucuc

SEQ ID NO: 4105087 - RNA, 19 nt, Streptococcus pneumoniae R6
uaagaaaggauauaaaucu

SEQ ID NO: 4105088 - RNA, 21 nt, Streptococcus pneumoniae R6
uaagaaaguaagaaucugcau

SEQ ID NO: 4105089 - RNA, 21 nt, Streptococcus pneumoniae R6
uaagaaauaguuuagauaaaa

SEQ ID NO: 4105090 - RNA, 15 nt, Streptococcus pneumoniae R6
uaagaaaucauacac

SEQ ID NO: 4105091 - RNA, 14 nt, Streptococcus pneumoniae R6
uaagaaaucuccag

SEQ ID NO: 4105092 - RNA, 20 nt, Streptococcus pneumoniae R6
uaagaaauuuucuuuuuccu

SEQ ID NO: 4105093 - RNA, 14 nt, Streptococcus pneumoniae R6
uaagaaauuuugga

SEQ ID NO: 4105094 - RNA, 15 nt, Streptococcus pneumoniae R6
uaagaaauuuuggau

SEQ ID NO: 4105095 - RNA, 20 nt, Streptococcus pneumoniae R6
uaagaacaggacaaaucgau

SEQ ID NO: 4105096 - RNA, 13 nt, Streptococcus pneumoniae R6
uaagaaccaauau

SEQ ID NO: 4105097 - RNA, 15 nt, Streptococcus pneumoniae R6
uaagaaguagaggug

SEQ ID NO: 4105098 - RNA, 18 nt, Streptococcus pneumoniae R6
uaagaauagcgauuuaau

SEQ ID NO: 4105099 - RNA, 21 nt, Streptococcus pneumoniae R6
uaagaauagcgauuuaaucau

SEQ ID NO: 4105100 - RNA, 17 nt, Streptococcus pneumoniae R6
uaagaauaucaagauaa

SEQ ID NO: 4105101 - RNA, 19 nt, Streptococcus pneumoniae R6
uaagaaucccucuuuuuac

SEQ ID NO: 4105102 - RNA, 15 nt, Streptococcus pneumoniae R6
uaagacagaugacaa

SEQ ID NO: 4105103 - RNA, 19 nt, Streptococcus pneumoniae R6
uaagacagaugacaaaucu

SEQ ID NO: 4105104 - RNA, 17 nt, Streptococcus pneumoniae R6
uaagacugacgaaguca

SEQ ID NO: 4105105 - RNA, 19 nt, Streptococcus pneumoniae R6
uaagacugacgaagucagc

SEQ ID NO: 4105106 - RNA, 22 nt, Streptococcus pneumoniae R6
uaagacuuuuccuguuguauuu

SEQ ID NO: 4105107 - RNA, 14 nt, Streptococcus pneumoniae R6
uaagagaacuucac

SEQ ID NO: 4105108 - RNA, 15 nt, Streptococcus pneumoniae R6
uaagagaagagagca

SEQ ID NO: 4105109 - RNA, 17 nt, Streptococcus pneumoniae R6
uaagagaguuacggguu

SEQ ID NO: 4105110 - RNA, 23 nt, Streptococcus pneumoniae R6
uaagagaguuacggguuuuaaac

SEQ ID NO: 4105111 - RNA, 15 nt, Streptococcus pneumoniae R6
uaagaggauuuuaaa

SEQ ID NO: 4105112 - RNA, 11 nt, Streptococcus pneumoniae R6
uaagaguagua

SEQ ID NO: 4105113 - RNA, 16 nt, Streptococcus pneumoniae R6
uaagaguauaaaaccu

SEQ ID NO: 4105114 - RNA, 12 nt, Streptococcus pneumoniae R6
uaagaguugaaa

SEQ ID NO: 4105115 - RNA, 16 nt, Streptococcus pneumoniae R6
uaagauaaggcaucuu

SEQ ID NO: 4105116 - RNA, 16 nt, Streptococcus pneumoniae R6
uaagauaaguuccauc

SEQ ID NO: 4105117 - RNA, 17 nt, Streptococcus pneumoniae R6
uaagauaauagcgauga

SEQ ID NO: 4105118 - RNA, 20 nt, Streptococcus pneumoniae R6
uaagauagagagauuugaag

SEQ ID NO: 4105119 - RNA, 21 nt, Streptococcus pneumoniae R6
uaagauagagguuauucaaaa

SEQ ID NO: 4105120 - RNA, 19 nt, Streptococcus pneumoniae R6
uaagauagucgauaaaaag

SEQ ID NO: 4105121 - RNA, 15 nt, Streptococcus pneumoniae R6
uaagauauacuaaaa

SEQ ID NO: 4105122 - RNA, 21 nt, Streptococcus pneumoniae R6
uaagauaugaacaaaucgauu

SEQ ID NO: 4105123 - RNA, 20 nt, Streptococcus pneumoniae R6
uaagauauuauuucaaagaa

SEQ ID NO: 4105124 - RNA, 15 nt, Streptococcus pneumoniae R6
uaagaugaccuuauc

SEQ ID NO: 4105125 - RNA, 17 nt, Streptococcus pneumoniae R6
uaagaugaccuuaucua

SEQ ID NO: 4105126 - RNA, 15 nt, Streptococcus pneumoniae R6
uaagaugagaacaaa

SEQ ID NO: 4105127 - RNA, 15 nt, Streptococcus pneumoniae R6
uaagaugauuuuucu

SEQ ID NO: 4105128 - RNA, 20 nt, Streptococcus pneumoniae R6
uaagaugugaacaacucuau

SEQ ID NO: 4105129 - RNA, 12 nt, Streptococcus pneumoniae R6
uaagauuagaau

SEQ ID NO: 4105130 - RNA, 16 nt, Streptococcus pneumoniae R6
uaagauucuucugguu

SEQ ID NO: 4105131 - RNA, 23 nt, Streptococcus pneumoniae R6
uaagauuuaaaaucguagucuuu

SEQ ID NO: 4105132 - RNA, 13 nt, Streptococcus pneumoniae R6
uaagauuuguuuu

SEQ ID NO: 4105133 - RNA, 17 nt, Streptococcus pneumoniae R6
uaagauuuguuuuucaa

SEQ ID NO: 4105134 - RNA, 19 nt, Streptococcus pneumoniae R6
uaagcaaaguccuuacuca

SEQ ID NO: 4105135 - RNA, 20 nt, Streptococcus pneumoniae R6
uaagcaauucaauuuuauac

SEQ ID NO: 4105136 - RNA, 20 nt, Streptococcus pneumoniae R6
uaagcaauuuuuuauagaca

SEQ ID NO: 4105137 - RNA, 20 nt, Streptococcus pneumoniae R6
uaagcaccuaguacaaagaa

SEQ ID NO: 4105138 - RNA, 20 nt, Streptococcus pneumoniae R6
uaagcauaacuaaaaccuuc

SEQ ID NO: 4105139 - RNA, 17 nt, Streptococcus pneumoniae R6
uaagcaugauaugaagu

SEQ ID NO: 4105140 - RNA, 16 nt, Streptococcus pneumoniae R6
uaagcccaaaucauca

SEQ ID NO: 4105141 - RNA, 21 nt, Streptococcus pneumoniae R6
uaagcccgaaaaauuucucug

SEQ ID NO: 4105142 - RNA, 21 nt, Streptococcus pneumoniae R6
uaagccggcuugucuuugauu

SEQ ID NO: 4105143 - RNA, 14 nt, Streptococcus pneumoniae R6
uaagccucuuuauc

SEQ ID NO: 4105144 - RNA, 14 nt, Streptococcus pneumoniae R6
uaagccucuuucau

SEQ ID NO: 4105145 - RNA, 15 nt, Streptococcus pneumoniae R6
uaagccucuuucaua

SEQ ID NO: 4105146 - RNA, 15 nt, Streptococcus pneumoniae R6
uaagccuuuuugaau

SEQ ID NO: 4105147 - RNA, 16 nt, Streptococcus pneumoniae R6
uaagcgauuuuauagu

SEQ ID NO: 4105148 - RNA, 18 nt, Streptococcus pneumoniae R6
uaagcucgagaaaggaca

SEQ ID NO: 4105149 - RNA, 21 nt, Streptococcus pneumoniae R6
uaagcucgagaaaggacaaau

SEQ ID NO: 4105150 - RNA, 15 nt, Streptococcus pneumoniae R6
uaagcucuuaaaagc

SEQ ID NO: 4105151 - RNA, 15 nt, Streptococcus pneumoniae R6
uaagcugaucaauau

SEQ ID NO: 4105152 - RNA, 21 nt, Streptococcus pneumoniae R6
uaagcugaucaauauucuccg

SEQ ID NO: 4105153 - RNA, 16 nt, Streptococcus pneumoniae R6
uaagcuugugaaagcu

SEQ ID NO: 4105154 - RNA, 20 nt, Streptococcus pneumoniae R6
uaaggacacgcuucuuuaug

SEQ ID NO: 4105155 - RNA, 22 nt, Streptococcus pneumoniae R6
uaaggacaggugcuuaaauagg

SEQ ID NO: 4105156 - RNA, 14 nt, Streptococcus pneumoniae R6
uaaggacuuugcuu

SEQ ID NO: 4105157 - RNA, 13 nt, Streptococcus pneumoniae R6
uaaggagcgaauu

SEQ ID NO: 4105158 - RNA, 15 nt, Streptococcus pneumoniae R6
uaaggauagaucccc

SEQ ID NO: 4105159 - RNA, 21 nt, Streptococcus pneumoniae R6
uaaggauauucagaaaucuag

SEQ ID NO: 4105160 - RNA, 20 nt, Streptococcus pneumoniae R6
uaaggcagugacuaccaauc

SEQ ID NO: 4105161 - RNA, 22 nt, Streptococcus pneumoniae R6
uaaggcauucucgugaaauuuu

SEQ ID NO: 4105162 - RNA, 14 nt, Streptococcus pneumoniae R6
uaaggcucauuagu

SEQ ID NO: 4105163 - RNA, 19 nt, Streptococcus pneumoniae R6
uaagggaaaaguggucugg

SEQ ID NO: 4105164 - RNA, 16 nt, Streptococcus pneumoniae R6
uaagguaccuccuaau

SEQ ID NO: 4105165 - RNA, 22 nt, Streptococcus pneumoniae R6
uaagguaggagugaaaaacuag

SEQ ID NO: 4105166 - RNA, 16 nt, Streptococcus pneumoniae R6
uaagguauauucaaaa

SEQ ID NO: 4105167 - RNA, 15 nt, Streptococcus pneumoniae R6
uaagguucaaaaaau

SEQ ID NO: 4105168 - RNA, 12 nt, Streptococcus pneumoniae R6
uaagguugcaua

SEQ ID NO: 4105169 - RNA, 19 nt, Streptococcus pneumoniae R6
uaagguuucaaaacgagga

SEQ ID NO: 4105170 - RNA, 19 nt, Streptococcus pneumoniae R6
uaagguuuuaccuucaagu

SEQ ID NO: 4105171 - RNA, 23 nt, Streptococcus pneumoniae R6
uaagguuuuaccuucaaguuguu

SEQ ID NO: 4105172 - RNA, 15 nt, Streptococcus pneumoniae R6
uaaguagaaaguuaa

SEQ ID NO: 4105173 - RNA, 16 nt, Streptococcus pneumoniae R6
uaaguaguaaccaccu

SEQ ID NO: 4105174 - RNA, 20 nt, Streptococcus pneumoniae R6
uaagucaaauaagaaagacc

SEQ ID NO: 4105175 - RNA, 21 nt, Streptococcus pneumoniae R6
uaagucaaauaagaaagacca

SEQ ID NO: 4105176 - RNA, 15 nt, Streptococcus pneumoniae R6
uaagucaacaucucu

SEQ ID NO: 4105177 - RNA, 17 nt, Streptococcus pneumoniae R6
uaagucaagucuucuug

SEQ ID NO: 4105178 - RNA, 15 nt, Streptococcus pneumoniae R6
uaagucauaacauuc

SEQ ID NO: 4105179 - RNA, 16 nt, Streptococcus pneumoniae R6
uaagucauaacauucu

SEQ ID NO: 4105180 - RNA, 14 nt, Streptococcus pneumoniae R6
uaagucauuuucuu

SEQ ID NO: 4105181 - RNA, 17 nt, Streptococcus pneumoniae R6
uaagucauuuucuuuua

SEQ ID NO: 4105182 - RNA, 18 nt, Streptococcus pneumoniae R6
uaagucauuuucuuuuac

SEQ ID NO: 4105183 - RNA, 18 nt, Streptococcus pneumoniae R6
uaaguccuuuuaguuuua

SEQ ID NO: 4105184 - RNA, 20 nt, Streptococcus pneumoniae R6
uaagucuuugauuuugagac

SEQ ID NO: 4105185 - RNA, 21 nt, Streptococcus pneumoniae R6
uaagugaccuugaugaucuaa

SEQ ID NO: 4105186 - RNA, 13 nt, Streptococcus pneumoniae R6
uaagugauuuaaa

SEQ ID NO: 4105187 - RNA, 16 nt, Streptococcus pneumoniae R6
uaagugauuuaaaugu

SEQ ID NO: 4105188 - RNA, 21 nt, Streptococcus pneumoniae R6
uaagugcguugauaaucuuau

SEQ ID NO: 4105189 - RNA, 21 nt, Streptococcus pneumoniae R6
uaaguguugaccgacuauuuu

SEQ ID NO: 4105190 - RNA, 14 nt, Streptococcus pneumoniae R6
uaaguuagaauaag

SEQ ID NO: 4105191 - RNA, 22 nt, Streptococcus pneumoniae R6
uaaguucaacaaaucagaaaag

SEQ ID NO: 4105192 - RNA, 16 nt, Streptococcus pneumoniae R6
uaaguucacuugagca

SEQ ID NO: 4105193 - RNA, 13 nt, Streptococcus pneumoniae R6
uaaguucuuuuug

SEQ ID NO: 4105194 - RNA, 12 nt, Streptococcus pneumoniae R6
uaaguugauacu

SEQ ID NO: 4105195 - RNA, 23 nt, Streptococcus pneumoniae R6
uaaguuguaguacugaacaauga

SEQ ID NO: 4105196 - RNA, 19 nt, Streptococcus pneumoniae R6
uaaguuuauaucuaauaau

SEQ ID NO: 4105197 - RNA, 15 nt, Streptococcus pneumoniae R6
uaaguuucuucuuua

SEQ ID NO: 4105198 - RNA, 19 nt, Streptococcus pneumoniae R6
uaaguuuuguuugucaguu

SEQ ID NO: 4105199 - RNA, 20 nt, Streptococcus pneumoniae R6
uaauaaagacacuaagaaga

SEQ ID NO: 4105200 - RNA, 14 nt, Streptococcus pneumoniae R6
uaauaacucucauc

SEQ ID NO: 4105201 - RNA, 23 nt, Streptococcus pneumoniae R6
uaauaacucucaucuaucuauuu

SEQ ID NO: 4105202 - RNA, 17 nt, Streptococcus pneumoniae R6
uaauaagcuuugaaaau

SEQ ID NO: 4105203 - RNA, 13 nt, Streptococcus pneumoniae R6
uaauaauacaaaa

SEQ ID NO: 4105204 - RNA, 15 nt, Streptococcus pneumoniae R6
uaauaaucaauauag

SEQ ID NO: 4105205 - RNA, 23 nt, Streptococcus pneumoniae R6
uaauaaugaagacaucauauaaa

SEQ ID NO: 4105206 - RNA, 21 nt, Streptococcus pneumoniae R6
uaauaauugacgaagaaacca

SEQ ID NO: 4105207 - RNA, 13 nt, Streptococcus pneumoniae R6
uaauacaaaaaau

SEQ ID NO: 4105208 - RNA, 15 nt, Streptococcus pneumoniae R6
uaauacaaaaaauag

SEQ ID NO: 4105209 - RNA, 14 nt, Streptococcus pneumoniae R6
uaauacacuucuac

SEQ ID NO: 4105210 - RNA, 19 nt, Streptococcus pneumoniae R6
uaauacacuucuacuauac

SEQ ID NO: 4105211 - RNA, 18 nt, Streptococcus pneumoniae R6
uaauacaugcaaguagaa

SEQ ID NO: 4105212 - RNA, 17 nt, Streptococcus pneumoniae R6
uaauaccuaccagagga

SEQ ID NO: 4105213 - RNA, 21 nt, Streptococcus pneumoniae R6
uaauacgaccaaucuuuucca

SEQ ID NO: 4105214 - RNA, 18 nt, Streptococcus pneumoniae R6
uaauacucaaugaaaauc

SEQ ID NO: 4105215 - RNA, 20 nt, Streptococcus pneumoniae R6
uaauacucaaugaaaaucaa

SEQ ID NO: 4105216 - RNA, 11 nt, Streptococcus pneumoniae R6
uaauagaaaac

SEQ ID NO: 4105217 - RNA, 14 nt, Streptococcus pneumoniae R6
uaauagaaaacaga

SEQ ID NO: 4105218 - RNA, 17 nt, Streptococcus pneumoniae R6
uaauagaaaacagacaa

SEQ ID NO: 4105219 - RNA, 19 nt, Streptococcus pneumoniae R6
uaauagaaaacagacaaaa

SEQ ID NO: 4105220 - RNA, 22 nt, Streptococcus pneumoniae R6
uaauagaaauuuugaaauaauc

SEQ ID NO: 4105221 - RNA, 19 nt, Streptococcus pneumoniae R6
uaauagagcugaggaaauu

SEQ ID NO: 4105222 - RNA, 21 nt, Streptococcus pneumoniae R6
uaauagauauaauuguaaaca

SEQ ID NO: 4105223 - RNA, 14 nt, Streptococcus pneumoniae R6
uaauagcacuuaaa

SEQ ID NO: 4105224 - RNA, 19 nt, Streptococcus pneumoniae R6
uaauagcagaaaaaugaca

SEQ ID NO: 4105225 - RNA, 21 nt, Streptococcus pneumoniae R6
uaauagccuuuggauauuuug

SEQ ID NO: 4105226 - RNA, 16 nt, Streptococcus pneumoniae R6
uaauagcgauagaugu

SEQ ID NO: 4105227 - RNA, 15 nt, Streptococcus pneumoniae R6
uaauagcugauuuuu

SEQ ID NO: 4105228 - RNA, 19 nt, Streptococcus pneumoniae R6
uaauagcuugcaauucuuu

SEQ ID NO: 4105229 - RNA, 19 nt, Streptococcus pneumoniae R6
uaauagugggaauuuguaa

SEQ ID NO: 4105230 - RNA, 13 nt, Streptococcus pneumoniae R6
uaauauaauaucu

SEQ ID NO: 4105231 - RNA, 14 nt, Streptococcus pneumoniae R6
uaauauaauaucuc

SEQ ID NO: 4105232 - RNA, 16 nt, Streptococcus pneumoniae R6
uaauauauaaaaaaua

SEQ ID NO: 4105233 - RNA, 19 nt, Streptococcus pneumoniae R6
uaauauauaaaaaauauag

SEQ ID NO: 4105234 - RNA, 17 nt, Streptococcus pneumoniae R6
uaauauauaaaauuucu

SEQ ID NO: 4105235 - RNA, 13 nt, Streptococcus pneumoniae R6
uaauaucaaggau

SEQ ID NO: 4105236 - RNA, 23 nt, Streptococcus pneumoniae R6
uaauaucagauauucuaaaaccu

SEQ ID NO: 4105237 - RNA, 14 nt, Streptococcus pneumoniae R6
uaauaucagccaga

SEQ ID NO: 4105238 - RNA, 20 nt, Streptococcus pneumoniae R6
uaauaucagccagagcacca

SEQ ID NO: 4105239 - RNA, 21 nt, Streptococcus pneumoniae R6
uaauaucagccagagcaccaa

SEQ ID NO: 4105240 - RNA, 20 nt, Streptococcus pneumoniae R6
uaauaucaggugugaaaacu

SEQ ID NO: 4105241 - RNA, 15 nt, Streptococcus pneumoniae R6
uaauaucauaaugag

SEQ ID NO: 4105242 - RNA, 15 nt, Streptococcus pneumoniae R6
uaauauccgauagca

SEQ ID NO: 4105243 - RNA, 12 nt, Streptococcus pneumoniae R6
uaauauuuucuu

SEQ ID NO: 4105244 - RNA, 13 nt, Streptococcus pneumoniae R6
uaaucaaaaggac

SEQ ID NO: 4105245 - RNA, 20 nt, Streptococcus pneumoniae R6
uaaucaaaauauguuuucuu

SEQ ID NO: 4105246 - RNA, 22 nt, Streptococcus pneumoniae R6
uaaucaaaauauguuuucuuug

SEQ ID NO: 4105247 - RNA, 21 nt, Streptococcus pneumoniae R6
uaaucaaacuagcaagugcua

SEQ ID NO: 4105248 - RNA, 18 nt, Streptococcus pneumoniae R6
uaaucaaucguuucaagu

SEQ ID NO: 4105249 - RNA, 19 nt, Streptococcus pneumoniae R6
uaaucaauuaucauuucca

SEQ ID NO: 4105250 - RNA, 15 nt, Streptococcus pneumoniae R6
uaaucauaagcaacu

SEQ ID NO: 4105251 - RNA, 13 nt, Streptococcus pneumoniae R6
uaaucaucucauc

SEQ ID NO: 4105252 - RNA, 13 nt, Streptococcus pneumoniae R6
uaaucaucuggau

SEQ ID NO: 4105253 - RNA, 14 nt, Streptococcus pneumoniae R6
uaaucauguuuuua

SEQ ID NO: 4105254 - RNA, 17 nt, Streptococcus pneumoniae R6
uaaucauuaaaauaacu

SEQ ID NO: 4105255 - RNA, 19 nt, Streptococcus pneumoniae R6
uaaucauuaaaauaacuca

SEQ ID NO: 4105256 - RNA, 15 nt, Streptococcus pneumoniae R6
uaaucauuuaauaau

SEQ ID NO: 4105257 - RNA, 16 nt, Streptococcus pneumoniae R6
uaaucauuuaauaaug

SEQ ID NO: 4105258 - RNA, 18 nt, Streptococcus pneumoniae R6
uaaucauuuaauaaugaa

SEQ ID NO: 4105259 - RNA, 20 nt, Streptococcus pneumoniae R6
uaaucauuuaauaaugaaga

SEQ ID NO: 4105260 - RNA, 19 nt, Streptococcus pneumoniae R6
uaauccaaaguaaaauaca

SEQ ID NO: 4105261 - RNA, 22 nt, Streptococcus pneumoniae R6
uaauccaauugaggaaguacca

SEQ ID NO: 4105262 - RNA, 20 nt, Streptococcus pneumoniae R6
uaauccauggaauaccaaua

SEQ ID NO: 4105263 - RNA, 19 nt, Streptococcus pneumoniae R6
uaaucccaaucauggcugg

SEQ ID NO: 4105264 - RNA, 23 nt, Streptococcus pneumoniae R6
uaauccccauuugcuucaucauu

SEQ ID NO: 4105265 - RNA, 15 nt, Streptococcus pneumoniae R6
uaaucccucagagua

SEQ ID NO: 4105266 - RNA, 16 nt, Streptococcus pneumoniae R6
uaaucgacaagauacc

SEQ ID NO: 4105267 - RNA, 22 nt, Streptococcus pneumoniae R6
uaaucgcaagguagagacagaa

SEQ ID NO: 4105268 - RNA, 20 nt, Streptococcus pneumoniae R6
uaaucgcuggcauuucccau

SEQ ID NO: 4105269 - RNA, 16 nt, Streptococcus pneumoniae R6
uaaucgguaggaugac

SEQ ID NO: 4105270 - RNA, 16 nt, Streptococcus pneumoniae R6
uaaucguuuaaaacac

SEQ ID NO: 4105271 - RNA, 20 nt, Streptococcus pneumoniae R6
uaaucguuuaaaacaccuuc

SEQ ID NO: 4105272 - RNA, 19 nt, Streptococcus pneumoniae R6
uaaucuacgcuuuaaaaau

SEQ ID NO: 4105273 - RNA, 14 nt, Streptococcus pneumoniae R6
uaaucuauacauuu

SEQ ID NO: 4105274 - RNA, 13 nt, Streptococcus pneumoniae R6
uaaucucaaaaca

SEQ ID NO: 4105275 - RNA, 17 nt, Streptococcus pneumoniae R6
uaaucucuagccccucu

SEQ ID NO: 4105276 - RNA, 19 nt, Streptococcus pneumoniae R6
uaaucucuccuuaucaaaa

SEQ ID NO: 4105277 - RNA, 19 nt, Streptococcus pneumoniae R6
uaaucugaauguuucccuu

SEQ ID NO: 4105278 - RNA, 22 nt, Streptococcus pneumoniae R6
uaaucuggucuuaagacaccug

SEQ ID NO: 4105279 - RNA, 16 nt, Streptococcus pneumoniae R6
uaaucuuaaaguuauu

SEQ ID NO: 4105280 - RNA, 12 nt, Streptococcus pneumoniae R6
uaaucuuaucuc

SEQ ID NO: 4105281 - RNA, 23 nt, Streptococcus pneumoniae R6
uaaucuucaaauuuuucauaauu

SEQ ID NO: 4105282 - RNA, 20 nt, Streptococcus pneumoniae R6
uaaucuugacuauauuucuu

SEQ ID NO: 4105283 - RNA, 17 nt, Streptococcus pneumoniae R6
uaaucuuggucaacaua

SEQ ID NO: 4105284 - RNA, 18 nt, Streptococcus pneumoniae R6
uaaugacagugauuaaaa

SEQ ID NO: 4105285 - RNA, 21 nt, Streptococcus pneumoniae R6
uaaugacuuguguuuuuccuu

SEQ ID NO: 4105286 - RNA, 22 nt, Streptococcus pneumoniae R6
uaaugagguugcugucguaguc

SEQ ID NO: 4105287 - RNA, 12 nt, Streptococcus pneumoniae R6
uaaugauauggu

SEQ ID NO: 4105288 - RNA, 14 nt, Streptococcus pneumoniae R6
uaaugcaguaaauc

SEQ ID NO: 4105289 - RNA, 21 nt, Streptococcus pneumoniae R6
uaaugccaaagaaauuauucu

SEQ ID NO: 4105290 - RNA, 18 nt, Streptococcus pneumoniae R6
uaaugccgugauuuccaa

SEQ ID NO: 4105291 - RNA, 14 nt, Streptococcus pneumoniae R6
uaaugcuuuccauu

SEQ ID NO: 4105292 - RNA, 19 nt, Streptococcus pneumoniae R6
uaauggauugaaauaagau

SEQ ID NO: 4105293 - RNA, 16 nt, Streptococcus pneumoniae R6
uaauggcuguguagau

SEQ ID NO: 4105294 - RNA, 16 nt, Streptococcus pneumoniae R6
uaauggcuuguuccaa

SEQ ID NO: 4105295 - RNA, 16 nt, Streptococcus pneumoniae R6
uaaugggccaaaucau

SEQ ID NO: 4105296 - RNA, 20 nt, Streptococcus pneumoniae R6
uaaugggccaaaucaucaua

SEQ ID NO: 4105297 - RNA, 18 nt, Streptococcus pneumoniae R6
uaauggguguuuauaggc

SEQ ID NO: 4105298 - RNA, 15 nt, Streptococcus pneumoniae R6
uaaugguaucacauu

SEQ ID NO: 4105299 - RNA, 15 nt, Streptococcus pneumoniae R6
uaaugguuauaucug

SEQ ID NO: 4105300 - RNA, 14 nt, Streptococcus pneumoniae R6
uaaugguugggaag

SEQ ID NO: 4105301 - RNA, 23 nt, Streptococcus pneumoniae R6
uaauguaaggugcaaaaaccuug

SEQ ID NO: 4105302 - RNA, 13 nt, Streptococcus pneumoniae R6
uaaugucuaguaa

SEQ ID NO: 4105303 - RNA, 18 nt, Streptococcus pneumoniae R6
uaauguuaaccacaaaaa

SEQ ID NO: 4105304 - RNA, 22 nt, Streptococcus pneumoniae R6
uaauguucuucggcuuccuuaa

SEQ ID NO: 4105305 - RNA, 19 nt, Streptococcus pneumoniae R6
uaauguuuucccuuugaua

SEQ ID NO: 4105306 - RNA, 23 nt, Streptococcus pneumoniae R6
uaauuaaaaguuuccccugccaa

SEQ ID NO: 4105307 - RNA, 13 nt, Streptococcus pneumoniae R6
uaauuaaaaugug

SEQ ID NO: 4105308 - RNA, 16 nt, Streptococcus pneumoniae R6
uaauuaaaucauccau

SEQ ID NO: 4105309 - RNA, 19 nt, Streptococcus pneumoniae R6
uaauuaacugguuaauuaa

SEQ ID NO: 4105310 - RNA, 14 nt, Streptococcus pneumoniae R6
uaauuagaaaaaaa

SEQ ID NO: 4105311 - RNA, 18 nt, Streptococcus pneumoniae R6
uaauuagaaaaaaauuuu

SEQ ID NO: 4105312 - RNA, 15 nt, Streptococcus pneumoniae R6
uaauuaguucagaau

SEQ ID NO: 4105313 - RNA, 21 nt, Streptococcus pneumoniae R6
uaauuaguucagaauuuucuu

SEQ ID NO: 4105314 - RNA, 22 nt, Streptococcus pneumoniae R6
uaauuauaggacguuuucagau

SEQ ID NO: 4105315 - RNA, 20 nt, Streptococcus pneumoniae R6
uaauuauauauaaaaagcua

SEQ ID NO: 4105316 - RNA, 21 nt, Streptococcus pneumoniae R6
uaauuaugaaauuuaaaaaga

SEQ ID NO: 4105317 - RNA, 22 nt, Streptococcus pneumoniae R6
uaauuaugaaauuuaaaaagaa

SEQ ID NO: 4105318 - RNA, 19 nt, Streptococcus pneumoniae R6
uaauucaauuaaguuuuac

SEQ ID NO: 4105319 - RNA, 21 nt, Streptococcus pneumoniae R6
uaauucaccuaaccaaauaau

SEQ ID NO: 4105320 - RNA, 21 nt, Streptococcus pneumoniae R6
uaauucaccuauuaacaauaa

SEQ ID NO: 4105321 - RNA, 13 nt, Streptococcus pneumoniae R6
uaauucauaugga

SEQ ID NO: 4105322 - RNA, 14 nt, Streptococcus pneumoniae R6
uaauuccacacaga

SEQ ID NO: 4105323 - RNA, 15 nt, Streptococcus pneumoniae R6
uaauuccacacagaa

SEQ ID NO: 4105324 - RNA, 17 nt, Streptococcus pneumoniae R6
uaauuccccaucuucaa

SEQ ID NO: 4105325 - RNA, 14 nt, Streptococcus pneumoniae R6
uaauucuaaaucuu

SEQ ID NO: 4105326 - RNA, 19 nt, Streptococcus pneumoniae R6
uaauucuaacaccuuuauu

SEQ ID NO: 4105327 - RNA, 14 nt, Streptococcus pneumoniae R6
uaauucucuaaaua

SEQ ID NO: 4105328 - RNA, 16 nt, Streptococcus pneumoniae R6
uaauucucuaaauaag

SEQ ID NO: 4105329 - RNA, 14 nt, Streptococcus pneumoniae R6
uaauucuucauaga

SEQ ID NO: 4105330 - RNA, 21 nt, Streptococcus pneumoniae R6
uaauugaaaacgguaacaaaa

SEQ ID NO: 4105331 - RNA, 14 nt, Streptococcus pneumoniae R6
uaauugaauuucaa

SEQ ID NO: 4105332 - RNA, 19 nt, Streptococcus pneumoniae R6
uaauugacgaagaaaccaa

SEQ ID NO: 4105333 - RNA, 19 nt, Streptococcus pneumoniae R6
uaauuggaaaauaaaucca

SEQ ID NO: 4105334 - RNA, 15 nt, Streptococcus pneumoniae R6
uaauugguacauuuu

SEQ ID NO: 4105335 - RNA, 18 nt, Streptococcus pneumoniae R6
uaauuguaaacaaaaauc

SEQ ID NO: 4105336 - RNA, 15 nt, Streptococcus pneumoniae R6
uaauugugacucuuu

SEQ ID NO: 4105337 - RNA, 17 nt, Streptococcus pneumoniae R6
uaauuguuccauaugau

SEQ ID NO: 4105338 - RNA, 17 nt, Streptococcus pneumoniae R6
uaauuuaagaguaguau

SEQ ID NO: 4105339 - RNA, 22 nt, Streptococcus pneumoniae R6
uaauuuagagaaugaaauauag

SEQ ID NO: 4105340 - RNA, 12 nt, Streptococcus pneumoniae R6
uaauuuauagaa

SEQ ID NO: 4105341 - RNA, 14 nt, Streptococcus pneumoniae R6
uaauuuauccaaag

SEQ ID NO: 4105342 - RNA, 13 nt, Streptococcus pneumoniae R6
uaauuucaaaauc

SEQ ID NO: 4105343 - RNA, 15 nt, Streptococcus pneumoniae R6
uaauuucaaaaucuu

SEQ ID NO: 4105344 - RNA, 16 nt, Streptococcus pneumoniae R6
uaauuucaaaaucuuc

SEQ ID NO: 4105345 - RNA, 18 nt, Streptococcus pneumoniae R6
uaauuucgcuguuaaagc

SEQ ID NO: 4105346 - RNA, 20 nt, Streptococcus pneumoniae R6
uaauuucgcuguuaaagcca

SEQ ID NO: 4105347 - RNA, 19 nt, Streptococcus pneumoniae R6
uaauuucuacuguauacuu

SEQ ID NO: 4105348 - RNA, 14 nt, Streptococcus pneumoniae R6
uaauuucuagaaau

SEQ ID NO: 4105349 - RNA, 13 nt, Streptococcus pneumoniae R6
uaauuucugaaau

SEQ ID NO: 4105350 - RNA, 15 nt, Streptococcus pneumoniae R6
uaauuucugaaauca

SEQ ID NO: 4105351 - RNA, 16 nt, Streptococcus pneumoniae R6
uaauuucugaaaucaa

SEQ ID NO: 4105352 - RNA, 22 nt, Streptococcus pneumoniae R6
uaauuucuuuuuguguuaaauc

SEQ ID NO: 4105353 - RNA, 24 nt, Streptococcus pneumoniae R6
uaauuucuuuuuguguuaaaucau

SEQ ID NO: 4105354 - RNA, 14 nt, Streptococcus pneumoniae R6
uaauuuggaaauaa

SEQ ID NO: 4105355 - RNA, 20 nt, Streptococcus pneumoniae R6
uaauuuuacuuuccugauag

SEQ ID NO: 4105356 - RNA, 13 nt, Streptococcus pneumoniae R6
uaauuuuccuuaa

SEQ ID NO: 4105357 - RNA, 17 nt, Streptococcus pneumoniae R6
uaauuuucgauaaagua

SEQ ID NO: 4105358 - RNA, 21 nt, Streptococcus pneumoniae R6
uaauuuucuggcagauagaga

SEQ ID NO: 4105359 - RNA, 21 nt, Streptococcus pneumoniae R6
uaauuuucuuuuugaguuuug

SEQ ID NO: 4105360 - RNA, 22 nt, Streptococcus pneumoniae R6
uaauuuugauucagauucauca

SEQ ID NO: 4105361 - RNA, 20 nt, Streptococcus pneumoniae R6
uaauuuugugauaaaaugua

SEQ ID NO: 4105362 - RNA, 18 nt, Streptococcus pneumoniae R6
uaauuuuuuucauagaaa

SEQ ID NO: 4105363 - RNA, 22 nt, Streptococcus pneumoniae R6
uaauuuuuuucauagaaaucaa

SEQ ID NO: 4105364 - RNA, 16 nt, Streptococcus pneumoniae R6
uacaaaaacaaagaga

SEQ ID NO: 4105365 - RNA, 12 nt, Streptococcus pneumoniae R6
uacaaaaccaaa

SEQ ID NO: 4105366 - RNA, 22 nt, Streptococcus pneumoniae R6
uacaaaagcacucaauauuaug

SEQ ID NO: 4105367 - RNA, 14 nt, Streptococcus pneumoniae R6
uacaaaccuuguac

SEQ ID NO: 4105368 - RNA, 16 nt, Streptococcus pneumoniae R6
uacaaaccuuguacua

SEQ ID NO: 4105369 - RNA, 22 nt, Streptococcus pneumoniae R6
uacaaacucucauuaaaacgga

SEQ ID NO: 4105370 - RNA, 22 nt, Streptococcus pneumoniae R6
uacaaagaauaaaauaguuagg

SEQ ID NO: 4105371 - RNA, 22 nt, Streptococcus pneumoniae R6
uacaaagcccauacgcccucca

SEQ ID NO: 4105372 - RNA, 22 nt, Streptococcus pneumoniae R6
uacaaaguauuuuuucuuccca

SEQ ID NO: 4105373 - RNA, 14 nt, Streptococcus pneumoniae R6
uacaaaguuaagua

SEQ ID NO: 4105374 - RNA, 22 nt, Streptococcus pneumoniae R6
uacaaaguuccacccauggcaa

SEQ ID NO: 4105375 - RNA, 13 nt, Streptococcus pneumoniae R6
uacaaauaagaaa

SEQ ID NO: 4105376 - RNA, 20 nt, Streptococcus pneumoniae R6
uacaaauaccauaaacuaag

SEQ ID NO: 4105377 - RNA, 13 nt, Streptococcus pneumoniae R6
uacaaaucccaug

SEQ ID NO: 4105378 - RNA, 11 nt, Streptococcus pneumoniae R6
uacaaauuaau

SEQ ID NO: 4105379 - RNA, 17 nt, Streptococcus pneumoniae R6
uacaacaauaagagaau

SEQ ID NO: 4105380 - RNA, 19 nt, Streptococcus pneumoniae R6
uacaacaggaaaagucuua

SEQ ID NO: 4105381 - RNA, 16 nt, Streptococcus pneumoniae R6
uacaaccuuaaaacag

SEQ ID NO: 4105382 - RNA, 15 nt, Streptococcus pneumoniae R6
uacaacgucuuuugc

SEQ ID NO: 4105383 - RNA, 18 nt, Streptococcus pneumoniae R6
uacaacgucuuuugccuu

SEQ ID NO: 4105384 - RNA, 17 nt, Streptococcus pneumoniae R6
uacaacuuuaaccaauu

SEQ ID NO: 4105385 - RNA, 20 nt, Streptococcus pneumoniae R6
uacaacuuuaaccaauuguu

SEQ ID NO: 4105386 - RNA, 19 nt, Streptococcus pneumoniae R6
uacaagaaaagugcaaaua

SEQ ID NO: 4105387 - RNA, 16 nt, Streptococcus pneumoniae R6
uacaagaacagucucu

SEQ ID NO: 4105388 - RNA, 21 nt, Streptococcus pneumoniae R6
uacaagacagguuuugaagca

SEQ ID NO: 4105389 - RNA, 18 nt, Streptococcus pneumoniae R6
uacaagcugccaaagcau

SEQ ID NO: 4105390 - RNA, 22 nt, Streptococcus pneumoniae R6
uacaaguaucuacuuugaaauu

SEQ ID NO: 4105391 - RNA, 20 nt, Streptococcus pneumoniae R6
uacaagucuugccuucaacc

SEQ ID NO: 4105392 - RNA, 21 nt, Streptococcus pneumoniae R6
uacaaguguuuucacuuccuu

SEQ ID NO: 4105393 - RNA, 23 nt, Streptococcus pneumoniae R6
uacaaguguuuucacuuccuuac

SEQ ID NO: 4105394 - RNA, 14 nt, Streptococcus pneumoniae R6
uacaauaacacccu

SEQ ID NO: 4105395 - RNA, 23 nt, Streptococcus pneumoniae R6
uacaauaacacccuuguaaauaa

SEQ ID NO: 4105396 - RNA, 22 nt, Streptococcus pneumoniae R6
uacaauaauugguacauuuuga

SEQ ID NO: 4105397 - RNA, 17 nt, Streptococcus pneumoniae R6
uacaauauauccaaaac

SEQ ID NO: 4105398 - RNA, 18 nt, Streptococcus pneumoniae R6
uacaauccugcgaaaucu

SEQ ID NO: 4105399 - RNA, 20 nt, Streptococcus pneumoniae R6
uacaaugucuaaaucuuuaa

SEQ ID NO: 4105400 - RNA, 22 nt, Streptococcus pneumoniae R6
uacaauguugucaauuuccauu

SEQ ID NO: 4105401 - RNA, 15 nt, Streptococcus pneumoniae R6
uacaauuggaaauaa

SEQ ID NO: 4105402 - RNA, 18 nt, Streptococcus pneumoniae R6
uacaauuggaaauaacaa

SEQ ID NO: 4105403 - RNA, 16 nt, Streptococcus pneumoniae R6
uacaauuguaaaaaga

SEQ ID NO: 4105404 - RNA, 18 nt, Streptococcus pneumoniae R6
uacacaagauccaauccu

SEQ ID NO: 4105405 - RNA, 16 nt, Streptococcus pneumoniae R6
uacacaucuacuucua

SEQ ID NO: 4105406 - RNA, 17 nt, Streptococcus pneumoniae R6
uacacaucuacuucuaa

SEQ ID NO: 4105407 - RNA, 16 nt, Streptococcus pneumoniae R6
uacaccauaaauauuu

SEQ ID NO: 4105408 - RNA, 14 nt, Streptococcus pneumoniae R6
uacaccaucccuua

SEQ ID NO: 4105409 - RNA, 12 nt, Streptococcus pneumoniae R6
uacacuggaugu

SEQ ID NO: 4105410 - RNA, 16 nt, Streptococcus pneumoniae R6
uacacuuaaauucaua

SEQ ID NO: 4105411 - RNA, 20 nt, Streptococcus pneumoniae R6
uacacuucugcuucuaaaac

SEQ ID NO: 4105412 - RNA, 16 nt, Streptococcus pneumoniae R6
uacacuugauuuaucc

SEQ ID NO: 4105413 - RNA, 16 nt, Streptococcus pneumoniae R6
uacagaacuaaaucuu

SEQ ID NO: 4105414 - RNA, 14 nt, Streptococcus pneumoniae R6
uacagaagaaaaac

SEQ ID NO: 4105415 - RNA, 18 nt, Streptococcus pneumoniae R6
uacagaagacuaggcuug

SEQ ID NO: 4105416 - RNA, 20 nt, Streptococcus pneumoniae R6
uacagaagcuuuaccauccu

SEQ ID NO: 4105417 - RNA, 20 nt, Streptococcus pneumoniae R6
uacagaaucccagauaaagc

SEQ ID NO: 4105418 - RNA, 20 nt, Streptococcus pneumoniae R6
uacagaaucuucauauacac

SEQ ID NO: 4105419 - RNA, 16 nt, Streptococcus pneumoniae R6
uacagauaaaaccugc

SEQ ID NO: 4105420 - RNA, 14 nt, Streptococcus pneumoniae R6
uacagauuugaaaa

SEQ ID NO: 4105421 - RNA, 13 nt, Streptococcus pneumoniae R6
uacagcaaaaaau

SEQ ID NO: 4105422 - RNA, 24 nt, Streptococcus pneumoniae R6
uacagcuagcuagaguuucaauug

SEQ ID NO: 4105423 - RNA, 17 nt, Streptococcus pneumoniae R6
uacaggcaugggcaggg

SEQ ID NO: 4105424 - RNA, 19 nt, Streptococcus pneumoniae R6
uacaggcaugggcaggguc

SEQ ID NO: 4105425 - RNA, 14 nt, Streptococcus pneumoniae R6
uacaguauuuauaa

SEQ ID NO: 4105426 - RNA, 18 nt, Streptococcus pneumoniae R6
uacaguauuuauaaacuu

SEQ ID NO: 4105427 - RNA, 13 nt, Streptococcus pneumoniae R6
uacaguccucccu

SEQ ID NO: 4105428 - RNA, 16 nt, Streptococcus pneumoniae R6
uacagugaaggcuuua

SEQ ID NO: 4105429 - RNA, 13 nt, Streptococcus pneumoniae R6
uacaguuagcaug

SEQ ID NO: 4105430 - RNA, 14 nt, Streptococcus pneumoniae R6
uacaguuauuuuag

SEQ ID NO: 4105431 - RNA, 22 nt, Streptococcus pneumoniae R6
uacaguuauuuuaguaaaaaaa

SEQ ID NO: 4105432 - RNA, 16 nt, Streptococcus pneumoniae R6
uacaguugacaaagag

SEQ ID NO: 4105433 - RNA, 21 nt, Streptococcus pneumoniae R6
uacaguugguccguguaaaac

SEQ ID NO: 4105434 - RNA, 18 nt, Streptococcus pneumoniae R6
uacauacccaugcuuuuc

SEQ ID NO: 4105435 - RNA, 18 nt, Streptococcus pneumoniae R6
uacauagacuucccagcc

SEQ ID NO: 4105436 - RNA, 20 nt, Streptococcus pneumoniae R6
uacauaucuagguaaaaauu

SEQ ID NO: 4105437 - RNA, 17 nt, Streptococcus pneumoniae R6
uacauauguaagaagau

SEQ ID NO: 4105438 - RNA, 18 nt, Streptococcus pneumoniae R6
uacaucaaaaucacagac

SEQ ID NO: 4105439 - RNA, 17 nt, Streptococcus pneumoniae R6
uacaucaagcucaucua

SEQ ID NO: 4105440 - RNA, 14 nt, Streptococcus pneumoniae R6
uacaucauugucaa

SEQ ID NO: 4105441 - RNA, 15 nt, Streptococcus pneumoniae R6
uacaucauugucaaa

SEQ ID NO: 4105442 - RNA, 20 nt, Streptococcus pneumoniae R6
uacaucauugucaaacaaga

SEQ ID NO: 4105443 - RNA, 19 nt, Streptococcus pneumoniae R6
uacauccaccagcuauuaa

SEQ ID NO: 4105444 - RNA, 14 nt, Streptococcus pneumoniae R6
uacaucuaucucac

SEQ ID NO: 4105445 - RNA, 22 nt, Streptococcus pneumoniae R6
uacaugcaaaguaaaguaagga

SEQ ID NO: 4105446 - RNA, 15 nt, Streptococcus pneumoniae R6
uacaugcgcaaaaua

SEQ ID NO: 4105447 - RNA, 16 nt, Streptococcus pneumoniae R6
uacaugcgcaaaauaa

SEQ ID NO: 4105448 - RNA, 17 nt, Streptococcus pneumoniae R6
uacaugcgcaaaauaau

SEQ ID NO: 4105449 - RNA, 19 nt, Streptococcus pneumoniae R6
uacaugcgcaaaauaauuu

SEQ ID NO: 4105450 - RNA, 17 nt, Streptococcus pneumoniae R6
uacauucccaaacaaaa

SEQ ID NO: 4105451 - RNA, 19 nt, Streptococcus pneumoniae R6
uacauucuuuuuaaggagu

SEQ ID NO: 4105452 - RNA, 21 nt, Streptococcus pneumoniae R6
uacauuuagaaagguaaaaua

SEQ ID NO: 4105453 - RNA, 18 nt, Streptococcus pneumoniae R6
uacauuugaguuucucuu

SEQ ID NO: 4105454 - RNA, 17 nt, Streptococcus pneumoniae R6
uacauuuuuugaaauaa

SEQ ID NO: 4105455 - RNA, 18 nt, Streptococcus pneumoniae R6
uacauuuuuugaaauaag

SEQ ID NO: 4105456 - RNA, 13 nt, Streptococcus pneumoniae R6
uaccaaagaaguc

SEQ ID NO: 4105457 - RNA, 17 nt, Streptococcus pneumoniae R6
uaccaacgcccucacac

SEQ ID NO: 4105458 - RNA, 22 nt, Streptococcus pneumoniae R6
uaccaacuacuaaaccaauaau

SEQ ID NO: 4105459 - RNA, 16 nt, Streptococcus pneumoniae R6
uaccaagcccucagcc

SEQ ID NO: 4105460 - RNA, 23 nt, Streptococcus pneumoniae R6
uaccaaggauugucugaacugcc

SEQ ID NO: 4105461 - RNA, 21 nt, Streptococcus pneumoniae R6
uaccaaggcaucacgaaaaua

SEQ ID NO: 4105462 - RNA, 24 nt, Streptococcus pneumoniae R6
uaccaaugcggaccaaauccccau

SEQ ID NO: 4105463 - RNA, 20 nt, Streptococcus pneumoniae R6
uaccaauuuuuccuuuuccg

SEQ ID NO: 4105464 - RNA, 13 nt, Streptococcus pneumoniae R6
uaccacaggagcu

SEQ ID NO: 4105465 - RNA, 20 nt, Streptococcus pneumoniae R6
uaccaccaacaugucgcugc

SEQ ID NO: 4105466 - RNA, 15 nt, Streptococcus pneumoniae R6
uaccaccaaguacag

SEQ ID NO: 4105467 - RNA, 19 nt, Streptococcus pneumoniae R6
uaccacggcagacagagaa

SEQ ID NO: 4105468 - RNA, 20 nt, Streptococcus pneumoniae R6
uaccacuagugaauuugguu

SEQ ID NO: 4105469 - RNA, 19 nt, Streptococcus pneumoniae R6
uaccagcaaucaaauucau

SEQ ID NO: 4105470 - RNA, 20 nt, Streptococcus pneumoniae R6
uaccagguaauccagaaaug

SEQ ID NO: 4105471 - RNA, 23 nt, Streptococcus pneumoniae R6
uaccauccugaauagugaagaua

SEQ ID NO: 4105472 - RNA, 18 nt, Streptococcus pneumoniae R6
uaccaucuuuaggaucau

SEQ ID NO: 4105473 - RNA, 13 nt, Streptococcus pneumoniae R6
uaccauucuucau

SEQ ID NO: 4105474 - RNA, 22 nt, Streptococcus pneumoniae R6
uaccauuuucguccaagucaac

SEQ ID NO: 4105475 - RNA, 15 nt, Streptococcus pneumoniae R6
uacccaaaacacaaa

SEQ ID NO: 4105476 - RNA, 20 nt, Streptococcus pneumoniae R6
uacccaaaacacaaaaaguc

SEQ ID NO: 4105477 - RNA, 23 nt, Streptococcus pneumoniae R6
uacccaaaacacaaaaaguccuc

SEQ ID NO: 4105478 - RNA, 18 nt, Streptococcus pneumoniae R6
uacccaaguaaucugcac

SEQ ID NO: 4105479 - RNA, 14 nt, Streptococcus pneumoniae R6
uacccacugugcuu

SEQ ID NO: 4105480 - RNA, 21 nt, Streptococcus pneumoniae R6
uacccauagauuuuuauuauu

SEQ ID NO: 4105481 - RNA, 18 nt, Streptococcus pneumoniae R6
uacccaugcuuuucuauu

SEQ ID NO: 4105482 - RNA, 13 nt, Streptococcus pneumoniae R6
uacccucuaucaa

SEQ ID NO: 4105483 - RNA, 15 nt, Streptococcus pneumoniae R6
uaccgaaaaauuaag

SEQ ID NO: 4105484 - RNA, 19 nt, Streptococcus pneumoniae R6
uaccgaccuugucucccca

SEQ ID NO: 4105485 - RNA, 21 nt, Streptococcus pneumoniae R6
uaccgaugauguucauaacuu

SEQ ID NO: 4105486 - RNA, 22 nt, Streptococcus pneumoniae R6
uaccgauggacuuuaucaccuc

SEQ ID NO: 4105487 - RNA, 17 nt, Streptococcus pneumoniae R6
uaccgcacuuaugaaga

SEQ ID NO: 4105488 - RNA, 16 nt, Streptococcus pneumoniae R6
uaccggagaaauauug

SEQ ID NO: 4105489 - RNA, 19 nt, Streptococcus pneumoniae R6
uaccggagaaauauuguuu

SEQ ID NO: 4105490 - RNA, 19 nt, Streptococcus pneumoniae R6
uaccgucaacgucaagaac

SEQ ID NO: 4105491 - RNA, 20 nt, Streptococcus pneumoniae R6
uaccguucauauccguucca

SEQ ID NO: 4105492 - RNA, 13 nt, Streptococcus pneumoniae R6
ucauauaaauaau

SEQ ID NO: 4105493 - RNA, 17 nt, Streptococcus pneumoniae R6
ucauauaaauaauuaua

SEQ ID NO: 4105494 - RNA, 20 nt, Streptococcus pneumoniae R6
ucauauagaccaacuauuuu

SEQ ID NO: 4105495 - RNA, 19 nt, Streptococcus pneumoniae R6
ucauaucaagguuuuucaa

SEQ ID NO: 4105496 - RNA, 14 nt, Streptococcus pneumoniae R6
ucauaucaaucucu

SEQ ID NO: 4105497 - RNA, 15 nt, Streptococcus pneumoniae R6
ucauaucaucaauca

SEQ ID NO: 4105498 - RNA, 17 nt, Streptococcus pneumoniae R6
ucauaucaucaaucaag

SEQ ID NO: 4105499 - RNA, 22 nt, Streptococcus pneumoniae R6
ucauaucaugggguguuuuucu

SEQ ID NO: 4105500 - RNA, 20 nt, Streptococcus pneumoniae R6
ucauaucuggcauuccugcu

SEQ ID NO: 4105501 - RNA, 19 nt, Streptococcus pneumoniae R6
ucauaucugucuuaccaca

SEQ ID NO: 4105502 - RNA, 17 nt, Streptococcus pneumoniae R6
ucauaucuuauuucaau

SEQ ID NO: 4105503 - RNA, 19 nt, Streptococcus pneumoniae R6
ucauaucuuauuucaauuu

SEQ ID NO: 4105504 - RNA, 16 nt, Streptococcus pneumoniae R6
ucauauuuauuaauuu

SEQ ID NO: 4105505 - RNA, 21 nt, Streptococcus pneumoniae R6
ucauauuuauuaauuucauua

SEQ ID NO: 4105506 - RNA, 15 nt, Streptococcus pneumoniae R6
ucauauuuucagaua

SEQ ID NO: 4105507 - RNA, 18 nt, Streptococcus pneumoniae R6
ucauauuuucagauaacc

SEQ ID NO: 4105508 - RNA, 24 nt, Streptococcus pneumoniae R6
ucauauuuucugggaagacuguca

SEQ ID NO: 4105509 - RNA, 19 nt, Streptococcus pneumoniae R6
ucauauuuuuugggaacag

SEQ ID NO: 4105510 - RNA, 13 nt, Streptococcus pneumoniae R6
ucaucaaaaauag

SEQ ID NO: 4105511 - RNA, 18 nt, Streptococcus pneumoniae R6
ucaucaaaauccguuuuu

SEQ ID NO: 4105512 - RNA, 18 nt, Streptococcus pneumoniae R6
ucaucaaaugucuuggca

SEQ ID NO: 4105513 - RNA, 14 nt, Streptococcus pneumoniae R6
ucaucaacccccau

SEQ ID NO: 4105514 - RNA, 19 nt, Streptococcus pneumoniae R6
ucaucacgacuaauuucaa

SEQ ID NO: 4105515 - RNA, 15 nt, Streptococcus pneumoniae R6
ucaucagcagagaaa

SEQ ID NO: 4105516 - RNA, 16 nt, Streptococcus pneumoniae R6
ucaucagcauaaucug

SEQ ID NO: 4105517 - RNA, 22 nt, Streptococcus pneumoniae R6
ucaucauaucagugaagguauu

SEQ ID NO: 4105518 - RNA, 11 nt, Streptococcus pneumoniae R6
ucaucaugaaa

SEQ ID NO: 4105519 - RNA, 15 nt, Streptococcus pneumoniae R6
ucaucauuaacaaua

SEQ ID NO: 4105520 - RNA, 13 nt, Streptococcus pneumoniae R6
ucauccacaaccu

SEQ ID NO: 4105521 - RNA, 18 nt, Streptococcus pneumoniae R6
ucauccacaaccucaaaa

SEQ ID NO: 4105522 - RNA, 22 nt, Streptococcus pneumoniae R6
ucauccacaaccucaaaacagu

SEQ ID NO: 4105523 - RNA, 17 nt, Streptococcus pneumoniae R6
ucauccagauuuuucug

SEQ ID NO: 4105524 - RNA, 22 nt, Streptococcus pneumoniae R6
ucauccauauaaaucuccagac

SEQ ID NO: 4105525 - RNA, 18 nt, Streptococcus pneumoniae R6
ucaucccuugucuuugau

SEQ ID NO: 4105526 - RNA, 21 nt, Streptococcus pneumoniae R6
ucauccgaagcaaaaauggca

SEQ ID NO: 4105527 - RNA, 13 nt, Streptococcus pneumoniae R6
ucauccuugaguu

SEQ ID NO: 4105528 - RNA, 17 nt, Streptococcus pneumoniae R6
ucaucgauuucuucuug

SEQ ID NO: 4105529 - RNA, 14 nt, Streptococcus pneumoniae R6
ucaucgauuuuuuc

SEQ ID NO: 4105530 - RNA, 16 nt, Streptococcus pneumoniae R6
ucaucgauuuuuucac

SEQ ID NO: 4105531 - RNA, 15 nt, Streptococcus pneumoniae R6
ucaucgccaaaucau

SEQ ID NO: 4105532 - RNA, 23 nt, Streptococcus pneumoniae R6
ucaucgcccaauuuauguaauca

SEQ ID NO: 4105533 - RNA, 15 nt, Streptococcus pneumoniae R6
ucaucggaaugguaa

SEQ ID NO: 4105534 - RNA, 23 nt, Streptococcus pneumoniae R6
ucaucggaaugguaaucaucuca

SEQ ID NO: 4105535 - RNA, 13 nt, Streptococcus pneumoniae R6
ucaucuacaaccu

SEQ ID NO: 4105536 - RNA, 14 nt, Streptococcus pneumoniae R6
ucaucuacaaccuc

SEQ ID NO: 4105537 - RNA, 15 nt, Streptococcus pneumoniae R6
ucaucuacaaccuca

SEQ ID NO: 4105538 - RNA, 13 nt, Streptococcus pneumoniae R6
ucaucuauaauca

SEQ ID NO: 4105539 - RNA, 23 nt, Streptococcus pneumoniae R6
ucaucucaggcuuggucauuaaa

SEQ ID NO: 4105540 - RNA, 14 nt, Streptococcus pneumoniae R6
ucaucuccugucaa

SEQ ID NO: 4105541 - RNA, 22 nt, Streptococcus pneumoniae R6
uccaauccuuguaugacaucuu

SEQ ID NO: 4105542 - RNA, 22 nt, Streptococcus pneumoniae R6
uccaauccuuuucuuuuacucu

SEQ ID NO: 4105543 - RNA, 22 nt, Streptococcus pneumoniae R6
uccaauucugcuuuuaaauagu

SEQ ID NO: 4105544 - RNA, 13 nt, Streptococcus pneumoniae R6
uccaauucuucgu

SEQ ID NO: 4105545 - RNA, 13 nt, Streptococcus pneumoniae R6
uccaauugauuaa

SEQ ID NO: 4105546 - RNA, 14 nt, Streptococcus pneumoniae R6
uccaauugauuaag

SEQ ID NO: 4105547 - RNA, 15 nt, Streptococcus pneumoniae R6
uccaauugauuaagu

SEQ ID NO: 4105548 - RNA, 21 nt, Streptococcus pneumoniae R6
uccaauuuguuuucaagugac

SEQ ID NO: 4105549 - RNA, 15 nt, Streptococcus pneumoniae R6
uccaauuuugucucu

SEQ ID NO: 4105550 - RNA, 19 nt, Streptococcus pneumoniae R6
uccaauuuugucucugaaa

SEQ ID NO: 4105551 - RNA, 16 nt, Streptococcus pneumoniae R6
uccacaaccucaaaac

SEQ ID NO: 4105552 - RNA, 18 nt, Streptococcus pneumoniae R6
uccacaaccucaaaacaa

SEQ ID NO: 4105553 - RNA, 18 nt, Streptococcus pneumoniae R6
uccacaaccucaaaacag

SEQ ID NO: 4105554 - RNA, 19 nt, Streptococcus pneumoniae R6
uccacaaccucaaaacagu

SEQ ID NO: 4105555 - RNA, 16 nt, Streptococcus pneumoniae R6
uccacaaccuuaaaac

SEQ ID NO: 4105556 - RNA, 19 nt, Streptococcus pneumoniae R6
uccacaaccuuaaaacagu

SEQ ID NO: 4105557 - RNA, 22 nt, Streptococcus pneumoniae R6
uccacaaccuuaaaacgguguu

SEQ ID NO: 4105558 - RNA, 16 nt, Streptococcus pneumoniae R6
uccacagaccugucca

SEQ ID NO: 4105559 - RNA, 20 nt, Streptococcus pneumoniae R6
uccacagccuugacucccca

SEQ ID NO: 4105560 - RNA, 19 nt, Streptococcus pneumoniae R6
uccacauccaaaugguugg

SEQ ID NO: 4105561 - RNA, 14 nt, Streptococcus pneumoniae R6
uccaccacaaaaga

SEQ ID NO: 4105562 - RNA, 23 nt, Streptococcus pneumoniae R6
uccaccacaaaagagaaagacuu

SEQ ID NO: 4105563 - RNA, 16 nt, Streptococcus pneumoniae R6
uccaccauucuuuccg

SEQ ID NO: 4105564 - RNA, 18 nt, Streptococcus pneumoniae R6
uccaccuucaucucucua

SEQ ID NO: 4105565 - RNA, 20 nt, Streptococcus pneumoniae R6
uccaccuugcaaaaaaacuu

SEQ ID NO: 4105566 - RNA, 19 nt, Streptococcus pneumoniae R6
uccacgauauuguuguuuu

SEQ ID NO: 4105567 - RNA, 19 nt, Streptococcus pneumoniae R6
uccacggagauagugagga

SEQ ID NO: 4105568 - RNA, 23 nt, Streptococcus pneumoniae R6
uccacguccgucaagaagagcuu

SEQ ID NO: 4105569 - RNA, 20 nt, Streptococcus pneumoniae R6
uccacucaaaucauuucuuu

SEQ ID NO: 4105570 - RNA, 13 nt, Streptococcus pneumoniae R6
uccacucaacauu

SEQ ID NO: 4105571 - RNA, 14 nt, Streptococcus pneumoniae R6
uccacucaacauua

SEQ ID NO: 4105572 - RNA, 20 nt, Streptococcus pneumoniae R6
uccacucaguauuacaucca

SEQ ID NO: 4105573 - RNA, 22 nt, Streptococcus pneumoniae R6
uccacugcaauuucuaaaaaau

SEQ ID NO: 4105574 - RNA, 19 nt, Streptococcus pneumoniae R6
uccacuggauaauuucuuu

SEQ ID NO: 4105575 - RNA, 14 nt, Streptococcus pneumoniae R6
uccacuuccagaag

SEQ ID NO: 4105576 - RNA, 16 nt, Streptococcus pneumoniae R6
uccacuugggaaacca

SEQ ID NO: 4105577 - RNA, 22 nt, Streptococcus pneumoniae R6
uccacuugguguugagaaagca

SEQ ID NO: 4105578 - RNA, 19 nt, Streptococcus pneumoniae R6
uccacuuguggcaaggagu

SEQ ID NO: 4105579 - RNA, 15 nt, Streptococcus pneumoniae R6
uccagaaccguucaa

SEQ ID NO: 4105580 - RNA, 18 nt, Streptococcus pneumoniae R6
uccagaaccguucaaggu

SEQ ID NO: 4105581 - RNA, 16 nt, Streptococcus pneumoniae R6
uccagaauacuugauc

SEQ ID NO: 4105582 - RNA, 15 nt, Streptococcus pneumoniae R6
uccagacccugcaca

SEQ ID NO: 4105583 - RNA, 19 nt, Streptococcus pneumoniae R6
uccagacccugcacaaaga

SEQ ID NO: 4105584 - RNA, 17 nt, Streptococcus pneumoniae R6
uccagauuaucuuccuu

SEQ ID NO: 4105585 - RNA, 18 nt, Streptococcus pneumoniae R6
uccagauuaucuuccuua

SEQ ID NO: 4105586 - RNA, 13 nt, Streptococcus pneumoniae R6
uccagauuggagg

SEQ ID NO: 4105587 - RNA, 21 nt, Streptococcus pneumoniae R6
uccagccugccugaucuugga

SEQ ID NO: 4105588 - RNA, 14 nt, Streptococcus pneumoniae R6
uccagccuugucuu

SEQ ID NO: 4105589 - RNA, 17 nt, Streptococcus pneumoniae R6
uccagcgguaucaauca

SEQ ID NO: 4105590 - RNA, 20 nt, Streptococcus pneumoniae R6
uccagcgguaucaaucauau

SEQ ID NO: 4105591 - RNA, 14 nt, Streptococcus pneumoniae R6
uccagcuuuuucuu

SEQ ID NO: 4105592 - RNA, 15 nt, Streptococcus pneumoniae R6
uccagcuuuuucuug

SEQ ID NO: 4105593 - RNA, 15 nt, Streptococcus pneumoniae R6
uccaggacugguuuu

SEQ ID NO: 4105594 - RNA, 22 nt, Streptococcus pneumoniae R6
uccaggacugguuuugauauag

SEQ ID NO: 4105595 - RNA, 15 nt, Streptococcus pneumoniae R6
uccaguaaaaacugu

SEQ ID NO: 4105596 - RNA, 16 nt, Streptococcus pneumoniae R6
uccaguaaaaacuguu

SEQ ID NO: 4105597 - RNA, 18 nt, Streptococcus pneumoniae R6
uccaguaaaaacuguugg

SEQ ID NO: 4105598 - RNA, 16 nt, Streptococcus pneumoniae R6
uccaguaauuucccau

SEQ ID NO: 4105599 - RNA, 16 nt, Streptococcus pneumoniae R6
uccaguagaucacuga

SEQ ID NO: 4105600 - RNA, 18 nt, Streptococcus pneumoniae R6
uccagugaaaacaggagu

SEQ ID NO: 4105601 - RNA, 19 nt, Streptococcus pneumoniae R6
uccaguuaucugcaaaagu

SEQ ID NO: 4105602 - RNA, 13 nt, Streptococcus pneumoniae R6
uccaguuuuguuu

SEQ ID NO: 4105603 - RNA, 13 nt, Streptococcus pneumoniae R6
uccauaaaaagac

SEQ ID NO: 4105604 - RNA, 20 nt, Streptococcus pneumoniae R6
uccauaaaaucacaucugcu

SEQ ID NO: 4105605 - RNA, 20 nt, Streptococcus pneumoniae R6
uccauaacgaguaaaagaua

SEQ ID NO: 4105606 - RNA, 17 nt, Streptococcus pneumoniae R6
uccauaccaucaaagac

SEQ ID NO: 4105607 - RNA, 20 nt, Streptococcus pneumoniae R6
uccauaccaucaaagaccac

SEQ ID NO: 4105608 - RNA, 23 nt, Streptococcus pneumoniae R6
uccauaccugcucgccccauuuc

SEQ ID NO: 4105609 - RNA, 16 nt, Streptococcus pneumoniae R6
uccauaguaaacuucu

SEQ ID NO: 4105610 - RNA, 23 nt, Streptococcus pneumoniae R6
uccauauaaaaaagcaagaccac

SEQ ID NO: 4105611 - RNA, 21 nt, Streptococcus pneumoniae R6
uccauaucuuuagggaaauua

SEQ ID NO: 4105612 - RNA, 14 nt, Streptococcus pneumoniae R6
uccauaugauucuu

SEQ ID NO: 4105613 - RNA, 20 nt, Streptococcus pneumoniae R6
uccauaugauucuuucuaau

SEQ ID NO: 4105614 - RNA, 21 nt, Streptococcus pneumoniae R6
uccaucaaguuuaccauucaa

SEQ ID NO: 4105615 - RNA, 15 nt, Streptococcus pneumoniae R6
uccauccacaaccuu

SEQ ID NO: 4105616 - RNA, 17 nt, Streptococcus pneumoniae R6
uccauccacaaccuuaa

SEQ ID NO: 4105617 - RNA, 23 nt, Streptococcus pneumoniae R6
uccauccacaaccuuaaaacagu

SEQ ID NO: 4105618 - RNA, 15 nt, Streptococcus pneumoniae R6
uccauccucaccagu

SEQ ID NO: 4105619 - RNA, 16 nt, Streptococcus pneumoniae R6
uccauccucaccagua

SEQ ID NO: 4105620 - RNA, 21 nt, Streptococcus pneumoniae R6
uccaucguuccugucuuauuu

SEQ ID NO: 4105621 - RNA, 15 nt, Streptococcus pneumoniae R6
uccaucuacaaccuu

SEQ ID NO: 4105622 - RNA, 12 nt, Streptococcus pneumoniae R6
uccaucuccaac

SEQ ID NO: 4105623 - RNA, 19 nt, Streptococcus pneumoniae R6
uccaucuccaacugcuguu

SEQ ID NO: 4105624 - RNA, 14 nt, Streptococcus pneumoniae R6
uccaucugcucucc

SEQ ID NO: 4105625 - RNA, 18 nt, Streptococcus pneumoniae R6
uccaucuuuuauuugagu

SEQ ID NO: 4105626 - RNA, 23 nt, Streptococcus pneumoniae R6
uccaucuuuuauuugaguaagga

SEQ ID NO: 4105627 - RNA, 16 nt, Streptococcus pneumoniae R6
uccaugauaaugguau

SEQ ID NO: 4105628 - RNA, 18 nt, Streptococcus pneumoniae R6
uccaugaugcugguuguc

SEQ ID NO: 4105629 - RNA, 16 nt, Streptococcus pneumoniae R6
uccaugcuaccagucg

SEQ ID NO: 4105630 - RNA, 18 nt, Streptococcus pneumoniae R6
uccaugguaucaaaggca

SEQ ID NO: 4105631 - RNA, 20 nt, Streptococcus pneumoniae R6
uccauguuaugauucuccuu

SEQ ID NO: 4105632 - RNA, 20 nt, Streptococcus pneumoniae R6
uccauuaugaagaacaccua

SEQ ID NO: 4105633 - RNA, 15 nt, Streptococcus pneumoniae R6
uccauucacaacauc

SEQ ID NO: 4105634 - RNA, 18 nt, Streptococcus pneumoniae R6
uccauucacaacaucuuc

SEQ ID NO: 4105635 - RNA, 20 nt, Streptococcus pneumoniae R6
uccauucgauucguuuuccu

SEQ ID NO: 4105636 - RNA, 20 nt, Streptococcus pneumoniae R6
uccauucuuuuuuaauucuu

SEQ ID NO: 4105637 - RNA, 23 nt, Streptococcus pneumoniae R6
uccauucuuuuuuaauucuuuuu

SEQ ID NO: 4105638 - RNA, 20 nt, Streptococcus pneumoniae R6
uccauugcaagagccuuuuu

SEQ ID NO: 4105639 - RNA, 15 nt, Streptococcus pneumoniae R6
uccauuuacagaagc

SEQ ID NO: 4105640 - RNA, 16 nt, Streptococcus pneumoniae R6
uccauuucuuugucuc

SEQ ID NO: 4105641 - RNA, 13 nt, Streptococcus pneumoniae R6
uccauuucuuuug

SEQ ID NO: 4105642 - RNA, 21 nt, Streptococcus pneumoniae R6
uccauuuggcaccgaauuuuu

SEQ ID NO: 4105643 - RNA, 18 nt, Streptococcus pneumoniae R6
uccuagucuacaaauuca

SEQ ID NO: 4105644 - RNA, 20 nt, Streptococcus pneumoniae R6
uccuaguuugcucuuugauu

SEQ ID NO: 4105645 - RNA, 15 nt, Streptococcus pneumoniae R6
uccuauagaaaaauc

SEQ ID NO: 4105646 - RNA, 16 nt, Streptococcus pneumoniae R6
uccuauggguucguga

SEQ ID NO: 4105647 - RNA, 19 nt, Streptococcus pneumoniae R6
uccuauuacuaucaagaag

SEQ ID NO: 4105648 - RNA, 12 nt, Streptococcus pneumoniae R6
uccuauucuuau

SEQ ID NO: 4105649 - RNA, 19 nt, Streptococcus pneumoniae R6
uccuauucuuauuucauuu

SEQ ID NO: 4105650 - RNA, 16 nt, Streptococcus pneumoniae R6
uccuauucuuguuuca

SEQ ID NO: 4105651 - RNA, 15 nt, Streptococcus pneumoniae R6
uccucaaaauucugu

SEQ ID NO: 4105652 - RNA, 21 nt, Streptococcus pneumoniae R6
uccucaauaagcccgaaaaau

SEQ ID NO: 4105653 - RNA, 21 nt, Streptococcus pneumoniae R6
uccucaauaaguccgaaaaau

SEQ ID NO: 4105654 - RNA, 22 nt, Streptococcus pneumoniae R6
uccucaauaaguccgaaaaauu

SEQ ID NO: 4105655 - RNA, 21 nt, Streptococcus pneumoniae R6
uccucaaugaauccgaaaaau

SEQ ID NO: 4105656 - RNA, 21 nt, Streptococcus pneumoniae R6
uccucaaugaguccgaaaaau

SEQ ID NO: 4105657 - RNA, 12 nt, Streptococcus pneumoniae R6
uccucaauuuga

SEQ ID NO: 4105658 - RNA, 22 nt, Streptococcus pneumoniae R6
uccucaccaguauagaccaaga

SEQ ID NO: 4105659 - RNA, 23 nt, Streptococcus pneumoniae R6
uccucagcacggagaaucuuccc

SEQ ID NO: 4105660 - RNA, 19 nt, Streptococcus pneumoniae R6
uccucauuagauaguuuug

SEQ ID NO: 4105661 - RNA, 13 nt, Streptococcus pneumoniae R6
uccucauuucaau

SEQ ID NO: 4105662 - RNA, 18 nt, Streptococcus pneumoniae R6
uccuccauaaaaagaccg

SEQ ID NO: 4105663 - RNA, 13 nt, Streptococcus pneumoniae R6
uccucccauauuu

SEQ ID NO: 4105664 - RNA, 16 nt, Streptococcus pneumoniae R6
uccuccccuuuagaac

SEQ ID NO: 4105665 - RNA, 13 nt, Streptococcus pneumoniae R6
uccucccuucuuu

SEQ ID NO: 4105666 - RNA, 20 nt, Streptococcus pneumoniae R6
uccucuaacuggaaagauaa

SEQ ID NO: 4105667 - RNA, 23 nt, Streptococcus pneumoniae R6
uccucuaucaugcgaaucaauuu

SEQ ID NO: 4105668 - RNA, 17 nt, Streptococcus pneumoniae R6
uccucuguaucaagaua

SEQ ID NO: 4105669 - RNA, 13 nt, Streptococcus pneumoniae R6
uccucuuuuuccc

SEQ ID NO: 4105670 - RNA, 18 nt, Streptococcus pneumoniae R6
uccucuuuuuguaucaau

SEQ ID NO: 4105671 - RNA, 12 nt, Streptococcus pneumoniae R6
uccugaaaagcc

SEQ ID NO: 4105672 - RNA, 15 nt, Streptococcus pneumoniae R6
uccugaaaagccacg

SEQ ID NO: 4105673 - RNA, 17 nt, Streptococcus pneumoniae R6
uccugaaaaucaucugc

SEQ ID NO: 4105674 - RNA, 20 nt, Streptococcus pneumoniae R6
uccugaaauaagggcaaaga

SEQ ID NO: 4105675 - RNA, 20 nt, Streptococcus pneumoniae R6
uccugaaugauuucuucuug

SEQ ID NO: 4105676 - RNA, 19 nt, Streptococcus pneumoniae R6
uccugagaacuaaauuacu

SEQ ID NO: 4105677 - RNA, 16 nt, Streptococcus pneumoniae R6
uccugauaccaaccag

SEQ ID NO: 4105678 - RNA, 13 nt, Streptococcus pneumoniae R6
uccugaucgauuu

SEQ ID NO: 4105679 - RNA, 21 nt, Streptococcus pneumoniae R6
uccugcaaaacuagaauccua

SEQ ID NO: 4105680 - RNA, 14 nt, Streptococcus pneumoniae R6
uccugcaaggcaua

SEQ ID NO: 4105681 - RNA, 18 nt, Streptococcus pneumoniae R6
uccugcccacuaaaaaua

SEQ ID NO: 4105682 - RNA, 15 nt, Streptococcus pneumoniae R6
uccuggcguaguaaa

SEQ ID NO: 4105683 - RNA, 15 nt, Streptococcus pneumoniae R6
uccugggaaauucca

SEQ ID NO: 4105684 - RNA, 21 nt, Streptococcus pneumoniae R6
uccuguaagaacuuuuuaaag

SEQ ID NO: 4105685 - RNA, 17 nt, Streptococcus pneumoniae R6
uccuguacccaaguaau

SEQ ID NO: 4105686 - RNA, 19 nt, Streptococcus pneumoniae R6
uccuguguacuguucuaaa

SEQ ID NO: 4105687 - RNA, 14 nt, Streptococcus pneumoniae R6
uccuguucuuguuu

SEQ ID NO: 4105688 - RNA, 17 nt, Streptococcus pneumoniae R6
uccuguucuuguuucaa

SEQ ID NO: 4105689 - RNA, 15 nt, Streptococcus pneumoniae R6
uccuguuguaauuuu

SEQ ID NO: 4105690 - RNA, 13 nt, Streptococcus pneumoniae R6
uccuuaaacucuu

SEQ ID NO: 4105691 - RNA, 13 nt, Streptococcus pneumoniae R6
uccuuaagucugu

SEQ ID NO: 4105692 - RNA, 13 nt, Streptococcus pneumoniae R6
uccuuaccuguuu

SEQ ID NO: 4105693 - RNA, 15 nt, Streptococcus pneumoniae R6
uccuuacggucaaag

SEQ ID NO: 4105694 - RNA, 16 nt, Streptococcus pneumoniae R6
uccuuacggucaaagu

SEQ ID NO: 4105695 - RNA, 19 nt, Streptococcus pneumoniae R6
uccuuacuagcaaauuuaa

SEQ ID NO: 4105696 - RNA, 16 nt, Streptococcus pneumoniae R6
uccuuacucaaauaaa

SEQ ID NO: 4105697 - RNA, 14 nt, Streptococcus pneumoniae R6
uccuuauucugaaa

SEQ ID NO: 4105698 - RNA, 22 nt, Streptococcus pneumoniae R6
uccuuauucuggaagugaaaaa

SEQ ID NO: 4105699 - RNA, 19 nt, Streptococcus pneumoniae R6
uccuuauuuugcagacgac

SEQ ID NO: 4105700 - RNA, 19 nt, Streptococcus pneumoniae R6
uccuucaaauccugcauug

SEQ ID NO: 4105701 - RNA, 19 nt, Streptococcus pneumoniae R6
uccuucgcacuuauuuuau

SEQ ID NO: 4105702 - RNA, 14 nt, Streptococcus pneumoniae R6
uccuucguuuucac

SEQ ID NO: 4105703 - RNA, 22 nt, Streptococcus pneumoniae R6
uccuugauaacagcugcgauuu

SEQ ID NO: 4105704 - RNA, 18 nt, Streptococcus pneumoniae R6
uccuugccuaauuuuuca

SEQ ID NO: 4105705 - RNA, 19 nt, Streptococcus pneumoniae R6
uccuugccuaauuuuucaa

SEQ ID NO: 4105706 - RNA, 19 nt, Streptococcus pneumoniae R6
uccuugccuucaaucuuuu

SEQ ID NO: 4105707 - RNA, 11 nt, Streptococcus pneumoniae R6
uccuuuaaaaa

SEQ ID NO: 4105708 - RNA, 14 nt, Streptococcus pneumoniae R6
uccuuuacuuguuu

SEQ ID NO: 4105709 - RNA, 20 nt, Streptococcus pneumoniae R6
uccuuuagaaagguuuuaaa

SEQ ID NO: 4105710 - RNA, 13 nt, Streptococcus pneumoniae R6
uccuuucuuuuuu

SEQ ID NO: 4105711 - RNA, 16 nt, Streptococcus pneumoniae R6
uccuuucuuuuuugau

SEQ ID NO: 4105712 - RNA, 17 nt, Streptococcus pneumoniae R6
uccuuucuuuuuugaua

SEQ ID NO: 4105713 - RNA, 17 nt, Streptococcus pneumoniae R6
uccuuugagguuaauca

SEQ ID NO: 4105714 - RNA, 19 nt, Streptococcus pneumoniae R6
uccuuugcguacaaaacuu

SEQ ID NO: 4105715 - RNA, 23 nt, Streptococcus pneumoniae R6
uccuuugcgugacauagaugcuu

SEQ ID NO: 4105716 - RNA, 17 nt, Streptococcus pneumoniae R6
uccuuuuaguuuuaccu

SEQ ID NO: 4105717 - RNA, 14 nt, Streptococcus pneumoniae R6
uccuuuuauuaucu

SEQ ID NO: 4105718 - RNA, 19 nt, Streptococcus pneumoniae R6
uccuuuuauuaucuuucca

SEQ ID NO: 4105719 - RNA, 20 nt, Streptococcus pneumoniae R6
uccuuuucugaggauuaggg

SEQ ID NO: 4105720 - RNA, 22 nt, Streptococcus pneumoniae R6
uccuuuuuaaauccgauaauau

SEQ ID NO: 4105721 - RNA, 16 nt, Streptococcus pneumoniae R6
uccuuuuugauaacgu

SEQ ID NO: 4105722 - RNA, 18 nt, Streptococcus pneumoniae R6
uccuuuuugcuguuaaua

SEQ ID NO: 4105723 - RNA, 20 nt, Streptococcus pneumoniae R6
uccuuuuugcuguuaauaac

SEQ ID NO: 4105724 - RNA, 17 nt, Streptococcus pneumoniae R6
uccuuuuuucuuuacuc

SEQ ID NO: 4105725 - RNA, 16 nt, Streptococcus pneumoniae R6
ucgaaaaccaaaggca

SEQ ID NO: 4105726 - RNA, 17 nt, Streptococcus pneumoniae R6
ucgaaacauucaaaucc

SEQ ID NO: 4105727 - RNA, 22 nt, Streptococcus pneumoniae R6
ucgaaaucacgcuuuucuugac

SEQ ID NO: 4105728 - RNA, 17 nt, Streptococcus pneumoniae R6
ucgaaauuccauaccua

SEQ ID NO: 4105729 - RNA, 19 nt, Streptococcus pneumoniae R6
ucgaaauuccauaccuaaa

SEQ ID NO: 4105730 - RNA, 13 nt, Streptococcus pneumoniae R6
ucgaagcuuccaa

SEQ ID NO: 4105731 - RNA, 18 nt, Streptococcus pneumoniae R6
ucgaagcuuccaauaaua

SEQ ID NO: 4105732 - RNA, 15 nt, Streptococcus pneumoniae R6
ucgaagguuauacca

SEQ ID NO: 4105733 - RNA, 21 nt, Streptococcus pneumoniae R6
ucgaagguuauaccaaaaaaa

SEQ ID NO: 4105734 - RNA, 14 nt, Streptococcus pneumoniae R6
ucgaaguuucaauc

SEQ ID NO: 4105735 - RNA, 18 nt, Streptococcus pneumoniae R6
ucgaaugacuacauuuuu

SEQ ID NO: 4105736 - RNA, 22 nt, Streptococcus pneumoniae R6
ucgaaugauauuuucaaaaaaa

SEQ ID NO: 4105737 - RNA, 20 nt, Streptococcus pneumoniae R6
ucgacaagauacccacaaaa

SEQ ID NO: 4105738 - RNA, 17 nt, Streptococcus pneumoniae R6
ucgacaggaguguagag

SEQ ID NO: 4105739 - RNA, 21 nt, Streptococcus pneumoniae R6
ucgaccaagccagcauuuuca

SEQ ID NO: 4105740 - RNA, 15 nt, Streptococcus pneumoniae R6
ucgacgcuuucuaag

SEQ ID NO: 4105741 - RNA, 16 nt, Streptococcus pneumoniae R6
ucgacuacuaaaacau

SEQ ID NO: 4105742 - RNA, 22 nt, Streptococcus pneumoniae R6
ucgacuggcaaaggcaugggcc

SEQ ID NO: 4105743 - RNA, 18 nt, Streptococcus pneumoniae R6
ucgacuucaggaaaaaau

SEQ ID NO: 4105744 - RNA, 18 nt, Streptococcus pneumoniae R6
ucgagaaaggggcucuuu

SEQ ID NO: 4105745 - RNA, 20 nt, Streptococcus pneumoniae R6
ucgagaaaggggcucuuugu

SEQ ID NO: 4105746 - RNA, 11 nt, Streptococcus pneumoniae R6
ucguuaucauu

SEQ ID NO: 4105747 - RNA, 18 nt, Streptococcus pneumoniae R6
ucguuccaguuuggcaaa

SEQ ID NO: 4105748 - RNA, 17 nt, Streptococcus pneumoniae R6
ucguuggauauaggagg

SEQ ID NO: 4105749 - RNA, 23 nt, Streptococcus pneumoniae R6
ucguuuacaagugaaguaacgau

SEQ ID NO: 4105750 - RNA, 12 nt, Streptococcus pneumoniae R6
ucguuucaagug

SEQ ID NO: 4105751 - RNA, 15 nt, Streptococcus pneumoniae R6
ucguuucuaauaauu

SEQ ID NO: 4105752 - RNA, 16 nt, Streptococcus pneumoniae R6
ucguuucuaauaauuu

SEQ ID NO: 4105753 - RNA, 17 nt, Streptococcus pneumoniae R6
ucguuucugacagagcu

SEQ ID NO: 4105754 - RNA, 19 nt, Streptococcus pneumoniae R6
ucguuugguguaauaaacu

SEQ ID NO: 4105755 - RNA, 21 nt, Streptococcus pneumoniae R6
ucguuuguuuuuuccuauaau

SEQ ID NO: 4105756 - RNA, 16 nt, Streptococcus pneumoniae R6
ucguuuuuacuacaaa

SEQ ID NO: 4105757 - RNA, 15 nt, Streptococcus pneumoniae R6
ucguuuuucaugaau

SEQ ID NO: 4105758 - RNA, 15 nt, Streptococcus pneumoniae R6
ucuaaaaaaaugaua

SEQ ID NO: 4105759 - RNA, 18 nt, Streptococcus pneumoniae R6
ucuaaaaauaaaaaagag

SEQ ID NO: 4105760 - RNA, 19 nt, Streptococcus pneumoniae R6
ucuaaaaauuuaaaagaua

SEQ ID NO: 4105761 - RNA, 17 nt, Streptococcus pneumoniae R6
ucuaaaauaaguucugu

SEQ ID NO: 4105762 - RNA, 16 nt, Streptococcus pneumoniae R6
ucuaaaauagaaggag

SEQ ID NO: 4105763 - RNA, 12 nt, Streptococcus pneumoniae R6
ucuaaaauagua

SEQ ID NO: 4105764 - RNA, 22 nt, Streptococcus pneumoniae R6
ucuaaaaucaucgccaaaucau

SEQ ID NO: 4105765 - RNA, 18 nt, Streptococcus pneumoniae R6
ucuaaaaucugauuccuu

SEQ ID NO: 4105766 - RNA, 19 nt, Streptococcus pneumoniae R6
ucuaaacaaacuccucucc

SEQ ID NO: 4105767 - RNA, 19 nt, Streptococcus pneumoniae R6
ucuaaacaauguucucaua

SEQ ID NO: 4105768 - RNA, 20 nt, Streptococcus pneumoniae R6
ucuaaagaauuugaaaaaaa

SEQ ID NO: 4105769 - RNA, 14 nt, Streptococcus pneumoniae R6
ucuaaauacaaaaa

SEQ ID NO: 4105770 - RNA, 16 nt, Streptococcus pneumoniae R6
ucuaaaucuugcccuu

SEQ ID NO: 4105771 - RNA, 18 nt, Streptococcus pneumoniae R6
ucuaaaucuugcccuucu

SEQ ID NO: 4105772 - RNA, 13 nt, Streptococcus pneumoniae R6
ucuaaauuaacua

SEQ ID NO: 4105773 - RNA, 13 nt, Streptococcus pneumoniae R6
ucuaacauauuuc

SEQ ID NO: 4105774 - RNA, 17 nt, Streptococcus pneumoniae R6
ucuaacauauuucuaga

SEQ ID NO: 4105775 - RNA, 16 nt, Streptococcus pneumoniae R6
ucuaacaucuuuugau

SEQ ID NO: 4105776 - RNA, 15 nt, Streptococcus pneumoniae R6
ucuaaccaauccaua

SEQ ID NO: 4105777 - RNA, 14 nt, Streptococcus pneumoniae R6
ucuaacucagcuuc

SEQ ID NO: 4105778 - RNA, 13 nt, Streptococcus pneumoniae R6
ucuaacugaagcu

SEQ ID NO: 4105779 - RNA, 19 nt, Streptococcus pneumoniae R6
ucuaacuggaaagauaacu

SEQ ID NO: 4105780 - RNA, 22 nt, Streptococcus pneumoniae R6
ucuaacuggaaagauaacugcu

SEQ ID NO: 4105781 - RNA, 19 nt, Streptococcus pneumoniae R6
ucuaacuguauugaccaaa

SEQ ID NO: 4105782 - RNA, 14 nt, Streptococcus pneumoniae R6
ucuaacuuaucagc

SEQ ID NO: 4105783 - RNA, 20 nt, Streptococcus pneumoniae R6
ucuaacuucaauagacuaua

SEQ ID NO: 4105784 - RNA, 16 nt, Streptococcus pneumoniae R6
ucuaacuucugcuaau

SEQ ID NO: 4105785 - RNA, 15 nt, Streptococcus pneumoniae R6
ucuaagaucugguua

SEQ ID NO: 4105786 - RNA, 16 nt, Streptococcus pneumoniae R6
ucuaagcgaaacaacc

SEQ ID NO: 4105787 - RNA, 18 nt, Streptococcus pneumoniae R6
ucuaagguauauucaaaa

SEQ ID NO: 4105788 - RNA, 20 nt, Streptococcus pneumoniae R6
ucuaaguaacuaacgccaaa

SEQ ID NO: 4105789 - RNA, 14 nt, Streptococcus pneumoniae R6
ucuaagucaaauaa

SEQ ID NO: 4105790 - RNA, 19 nt, Streptococcus pneumoniae R6
ucuaauagacuaucuaaaa

SEQ ID NO: 4105791 - RNA, 15 nt, Streptococcus pneumoniae R6
ucuaauguaauucuc

SEQ ID NO: 4105792 - RNA, 16 nt, Streptococcus pneumoniae R6
ucuaauguaauucuca

SEQ ID NO: 4105793 - RNA, 15 nt, Streptococcus pneumoniae R6
ucuaaugucucugcu

SEQ ID NO: 4105794 - RNA, 15 nt, Streptococcus pneumoniae R6
ucuaauuaaaucauc

SEQ ID NO: 4105795 - RNA, 21 nt, Streptococcus pneumoniae R6
ucuaauucggugguauuuaga

SEQ ID NO: 4105796 - RNA, 12 nt, Streptococcus pneumoniae R6
ucuaauugaaaa

SEQ ID NO: 4105797 - RNA, 15 nt, Streptococcus pneumoniae R6
ucuacaaauaagaaa

SEQ ID NO: 4105798 - RNA, 19 nt, Streptococcus pneumoniae R6
ucuacaaccucaaaaccau

SEQ ID NO: 4105799 - RNA, 16 nt, Streptococcus pneumoniae R6
ucuacaaccuuaaaac

SEQ ID NO: 4105800 - RNA, 19 nt, Streptococcus pneumoniae R6
ucuacaaccuuaaaacagu

SEQ ID NO: 4105801 - RNA, 22 nt, Streptococcus pneumoniae R6
ucuacaaccuuaaaacaguguu

SEQ ID NO: 4105802 - RNA, 20 nt, Streptococcus pneumoniae R6
ucuacaacgucuuuugccuu

SEQ ID NO: 4105803 - RNA, 12 nt, Streptococcus pneumoniae R6
ucuacaauaaca

SEQ ID NO: 4105804 - RNA, 22 nt, Streptococcus pneumoniae R6
ucuacaauuucucguguaaugc

SEQ ID NO: 4105805 - RNA, 17 nt, Streptococcus pneumoniae R6
ucuacaccauaaauauu

SEQ ID NO: 4105806 - RNA, 19 nt, Streptococcus pneumoniae R6
ucuacaccauaaauauuug

SEQ ID NO: 4105807 - RNA, 23 nt, Streptococcus pneumoniae R6
ucuacauacccaugcuuuucuau

SEQ ID NO: 4105808 - RNA, 20 nt, Streptococcus pneumoniae R6
ucuacaucauugucaaacaa

SEQ ID NO: 4105809 - RNA, 17 nt, Streptococcus pneumoniae R6
ucuacauucccaaacaa

SEQ ID NO: 4105810 - RNA, 15 nt, Streptococcus pneumoniae R6
ucuaccaagcccuca

SEQ ID NO: 4105811 - RNA, 17 nt, Streptococcus pneumoniae R6
ucuacgcuuuaaaaauc

SEQ ID NO: 4105812 - RNA, 23 nt, Streptococcus pneumoniae R6
ucuacuaaaauuauguuuuugaa

SEQ ID NO: 4105813 - RNA, 21 nt, Streptococcus pneumoniae R6
ucuacuauagaaaaaagucuu

SEQ ID NO: 4105814 - RNA, 13 nt, Streptococcus pneumoniae R6
ucuacuuuuucaa

SEQ ID NO: 4105815 - RNA, 20 nt, Streptococcus pneumoniae R6
ucuagaaaucucuuuuuucu

SEQ ID NO: 4105816 - RNA, 14 nt, Streptococcus pneumoniae R6
ucuagaaauuaauu

SEQ ID NO: 4105817 - RNA, 15 nt, Streptococcus pneumoniae R6
ucuagaaauuaauuu

SEQ ID NO: 4105818 - RNA, 19 nt, Streptococcus pneumoniae R6
ucuagaagcaagacaaaaa

SEQ ID NO: 4105819 - RNA, 23 nt, Streptococcus pneumoniae R6
ucuagaaugucuuccaaacgugg

SEQ ID NO: 4105820 - RNA, 23 nt, Streptococcus pneumoniae R6
ucuagaccaugcggaugcaugcc

SEQ ID NO: 4105821 - RNA, 13 nt, Streptococcus pneumoniae R6
ucuagaguccaag

SEQ ID NO: 4105822 - RNA, 22 nt, Streptococcus pneumoniae R6
ucuagcuuuuauaaauuuucca

SEQ ID NO: 4105823 - RNA, 14 nt, Streptococcus pneumoniae R6
ucuaggaauaucaa

SEQ ID NO: 4105824 - RNA, 22 nt, Streptococcus pneumoniae R6
ucuaguaaagcuagauuuaaaa

SEQ ID NO: 4105825 - RNA, 13 nt, Streptococcus pneumoniae R6
ucuaguagguaua

SEQ ID NO: 4105826 - RNA, 14 nt, Streptococcus pneumoniae R6
ucuaguccaucucc

SEQ ID NO: 4105827 - RNA, 11 nt, Streptococcus pneumoniae R6
ucuaguuucaa

SEQ ID NO: 4105828 - RNA, 22 nt, Streptococcus pneumoniae R6
ucuaguuuuuugcguuucugga

SEQ ID NO: 4105829 - RNA, 13 nt, Streptococcus pneumoniae R6
ucuauaaaauaua

SEQ ID NO: 4105830 - RNA, 14 nt, Streptococcus pneumoniae R6
ucuauaaaauauag

SEQ ID NO: 4105831 - RNA, 16 nt, Streptococcus pneumoniae R6
ucuauaaaucaauuuu

SEQ ID NO: 4105832 - RNA, 22 nt, Streptococcus pneumoniae R6
ucuauaaucaauauagaaguag

SEQ ID NO: 4105833 - RNA, 20 nt, Streptococcus pneumoniae R6
ucuauacacgaccuauagaa

SEQ ID NO: 4105834 - RNA, 21 nt, Streptococcus pneumoniae R6
ucuauagaacuaguaaauugu

SEQ ID NO: 4105835 - RNA, 22 nt, Streptococcus pneumoniae R6
ucuauagaacuaguaaauuguc

SEQ ID NO: 4105836 - RNA, 23 nt, Streptococcus pneumoniae R6
ucuauagcguuuugaaacuagaa

SEQ ID NO: 4105837 - RNA, 19 nt, Streptococcus pneumoniae R6
ucuauaggucguguauaga

SEQ ID NO: 4105838 - RNA, 21 nt, Streptococcus pneumoniae R6
ucuauaguagauugaaauaag

SEQ ID NO: 4105839 - RNA, 15 nt, Streptococcus pneumoniae R6
ucuauaguuaaauua

SEQ ID NO: 4105840 - RNA, 17 nt, Streptococcus pneumoniae R6
ucuaucaacucaagaau

SEQ ID NO: 4105841 - RNA, 18 nt, Streptococcus pneumoniae R6
ucuaucaacucaagaauu

SEQ ID NO: 4105842 - RNA, 24 nt, Streptococcus pneumoniae R6
ucuaucagaaagucgugauuucua

SEQ ID NO: 4105843 - RNA, 20 nt, Streptococcus pneumoniae R6
ucuaucaggaaagucaaauu

SEQ ID NO: 4105844 - RNA, 15 nt, Streptococcus pneumoniae R6
ucuauccacaaccuc

SEQ ID NO: 4105845 - RNA, 16 nt, Streptococcus pneumoniae R6
ucuauccacaaccuca

SEQ ID NO: 4105846 - RNA, 20 nt, Streptococcus pneumoniae R6
ucuauccagccuucauaaaa

SEQ ID NO: 4105847 - RNA, 15 nt, Streptococcus pneumoniae R6
ucuaucuacaaccuc

SEQ ID NO: 4105848 - RNA, 12 nt, Streptococcus pneumoniae R6
ucuaucuauuuu

SEQ ID NO: 4105849 - RNA, 20 nt, Streptococcus pneumoniae R6
ucucugguuccuuauucugg

SEQ ID NO: 4105850 - RNA, 23 nt, Streptococcus pneumoniae R6
ucucuucaaaccacgucagcuuu

SEQ ID NO: 4105851 - RNA, 22 nt, Streptococcus pneumoniae R6
ucucuucaaaccgcgucagcuu

SEQ ID NO: 4105852 - RNA, 22 nt, Streptococcus pneumoniae R6
ucucuucaaauuugacuaaaaa

SEQ ID NO: 4105853 - RNA, 13 nt, Streptococcus pneumoniae R6
ucucuuguauucg

SEQ ID NO: 4105854 - RNA, 21 nt, Streptococcus pneumoniae R6
ucucuuuccacacuuguucaa

SEQ ID NO: 4105855 - RNA, 12 nt, Streptococcus pneumoniae R6
ucucuuucuaaa

SEQ ID NO: 4105856 - RNA, 13 nt, Streptococcus pneumoniae R6
ucucuuucuaaaa

SEQ ID NO: 4105857 - RNA, 20 nt, Streptococcus pneumoniae R6
ucucuuugaaugccuguucc

SEQ ID NO: 4105858 - RNA, 16 nt, Streptococcus pneumoniae R6
ucucuuuuuucuccaa

SEQ ID NO: 4105859 - RNA, 22 nt, Streptococcus pneumoniae R6
ucucuuuuuugauguucaaagu

SEQ ID NO: 4105860 - RNA, 10 nt, Streptococcus pneumoniae R6
ucugaaaaau

SEQ ID NO: 4105861 - RNA, 19 nt, Streptococcus pneumoniae R6
ucugaaacacugauuucaa

SEQ ID NO: 4105862 - RNA, 14 nt, Streptococcus pneumoniae R6
ucugaaacuaagcu

SEQ ID NO: 4105863 - RNA, 15 nt, Streptococcus pneumoniae R6
ucugaacuaaaaaau

SEQ ID NO: 4105864 - RNA, 20 nt, Streptococcus pneumoniae R6
ucugaacugccccccaaaag

SEQ ID NO: 4105865 - RNA, 14 nt, Streptococcus pneumoniae R6
ucugaagaaagcaa

SEQ ID NO: 4105866 - RNA, 15 nt, Streptococcus pneumoniae R6
ucugaagacuggagu

SEQ ID NO: 4105867 - RNA, 23 nt, Streptococcus pneumoniae R6
ucugaaggaacuaacucaucaaa

SEQ ID NO: 4105868 - RNA, 16 nt, Streptococcus pneumoniae R6
ucugaagucacuacuu

SEQ ID NO: 4105869 - RNA, 15 nt, Streptococcus pneumoniae R6
ucugaauagaaggcu

SEQ ID NO: 4105870 - RNA, 22 nt, Streptococcus pneumoniae R6
ucugaaucugccucaagaagug

SEQ ID NO: 4105871 - RNA, 19 nt, Streptococcus pneumoniae R6
ucugaaugacaaauccauu

SEQ ID NO: 4105872 - RNA, 16 nt, Streptococcus pneumoniae R6
ucugaaugcuuuccaa

SEQ ID NO: 4105873 - RNA, 22 nt, Streptococcus pneumoniae R6
ucugacaggcuauugaagaaga

SEQ ID NO: 4105874 - RNA, 20 nt, Streptococcus pneumoniae R6
ucugaccaugcguuggaacg

SEQ ID NO: 4105875 - RNA, 15 nt, Streptococcus pneumoniae R6
ucugacuucgucagu

SEQ ID NO: 4105876 - RNA, 19 nt, Streptococcus pneumoniae R6
ucugacuucgucaguucua

SEQ ID NO: 4105877 - RNA, 21 nt, Streptococcus pneumoniae R6
ucugacuuugggagaauuuca

SEQ ID NO: 4105878 - RNA, 13 nt, Streptococcus pneumoniae R6
ucugacuuuucca

SEQ ID NO: 4105879 - RNA, 15 nt, Streptococcus pneumoniae R6
ucugagcuacuauag

SEQ ID NO: 4105880 - RNA, 22 nt, Streptococcus pneumoniae R6
ucugagguaggaguccucugua

SEQ ID NO: 4105881 - RNA, 20 nt, Streptococcus pneumoniae R6
ucugauagaagagucagcuc

SEQ ID NO: 4105882 - RNA, 19 nt, Streptococcus pneumoniae R6
ucugauagugguguuucaa

SEQ ID NO: 4105883 - RNA, 22 nt, Streptococcus pneumoniae R6
ucugaugcacuauuuuccaaaa

SEQ ID NO: 4105884 - RNA, 18 nt, Streptococcus pneumoniae R6
ucugaugccaucuucgua

SEQ ID NO: 4105885 - RNA, 18 nt, Streptococcus pneumoniae R6
ucugauuccuuuuuucua

SEQ ID NO: 4105886 - RNA, 23 nt, Streptococcus pneumoniae R6
ucugauuuugaaaauuuuuccca

SEQ ID NO: 4105887 - RNA, 23 nt, Streptococcus pneumoniae R6
ucugcaaaaaauauuuauaguaa

SEQ ID NO: 4105888 - RNA, 21 nt, Streptococcus pneumoniae R6
ucugcaaccucuacaauaaca

SEQ ID NO: 4105889 - RNA, 22 nt, Streptococcus pneumoniae R6
ucugcaaccuuaaaacaguguu

SEQ ID NO: 4105890 - RNA, 12 nt, Streptococcus pneumoniae R6
ucugcaaucaag

SEQ ID NO: 4105891 - RNA, 21 nt, Streptococcus pneumoniae R6
ucugcaccugauuucuccgcu

SEQ ID NO: 4105892 - RNA, 13 nt, Streptococcus pneumoniae R6
ucugcacucucau

SEQ ID NO: 4105893 - RNA, 14 nt, Streptococcus pneumoniae R6
ucugcacucucauu

SEQ ID NO: 4105894 - RNA, 20 nt, Streptococcus pneumoniae R6
ucugcauaagcuggucuuuu

SEQ ID NO: 4105895 - RNA, 18 nt, Streptococcus pneumoniae R6
ucugccagaaauucccuc

SEQ ID NO: 4105896 - RNA, 16 nt, Streptococcus pneumoniae R6
ucugccauaucaucgu

SEQ ID NO: 4105897 - RNA, 15 nt, Streptococcus pneumoniae R6
ucugcccaaagacag

SEQ ID NO: 4105898 - RNA, 21 nt, Streptococcus pneumoniae R6
ucugccgccauacuuucucug

SEQ ID NO: 4105899 - RNA, 15 nt, Streptococcus pneumoniae R6
ucugccuuccuuguc

SEQ ID NO: 4105900 - RNA, 17 nt, Streptococcus pneumoniae R6
ucugcggauaaaaccug

SEQ ID NO: 4105901 - RNA, 14 nt, Streptococcus pneumoniae R6
ucugcuaacugcug

SEQ ID NO: 4105902 - RNA, 18 nt, Streptococcus pneumoniae R6
ucugcuagacuaacuucu

SEQ ID NO: 4105903 - RNA, 19 nt, Streptococcus pneumoniae R6
ucugcuagacuaacuucuu

SEQ ID NO: 4105904 - RNA, 18 nt, Streptococcus pneumoniae R6
ucugcuccauaggcagcu

SEQ ID NO: 4105905 - RNA, 14 nt, Streptococcus pneumoniae R6
ucugcucuccaucu

SEQ ID NO: 4105906 - RNA, 16 nt, Streptococcus pneumoniae R6
ucugcucuccaucuug

SEQ ID NO: 4105907 - RNA, 16 nt, Streptococcus pneumoniae R6
ucugcugcgucugucu

SEQ ID NO: 4105908 - RNA, 15 nt, Streptococcus pneumoniae R6
ucugcugucagcaau

SEQ ID NO: 4105909 - RNA, 20 nt, Streptococcus pneumoniae R6
ucugcugucagcaauuccuu

SEQ ID NO: 4105910 - RNA, 14 nt, Streptococcus pneumoniae R6
ucugcuucuaaaac

SEQ ID NO: 4105911 - RNA, 15 nt, Streptococcus pneumoniae R6
ucugcuucuaaaaca

SEQ ID NO: 4105912 - RNA, 17 nt, Streptococcus pneumoniae R6
ucugcuucuaaaacauu

SEQ ID NO: 4105913 - RNA, 12 nt, Streptococcus pneumoniae R6
ucugcuucuuuu

SEQ ID NO: 4105914 - RNA, 19 nt, Streptococcus pneumoniae R6
ucugcuuucaaaaagcauu

SEQ ID NO: 4105915 - RNA, 15 nt, Streptococcus pneumoniae R6
ucuggaagugaaaaa

SEQ ID NO: 4105916 - RNA, 23 nt, Streptococcus pneumoniae R6
ucuggagaagcaccaguugcagu

SEQ ID NO: 4105917 - RNA, 16 nt, Streptococcus pneumoniae R6
ucuggagauuuuucaa

SEQ ID NO: 4105918 - RNA, 18 nt, Streptococcus pneumoniae R6
ucuggauaacugaaauug

SEQ ID NO: 4105919 - RNA, 22 nt, Streptococcus pneumoniae R6
ucuggauaagcuugugaaagcu

SEQ ID NO: 4105920 - RNA, 15 nt, Streptococcus pneumoniae R6
ucuggauauccuuuu

SEQ ID NO: 4105921 - RNA, 18 nt, Streptococcus pneumoniae R6
ucuggaugccauuggaca

SEQ ID NO: 4105922 - RNA, 12 nt, Streptococcus pneumoniae R6
ucuggauuuuca

SEQ ID NO: 4105923 - RNA, 15 nt, Streptococcus pneumoniae R6
ucuggauuuucuccc

SEQ ID NO: 4105924 - RNA, 20 nt, Streptococcus pneumoniae R6
ucuggcaauuuaucuccuac

SEQ ID NO: 4105925 - RNA, 24 nt, Streptococcus pneumoniae R6
ucuggcacagaaacaccuuuauca

SEQ ID NO: 4105926 - RNA, 16 nt, Streptococcus pneumoniae R6
ucuggcagauuuugaa

SEQ ID NO: 4105927 - RNA, 19 nt, Streptococcus pneumoniae R6
ucuggcagauuuugaagau

SEQ ID NO: 4105928 - RNA, 13 nt, Streptococcus pneumoniae R6
ucuggcaggcuga

SEQ ID NO: 4105929 - RNA, 15 nt, Streptococcus pneumoniae R6
ucugggaaaaauuuu

SEQ ID NO: 4105930 - RNA, 14 nt, Streptococcus pneumoniae R6
ucugggaagacugu

SEQ ID NO: 4105931 - RNA, 19 nt, Streptococcus pneumoniae R6
ucugggauggucacagaac

SEQ ID NO: 4105932 - RNA, 18 nt, Streptococcus pneumoniae R6
ucugggauuacaagaccg

SEQ ID NO: 4105933 - RNA, 14 nt, Streptococcus pneumoniae R6
ucugggcuaauucu

SEQ ID NO: 4105934 - RNA, 18 nt, Streptococcus pneumoniae R6
ucuggguacucuuuuuuc

SEQ ID NO: 4105935 - RNA, 22 nt, Streptococcus pneumoniae R6
ucuggucuagcuauuucuugcu

SEQ ID NO: 4105936 - RNA, 18 nt, Streptococcus pneumoniae R6
ucuggucuuaagacaccu

SEQ ID NO: 4105937 - RNA, 13 nt, Streptococcus pneumoniae R6
ucuggugcuggaa

SEQ ID NO: 4105938 - RNA, 14 nt, Streptococcus pneumoniae R6
ucuguaaaacucuu

SEQ ID NO: 4105939 - RNA, 21 nt, Streptococcus pneumoniae R6
ucuguaaaaucaggaagguca

SEQ ID NO: 4105940 - RNA, 18 nt, Streptococcus pneumoniae R6
ucuguaagucauuuucuu

SEQ ID NO: 4105941 - RNA, 16 nt, Streptococcus pneumoniae R6
ucuguaauauacaugu

SEQ ID NO: 4105942 - RNA, 15 nt, Streptococcus pneumoniae R6
ucuguaauaugaaca

SEQ ID NO: 4105943 - RNA, 23 nt, Streptococcus pneumoniae R6
ucuguaauaugaacaaaaccugg

SEQ ID NO: 4105944 - RNA, 18 nt, Streptococcus pneumoniae R6
ucuguaccgaccuugucu

SEQ ID NO: 4105945 - RNA, 20 nt, Streptococcus pneumoniae R6
ucuguagaauugcugucaaa

SEQ ID NO: 4105946 - RNA, 19 nt, Streptococcus pneumoniae R6
ucuguagagaguuaaaaaa

SEQ ID NO: 4105947 - RNA, 22 nt, Streptococcus pneumoniae R6
ucuguauaggucuggcuauuuu

SEQ ID NO: 4105948 - RNA, 16 nt, Streptococcus pneumoniae R6
ucuguauuuggcauug

SEQ ID NO: 4105949 - RNA, 13 nt, Streptococcus pneumoniae R6
ucugucaaaccau

SEQ ID NO: 4105950 - RNA, 16 nt, Streptococcus pneumoniae R6
ucugucaccuuaucac

SEQ ID NO: 4105951 - RNA, 14 nt, Streptococcus pneumoniae R6
ucuucuucgucaaa

SEQ ID NO: 4105952 - RNA, 17 nt, Streptococcus pneumoniae R6
ucuucuugguauuccuu

SEQ ID NO: 4105953 - RNA, 15 nt, Streptococcus pneumoniae R6
ucuucuuuauaauau

SEQ ID NO: 4105954 - RNA, 22 nt, Streptococcus pneumoniae R6
ucuucuuugauggaguuuucaa

SEQ ID NO: 4105955 - RNA, 11 nt, Streptococcus pneumoniae R6
ucuucuuuucu

SEQ ID NO: 4105956 - RNA, 18 nt, Streptococcus pneumoniae R6
ucuucuuuuuguccuucu

SEQ ID NO: 4105957 - RNA, 12 nt, Streptococcus pneumoniae R6
ucuugaaaugaa

SEQ ID NO: 4105958 - RNA, 16 nt, Streptococcus pneumoniae R6
ucuugaaaugaaguua

SEQ ID NO: 4105959 - RNA, 19 nt, Streptococcus pneumoniae R6
ucuugaacugcauuuuuuc

SEQ ID NO: 4105960 - RNA, 19 nt, Streptococcus pneumoniae R6
ucuugaagacuuuuuaaag

SEQ ID NO: 4105961 - RNA, 21 nt, Streptococcus pneumoniae R6
ucuugaauuuacguccuugga

SEQ ID NO: 4105962 - RNA, 19 nt, Streptococcus pneumoniae R6
ucuugacaaagaaaaaaca

SEQ ID NO: 4105963 - RNA, 23 nt, Streptococcus pneumoniae R6
ucuugacauacaacuuaaaaaga

SEQ ID NO: 4105964 - RNA, 14 nt, Streptococcus pneumoniae R6
ucuugagacgauga

SEQ ID NO: 4105965 - RNA, 18 nt, Streptococcus pneumoniae R6
ucuugagcgauuuuaaug

SEQ ID NO: 4105966 - RNA, 20 nt, Streptococcus pneumoniae R6
ucuugaggaagagcuuugcu

SEQ ID NO: 4105967 - RNA, 21 nt, Streptococcus pneumoniae R6
ucuugaggaagagcuuugcuu

SEQ ID NO: 4105968 - RNA, 20 nt, Streptococcus pneumoniae R6
ucuugaguaaguuuaauguc

SEQ ID NO: 4105969 - RNA, 22 nt, Streptococcus pneumoniae R6
ucuugaguaaguuuaaugucca

SEQ ID NO: 4105970 - RNA, 13 nt, Streptococcus pneumoniae R6
ucuugaugaaaga

SEQ ID NO: 4105971 - RNA, 21 nt, Streptococcus pneumoniae R6
ucuugauggacaacaaugaga

SEQ ID NO: 4105972 - RNA, 22 nt, Streptococcus pneumoniae R6
ucuugauggacaacaaugagaa

SEQ ID NO: 4105973 - RNA, 15 nt, Streptococcus pneumoniae R6
ucuugaugucuugga

SEQ ID NO: 4105974 - RNA, 20 nt, Streptococcus pneumoniae R6
ucuugauuuaggguacuuuc

SEQ ID NO: 4105975 - RNA, 14 nt, Streptococcus pneumoniae R6
ucuugauuuucauu

SEQ ID NO: 4105976 - RNA, 16 nt, Streptococcus pneumoniae R6
ucuugauuuucuuuaa

SEQ ID NO: 4105977 - RNA, 12 nt, Streptococcus pneumoniae R6
ucuugcccugug

SEQ ID NO: 4105978 - RNA, 14 nt, Streptococcus pneumoniae R6
ucuugcgaagugau

SEQ ID NO: 4105979 - RNA, 19 nt, Streptococcus pneumoniae R6
ucuugcgaagugauaauga

SEQ ID NO: 4105980 - RNA, 21 nt, Streptococcus pneumoniae R6
ucuugcgaagugauaaugauu

SEQ ID NO: 4105981 - RNA, 19 nt, Streptococcus pneumoniae R6
ucuugcgcagucagugguu

SEQ ID NO: 4105982 - RNA, 16 nt, Streptococcus pneumoniae R6
ucuugcgcucaagcac

SEQ ID NO: 4105983 - RNA, 22 nt, Streptococcus pneumoniae R6
ucuugcucgaccaagccagcau

SEQ ID NO: 4105984 - RNA, 18 nt, Streptococcus pneumoniae R6
ucuugcugguuugugaag

SEQ ID NO: 4105985 - RNA, 13 nt, Streptococcus pneumoniae R6
ucuugcuugcuac

SEQ ID NO: 4105986 - RNA, 21 nt, Streptococcus pneumoniae R6
ucuuggauuuuugauucagua

SEQ ID NO: 4105987 - RNA, 21 nt, Streptococcus pneumoniae R6
ucuuggcaaaguuuuugguaa

SEQ ID NO: 4105988 - RNA, 23 nt, Streptococcus pneumoniae R6
ucuuggcuaauuucaagaaguug

SEQ ID NO: 4105989 - RNA, 23 nt, Streptococcus pneumoniae R6
ucuugggcuggacguucuucaag

SEQ ID NO: 4105990 - RNA, 16 nt, Streptococcus pneumoniae R6
ucuuggguuucuucua

SEQ ID NO: 4105991 - RNA, 16 nt, Streptococcus pneumoniae R6
ucuuguaaaaccuuuu

SEQ ID NO: 4105992 - RNA, 14 nt, Streptococcus pneumoniae R6
ucuuguauucgcuu

SEQ ID NO: 4105993 - RNA, 21 nt, Streptococcus pneumoniae R6
ucuuguauucgcuuacauaaa

SEQ ID NO: 4105994 - RNA, 14 nt, Streptococcus pneumoniae R6
ucuuguccuaaaua

SEQ ID NO: 4105995 - RNA, 20 nt, Streptococcus pneumoniae R6
ucuuguccuaaauagaagau

SEQ ID NO: 4105996 - RNA, 18 nt, Streptococcus pneumoniae R6
ucuugucgauguuuuggu

SEQ ID NO: 4105997 - RNA, 17 nt, Streptococcus pneumoniae R6
ucuugucguugaaaaag

SEQ ID NO: 4105998 - RNA, 21 nt, Streptococcus pneumoniae R6
ucuugugaauagcucaaaagc

SEQ ID NO: 4105999 - RNA, 16 nt, Streptococcus pneumoniae R6
ucuugugagaauauuu

SEQ ID NO: 4106000 - RNA, 18 nt, Streptococcus pneumoniae R6
ucuugugcugacauugaa

SEQ ID NO: 4106001 - RNA, 22 nt, Streptococcus pneumoniae R6
ucuuguggagacagcaccaacu

SEQ ID NO: 4106002 - RNA, 14 nt, Streptococcus pneumoniae R6
ucuuguguuuaaau

SEQ ID NO: 4106003 - RNA, 16 nt, Streptococcus pneumoniae R6
ucuuguucuuguuuca

SEQ ID NO: 4106004 - RNA, 14 nt, Streptococcus pneumoniae R6
ucuuuaaaaaauuu

SEQ ID NO: 4106005 - RNA, 13 nt, Streptococcus pneumoniae R6
ucuuuaaaaucug

SEQ ID NO: 4106006 - RNA, 14 nt, Streptococcus pneumoniae R6
ucuuuaaaaucuga

SEQ ID NO: 4106007 - RNA, 13 nt, Streptococcus pneumoniae R6
ucuuuaaacuuuu

SEQ ID NO: 4106008 - RNA, 14 nt, Streptococcus pneumoniae R6
ucuuuaacaaaauc

SEQ ID NO: 4106009 - RNA, 16 nt, Streptococcus pneumoniae R6
ucuuuaacuacuugau

SEQ ID NO: 4106010 - RNA, 13 nt, Streptococcus pneumoniae R6
ucuuuaaugucua

SEQ ID NO: 4106011 - RNA, 23 nt, Streptococcus pneumoniae R6
ucuuuacaugcgcaaaauaauuu

SEQ ID NO: 4106012 - RNA, 22 nt, Streptococcus pneumoniae R6
ucuuuacguccaccacaaaaga

SEQ ID NO: 4106013 - RNA, 12 nt, Streptococcus pneumoniae R6
ucuuuacuucug

SEQ ID NO: 4106014 - RNA, 22 nt, Streptococcus pneumoniae R6
ucuuuagaaaacuaguuuaaau

SEQ ID NO: 4106015 - RNA, 16 nt, Streptococcus pneumoniae R6
ucuuuagagagaugaa

SEQ ID NO: 4106016 - RNA, 14 nt, Streptococcus pneumoniae R6
ucuuuagcagagaa

SEQ ID NO: 4106017 - RNA, 16 nt, Streptococcus pneumoniae R6
ucuuuagcauaauagc

SEQ ID NO: 4106018 - RNA, 20 nt, Streptococcus pneumoniae R6
ucuuuagggaaauuauuuau

SEQ ID NO: 4106019 - RNA, 14 nt, Streptococcus pneumoniae R6
ucuuuauuagcaua

SEQ ID NO: 4106020 - RNA, 20 nt, Streptococcus pneumoniae R6
ucuuuauuuucguauggcaa

SEQ ID NO: 4106021 - RNA, 13 nt, Streptococcus pneumoniae R6
ucuuucaaagccu

SEQ ID NO: 4106022 - RNA, 20 nt, Streptococcus pneumoniae R6
ucuuuccuuagauagcgcau

SEQ ID NO: 4106023 - RNA, 13 nt, Streptococcus pneumoniae R6
ucuuucucaaaca

SEQ ID NO: 4106024 - RNA, 17 nt, Streptococcus pneumoniae R6
ucuuucuuauccguuuu

SEQ ID NO: 4106025 - RNA, 19 nt, Streptococcus pneumoniae R6
ucuuugaaauaaucaaaau

SEQ ID NO: 4106026 - RNA, 13 nt, Streptococcus pneumoniae R6
ucuuugaaaucag

SEQ ID NO: 4106027 - RNA, 12 nt, Streptococcus pneumoniae R6
ucuuugacaccg

SEQ ID NO: 4106028 - RNA, 15 nt, Streptococcus pneumoniae R6
ucuuugauaagauaa

SEQ ID NO: 4106029 - RNA, 17 nt, Streptococcus pneumoniae R6
ucuuugauuuacuauua

SEQ ID NO: 4106030 - RNA, 14 nt, Streptococcus pneumoniae R6
ucuuugauuucuug

SEQ ID NO: 4106031 - RNA, 14 nt, Streptococcus pneumoniae R6
ucuuugauuuuaau

SEQ ID NO: 4106032 - RNA, 18 nt, Streptococcus pneumoniae R6
ucuuugauuuuaaugcua

SEQ ID NO: 4106033 - RNA, 17 nt, Streptococcus pneumoniae R6
ucuuugauuuucauuga

SEQ ID NO: 4106034 - RNA, 17 nt, Streptococcus pneumoniae R6
ucuuugccaguucuuca

SEQ ID NO: 4106035 - RNA, 23 nt, Streptococcus pneumoniae R6
ucuuuggcaccuuuguauggaaa

SEQ ID NO: 4106036 - RNA, 19 nt, Streptococcus pneumoniae R6
ucuuuggucaauccgaguu

SEQ ID NO: 4106037 - RNA, 16 nt, Streptococcus pneumoniae R6
ucuuugucaacuguag

SEQ ID NO: 4106038 - RNA, 20 nt, Streptococcus pneumoniae R6
ucuuuguuaaaugaauauau

SEQ ID NO: 4106039 - RNA, 19 nt, Streptococcus pneumoniae R6
ucuuuguuaagaauaucca

SEQ ID NO: 4106040 - RNA, 14 nt, Streptococcus pneumoniae R6
ucuuuuaacuaauu

SEQ ID NO: 4106041 - RNA, 15 nt, Streptococcus pneumoniae R6
ucuuuuacacucaau

SEQ ID NO: 4106042 - RNA, 12 nt, Streptococcus pneumoniae R6
ucuuuuacuucu

SEQ ID NO: 4106043 - RNA, 15 nt, Streptococcus pneumoniae R6
ucuuuuacuucuuug

SEQ ID NO: 4106044 - RNA, 14 nt, Streptococcus pneumoniae R6
ucuuuucaagaacu

SEQ ID NO: 4106045 - RNA, 16 nt, Streptococcus pneumoniae R6
ucuuuucauaaagaga

SEQ ID NO: 4106046 - RNA, 14 nt, Streptococcus pneumoniae R6
ucuuuucaucucuu

SEQ ID NO: 4106047 - RNA, 21 nt, Streptococcus pneumoniae R6
ucuuuucauuccaaacgucug

SEQ ID NO: 4106048 - RNA, 16 nt, Streptococcus pneumoniae R6
ucuuuuccaaacauac

SEQ ID NO: 4106049 - RNA, 22 nt, Streptococcus pneumoniae R6
ucuuuucgauaaaaaauaaaca

SEQ ID NO: 4106050 - RNA, 16 nt, Streptococcus pneumoniae R6
ucuuuucuuuuaguga

SEQ ID NO: 4106051 - RNA, 12 nt, Streptococcus pneumoniae R6
ucuuuugauaga

SEQ ID NO: 4106052 - RNA, 24 nt, Streptococcus pneumoniae R6
ucuuuuguaaaggguucuacaaau

SEQ ID NO: 4106053 - RNA, 17 nt, Streptococcus pneumoniae R6
ucuuuuuaaauaaaucu

SEQ ID NO: 4106054 - RNA, 23 nt, Streptococcus pneumoniae R6
ugaacaucuuuuggacucacuaa

SEQ ID NO: 4106055 - RNA, 17 nt, Streptococcus pneumoniae R6
ugaacauguccauucau

SEQ ID NO: 4106056 - RNA, 21 nt, Streptococcus pneumoniae R6
ugaaccucuucauucaaagaa

SEQ ID NO: 4106057 - RNA, 23 nt, Streptococcus pneumoniae R6
ugaaccugauuggccgcaagcag

SEQ ID NO: 4106058 - RNA, 15 nt, Streptococcus pneumoniae R6
ugaaccuuucuucau

SEQ ID NO: 4106059 - RNA, 17 nt, Streptococcus pneumoniae R6
ugaacggagauaguacc

SEQ ID NO: 4106060 - RNA, 17 nt, Streptococcus pneumoniae R6
ugaacgucuaaacugua

SEQ ID NO: 4106061 - RNA, 23 nt, Streptococcus pneumoniae R6
ugaacucagguccuuucuuuuuu

SEQ ID NO: 4106062 - RNA, 16 nt, Streptococcus pneumoniae R6
ugaacugcauuuuuuc

SEQ ID NO: 4106063 - RNA, 23 nt, Streptococcus pneumoniae R6
ugaacugccccccaaaaguuaga

SEQ ID NO: 4106064 - RNA, 15 nt, Streptococcus pneumoniae R6
ugaacugcugccgca

SEQ ID NO: 4106065 - RNA, 18 nt, Streptococcus pneumoniae R6
ugaacugcuugagcugcu

SEQ ID NO: 4106066 - RNA, 20 nt, Streptococcus pneumoniae R6
ugaacuugaccuaaaucacu

SEQ ID NO: 4106067 - RNA, 15 nt, Streptococcus pneumoniae R6
ugaacuuuuucuaac

SEQ ID NO: 4106068 - RNA, 23 nt, Streptococcus pneumoniae R6
ugaacuuuuucuaacaucuuuug

SEQ ID NO: 4106069 - RNA, 16 nt, Streptococcus pneumoniae R6
ugaagaaaagcuaagc

SEQ ID NO: 4106070 - RNA, 18 nt, Streptococcus pneumoniae R6
ugaagaaagcaauuuuaa

SEQ ID NO: 4106071 - RNA, 23 nt, Streptococcus pneumoniae R6
ugaagaaagcgaagaucuagaaa

SEQ ID NO: 4106072 - RNA, 23 nt, Streptococcus pneumoniae R6
ugaagaccacgaugaugauugga

SEQ ID NO: 4106073 - RNA, 21 nt, Streptococcus pneumoniae R6
ugaagacuuuuauccaccuau

SEQ ID NO: 4106074 - RNA, 23 nt, Streptococcus pneumoniae R6
ugaagauaguaaaggacaccagc

SEQ ID NO: 4106075 - RNA, 15 nt, Streptococcus pneumoniae R6
ugaagauugauaaag

SEQ ID NO: 4106076 - RNA, 17 nt, Streptococcus pneumoniae R6
ugaagauugauaaaggc

SEQ ID NO: 4106077 - RNA, 14 nt, Streptococcus pneumoniae R6
ugaagcaaacauuc

SEQ ID NO: 4106078 - RNA, 19 nt, Streptococcus pneumoniae R6
ugaagcaaacauucccaca

SEQ ID NO: 4106079 - RNA, 20 nt, Streptococcus pneumoniae R6
ugaagcaucaaauccuucag

SEQ ID NO: 4106080 - RNA, 22 nt, Streptococcus pneumoniae R6
ugaaggaucauggauuuuucuu

SEQ ID NO: 4106081 - RNA, 16 nt, Streptococcus pneumoniae R6
ugaaggcuuuaaaugc

SEQ ID NO: 4106082 - RNA, 17 nt, Streptococcus pneumoniae R6
ugaaggucuuuugucuu

SEQ ID NO: 4106083 - RNA, 16 nt, Streptococcus pneumoniae R6
ugaaguaaauauuucu

SEQ ID NO: 4106084 - RNA, 19 nt, Streptococcus pneumoniae R6
ugaaguaacgauagcacca

SEQ ID NO: 4106085 - RNA, 19 nt, Streptococcus pneumoniae R6
ugaagucacuacuuccauc

SEQ ID NO: 4106086 - RNA, 15 nt, Streptococcus pneumoniae R6
ugaagucagcuaagc

SEQ ID NO: 4106087 - RNA, 19 nt, Streptococcus pneumoniae R6
ugaagucgaguuuuuuccc

SEQ ID NO: 4106088 - RNA, 21 nt, Streptococcus pneumoniae R6
ugaagucguguuuuuucacau

SEQ ID NO: 4106089 - RNA, 19 nt, Streptococcus pneumoniae R6
ugaagucuagcaauucuug

SEQ ID NO: 4106090 - RNA, 14 nt, Streptococcus pneumoniae R6
ugaaguguuuuuuc

SEQ ID NO: 4106091 - RNA, 18 nt, Streptococcus pneumoniae R6
ugaaguguuuuuucauag

SEQ ID NO: 4106092 - RNA, 20 nt, Streptococcus pneumoniae R6
ugaaguuagguuuuguuucu

SEQ ID NO: 4106093 - RNA, 21 nt, Streptococcus pneumoniae R6
ugaaguuagguuuuguuucuu

SEQ ID NO: 4106094 - RNA, 18 nt, Streptococcus pneumoniae R6
ugaaguucauuuucuuua

SEQ ID NO: 4106095 - RNA, 23 nt, Streptococcus pneumoniae R6
ugaaguucauuuucuuuacuucu

SEQ ID NO: 4106096 - RNA, 17 nt, Streptococcus pneumoniae R6
ugaaguugaaagauuau

SEQ ID NO: 4106097 - RNA, 15 nt, Streptococcus pneumoniae R6
ugaaguuuauuucgu

SEQ ID NO: 4106098 - RNA, 16 nt, Streptococcus pneumoniae R6
ugaaguuuucaaaguu

SEQ ID NO: 4106099 - RNA, 15 nt, Streptococcus pneumoniae R6
ugaauaccuaaucuu

SEQ ID NO: 4106100 - RNA, 21 nt, Streptococcus pneumoniae R6
ugaauaggugguuggaaguag

SEQ ID NO: 4106101 - RNA, 13 nt, Streptococcus pneumoniae R6
ugaauaguaaguu

SEQ ID NO: 4106102 - RNA, 13 nt, Streptococcus pneumoniae R6
ugaauagugaaga

SEQ ID NO: 4106103 - RNA, 14 nt, Streptococcus pneumoniae R6
ugaauauauucucc

SEQ ID NO: 4106104 - RNA, 14 nt, Streptococcus pneumoniae R6
ugaauauccccuga

SEQ ID NO: 4106105 - RNA, 16 nt, Streptococcus pneumoniae R6
ugaauauccuuauaua

SEQ ID NO: 4106106 - RNA, 17 nt, Streptococcus pneumoniae R6
ugaauauggauaauuga

SEQ ID NO: 4106107 - RNA, 14 nt, Streptococcus pneumoniae R6
ugaauauuuuucuu

SEQ ID NO: 4106108 - RNA, 14 nt, Streptococcus pneumoniae R6
ugaaucaaaauuau

SEQ ID NO: 4106109 - RNA, 15 nt, Streptococcus pneumoniae R6
ugaaucauuuccuuc

SEQ ID NO: 4106110 - RNA, 21 nt, Streptococcus pneumoniae R6
ugaaucauuuccuucguuuuc

SEQ ID NO: 4106111 - RNA, 13 nt, Streptococcus pneumoniae R6
ugaaucauuuugu

SEQ ID NO: 4106112 - RNA, 20 nt, Streptococcus pneumoniae R6
ugaauccgaaaaauuucucc

SEQ ID NO: 4106113 - RNA, 18 nt, Streptococcus pneumoniae R6
ugaaucuaaaauaguacg

SEQ ID NO: 4106114 - RNA, 23 nt, Streptococcus pneumoniae R6
ugaaucuaaaauaguacgaaaca

SEQ ID NO: 4106115 - RNA, 17 nt, Streptococcus pneumoniae R6
ugaaucuaguaaagcua

SEQ ID NO: 4106116 - RNA, 17 nt, Streptococcus pneumoniae R6
ugaaucuccucaggaac

SEQ ID NO: 4106117 - RNA, 14 nt, Streptococcus pneumoniae R6
ugaaucugaaauag

SEQ ID NO: 4106118 - RNA, 18 nt, Streptococcus pneumoniae R6
ugaaucugaaauaguacg

SEQ ID NO: 4106119 - RNA, 23 nt, Streptococcus pneumoniae R6
ugaaucugaaauaguacgaaaca

SEQ ID NO: 4106120 - RNA, 16 nt, Streptococcus pneumoniae R6
ugaaucugaaucaaaa

SEQ ID NO: 4106121 - RNA, 17 nt, Streptococcus pneumoniae R6
ugaaucugaaucaaaau

SEQ ID NO: 4106122 - RNA, 23 nt, Streptococcus pneumoniae R6
ugaaucugccucaagaagugguu

SEQ ID NO: 4106123 - RNA, 21 nt, Streptococcus pneumoniae R6
ugaaugacaaauccauucuuu

SEQ ID NO: 4106124 - RNA, 16 nt, Streptococcus pneumoniae R6
ugaaugauaaaacaua

SEQ ID NO: 4106125 - RNA, 18 nt, Streptococcus pneumoniae R6
ugaaugcucccuucuuua

SEQ ID NO: 4106126 - RNA, 23 nt, Streptococcus pneumoniae R6
ugaaugcuuacuucacuucugua

SEQ ID NO: 4106127 - RNA, 21 nt, Streptococcus pneumoniae R6
ugaauggauuuaucaguauau

SEQ ID NO: 4106128 - RNA, 17 nt, Streptococcus pneumoniae R6
ugaauggccuccuucau

SEQ ID NO: 4106129 - RNA, 21 nt, Streptococcus pneumoniae R6
ugaauuagcaaucacucuaac

SEQ ID NO: 4106130 - RNA, 14 nt, Streptococcus pneumoniae R6
ugaauuagugaagu

SEQ ID NO: 4106131 - RNA, 16 nt, Streptococcus pneumoniae R6
ugaauucccuuacucu

SEQ ID NO: 4106132 - RNA, 12 nt, Streptococcus pneumoniae R6
ugaauucuaaug

SEQ ID NO: 4106133 - RNA, 22 nt, Streptococcus pneumoniae R6
ugaauucuccaaucaaauugug

SEQ ID NO: 4106134 - RNA, 20 nt, Streptococcus pneumoniae R6
ugaauucuccauuuuggaua

SEQ ID NO: 4106135 - RNA, 13 nt, Streptococcus pneumoniae R6
ugaauugaaauaa

SEQ ID NO: 4106136 - RNA, 20 nt, Streptococcus pneumoniae R6
ugaauuggauuguuaaacaa

SEQ ID NO: 4106137 - RNA, 23 nt, Streptococcus pneumoniae R6
ugaauuucaagaaugaaaguuua

SEQ ID NO: 4106138 - RNA, 16 nt, Streptococcus pneumoniae R6
ugaauuucaugguucg

SEQ ID NO: 4106139 - RNA, 13 nt, Streptococcus pneumoniae R6
ugaauuucuacaa

SEQ ID NO: 4106140 - RNA, 22 nt, Streptococcus pneumoniae R6
ugaauuucuacaaauguuuuag

SEQ ID NO: 4106141 - RNA, 14 nt, Streptococcus pneumoniae R6
ugaauuugaaacaa

SEQ ID NO: 4106142 - RNA, 18 nt, Streptococcus pneumoniae R6
ugaauuugaaacaaugaa

SEQ ID NO: 4106143 - RNA, 20 nt, Streptococcus pneumoniae R6
ugaauuugaaacaaugaaaa

SEQ ID NO: 4106144 - RNA, 18 nt, Streptococcus pneumoniae R6
ugaauuuucuaauugauu

SEQ ID NO: 4106145 - RNA, 15 nt, Streptococcus pneumoniae R6
ugacaaaauaaaaac

SEQ ID NO: 4106146 - RNA, 16 nt, Streptococcus pneumoniae R6
ugacaaagaaaaaaca

SEQ ID NO: 4106147 - RNA, 17 nt, Streptococcus pneumoniae R6
ugacaaagagccaaaaa

SEQ ID NO: 4106148 - RNA, 19 nt, Streptococcus pneumoniae R6
ugacaaagagccaaaaaag

SEQ ID NO: 4106149 - RNA, 20 nt, Streptococcus pneumoniae R6
ugacaaagagccaaaaaaga

SEQ ID NO: 4106150 - RNA, 15 nt, Streptococcus pneumoniae R6
ugacaaagagccaga

SEQ ID NO: 4106151 - RNA, 22 nt, Streptococcus pneumoniae R6
ugacaaagagccauaaaaauaa

SEQ ID NO: 4106152 - RNA, 19 nt, Streptococcus pneumoniae R6
ugacaaagagccccuuucu

SEQ ID NO: 4106153 - RNA, 22 nt, Streptococcus pneumoniae R6
ugacaaagagccgaaaaaauag

SEQ ID NO: 4106154 - RNA, 16 nt, Streptococcus pneumoniae R6
ugacaaauccauucuu

SEQ ID NO: 4106155 - RNA, 20 nt, Streptococcus pneumoniae R6
ugacaaaucuaagucaaaua

SEQ ID NO: 4106156 - RNA, 16 nt, Streptococcus pneumoniae R6
ugagauaaucugcaaa

SEQ ID NO: 4106157 - RNA, 21 nt, Streptococcus pneumoniae R6
ugagauaguaucaaaugacua

SEQ ID NO: 4106158 - RNA, 21 nt, Streptococcus pneumoniae R6
ugagaucuucuucuagaaaca

SEQ ID NO: 4106159 - RNA, 16 nt, Streptococcus pneumoniae R6
ugagaugacaacaugg

SEQ ID NO: 4106160 - RNA, 14 nt, Streptococcus pneumoniae R6
ugagaugagacagc

SEQ ID NO: 4106161 - RNA, 13 nt, Streptococcus pneumoniae R6
ugagaugaggcgc

SEQ ID NO: 4106162 - RNA, 17 nt, Streptococcus pneumoniae R6
ugagauggauuuuccuu

SEQ ID NO: 4106163 - RNA, 21 nt, Streptococcus pneumoniae R6
ugagauuacugauaaaacuga

SEQ ID NO: 4106164 - RNA, 23 nt, Streptococcus pneumoniae R6
ugagauuauugguggcuuccagu

SEQ ID NO: 4106165 - RNA, 16 nt, Streptococcus pneumoniae R6
ugagauuggauuuucu

SEQ ID NO: 4106166 - RNA, 22 nt, Streptococcus pneumoniae R6
ugagauuucacgguaauuguuu

SEQ ID NO: 4106167 - RNA, 16 nt, Streptococcus pneumoniae R6
ugagauuuuggaagag

SEQ ID NO: 4106168 - RNA, 17 nt, Streptococcus pneumoniae R6
ugagcaaccugcggcua

SEQ ID NO: 4106169 - RNA, 18 nt, Streptococcus pneumoniae R6
ugagcaagucucuccagc

SEQ ID NO: 4106170 - RNA, 19 nt, Streptococcus pneumoniae R6
ugagcaaguucaagacuug

SEQ ID NO: 4106171 - RNA, 14 nt, Streptococcus pneumoniae R6
ugagcaauuccuuc

SEQ ID NO: 4106172 - RNA, 16 nt, Streptococcus pneumoniae R6
ugagcaauuugacgaa

SEQ ID NO: 4106173 - RNA, 18 nt, Streptococcus pneumoniae R6
ugagcagaacaaugacuc

SEQ ID NO: 4106174 - RNA, 12 nt, Streptococcus pneumoniae R6
ugagcauacugc

SEQ ID NO: 4106175 - RNA, 17 nt, Streptococcus pneumoniae R6
ugagccacaacuuuuaa

SEQ ID NO: 4106176 - RNA, 20 nt, Streptococcus pneumoniae R6
ugagccuagugucucaaagu

SEQ ID NO: 4106177 - RNA, 15 nt, Streptococcus pneumoniae R6
ugagcuaauuuugcc

SEQ ID NO: 4106178 - RNA, 14 nt, Streptococcus pneumoniae R6
ugagcuauuagaug

SEQ ID NO: 4106179 - RNA, 21 nt, Streptococcus pneumoniae R6
ugagcuccguacgcuccugaa

SEQ ID NO: 4106180 - RNA, 13 nt, Streptococcus pneumoniae R6
ugagcuggaagaa

SEQ ID NO: 4106181 - RNA, 11 nt, Streptococcus pneumoniae R6
ugagcuggcuc

SEQ ID NO: 4106182 - RNA, 13 nt, Streptococcus pneumoniae R6
ugaggaaagaaug

SEQ ID NO: 4106183 - RNA, 17 nt, Streptococcus pneumoniae R6
ugaggaaguaccaagga

SEQ ID NO: 4106184 - RNA, 21 nt, Streptococcus pneumoniae R6
ugaggaaguaccaaggaagaa

SEQ ID NO: 4106185 - RNA, 23 nt, Streptococcus pneumoniae R6
ugaggacaauagcgaguaggcug

SEQ ID NO: 4106186 - RNA, 20 nt, Streptococcus pneumoniae R6
ugaggaccgacaccaguauu

SEQ ID NO: 4106187 - RNA, 15 nt, Streptococcus pneumoniae R6
ugaggagaaagaaga

SEQ ID NO: 4106188 - RNA, 14 nt, Streptococcus pneumoniae R6
ugaggagauuggaa

SEQ ID NO: 4106189 - RNA, 16 nt, Streptococcus pneumoniae R6
ugaggagcgaggccgc

SEQ ID NO: 4106190 - RNA, 13 nt, Streptococcus pneumoniae R6
ugaggaguuucaa

SEQ ID NO: 4106191 - RNA, 17 nt, Streptococcus pneumoniae R6
ugaggauggcuuucuuu

SEQ ID NO: 4106192 - RNA, 19 nt, Streptococcus pneumoniae R6
ugaggauggcuuucuuuca

SEQ ID NO: 4106193 - RNA, 20 nt, Streptococcus pneumoniae R6
ugaggauggcuuucuuucaa

SEQ ID NO: 4106194 - RNA, 17 nt, Streptococcus pneumoniae R6
ugagggcuagacggcug

SEQ ID NO: 4106195 - RNA, 13 nt, Streptococcus pneumoniae R6
ugagguaauuaug

SEQ ID NO: 4106196 - RNA, 21 nt, Streptococcus pneumoniae R6
ugagguuuuagauaagacuga

SEQ ID NO: 4106197 - RNA, 19 nt, Streptococcus pneumoniae R6
ugaguaacggcuuccugug

SEQ ID NO: 4106198 - RNA, 18 nt, Streptococcus pneumoniae R6
ugaguaccagauauacca

SEQ ID NO: 4106199 - RNA, 13 nt, Streptococcus pneumoniae R6
ugaguauaaaugg

SEQ ID NO: 4106200 - RNA, 13 nt, Streptococcus pneumoniae R6
ugaguauaagguu

SEQ ID NO: 4106201 - RNA, 16 nt, Streptococcus pneumoniae R6
ugaguaugaaaagaga

SEQ ID NO: 4106202 - RNA, 15 nt, Streptococcus pneumoniae R6
ugaguauuauuucau

SEQ ID NO: 4106203 - RNA, 17 nt, Streptococcus pneumoniae R6
ugaguauuuagcaacca

SEQ ID NO: 4106204 - RNA, 20 nt, Streptococcus pneumoniae R6
ugaguauuuagcaaccauuu

SEQ ID NO: 4106205 - RNA, 19 nt, Streptococcus pneumoniae R6
ugaguauuuuauaguaauu

SEQ ID NO: 4106206 - RNA, 18 nt, Streptococcus pneumoniae R6
ugagucagggaaaaaacu

SEQ ID NO: 4106207 - RNA, 22 nt, Streptococcus pneumoniae R6
ugaguccauaggcugcuagugu

SEQ ID NO: 4106208 - RNA, 16 nt, Streptococcus pneumoniae R6
ugagucguucucuuau

SEQ ID NO: 4106209 - RNA, 15 nt, Streptococcus pneumoniae R6
ugagucuauucccug

SEQ ID NO: 4106210 - RNA, 19 nt, Streptococcus pneumoniae R6
ugaguggaaaaaccuucaa

SEQ ID NO: 4106211 - RNA, 23 nt, Streptococcus pneumoniae R6
ugaguggaaaaaccuucaagcuu

SEQ ID NO: 4106212 - RNA, 22 nt, Streptococcus pneumoniae R6
ugaguggauuagguguauuuag

SEQ ID NO: 4106213 - RNA, 15 nt, Streptococcus pneumoniae R6
ugaguggauuuuucg

SEQ ID NO: 4106214 - RNA, 20 nt, Streptococcus pneumoniae R6
ugaguguaaaaagaaagucc

SEQ ID NO: 4106215 - RNA, 21 nt, Streptococcus pneumoniae R6
ugaguucaucuggaguagcau

SEQ ID NO: 4106216 - RNA, 18 nt, Streptococcus pneumoniae R6
ugaguucauuaugauuug

SEQ ID NO: 4106217 - RNA, 17 nt, Streptococcus pneumoniae R6
ugaguucuucaacaaug

SEQ ID NO: 4106218 - RNA, 18 nt, Streptococcus pneumoniae R6
ugaguucuuuaacaaaga

SEQ ID NO: 4106219 - RNA, 19 nt, Streptococcus pneumoniae R6
ugaguuuggcuucaguaau

SEQ ID NO: 4106220 - RNA, 21 nt, Streptococcus pneumoniae R6
ugaguuuuacaauguaauauu

SEQ ID NO: 4106221 - RNA, 23 nt, Streptococcus pneumoniae R6
ugaguuuugcccauucuuuagca

SEQ ID NO: 4106222 - RNA, 23 nt, Streptococcus pneumoniae R6
ugaguuuuugaagaauguuuuca

SEQ ID NO: 4106223 - RNA, 17 nt, Streptococcus pneumoniae R6
ugaguuuuuugacuuca

SEQ ID NO: 4106224 - RNA, 19 nt, Streptococcus pneumoniae R6
ugauaaaacgcauaaaauc

SEQ ID NO: 4106225 - RNA, 21 nt, Streptococcus pneumoniae R6
ugauaaaaggcuuagccaguc

SEQ ID NO: 4106226 - RNA, 18 nt, Streptococcus pneumoniae R6
ugauaaaauuuaaaaaua

SEQ ID NO: 4106227 - RNA, 15 nt, Streptococcus pneumoniae R6
ugauaaaguuucugu

SEQ ID NO: 4106228 - RNA, 23 nt, Streptococcus pneumoniae R6
ugauaacagcugcgauuuuagca

SEQ ID NO: 4106229 - RNA, 20 nt, Streptococcus pneumoniae R6
ugauaacauugacaucugug

SEQ ID NO: 4106230 - RNA, 18 nt, Streptococcus pneumoniae R6
ugauaaccacagacugag

SEQ ID NO: 4106231 - RNA, 16 nt, Streptococcus pneumoniae R6
ugauaacgaagagcug

SEQ ID NO: 4106232 - RNA, 19 nt, Streptococcus pneumoniae R6
ugauaagaauaucaagaua

SEQ ID NO: 4106233 - RNA, 19 nt, Streptococcus pneumoniae R6
ugauaagaggauuuuaaag

SEQ ID NO: 4106234 - RNA, 16 nt, Streptococcus pneumoniae R6
ugauaagauaaagugg

SEQ ID NO: 4106235 - RNA, 20 nt, Streptococcus pneumoniae R6
ugauaagauaaggcaucuua

SEQ ID NO: 4106236 - RNA, 18 nt, Streptococcus pneumoniae R6
ugauaagauuuuuggaaa

SEQ ID NO: 4106237 - RNA, 19 nt, Streptococcus pneumoniae R6
ugauaagauuuuuggaaaa

SEQ ID NO: 4106238 - RNA, 23 nt, Streptococcus pneumoniae R6
ugauaagauuuuuggaaaaaaua

SEQ ID NO: 4106239 - RNA, 15 nt, Streptococcus pneumoniae R6
ugauaagguacagac

SEQ ID NO: 4106240 - RNA, 15 nt, Streptococcus pneumoniae R6
ugauaaguaaagcuu

SEQ ID NO: 4106241 - RNA, 20 nt, Streptococcus pneumoniae R6
ugauaauacgaccaaucuuu

SEQ ID NO: 4106242 - RNA, 19 nt, Streptococcus pneumoniae R6
ugauaaugcguuuagcauc

SEQ ID NO: 4106243 - RNA, 20 nt, Streptococcus pneumoniae R6
ugauacaaguucaucuucaa

SEQ ID NO: 4106244 - RNA, 22 nt, Streptococcus pneumoniae R6
ugauacaaguucaucuucaaaa

SEQ ID NO: 4106245 - RNA, 12 nt, Streptococcus pneumoniae R6
ugauaccagagc

SEQ ID NO: 4106246 - RNA, 15 nt, Streptococcus pneumoniae R6
ugauaccuugaucaa

SEQ ID NO: 4106247 - RNA, 14 nt, Streptococcus pneumoniae R6
ugauacgaaaucau

SEQ ID NO: 4106248 - RNA, 23 nt, Streptococcus pneumoniae R6
ugauagaaaagcccuucaucagu

SEQ ID NO: 4106249 - RNA, 22 nt, Streptococcus pneumoniae R6
ugauagagauuauagugguguu

SEQ ID NO: 4106250 - RNA, 11 nt, Streptococcus pneumoniae R6
ugauagaguua

SEQ ID NO: 4106251 - RNA, 14 nt, Streptococcus pneumoniae R6
ugauagaguuagag

SEQ ID NO: 4106252 - RNA, 19 nt, Streptococcus pneumoniae R6
ugauagugauguuucaagu

SEQ ID NO: 4106253 - RNA, 19 nt, Streptococcus pneumoniae R6
ugauagugguguuucaagu

SEQ ID NO: 4106254 - RNA, 17 nt, Streptococcus pneumoniae R6
ugauauaauaaaaagag

SEQ ID NO: 4106255 - RNA, 20 nt, Streptococcus pneumoniae R6
ugauauaaugguuauaucug

SEQ ID NO: 4106256 - RNA, 17 nt, Streptococcus pneumoniae R6
ugauauagucuauugaa

SEQ ID NO: 4106257 - RNA, 14 nt, Streptococcus pneumoniae R6
ugauauauaaauga

SEQ ID NO: 4106258 - RNA, 15 nt, Streptococcus pneumoniae R6
ugcaaaaaaaaugaa

SEQ ID NO: 4106259 - RNA, 17 nt, Streptococcus pneumoniae R6
ugcaaaaaaaaugaaaa

SEQ ID NO: 4106260 - RNA, 18 nt, Streptococcus pneumoniae R6
ugcaaaaaaaaugaaaaa

SEQ ID NO: 4106261 - RNA, 21 nt, Streptococcus pneumoniae R6
ugcaaaaaaaaugaaaaaaau

SEQ ID NO: 4106262 - RNA, 20 nt, Streptococcus pneumoniae R6
ugcaaaacuagaauccuagu

SEQ ID NO: 4106263 - RNA, 17 nt, Streptococcus pneumoniae R6
ugcaaagacagggccuu

SEQ ID NO: 4106264 - RNA, 12 nt, Streptococcus pneumoniae R6
ugcaaagaguuu

SEQ ID NO: 4106265 - RNA, 15 nt, Streptococcus pneumoniae R6
ugcaaagcaaucuaa

SEQ ID NO: 4106266 - RNA, 16 nt, Streptococcus pneumoniae R6
ugcaaaguuuucuuug

SEQ ID NO: 4106267 - RNA, 17 nt, Streptococcus pneumoniae R6
ugcaaauaagaaaucuc

SEQ ID NO: 4106268 - RNA, 16 nt, Streptococcus pneumoniae R6
ugcaaaucucauuuga

SEQ ID NO: 4106269 - RNA, 22 nt, Streptococcus pneumoniae R6
ugcaaauuauuuacagaaagaa

SEQ ID NO: 4106270 - RNA, 17 nt, Streptococcus pneumoniae R6
ugcaaauuuauaaaucu

SEQ ID NO: 4106271 - RNA, 18 nt, Streptococcus pneumoniae R6
ugcaaauuuauaaaucuu

SEQ ID NO: 4106272 - RNA, 22 nt, Streptococcus pneumoniae R6
ugcaaauuuauaaaucuucuaa

SEQ ID NO: 4106273 - RNA, 16 nt, Streptococcus pneumoniae R6
ugcaaccucaaaacag

SEQ ID NO: 4106274 - RNA, 19 nt, Streptococcus pneumoniae R6
ugcaaccucaaaacagugu

SEQ ID NO: 4106275 - RNA, 19 nt, Streptococcus pneumoniae R6
ugcaaccuuaaaacagugu

SEQ ID NO: 4106276 - RNA, 18 nt, Streptococcus pneumoniae R6
ugcaacuuguuuuuccug

SEQ ID NO: 4106277 - RNA, 20 nt, Streptococcus pneumoniae R6
ugcaacuuguuuuuccugau

SEQ ID NO: 4106278 - RNA, 18 nt, Streptococcus pneumoniae R6
ugcaagaaaguagagucc

SEQ ID NO: 4106279 - RNA, 20 nt, Streptococcus pneumoniae R6
ugcaagagcgguuaauuuaa

SEQ ID NO: 4106280 - RNA, 17 nt, Streptococcus pneumoniae R6
ugcaaguagaacgcuga

SEQ ID NO: 4106281 - RNA, 22 nt, Streptococcus pneumoniae R6
ugcaaguuuaugccuugcagga

SEQ ID NO: 4106282 - RNA, 20 nt, Streptococcus pneumoniae R6
ugcaauacagaacuaaaucu

SEQ ID NO: 4106283 - RNA, 21 nt, Streptococcus pneumoniae R6
ugcaauacagaacuaaaucuu

SEQ ID NO: 4106284 - RNA, 17 nt, Streptococcus pneumoniae R6
ugcaauauagugaaauu

SEQ ID NO: 4106285 - RNA, 13 nt, Streptococcus pneumoniae R6
ugcaaucauugca

SEQ ID NO: 4106286 - RNA, 15 nt, Streptococcus pneumoniae R6
ugcaaucauugcaaa

SEQ ID NO: 4106287 - RNA, 14 nt, Streptococcus pneumoniae R6
ugcaaucccaagcc

SEQ ID NO: 4106288 - RNA, 23 nt, Streptococcus pneumoniae R6
ugcaaucccaagcccugcaaacu

SEQ ID NO: 4106289 - RNA, 19 nt, Streptococcus pneumoniae R6
ugcaaugagccaaggaagu

SEQ ID NO: 4106290 - RNA, 14 nt, Streptococcus pneumoniae R6
ugcaauugaauucu

SEQ ID NO: 4106291 - RNA, 18 nt, Streptococcus pneumoniae R6
ugcaauuucuuuauauaa

SEQ ID NO: 4106292 - RNA, 22 nt, Streptococcus pneumoniae R6
ugcaauuucuuuauauaaaaag

SEQ ID NO: 4106293 - RNA, 15 nt, Streptococcus pneumoniae R6
ugcacacucagaacc

SEQ ID NO: 4106294 - RNA, 18 nt, Streptococcus pneumoniae R6
ugcacauugguucuuuuu

SEQ ID NO: 4106295 - RNA, 20 nt, Streptococcus pneumoniae R6
ugcaccuaaaauucccuuau

SEQ ID NO: 4106296 - RNA, 11 nt, Streptococcus pneumoniae R6
ugcacuaagga

SEQ ID NO: 4106297 - RNA, 23 nt, Streptococcus pneumoniae R6
ugcacuauuuuccaaaaaucucu

SEQ ID NO: 4106298 - RNA, 16 nt, Streptococcus pneumoniae R6
ugcagaaucgugaguu

SEQ ID NO: 4106299 - RNA, 21 nt, Streptococcus pneumoniae R6
ugcagaaucgugaguuccugu

SEQ ID NO: 4106300 - RNA, 14 nt, Streptococcus pneumoniae R6
ugcagagagauaaa

SEQ ID NO: 4106301 - RNA, 19 nt, Streptococcus pneumoniae R6
ugcagagagauaaauauug

SEQ ID NO: 4106302 - RNA, 13 nt, Streptococcus pneumoniae R6
ugcagauaagacu

SEQ ID NO: 4106303 - RNA, 15 nt, Streptococcus pneumoniae R6
ugcagauaagacuga

SEQ ID NO: 4106304 - RNA, 20 nt, Streptococcus pneumoniae R6
ugcagcaacgucuucaauac

SEQ ID NO: 4106305 - RNA, 22 nt, Streptococcus pneumoniae R6
ugcagccucaaaacacuguuuu

SEQ ID NO: 4106306 - RNA, 15 nt, Streptococcus pneumoniae R6
ugcagcuaguuuccu

SEQ ID NO: 4106307 - RNA, 20 nt, Streptococcus pneumoniae R6
ugcagcuuguuguuaaacaa

SEQ ID NO: 4106308 - RNA, 19 nt, Streptococcus pneumoniae R6
ugcaggauuuuugcuucug

SEQ ID NO: 4106309 - RNA, 13 nt, Streptococcus pneumoniae R6
ugcaguauaucug

SEQ ID NO: 4106310 - RNA, 12 nt, Streptococcus pneumoniae R6
ugcaguucccac

SEQ ID NO: 4106311 - RNA, 22 nt, Streptococcus pneumoniae R6
ugcaguuucucuacuaacucaa

SEQ ID NO: 4106312 - RNA, 13 nt, Streptococcus pneumoniae R6
ugcaguuuucauu

SEQ ID NO: 4106313 - RNA, 18 nt, Streptococcus pneumoniae R6
ugcaguuuucauucuacu

SEQ ID NO: 4106314 - RNA, 18 nt, Streptococcus pneumoniae R6
ugcauaauuuccauacca

SEQ ID NO: 4106315 - RNA, 14 nt, Streptococcus pneumoniae R6
ugcaucaacuauuc

SEQ ID NO: 4106316 - RNA, 16 nt, Streptococcus pneumoniae R6
ugcaucaacuauucuu

SEQ ID NO: 4106317 - RNA, 22 nt, Streptococcus pneumoniae R6
ugcaucaagugccaagaagguu

SEQ ID NO: 4106318 - RNA, 12 nt, Streptococcus pneumoniae R6
ugcaucagaugg

SEQ ID NO: 4106319 - RNA, 18 nt, Streptococcus pneumoniae R6
ugcauccaacaauucuug

SEQ ID NO: 4106320 - RNA, 19 nt, Streptococcus pneumoniae R6
ugcauccaccuucaucucu

SEQ ID NO: 4106321 - RNA, 23 nt, Streptococcus pneumoniae R6
ugcaucugcguuaacuucaagaa

SEQ ID NO: 4106322 - RNA, 22 nt, Streptococcus pneumoniae R6
ugcaucuuuguaaguuucuucu

SEQ ID NO: 4106323 - RNA, 20 nt, Streptococcus pneumoniae R6
ugcauucgaaacgugggcug

SEQ ID NO: 4106324 - RNA, 14 nt, Streptococcus pneumoniae R6
ugcauuuagauagu

SEQ ID NO: 4106325 - RNA, 12 nt, Streptococcus pneumoniae R6
ugcauuucugga

SEQ ID NO: 4106326 - RNA, 18 nt, Streptococcus pneumoniae R6
ugcauuuuaauuucaaug

SEQ ID NO: 4106327 - RNA, 19 nt, Streptococcus pneumoniae R6
ugcauuuuaauuucaaugu

SEQ ID NO: 4106328 - RNA, 13 nt, Streptococcus pneumoniae R6
ugccaaagguaau

SEQ ID NO: 4106329 - RNA, 23 nt, Streptococcus pneumoniae R6
ugccaacaaacauggcgccauuu

SEQ ID NO: 4106330 - RNA, 18 nt, Streptococcus pneumoniae R6
ugccaacccucucuucaa

SEQ ID NO: 4106331 - RNA, 17 nt, Streptococcus pneumoniae R6
ugccaagaaaguugagc

SEQ ID NO: 4106332 - RNA, 17 nt, Streptococcus pneumoniae R6
ugccaaucgacccugga

SEQ ID NO: 4106333 - RNA, 15 nt, Streptococcus pneumoniae R6
ugccaauugcucaac

SEQ ID NO: 4106334 - RNA, 10 nt, Streptococcus pneumoniae R6
ugccacaacu

SEQ ID NO: 4106335 - RNA, 15 nt, Streptococcus pneumoniae R6
ugccagaaauucccu

SEQ ID NO: 4106336 - RNA, 18 nt, Streptococcus pneumoniae R6
ugccagaaauucccucug

SEQ ID NO: 4106337 - RNA, 15 nt, Streptococcus pneumoniae R6
ugccagauuccugaa

SEQ ID NO: 4106338 - RNA, 18 nt, Streptococcus pneumoniae R6
ugccagcugagcuaagga

SEQ ID NO: 4106339 - RNA, 13 nt, Streptococcus pneumoniae R6
ugccauagcuccu

SEQ ID NO: 4106340 - RNA, 23 nt, Streptococcus pneumoniae R6
ugccauauguccuucaugaaauu

SEQ ID NO: 4106341 - RNA, 12 nt, Streptococcus pneumoniae R6
ugccaugagaau

SEQ ID NO: 4106342 - RNA, 19 nt, Streptococcus pneumoniae R6
ugccaugagcgucuuucuu

SEQ ID NO: 4106343 - RNA, 20 nt, Streptococcus pneumoniae R6
ugccaugagcgucuuucuua

SEQ ID NO: 4106344 - RNA, 15 nt, Streptococcus pneumoniae R6
ugccaugcugacgau

SEQ ID NO: 4106345 - RNA, 21 nt, Streptococcus pneumoniae R6
ugccauggccauaucugguuu

SEQ ID NO: 4106346 - RNA, 16 nt, Streptococcus pneumoniae R6
ugccauuaauuccuga

SEQ ID NO: 4106347 - RNA, 20 nt, Streptococcus pneumoniae R6
ugccauuguuucguuucuuc

SEQ ID NO: 4106348 - RNA, 22 nt, Streptococcus pneumoniae R6
ugcccaaagacagguuucacau

SEQ ID NO: 4106349 - RNA, 14 nt, Streptococcus pneumoniae R6
ugcccaagagacuc

SEQ ID NO: 4106350 - RNA, 16 nt, Streptococcus pneumoniae R6
ugcccaagagacucuu

SEQ ID NO: 4106351 - RNA, 16 nt, Streptococcus pneumoniae R6
ugcccacuaaaaauau

SEQ ID NO: 4106352 - RNA, 17 nt, Streptococcus pneumoniae R6
ugcccaucauuccugau

SEQ ID NO: 4106353 - RNA, 23 nt, Streptococcus pneumoniae R6
ugcccauucuuuagcagagaaga

SEQ ID NO: 4106354 - RNA, 13 nt, Streptococcus pneumoniae R6
ugccccugaugag

SEQ ID NO: 4106355 - RNA, 13 nt, Streptococcus pneumoniae R6
ugcccucuucuuu

SEQ ID NO: 4106356 - RNA, 16 nt, Streptococcus pneumoniae R6
ugccgauaucaccaaa

SEQ ID NO: 4106357 - RNA, 20 nt, Streptococcus pneumoniae R6
ugccgccauacuuucucuga

SEQ ID NO: 4106358 - RNA, 19 nt, Streptococcus pneumoniae R6
ugccguccuuguaaagacu

SEQ ID NO: 4106359 - RNA, 20 nt, Streptococcus pneumoniae R6
ugccgugauuuccaaucuuc

SEQ ID NO: 4106360 - RNA, 20 nt, Streptococcus pneumoniae R6
ugcuuuacuaguucucaaau

SEQ ID NO: 4106361 - RNA, 17 nt, Streptococcus pneumoniae R6
ugcuuuagaaacuauga

SEQ ID NO: 4106362 - RNA, 19 nt, Streptococcus pneumoniae R6
ugcuuucaaaaagcauucu

SEQ ID NO: 4106363 - RNA, 23 nt, Streptococcus pneumoniae R6
ugcuuuccaacgauuuuauccaa

SEQ ID NO: 4106364 - RNA, 17 nt, Streptococcus pneumoniae R6
ugcuuuccaauaauuca

SEQ ID NO: 4106365 - RNA, 23 nt, Streptococcus pneumoniae R6
ugcuuuccaauaauucaccuauu

SEQ ID NO: 4106366 - RNA, 15 nt, Streptococcus pneumoniae R6
ugcuuuccuuucaaa

SEQ ID NO: 4106367 - RNA, 13 nt, Streptococcus pneumoniae R6
ugcuuucuaucaa

SEQ ID NO: 4106368 - RNA, 20 nt, Streptococcus pneumoniae R6
ugcuuucuucagauuuuaua

SEQ ID NO: 4106369 - RNA, 16 nt, Streptococcus pneumoniae R6
ugcuuugaacaaaugu

SEQ ID NO: 4106370 - RNA, 14 nt, Streptococcus pneumoniae R6
ugcuuuuagcuucu

SEQ ID NO: 4106371 - RNA, 13 nt, Streptococcus pneumoniae R6
ugcuuuuauucag

SEQ ID NO: 4106372 - RNA, 22 nt, Streptococcus pneumoniae R6
ugcuuuucguacauaguuucau

SEQ ID NO: 4106373 - RNA, 14 nt, Streptococcus pneumoniae R6
ugcuuuucuauuaa

SEQ ID NO: 4106374 - RNA, 12 nt, Streptococcus pneumoniae R6
ugcuuuucuuga

SEQ ID NO: 4106375 - RNA, 16 nt, Streptococcus pneumoniae R6
ugcuuuugugauuuua

SEQ ID NO: 4106376 - RNA, 18 nt, Streptococcus pneumoniae R6
ugcuuuugugauuuuaaa

SEQ ID NO: 4106377 - RNA, 15 nt, Streptococcus pneumoniae R6
ugcuuuuucaaucag

SEQ ID NO: 4106378 - RNA, 21 nt, Streptococcus pneumoniae R6
ugcuuuuuuauauggaaaaau

SEQ ID NO: 4106379 - RNA, 22 nt, Streptococcus pneumoniae R6
uggaaaaaagucuuuaaaaucu

SEQ ID NO: 4106380 - RNA, 16 nt, Streptococcus pneumoniae R6
uggaaaaaauaaaaaa

SEQ ID NO: 4106381 - RNA, 21 nt, Streptococcus pneumoniae R6
uggaaaaacguggacugguuu

SEQ ID NO: 4106382 - RNA, 16 nt, Streptococcus pneumoniae R6
uggaaaacaauaucag

SEQ ID NO: 4106383 - RNA, 11 nt, Streptococcus pneumoniae R6
uggaaaacuaa

SEQ ID NO: 4106384 - RNA, 15 nt, Streptococcus pneumoniae R6
uggaaaauagaaaaa

SEQ ID NO: 4106385 - RNA, 16 nt, Streptococcus pneumoniae R6
uggaaaauagaaaaaa

SEQ ID NO: 4106386 - RNA, 16 nt, Streptococcus pneumoniae R6
uggaaacucaggaugu

SEQ ID NO: 4106387 - RNA, 20 nt, Streptococcus pneumoniae R6
uggaaagaggacuuuuugug

SEQ ID NO: 4106388 - RNA, 22 nt, Streptococcus pneumoniae R6
uggaaagcaucuccauccucac

SEQ ID NO: 4106389 - RNA, 21 nt, Streptococcus pneumoniae R6
uggaaauaacaaaccaagaau

SEQ ID NO: 4106390 - RNA, 14 nt, Streptococcus pneumoniae R6
uggaaauaaucuuu

SEQ ID NO: 4106391 - RNA, 13 nt, Streptococcus pneumoniae R6
uggaaaugauaau

SEQ ID NO: 4106392 - RNA, 17 nt, Streptococcus pneumoniae R6
uggaacgcguugugcag

SEQ ID NO: 4106393 - RNA, 17 nt, Streptococcus pneumoniae R6
uggaaguacaugucagg

SEQ ID NO: 4106394 - RNA, 16 nt, Streptococcus pneumoniae R6
uggaagugaaaaagca

SEQ ID NO: 4106395 - RNA, 17 nt, Streptococcus pneumoniae R6
uggaauaguccucccuu

SEQ ID NO: 4106396 - RNA, 21 nt, Streptococcus pneumoniae R6
uggaauauuuacuaauuaauu

SEQ ID NO: 4106397 - RNA, 23 nt, Streptococcus pneumoniae R6
uggaaucacauuggcaagagcug

SEQ ID NO: 4106398 - RNA, 18 nt, Streptococcus pneumoniae R6
uggaaucagaacacuucc

SEQ ID NO: 4106399 - RNA, 18 nt, Streptococcus pneumoniae R6
uggaauccacacuuccaa

SEQ ID NO: 4106400 - RNA, 19 nt, Streptococcus pneumoniae R6
uggaaugauuugggcaagg

SEQ ID NO: 4106401 - RNA, 18 nt, Streptococcus pneumoniae R6
uggacaacaaugagaaau

SEQ ID NO: 4106402 - RNA, 13 nt, Streptococcus pneumoniae R6
uggacaugagucc

SEQ ID NO: 4106403 - RNA, 12 nt, Streptococcus pneumoniae R6
uggacgagcagc

SEQ ID NO: 4106404 - RNA, 14 nt, Streptococcus pneumoniae R6
uggacgucuucacg

SEQ ID NO: 4106405 - RNA, 23 nt, Streptococcus pneumoniae R6
uggacuguuauagauucaauaua

SEQ ID NO: 4106406 - RNA, 22 nt, Streptococcus pneumoniae R6
uggagaaacuccuuggcuacuu

SEQ ID NO: 4106407 - RNA, 14 nt, Streptococcus pneumoniae R6
uggagacagcacca

SEQ ID NO: 4106408 - RNA, 17 nt, Streptococcus pneumoniae R6
uggagacagcaccaacu

SEQ ID NO: 4106409 - RNA, 22 nt, Streptococcus pneumoniae R6
uggagcaucugguuucguagca

SEQ ID NO: 4106410 - RNA, 20 nt, Streptococcus pneumoniae R6
uggagcuucaucaguuccag

SEQ ID NO: 4106411 - RNA, 22 nt, Streptococcus pneumoniae R6
uggagcuucaucaguuccagca

SEQ ID NO: 4106412 - RNA, 20 nt, Streptococcus pneumoniae R6
uggaggcaauacguuuucaa

SEQ ID NO: 4106413 - RNA, 15 nt, Streptococcus pneumoniae R6
uggaguacuucuuug

SEQ ID NO: 4106414 - RNA, 15 nt, Streptococcus pneumoniae R6
uggaguagcaucccc

SEQ ID NO: 4106415 - RNA, 17 nt, Streptococcus pneumoniae R6
uggaguagcauccccag

SEQ ID NO: 4106416 - RNA, 17 nt, Streptococcus pneumoniae R6
uggagucugaccaugcg

SEQ ID NO: 4106417 - RNA, 20 nt, Streptococcus pneumoniae R6
uggagugauggguucagaau

SEQ ID NO: 4106418 - RNA, 19 nt, Streptococcus pneumoniae R6
uggaguguucuaaaauaag

SEQ ID NO: 4106419 - RNA, 14 nt, Streptococcus pneumoniae R6
uggaguucuuuuca

SEQ ID NO: 4106420 - RNA, 17 nt, Streptococcus pneumoniae R6
uggaguuuucaaugaua

SEQ ID NO: 4106421 - RNA, 14 nt, Streptococcus pneumoniae R6
uggauaaaaucuuu

SEQ ID NO: 4106422 - RNA, 21 nt, Streptococcus pneumoniae R6
uggauaaaguuaugaaaaaga

SEQ ID NO: 4106423 - RNA, 15 nt, Streptococcus pneumoniae R6
uggauaacugaaauu

SEQ ID NO: 4106424 - RNA, 20 nt, Streptococcus pneumoniae R6
uggauaagcuugugaaagcu

SEQ ID NO: 4106425 - RNA, 13 nt, Streptococcus pneumoniae R6
uggauagguugca

SEQ ID NO: 4106426 - RNA, 13 nt, Streptococcus pneumoniae R6
uggauaguccaga

SEQ ID NO: 4106427 - RNA, 21 nt, Streptococcus pneumoniae R6
uggauauagucuacaauuucu

SEQ ID NO: 4106428 - RNA, 16 nt, Streptococcus pneumoniae R6
uggauauccuuuucca

SEQ ID NO: 4106429 - RNA, 17 nt, Streptococcus pneumoniae R6
uggaucagcuuuuucag

SEQ ID NO: 4106430 - RNA, 18 nt, Streptococcus pneumoniae R6
uggaucaugguugcuccg

SEQ ID NO: 4106431 - RNA, 18 nt, Streptococcus pneumoniae R6
uggaucuagauaguacca

SEQ ID NO: 4106432 - RNA, 15 nt, Streptococcus pneumoniae R6
uggaugaaacugacg

SEQ ID NO: 4106433 - RNA, 16 nt, Streptococcus pneumoniae R6
uggaugaguuuacuau

SEQ ID NO: 4106434 - RNA, 15 nt, Streptococcus pneumoniae R6
uaccuaaucuuucug

SEQ ID NO: 4106435 - RNA, 15 nt, Streptococcus pneumoniae R6
uaccucauaucucuu

SEQ ID NO: 4106436 - RNA, 18 nt, Streptococcus pneumoniae R6
uaccucuuuuuauucuuu

SEQ ID NO: 4106437 - RNA, 21 nt, Streptococcus pneumoniae R6
uaccugcggauaaaagagaau

SEQ ID NO: 4106438 - RNA, 23 nt, Streptococcus pneumoniae R6
uaccugcucgccccauuucuuca

SEQ ID NO: 4106439 - RNA, 14 nt, Streptococcus pneumoniae R6
uaccuguuaagccu

SEQ ID NO: 4106440 - RNA, 16 nt, Streptococcus pneumoniae R6
uaccuuaagcauggca

SEQ ID NO: 4106441 - RNA, 13 nt, Streptococcus pneumoniae R6
uaccuuaauucuc

SEQ ID NO: 4106442 - RNA, 15 nt, Streptococcus pneumoniae R6
uaccuuaauucucuu

SEQ ID NO: 4106443 - RNA, 18 nt, Streptococcus pneumoniae R6
uaccuucaaguuguuuga

SEQ ID NO: 4106444 - RNA, 24 nt, Streptococcus pneumoniae R6
uaccuucagccacggcacguucca

SEQ ID NO: 4106445 - RNA, 16 nt, Streptococcus pneumoniae R6
uaccuucuuuaucauu

SEQ ID NO: 4106446 - RNA, 20 nt, Streptococcus pneumoniae R6
uaccuugaauuuugugagga

SEQ ID NO: 4106447 - RNA, 18 nt, Streptococcus pneumoniae R6
uaccuugaucggaagcua

SEQ ID NO: 4106448 - RNA, 22 nt, Streptococcus pneumoniae R6
uaccuuuccuccgauaauuauu

SEQ ID NO: 4106449 - RNA, 12 nt, Streptococcus pneumoniae R6
uacgaauuauuu

SEQ ID NO: 4106450 - RNA, 15 nt, Streptococcus pneumoniae R6
uacgaauuauuuccu

SEQ ID NO: 4106451 - RNA, 19 nt, Streptococcus pneumoniae R6
uacgaccaaucuuuuccaa

SEQ ID NO: 4106452 - RNA, 15 nt, Streptococcus pneumoniae R6
uacgaucugaaauaa

SEQ ID NO: 4106453 - RNA, 16 nt, Streptococcus pneumoniae R6
uacgauucccacaagg

SEQ ID NO: 4106454 - RNA, 19 nt, Streptococcus pneumoniae R6
uacgauucccacaagggau

SEQ ID NO: 4106455 - RNA, 18 nt, Streptococcus pneumoniae R6
uacgauugguucugcucc

SEQ ID NO: 4106456 - RNA, 17 nt, Streptococcus pneumoniae R6
uacgcauacuaauagca

SEQ ID NO: 4106457 - RNA, 23 nt, Streptococcus pneumoniae R6
uacgcaucgacuacuaaaacauu

SEQ ID NO: 4106458 - RNA, 14 nt, Streptococcus pneumoniae R6
uacgcccuccauua

SEQ ID NO: 4106459 - RNA, 17 nt, Streptococcus pneumoniae R6
uacggcaaggcaaagcu

SEQ ID NO: 4106460 - RNA, 13 nt, Streptococcus pneumoniae R6
uacgucugcacgg

SEQ ID NO: 4106461 - RNA, 15 nt, Streptococcus pneumoniae R6
uacgugacucagcuu

SEQ ID NO: 4106462 - RNA, 13 nt, Streptococcus pneumoniae R6
uacguucaaauuc

SEQ ID NO: 4106463 - RNA, 19 nt, Streptococcus pneumoniae R6
uacguucauccauaucuuu

SEQ ID NO: 4106464 - RNA, 14 nt, Streptococcus pneumoniae R6
uacguuuuaaaaaa

SEQ ID NO: 4106465 - RNA, 14 nt, Streptococcus pneumoniae R6
uacguuuuaucaua

SEQ ID NO: 4106466 - RNA, 17 nt, Streptococcus pneumoniae R6
uacuaaaacauuucuau

SEQ ID NO: 4106467 - RNA, 18 nt, Streptococcus pneumoniae R6
uacuaaaacauuucuaua

SEQ ID NO: 4106468 - RNA, 17 nt, Streptococcus pneumoniae R6
uacuaaggaaagucaaa

SEQ ID NO: 4106469 - RNA, 18 nt, Streptococcus pneumoniae R6
uacuaaggcccaauuaaa

SEQ ID NO: 4106470 - RNA, 15 nt, Streptococcus pneumoniae R6
uacuaaguuccuguu

SEQ ID NO: 4106471 - RNA, 23 nt, Streptococcus pneumoniae R6
uacuaaugcccuuuuuuguuuca

SEQ ID NO: 4106472 - RNA, 23 nt, Streptococcus pneumoniae R6
uacuacacagcuugguaaugcuc

SEQ ID NO: 4106473 - RNA, 14 nt, Streptococcus pneumoniae R6
uacuacuggaacau

SEQ ID NO: 4106474 - RNA, 12 nt, Streptococcus pneumoniae R6
uacuaggcagga

SEQ ID NO: 4106475 - RNA, 14 nt, Streptococcus pneumoniae R6
uacuagucuuucuu

SEQ ID NO: 4106476 - RNA, 16 nt, Streptococcus pneumoniae R6
uacuagucuuucuucg

SEQ ID NO: 4106477 - RNA, 22 nt, Streptococcus pneumoniae R6
uacuaguucucaaauuuucaua

SEQ ID NO: 4106478 - RNA, 12 nt, Streptococcus pneumoniae R6
uacuauaagacu

SEQ ID NO: 4106479 - RNA, 20 nt, Streptococcus pneumoniae R6
uacuauaagacuccucuuua

SEQ ID NO: 4106480 - RNA, 20 nt, Streptococcus pneumoniae R6
uacuauacgacaugccuguc

SEQ ID NO: 4106481 - RNA, 14 nt, Streptococcus pneumoniae R6
uacuauauaucaua

SEQ ID NO: 4106482 - RNA, 20 nt, Streptococcus pneumoniae R6
uacuauccucauuagauagu

SEQ ID NO: 4106483 - RNA, 16 nt, Streptococcus pneumoniae R6
uacuaugcguuuuaau

SEQ ID NO: 4106484 - RNA, 17 nt, Streptococcus pneumoniae R6
uacuaugcguuuuaaug

SEQ ID NO: 4106485 - RNA, 17 nt, Streptococcus pneumoniae R6
uacuaugcuuuuuucua

SEQ ID NO: 4106486 - RNA, 20 nt, Streptococcus pneumoniae R6
uacuaugggaagauuuacuu

SEQ ID NO: 4106487 - RNA, 14 nt, Streptococcus pneumoniae R6
uacuauucuaguuu

SEQ ID NO: 4106488 - RNA, 17 nt, Streptococcus pneumoniae R6
uacuauucuaguuucaa

SEQ ID NO: 4106489 - RNA, 21 nt, Streptococcus pneumoniae R6
uacuauugaguucacaaauga

SEQ ID NO: 4106490 - RNA, 15 nt, Streptococcus pneumoniae R6
uacucaacagaagaa

SEQ ID NO: 4106491 - RNA, 15 nt, Streptococcus pneumoniae R6
uacucaaguccuuuu

SEQ ID NO: 4106492 - RNA, 14 nt, Streptococcus pneumoniae R6
uacucaaugaaaau

SEQ ID NO: 4106493 - RNA, 16 nt, Streptococcus pneumoniae R6
uacucaaugaaaauca

SEQ ID NO: 4106494 - RNA, 23 nt, Streptococcus pneumoniae R6
uacucaaugaaaaucaaagagca

SEQ ID NO: 4106495 - RNA, 14 nt, Streptococcus pneumoniae R6
uacucacuuacaua

SEQ ID NO: 4106496 - RNA, 22 nt, Streptococcus pneumoniae R6
uacucaggauaaaaccaaaaag

SEQ ID NO: 4106497 - RNA, 16 nt, Streptococcus pneumoniae R6
uacucaguauuuggau

SEQ ID NO: 4106498 - RNA, 15 nt, Streptococcus pneumoniae R6
uacucauaaagucuu

SEQ ID NO: 4106499 - RNA, 16 nt, Streptococcus pneumoniae R6
uacucaucugcuuuca

SEQ ID NO: 4106500 - RNA, 20 nt, Streptococcus pneumoniae R6
uacuccaaaacaucugguuu

SEQ ID NO: 4106501 - RNA, 21 nt, Streptococcus pneumoniae R6
uacuccgugaagugaaaggag

SEQ ID NO: 4106502 - RNA, 13 nt, Streptococcus pneumoniae R6
uacuccuuuucua

SEQ ID NO: 4106503 - RNA, 18 nt, Streptococcus pneumoniae R6
uacucgugaagaaaucau

SEQ ID NO: 4106504 - RNA, 12 nt, Streptococcus pneumoniae R6
uacucuguuuuc

SEQ ID NO: 4106505 - RNA, 14 nt, Streptococcus pneumoniae R6
uacucuguuuucac

SEQ ID NO: 4106506 - RNA, 15 nt, Streptococcus pneumoniae R6
uacucuucaaaaauc

SEQ ID NO: 4106507 - RNA, 14 nt, Streptococcus pneumoniae R6
uacucuucgaaaau

SEQ ID NO: 4106508 - RNA, 18 nt, Streptococcus pneumoniae R6
uacucuucgaaaaucucu

SEQ ID NO: 4106509 - RNA, 13 nt, Streptococcus pneumoniae R6
uacucuuuacuuu

SEQ ID NO: 4106510 - RNA, 15 nt, Streptococcus pneumoniae R6
uacucuuugauuuuc

SEQ ID NO: 4106511 - RNA, 20 nt, Streptococcus pneumoniae R6
uacucuuugauuuucauuga

SEQ ID NO: 4106512 - RNA, 12 nt, Streptococcus pneumoniae R6
uacugaaacaac

SEQ ID NO: 4106513 - RNA, 22 nt, Streptococcus pneumoniae R6
uacugaaacaacaucuuuccag

SEQ ID NO: 4106514 - RNA, 21 nt, Streptococcus pneumoniae R6
uacugaacaaugaaaaaaaca

SEQ ID NO: 4106515 - RNA, 16 nt, Streptococcus pneumoniae R6
uacugacuucgucagu

SEQ ID NO: 4106516 - RNA, 22 nt, Streptococcus pneumoniae R6
uacugacuucgucaguuucauc

SEQ ID NO: 4106517 - RNA, 19 nt, Streptococcus pneumoniae R6
uacugccccccaaaaaagu

SEQ ID NO: 4106518 - RNA, 21 nt, Streptococcus pneumoniae R6
uacugccuugagguuuuagau

SEQ ID NO: 4106519 - RNA, 16 nt, Streptococcus pneumoniae R6
uacugcucgguaaaac

SEQ ID NO: 4106520 - RNA, 14 nt, Streptococcus pneumoniae R6
uacugcuuugaggu

SEQ ID NO: 4106521 - RNA, 15 nt, Streptococcus pneumoniae R6
uacuguacguuuuau

SEQ ID NO: 4106522 - RNA, 14 nt, Streptococcus pneumoniae R6
uacuguauuucuuu

SEQ ID NO: 4106523 - RNA, 19 nt, Streptococcus pneumoniae R6
uacuguauuuuuuuugguu

SEQ ID NO: 4106524 - RNA, 14 nt, Streptococcus pneumoniae R6
uacuguccuucuuu

SEQ ID NO: 4106525 - RNA, 21 nt, Streptococcus pneumoniae R6
uacuguccuucuuuuacuucu

SEQ ID NO: 4106526 - RNA, 23 nt, Streptococcus pneumoniae R6
uacuguccuucuuuuacuucuuu

SEQ ID NO: 4106527 - RNA, 16 nt, Streptococcus pneumoniae R6
uacuguuaauaaaauu

SEQ ID NO: 4106528 - RNA, 17 nt, Streptococcus pneumoniae R6
uacuuaaacgugcuaua

SEQ ID NO: 4106529 - RNA, 15 nt, Streptococcus pneumoniae R6
uacuuagccaaguca

SEQ ID NO: 4106530 - RNA, 15 nt, Streptococcus pneumoniae R6
uacuuagcuaauuuu

SEQ ID NO: 4106531 - RNA, 17 nt, Streptococcus pneumoniae R6
uacuuauccuuuuuuac

SEQ ID NO: 4106532 - RNA, 14 nt, Streptococcus pneumoniae R6
uacuucauguuuuc

SEQ ID NO: 4106533 - RNA, 18 nt, Streptococcus pneumoniae R6
uacuucauguuuuccuaa

SEQ ID NO: 4106534 - RNA, 19 nt, Streptococcus pneumoniae R6
uacuucccacccauauuuu

SEQ ID NO: 4106535 - RNA, 18 nt, Streptococcus pneumoniae R6
uacuuccguaaucuuguu

SEQ ID NO: 4106536 - RNA, 22 nt, Streptococcus pneumoniae R6
uacuuccguaaucuuguuaaga

SEQ ID NO: 4106537 - RNA, 17 nt, Streptococcus pneumoniae R6
uacuuccugcucaaaau

SEQ ID NO: 4106538 - RNA, 16 nt, Streptococcus pneumoniae R6
uacuuccuuuuuaaau

SEQ ID NO: 4106539 - RNA, 20 nt, Streptococcus pneumoniae R6
uacuucguucacccuugcuu

SEQ ID NO: 4106540 - RNA, 14 nt, Streptococcus pneumoniae R6
uacuucuaaaacau

SEQ ID NO: 4106541 - RNA, 17 nt, Streptococcus pneumoniae R6
uacuucuaaaacauugu

SEQ ID NO: 4106542 - RNA, 12 nt, Streptococcus pneumoniae R6
uacuucuuuuuc

SEQ ID NO: 4106543 - RNA, 18 nt, Streptococcus pneumoniae R6
uacuugaaggucaagaau

SEQ ID NO: 4106544 - RNA, 15 nt, Streptococcus pneumoniae R6
uacuugauaaaaguu

SEQ ID NO: 4106545 - RNA, 23 nt, Streptococcus pneumoniae R6
uacuugauauaguuaaaaaagau

SEQ ID NO: 4106546 - RNA, 17 nt, Streptococcus pneumoniae R6
uacuugauugcaaagca

SEQ ID NO: 4106547 - RNA, 12 nt, Streptococcus pneumoniae R6
uacuugcuuccc

SEQ ID NO: 4106548 - RNA, 17 nt, Streptococcus pneumoniae R6
uacuuggagaaccuaga

SEQ ID NO: 4106549 - RNA, 16 nt, Streptococcus pneumoniae R6
uacuuuauaauucaua

SEQ ID NO: 4106550 - RNA, 16 nt, Streptococcus pneumoniae R6
uacuuucaacuccuua

SEQ ID NO: 4106551 - RNA, 12 nt, Streptococcus pneumoniae R6
uacuuuccaauu

SEQ ID NO: 4106552 - RNA, 17 nt, Streptococcus pneumoniae R6
uacuuucuaucuucauu

SEQ ID NO: 4106553 - RNA, 17 nt, Streptococcus pneumoniae R6
uacuuugacccugacuc

SEQ ID NO: 4106554 - RNA, 21 nt, Streptococcus pneumoniae R6
uacuuugacccugacucuccu

SEQ ID NO: 4106555 - RNA, 17 nt, Streptococcus pneumoniae R6
uacuuugagcaaccugc

SEQ ID NO: 4106556 - RNA, 17 nt, Streptococcus pneumoniae R6
uacuuugggugcaacuu

SEQ ID NO: 4106557 - RNA, 16 nt, Streptococcus pneumoniae R6
uacuuuuaauauacuu

SEQ ID NO: 4106558 - RNA, 20 nt, Streptococcus pneumoniae R6
uacuuuuuauuacaucuauc

SEQ ID NO: 4106559 - RNA, 18 nt, Streptococcus pneumoniae R6
uacuuuuucguuugguaa

SEQ ID NO: 4106560 - RNA, 20 nt, Streptococcus pneumoniae R6
uacuuuuuucuuaaguaagu

SEQ ID NO: 4106561 - RNA, 11 nt, Streptococcus pneumoniae R6
uagaaaaaagc

SEQ ID NO: 4106562 - RNA, 16 nt, Streptococcus pneumoniae R6
uagaaaaaaggaauca

SEQ ID NO: 4106563 - RNA, 17 nt, Streptococcus pneumoniae R6
uagaaaaaaggaaucag

SEQ ID NO: 4106564 - RNA, 16 nt, Streptococcus pneumoniae R6
uagaaaaagcuucauu

SEQ ID NO: 4106565 - RNA, 23 nt, Streptococcus pneumoniae R6
uagaaaaagcuucauuuaucuuc

SEQ ID NO: 4106566 - RNA, 11 nt, Streptococcus pneumoniae R6
uagaaaaagua

SEQ ID NO: 4106567 - RNA, 13 nt, Streptococcus pneumoniae R6
uagaaaaaguagu

SEQ ID NO: 4106568 - RNA, 18 nt, Streptococcus pneumoniae R6
uagaaaaaugcaaagacc

SEQ ID NO: 4106569 - RNA, 22 nt, Streptococcus pneumoniae R6
uagaaaaauuuuagcagucaag

SEQ ID NO: 4106570 - RNA, 13 nt, Streptococcus pneumoniae R6
uagaaaacaaaaa

SEQ ID NO: 4106571 - RNA, 21 nt, Streptococcus pneumoniae R6
uagaaaacaacuuauaaaaaa

SEQ ID NO: 4106572 - RNA, 20 nt, Streptococcus pneumoniae R6
uagaaaagcccuucauaagc

SEQ ID NO: 4106573 - RNA, 16 nt, Streptococcus pneumoniae R6
uagaaaaugaaauaca

SEQ ID NO: 4106574 - RNA, 20 nt, Streptococcus pneumoniae R6
uagaaaaugaaauacauauu

SEQ ID NO: 4106575 - RNA, 15 nt, Streptococcus pneumoniae R6
uagaaaaugaggaaa

SEQ ID NO: 4106576 - RNA, 22 nt, Streptococcus pneumoniae R6
uagaaaaugguuccaaaaggca

SEQ ID NO: 4106577 - RNA, 14 nt, Streptococcus pneumoniae R6
uagaaaauuaacuu

SEQ ID NO: 4106578 - RNA, 16 nt, Streptococcus pneumoniae R6
uagaaaauucaaauua

SEQ ID NO: 4106579 - RNA, 18 nt, Streptococcus pneumoniae R6
uagaaaccagcuaccaga

SEQ ID NO: 4106580 - RNA, 21 nt, Streptococcus pneumoniae R6
uagaaaggagcagauuuguug

SEQ ID NO: 4106581 - RNA, 17 nt, Streptococcus pneumoniae R6
uagaaagguuuuaaaga

SEQ ID NO: 4106582 - RNA, 19 nt, Streptococcus pneumoniae R6
uagaaaguauagucaauua

SEQ ID NO: 4106583 - RNA, 23 nt, Streptococcus pneumoniae R6
uagaaauagcagagacauuagaa

SEQ ID NO: 4106584 - RNA, 17 nt, Streptococcus pneumoniae R6
uagaaauagggauuaau

SEQ ID NO: 4106585 - RNA, 12 nt, Streptococcus pneumoniae R6
uagaaauaucug

SEQ ID NO: 4106586 - RNA, 21 nt, Streptococcus pneumoniae R6
uagaaauaucugcacucucau

SEQ ID NO: 4106587 - RNA, 22 nt, Streptococcus pneumoniae R6
uagaaauauuuuagcagucaag

SEQ ID NO: 4106588 - RNA, 20 nt, Streptococcus pneumoniae R6
uagaaaucucuuuuuucucc

SEQ ID NO: 4106589 - RNA, 21 nt, Streptococcus pneumoniae R6
uagaaaugcgccaccaacugc

SEQ ID NO: 4106590 - RNA, 15 nt, Streptococcus pneumoniae R6
uagaaauguuuuagu

SEQ ID NO: 4106591 - RNA, 20 nt, Streptococcus pneumoniae R6
uagaacaggacaacauaacu

SEQ ID NO: 4106592 - RNA, 19 nt, Streptococcus pneumoniae R6
uagaacugacgaagucagc

SEQ ID NO: 4106593 - RNA, 19 nt, Streptococcus pneumoniae R6
uagaacugacgaagucagu

SEQ ID NO: 4106594 - RNA, 14 nt, Streptococcus pneumoniae R6
uagaacuuccguau

SEQ ID NO: 4106595 - RNA, 18 nt, Streptococcus pneumoniae R6
uagaagaacaauccaaau

SEQ ID NO: 4106596 - RNA, 15 nt, Streptococcus pneumoniae R6
uagaagacuuuuguu

SEQ ID NO: 4106597 - RNA, 17 nt, Streptococcus pneumoniae R6
uagaagagguaucugua

SEQ ID NO: 4106598 - RNA, 16 nt, Streptococcus pneumoniae R6
uagaagauaaagaguc

SEQ ID NO: 4106599 - RNA, 18 nt, Streptococcus pneumoniae R6
uagaagauuuccuccaua

SEQ ID NO: 4106600 - RNA, 14 nt, Streptococcus pneumoniae R6
uagaagcagaggug

SEQ ID NO: 4106601 - RNA, 18 nt, Streptococcus pneumoniae R6
uagaagcuucuuggaauu

SEQ ID NO: 4106602 - RNA, 15 nt, Streptococcus pneumoniae R6
uagaaggcaauuaaa

SEQ ID NO: 4106603 - RNA, 17 nt, Streptococcus pneumoniae R6
uagaaggucaagagaaa

SEQ ID NO: 4106604 - RNA, 15 nt, Streptococcus pneumoniae R6
uagaaguugcuacga

SEQ ID NO: 4106605 - RNA, 18 nt, Streptococcus pneumoniae R6
uagaauagaaacaaaaua

SEQ ID NO: 4106606 - RNA, 20 nt, Streptococcus pneumoniae R6
uagaauagaaacaaaauaua

SEQ ID NO: 4106607 - RNA, 21 nt, Streptococcus pneumoniae R6
uagaauaugaacauuuuccga

SEQ ID NO: 4106608 - RNA, 12 nt, Streptococcus pneumoniae R6
uagaauauguaa

SEQ ID NO: 4106609 - RNA, 19 nt, Streptococcus pneumoniae R6
uagaaugcuuuuugaaagc

SEQ ID NO: 4106610 - RNA, 23 nt, Streptococcus pneumoniae R6
uagaauucgauuugacuguccug

SEQ ID NO: 4106611 - RNA, 12 nt, Streptococcus pneumoniae R6
uagaauuucuuu

SEQ ID NO: 4106612 - RNA, 18 nt, Streptococcus pneumoniae R6
uagaauuucuuuauuagu

SEQ ID NO: 4106613 - RNA, 14 nt, Streptococcus pneumoniae R6
uagacaauuuucau

SEQ ID NO: 4106614 - RNA, 13 nt, Streptococcus pneumoniae R6
uagacacaauggu

SEQ ID NO: 4106615 - RNA, 20 nt, Streptococcus pneumoniae R6
uagacacaaugguuagaaaa

SEQ ID NO: 4106616 - RNA, 13 nt, Streptococcus pneumoniae R6
uagacagaaaaaa

SEQ ID NO: 4106617 - RNA, 14 nt, Streptococcus pneumoniae R6
uagacagaaaaaau

SEQ ID NO: 4106618 - RNA, 18 nt, Streptococcus pneumoniae R6
uagacagaaaaaaucuaa

SEQ ID NO: 4106619 - RNA, 17 nt, Streptococcus pneumoniae R6
uagacauuuucugugua

SEQ ID NO: 4106620 - RNA, 22 nt, Streptococcus pneumoniae R6
uagaccaagaacucuucugguu

SEQ ID NO: 4106621 - RNA, 22 nt, Streptococcus pneumoniae R6
uagacccuauauuucaagaauu

SEQ ID NO: 4106622 - RNA, 18 nt, Streptococcus pneumoniae R6
uagacccuuguuucuaaa

SEQ ID NO: 4106623 - RNA, 13 nt, Streptococcus pneumoniae R6
uagacgaauaaag

SEQ ID NO: 4106624 - RNA, 19 nt, Streptococcus pneumoniae R6
uagacgaauaaagaaacuu

SEQ ID NO: 4106625 - RNA, 22 nt, Streptococcus pneumoniae R6
uagacuauaacagagaagaaau

SEQ ID NO: 4106626 - RNA, 22 nt, Streptococcus pneumoniae R6
uagacuauauugauuauuacaa

SEQ ID NO: 4106627 - RNA, 19 nt, Streptococcus pneumoniae R6
uagacucuuauuucucaac

SEQ ID NO: 4106628 - RNA, 17 nt, Streptococcus pneumoniae R6
uagacugaaucuaaaau

SEQ ID NO: 4106629 - RNA, 18 nt, Streptococcus pneumoniae R6
uagacugaaucuaaaaua

SEQ ID NO: 4106630 - RNA, 17 nt, Streptococcus pneumoniae R6
uagacugaaucugaaau

SEQ ID NO: 4106631 - RNA, 23 nt, Streptococcus pneumoniae R6
uagacugauuaaauagagccuuc

SEQ ID NO: 4106632 - RNA, 16 nt, Streptococcus pneumoniae R6
uagacuugaccgcaga

SEQ ID NO: 4106633 - RNA, 16 nt, Streptococcus pneumoniae R6
uagagaaagaaaaacu

SEQ ID NO: 4106634 - RNA, 18 nt, Streptococcus pneumoniae R6
uagagaaagaaaaacugc

SEQ ID NO: 4106635 - RNA, 17 nt, Streptococcus pneumoniae R6
uagagaagccaagagua

SEQ ID NO: 4106636 - RNA, 22 nt, Streptococcus pneumoniae R6
uagagaaggacagguuuaucuu

SEQ ID NO: 4106637 - RNA, 17 nt, Streptococcus pneumoniae R6
uagagagcuccaaagaa

SEQ ID NO: 4106638 - RNA, 16 nt, Streptococcus pneumoniae R6
uagagaguucugaaau

SEQ ID NO: 4106639 - RNA, 20 nt, Streptococcus pneumoniae R6
uagagaguucugaaaucagu

SEQ ID NO: 4106640 - RNA, 18 nt, Streptococcus pneumoniae R6
uagagauaccuuuuccuu

SEQ ID NO: 4106641 - RNA, 22 nt, Streptococcus pneumoniae R6
uagagauagaaggucaagagaa

SEQ ID NO: 4106642 - RNA, 17 nt, Streptococcus pneumoniae R6
uagagauuauaguggug

SEQ ID NO: 4106643 - RNA, 15 nt, Streptococcus pneumoniae R6
uagagccuucuucca

SEQ ID NO: 4106644 - RNA, 18 nt, Streptococcus pneumoniae R6
uagagcggacuaggcggc

SEQ ID NO: 4106645 - RNA, 18 nt, Streptococcus pneumoniae R6
uagagcuaacuuuuccuu

SEQ ID NO: 4106646 - RNA, 19 nt, Streptococcus pneumoniae R6
uagagcuaacuuuuccuua

SEQ ID NO: 4106647 - RNA, 21 nt, Streptococcus pneumoniae R6
uagagguguacuauucuaguu

SEQ ID NO: 4106648 - RNA, 20 nt, Streptococcus pneumoniae R6
uagaguagucugggugcuga

SEQ ID NO: 4106649 - RNA, 22 nt, Streptococcus pneumoniae R6
uagaguagugcucguaaaauuc

SEQ ID NO: 4106650 - RNA, 15 nt, Streptococcus pneumoniae R6
uagaguccaaagacc

SEQ ID NO: 4106651 - RNA, 23 nt, Streptococcus pneumoniae R6
uagaguccaagauucaacaucac

SEQ ID NO: 4106652 - RNA, 12 nt, Streptococcus pneumoniae R6
uagaguuagagc

SEQ ID NO: 4106653 - RNA, 23 nt, Streptococcus pneumoniae R6
uagaguugcagggcuauuuggcu

SEQ ID NO: 4106654 - RNA, 13 nt, Streptococcus pneumoniae R6
uagaguuuugguu

SEQ ID NO: 4106655 - RNA, 13 nt, Streptococcus pneumoniae R6
uagauaaaaaaca

SEQ ID NO: 4106656 - RNA, 12 nt, Streptococcus pneumoniae R6
uagauaaaagaa

SEQ ID NO: 4106657 - RNA, 20 nt, Streptococcus pneumoniae R6
uagauaaaagaaugcucaga

SEQ ID NO: 4106658 - RNA, 17 nt, Streptococcus pneumoniae R6
uagauaacuuuucugcu

SEQ ID NO: 4106659 - RNA, 14 nt, Streptococcus pneumoniae R6
uagauaagacugac

SEQ ID NO: 4106660 - RNA, 13 nt, Streptococcus pneumoniae R6
uagauaauuuaaa

SEQ ID NO: 4106661 - RNA, 17 nt, Streptococcus pneumoniae R6
uagauacaaaaccaaac

SEQ ID NO: 4106662 - RNA, 22 nt, Streptococcus pneumoniae R6
uagauacagugaaggcuuuaaa

SEQ ID NO: 4106663 - RNA, 22 nt, Streptococcus pneumoniae R6
uagauacccaagguauuucagu

SEQ ID NO: 4106664 - RNA, 12 nt, Streptococcus pneumoniae R6
uagauagaacug

SEQ ID NO: 4106665 - RNA, 20 nt, Streptococcus pneumoniae R6
uagauagcaucgguaagaaa

SEQ ID NO: 4106666 - RNA, 16 nt, Streptococcus pneumoniae R6
uagauauaauuguaaa

SEQ ID NO: 4106667 - RNA, 19 nt, Streptococcus pneumoniae R6
uagauauaauuguaaacaa

SEQ ID NO: 4106668 - RNA, 12 nt, Streptococcus pneumoniae R6
uagauauagaau

SEQ ID NO: 4106669 - RNA, 13 nt, Streptococcus pneumoniae R6
uagauauuuugaa

SEQ ID NO: 4106670 - RNA, 11 nt, Streptococcus pneumoniae R6
uagaucaucug

SEQ ID NO: 4106671 - RNA, 12 nt, Streptococcus pneumoniae R6
uagaucaucugc

SEQ ID NO: 4106672 - RNA, 15 nt, Streptococcus pneumoniae R6
uagaucaugacugag

SEQ ID NO: 4106673 - RNA, 12 nt, Streptococcus pneumoniae R6
uagauccaagca

SEQ ID NO: 4106674 - RNA, 14 nt, Streptococcus pneumoniae R6
uagauccuuuuaau

SEQ ID NO: 4106675 - RNA, 20 nt, Streptococcus pneumoniae R6
uagaucucucgaauaagguu

SEQ ID NO: 4106676 - RNA, 15 nt, Streptococcus pneumoniae R6
uagaugaaacugacg

SEQ ID NO: 4106677 - RNA, 15 nt, Streptococcus pneumoniae R6
uagaugaagcaugaa

SEQ ID NO: 4106678 - RNA, 20 nt, Streptococcus pneumoniae R6
uagaugagaaaaagccucca

SEQ ID NO: 4106679 - RNA, 22 nt, Streptococcus pneumoniae R6
uagaugaucgagcagauuucuu

SEQ ID NO: 4106680 - RNA, 19 nt, Streptococcus pneumoniae R6
uagaugauuggaaauucaa

SEQ ID NO: 4106681 - RNA, 21 nt, Streptococcus pneumoniae R6
uagaugauuuucaaauuuucu

SEQ ID NO: 4106682 - RNA, 19 nt, Streptococcus pneumoniae R6
uagauggaaguagugacuu

SEQ ID NO: 4106683 - RNA, 17 nt, Streptococcus pneumoniae R6
uagauguuauuuacugu

SEQ ID NO: 4106684 - RNA, 17 nt, Streptococcus pneumoniae R6
uagauguucuuugaaau

SEQ ID NO: 4106685 - RNA, 13 nt, Streptococcus pneumoniae R6
uagauguuuucaa

SEQ ID NO: 4106686 - RNA, 13 nt, Streptococcus pneumoniae R6
uagauuacaaaaa

SEQ ID NO: 4106687 - RNA, 20 nt, Streptococcus pneumoniae R6
uagauuauguaagauagaga

SEQ ID NO: 4106688 - RNA, 15 nt, Streptococcus pneumoniae R6
uagauuccuucuugu

SEQ ID NO: 4106689 - RNA, 20 nt, Streptococcus pneumoniae R6
uagauucgaucugauauauu

SEQ ID NO: 4106690 - RNA, 13 nt, Streptococcus pneumoniae R6
uagauugaaauaa

SEQ ID NO: 4106691 - RNA, 15 nt, Streptococcus pneumoniae R6
uagauuggauaaaau

SEQ ID NO: 4106692 - RNA, 19 nt, Streptococcus pneumoniae R6
uagauuggauaaaaucuuu

SEQ ID NO: 4106693 - RNA, 14 nt, Streptococcus pneumoniae R6
uagauuuauaauuu

SEQ ID NO: 4106694 - RNA, 13 nt, Streptococcus pneumoniae R6
uagauuuucuggc

SEQ ID NO: 4106695 - RNA, 23 nt, Streptococcus pneumoniae R6
uagauuuucuggcagauuuugaa

SEQ ID NO: 4106696 - RNA, 20 nt, Streptococcus pneumoniae R6
uagauuuuuaaauucuucca

SEQ ID NO: 4106697 - RNA, 13 nt, Streptococcus pneumoniae R6
uagauuuuuauua

SEQ ID NO: 4106698 - RNA, 16 nt, Streptococcus pneumoniae R6
uagauuuuuauuauuu

SEQ ID NO: 4106699 - RNA, 13 nt, Streptococcus pneumoniae R6
uagauuuuuucug

SEQ ID NO: 4106700 - RNA, 14 nt, Streptococcus pneumoniae R6
uagauuuuuucugu

SEQ ID NO: 4106701 - RNA, 17 nt, Streptococcus pneumoniae R6
uagauuuuuucugucua

SEQ ID NO: 4106702 - RNA, 16 nt, Streptococcus pneumoniae R6
uagcaaaaucauagca

SEQ ID NO: 4106703 - RNA, 20 nt, Streptococcus pneumoniae R6
uagcaaacuaaauaccuuau

SEQ ID NO: 4106704 - RNA, 17 nt, Streptococcus pneumoniae R6
uagcaaagacuucaacc

SEQ ID NO: 4106705 - RNA, 15 nt, Streptococcus pneumoniae R6
uagcaacuaucugaa

SEQ ID NO: 4106706 - RNA, 23 nt, Streptococcus pneumoniae R6
uagcaacuguuuuuucaacagcu

SEQ ID NO: 4106707 - RNA, 17 nt, Streptococcus pneumoniae R6
uagcaagaguuuuucuc

SEQ ID NO: 4106708 - RNA, 20 nt, Streptococcus pneumoniae R6
uagcaauaaaccaucgugua

SEQ ID NO: 4106709 - RNA, 14 nt, Streptococcus pneumoniae R6
uagcaaucacucua

SEQ ID NO: 4106710 - RNA, 15 nt, Streptococcus pneumoniae R6
uagcaaucacucuaa

SEQ ID NO: 4106711 - RNA, 23 nt, Streptococcus pneumoniae R6
uagcaaucuuccuuacuagcaaa

SEQ ID NO: 4106712 - RNA, 14 nt, Streptococcus pneumoniae R6
uagcacaccaaaca

SEQ ID NO: 4106713 - RNA, 19 nt, Streptococcus pneumoniae R6
uagcaccuguggcuguuuu

SEQ ID NO: 4106714 - RNA, 13 nt, Streptococcus pneumoniae R6
uagcacuuuucca

SEQ ID NO: 4106715 - RNA, 15 nt, Streptococcus pneumoniae R6
uagcacuuuuccauu

SEQ ID NO: 4106716 - RNA, 18 nt, Streptococcus pneumoniae R6
uagcagaaucuuuuaauu

SEQ ID NO: 4106717 - RNA, 16 nt, Streptococcus pneumoniae R6
uagcagagacauuaga

SEQ ID NO: 4106718 - RNA, 15 nt, Streptococcus pneumoniae R6
uagcagauagguggg

SEQ ID NO: 4106719 - RNA, 20 nt, Streptococcus pneumoniae R6
uagcagauagguggggcaaa

SEQ ID NO: 4106720 - RNA, 18 nt, Streptococcus pneumoniae R6
uagcagccacuuuuuauc

SEQ ID NO: 4106721 - RNA, 15 nt, Streptococcus pneumoniae R6
uagcagcgguuccau

SEQ ID NO: 4106722 - RNA, 14 nt, Streptococcus pneumoniae R6
uagcagcuuucaaa

SEQ ID NO: 4106723 - RNA, 14 nt, Streptococcus pneumoniae R6
uagcaguaacuucu

SEQ ID NO: 4106724 - RNA, 21 nt, Streptococcus pneumoniae R6
uagcaguaguuggcuugucuu

SEQ ID NO: 4106725 - RNA, 15 nt, Streptococcus pneumoniae R6
uagcauaaaagccuc

SEQ ID NO: 4106726 - RNA, 14 nt, Streptococcus pneumoniae R6
uagcauccaccacu

SEQ ID NO: 4106727 - RNA, 17 nt, Streptococcus pneumoniae R6
uagcaucgcccauggcc

SEQ ID NO: 4106728 - RNA, 15 nt, Streptococcus pneumoniae R6
uagcaucuucuucug

SEQ ID NO: 4106729 - RNA, 23 nt, Streptococcus pneumoniae R6
uagcaucuuguguuuuuugagca

SEQ ID NO: 4106730 - RNA, 18 nt, Streptococcus pneumoniae R6
uagcauggucaaaguagu

SEQ ID NO: 4106731 - RNA, 18 nt, Streptococcus pneumoniae R6
uagcauucuucucagcua

SEQ ID NO: 4106732 - RNA, 24 nt, Streptococcus pneumoniae R6
uagccacucuggcaauuuaucucc
